United States Patent 12,624,385 (RIBOREGULATORS AND METHODS OF USE THEREOF) - sequence listing, part 6

SEQ ID NO: 84904 - DNA, 103 bp, Artificial Sequence
  Synthetic Polynucleotide
taatacgactcactatagggtcttgaaacagaggagatcccgcagataccaacagaggagaggtatcatggggatctccaacctggcggcagcgcaaaagatg

SEQ ID NO: 84905 - DNA, 103 bp, Artificial Sequence
  Synthetic Polynucleotide
taatacgactcactatagggtccattcttgaaacagaggagatcccgcagaacagaggagactgcggatgctcctctgtaacctggcggcagcgcaaaagatg

SEQ ID NO: 84906 - DNA, 103 bp, Artificial Sequence
  Synthetic Polynucleotide
taatacgactcactatagggtgttctccattcttgaaacagaggagatccaacagaggagaggatctatgctgtttcaaaacctggcggcagcgcaaaagatg

SEQ ID NO: 84907 - DNA, 103 bp, Artificial Sequence
  Synthetic Polynucleotide
taatacgactcactatagggcatgatgttctccattcttgaaacagaggaaacagaggagatcctctatgtcaagaatgaacctggcggcagcgcaaaagatg

SEQ ID NO: 84908 - DNA, 103 bp, Artificial Sequence
  Synthetic Polynucleotide
taatacgactcactatagggctccacatgatgttctccattcttgaaacaaacagaggagatgtttcatgaatggagaaaacctggcggcagcgcaaaagatg

SEQ ID NO: 84909 - DNA, 103 bp, Artificial Sequence
  Synthetic Polynucleotide
taatacgactcactatagggctgatctccacatgatgttctccattcttgaacagaggagacaagaaatgagaacatcaaacctggcggcagcgcaaaagatg

SEQ ID NO: 84910 - DNA, 103 bp, Artificial Sequence
  Synthetic Polynucleotide
taatacgactcactatagggttctactgatctccacatgatgttctccataacagaggagaatggagatgatcatgtggaacctggcggcagcgcaaaagatg

SEQ ID NO: 84911 - DNA, 103 bp, Artificial Sequence
  Synthetic Polynucleotide
taatacgactcactatagggtccccttctactgatctccacatgatgttcaacagaggagagaacatatggtggagatcaacctggcggcagcgcaaaagatg

SEQ ID NO: 84912 - DNA, 103 bp, Artificial Sequence
  Synthetic Polynucleotide
taatacgactcactatagggtgagctccccttctactgatctccacatgaaacagaggagatcatgtatggatcagtagaacctggcggcagcgcaaaagatg

SEQ ID NO: 84913 - DNA, 103 bp, Artificial Sequence
  Synthetic Polynucleotide
taatacgactcactatagggtgcgttgagctccccttctactgatctccaaacagaggagatggagaatggtagaagggaacctggcggcagcgcaaaagatg

SEQ ID NO: 84914 - DNA, 103 bp, Artificial Sequence
  Synthetic Polynucleotide
taatacgactcactatagggagtgatggcttgattgccgtgaatctcaaaaacagaggagatttgagatgcacggcaataacctggcggcagcgcaaaagatg

SEQ ID NO: 84915 - DNA, 103 bp, Artificial Sequence
  Synthetic Polynucleotide
taatacgactcactatagggaagattgcgttgagctccccttctactgataacagaggagaatcagtatgaggggagctaacctggcggcagcgcaaaagatg

SEQ ID NO: 84916 - DNA, 103 bp, Artificial Sequence
  Synthetic Polynucleotide
taatacgactcactatagggcttccaagattgcgttgagctccccttctaaacagaggagatagaagatgagctcaacgaacctggcggcagcgcaaaagatg

SEQ ID NO: 84917 - DNA, 103 bp, Artificial Sequence
  Synthetic Polynucleotide
taatacgactcactatagggattctcttccaagattgcgttgagctccccaacagaggagaggggagatgaacgcaatcaacctggcggcagcgcaaaagatg

SEQ ID NO: 84918 - DNA, 103 bp, Artificial Sequence
  Synthetic Polynucleotide
taatacgactcactatagggactccattctcttccaagattgcgttgagcaacagaggagagctcaaatgaatcttggaaacctggcggcagcgcaaaagatg

SEQ ID NO: 84919 - DNA, 103 bp, Artificial Sequence
  Synthetic Polynucleotide
taatacgactcactataggggttgaactccattctcttccaagattgcgtaacagaggagaacgcaaatgtggaagagaaacctggcggcagcgcaaaagatg

SEQ ID NO: 84920 - DNA, 103 bp, Artificial Sequence
  Synthetic Polynucleotide
taatacgactcactatagggcgtcagttgaactccattctcttccaagataacagaggagaatcttgatggagaatggaaacctggcggcagcgcaaaagatg

SEQ ID NO: 84921 - DNA, 103 bp, Artificial Sequence
  Synthetic Polynucleotide
taatacgactcactatagggacgaccgtcagttgaactccattctcttccaacagaggagaggaagaatgtggagttcaaacctggcggcagcgcaaaagatg

SEQ ID NO: 84922 - DNA, 103 bp, Artificial Sequence
  Synthetic Polynucleotide
taatacgactcactatagggccacaacgaccgtcagttgaactccattctaacagaggagaagaatgatgttcaactgaaacctggcggcagcgcaaaagatg

SEQ ID NO: 84923 - DNA, 103 bp, Artificial Sequence
  Synthetic Polynucleotide
taatacgactcactatagggagatcccacaacgaccgtcagttgaactccaacagaggagaggagttatgctgacggtcaacctggcggcagcgcaaaagatg

SEQ ID NO: 84924 - DNA, 103 bp, Artificial Sequence
  Synthetic Polynucleotide
taatacgactcactatagggtttacagatcccacaacgaccgtcagttgaaacagaggagatcaactatgggtcgttgtaacctggcggcagcgcaaaagatg

SEQ ID NO: 84925 - DNA, 103 bp, Artificial Sequence
  Synthetic Polynucleotide
taatacgactcactataggggacccagtgatggcttgattgccgtgaatcaacagaggagagattcaatgcaatcaagcaacctggcggcagcgcaaaagatg

SEQ ID NO: 84926 - DNA, 103 bp, Artificial Sequence
  Synthetic Polynucleotide
taatacgactcactatagggggttttttacagatcccacaacgaccgtcaaacagaggagatgacggatgttgtgggataacctggcggcagcgcaaaagatg

SEQ ID NO: 84927 - DNA, 103 bp, Artificial Sequence
  Synthetic Polynucleotide
taatacgactcactatagggcatggggttttttacagatcccacaacgacaacagaggagagtcgttatgggatctgtaaacctggcggcagcgcaaaagatg

SEQ ID NO: 84928 - DNA, 103 bp, Artificial Sequence
  Synthetic Polynucleotide
taatacgactcactatagggctccacatggggttttttacagatcccacaaacagaggagatgtgggatgtgtaaaaaaaacctggcggcagcgcaaaagatg

SEQ ID NO: 84929 - DNA, 103 bp, Artificial Sequence
  Synthetic Polynucleotide
taatacgactcactataggggacctctccacatggggttttttacagatcaacagaggagagatctgatgaaaaccccaaacctggcggcagcgcaaaagatg

SEQ ID NO: 84930 - DNA, 103 bp, Artificial Sequence
  Synthetic Polynucleotide
taatacgactcactatagggctgtggacctctccacatggggttttttacaacagaggagagtaaaaatgcccatgtggaacctggcggcagcgcaaaagatg

SEQ ID NO: 84931 - DNA, 103 bp, Artificial Sequence
  Synthetic Polynucleotide
taatacgactcactatagggaatctctgtggacctctccacatggggtttaacagaggagaaaacccatggtggagaggaacctggcggcagcgcaaaagatg

SEQ ID NO: 84932 - DNA, 103 bp, Artificial Sequence
  Synthetic Polynucleotide
taatacgactcactatagggcgggcaatctctgtggacctctccacatggaacagaggagaccatgtatggaggtccacaacctggcggcagcgcaaaagatg

SEQ ID NO: 84933 - DNA, 103 bp, Artificial Sequence
  Synthetic Polynucleotide
taatacgactcactatagggaggcacgggcaatctctgtggacctctccaaacagaggagatggagaatgccacagagaaacctggcggcagcgcaaaagatg

SEQ ID NO: 84934 - DNA, 103 bp, Artificial Sequence
  Synthetic Polynucleotide
taatacgactcactatagggttcacaggcacgggcaatctctgtggacctaacagaggagaaggtccatggagattgccaacctggcggcagcgcaaaagatg

SEQ ID NO: 84935 - DNA, 103 bp, Artificial Sequence
  Synthetic Polynucleotide
taatacgactcactataggggctcgttcacaggcacgggcaatctctgtgaacagaggagacacagaatgtgcccgtgcaacctggcggcagcgcaaaagatg

SEQ ID NO: 84936 - DNA, 103 bp, Artificial Sequence
  Synthetic Polynucleotide
taatacgactcactataggggatgagacccagtgatggcttgattgccgtaacagaggagaacggcaatgaagccatcaaacctggcggcagcgcaaaagatg

SEQ ID NO: 84937 - DNA, 103 bp, Artificial Sequence
  Synthetic Polynucleotide
taatacgactcactataggggggcagctcgttcacaggcacgggcaatctaacagaggagaagattgatggtgcctgtgaacctggcggcagcgcaaaagatg

SEQ ID NO: 84938 - DNA, 103 bp, Artificial Sequence
  Synthetic Polynucleotide
taatacgactcactatagggccgtggggcagctcgttcacaggcacgggcaacagaggagagcccgtatgtgtgaacgaaacctggcggcagcgcaaaagatg

SEQ ID NO: 84939 - DNA, 103 bp, Artificial Sequence
  Synthetic Polynucleotide
taatacgactcactatagggtccagccgtggggcagctcgttcacaggcaaacagaggagatgcctgatgacgagctgcaacctggcggcagcgcaaaagatg

SEQ ID NO: 84940 - DNA, 103 bp, Artificial Sequence
  Synthetic Polynucleotide
taatacgactcactatagggagccttccagccgtggggcagctcgttcacaacagaggagagtgaacatgctgccccacaacctggcggcagcgcaaaagatg

SEQ ID NO: 84941 - DNA, 103 bp, Artificial Sequence
  Synthetic Polynucleotide
taatacgactcactatagggccccaagccttccagccgtggggcagctcgaacagaggagacgagctatgccacggctgaacctggcggcagcgcaaaagatg

SEQ ID NO: 84942 - DNA, 103 bp, Artificial Sequence
  Synthetic Polynucleotide
taatacgactcactatagggatttcccccaagccttccagccgtggggcaaacagaggagatgccccatggctggaaggaacctggcggcagcgcaaaagatg

SEQ ID NO: 84943 - DNA, 103 bp, Artificial Sequence
  Synthetic Polynucleotide
taatacgactcactataggggtacgatttcccccaagccttccagccgtgaacagaggagacacggcatgaaggcttggaacctggcggcagcgcaaaagatg

SEQ ID NO: 84944 - DNA, 103 bp, Artificial Sequence
  Synthetic Polynucleotide
taatacgactcactatagggacgaagtacgatttcccccaagccttccagaacagaggagactggaaatgttgggggaaaacctggcggcagcgcaaaagatg

SEQ ID NO: 84945 - DNA, 103 bp, Artificial Sequence
  Synthetic Polynucleotide
taatacgactcactatagggctctgacgaagtacgatttcccccaagcctaacagaggagaaggcttatgggaaatcgtaacctggcggcagcgcaaaagatg

SEQ ID NO: 84946 - DNA, 103 bp, Artificial Sequence
  Synthetic Polynucleotide
taatacgactcactatagggtgctgctctgacgaagtacgatttcccccaaacagaggagatgggggatgtcgtacttcaacctggcggcagcgcaaaagatg

SEQ ID NO: 84947 - DNA, 103 bp, Artificial Sequence
  Synthetic Polynucleotide
taatacgactcactatagggctattgatgagacccagtgatggcttgattaacagaggagaaatcaaatgatcactgggaacctggcggcagcgcaaaagatg

SEQ ID NO: 84948 - DNA, 103 bp, Artificial Sequence
  Synthetic Polynucleotide
taatacgactcactataggggtctttgctgctctgacgaagtacgatttcaacagaggagagaaatcatgcttcgtcagaacctggcggcagcgcaaaagatg

SEQ ID NO: 84949 - DNA, 103 bp, Artificial Sequence
  Synthetic Polynucleotide
taatacgactcactatagggtatttgtctttgctgctctgacgaagtacgaacagaggagacgtactatgtcagagcagaacctggcggcagcgcaaaagatg

SEQ ID NO: 84950 - DNA, 103 bp, Artificial Sequence
  Synthetic Polynucleotide
taatacgactcactataggggctgttatttgtctttgctgctctgacgaaaacagaggagattcgtcatggcagcaaagaacctggcggcagcgcaaaagatg

SEQ ID NO: 84951 - DNA, 103 bp, Artificial Sequence
  Synthetic Polynucleotide
taatacgactcactatagggacaaagctgttatttgtctttgctgctctgaacagaggagacagagcatgaaagacaaaaacctggcggcagcgcaaaagatg

SEQ ID NO: 84952 - DNA, 103 bp, Artificial Sequence
  Synthetic Polynucleotide
taatacgactcactatagggccacgacaaagctgttatttgtctttgctgaacagaggagacagcaaatgcaaataacaaacctggcggcagcgcaaaagatg

SEQ ID NO: 84953 - DNA, 103 bp, Artificial Sequence
  Synthetic Polynucleotide
taatacgactcactatagggaccatccacgacaaagctgttatttgtcttaacagaggagaaagacaatgaacagctttaacctggcggcagcgcaaaagatg

SEQ ID NO: 84954 - DNA, 103 bp, Artificial Sequence
  Synthetic Polynucleotide
taatacgactcactataggggtgtcaccatccacgacaaagctgttatttaacagaggagaaaataaatgctttgtcgtaacctggcggcagcgcaaaagatg

SEQ ID NO: 84955 - DNA, 103 bp, Artificial Sequence
  Synthetic Polynucleotide
taatacgactcactatagggtcagtgtgtcaccatccacgacaaagctgtaacagaggagaacagctatgtcgtggatgaacctggcggcagcgcaaaagatg

SEQ ID NO: 84956 - DNA, 103 bp, Artificial Sequence
  Synthetic Polynucleotide
taatacgactcactatagggttccttcagtgtgtcaccatccacgacaaaaacagaggagatttgtcatggatggtgacaacctggcggcagcgcaaaagatg

SEQ ID NO: 84957 - DNA, 103 bp, Artificial Sequence
  Synthetic Polynucleotide
taatacgactcactataggggggcattccttcagtgtgtcaccatccacgaacagaggagacgtggaatgtgacacactaacctggcggcagcgcaaaagatg

SEQ ID NO: 84958 - DNA, 103 bp, Artificial Sequence
  Synthetic Polynucleotide
taatacgactcactatagggcccatctattgatgagacccagtgatggctaacagaggagaagccatatgtgggtctcaaacctggcggcagcgcaaaagatg

SEQ ID NO: 84959 - DNA, 103 bp, Artificial Sequence
  Synthetic Polynucleotide
taatacgactcactatagggcgagtgggcattccttcagtgtgtcaccataacagaggagaatggtgatgcactgaaggaacctggcggcagcgcaaaagatg

SEQ ID NO: 84960 - DNA, 103 bp, Artificial Sequence
  Synthetic Polynucleotide
taatacgactcactatagggatgttcgagtgggcattccttcagtgtgtcaacagaggagagacacaatgaaggaatgcaacctggcggcagcgcaaaagatg

SEQ ID NO: 84961 - DNA, 103 bp, Artificial Sequence
  Synthetic Polynucleotide
taatacgactcactataggggctctatgttcgagtgggcattccttcagtaacagaggagaactgaaatgatgcccactaacctggcggcagcgcaaaagatg

SEQ ID NO: 84962 - DNA, 103 bp, Artificial Sequence
  Synthetic Polynucleotide
taatacgactcactatagggtccatgctctatgttcgagtgggcattcctaacagaggagaaggaatatgcactcgaacaacctggcggcagcgcaaaagatg

SEQ ID NO: 84963 - DNA, 103 bp, Artificial Sequence
  Synthetic Polynucleotide
taatacgactcactataggggctgttccatgctctatgttcgagtgggcaaacagaggagatgcccaatggaacatagaaacctggcggcagcgcaaaagatg

SEQ ID NO: 84964 - DNA, 103 bp, Artificial Sequence
  Synthetic Polynucleotide
taatacgactcactatagggagaaagctgttccatgctctatgttcgagtaacagaggagaactcgaatgtagagcatgaacctggcggcagcgcaaaagatg

SEQ ID NO: 84965 - DNA, 103 bp, Artificial Sequence
  Synthetic Polynucleotide
taatacgactcactatagggccacaagaaagctgttccatgctctatgttaacagaggagaaacataatgcatggaacaaacctggcggcagcgcaaaagatg

SEQ ID NO: 84966 - DNA, 103 bp, Artificial Sequence
  Synthetic Polynucleotide
taatacgactcactatagggatcctccacaagaaagctgttccatgctctaacagaggagaagagcaatgaacagctttaacctggcggcagcgcaaaagatg

SEQ ID NO: 84967 - DNA, 103 bp, Artificial Sequence
  Synthetic Polynucleotide
taatacgactcactatagggccatgatcctccacaagaaagctgttccataacagaggagaatggaaatgctttcttgtaacctggcggcagcgcaaaagatg

SEQ ID NO: 84968 - DNA, 103 bp, Artificial Sequence
  Synthetic Polynucleotide
taatacgactcactatagggcgaacccatgatcctccacaagaaagctgtaacagaggagaacagctatgttgtggaggaacctggcggcagcgcaaaagatg

SEQ ID NO: 84969 - DNA, 103 bp, Artificial Sequence
  Synthetic Polynucleotide
taatacgactcactatagggtgaaccccatctattgatgagacccagtgaaacagaggagatcactgatgctcatcaataacctggcggcagcgcaaaagatg

SEQ ID NO: 84970 - DNA, 103 bp, Artificial Sequence
  Synthetic Polynucleotide
taatacgactcactatagggtaccccgaacccatgatcctccacaagaaaaacagaggagatttcttatggaggatcataacctggcggcagcgcaaaagatg

SEQ ID NO: 84971 - DNA, 103 bp, Artificial Sequence
  Synthetic Polynucleotide
taatacgactcactatagggtgaaataccccgaacccatgatcctccacaaacagaggagatgtggaatgtcatgggttaacctggcggcagcgcaaaagatg

SEQ ID NO: 84972 - DNA, 103 bp, Artificial Sequence
  Synthetic Polynucleotide
taatacgactcactatagggtagtgtgaaataccccgaacccatgatcctaacagaggagaaggatcatgggttcggggaacctggcggcagcgcaaaagatg

SEQ ID NO: 84973 - DNA, 103 bp, Artificial Sequence
  Synthetic Polynucleotide
taatacgactcactataggggacactagtgtgaaataccccgaacccatgaacagaggagacatgggatgggggtatttaacctggcggcagcgcaaaagatg

SEQ ID NO: 84974 - DNA, 103 bp, Artificial Sequence
  Synthetic Polynucleotide
taatacgactcactatagggagccagacactagtgtgaaataccccgaacaacagaggagagttcggatgatttcacacaacctggcggcagcgcaaaagatg

SEQ ID NO: 84975 - DNA, 103 bp, Artificial Sequence
  Synthetic Polynucleotide
taatacgactcactatagggccttgagccagacactagtgtgaaatacccaacagaggagagggtatatgacactagtgaacctggcggcagcgcaaaagatg

SEQ ID NO: 84976 - DNA, 103 bp, Artificial Sequence
  Synthetic Polynucleotide
taatacgactcactatagggtctaaccttgagccagacactagtgtgaaaaacagaggagatttcacatgagtgtctggaacctggcggcagcgcaaaagatg

SEQ ID NO: 84977 - DNA, 103 bp, Artificial Sequence
  Synthetic Polynucleotide
taatacgactcactatagggtcttctctaaccttgagccagacactagtgaacagaggagacactagatgctggctcaaaacctggcggcagcgcaaaagatg

SEQ ID NO: 84978 - DNA, 103 bp, Artificial Sequence
  Synthetic Polynucleotide
taatacgactcactatagggaataatcttctctaaccttgagccagacacaacagaggagagtgtctatgtcaaggttaaacctggcggcagcgcaaaagatg

SEQ ID NO: 84979 - DNA, 103 bp, Artificial Sequence
  Synthetic Polynucleotide
taatacgactcactatagggtaatgaataatcttctctaaccttgagccaaacagaggagatggctcatggttagagaaaacctggcggcagcgcaaaagatg

SEQ ID NO: 84980 - DNA, 103 bp, Artificial Sequence
  Synthetic Polynucleotide
taatacgactcactatagggtagctttcgcttcaaactcgaactgtcgcaaacagaggagatgcgacatgtcgagtttgaacctggcggcagcgcaaaagatg

SEQ ID NO: 84981 - DNA, 103 bp, Artificial Sequence
  Synthetic Polynucleotide
taatacgactcactatagggcccactgaaccccatctattgatgagacccaacagaggagagggtctatgcaatagatgaacctggcggcagcgcaaaagatg

SEQ ID NO: 84982 - DNA, 103 bp, Artificial Sequence
  Synthetic Polynucleotide
taatacgactcactatagggcactctaatgaataatcttctctaaccttgaacagaggagacaaggtatgagaagattaaacctggcggcagcgcaaaagatg

SEQ ID NO: 84983 - DNA, 103 bp, Artificial Sequence
  Synthetic Polynucleotide
taatacgactcactataggggatcacactctaatgaataatcttctctaaaacagaggagattagagatgattattcataacctggcggcagcgcaaaagatg

SEQ ID NO: 84984 - DNA, 103 bp, Artificial Sequence
  Synthetic Polynucleotide
taatacgactcactatagggggctggatcacactctaatgaataatcttcaacagaggagagaagatatgtcattagagaacctggcggcagcgcaaaagatg

SEQ ID NO: 84985 - DNA, 103 bp, Artificial Sequence
  Synthetic Polynucleotide
taatacgactcactatagggataacggctggatcacactctaatgaataaaacagaggagattattcatgagagtgtgaaacctggcggcagcgcaaaagatg

SEQ ID NO: 84986 - DNA, 103 bp, Artificial Sequence
  Synthetic Polynucleotide
taatacgactcactatagggttccaataacggctggatcacactctaatgaacagaggagacattagatggtgatccagaacctggcggcagcgcaaaagatg

SEQ ID NO: 84987 - DNA, 103 bp, Artificial Sequence
  Synthetic Polynucleotide
taatacgactcactatagggagctgttccaataacggctggatcacactcaacagaggagagagtgtatgccagccgttaacctggcggcagcgcaaaagatg

SEQ ID NO: 84988 - DNA, 103 bp, Artificial Sequence
  Synthetic Polynucleotide
taatacgactcactatagggttaacagctgttccaataacggctggatcaaacagaggagatgatccatgcgttattggaacctggcggcagcgcaaaagatg

SEQ ID NO: 84989 - DNA, 103 bp, Artificial Sequence
  Synthetic Polynucleotide
taatacgactcactatagggtccccttaacagctgttccaataacggctgaacagaggagacagccgatgttggaacagaacctggcggcagcgcaaaagatg

SEQ ID NO: 84990 - DNA, 103 bp, Artificial Sequence
  Synthetic Polynucleotide
taatacgactcactatagggctccttccccttaacagctgttccaataacaacagaggagagttattatgacagctgttaacctggcggcagcgcaaaagatg

SEQ ID NO: 84991 - DNA, 103 bp, Artificial Sequence
  Synthetic Polynucleotide
taatacgactcactatagggacagcctccttccccttaacagctgttccaaacagaggagatggaacatgtgttaagggaacctggcggcagcgcaaaagatg

SEQ ID NO: 84992 - DNA, 103 bp, Artificial Sequence
  Synthetic Polynucleotide
taatacgactcactatagggttttccccactgaaccccatctattgatgaaacagaggagatcatcaatggatggggttaacctggcggcagcgcaaaagatg

SEQ ID NO: 84993 - DNA, 103 bp, Artificial Sequence
  Synthetic Polynucleotide
taatacgactcactatagggtgtgtacagcctccttccccttaacagctgaacagaggagacagctgatgaggggaaggaacctggcggcagcgcaaaagatg

SEQ ID NO: 84994 - DNA, 103 bp, Artificial Sequence
  Synthetic Polynucleotide
taatacgactcactatagggatcactgtgtacagcctccttccccttaacaacagaggagagttaagatgaaggaggctaacctggcggcagcgcaaaagatg

SEQ ID NO: 84995 - DNA, 103 bp, Artificial Sequence
  Synthetic Polynucleotide
taatacgactcactatagggcctagatcactgtgtacagcctccttccccaacagaggagaggggaaatgggctgtacaaacctggcggcagcgcaaaagatg

SEQ ID NO: 84996 - DNA, 103 bp, Artificial Sequence
  Synthetic Polynucleotide
taatacgactcactatagggagtagcctagatcactgtgtacagcctcctaacagaggagaaggaggatgtacacagtgaacctggcggcagcgcaaaagatg

SEQ ID NO: 84997 - DNA, 103 bp, Artificial Sequence
  Synthetic Polynucleotide
taatacgactcactatagggaatccagtagcctagatcactgtgtacagcaacagaggagagctgtaatgagtgatctaaacctggcggcagcgcaaaagatg

SEQ ID NO: 84998 - DNA, 103 bp, Artificial Sequence
  Synthetic Polynucleotide
taatacgactcactatagggctctcaatccagtagcctagatcactgtgtaacagaggagaacacagatgtctaggctaaacctggcggcagcgcaaaagatg

SEQ ID NO: 84999 - DNA, 103 bp, Artificial Sequence
  Synthetic Polynucleotide
taatacgactcactatagggtctcactctcaatccagtagcctagatcacaacagaggagagtgatcatggctactggaaacctggcggcagcgcaaaagatg

SEQ ID NO: 85000 - DNA, 103 bp, Artificial Sequence
  Synthetic Polynucleotide
taatacgactcactatagggattcttctcactctcaatccagtagcctagaacagaggagactaggcatgtggattgagaacctggcggcagcgcaaaagatg

SEQ ID NO: 85001 - DNA, 103 bp, Artificial Sequence
  Synthetic Polynucleotide
taatacgactcactataggggtgtcattcttctcactctcaatccagtagaacagaggagactactgatgtgagagtgaaacctggcggcagcgcaaaagatg

SEQ ID NO: 85002 - DNA, 103 bp, Artificial Sequence
  Synthetic Polynucleotide
taatacgactcactatagggtccatgtgtcattcttctcactctcaatccaacagaggagaggattgatggtgagaagaaacctggcggcagcgcaaaagatg

SEQ ID NO: 85003 - DNA, 103 bp, Artificial Sequence
  Synthetic Polynucleotide
taatacgactcactatagggctcttttttccccactgaaccccatctattaacagaggagaaatagaatgggttcagtgaacctggcggcagcgcaaaagatg

SEQ ID NO: 85004 - DNA, 103 bp, Artificial Sequence
  Synthetic Polynucleotide
taatacgactcactatagggcagcctccatgtgtcattcttctcactctcaacagaggagagagagtatgaagaatgacaacctggcggcagcgcaaaagatg

SEQ ID NO: 85005 - DNA, 103 bp, Artificial Sequence
  Synthetic Polynucleotide
taatacgactcactatagggctcttcagcctccatgtgtcattcttctcaaacagaggagatgagaaatgtgacacatgaacctggcggcagcgcaaaagatg

SEQ ID NO: 85006 - DNA, 103 bp, Artificial Sequence
  Synthetic Polynucleotide
taatacgactcactataggggggccctcttcagcctccatgtgtcattctaacagaggagaagaatgatgcatggaggcaacctggcggcagcgcaaaagatg

SEQ ID NO: 85007 - DNA, 103 bp, Artificial Sequence
  Synthetic Polynucleotide
taatacgactcactatagggtagatgggccctcttcagcctccatgtgtcaacagaggagagacacaatgaggctgaagaacctggcggcagcgcaaaagatg

SEQ ID NO: 85008 - DNA, 103 bp, Artificial Sequence
  Synthetic Polynucleotide
taatacgactcactatagggtcgattagatgggccctcttcagcctccataacagaggagaatggagatggaagagggcaacctggcggcagcgcaaaagatg

SEQ ID NO: 85009 - DNA, 103 bp, Artificial Sequence
  Synthetic Polynucleotide
taatacgactcactatagggtcatctcgattagatgggccctcttcagccaacagaggagaggctgaatggggcccatcaacctggcggcagcgcaaaagatg

SEQ ID NO: 85010 - DNA, 103 bp, Artificial Sequence
  Synthetic Polynucleotide
taatacgactcactatagggtgttttcatctcgattagatgggccctcttaacagaggagaaagaggatgcatctaatcaacctggcggcagcgcaaaagatg

SEQ ID NO: 85011 - DNA, 103 bp, Artificial Sequence
  Synthetic Polynucleotide
taatacgactcactatagggtcacatgttttcatctcgattagatgggccaacagaggagaggcccaatgaatcgagataacctggcggcagcgcaaaagatg

SEQ ID NO: 85012 - DNA, 103 bp, Artificial Sequence
  Synthetic Polynucleotide
taatacgactcactataggggccattcacatgttttcatctcgattagataacagaggagaatctaaatgagatgaaaaaacctggcggcagcgcaaaagatg

SEQ ID NO: 85013 - DNA, 103 bp, Artificial Sequence
  Synthetic Polynucleotide
taatacgactcactatagggctttggccattcacatgttttcatctcgataacagaggagaatcgagatgaaaacatgtaacctggcggcagcgcaaaagatg

SEQ ID NO: 85014 - DNA, 103 bp, Artificial Sequence
  Synthetic Polynucleotide
taatacgactcactatagggatagcctcttttttccccactgaaccccataacagaggagaatggggatgagtggggaaaacctggcggcagcgcaaaagatg

SEQ ID NO: 85015 - DNA, 103 bp, Artificial Sequence
  Synthetic Polynucleotide
taatacgactcactatagggtgggactttggccattcacatgttttcatcaacagaggagagatgaaatgatgtgaatgaacctggcggcagcgcaaaagatg

SEQ ID NO: 85016 - DNA, 103 bp, Artificial Sequence
  Synthetic Polynucleotide
taatacgactcactatagggatgtgtgggactttggccattcacatgtttaacagaggagaaaacatatgaatggccaaaacctggcggcagcgcaaaagatg

SEQ ID NO: 85017 - DNA, 103 bp, Artificial Sequence
  Synthetic Polynucleotide
taatacgactcactatagggccacaatgtgtgggactttggccattcacaaacagaggagatgtgaaatgccaaagtccaacctggcggcagcgcaaaagatg

SEQ ID NO: 85018 - DNA, 103 bp, Artificial Sequence
  Synthetic Polynucleotide
taatacgactcactatagggtctgcccacaatgtgtgggactttggccataacagaggagaatggccatggtcccacacaacctggcggcagcgcaaaagatg

SEQ ID NO: 85019 - DNA, 103 bp, Artificial Sequence
  Synthetic Polynucleotide
taatacgactcactatagggttccatctgcccacaatgtgtgggactttgaacagaggagacaaagtatgacacattgtaacctggcggcagcgcaaaagatg

SEQ ID NO: 85020 - DNA, 103 bp, Artificial Sequence
  Synthetic Polynucleotide
taatacgactcactatagggttctattccatctgcccacaatgtgtgggaaacagaggagatcccacatgttgtgggcaaacctggcggcagcgcaaaagatg

SEQ ID NO: 85021 - DNA, 103 bp, Artificial Sequence
  Synthetic Polynucleotide
taatacgactcactatagggctctcttctattccatctgcccacaatgtgaacagaggagacacattatgggcagatggaacctggcggcagcgcaaaagatg

SEQ ID NO: 85022 - DNA, 103 bp, Artificial Sequence
  Synthetic Polynucleotide
taatacgactcactataggggatcactctcttctattccatctgcccacaaacagaggagatgtgggatgatggaatagaacctggcggcagcgcaaaagatg

SEQ ID NO: 85023 - DNA, 103 bp, Artificial Sequence
  Synthetic Polynucleotide
taatacgactcactataggggatcagatcactctcttctattccatctgcaacagaggagagcagatatgatagaagagaacctggcggcagcgcaaaagatg

SEQ ID NO: 85024 - DNA, 103 bp, Artificial Sequence
  Synthetic Polynucleotide
taatacgactcactatagggggaatgatcagatcactctcttctattccaaacagaggagatggaatatgagagagtgaaacctggcggcagcgcaaaagatg

SEQ ID NO: 85025 - DNA, 103 bp, Artificial Sequence
  Synthetic Polynucleotide
taatacgactcactatagggtttccatagcctcttttttccccactgaacaacagaggagagttcagatgggaaaaaagaacctggcggcagcgcaaaagatg

SEQ ID NO: 85026 - DNA, 103 bp, Artificial Sequence
  Synthetic Polynucleotide
taatacgactcactatagggacttgggaatgatcagatcactctcttctaaacagaggagatagaagatggtgatctgaaacctggcggcagcgcaaaagatg

SEQ ID NO: 85027 - DNA, 103 bp, Artificial Sequence
  Synthetic Polynucleotide
taatacgactcactatagggtaaagacttgggaatgatcagatcactctcaacagaggagagagagtatgctgatcattaacctggcggcagcgcaaaagatg

SEQ ID NO: 85028 - DNA, 103 bp, Artificial Sequence
  Synthetic Polynucleotide
taatacgactcactatagggccagctaaagacttgggaatgatcagatcaaacagaggagatgatctatgcattcccaaaacctggcggcagcgcaaaagatg

SEQ ID NO: 85029 - DNA, 103 bp, Artificial Sequence
  Synthetic Polynucleotide
taatacgactcactataggggtggcccagctaaagacttgggaatgatcaaacagaggagatgatcaatgccaagtcttaacctggcggcagcgcaaaagatg

SEQ ID NO: 85030 - DNA, 103 bp, Artificial Sequence
  Synthetic Polynucleotide
taatacgactcactataggggctgagtggcccagctaaagacttgggaataacagaggagaattcccatgtctttagctaacctggcggcagcgcaaaagatg

SEQ ID NO: 85031 - DNA, 103 bp, Artificial Sequence
  Synthetic Polynucleotide
taatacgactcactatagggtgatggctgagtggcccagctaaagacttgaacagaggagacaagtcatgagctgggccaacctggcggcagcgcaaaagatg

SEQ ID NO: 85032 - DNA, 103 bp, Artificial Sequence
  Synthetic Polynucleotide
taatacgactcactatagggtattgtgatggctgagtggcccagctaaagaacagaggagactttagatgggccactcaaacctggcggcagcgcaaaagatg

SEQ ID NO: 85033 - DNA, 103 bp, Artificial Sequence
  Synthetic Polynucleotide
taatacgactcactatagggtctggtattgtgatggctgagtggcccagcaacagaggagagctgggatgctcagccataacctggcggcagcgcaaaagatg

SEQ ID NO: 85034 - DNA, 103 bp, Artificial Sequence
  Synthetic Polynucleotide
taatacgactcactatagggccctctctggtattgtgatggctgagtggcaacagaggagagccactatgccatcacaaaacctggcggcagcgcaaaagatg

SEQ ID NO: 85035 - DNA, 103 bp, Artificial Sequence
  Synthetic Polynucleotide
taatacgactcactatagggtgtagccctctctggtattgtgatggctgaaacagaggagatcagccatgacaataccaaacctggcggcagcgcaaaagatg

SEQ ID NO: 85036 - DNA, 103 bp, Artificial Sequence
  Synthetic Polynucleotide
taatacgactcactatagggtattatttccatagcctcttttttccccacaacagaggagagtggggatgaaagaggctaacctggcggcagcgcaaaagatg

SEQ ID NO: 85037 - DNA, 103 bp, Artificial Sequence
  Synthetic Polynucleotide
taatacgactcactatagggggtcctgtagccctctctggtattgtgatgaacagaggagacatcacatgaccagagagaacctggcggcagcgcaaaagatg

SEQ ID NO: 85038 - DNA, 103 bp, Artificial Sequence
  Synthetic Polynucleotide
taatacgactcactatagggatttgggtcctgtagccctctctggtattgaacagaggagacaatacatgagagggctaaacctggcggcagcgcaaaagatg

SEQ ID NO: 85039 - DNA, 103 bp, Artificial Sequence
  Synthetic Polynucleotide
taatacgactcactatagggctttcatttgggtcctgtagccctctctggaacagaggagaccagagatggctacaggaaacctggcggcagcgcaaaagatg

SEQ ID NO: 85040 - DNA, 103 bp, Artificial Sequence
  Synthetic Polynucleotide
taatacgactcactatagggtggccctttcatttgggtcctgtagccctcaacagaggagagagggcatgaggacccaaaacctggcggcagcgcaaaagatg

SEQ ID NO: 85041 - DNA, 103 bp, Artificial Sequence
  Synthetic Polynucleotide
taatacgactcactatagggtgccatggccctttcatttgggtcctgtagaacagaggagactacagatgccaaatgaaaacctggcggcagcgcaaaagatg

SEQ ID NO: 85042 - DNA, 103 bp, Artificial Sequence
  Synthetic Polynucleotide
taatacgactcactatagggcactgtgccatggccctttcatttgggtccaacagaggagaggacccatgtgaaagggcaacctggcggcagcgcaaaagatg

SEQ ID NO: 85043 - DNA, 103 bp, Artificial Sequence
  Synthetic Polynucleotide
taatacgactcactatagggctcttcactgtgccatggccctttcatttgaacagaggagacaaatgatggggccatggaacctggcggcagcgcaaaagatg

SEQ ID NO: 85044 - DNA, 103 bp, Artificial Sequence
  Synthetic Polynucleotide
taatacgactcactatagggtcaagctcttcactgtgccatggccctttcaacagaggagagaaaggatgatggcacagaacctggcggcagcgcaaaagatg

SEQ ID NO: 85045 - DNA, 103 bp, Artificial Sequence
  Synthetic Polynucleotide
taatacgactcactataggggaatttcaagctcttcactgtgccatggccaacagaggagaggccatatgacagtgaagaacctggcggcagcgcaaaagatg

SEQ ID NO: 85046 - DNA, 103 bp, Artificial Sequence
  Synthetic Polynucleotide
taatacgactcactatagggaaaccgaatttcaagctcttcactgtgccaaacagaggagatggcacatggaagagcttaacctggcggcagcgcaaaagatg

SEQ ID NO: 85047 - DNA, 103 bp, Artificial Sequence
  Synthetic Polynucleotide
taatacgactcactatagggttctttattatttccatagcctcttttttcaacagaggagagaaaaaatgggctatggaaacctggcggcagcgcaaaagatg

SEQ ID NO: 85048 - DNA, 103 bp, Artificial Sequence
  Synthetic Polynucleotide
taatacgactcactatagggtcctcaaaccgaatttcaagctcttcactgaacagaggagacagtgaatggcttgaaataacctggcggcagcgcaaaagatg

SEQ ID NO: 85049 - DNA, 103 bp, Artificial Sequence
  Synthetic Polynucleotide
taatacgactcactatagggggcattcctcaaaccgaatttcaagctcttaacagaggagaaagagcatgaaattcggtaacctggcggcagcgcaaaagatg

SEQ ID NO: 85050 - DNA, 103 bp, Artificial Sequence
  Synthetic Polynucleotide
taatacgactcactataggggcccgggcattcctcaaaccgaatttcaagaacagaggagacttgaaatgcggtttgagaacctggcggcagcgcaaaagatg

SEQ ID NO: 85051 - DNA, 103 bp, Artificial Sequence
  Synthetic Polynucleotide
taatacgactcactatagggttagtgcccgggcattcctcaaaccgaattaacagaggagaaattcgatgtgaggaatgaacctggcggcagcgcaaaagatg

SEQ ID NO: 85052 - DNA, 103 bp, Artificial Sequence
  Synthetic Polynucleotide
taatacgactcactatagggggaccttagtgcccgggcattcctcaaaccaacagaggagaggtttgatgaatgcccggaacctggcggcagcgcaaaagatg

SEQ ID NO: 85053 - DNA, 103 bp, Artificial Sequence
  Synthetic Polynucleotide
taatacgactcactatagggcacgtggaccttagtgcccgggcattcctcaacagaggagagaggaaatgccgggcactaacctggcggcagcgcaaaagatg

SEQ ID NO: 85054 - DNA, 103 bp, Artificial Sequence
  Synthetic Polynucleotide
taatacgactcactatagggtcctccacgtggaccttagtgcccgggcataacagaggagaatgcccatgcactaaggtaacctggcggcagcgcaaaagatg

SEQ ID NO: 85055 - DNA, 103 bp, Artificial Sequence
  Synthetic Polynucleotide
taatacgactcactatagggatgtttcctccacgtggaccttagtgcccgaacagaggagacgggcaatgaggtccacgaacctggcggcagcgcaaaagatg

SEQ ID NO: 85056 - DNA, 103 bp, Artificial Sequence
  Synthetic Polynucleotide
taatacgactcactatagggtccacatgtttcctccacgtggaccttagtaacagaggagaactaagatgcacgtggagaacctggcggcagcgcaaaagatg

SEQ ID NO: 85057 - DNA, 103 bp, Artificial Sequence
  Synthetic Polynucleotide
taatacgactcactatagggcttgttccacatgtttcctccacgtggaccaacagaggagaggtccaatgggaggaaacaacctggcggcagcgcaaaagatg

SEQ ID NO: 85058 - DNA, 103 bp, Artificial Sequence
  Synthetic Polynucleotide
taatacgactcactatagggtgaacttctttattatttccatagcctcttaacagaggagaaagaggatgtggaaataaaacctggcggcagcgcaaaagatg

SEQ ID NO: 85059 - DNA, 103 bp, Artificial Sequence
  Synthetic Polynucleotide
taatacgactcactataggggtcctcttgttccacatgtttcctccacgtaacagaggagaacgtggatgaaacatgtgaacctggcggcagcgcaaaagatg

SEQ ID NO: 85060 - DNA, 103 bp, Artificial Sequence
  Synthetic Polynucleotide
taatacgactcactatagggagatggtcctcttgttccacatgtttcctcaacagaggagagaggaaatgtgtggaacaaacctggcggcagcgcaaaagatg

SEQ ID NO: 85061 - DNA, 103 bp, Artificial Sequence
  Synthetic Polynucleotide
taatacgactcactatagggctcagagatggtcctcttgttccacatgttaacagaggagaaacatgatgaacaagaggaacctggcggcagcgcaaaagatg

SEQ ID NO: 85062 - DNA, 103 bp, Artificial Sequence
  Synthetic Polynucleotide
taatacgactcactatagggttgatctcagagatggtcctcttgttccacaacagaggagagtggaaatggaggaccataacctggcggcagcgcaaaagatg

SEQ ID NO: 85063 - DNA, 103 bp, Artificial Sequence
  Synthetic Polynucleotide
taatacgactcactatagggagtggttgatctcagagatggtcctcttgtaacagaggagaacaagaatgccatctctgaacctggcggcagcgcaaaagatg

SEQ ID NO: 85064 - DNA, 103 bp, Artificial Sequence
  Synthetic Polynucleotide
taatacgactcactatagggcttgcagtggttgatctcagagatggtcctaacagaggagaaggaccatgtctgagatcaacctggcggcagcgcaaaagatg

SEQ ID NO: 85065 - DNA, 103 bp, Artificial Sequence
  Synthetic Polynucleotide
taatacgactcactatagggttccgcttgcagtggttgatctcagagatgaacagaggagacatctcatggatcaaccaaacctggcggcagcgcaaaagatg

SEQ ID NO: 85066 - DNA, 103 bp, Artificial Sequence
  Synthetic Polynucleotide
taatacgactcactatagggcacccttccgcttgcagtggttgatctcagaacagaggagactgagaatgaccactgcaaacctggcggcagcgcaaaagatg

SEQ ID NO: 85067 - DNA, 103 bp, Artificial Sequence
  Synthetic Polynucleotide
taatacgactcactatagggtcgatcacccttccgcttgcagtggttgataacagaggagaatcaacatgtgcaagcggaacctggcggcagcgcaaaagatg

SEQ ID NO: 85068 - DNA, 103 bp, Artificial Sequence
  Synthetic Polynucleotide
taatacgactcactatagggattcctcgatcacccttccgcttgcagtggaacagaggagaccactgatggcggaagggaacctggcggcagcgcaaaagatg

SEQ ID NO: 85069 - DNA, 103 bp, Artificial Sequence
  Synthetic Polynucleotide
taatacgactcactatagggtttcttgaacttctttattatttccatagcaacagaggagagctatgatgataataaagaacctggcggcagcgcaaaagatg

SEQ ID NO: 85070 - DNA, 103 bp, Artificial Sequence
  Synthetic Polynucleotide
taatacgactcactataggggcaccattcctcgatcacccttccgcttgcaacagaggagagcaagcatgagggtgatcaacctggcggcagcgcaaaagatg

SEQ ID NO: 85071 - DNA, 103 bp, Artificial Sequence
  Synthetic Polynucleotide
taatacgactcactatagggctgcagcaccattcctcgatcacccttccgaacagaggagacggaagatggatcgaggaaacctggcggcagcgcaaaagatg

SEQ ID NO: 85072 - DNA, 103 bp, Artificial Sequence
  Synthetic Polynucleotide
taatacgactcactatagggactccctgcagcaccattcctcgatcacccaacagaggagagggtgaatgaggaatggtaacctggcggcagcgcaaaagatg

SEQ ID NO: 85073 - DNA, 103 bp, Artificial Sequence
  Synthetic Polynucleotide
taatacgactcactatagggtgtgcactccctgcagcaccattcctcgataacagaggagaatcgagatgtggtgctgcaacctggcggcagcgcaaaagatg

SEQ ID NO: 85074 - DNA, 103 bp, Artificial Sequence
  Synthetic Polynucleotide
taatacgactcactatagggggcattgtgcactccctgcagcaccattccaacagaggagaggaatgatgctgcagggaaacctggcggcagcgcaaaagatg

SEQ ID NO: 85075 - DNA, 103 bp, Artificial Sequence
  Synthetic Polynucleotide
taatacgactcactataggggtgggggcattgtgcactccctgcagcaccaacagaggagaggtgctatggggagtgcaaacctggcggcagcgcaaaagatg

SEQ ID NO: 85076 - DNA, 103 bp, Artificial Sequence
  Synthetic Polynucleotide
taatacgactcactatagggcgacagtgggggcattgtgcactccctgcaaacagaggagatgcaggatgtgcacaatgaacctggcggcagcgcaaaagatg

SEQ ID NO: 85077 - DNA, 103 bp, Artificial Sequence
  Synthetic Polynucleotide
taatacgactcactatagggcggaacgacagtgggggcattgtgcactccaacagaggagaggagtgatgaatgcccccaacctggcggcagcgcaaaagatg

SEQ ID NO: 85078 - DNA, 103 bp, Artificial Sequence
  Synthetic Polynucleotide
taatacgactcactatagggtagcccggaacgacagtgggggcattgtgcaacagaggagagcacaaatgccccactgtaacctggcggcagcgcaaaagatg

SEQ ID NO: 85079 - DNA, 103 bp, Artificial Sequence
  Synthetic Polynucleotide
taatacgactcactatagggatctttagcccggaacgacagtgggggcataacagaggagaatgcccatgctgtcgttcaacctggcggcagcgcaaaagatg

SEQ ID NO: 85080 - DNA, 103 bp, Artificial Sequence
  Synthetic Polynucleotide
taatacgactcactatagggagatctttcttgaacttctttattatttccaacagaggagaggaaatatgaaagaagttaacctggcggcagcgcaaaagatg

SEQ ID NO: 85081 - DNA, 103 bp, Artificial Sequence
  Synthetic Polynucleotide
taatacgactcactatagggcagccatctttagcccggaacgacagtgggaacagaggagacccactatggttccgggcaacctggcggcagcgcaaaagatg

SEQ ID NO: 85082 - DNA, 103 bp, Artificial Sequence
  Synthetic Polynucleotide
taatacgactcactatagggaccaacagccatctttagcccggaacgacaaacagaggagatgtcgtatggggctaaagaacctggcggcagcgcaaaagatg

SEQ ID NO: 85083 - DNA, 103 bp, Artificial Sequence
  Synthetic Polynucleotide
taatacgactcactatagggtccataccaacagccatctttagcccggaaaacagaggagattccggatgaaagatggcaacctggcggcagcgcaaaagatg

SEQ ID NO: 85084 - DNA, 103 bp, Artificial Sequence
  Synthetic Polynucleotide
taatacgactcactatagggtccattccataccaacagccatctttagccaacagaggagaggctaaatgtggctgttgaacctggcggcagcgcaaaagatg

SEQ ID NO: 85085 - DNA, 103 bp, Artificial Sequence
  Synthetic Polynucleotide
taatacgactcactatagggttatctccattccataccaacagccatcttaacagaggagaaagatgatggttggtatgaacctggcggcagcgcaaaagatg

SEQ ID NO: 85086 - DNA, 103 bp, Artificial Sequence
  Synthetic Polynucleotide
taatacgactcactataggggggccttatctccattccataccaacagccaacagaggagaggctgtatgtatggaatgaacctggcggcagcgcaaaagatg

SEQ ID NO: 85087 - DNA, 103 bp, Artificial Sequence
  Synthetic Polynucleotide
taatacgactcactatagggttcctgggccttatctccattccataccaaaacagaggagattggtaatgaatggagataacctggcggcagcgcaaaagatg

SEQ ID NO: 85088 - DNA, 103 bp, Artificial Sequence
  Synthetic Polynucleotide
taatacgactcactataggggttctttcctgggccttatctccattccataacagaggagaatggaaatgagataaggcaacctggcggcagcgcaaaagatg

SEQ ID NO: 85089 - DNA, 103 bp, Artificial Sequence
  Synthetic Polynucleotide
taatacgactcactatagggttctggttctttcctgggccttatctccataacagaggagaatggagatgaggcccaggaacctggcggcagcgcaaaagatg

SEQ ID NO: 85090 - DNA, 103 bp, Artificial Sequence
  Synthetic Polynucleotide
taatacgactcactatagggttgctttctggttctttcctgggccttatcaacagaggagagataagatgcaggaaagaaacctggcggcagcgcaaaagatg

SEQ ID NO: 85091 - DNA, 103 bp, Artificial Sequence
  Synthetic Polynucleotide
taatacgactcactataggggttgctagctttcgcttcaaactcgaactgaacagaggagacagttcatgtttgaagcgaacctggcggcagcgcaaaagatg

SEQ ID NO: 85092 - DNA, 103 bp, Artificial Sequence
  Synthetic Polynucleotide
taatacgactcactatagggcagccagatctttcttgaacttctttattaaacagaggagataataaatgagttcaagaaacctggcggcagcgcaaaagatg

SEQ ID NO: 85093 - DNA, 103 bp, Artificial Sequence
  Synthetic Polynucleotide
taatacgactcactatagggctaagttgctttctggttctttcctgggccaacagaggagaggcccaatgaagaaccagaacctggcggcagcgcaaaagatg

SEQ ID NO: 85094 - DNA, 103 bp, Artificial Sequence
  Synthetic Polynucleotide
taatacgactcactatagggccttactaagttgctttctggttctttcctaacagaggagaaggaaaatgccagaaagcaacctggcggcagcgcaaaagatg

SEQ ID NO: 85095 - DNA, 103 bp, Artificial Sequence
  Synthetic Polynucleotide
taatacgactcactatagggactgaccttactaagttgctttctggttctaacagaggagaagaaccatgaagcaacttaacctggcggcagcgcaaaagatg

SEQ ID NO: 85096 - DNA, 103 bp, Artificial Sequence
  Synthetic Polynucleotide
taatacgactcactatagggtcaccactgaccttactaagttgctttctgaacagaggagacagaaaatgacttagtaaaacctggcggcagcgcaaaagatg

SEQ ID NO: 85097 - DNA, 103 bp, Artificial Sequence
  Synthetic Polynucleotide
taatacgactcactatagggtgcagtcaccactgaccttactaagttgctaacagaggagaagcaacatggtaaggtcaaacctggcggcagcgcaaaagatg

SEQ ID NO: 85098 - DNA, 103 bp, Artificial Sequence
  Synthetic Polynucleotide
taatacgactcactataggggatcctgcagtcaccactgaccttactaagaacagaggagacttagtatggtcagtggtaacctggcggcagcgcaaaagatg

SEQ ID NO: 85099 - DNA, 103 bp, Artificial Sequence
  Synthetic Polynucleotide
taatacgactcactatagggcagttgatcctgcagtcaccactgaccttaaacagaggagataaggtatgtggtgactgaacctggcggcagcgcaaaagatg

SEQ ID NO: 85100 - DNA, 103 bp, Artificial Sequence
  Synthetic Polynucleotide
taatacgactcactataggggtgatcagttgatcctgcagtcaccactgaaacagaggagatcagtgatgactgcaggaaacctggcggcagcgcaaaagatg

SEQ ID NO: 85101 - DNA, 103 bp, Artificial Sequence
  Synthetic Polynucleotide
taatacgactcactatagggtccatgtgatcagttgatcctgcagtcaccaacagaggagaggtgacatgaggatcaacaacctggcggcagcgcaaaagatg

SEQ ID NO: 85102 - DNA, 103 bp, Artificial Sequence
  Synthetic Polynucleotide
taatacgactcactatagggagtgatccatgtgatcagttgatcctgcagaacagaggagactgcagatgcaactgatcaacctggcggcagcgcaaaagatg

SEQ ID NO: 85103 - DNA, 103 bp, Artificial Sequence
  Synthetic Polynucleotide
taatacgactcactatagggcatggcagccagatctttcttgaacttcttaacagaggagaaagaagatgaagaaagataacctggcggcagcgcaaaagatg

SEQ ID NO: 85104 - DNA, 103 bp, Artificial Sequence
  Synthetic Polynucleotide
taatacgactcactatagggggagaagtgatccatgtgatcagttgatccaacagaggagaggatcaatggatcacatgaacctggcggcagcgcaaaagatg

SEQ ID NO: 85105 - DNA, 103 bp, Artificial Sequence
  Synthetic Polynucleotide
taatacgactcactatagggccaagggagaagtgatccatgtgatcagttaacagaggagaaactgaatgcatggatcaaacctggcggcagcgcaaaagatg

SEQ ID NO: 85106 - DNA, 103 bp, Artificial Sequence
  Synthetic Polynucleotide
taatacgactcactataggggcactccaagggagaagtgatccatgtgataacagaggagaatcacaatgatcacttctaacctggcggcagcgcaaaagatg

SEQ ID NO: 85107 - DNA, 103 bp, Artificial Sequence
  Synthetic Polynucleotide
taatacgactcactatagggcacaagcactccaagggagaagtgatccataacagaggagaatggatatgttctcccttaacctggcggcagcgcaaaagatg

SEQ ID NO: 85108 - DNA, 103 bp, Artificial Sequence
  Synthetic Polynucleotide
taatacgactcactatagggagaatcacaagcactccaagggagaagtgaaacagaggagatcacttatgccttggagtaacctggcggcagcgcaaaagatg

SEQ ID NO: 85109 - DNA, 103 bp, Artificial Sequence
  Synthetic Polynucleotide
taatacgactcactatagggtgagcagaatcacaagcactccaagggagaaacagaggagatctcccatggagtgcttgaacctggcggcagcgcaaaagatg

SEQ ID NO: 85110 - DNA, 103 bp, Artificial Sequence
  Synthetic Polynucleotide
taatacgactcactatagggcaccatgagcagaatcacaagcactccaagaacagaggagacttggaatgcttgtgattaacctggcggcagcgcaaaagatg

SEQ ID NO: 85111 - DNA, 103 bp, Artificial Sequence
  Synthetic Polynucleotide
taatacgactcactatagggtcctgcaccatgagcagaatcacaagcactaacagaggagaagtgctatggattctgctaacctggcggcagcgcaaaagatg

SEQ ID NO: 85112 - DNA, 103 bp, Artificial Sequence
  Synthetic Polynucleotide
taatacgactcactataggggcccttcctgcaccatgagcagaatcacaaaacagaggagattgtgaatgtgctcatggaacctggcggcagcgcaaaagatg

SEQ ID NO: 85113 - DNA, 103 bp, Artificial Sequence
  Synthetic Polynucleotide
taatacgactcactatagggcttcagcccttcctgcaccatgagcagaataacagaggagaattctgatgatggtgcagaacctggcggcagcgcaaaagatg

SEQ ID NO: 85114 - DNA, 103 bp, Artificial Sequence
  Synthetic Polynucleotide
taatacgactcactatagggctcagcatggcagccagatctttcttgaacaacagaggagagttcaaatgagatctggcaacctggcggcagcgcaaaagatg

SEQ ID NO: 85115 - DNA, 103 bp, Artificial Sequence
  Synthetic Polynucleotide
taatacgactcactatagggctcttcttcagcccttcctgcaccatgagcaacagaggagagctcatatggcaggaaggaacctggcggcagcgcaaaagatg

SEQ ID NO: 85116 - DNA, 103 bp, Artificial Sequence
  Synthetic Polynucleotide
taatacgactcactatagggtcattctcttcttcagcccttcctgcaccaaacagaggagatggtgcatgaagggctgaaacctggcggcagcgcaaaagatg

SEQ ID NO: 85117 - DNA, 103 bp, Artificial Sequence
  Synthetic Polynucleotide
taatacgactcactatagggtgtggtcattctcttcttcagcccttcctgaacagaggagacaggaaatgctgaagaagaacctggcggcagcgcaaaagatg

SEQ ID NO: 85118 - DNA, 103 bp, Artificial Sequence
  Synthetic Polynucleotide
taatacgactcactatagggatctttgtggtcattctcttcttcagccctaacagaggagaagggctatggaagagaataacctggcggcagcgcaaaagatg

SEQ ID NO: 85119 - DNA, 103 bp, Artificial Sequence
  Synthetic Polynucleotide
taatacgactcactatagggtgatgatctttgtggtcattctcttcttcaaacagaggagatgaagaatggaatgaccaaacctggcggcagcgcaaaagatg

SEQ ID NO: 85120 - DNA, 103 bp, Artificial Sequence
  Synthetic Polynucleotide
taatacgactcactataggggcttatgatgatctttgtggtcattctcttaacagaggagaaagagaatgaccacaaagaacctggcggcagcgcaaaagatg

SEQ ID NO: 85121 - DNA, 103 bp, Artificial Sequence
  Synthetic Polynucleotide
taatacgactcactataggggatgtgcttatgatgatctttgtggtcattaacagaggagaaatgacatgaaagatcataacctggcggcagcgcaaaagatg

SEQ ID NO: 85122 - DNA, 103 bp, Artificial Sequence
  Synthetic Polynucleotide
taatacgactcactatagggccattgatgtgcttatgatgatctttgtggaacagaggagaccacaaatgtcatcataaaacctggcggcagcgcaaaagatg

SEQ ID NO: 85123 - DNA, 103 bp, Artificial Sequence
  Synthetic Polynucleotide
taatacgactcactatagggcactgccattgatgtgcttatgatgatcttaacagaggagaaagatcatgataagcacaaacctggcggcagcgcaaaagatg

SEQ ID NO: 85124 - DNA, 103 bp, Artificial Sequence
  Synthetic Polynucleotide
taatacgactcactatagggaccagcactgccattgatgtgcttatgatgaacagaggagacatcatatgcacatcaataacctggcggcagcgcaaaagatg

SEQ ID NO: 85125 - DNA, 103 bp, Artificial Sequence
  Synthetic Polynucleotide
taatacgactcactatagggttattctcagcatggcagccagatctttctaacagaggagaagaaagatgtggctgccaaacctggcggcagcgcaaaagatg

SEQ ID NO: 85126 - DNA, 103 bp, Artificial Sequence
  Synthetic Polynucleotide
taatacgactcactatagggtagctaccagcactgccattgatgtgcttaaacagaggagataagcaatgcaatggcagaacctggcggcagcgcaaaagatg

SEQ ID NO: 85127 - DNA, 103 bp, Artificial Sequence
  Synthetic Polynucleotide
taatacgactcactataggggatcatagctaccagcactgccattgatgtaacagaggagaacatcaatggcagtgctgaacctggcggcagcgcaaaagatg

SEQ ID NO: 85128 - DNA, 103 bp, Artificial Sequence
  Synthetic Polynucleotide
taatacgactcactatagggcccaggatcatagctaccagcactgccattaacagaggagaaatggcatggctggtagcaacctggcggcagcgcaaaagatg

SEQ ID NO: 85129 - DNA, 103 bp, Artificial Sequence
  Synthetic Polynucleotide
taatacgactcactatagggatcctcccaggatcatagctaccagcactgaacagaggagacagtgcatgtagctatgaaacctggcggcagcgcaaaagatg

SEQ ID NO: 85130 - DNA, 103 bp, Artificial Sequence
  Synthetic Polynucleotide
taatacgactcactatagggtgaaaatcctcccaggatcatagctaccagaacagaggagactggtaatgatgatcctgaacctggcggcagcgcaaaagatg

SEQ ID NO: 85131 - DNA, 103 bp, Artificial Sequence
  Synthetic Polynucleotide
taatacgactcactatagggctcattgaaaatcctcccaggatcatagctaacagaggagaagctatatgcctgggaggaacctggcggcagcgcaaaagatg

SEQ ID NO: 85132 - DNA, 103 bp, Artificial Sequence
  Synthetic Polynucleotide
taatacgactcactatagggggtcactcattgaaaatcctcccaggatcaaacagaggagatgatccatggaggattttaacctggcggcagcgcaaaagatg

SEQ ID NO: 85133 - DNA, 103 bp, Artificial Sequence
  Synthetic Polynucleotide
taatacgactcactatagggagccaggtcactcattgaaaatcctcccagaacagaggagactgggaatgttttcaatgaacctggcggcagcgcaaaagatg

SEQ ID NO: 85134 - DNA, 103 bp, Artificial Sequence
  Synthetic Polynucleotide
taatacgactcactatagggagcttagccaggtcactcattgaaaatcctaacagaggagaaggattatgaatgagtgaaacctggcggcagcgcaaaagatg

SEQ ID NO: 85135 - DNA, 103 bp, Artificial Sequence
  Synthetic Polynucleotide
taatacgactcactatagggttgcaagcttagccaggtcactcattgaaaaacagaggagatttcaaatggtgacctggaacctggcggcagcgcaaaagatg

SEQ ID NO: 85136 - DNA, 103 bp, Artificial Sequence
  Synthetic Polynucleotide
taatacgactcactatagggattgattattctcagcatggcagccagatcaacagaggagagatctgatggccatgctgaacctggcggcagcgcaaaagatg

SEQ ID NO: 85137 - DNA, 103 bp, Artificial Sequence
  Synthetic Polynucleotide
taatacgactcactatagggcaaaattgcaagcttagccaggtcactcataacagaggagaatgagtatgctggctaagaacctggcggcagcgcaaaagatg

SEQ ID NO: 85138 - DNA, 103 bp, Artificial Sequence
  Synthetic Polynucleotide
taatacgactcactatagggcccatcaaaattgcaagcttagccaggtcaaacagaggagatgacctatgtaagcttgcaacctggcggcagcgcaaaagatg

SEQ ID NO: 85139 - DNA, 103 bp, Artificial Sequence
  Synthetic Polynucleotide
taatacgactcactatagggtggcgcccatcaaaattgcaagcttagccaaacagaggagatggctaatgttgcaatttaacctggcggcagcgcaaaagatg

SEQ ID NO: 85140 - DNA, 103 bp, Artificial Sequence
  Synthetic Polynucleotide
taatacgactcactataggggaaggtggcgcccatcaaaattgcaagcttaacagaggagaaagcttatgattttgatgaacctggcggcagcgcaaaagatg

SEQ ID NO: 85141 - DNA, 103 bp, Artificial Sequence
  Synthetic Polynucleotide
taatacgactcactatagggtccgcgaaggtggcgcccatcaaaattgcaaacagaggagatgcaatatggatgggcgcaacctggcggcagcgcaaaagatg

SEQ ID NO: 85142 - DNA, 103 bp, Artificial Sequence
  Synthetic Polynucleotide
taatacgactcactatagggtcatttccgcgaaggtggcgcccatcaaaaaacagaggagattttgaatggcgccacctaacctggcggcagcgcaaaagatg

SEQ ID NO: 85143 - DNA, 103 bp, Artificial Sequence
  Synthetic Polynucleotide
taatacgactcactatagggagtgttcatttccgcgaaggtggcgcccataacagaggagaatgggcatgaccttcgcgaacctggcggcagcgcaaaagatg

SEQ ID NO: 85144 - DNA, 103 bp, Artificial Sequence
  Synthetic Polynucleotide
taatacgactcactatagggcctccagtgttcatttccgcgaaggtggcgaacagaggagacgccacatgcgcggaaataacctggcggcagcgcaaaagatg

SEQ ID NO: 85145 - DNA, 103 bp, Artificial Sequence
  Synthetic Polynucleotide
taatacgactcactatagggcatctcctccagtgttcatttccgcgaaggaacagaggagaccttcgatgaaatgaacaaacctggcggcagcgcaaaagatg

SEQ ID NO: 85146 - DNA, 103 bp, Artificial Sequence
  Synthetic Polynucleotide
taatacgactcactatagggagctacatctcctccagtgttcatttccgcaacagaggagagcggaaatgaacactggaaacctggcggcagcgcaaaagatg

SEQ ID NO: 85147 - DNA, 103 bp, Artificial Sequence
  Synthetic Polynucleotide
taatacgactcactatagggctagcattgattattctcagcatggcagccaacagaggagaggctgcatggctgagaataacctggcggcagcgcaaaagatg

SEQ ID NO: 85148 - DNA, 103 bp, Artificial Sequence
  Synthetic Polynucleotide
taatacgactcactatagggagatgagctacatctcctccagtgttcattaacagaggagaaatgaaatgtggaggagaaacctggcggcagcgcaaaagatg

SEQ ID NO: 85149 - DNA, 103 bp, Artificial Sequence
  Synthetic Polynucleotide
taatacgactcactataggggcgccagatgagctacatctcctccagtgtaacagaggagaacactgatggagatgtagaacctggcggcagcgcaaaagatg

SEQ ID NO: 85150 - DNA, 103 bp, Artificial Sequence
  Synthetic Polynucleotide
taatacgactcactatagggtatcagcgccagatgagctacatctcctccaacagaggagaggaggaatggtagctcataacctggcggcagcgcaaaagatg

SEQ ID NO: 85151 - DNA, 103 bp, Artificial Sequence
  Synthetic Polynucleotide
taatacgactcactataggggccgctatcagcgccagatgagctacatctaacagaggagaagatgtatgtcatctggcaacctggcggcagcgcaaaagatg

SEQ ID NO: 85152 - DNA, 103 bp, Artificial Sequence
  Synthetic Polynucleotide
taatacgactcactatagggtgaatgccgctatcagcgccagatgagctaaacagaggagatagctcatgtggcgctgaaacctggcggcagcgcaaaagatg

SEQ ID NO: 85153 - DNA, 103 bp, Artificial Sequence
  Synthetic Polynucleotide
taatacgactcactataggggactttgaatgccgctatcagcgccagatgaacagaggagacatctgatgctgatagcgaacctggcggcagcgcaaaagatg

SEQ ID NO: 85154 - DNA, 103 bp, Artificial Sequence
  Synthetic Polynucleotide
taatacgactcactatagggggtctgactttgaatgccgctatcagcgccaacagaggagaggcgctatgagcggcattaacctggcggcagcgcaaaagatg

SEQ ID NO: 85155 - DNA, 103 bp, Artificial Sequence
  Synthetic Polynucleotide
taatacgactcactatagggacgctggtctgactttgaatgccgctatcaaacagaggagatgatagatgcattcaaagaacctggcggcagcgcaaaagatg

SEQ ID NO: 85156 - DNA, 103 bp, Artificial Sequence
  Synthetic Polynucleotide
taatacgactcactatagggcagcaacgctggtctgactttgaatgccgcaacagaggagagcggcaatgaaagtcagaaacctggcggcagcgcaaaagatg

SEQ ID NO: 85157 - DNA, 103 bp, Artificial Sequence
  Synthetic Polynucleotide
taatacgactcactataggggataccagcaacgctggtctgactttgaataacagaggagaattcaaatgcagaccagcaacctggcggcagcgcaaaagatg

SEQ ID NO: 85158 - DNA, 103 bp, Artificial Sequence
  Synthetic Polynucleotide
taatacgactcactatagggccttcctagcattgattattctcagcatggaacagaggagaccatgcatggaataatcaaacctggcggcagcgcaaaagatg

SEQ ID NO: 85159 - DNA, 103 bp, Artificial Sequence
  Synthetic Polynucleotide
taatacgactcactatagggtgaaagataccagcaacgctggtctgacttaacagaggagaaagtcaatgcagcgttgcaacctggcggcagcgcaaaagatg

SEQ ID NO: 85160 - DNA, 103 bp, Artificial Sequence
  Synthetic Polynucleotide
taatacgactcactataggggaagatgaaagataccagcaacgctggtctaacagaggagaagaccaatgttgctggtaaacctggcggcagcgcaaaagatg

SEQ ID NO: 85161 - DNA, 103 bp, Artificial Sequence
  Synthetic Polynucleotide
taatacgactcactataggggctctgaagatgaaagataccagcaacgctaacagaggagaagcgttatgggtatctttaacctggcggcagcgcaaaagatg

SEQ ID NO: 85162 - DNA, 103 bp, Artificial Sequence
  Synthetic Polynucleotide
taatacgactcactatagggaattagctctgaagatgaaagataccagcaaacagaggagatgctggatgctttcatctaacctggcggcagcgcaaaagatg

SEQ ID NO: 85163 - DNA, 103 bp, Artificial Sequence
  Synthetic Polynucleotide
taatacgactcactatagggtgtccaattagctctgaagatgaaagatacaacagaggagagtatctatgatcttcagaaacctggcggcagcgcaaaagatg

SEQ ID NO: 85164 - DNA, 103 bp, Artificial Sequence
  Synthetic Polynucleotide
taatacgactcactatagggcggggtgtccaattagctctgaagatgaaaaacagaggagatttcatatgcagagctaaaacctggcggcagcgcaaaagatg

SEQ ID NO: 85165 - DNA, 103 bp, Artificial Sequence
  Synthetic Polynucleotide
taatacgactcactatagggtttcacggggtgtccaattagctctgaagaaacagaggagatcttcaatgctaattggaaacctggcggcagcgcaaaagatg

SEQ ID NO: 85166 - DNA, 103 bp, Artificial Sequence
  Synthetic Polynucleotide
taatacgactcactatagggcatgctttcacggggtgtccaattagctctaacagaggagaagagctatgtggacacccaacctggcggcagcgcaaaagatg

SEQ ID NO: 85167 - DNA, 103 bp, Artificial Sequence
  Synthetic Polynucleotide
taatacgactcactatagggagcagcatgctttcacggggtgtccaattaaacagaggagataattgatgaccccgtgaaacctggcggcagcgcaaaagatg

SEQ ID NO: 85168 - DNA, 103 bp, Artificial Sequence
  Synthetic Polynucleotide
taatacgactcactatagggaggccagcagcatgctttcacggggtgtccaacagaggagaggacacatggtgaaagcaaacctggcggcagcgcaaaagatg

SEQ ID NO: 85169 - DNA, 103 bp, Artificial Sequence
  Synthetic Polynucleotide
taatacgactcactatagggcttctccttcctagcattgattattctcagaacagaggagactgagaatgatcaatgctaacctggcggcagcgcaaaagatg

SEQ ID NO: 85170 - DNA, 103 bp, Artificial Sequence
  Synthetic Polynucleotide
taatacgactcactatagggggccaaggccagcagcatgctttcacggggaacagaggagaccccgtatgagcatgctgaacctggcggcagcgcaaaagatg

SEQ ID NO: 85171 - DNA, 103 bp, Artificial Sequence
  Synthetic Polynucleotide
taatacgactcactatagggcacgaggccaaggccagcagcatgctttcaaacagaggagatgaaagatggctgctggcaacctggcggcagcgcaaaagatg

SEQ ID NO: 85172 - DNA, 103 bp, Artificial Sequence
  Synthetic Polynucleotide
taatacgactcactatagggaaagacacgaggccaaggccagcagcatgcaacagaggagagcatgcatgtggccttggaacctggcggcagcgcaaaagatg

SEQ ID NO: 85173 - DNA, 103 bp, Artificial Sequence
  Synthetic Polynucleotide
taatacgactcactatagggttgcaaaagacacgaggccaaggccagcagaacagaggagactgctgatgttggcctcgaacctggcggcagcgcaaaagatg

SEQ ID NO: 85174 - DNA, 103 bp, Artificial Sequence
  Synthetic Polynucleotide
taatacgactcactataggggcagtttgcaaaagacacgaggccaaggccaacagaggagaggccttatgctcgtgtctaacctggcggcagcgcaaaagatg

SEQ ID NO: 85175 - DNA, 103 bp, Artificial Sequence
  Synthetic Polynucleotide
taatacgactcactatagggagatcgcagtttgcaaaagacacgaggccaaacagaggagatggcctatggtcttttgcaacctggcggcagcgcaaaagatg

SEQ ID NO: 85176 - DNA, 103 bp, Artificial Sequence
  Synthetic Polynucleotide
taatacgactcactatagggggcggagatcgcagtttgcaaaagacacgaaacagaggagatcgtgtatgttgcaaactaacctggcggcagcgcaaaagatg

SEQ ID NO: 85177 - DNA, 103 bp, Artificial Sequence
  Synthetic Polynucleotide
taatacgactcactatagggtccaaggcggagatcgcagtttgcaaaagaaacagaggagatcttttatgaactgcgataacctggcggcagcgcaaaagatg

SEQ ID NO: 85178 - DNA, 103 bp, Artificial Sequence
  Synthetic Polynucleotide
taatacgactcactatagggcgccttccaaggcggagatcgcagtttgcaaacagaggagatgcaaaatgcgatctccgaacctggcggcagcgcaaaagatg

SEQ ID NO: 85179 - DNA, 103 bp, Artificial Sequence
  Synthetic Polynucleotide
taatacgactcactatagggcaggtcgccttccaaggcggagatcgcagtaacagaggagaactgcgatgtccgccttgaacctggcggcagcgcaaaagatg

SEQ ID NO: 85180 - DNA, 103 bp, Artificial Sequence
  Synthetic Polynucleotide
taatacgactcactatagggctcttcttctccttcctagcattgattattaacagaggagaaataatatgtgctaggaaaacctggcggcagcgcaaaagatg

SEQ ID NO: 85181 - DNA, 103 bp, Artificial Sequence
  Synthetic Polynucleotide
taatacgactcactatagggaccatcaggtcgccttccaaggcggagatcaacagaggagagatctcatgcttggaaggaacctggcggcagcgcaaaagatg

SEQ ID NO: 85182 - DNA, 103 bp, Artificial Sequence
  Synthetic Polynucleotide
taatacgactcactatagggtgagaaccatcaggtcgccttccaaggcggaacagaggagaccgcctatgaaggcgaccaacctggcggcagcgcaaaagatg

SEQ ID NO: 85183 - DNA, 103 bp, Artificial Sequence
  Synthetic Polynucleotide
taatacgactcactatagggattgatgagaaccatcaggtcgccttccaaaacagaggagattggaaatggacctgatgaacctggcggcagcgcaaaagatg

SEQ ID NO: 85184 - DNA, 103 bp, Artificial Sequence
  Synthetic Polynucleotide
taatacgactcactatagggaaaccattgatgagaaccatcaggtcgcctaacagaggagaaggcgaatggatggttctaacctggcggcagcgcaaaagatg

SEQ ID NO: 85185 - DNA, 103 bp, Artificial Sequence
  Synthetic Polynucleotide
taatacgactcactatagggaagcaaaaccattgatgagaaccatcaggtaacagaggagaacctgaatgttctcatcaaacctggcggcagcgcaaaagatg

SEQ ID NO: 85186 - DNA, 103 bp, Artificial Sequence
  Synthetic Polynucleotide
taatacgactcactatagggggccaaagcaaaaccattgatgagaaccataacagaggagaatggttatgatcaatggtaacctggcggcagcgcaaaagatg

SEQ ID NO: 85187 - DNA, 103 bp, Artificial Sequence
  Synthetic Polynucleotide
taatacgactcactatagggaaccaggccaaagcaaaaccattgatgagaaacagaggagatctcatatgtggttttgcaacctggcggcagcgcaaaagatg

SEQ ID NO: 85188 - DNA, 103 bp, Artificial Sequence
  Synthetic Polynucleotide
taatacgactcactatagggttgccaaccaggccaaagcaaaaccattgaaacagaggagatcaatgatgttgctttggaacctggcggcagcgcaaaagatg

SEQ ID NO: 85189 - DNA, 103 bp, Artificial Sequence
  Synthetic Polynucleotide
taatacgactcactatagggtcgtattgccaaccaggccaaagcaaaaccaacagaggagaggttttatgttggcctggaacctggcggcagcgcaaaagatg

SEQ ID NO: 85190 - DNA, 103 bp, Artificial Sequence
  Synthetic Polynucleotide
taatacgactcactatagggatcgctcgtattgccaaccaggccaaagcaaacagaggagatgctttatgctggttggcaacctggcggcagcgcaaaagatg

SEQ ID NO: 85191 - DNA, 103 bp, Artificial Sequence
  Synthetic Polynucleotide
taatacgactcactatagggctcgtctcttcttctccttcctagcattgaaacagaggagatcaatgatgggaaggagaaacctggcggcagcgcaaaagatg

SEQ ID NO: 85192 - DNA, 103 bp, Artificial Sequence
  Synthetic Polynucleotide
taatacgactcactatagggcaaccatcgctcgtattgccaaccaggccaaacagaggagatggcctatgtggcaatacaacctggcggcagcgcaaaagatg

SEQ ID NO: 85193 - DNA, 103 bp, Artificial Sequence
  Synthetic Polynucleotide
taatacgactcactatagggtggaacaaccatcgctcgtattgccaaccaaacagaggagatggttgatgatacgagcgaacctggcggcagcgcaaaagatg

SEQ ID NO: 85194 - DNA, 103 bp, Artificial Sequence
  Synthetic Polynucleotide
taatacgactcactataggggtgcgtggaacaaccatcgctcgtattgccaacagaggagaggcaatatgagcgatggtaacctggcggcagcgcaaaagatg

SEQ ID NO: 85195 - DNA, 103 bp, Artificial Sequence
  Synthetic Polynucleotide
taatacgactcactatagggtatcagtgcgtggaacaaccatcgctcgtaaacagaggagatacgagatgtggttgttcaacctggcggcagcgcaaaagatg

SEQ ID NO: 85196 - DNA, 103 bp, Artificial Sequence
  Synthetic Polynucleotide
taatacgactcactataggggatgttatcagtgcgtggaacaaccatcgcaacagaggagagcgatgatggttccacgcaacctggcggcagcgcaaaagatg

SEQ ID NO: 85197 - DNA, 103 bp, Artificial Sequence
  Synthetic Polynucleotide
taatacgactcactatagggaaggtgatgttatcagtgcgtggaacaaccaacagaggagaggttgtatgacgcactgaaacctggcggcagcgcaaaagatg

SEQ ID NO: 85198 - DNA, 103 bp, Artificial Sequence
  Synthetic Polynucleotide
taatacgactcactatagggttgccaaggtgatgttatcagtgcgtggaaaacagaggagattccacatgctgataacaaacctggcggcagcgcaaaagatg

SEQ ID NO: 85199 - DNA, 103 bp, Artificial Sequence
  Synthetic Polynucleotide
taatacgactcactatagggcaggattgccaaggtgatgttatcagtgcgaacagaggagacgcactatgaacatcaccaacctggcggcagcgcaaaagatg

SEQ ID NO: 85200 - DNA, 103 bp, Artificial Sequence
  Synthetic Polynucleotide
taatacgactcactataggggcagccaggattgccaaggtgatgttatcaaacagaggagatgataaatgcaccttggcaacctggcggcagcgcaaaagatg

SEQ ID NO: 85201 - DNA, 103 bp, Artificial Sequence
  Synthetic Polynucleotide
taatacgactcactatagggtcagagcagccaggattgccaaggtgatgtaacagaggagaacatcaatgtggcaatccaacctggcggcagcgcaaaagatg

SEQ ID NO: 85202 - DNA, 103 bp, Artificial Sequence
  Synthetic Polynucleotide
taatacgactcactatagggatactgttgctagctttcgcttcaaactcgaacagaggagacgagttatgagcgaaagcaacctggcggcagcgcaaaagatg

SEQ ID NO: 85203 - DNA, 103 bp, Artificial Sequence
  Synthetic Polynucleotide
taatacgactcactatagggtgcgcctcgtctcttcttctccttcctagcaacagaggagagctaggatggagaagaagaacctggcggcagcgcaaaagatg

SEQ ID NO: 85204 - DNA, 103 bp, Artificial Sequence
  Synthetic Polynucleotide
taatacgactcactatagggtggtgtcagagcagccaggattgccaaggtaacagaggagaaccttgatgatcctggctaacctggcggcagcgcaaaagatg

SEQ ID NO: 85205 - DNA, 103 bp, Artificial Sequence
  Synthetic Polynucleotide
taatacgactcactataggggccagtggtgtcagagcagccaggattgccaacagaggagaggcaatatgggctgctctaacctggcggcagcgcaaaagatg

SEQ ID NO: 85206 - DNA, 103 bp, Artificial Sequence
  Synthetic Polynucleotide
taatacgactcactatagggcccgggccagtggtgtcagagcagccaggaaacagaggagatcctggatgctctgacacaacctggcggcagcgcaaaagatg

SEQ ID NO: 85207 - DNA, 103 bp, Artificial Sequence
  Synthetic Polynucleotide
taatacgactcactatagggtgtgccccgggccagtggtgtcagagcagcaacagaggagagctgctatgacaccactgaacctggcggcagcgcaaaagatg

SEQ ID NO: 85208 - DNA, 103 bp, Artificial Sequence
  Synthetic Polynucleotide
taatacgactcactatagggagcagtgtgccccgggccagtggtgtcagaaacagaggagatctgacatgactggcccgaacctggcggcagcgcaaaagatg

SEQ ID NO: 85209 - DNA, 103 bp, Artificial Sequence
  Synthetic Polynucleotide
taatacgactcactatagggccacaagcagtgtgccccgggccagtggtgaacagaggagacaccacatgcccggggcaaacctggcggcagcgcaaaagatg

SEQ ID NO: 85210 - DNA, 103 bp, Artificial Sequence
  Synthetic Polynucleotide
taatacgactcactatagggccacgccacaagcagtgtgccccgggccagaacagaggagactggccatgggcacactgaacctggcggcagcgcaaaagatg

SEQ ID NO: 85211 - DNA, 103 bp, Artificial Sequence
  Synthetic Polynucleotide
taatacgactcactataggggctctccacgccacaagcagtgtgccccggaacagaggagaccggggatgactgcttgtaacctggcggcagcgcaaaagatg

SEQ ID NO: 85212 - DNA, 103 bp, Artificial Sequence
  Synthetic Polynucleotide
taatacgactcactatagggggcctgctctccacgccacaagcagtgtgcaacagaggagagcacacatgttgtggcgtaacctggcggcagcgcaaaagatg

SEQ ID NO: 85213 - DNA, 103 bp, Artificial Sequence
  Synthetic Polynucleotide
taatacgactcactatagggagcaaggcctgctctccacgccacaagcagaacagaggagactgcttatggcgtggagaaacctggcggcagcgcaaaagatg

SEQ ID NO: 85214 - DNA, 103 bp, Artificial Sequence
  Synthetic Polynucleotide
taatacgactcactataggggtatctgcgcctcgtctcttcttctccttcaacagaggagagaaggaatggaagagacgaacctggcggcagcgcaaaagatg

SEQ ID NO: 85215 - DNA, 103 bp, Artificial Sequence
  Synthetic Polynucleotide
taatacgactcactatagggcaagtagcaaggcctgctctccacgccacaaacagaggagatgtggcatggagagcaggaacctggcggcagcgcaaaagatg

SEQ ID NO: 85216 - DNA, 103 bp, Artificial Sequence
  Synthetic Polynucleotide
taatacgactcactatagggccccgcaagtagcaaggcctgctctccacgaacagaggagacgtggaatgcaggccttgaacctggcggcagcgcaaaagatg

SEQ ID NO: 85217 - DNA, 103 bp, Artificial Sequence
  Synthetic Polynucleotide
taatacgactcactatagggaaaccccccgcaagtagcaaggcctgctctaacagaggagaagagcaatgcttgctactaacctggcggcagcgcaaaagatg

SEQ ID NO: 85218 - DNA, 103 bp, Artificial Sequence
  Synthetic Polynucleotide
taatacgactcactatagggagcataaaccccccgcaagtagcaaggcctaacagaggagaaggcctatgtacttgcggaacctggcggcagcgcaaaagatg

SEQ ID NO: 85219 - DNA, 103 bp, Artificial Sequence
  Synthetic Polynucleotide
taatacgactcactatagggagaggagcataaaccccccgcaagtagcaaaacagaggagattgctaatggcggggggtaacctggcggcagcgcaaaagatg

SEQ ID NO: 85220 - DNA, 103 bp, Artificial Sequence
  Synthetic Polynucleotide
taatacgactcactatagggcagagagaggagcataaaccccccgcaagtaacagaggagaacttgcatggggtttatgaacctggcggcagcgcaaaagatg

SEQ ID NO: 85221 - DNA, 103 bp, Artificial Sequence
  Synthetic Polynucleotide
taatacgactcactatagggcccttcagagagaggagcataaaccccccgaacagaggagacgggggatgtatgctcctaacctggcggcagcgcaaaagatg

SEQ ID NO: 85222 - DNA, 103 bp, Artificial Sequence
  Synthetic Polynucleotide
taatacgactcactatagggcttttcccttcagagagaggagcataaaccaacagaggagaggtttaatgtcctctctcaacctggcggcagcgcaaaagatg

SEQ ID NO: 85223 - DNA, 103 bp, Artificial Sequence
  Synthetic Polynucleotide
taatacgactcactatagggactgccttttcccttcagagagaggagcataacagaggagaatgctcatgtctctgaagaacctggcggcagcgcaaaagatg

SEQ ID NO: 85224 - DNA, 103 bp, Artificial Sequence
  Synthetic Polynucleotide
taatacgactcactatagggttcacactgccttttcccttcagagagaggaacagaggagacctctcatggaagggaaaaacctggcggcagcgcaaaagatg

SEQ ID NO: 85225 - DNA, 103 bp, Artificial Sequence
  Synthetic Polynucleotide
taatacgactcactatagggcactagtatctgcgcctcgtctcttcttctaacagaggagaagaagaatggacgaggcgaacctggcggcagcgcaaaagatg

SEQ ID NO: 85226 - DNA, 103 bp, Artificial Sequence
  Synthetic Polynucleotide
taatacgactcactatagggtcttcttcacactgccttttcccttcagagaacagaggagactctgaatggaaaaggcaaacctggcggcagcgcaaaagatg

SEQ ID NO: 85227 - DNA, 103 bp, Artificial Sequence
  Synthetic Polynucleotide
taatacgactcactatagggtaagttcttcttcacactgccttttcccttaacagaggagaaagggaatgggcagtgtgaacctggcggcagcgcaaaagatg

SEQ ID NO: 85228 - DNA, 103 bp, Artificial Sequence
  Synthetic Polynucleotide
taatacgactcactatagggaatggtaagttcttcttcacactgccttttaacagaggagaaaaaggatgtgtgaagaaaacctggcggcagcgcaaaagatg

SEQ ID NO: 85229 - DNA, 103 bp, Artificial Sequence
  Synthetic Polynucleotide
taatacgactcactatagggtgacaaatggtaagttcttcttcacactgcaacagaggagagcagtgatgagaagaactaacctggcggcagcgcaaaagatg

SEQ ID NO: 85230 - DNA, 103 bp, Artificial Sequence
  Synthetic Polynucleotide
taatacgactcactatagggggccatgacaaatggtaagttcttcttcacaacagaggagagtgaagatgaacttaccaaacctggcggcagcgcaaaagatg

SEQ ID NO: 85231 - DNA, 103 bp, Artificial Sequence
  Synthetic Polynucleotide
taatacgactcactatagggcccagggccatgacaaatggtaagttcttcaacagaggagagaagaaatgaccatttgtaacctggcggcagcgcaaaagatg

SEQ ID NO: 85232 - DNA, 103 bp, Artificial Sequence
  Synthetic Polynucleotide
taatacgactcactatagggttagtcccagggccatgacaaatggtaagtaacagaggagaacttacatgttgtcatggaacctggcggcagcgcaaaagatg

SEQ ID NO: 85233 - DNA, 103 bp, Artificial Sequence
  Synthetic Polynucleotide
taatacgactcactatagggagcggttagtcccagggccatgacaaatggaacagaggagaccatttatgatggccctgaacctggcggcagcgcaaaagatg

SEQ ID NO: 85234 - DNA, 103 bp, Artificial Sequence
  Synthetic Polynucleotide
taatacgactcactatagggctcacagcggttagtcccagggccatgacaaacagaggagatgtcatatgcctgggactaacctggcggcagcgcaaaagatg

SEQ ID NO: 85235 - DNA, 103 bp, Artificial Sequence
  Synthetic Polynucleotide
taatacgactcactatagggccagcctcacagcggttagtcccagggccaaacagaggagatggcccatggactaaccgaacctggcggcagcgcaaaagatg

SEQ ID NO: 85236 - DNA, 103 bp, Artificial Sequence
  Synthetic Polynucleotide
taatacgactcactatagggtccgacactagtatctgcgcctcgtctcttaacagaggagaaagagaatgggcgcagataacctggcggcagcgcaaaagatg

SEQ ID NO: 85237 - DNA, 103 bp, Artificial Sequence
  Synthetic Polynucleotide
taatacgactcactataggggtcgaccagcctcacagcggttagtcccagaacagaggagactgggaatgaccgctgtgaacctggcggcagcgcaaaagatg

SEQ ID NO: 85238 - DNA, 103 bp, Artificial Sequence
  Synthetic Polynucleotide
taatacgactcactatagggatggggtcgaccagcctcacagcggttagtaacagaggagaactaacatgtgtgaggctaacctggcggcagcgcaaaagatg

SEQ ID NO: 85239 - DNA, 103 bp, Artificial Sequence
  Synthetic Polynucleotide
taatacgactcactatagggcgttgatggggtcgaccagcctcacagcggaacagaggagaccgctgatgggctggtcgaacctggcggcagcgcaaaagatg

SEQ ID NO: 85240 - DNA, 103 bp, Artificial Sequence
  Synthetic Polynucleotide
taatacgactcactatagggcaccacgttgatggggtcgaccagcctcacaacagaggagagtgaggatggtcgaccccaacctggcggcagcgcaaaagatg

SEQ ID NO: 85241 - DNA, 103 bp, Artificial Sequence
  Synthetic Polynucleotide
taatacgactcactatagggagtcccaccacgttgatggggtcgaccagcaacagaggagagctggtatgccccatcaaaacctggcggcagcgcaaaagatg

SEQ ID NO: 85242 - DNA, 103 bp, Artificial Sequence
  Synthetic Polynucleotide
taatacgactcactatagggacagcagtcccaccacgttgatggggtcgaaacagaggagatcgaccatgtcaacgtggaacctggcggcagcgcaaaagatg

SEQ ID NO: 85243 - DNA, 103 bp, Artificial Sequence
  Synthetic Polynucleotide
taatacgactcactataggggagcaacagcagtcccaccacgttgatgggaacagaggagacccatcatggtggtgggaaacctggcggcagcgcaaaagatg

SEQ ID NO: 85244 - DNA, 103 bp, Artificial Sequence
  Synthetic Polynucleotide
taatacgactcactatagggcttgtgagcaacagcagtcccaccacgttgaacagaggagacaacgtatggggactgctaacctggcggcagcgcaaaagatg

SEQ ID NO: 85245 - DNA, 103 bp, Artificial Sequence
  Synthetic Polynucleotide
taatacgactcactatagggcactccttgtgagcaacagcagtcccaccaaacagaggagatggtggatgtgctgttgcaacctggcggcagcgcaaaagatg

SEQ ID NO: 85246 - DNA, 103 bp, Artificial Sequence
  Synthetic Polynucleotide
taatacgactcactatagggcttcccactccttgtgagcaacagcagtccaacagaggagaggactgatgttgctcacaaacctggcggcagcgcaaaagatg

SEQ ID NO: 85247 - DNA, 103 bp, Artificial Sequence
  Synthetic Polynucleotide
taatacgactcactatagggacaattccgacactagtatctgcgcctcgtaacagaggagaacgaggatgagatactagaacctggcggcagcgcaaaagatg

SEQ ID NO: 85248 - DNA, 103 bp, Artificial Sequence
  Synthetic Polynucleotide
taatacgactcactatagggctccgcttcccactccttgtgagcaacagcaacagaggagagctgttatgcacaaggagaacctggcggcagcgcaaaagatg

SEQ ID NO: 85249 - DNA, 103 bp, Artificial Sequence
  Synthetic Polynucleotide
taatacgactcactataggggccagctccgcttcccactccttgtgagcaaacagaggagatgctcaatgggagtgggaaacctggcggcagcgcaaaagatg

SEQ ID NO: 85250 - DNA, 103 bp, Artificial Sequence
  Synthetic Polynucleotide
taatacgactcactatagggagggggccagctccgcttcccactccttgtaacagaggagaacaaggatggggaagcggaacctggcggcagcgcaaaagatg

SEQ ID NO: 85251 - DNA, 103 bp, Artificial Sequence
  Synthetic Polynucleotide
taatacgactcactatagggtcgctagggggccagctccgcttcccactcaacagaggagagagtggatggcggagctgaacctggcggcagcgcaaaagatg

SEQ ID NO: 85252 - DNA, 103 bp, Artificial Sequence
  Synthetic Polynucleotide
taatacgactcactataggggtacttcgctagggggccagctccgcttccaacagaggagaggaagcatggctggccccaacctggcggcagcgcaaaagatg

SEQ ID NO: 85253 - DNA, 103 bp, Artificial Sequence
  Synthetic Polynucleotide
taatacgactcactatagggtgtgagtacttcgctagggggccagctccgaacagaggagacggagcatgccccctagcaacctggcggcagcgcaaaagatg

SEQ ID NO: 85254 - DNA, 103 bp, Artificial Sequence
  Synthetic Polynucleotide
taatacgactcactatagggacagctgtgagtacttcgctagggggccagaacagaggagactggccatgtagcgaagtaacctggcggcagcgcaaaagatg

SEQ ID NO: 85255 - DNA, 103 bp, Artificial Sequence
  Synthetic Polynucleotide
taatacgactcactatagggggccaacagctgtgagtacttcgctaggggaacagaggagacccctaatgaagtactcaaacctggcggcagcgcaaaagatg

SEQ ID NO: 85256 - DNA, 103 bp, Artificial Sequence
  Synthetic Polynucleotide
taatacgactcactatagggtatcaggccaacagctgtgagtacttcgctaacagaggagaagcgaaatgctcacagctaacctggcggcagcgcaaaagatg

SEQ ID NO: 85257 - DNA, 103 bp, Artificial Sequence
  Synthetic Polynucleotide
taatacgactcactataggggcgcatatcaggccaacagctgtgagtactaacagaggagaagtactatgagctgttggaacctggcggcagcgcaaaagatg

SEQ ID NO: 85258 - DNA, 103 bp, Artificial Sequence
  Synthetic Polynucleotide
taatacgactcactatagggggccaacaattccgacactagtatctgcgcaacagaggagagcgcagatgctagtgtcgaacctggcggcagcgcaaaagatg

SEQ ID NO: 85259 - DNA, 103 bp, Artificial Sequence
  Synthetic Polynucleotide
taatacgactcactatagggccaatgcgcatatcaggccaacagctgtgaaacagaggagatcacagatgttggcctgaaacctggcggcagcgcaaaagatg

SEQ ID NO: 85260 - DNA, 103 bp, Artificial Sequence
  Synthetic Polynucleotide
taatacgactcactatagggtccagccaatgcgcatatcaggccaacagcaacagaggagagctgttatgctgatatgcaacctggcggcagcgcaaaagatg

SEQ ID NO: 85261 - DNA, 103 bp, Artificial Sequence
  Synthetic Polynucleotide
taatacgactcactatagggaaccctccagccaatgcgcatatcaggccaaacagaggagatggcctatgatgcgcattaacctggcggcagcgcaaaagatg

SEQ ID NO: 85262 - DNA, 103 bp, Artificial Sequence
  Synthetic Polynucleotide
taatacgactcactatagggtggcgaaccctccagccaatgcgcatatcaaacagaggagatgatatatgcattggctgaacctggcggcagcgcaaaagatg

SEQ ID NO: 85263 - DNA, 103 bp, Artificial Sequence
  Synthetic Polynucleotide
taatacgactcactatagggtgccttggcgaaccctccagccaatgcgcaaacagaggagatgcgcaatggctggagggaacctggcggcagcgcaaaagatg

SEQ ID NO: 85264 - DNA, 103 bp, Artificial Sequence
  Synthetic Polynucleotide
taatacgactcactatagggatatctgccttggcgaaccctccagccaataacagaggagaattggcatgagggttcgcaacctggcggcagcgcaaaagatg

SEQ ID NO: 85265 - DNA, 103 bp, Artificial Sequence
  Synthetic Polynucleotide
taatacgactcactatagggtctctatatctgccttggcgaaccctccagaacagaggagactggagatgtcgccaaggaacctggcggcagcgcaaaagatg

SEQ ID NO: 85266 - DNA, 103 bp, Artificial Sequence
  Synthetic Polynucleotide
taatacgactcactatagggagccatctctatatctgccttggcgaacccaacagaggagagggttcatgaaggcagataacctggcggcagcgcaaaagatg

SEQ ID NO: 85267 - DNA, 103 bp, Artificial Sequence
  Synthetic Polynucleotide
taatacgactcactatagggggcccagccatctctatatctgccttggcgaacagaggagacgccaaatgagatatagaaacctggcggcagcgcaaaagatg

SEQ ID NO: 85268 - DNA, 103 bp, Artificial Sequence
  Synthetic Polynucleotide
taatacgactcactatagggccatgggcccagccatctctatatctgcctaacagaggagaaggcagatgtagagatggaacctggcggcagcgcaaaagatg

SEQ ID NO: 85269 - DNA, 103 bp, Artificial Sequence
  Synthetic Polynucleotide
taatacgactcactatagggcaggaggccaacaattccgacactagtatcaacagaggagagatactatggtcggaattaacctggcggcagcgcaaaagatg

SEQ ID NO: 85270 - DNA, 103 bp, Artificial Sequence
  Synthetic Polynucleotide
taatacgactcactatagggcgcggccatgggcccagccatctctatatcaacagaggagagatataatgatggctgggaacctggcggcagcgcaaaagatg

SEQ ID NO: 85271 - DNA, 103 bp, Artificial Sequence
  Synthetic Polynucleotide
taatacgactcactatagggccgaccgcggccatgggcccagccatctctaacagaggagaagagatatgtgggcccataacctggcggcagcgcaaaagatg

SEQ ID NO: 85272 - DNA, 103 bp, Artificial Sequence
  Synthetic Polynucleotide
taatacgactcactataggggcagaccgaccgcggccatgggcccagccaaacagaggagatggctgatgccatggccgaacctggcggcagcgcaaaagatg

SEQ ID NO: 85273 - DNA, 103 bp, Artificial Sequence
  Synthetic Polynucleotide
taatacgactcactatagggaattagcagaccgaccgcggccatgggcccaacagaggagagggcccatggccgcggtcaacctggcggcagcgcaaaagatg

SEQ ID NO: 85274 - DNA, 103 bp, Artificial Sequence
  Synthetic Polynucleotide
taatacgactcactatagggctgacaattagcagaccgaccgcggccatgaacagaggagacatggcatgggtcggtctaacctggcggcagcgcaaaagatg

SEQ ID NO: 85275 - DNA, 103 bp, Artificial Sequence
  Synthetic Polynucleotide
taatacgactcactatagggcgtaactgacaattagcagaccgaccgcggaacagaggagaccgcggatggtctgctaaaacctggcggcagcgcaaaagatg

SEQ ID NO: 85276 - DNA, 103 bp, Artificial Sequence
  Synthetic Polynucleotide
taatacgactcactataggggaccacgtaactgacaattagcagaccgacaacagaggagagtcggtatgctaattgtcaacctggcggcagcgcaaaagatg

SEQ ID NO: 85277 - DNA, 103 bp, Artificial Sequence
  Synthetic Polynucleotide
taatacgactcactatagggcctgagaccacgtaactgacaattagcagaaacagaggagatctgctatgtgtcagttaaacctggcggcagcgcaaaagatg

SEQ ID NO: 85278 - DNA, 103 bp, Artificial Sequence
  Synthetic Polynucleotide
taatacgactcactatagggtctttcctgagaccacgtaactgacaattaaacagaggagataattgatggttacgtggaacctggcggcagcgcaaaagatg

SEQ ID NO: 85279 - DNA, 103 bp, Artificial Sequence
  Synthetic Polynucleotide
taatacgactcactatagggcacactctttcctgagaccacgtaactgacaacagaggagagtcagtatggtggtctcaaacctggcggcagcgcaaaagatg

SEQ ID NO: 85280 - DNA, 103 bp, Artificial Sequence
  Synthetic Polynucleotide
taatacgactcactataggggtcagcaggaggccaacaattccgacactaaacagaggagatagtgtatgaattgttggaacctggcggcagcgcaaaagatg

SEQ ID NO: 85281 - DNA, 103 bp, Artificial Sequence
  Synthetic Polynucleotide
taatacgactcactatagggatgtccacactctttcctgagaccacgtaaaacagaggagattacgtatgctcaggaaaaacctggcggcagcgcaaaagatg

SEQ ID NO: 85282 - DNA, 103 bp, Artificial Sequence
  Synthetic Polynucleotide
taatacgactcactatagggtgtacatgtccacactctttcctgagaccaaacagaggagatggtctatggaaagagtgaacctggcggcagcgcaaaagatg

SEQ ID NO: 85283 - DNA, 103 bp, Artificial Sequence
  Synthetic Polynucleotide
taatacgactcactatagggttcaatgtacatgtccacactctttcctgaaacagaggagatcaggaatgagtgtggacaacctggcggcagcgcaaaagatg

SEQ ID NO: 85284 - DNA, 103 bp, Artificial Sequence
  Synthetic Polynucleotide
taatacgactcactataggggctctttcaatgtacatgtccacactctttaacagaggagaaaagagatgggacatgtaaacctggcggcagcgcaaaagatg

SEQ ID NO: 85285 - DNA, 103 bp, Artificial Sequence
  Synthetic Polynucleotide
taatacgactcactatagggcacctgctctttcaatgtacatgtccacacaacagaggagagtgtggatgtgtacattgaacctggcggcagcgcaaaagatg

SEQ ID NO: 85286 - DNA, 103 bp, Artificial Sequence
  Synthetic Polynucleotide
taatacgactcactataggggatgtcacctgctctttcaatgtacatgtcaacagaggagagacatgatgattgaaagaaacctggcggcagcgcaaaagatg

SEQ ID NO: 85287 - DNA, 103 bp, Artificial Sequence
  Synthetic Polynucleotide
taatacgactcactatagggcatgtgatgtcacctgctctttcaatgtacaacagaggagagtacatatgaagagcaggaacctggcggcagcgcaaaagatg

SEQ ID NO: 85288 - DNA, 103 bp, Artificial Sequence
  Synthetic Polynucleotide
taatacgactcactatagggtttcccatgtgatgtcacctgctctttcaaaacagaggagattgaaaatgcaggtgacaaacctggcggcagcgcaaaagatg

SEQ ID NO: 85289 - DNA, 103 bp, Artificial Sequence
  Synthetic Polynucleotide
taatacgactcactatagggatctttttcccatgtgatgtcacctgctctaacagaggagaagagcaatggacatcacaaacctggcggcagcgcaaaagatg

SEQ ID NO: 85290 - DNA, 103 bp, Artificial Sequence
  Synthetic Polynucleotide
taatacgactcactatagggtccgcatctttttcccatgtgatgtcacctaacagaggagaaggtgaatgcacatgggaaacctggcggcagcgcaaaagatg

SEQ ID NO: 85291 - DNA, 103 bp, Artificial Sequence
  Synthetic Polynucleotide
taatacgactcactatagggctgtggtcagcaggaggccaacaattccgaaacagaggagatcggaaatgttggcctccaacctggcggcagcgcaaaagatg

SEQ ID NO: 85292 - DNA, 103 bp, Artificial Sequence
  Synthetic Polynucleotide
taatacgactcactatagggtgacttccgcatctttttcccatgtgatgtaacagaggagaacatcaatggggaaaaagaacctggcggcagcgcaaaagatg

SEQ ID NO: 85293 - DNA, 103 bp, Artificial Sequence
  Synthetic Polynucleotide
taatacgactcactatagggtccagtgacttccgcatctttttcccatgtaacagaggagaacatggatgaaagatgcgaacctggcggcagcgcaaaagatg

SEQ ID NO: 85294 - DNA, 103 bp, Artificial Sequence
  Synthetic Polynucleotide
taatacgactcactatagggctgtttccagtgacttccgcatctttttccaacagaggagaggaaaaatgtgcggaagtaacctggcggcagcgcaaaagatg

SEQ ID NO: 85295 - DNA, 103 bp, Artificial Sequence
  Synthetic Polynucleotide
taatacgactcactatagggggggactgtttccagtgacttccgcatcttaacagaggagaaagatgatgaagtcactgaacctggcggcagcgcaaaagatg

SEQ ID NO: 85296 - DNA, 103 bp, Artificial Sequence
  Synthetic Polynucleotide
taatacgactcactataggggagccggggactgtttccagtgacttccgcaacagaggagagcggaaatgactggaaacaacctggcggcagcgcaaaagatg

SEQ ID NO: 85297 - DNA, 103 bp, Artificial Sequence
  Synthetic Polynucleotide
taatacgactcactatagggacatcgagccggggactgtttccagtgactaacagaggagaagtcacatgaaacagtccaacctggcggcagcgcaaaagatg

SEQ ID NO: 85298 - DNA, 103 bp, Artificial Sequence
  Synthetic Polynucleotide
taatacgactcactataggggcgccacatcgagccggggactgtttccagaacagaggagactggaaatggtccccggcaacctggcggcagcgcaaaagatg

SEQ ID NO: 85299 - DNA, 103 bp, Artificial Sequence
  Synthetic Polynucleotide
taatacgactcactatagggatctagcgccacatcgagccggggactgttaacagaggagaaacagtatgcggctcgataacctggcggcagcgcaaaagatg

SEQ ID NO: 85300 - DNA, 103 bp, Artificial Sequence
  Synthetic Polynucleotide
taatacgactcactatagggctctcatctagcgccacatcgagccggggaaacagaggagatccccgatgcgatgtggcaacctggcggcagcgcaaaagatg

SEQ ID NO: 85301 - DNA, 103 bp, Artificial Sequence
  Synthetic Polynucleotide
taatacgactcactatagggcaccactctcatctagcgccacatcgagccaacagaggagaggctcgatgtggcgctagaacctggcggcagcgcaaaagatg

SEQ ID NO: 85302 - DNA, 103 bp, Artificial Sequence
  Synthetic Polynucleotide
taatacgactcactatagggcatagctgtggtcagcaggaggccaacaataacagaggagaattgttatgctcctgctgaacctggcggcagcgcaaaagatg

SEQ ID NO: 85303 - DNA, 103 bp, Artificial Sequence
  Synthetic Polynucleotide
taatacgactcactataggggaaatcaccactctcatctagcgccacatcaacagaggagagatgtgatgctagatgagaacctggcggcagcgcaaaagatg

SEQ ID NO: 85304 - DNA, 103 bp, Artificial Sequence
  Synthetic Polynucleotide
taatacgactcactatagggagggagaaatcaccactctcatctagcgccaacagaggagaggcgctatgtgagagtggaacctggcggcagcgcaaaagatg

SEQ ID NO: 85305 - DNA, 103 bp, Artificial Sequence
  Synthetic Polynucleotide
taatacgactcactatagggccaccagggagaaatcaccactctcatctaaacagaggagatagatgatggtggtgattaacctggcggcagcgcaaaagatg

SEQ ID NO: 85306 - DNA, 103 bp, Artificial Sequence
  Synthetic Polynucleotide
taatacgactcactatagggatcctccaccagggagaaatcaccactctcaacagaggagagagagtatggatttctccaacctggcggcagcgcaaaagatg

SEQ ID NO: 85307 - DNA, 103 bp, Artificial Sequence
  Synthetic Polynucleotide
taatacgactcactatagggccgtcatcctccaccagggagaaatcaccaaacagaggagatggtgaatgctccctggtaacctggcggcagcgcaaaagatg

SEQ ID NO: 85308 - DNA, 103 bp, Artificial Sequence
  Synthetic Polynucleotide
taatacgactcactatagggggggaccgtcatcctccaccagggagaaataacagaggagaatttctatgtggtggaggaacctggcggcagcgcaaaagatg

SEQ ID NO: 85309 - DNA, 103 bp, Artificial Sequence
  Synthetic Polynucleotide
taatacgactcactatagggcatggggggaccgtcatcctccaccagggaaacagaggagatccctgatggaggatgacaacctggcggcagcgcaaaagatg

SEQ ID NO: 85310 - DNA, 103 bp, Artificial Sequence
  Synthetic Polynucleotide
taatacgactcactatagggtctctcatggggggaccgtcatcctccaccaacagaggagaggtggaatgtgacggtccaacctggcggcagcgcaaaagatg

SEQ ID NO: 85311 - DNA, 103 bp, Artificial Sequence
  Synthetic Polynucleotide
taatacgactcactatagggtgatctctctcatggggggaccgtcatcctaacagaggagaaggatgatggtccccccaaacctggcggcagcgcaaaagatg

SEQ ID NO: 85312 - DNA, 103 bp, Artificial Sequence
  Synthetic Polynucleotide
taatacgactcactataggggagtatgatctctctcatggggggaccgtcaacagaggagagacggtatgcccatgagaaacctggcggcagcgcaaaagatg

SEQ ID NO: 85313 - DNA, 103 bp, Artificial Sequence
  Synthetic Polynucleotide
taatacgactcactatagggtgttgatactgttgctagctttcgcttcaaaacagaggagattgaagatgaagctagcaaacctggcggcagcgcaaaagatg

SEQ ID NO: 85314 - DNA, 103 bp, Artificial Sequence
  Synthetic Polynucleotide
taatacgactcactataggggctgccatagctgtggtcagcaggaggccaaacagaggagatggcctatggctgaccacaacctggcggcagcgcaaaagatg

SEQ ID NO: 85315 - DNA, 103 bp, Artificial Sequence
  Synthetic Polynucleotide
taatacgactcactatagggaccttgagtatgatctctctcatggggggaaacagaggagatcccccatggagagagataacctggcggcagcgcaaaagatg

SEQ ID NO: 85316 - DNA, 103 bp, Artificial Sequence
  Synthetic Polynucleotide
taatacgactcactatagggggaccaccttgagtatgatctctctcatggaacagaggagaccatgaatgagatcatacaacctggcggcagcgcaaaagatg

SEQ ID NO: 85317 - DNA, 103 bp, Artificial Sequence
  Synthetic Polynucleotide
taatacgactcactatagggcatcaggaccaccttgagtatgatctctctaacagaggagaagagagatgatactcaagaacctggcggcagcgcaaaagatg

SEQ ID NO: 85318 - DNA, 103 bp, Artificial Sequence
  Synthetic Polynucleotide
taatacgactcactatagggatggtcatcaggaccaccttgagtatgatcaacagaggagagatcatatgcaaggtggtaacctggcggcagcgcaaaagatg

SEQ ID NO: 85319 - DNA, 103 bp, Artificial Sequence
  Synthetic Polynucleotide
taatacgactcactatagggcacagatggtcatcaggaccaccttgagtaaacagaggagatactcaatgtggtcctgaaacctggcggcagcgcaaaagatg

SEQ ID NO: 85320 - DNA, 103 bp, Artificial Sequence
  Synthetic Polynucleotide
taatacgactcactatagggcatgccacagatggtcatcaggaccaccttaacagaggagaaaggtgatgctgatgaccaacctggcggcagcgcaaaagatg

SEQ ID NO: 85321 - DNA, 103 bp, Artificial Sequence
  Synthetic Polynucleotide
taatacgactcactataggggggttcatgccacagatggtcatcaggaccaacagaggagaggtcctatggaccatctgaacctggcggcagcgcaaaagatg

SEQ ID NO: 85322 - DNA, 103 bp, Artificial Sequence
  Synthetic Polynucleotide
taatacgactcactatagggctattgggttcatgccacagatggtcatcaaacagaggagatgatgaatgtctgtggcaaacctggcggcagcgcaaaagatg

SEQ ID NO: 85323 - DNA, 103 bp, Artificial Sequence
  Synthetic Polynucleotide
taatacgactcactatagggtatggctattgggttcatgccacagatggtaacagaggagaaccatcatgggcatgaacaacctggcggcagcgcaaaagatg

SEQ ID NO: 85324 - DNA, 103 bp, Artificial Sequence
  Synthetic Polynucleotide
taatacgactcactatagggaagggtatggctattgggttcatgccacagaacagaggagactgtggatggaacccaataacctggcggcagcgcaaaagatg

SEQ ID NO: 85325 - DNA, 103 bp, Artificial Sequence
  Synthetic Polynucleotide
taatacgactcactatagggcctccgctgccatagctgtggtcagcaggaaacagaggagatcctgcatgccacagctaaacctggcggcagcgcaaaagatg

SEQ ID NO: 85326 - DNA, 103 bp, Artificial Sequence
  Synthetic Polynucleotide
taatacgactcactatagggctgcaaagggtatggctattgggttcatgcaacagaggagagcatgaatgcaatagccaaacctggcggcagcgcaaaagatg

SEQ ID NO: 85327 - DNA, 103 bp, Artificial Sequence
  Synthetic Polynucleotide
taatacgactcactatagggtccagctgcaaagggtatggctattgggttaacagaggagaaacccaatggccatacccaacctggcggcagcgcaaaagatg

SEQ ID NO: 85328 - DNA, 103 bp, Artificial Sequence
  Synthetic Polynucleotide
taatacgactcactatagggcacgctccagctgcaaagggtatggctattaacagaggagaaatagcatgaccctttgcaacctggcggcagcgcaaaagatg

SEQ ID NO: 85329 - DNA, 103 bp, Artificial Sequence
  Synthetic Polynucleotide
taatacgactcactatagggcgtaccacgctccagctgcaaagggtatggaacagaggagaccatacatgttgcagctgaacctggcggcagcgcaaaagatg

SEQ ID NO: 85330 - DNA, 103 bp, Artificial Sequence
  Synthetic Polynucleotide
taatacgactcactataggggtatacgtaccacgctccagctgcaaagggaacagaggagaccctttatggctggagcgaacctggcggcagcgcaaaagatg

SEQ ID NO: 85331 - DNA, 103 bp, Artificial Sequence
  Synthetic Polynucleotide
taatacgactcactatagggttcacgtatacgtaccacgctccagctgcaaacagaggagatgcagcatgagcgtggtaaacctggcggcagcgcaaaagatg

SEQ ID NO: 85332 - DNA, 103 bp, Artificial Sequence
  Synthetic Polynucleotide
taatacgactcactatagggcagtcttcacgtatacgtaccacgctccagaacagaggagactggagatgggtacgtataacctggcggcagcgcaaaagatg

SEQ ID NO: 85333 - DNA, 103 bp, Artificial Sequence
  Synthetic Polynucleotide
taatacgactcactatagggttttccagtcttcacgtatacgtaccacgcaacagaggagagcgtggatggtatacgtgaacctggcggcagcgcaaaagatg

SEQ ID NO: 85334 - DNA, 103 bp, Artificial Sequence
  Synthetic Polynucleotide
taatacgactcactatagggctcctttttccagtcttcacgtatacgtacaacagaggagagtacgtatgcgtgaagacaacctggcggcagcgcaaaagatg

SEQ ID NO: 85335 - DNA, 103 bp, Artificial Sequence
  Synthetic Polynucleotide
taatacgactcactatagggcaccactcctttttccagtcttcacgtataaacagaggagatatacgatgagactggaaaacctggcggcagcgcaaaagatg

SEQ ID NO: 85336 - DNA, 103 bp, Artificial Sequence
  Synthetic Polynucleotide
taatacgactcactatagggagtgacctccgctgccatagctgtggtcagaacagaggagactgaccatggctatggcaaacctggcggcagcgcaaaagatg

SEQ ID NO: 85337 - DNA, 103 bp, Artificial Sequence
  Synthetic Polynucleotide
taatacgactcactatagggtagagcaccactcctttttccagtcttcacaacagaggagagtgaagatgggaaaaaggaacctggcggcagcgcaaaagatg

SEQ ID NO: 85338 - DNA, 103 bp, Artificial Sequence
  Synthetic Polynucleotide
taatacgactcactatagggtcccatagagcaccactcctttttccagtcaacagaggagagactggatgaaggagtggaacctggcggcagcgcaaaagatg

SEQ ID NO: 85339 - DNA, 103 bp, Artificial Sequence
  Synthetic Polynucleotide
taatacgactcactataggggcacatcccatagagcaccactcctttttcaacagaggagagaaaaaatggtggtgctcaacctggcggcagcgcaaaagatg

SEQ ID NO: 85340 - DNA, 103 bp, Artificial Sequence
  Synthetic Polynucleotide
taatacgactcactatagggagcaggcacatcccatagagcaccactcctaacagaggagaaggagtatggctctatggaacctggcggcagcgcaaaagatg

SEQ ID NO: 85341 - DNA, 103 bp, Artificial Sequence
  Synthetic Polynucleotide
taatacgactcactatagggttgggagcaggcacatcccatagagcaccaaacagaggagatggtgcatgatgggatgtaacctggcggcagcgcaaaagatg

SEQ ID NO: 85342 - DNA, 103 bp, Artificial Sequence
  Synthetic Polynucleotide
taatacgactcactatagggcttccttgggagcaggcacatcccatagagaacagaggagactctatatgatgtgcctgaacctggcggcagcgcaaaagatg

SEQ ID NO: 85343 - DNA, 103 bp, Artificial Sequence
  Synthetic Polynucleotide
taatacgactcactatagggttttacttccttgggagcaggcacatcccaaacagaggagatgggatatgcctgctcccaacctggcggcagcgcaaaagatg

SEQ ID NO: 85344 - DNA, 103 bp, Artificial Sequence
  Synthetic Polynucleotide
taatacgactcactatagggcccttttttacttccttgggagcaggcacaaacagaggagatgtgccatgtcccaaggaaacctggcggcagcgcaaaagatg

SEQ ID NO: 85345 - DNA, 103 bp, Artificial Sequence
  Synthetic Polynucleotide
taatacgactcactatagggtctcccccttttttacttccttgggagcagaacagaggagactgctcatgaggaagtaaaacctggcggcagcgcaaaagatg

SEQ ID NO: 85346 - DNA, 103 bp, Artificial Sequence
  Synthetic Polynucleotide
taatacgactcactatagggtgtggtctcccccttttttacttccttgggaacagaggagacccaagatggtaaaaaagaacctggcggcagcgcaaaagatg

SEQ ID NO: 85347 - DNA, 103 bp, Artificial Sequence
  Synthetic Polynucleotide
taatacgactcactatagggcgtctagtgacctccgctgccatagctgtgaacagaggagacacagcatgggcagcggaaacctggcggcagcgcaaaagatg

SEQ ID NO: 85348 - DNA, 103 bp, Artificial Sequence
  Synthetic Polynucleotide
taatacgactcactatagggccatctgtggtctcccccttttttacttccaacagaggagaggaagtatgaaagggggaaacctggcggcagcgcaaaagatg

SEQ ID NO: 85349 - DNA, 103 bp, Artificial Sequence
  Synthetic Polynucleotide
taatacgactcactatagggacactccatctgtggtctcccccttttttaaacagaggagataaaaaatggggagaccaaacctggcggcagcgcaaaagatg

SEQ ID NO: 85350 - DNA, 103 bp, Artificial Sequence
  Synthetic Polynucleotide
taatacgactcactatagggtctgtacactccatctgtggtctcccccttaacagaggagaaaggggatgaccacagataacctggcggcagcgcaaaagatg

SEQ ID NO: 85351 - DNA, 103 bp, Artificial Sequence
  Synthetic Polynucleotide
taatacgactcactatagggattactctgtacactccatctgtggtctccaacagaggagaggagacatgagatggagtaacctggcggcagcgcaaaagatg

SEQ ID NO: 85352 - DNA, 103 bp, Artificial Sequence
  Synthetic Polynucleotide
taatacgactcactataggggagtcattactctgtacactccatctgtggaacagaggagaccacagatggagtgtacaaacctggcggcagcgcaaaagatg

SEQ ID NO: 85353 - DNA, 103 bp, Artificial Sequence
  Synthetic Polynucleotide
taatacgactcactatagggtctacgagtcattactctgtacactccatcaacagaggagagatggaatgtacagagtaaacctggcggcagcgcaaaagatg

SEQ ID NO: 85354 - DNA, 103 bp, Artificial Sequence
  Synthetic Polynucleotide
taatacgactcactatagggagcagtctacgagtcattactctgtacactaacagaggagaagtgtaatgagtaatgacaacctggcggcagcgcaaaagatg

SEQ ID NO: 85355 - DNA, 103 bp, Artificial Sequence
  Synthetic Polynucleotide
taatacgactcactatagggaacctagcagtctacgagtcattactctgtaacagaggagaacagagatgtgactcgtaaacctggcggcagcgcaaaagatg

SEQ ID NO: 85356 - DNA, 103 bp, Artificial Sequence
  Synthetic Polynucleotide
taatacgactcactatagggtgttgaacctagcagtctacgagtcattacaacagaggagagtaatgatgcgtagactgaacctggcggcagcgcaaaagatg

SEQ ID NO: 85357 - DNA, 103 bp, Artificial Sequence
  Synthetic Polynucleotide
taatacgactcactatagggacttgtgttgaacctagcagtctacgagtcaacagaggagagactcgatgactgctaggaacctggcggcagcgcaaaagatg

SEQ ID NO: 85358 - DNA, 103 bp, Artificial Sequence
  Synthetic Polynucleotide
taatacgactcactatagggtcccacgtctagtgacctccgctgccatagaacagaggagactatggatgcggaggtcaaacctggcggcagcgcaaaagatg

SEQ ID NO: 85359 - DNA, 103 bp, Artificial Sequence
  Synthetic Polynucleotide
taatacgactcactatagggctccaacttgtgttgaacctagcagtctacaacagaggagagtagacatgtaggttcaaaacctggcggcagcgcaaaagatg

SEQ ID NO: 85360 - DNA, 103 bp, Artificial Sequence
  Synthetic Polynucleotide
taatacgactcactatagggtcccactccaacttgtgttgaacctagcagaacagaggagactgctaatgtcaacacaaaacctggcggcagcgcaaaagatg

SEQ ID NO: 85361 - DNA, 103 bp, Artificial Sequence
  Synthetic Polynucleotide
taatacgactcactatagggataactcccactccaacttgtgttgaacctaacagaggagaaggttcatgacaagttggaacctggcggcagcgcaaaagatg

SEQ ID NO: 85362 - DNA, 103 bp, Artificial Sequence
  Synthetic Polynucleotide
taatacgactcactatagggcttgcataactcccactccaacttgtgttgaacagaggagacaacacatgttggagtggaacctggcggcagcgcaaaagatg

SEQ ID NO: 85363 - DNA, 103 bp, Artificial Sequence
  Synthetic Polynucleotide
taatacgactcactatagggcccctcttgcataactcccactccaacttgaacagaggagacaagttatggtgggagttaacctggcggcagcgcaaaagatg

SEQ ID NO: 85364 - DNA, 103 bp, Artificial Sequence
  Synthetic Polynucleotide
taatacgactcactatagggaagaccccctcttgcataactcccactccaaacagaggagatggagtatgagttatgcaaacctggcggcagcgcaaaagatg

SEQ ID NO: 85365 - DNA, 103 bp, Artificial Sequence
  Synthetic Polynucleotide
taatacgactcactatagggtgtgaaagaccccctcttgcataactcccaaacagaggagatgggagatgtgcaagaggaacctggcggcagcgcaaaagatg

SEQ ID NO: 85366 - DNA, 103 bp, Artificial Sequence
  Synthetic Polynucleotide
taatacgactcactatagggcatagtgtgaaagaccccctcttgcataacaacagaggagagttatgatggagggggtcaacctggcggcagcgcaaaagatg

SEQ ID NO: 85367 - DNA, 103 bp, Artificial Sequence
  Synthetic Polynucleotide
taatacgactcactatagggtgccacatagtgtgaaagaccccctcttgcaacagaggagagcaagaatgggtctttcaaacctggcggcagcgcaaaagatg

SEQ ID NO: 85368 - DNA, 103 bp, Artificial Sequence
  Synthetic Polynucleotide
taatacgactcactatagggtgacgtgccacatagtgtgaaagaccccctaacagaggagaagggggatgttcacactaaacctggcggcagcgcaaaagatg

SEQ ID NO: 85369 - DNA, 103 bp, Artificial Sequence
  Synthetic Polynucleotide
taatacgactcactatagggtgcactcccacgtctagtgacctccgctgcaacagaggagagcagcgatggtcactagaaacctggcggcagcgcaaaagatg

SEQ ID NO: 85370 - DNA, 103 bp, Artificial Sequence
  Synthetic Polynucleotide
taatacgactcactatagggttttgtgacgtgccacatagtgtgaaagacaacagaggagagtctttatgactatgtggaacctggcggcagcgcaaaagatg

SEQ ID NO: 85371 - DNA, 103 bp, Artificial Sequence
  Synthetic Polynucleotide
taatacgactcactataggggatccttttgtgacgtgccacatagtgtgaaacagaggagatcacacatggtggcacgtaacctggcggcagcgcaaaagatg

SEQ ID NO: 85372 - DNA, 103 bp, Artificial Sequence
  Synthetic Polynucleotide
taatacgactcactataggggcgcggatccttttgtgacgtgccacatagaacagaggagactatgtatgacgtcacaaaacctggcggcagcgcaaaagatg

SEQ ID NO: 85373 - DNA, 103 bp, Artificial Sequence
  Synthetic Polynucleotide
taatacgactcactatagggtctcagcgcggatccttttgtgacgtgccaaacagaggagatggcacatgacaaaaggaaacctggcggcagcgcaaaagatg

SEQ ID NO: 85374 - DNA, 103 bp, Artificial Sequence
  Synthetic Polynucleotide
taatacgactcactatagggccgcttctcagcgcggatccttttgtgacgaacagaggagacgtcacatgaggatccgcaacctggcggcagcgcaaaagatg

SEQ ID NO: 85375 - DNA, 103 bp, Artificial Sequence
  Synthetic Polynucleotide
taatacgactcactatagggcttcaccgcttctcagcgcggatccttttgaacagaggagacaaaagatgccgcgctgaaacctggcggcagcgcaaaagatg

SEQ ID NO: 85376 - DNA, 103 bp, Artificial Sequence
  Synthetic Polynucleotide
taatacgactcactatagggtctcccttcaccgcttctcagcgcggatccaacagaggagaggatccatgctgagaagcaacctggcggcagcgcaaaagatg

SEQ ID NO: 85377 - DNA, 103 bp, Artificial Sequence
  Synthetic Polynucleotide
taatacgactcactatagggtcaagtctcccttcaccgcttctcagcgcgaacagaggagacgcgctatgaagcggtgaaacctggcggcagcgcaaaagatg

SEQ ID NO: 85378 - DNA, 103 bp, Artificial Sequence
  Synthetic Polynucleotide
taatacgactcactatagggatggatcaagtctcccttcaccgcttctcaaacagaggagatgagaaatggtgaagggaaacctggcggcagcgcaaaagatg

SEQ ID NO: 85379 - DNA, 103 bp, Artificial Sequence
  Synthetic Polynucleotide
taatacgactcactatagggccagtatggatcaagtctcccttcaccgctaacagaggagaagcggtatggggagacttaacctggcggcagcgcaaaagatg

SEQ ID NO: 85380 - DNA, 103 bp, Artificial Sequence
  Synthetic Polynucleotide
taatacgactcactatagggtagtatgcactcccacgtctagtgacctccaacagaggagaggaggtatgtagacgtggaacctggcggcagcgcaaaagatg

SEQ ID NO: 85381 - DNA, 103 bp, Artificial Sequence
  Synthetic Polynucleotide
taatacgactcactatagggtctccccagtatggatcaagtctcccttcaaacagaggagatgaaggatgacttgatccaacctggcggcagcgcaaaagatg

SEQ ID NO: 85382 - DNA, 103 bp, Artificial Sequence
  Synthetic Polynucleotide
taatacgactcactatagggtgacatctccccagtatggatcaagtctccaacagaggagaggagacatgatccatactaacctggcggcagcgcaaaagatg

SEQ ID NO: 85383 - DNA, 103 bp, Artificial Sequence
  Synthetic Polynucleotide
taatacgactcactatagggctgcttgacatctccccagtatggatcaagaacagaggagacttgatatgtactggggaaacctggcggcagcgcaaaagatg

SEQ ID NO: 85384 - DNA, 103 bp, Artificial Sequence
  Synthetic Polynucleotide
taatacgactcactatagggagatcctgcttgacatctccccagtatggaaacagaggagatccataatggggagatgtaacctggcggcagcgcaaaagatg

SEQ ID NO: 85385 - DNA, 103 bp, Artificial Sequence
  Synthetic Polynucleotide
taatacgactcactatagggacaccagatcctgcttgacatctccccagtaacagaggagaactgggatgatgtcaagcaacctggcggcagcgcaaaagatg

SEQ ID NO: 85386 - DNA, 103 bp, Artificial Sequence
  Synthetic Polynucleotide
taatacgactcactataggggtatgacaccagatcctgcttgacatctccaacagaggagaggagatatgaagcaggataacctggcggcagcgcaaaagatg

SEQ ID NO: 85387 - DNA, 103 bp, Artificial Sequence
  Synthetic Polynucleotide
taatacgactcactatagggccacagtatgacaccagatcctgcttgacaaacagaggagatgtcaaatgggatctggtaacctggcggcagcgcaaaagatg

SEQ ID NO: 85388 - DNA, 103 bp, Artificial Sequence
  Synthetic Polynucleotide
taatacgactcactatagggatggaccacagtatgacaccagatcctgctaacagaggagaagcaggatgtggtgtcataacctggcggcagcgcaaaagatg

SEQ ID NO: 85389 - DNA, 103 bp, Artificial Sequence
  Synthetic Polynucleotide
taatacgactcactatagggcttccatggaccacagtatgacaccagatcaacagaggagagatctgatgtcatactgtaacctggcggcagcgcaaaagatg

SEQ ID NO: 85390 - DNA, 103 bp, Artificial Sequence
  Synthetic Polynucleotide
taatacgactcactatagggtctagcttccatggaccacagtatgacaccaacagaggagaggtgtcatgctgtggtccaacctggcggcagcgcaaaagatg

SEQ ID NO: 85391 - DNA, 103 bp, Artificial Sequence
  Synthetic Polynucleotide
taatacgactcactatagggacatatagtatgcactcccacgtctagtgaaacagaggagatcactaatggtgggagtgaacctggcggcagcgcaaaagatg

SEQ ID NO: 85392 - DNA, 103 bp, Artificial Sequence
  Synthetic Polynucleotide
taatacgactcactatagggcggcatctagcttccatggaccacagtatgaacagaggagacatactatggtccatggaaacctggcggcagcgcaaaagatg

SEQ ID NO: 85393 - DNA, 103 bp, Artificial Sequence
  Synthetic Polynucleotide
taatacgactcactatagggccaggcggcatctagcttccatggaccacaaacagaggagatgtggtatgtggaagctaaacctggcggcagcgcaaaagatg

SEQ ID NO: 85394 - DNA, 103 bp, Artificial Sequence
  Synthetic Polynucleotide
taatacgactcactatagggccgtcccaggcggcatctagcttccatggaaacagaggagatccatgatggctagatgcaacctggcggcagcgcaaaagatg

SEQ ID NO: 85395 - DNA, 103 bp, Artificial Sequence
  Synthetic Polynucleotide
taatacgactcactatagggtgtgcccgtcccaggcggcatctagcttccaacagaggagaggaagcatgatgccgcctaacctggcggcagcgcaaaagatg

SEQ ID NO: 85396 - DNA, 103 bp, Artificial Sequence
  Synthetic Polynucleotide
taatacgactcactatagggctcgctgtgcccgtcccaggcggcatctagaacagaggagactagatatggcctgggacaacctggcggcagcgcaaaagatg

SEQ ID NO: 85397 - DNA, 103 bp, Artificial Sequence
  Synthetic Polynucleotide
taatacgactcactatagggtgcacctcgctgtgcccgtcccaggcggcaaacagaggagatgccgcatgggacgggcaaacctggcggcagcgcaaaagatg

SEQ ID NO: 85398 - DNA, 103 bp, Artificial Sequence
  Synthetic Polynucleotide
taatacgactcactatagggagagctgcacctcgctgtgcccgtcccaggaacagaggagacctgggatgggcacagcgaacctggcggcagcgcaaaagatg

SEQ ID NO: 85399 - DNA, 103 bp, Artificial Sequence
  Synthetic Polynucleotide
taatacgactcactatagggggccaagagctgcacctcgctgtgcccgtcaacagaggagagacgggatgagcgaggtgaacctggcggcagcgcaaaagatg

SEQ ID NO: 85400 - DNA, 103 bp, Artificial Sequence
  Synthetic Polynucleotide
taatacgactcactatagggggcacggccaagagctgcacctcgctgtgcaacagaggagagcacagatgggtgcagctaacctggcggcagcgcaaaagatg

SEQ ID NO: 85401 - DNA, 103 bp, Artificial Sequence
  Synthetic Polynucleotide
taatacgactcactatagggcggggggcacggccaagagctgcacctcgcaacagaggagagcgaggatgagctcttggaacctggcggcagcgcaaaagatg

SEQ ID NO: 85402 - DNA, 103 bp, Artificial Sequence
  Synthetic Polynucleotide
taatacgactcactatagggcaagtacatatagtatgcactcccacgtctaacagaggagaagacgtatgagtgcatacaacctggcggcagcgcaaaagatg

SEQ ID NO: 85403 - DNA, 103 bp, Artificial Sequence
  Synthetic Polynucleotide
taatacgactcactatagggctctccggggggcacggccaagagctgcacaacagaggagagtgcagatgttggccgtgaacctggcggcagcgcaaaagatg

SEQ ID NO: 85404 - DNA, 103 bp, Artificial Sequence
  Synthetic Polynucleotide
taatacgactcactataggggctctctctccggggggcacggccaagagcaacagaggagagctcttatgcgtgcccccaacctggcggcagcgcaaaagatg

SEQ ID NO: 85405 - DNA, 103 bp, Artificial Sequence
  Synthetic Polynucleotide
taatacgactcactatagggtcctcgctctctctccggggggcacggccaaacagaggagatggccgatgcccccggagaacctggcggcagcgcaaaagatg

SEQ ID NO: 85406 - DNA, 103 bp, Artificial Sequence
  Synthetic Polynucleotide
taatacgactcactataggggatgttcctcgctctctctccggggggcacaacagaggagagtgcccatgggagagagaaacctggcggcagcgcaaaagatg

SEQ ID NO: 85407 - DNA, 103 bp, Artificial Sequence
  Synthetic Polynucleotide
taatacgactcactataggggtctggatgttcctcgctctctctccggggaacagaggagaccccggatggagagcgagaacctggcggcagcgcaaaagatg

SEQ ID NO: 85408 - DNA, 103 bp, Artificial Sequence
  Synthetic Polynucleotide
taatacgactcactataggggcagagtctggatgttcctcgctctctctcaacagaggagagagagaatgcgaggaacaaacctggcggcagcgcaaaagatg

SEQ ID NO: 85409 - DNA, 103 bp, Artificial Sequence
  Synthetic Polynucleotide
taatacgactcactatagggtccgggcagagtctggatgttcctcgctctaacagaggagaagagcgatgaacatccagaacctggcggcagcgcaaaagatg

SEQ ID NO: 85410 - DNA, 103 bp, Artificial Sequence
  Synthetic Polynucleotide
taatacgactcactatagggaatattccgggcagagtctggatgttcctcaacagaggagagaggaaatgccagactctaacctggcggcagcgcaaaagatg

SEQ ID NO: 85411 - DNA, 103 bp, Artificial Sequence
  Synthetic Polynucleotide
taatacgactcactatagggtcttaaatattccgggcagagtctggatgtaacagaggagaacatccatgctctgcccgaacctggcggcagcgcaaaagatg

SEQ ID NO: 85412 - DNA, 103 bp, Artificial Sequence
  Synthetic Polynucleotide
taatacgactcactatagggctttgtcttaaatattccgggcagagtctgaacagaggagacagactatgcccggaataaacctggcggcagcgcaaaagatg

SEQ ID NO: 85413 - DNA, 103 bp, Artificial Sequence
  Synthetic Polynucleotide
taatacgactcactatagggctgtccaagtacatatagtatgcactcccaaacagaggagatgggagatgatactatataacctggcggcagcgcaaaagatg

SEQ ID NO: 85414 - DNA, 103 bp, Artificial Sequence
  Synthetic Polynucleotide
taatacgactcactatagggccatcctttgtcttaaatattccgggcagaaacagaggagatctgccatgaatatttaaaacctggcggcagcgcaaaagatg

SEQ ID NO: 85415 - DNA, 103 bp, Artificial Sequence
  Synthetic Polynucleotide
taatacgactcactatagggtgtccccatcctttgtcttaaatattccggaacagaggagaccggaaatgttaagacaaaacctggcggcagcgcaaaagatg

SEQ ID NO: 85416 - DNA, 103 bp, Artificial Sequence
  Synthetic Polynucleotide
taatacgactcactatagggtccaatgtccccatcctttgtcttaaatataacagaggagaatatttatgacaaaggataacctggcggcagcgcaaaagatg

SEQ ID NO: 85417 - DNA, 103 bp, Artificial Sequence
  Synthetic Polynucleotide
taatacgactcactatagggaccgctccaatgtccccatcctttgtcttaaacagaggagataagacatgggatggggaaacctggcggcagcgcaaaagatg

SEQ ID NO: 85418 - DNA, 103 bp, Artificial Sequence
  Synthetic Polynucleotide
taatacgactcactataggggcgcaaccgctccaatgtccccatcctttgaacagaggagacaaaggatggggacattgaacctggcggcagcgcaaaagatg

SEQ ID NO: 85419 - DNA, 103 bp, Artificial Sequence
  Synthetic Polynucleotide
taatacgactcactatagggatccagcgcaaccgctccaatgtccccatcaacagaggagagatgggatgattggagcgaacctggcggcagcgcaaaagatg

SEQ ID NO: 85420 - DNA, 103 bp, Artificial Sequence
  Synthetic Polynucleotide
taatacgactcactataggggggtaatccagcgcaaccgctccaatgtccaacagaggagaggacatatgagcggttgcaacctggcggcagcgcaaaagatg

SEQ ID NO: 85421 - DNA, 103 bp, Artificial Sequence
  Synthetic Polynucleotide
taatacgactcactatagggctgctgggtaatccagcgcaaccgctccaaaacagaggagattggagatgttgcgctggaacctggcggcagcgcaaaagatg

SEQ ID NO: 85422 - DNA, 103 bp, Artificial Sequence
  Synthetic Polynucleotide
taatacgactcactatagggagttcctgctgggtaatccagcgcaaccgcaacagaggagagcggttatgctggattacaacctggcggcagcgcaaaagatg

SEQ ID NO: 85423 - DNA, 103 bp, Artificial Sequence
  Synthetic Polynucleotide
taatacgactcactatagggcctgaagttcctgctgggtaatccagcgcaaacagaggagatgcgctatgttacccagcaacctggcggcagcgcaaaagatg

SEQ ID NO: 85424 - DNA, 103 bp, Artificial Sequence
  Synthetic Polynucleotide
taatacgactcactatagggggagttcaccatatacgaactcatgaccataacagaggagaatggtcatgagttcgtataacctggcggcagcgcaaaagatg

SEQ ID NO: 85425 - DNA, 103 bp, Artificial Sequence
  Synthetic Polynucleotide
taatacgactcactataggggccgccgccgtagtagtcggcgccctgctcaacagaggagagagcagatggccgactacaacctggcggcagcgcaaaagatg

SEQ ID NO: 85426 - DNA, 103 bp, Artificial Sequence
  Synthetic Polynucleotide
taatacgactcactatagggcgccctgcgcgccgccgccgtagtagtcggaacagaggagaccgactatgacggcggcgaacctggcggcagcgcaaaagatg

SEQ ID NO: 85427 - DNA, 103 bp, Artificial Sequence
  Synthetic Polynucleotide
taatacgactcactatagggtggaagtctgcgccctgcgcgccgccgccgaacagaggagacggcggatgcgcgcagggaacctggcggcagcgcaaaagatg

SEQ ID NO: 85428 - DNA, 103 bp, Artificial Sequence
  Synthetic Polynucleotide
taatacgactcactatagggccccgggggctggaagtctgcgccctgcgcaacagaggagagcgcagatggcagacttcaacctggcggcagcgcaaaagatg

SEQ ID NO: 85429 - DNA, 103 bp, Artificial Sequence
  Synthetic Polynucleotide
taatacgactcactataggggtgggtagagccccgggggctggaagtctgaacagaggagacagactatgagcccccggaacctggcggcagcgcaaaagatg

SEQ ID NO: 85430 - DNA, 103 bp, Artificial Sequence
  Synthetic Polynucleotide
taatacgactcactatagggaagtcgggccgtgggtagagccccgggggcaacagaggagagcccccatggctctacccaacctggcggcagcgcaaaagatg

SEQ ID NO: 85431 - DNA, 103 bp, Artificial Sequence
  Synthetic Polynucleotide
taatacgactcactatagggctgctcaccgaagtcgggccgtgggtagagaacagaggagactctacatgcggcccgacaacctggcggcagcgcaaaagatg

SEQ ID NO: 85432 - DNA, 103 bp, Artificial Sequence
  Synthetic Polynucleotide
taatacgactcactatagggctccgaaaggctgctcaccgaagtcgggccaacagaggagaggcccgatgtcggtgagcaacctggcggcagcgcaaaagatg

SEQ ID NO: 85433 - DNA, 103 bp, Artificial Sequence
  Synthetic Polynucleotide
taatacgactcactataggggggccgctgcctccgaaaggctgctcaccgaacagaggagacggtgaatggcctttcggaacctggcggcagcgcaaaagatg

SEQ ID NO: 85434 - DNA, 103 bp, Artificial Sequence
  Synthetic Polynucleotide
taatacgactcactataggggccaggcccggggccgctgcctccgaaaggaacagaggagacctttcatgggcagcggcaacctggcggcagcgcaaaagatg

SEQ ID NO: 85435 - DNA, 103 bp, Artificial Sequence
  Synthetic Polynucleotide
taatacgactcactatagggccacatacttggagttcaccatatacgaacaacagaggagagttcgtatgtggtgaactaacctggcggcagcgcaaaagatg

SEQ ID NO: 85436 - DNA, 103 bp, Artificial Sequence
  Synthetic Polynucleotide
taatacgactcactataggggcagcgccgagccaggcccggggccgctgcaacagaggagagcagcgatgccgggcctgaacctggcggcagcgcaaaagatg

SEQ ID NO: 85437 - DNA, 103 bp, Artificial Sequence
  Synthetic Polynucleotide
taatacgactcactatagggccccgcgcaggcagcgccgagccaggcccgaacagaggagacgggccatgctcggcgctaacctggcggcagcgcaaaagatg

SEQ ID NO: 85438 - DNA, 103 bp, Artificial Sequence
  Synthetic Polynucleotide
taatacgactcactatagggttgtccgtgaccccgcgcaggcagcgccgaaacagaggagatcggcgatgcctgcgcggaacctggcggcagcgcaaaagatg

SEQ ID NO: 85439 - DNA, 103 bp, Artificial Sequence
  Synthetic Polynucleotide
taatacgactcactatagggcgcctggctcttgtccgtgaccccgcgcagaacagaggagactgcgcatggtcacggacaacctggcggcagcgcaaaagatg

SEQ ID NO: 85440 - DNA, 103 bp, Artificial Sequence
  Synthetic Polynucleotide
taatacgactcactatagggccgccggggccgcctggctcttgtccgtgaaacagaggagatcacggatgagagccaggaacctggcggcagcgcaaaagatg

SEQ ID NO: 85441 - DNA, 103 bp, Artificial Sequence
  Synthetic Polynucleotide
taatacgactcactatagggggcgtagtgaccgccggggccgcctggctcaacagaggagagagccaatgggccccggcaacctggcggcagcgcaaaagatg

SEQ ID NO: 85442 - DNA, 103 bp, Artificial Sequence
  Synthetic Polynucleotide
taatacgactcactatagggctcctggagcggcgtagtgaccgccggggcaacagaggagagccccgatggtcactacgaacctggcggcagcgcaaaagatg

SEQ ID NO: 85443 - DNA, 103 bp, Artificial Sequence
  Synthetic Polynucleotide
taatacgactcactataggggggcaaggctctcctggagcggcgtagtgaaacagaggagatcactaatgcgctccaggaacctggcggcagcgcaaaagatg

SEQ ID NO: 85444 - DNA, 103 bp, Artificial Sequence
  Synthetic Polynucleotide
taatacgactcactatagggcgggggagctgggcaaggctctcctggagcaacagaggagagctccaatggagccttgcaacctggcggcagcgcaaaagatg

SEQ ID NO: 85445 - DNA, 103 bp, Artificial Sequence
  Synthetic Polynucleotide
taatacgactcactataggggcggaggcgccgggggagctgggcaaggctaacagaggagaagccttatgcagctccccaacctggcggcagcgcaaaagatg

SEQ ID NO: 85446 - DNA, 103 bp, Artificial Sequence
  Synthetic Polynucleotide
taatacgactcactatagggaacttggggtccacatacttggagttcaccaacagaggagaggtgaaatgcaagtatgtaacctggcggcagcgcaaaagatg

SEQ ID NO: 85447 - DNA, 103 bp, Artificial Sequence
  Synthetic Polynucleotide
taatacgactcactatagggaggggcgccggcggaggcgccgggggagctaacagaggagaagctccatgggcgcctccaacctggcggcagcgcaaaagatg

SEQ ID NO: 85448 - DNA, 103 bp, Artificial Sequence
  Synthetic Polynucleotide
taatacgactcactatagggggcgccaggcaggggcgccggcggaggcgcaacagaggagagcgcctatgccggcgcccaacctggcggcagcgcaaaagatg

SEQ ID NO: 85449 - DNA, 103 bp, Artificial Sequence
  Synthetic Polynucleotide
taatacgactcactatagggtgtaggcccgggcgccaggcaggggcgccgaacagaggagacggcgcatgtgcctggcgaacctggcggcagcgcaaaagatg

SEQ ID NO: 85450 - DNA, 103 bp, Artificial Sequence
  Synthetic Polynucleotide
taatacgactcactatagggtcggactgactgtaggcccgggcgccaggcaacagaggagagcctggatgccgggcctaaacctggcggcagcgcaaaagatg

SEQ ID NO: 85451 - DNA, 103 bp, Artificial Sequence
  Synthetic Polynucleotide
taatacgactcactatagggctgcttggggtcggactgactgtaggcccgaacagaggagacgggccatgagtcagtccaacctggcggcagcgcaaaagatg

SEQ ID NO: 85452 - DNA, 103 bp, Artificial Sequence
  Synthetic Polynucleotide
taatacgactcactatagggcggagggcggctgcttggggtcggactgacaacagaggagagtcagtatgaccccaagcaacctggcggcagcgcaaaagatg

SEQ ID NO: 85453 - DNA, 103 bp, Artificial Sequence
  Synthetic Polynucleotide
taatacgactcactatagggagtgccgtcccggagggcggctgcttggggaacagaggagaccccaaatggccgccctcaacctggcggcagcgcaaaagatg

SEQ ID NO: 85454 - DNA, 103 bp, Artificial Sequence
  Synthetic Polynucleotide
taatacgactcactatagggcggctgcttgagtgccgtcccggagggcggaacagaggagaccgcccatggggacggcaaacctggcggcagcgcaaaagatg

SEQ ID NO: 85455 - DNA, 103 bp, Artificial Sequence
  Synthetic Polynucleotide
taatacgactcactatagggagaccacggccggctgcttgagtgccgtccaacagaggagaggacggatgtcaagcagcaacctggcggcagcgcaaaagatg

SEQ ID NO: 85456 - DNA, 103 bp, Artificial Sequence
  Synthetic Polynucleotide
taatacgactcactatagggatccaggggtagaccacggccggctgcttgaacagaggagacaagcaatgggccgtggtaacctggcggcagcgcaaaagatg

SEQ ID NO: 85457 - DNA, 103 bp, Artificial Sequence
  Synthetic Polynucleotide
taatacgactcactataggggcacggagggaacttggggtccacatacttaacagaggagaaagtatatggaccccaagaacctggcggcagcgcaaaagatg

SEQ ID NO: 85458 - DNA, 103 bp, Artificial Sequence
  Synthetic Polynucleotide
taatacgactcactatagggcaccttcttcatccaggggtagaccacggcaacagaggagagccgtgatgtacccctggaacctggcggcagcgcaaaagatg

SEQ ID NO: 85459 - DNA, 103 bp, Artificial Sequence
  Synthetic Polynucleotide
taatacgactcactatagggaattcacgtgcaccttcttcatccaggggtaacagaggagaacccctatgtgaagaaggaacctggcggcagcgcaaaagatg

SEQ ID NO: 85460 - DNA, 103 bp, Artificial Sequence
  Synthetic Polynucleotide
taatacgactcactatagggcagatacccgaattcacgtgcaccttcttcaacagaggagagaagaaatggcacgtgaaaacctggcggcagcgcaaaagatg

SEQ ID NO: 85461 - DNA, 103 bp, Artificial Sequence
  Synthetic Polynucleotide
taatacgactcactatagggaatactcctcgcacggagggaacttggggtaacagaggagaaccccaatgtccctccgtaacctggcggcagcgcaaaagatg

SEQ ID NO: 85462 - DNA, 103 bp, Artificial Sequence
  Synthetic Polynucleotide
taatacgactcactatagggccgccctgcaaatactcctcgcacggagggaacagaggagaccctccatgcgaggagtaaacctggcggcagcgcaaaagatg

SEQ ID NO: 85463 - DNA, 103 bp, Artificial Sequence
  Synthetic Polynucleotide
taatacgactcactataggggcctaggtagccgccctgcaaatactcctcaacagaggagagaggagatgttgcagggcaacctggcggcagcgcaaaagatg

SEQ ID NO: 85464 - DNA, 103 bp, Artificial Sequence
  Synthetic Polynucleotide
taatacgactcactatagggcgccctgctcgcctaggtagccgccctgcaaacagaggagatgcaggatggctacctagaacctggcggcagcgcaaaagatg

SEQ ID NO: 85465 - DNA, 103 bp, Artificial Sequence
  Synthetic Polynucleotide
taatacgactcactatagggtagtagtcggcgccctgctcgcctaggtagaacagaggagactacctatgcgagcagggaacctggcggcagcgcaaaagatg

SEQ ID NO: 85466 - DNA, 103 bp, Artificial Sequence
  Synthetic Polynucleotide
taatacgactcactataggggtcggacttgggggtctcagggaaactcacaacagaggagagtgagtatgcctgagaccaacctggcggcagcgcaaaagatg

SEQ ID NO: 85467 - DNA, 103 bp, Artificial Sequence
  Synthetic Polynucleotide
taatacgactcactatagggggccctctccttttcgctctccgaggggctaacagaggagaagccccatggagagcgaaaacctggcggcagcgcaaaagatg

SEQ ID NO: 85468 - DNA, 103 bp, Artificial Sequence
  Synthetic Polynucleotide
taatacgactcactatagggcggcagctttggccctctccttttcgctctaacagaggagaagagcgatgaggagagggaacctggcggcagcgcaaaagatg

SEQ ID NO: 85469 - DNA, 103 bp, Artificial Sequence
  Synthetic Polynucleotide
taatacgactcactataggggggctggagtcggcagctttggccctctccaacagaggagaggagagatgcaaagctgcaacctggcggcagcgcaaaagatg

SEQ ID NO: 85470 - DNA, 103 bp, Artificial Sequence
  Synthetic Polynucleotide
taatacgactcactatagggcgaggtgtctgggctggagtcggcagctttaacagaggagaaaagctatggactccagcaacctggcggcagcgcaaaagatg

SEQ ID NO: 85471 - DNA, 103 bp, Artificial Sequence
  Synthetic Polynucleotide
taatacgactcactatagggcttcgttatccgaggtgtctgggctggagtaacagaggagaactccaatgcagacacctaacctggcggcagcgcaaaagatg

SEQ ID NO: 85472 - DNA, 103 bp, Artificial Sequence
  Synthetic Polynucleotide
taatacgactcactataggggtctctttcgcttcgttatccgaggtgtctaacagaggagaagacacatgggataacgaaacctggcggcagcgcaaaagatg

SEQ ID NO: 85473 - DNA, 103 bp, Artificial Sequence
  Synthetic Polynucleotide
taatacgactcactatagggcttgccgtccgtctctttcgcttcgttatcaacagaggagagataacatggcgaaagagaacctggcggcagcgcaaaagatg

SEQ ID NO: 85474 - DNA, 103 bp, Artificial Sequence
  Synthetic Polynucleotide
taatacgactcactatagggttcgggaccgcttgccgtccgtctctttcgaacagaggagacgaaagatgcggacggcaaacctggcggcagcgcaaaagatg

SEQ ID NO: 85475 - DNA, 103 bp, Artificial Sequence
  Synthetic Polynucleotide
taatacgactcactataggggtgtaactggttcgggaccgcttgccgtccaacagaggagaggacggatggcggtcccgaacctggcggcagcgcaaaagatg

SEQ ID NO: 85476 - DNA, 103 bp, Artificial Sequence
  Synthetic Polynucleotide
taatacgactcactatagggctggtagcgcgtgtaactggttcgggaccgaacagaggagacggtccatgaccagttacaacctggcggcagcgcaaaagatg

SEQ ID NO: 85477 - DNA, 103 bp, Artificial Sequence
  Synthetic Polynucleotide
taatacgactcactataggggggtctggctgtcggacttgggggtctcagaacagaggagactgagaatgccaagtccgaacctggcggcagcgcaaaagatg

SEQ ID NO: 85478 - DNA, 103 bp, Artificial Sequence
  Synthetic Polynucleotide
taatacgactcactataggggttccagagtctggtagcgcgtgtaactggaacagaggagaccagttatgcgcgctaccaacctggcggcagcgcaaaagatg

SEQ ID NO: 85479 - DNA, 103 bp, Artificial Sequence
  Synthetic Polynucleotide
taatacgactcactatagggtctttctcgagttccagagtctggtagcgcaacagaggagagcgctaatggactctggaaacctggcggcagcgcaaaagatg

SEQ ID NO: 85480 - DNA, 103 bp, Artificial Sequence
  Synthetic Polynucleotide
taatacgactcactatagggaaagtggaattctttctcgagttccagagtaacagaggagaactctgatgctcgagaaaaacctggcggcagcgcaaaagatg

SEQ ID NO: 85481 - DNA, 103 bp, Artificial Sequence
  Synthetic Polynucleotide
taatacgactcactatagggggtagcggttaaagtggaattctttctcgaaacagaggagatcgagaatgaattccactaacctggcggcagcgcaaaagatg

SEQ ID NO: 85482 - DNA, 103 bp, Artificial Sequence
  Synthetic Polynucleotide
taatacgactcactatagggcggcgagtgaggtagcggttaaagtggaataacagaggagaattccaatgtaaccgctaaacctggcggcagcgcaaaagatg

SEQ ID NO: 85483 - DNA, 103 bp, Artificial Sequence
  Synthetic Polynucleotide
taatacgactcactatagggtatgcgcctgcggcgagtgaggtagcggttaacagaggagaaaccgcatgctcactcgcaacctggcggcagcgcaaaagatg

SEQ ID NO: 85484 - DNA, 103 bp, Artificial Sequence
  Synthetic Polynucleotide
taatacgactcactatagggtggcgatctctatgcgcctgcggcgagtgaaacagaggagatcactcatggcaggcgcaaacctggcggcagcgcaaaagatg

SEQ ID NO: 85485 - DNA, 103 bp, Artificial Sequence
  Synthetic Polynucleotide
taatacgactcactatagggcacaagttgttggcgatctctatgcgcctgaacagaggagacaggcgatgagagatcgcaacctggcggcagcgcaaaagatg

SEQ ID NO: 85486 - DNA, 103 bp, Artificial Sequence
  Synthetic Polynucleotide
taatacgactcactatagggctcattgagacacaagttgttggcgatctcaacagaggagagagatcatgaacaacttgaacctggcggcagcgcaaaagatg

SEQ ID NO: 85487 - DNA, 103 bp, Artificial Sequence
  Synthetic Polynucleotide
taatacgactcactatagggtgatctgtctctcattgagacacaagttgtaacagaggagaacaactatggtctcaatgaacctggcggcagcgcaaaagatg

SEQ ID NO: 85488 - DNA, 103 bp, Artificial Sequence
  Synthetic Polynucleotide
taatacgactcactatagggttggggctgggggtctggctgtcggacttgaacagaggagacaagtcatgcagccagacaacctggcggcagcgcaaaagatg

SEQ ID NO: 85489 - DNA, 103 bp, Artificial Sequence
  Synthetic Polynucleotide
taatacgactcactatagggaaccagatcttgatctgtctctcattgagaaacagaggagatctcaaatggagacagataacctggcggcagcgcaaaagatg

SEQ ID NO: 85490 - DNA, 103 bp, Artificial Sequence
  Synthetic Polynucleotide
taatacgactcactataggggcggttctggaaccagatcttgatctgtctaacagaggagaagacagatgaagatctggaacctggcggcagcgcaaaagatg

SEQ ID NO: 85491 - DNA, 103 bp, Artificial Sequence
  Synthetic Polynucleotide
taatacgactcactatagggacttcatcctgcggttctggaaccagatctaacagaggagaagatctatgtccagaaccaacctggcggcagcgcaaaagatg

SEQ ID NO: 85492 - DNA, 103 bp, Artificial Sequence
  Synthetic Polynucleotide
taatacgactcactatagggtctttcttccacttcatcctgcggttctggaacagaggagaccagaaatgcaggatgaaaacctggcggcagcgcaaaagatg

SEQ ID NO: 85493 - DNA, 103 bp, Artificial Sequence
  Synthetic Polynucleotide
taatacgactcactatagggcattttggaatctttcttccacttcatcctaacagaggagaaggatgatgtggaagaaaaacctggcggcagcgcaaaagatg

SEQ ID NO: 85494 - DNA, 103 bp, Artificial Sequence
  Synthetic Polynucleotide
taatacgactcactatagggctttgcttttcattttggaatctttcttccaacagaggagaggaagaatgattccaaaaaacctggcggcagcgcaaaagatg

SEQ ID NO: 85495 - DNA, 103 bp, Artificial Sequence
  Synthetic Polynucleotide
taatacgactcactatagggtaaagagcctctttgcttttcattttggaaaacagaggagattccaaatggaaaagcaaaacctggcggcagcgcaaaagatg

SEQ ID NO: 85496 - DNA, 103 bp, Artificial Sequence
  Synthetic Polynucleotide
taatacgactcactatagggcttgatttcattggggctgggggtctggctaacagaggagaagccagatgcccagccccaacctggcggcagcgcaaaagatg

SEQ ID NO: 85497 - DNA, 103 bp, Artificial Sequence
  Synthetic Polynucleotide
taatacgactcactatagggtctgctccgtcttgatttcattggggctggaacagaggagaccagccatgatgaaatcaaacctggcggcagcgcaaaagatg

SEQ ID NO: 85498 - DNA, 103 bp, Artificial Sequence
  Synthetic Polynucleotide
taatacgactcactatagggcccgccaggctctgctccgtcttgatttcaaacagaggagatgaaatatggacggagcaaacctggcggcagcgcaaaagatg

SEQ ID NO: 85499 - DNA, 103 bp, Artificial Sequence
  Synthetic Polynucleotide
taatacgactcactatagggccctttagggcccgccaggctctgctccgtaacagaggagaacggagatgagcctggcgaacctggcggcagcgcaaaagatg

SEQ ID NO: 85500 - DNA, 103 bp, Artificial Sequence
  Synthetic Polynucleotide
taatacgactcactatagggccgaggggctccctttagggcccgccaggcaacagaggagagcctggatggccctaaagaacctggcggcagcgcaaaagatg

SEQ ID NO: 85501 - DNA, 103 bp, Artificial Sequence
  Synthetic Polynucleotide
taatacgactcactatagggttttcgctctccgaggggctccctttagggaacagaggagaccctaaatggagcccctcaacctggcggcagcgcaaaagatg

SEQ ID NO: 85502 - DNA, 103 bp, Artificial Sequence
  Synthetic Polynucleotide
taatacgactcactatagggttttgtctcagtcccagattcttgcatcataacagaggagaatgatgatggaatctgggaacctggcggcagcgcaaaagatg

SEQ ID NO: 85503 - DNA, 103 bp, Artificial Sequence
  Synthetic Polynucleotide
taatacgactcactatagggctctccgttggaccgcccctcccgaagaccaacagaggagaggtcttatggaggggcggaacctggcggcagcgcaaaagatg

SEQ ID NO: 85504 - DNA, 103 bp, Artificial Sequence
  Synthetic Polynucleotide
taatacgactcactatagggttgggctgtacttctatcgtccagcgcatgaacagaggagacatgcgatggacgatagaaacctggcggcagcgcaaaagatg

SEQ ID NO: 85505 - DNA, 103 bp, Artificial Sequence
  Synthetic Polynucleotide
taatacgactcactataggggtactctacattgggctgtacttctatcgtaacagaggagaacgataatggtacagcccaacctggcggcagcgcaaaagatg

SEQ ID NO: 85506 - DNA, 103 bp, Artificial Sequence
  Synthetic Polynucleotide
taatacgactcactatagggacctgcatttgtactctacattgggctgtaaacagaggagatacagcatgatgtagagtaacctggcggcagcgcaaaagatg

SEQ ID NO: 85507 - DNA, 103 bp, Artificial Sequence
  Synthetic Polynucleotide
taatacgactcactatagggctgctgtacaacctgcatttgtactctacaaacagaggagatgtagaatgcaaatgcagaacctggcggcagcgcaaaagatg

SEQ ID NO: 85508 - DNA, 103 bp, Artificial Sequence
  Synthetic Polynucleotide
taatacgactcactataggggtagctctaactgctgtacaacctgcatttaacagaggagaaaatgcatgttgtacagcaacctggcggcagcgcaaaagatg

SEQ ID NO: 85509 - DNA, 103 bp, Artificial Sequence
  Synthetic Polynucleotide
taatacgactcactatagggtttgcaagctgtagctctaactgctgtacaaacagaggagatgtacaatggttagagctaacctggcggcagcgcaaaagatg

SEQ ID NO: 85510 - DNA, 103 bp, Artificial Sequence
  Synthetic Polynucleotide
taatacgactcactatagggttctttgtcttttgcaagctgtagctctaaaacagaggagattagagatgcagcttgcaaacctggcggcagcgcaaaagatg

SEQ ID NO: 85511 - DNA, 103 bp, Artificial Sequence
  Synthetic Polynucleotide
taatacgactcactatagggcttgcaggcgttctttgtcttttgcaagctaacagaggagaagcttgatgaagacaaagaacctggcggcagcgcaaaagatg

SEQ ID NO: 85512 - DNA, 103 bp, Artificial Sequence
  Synthetic Polynucleotide
taatacgactcactataggggtcatcatggcttgcaggcgttctttgtctaacagaggagaagacaaatgacgcctgcaaacctggcggcagcgcaaaagatg

SEQ ID NO: 85513 - DNA, 103 bp, Artificial Sequence
  Synthetic Polynucleotide
taatacgactcactatagggatgcaggtgggtcatcatggcttgcaggcgaacagaggagacgcctgatggccatgatgaacctggcggcagcgcaaaagatg

SEQ ID NO: 85514 - DNA, 103 bp, Artificial Sequence
  Synthetic Polynucleotide
taatacgactcactatagggcggccggcgtctctccgttggaccgcccctaacagaggagaaggggcatgccaacggagaacctggcggcagcgcaaaagatg

SEQ ID NO: 85515 - DNA, 103 bp, Artificial Sequence
  Synthetic Polynucleotide
taatacgactcactatagggtagacttcacatgcaggtgggtcatcatggaacagaggagaccatgaatgcccacctgcaacctggcggcagcgcaaaagatg

SEQ ID NO: 85516 - DNA, 103 bp, Artificial Sequence
  Synthetic Polynucleotide
taatacgactcactatagggttgggttctgtagacttcacatgcaggtggaacagaggagaccacctatgtgtgaagtcaacctggcggcagcgcaaaagatg

SEQ ID NO: 85517 - DNA, 103 bp, Artificial Sequence
  Synthetic Polynucleotide
taatacgactcactatagggaggggcggctttgggttctgtagacttcacaacagaggagagtgaagatgacagaacccaacctggcggcagcgcaaaagatg

SEQ ID NO: 85518 - DNA, 103 bp, Artificial Sequence
  Synthetic Polynucleotide
taatacgactcactatagggtcaagggctgaggggcggctttgggttctgaacagaggagacagaacatgaagccgcccaacctggcggcagcgcaaaagatg

SEQ ID NO: 85519 - DNA, 103 bp, Artificial Sequence
  Synthetic Polynucleotide
taatacgactcactataggggataccagattcaagggctgaggggcggctaacagaggagaagccgcatgtcagcccttaacctggcggcagcgcaaaagatg

SEQ ID NO: 85520 - DNA, 103 bp, Artificial Sequence
  Synthetic Polynucleotide
taatacgactcactatagggagtgacacttgataccagattcaagggctgaacagaggagacagcccatgaatctggtaaacctggcggcagcgcaaaagatg

SEQ ID NO: 85521 - DNA, 103 bp, Artificial Sequence
  Synthetic Polynucleotide
taatacgactcactatagggacttggagagagtgacacttgataccagataacagaggagaatctggatgcaagtgtcaaacctggcggcagcgcaaaagatg

SEQ ID NO: 85522 - DNA, 103 bp, Artificial Sequence
  Synthetic Polynucleotide
taatacgactcactatagggtccgatgcggacttggagagagtgacacttaacagaggagaaagtgtatgtctctccaaaacctggcggcagcgcaaaagatg

SEQ ID NO: 85523 - DNA, 103 bp, Artificial Sequence
  Synthetic Polynucleotide
taatacgactcactatagggtggagaagcctccgatgcggacttggagagaacagaggagactctccatgtccgcatcgaacctggcggcagcgcaaaagatg

SEQ ID NO: 85524 - DNA, 103 bp, Artificial Sequence
  Synthetic Polynucleotide
taatacgactcactataggggtaagctctgtggagaagcctccgatgcggaacagaggagaccgcatatgaggcttctcaacctggcggcagcgcaaaagatg

SEQ ID NO: 85525 - DNA, 103 bp, Artificial Sequence
  Synthetic Polynucleotide
taatacgactcactatagggccgatgtccacggccggcgtctctccgttgaacagaggagacaacggatggacgccggcaacctggcggcagcgcaaaagatg

SEQ ID NO: 85526 - DNA, 103 bp, Artificial Sequence
  Synthetic Polynucleotide
taatacgactcactatagggggagtatgaggtaagctctgtggagaagccaacagaggagaggcttcatgacagagcttaacctggcggcagcgcaaaagatg

SEQ ID NO: 85527 - DNA, 103 bp, Artificial Sequence
  Synthetic Polynucleotide
taatacgactcactatagggtggggtcgttggagtatgaggtaagctctgaacagaggagacagagcatgcctcatactaacctggcggcagcgcaaaagatg

SEQ ID NO: 85528 - DNA, 103 bp, Artificial Sequence
  Synthetic Polynucleotide
taatacgactcactatagggggggggcggttggggtcgttggagtatgagaacagaggagactcataatgcaacgacccaacctggcggcagcgcaaaagatg

SEQ ID NO: 85529 - DNA, 103 bp, Artificial Sequence
  Synthetic Polynucleotide
taatacgactcactatagggacgggagtcaggggggcggttggggtcgttaacagaggagaaacgacatgaaccgccccaacctggcggcagcgcaaaagatg

SEQ ID NO: 85530 - DNA, 103 bp, Artificial Sequence
  Synthetic Polynucleotide
taatacgactcactataggggccttgggtgacgggagtcaggggggcggtaacagaggagaaccgccatgctgactcccaacctggcggcagcgcaaaagatg

SEQ ID NO: 85531 - DNA, 103 bp, Artificial Sequence
  Synthetic Polynucleotide
taatacgactcactatagggtgacagaggggccttgggtgacgggagtcaaacagaggagatgactcatgtcacccaagaacctggcggcagcgcaaaagatg

SEQ ID NO: 85532 - DNA, 103 bp, Artificial Sequence
  Synthetic Polynucleotide
taatacgactcactataggggtggttgtgatgacagaggggccttgggtgaacagaggagacacccaatgcccctctgtaacctggcggcagcgcaaaagatg

SEQ ID NO: 85533 - DNA, 103 bp, Artificial Sequence
  Synthetic Polynucleotide
taatacgactcactataggggtgcatgctggtggttgtgatgacagagggaacagaggagaccctctatgatcacaaccaacctggcggcagcgcaaaagatg

SEQ ID NO: 85534 - DNA, 103 bp, Artificial Sequence
  Synthetic Polynucleotide
taatacgactcactataggggtcccaccgtgtgcatgctggtggttgtgaaacagaggagatcacaaatgccagcatgcaacctggcggcagcgcaaaagatg

SEQ ID NO: 85535 - DNA, 103 bp, Artificial Sequence
  Synthetic Polynucleotide
taatacgactcactatagggctgcggatgggtcccaccgtgtgcatgctgaacagaggagacagcatatgcacggtgggaacctggcggcagcgcaaaagatg

SEQ ID NO: 85536 - DNA, 103 bp, Artificial Sequence
  Synthetic Polynucleotide
taatacgactcactataggggtcagctgccccgatgtccacggccggcgtaacagaggagaacgccgatggtggacatcaacctggcggcagcgcaaaagatg

SEQ ID NO: 85537 - DNA, 103 bp, Artificial Sequence
  Synthetic Polynucleotide
taatacgactcactatagggtgagtaccgcctgcggatgggtcccaccgtaacagaggagaacggtgatgcccatccgcaacctggcggcagcgcaaaagatg

SEQ ID NO: 85538 - DNA, 103 bp, Artificial Sequence
  Synthetic Polynucleotide
taatacgactcactatagggtgtatttgtctgagtaccgcctgcggatggaacagaggagaccatccatgggcggtactaacctggcggcagcgcaaaagatg

SEQ ID NO: 85539 - DNA, 103 bp, Artificial Sequence
  Synthetic Polynucleotide
taatacgactcactatagggatgggcacgttgtatttgtctgagtaccgcaacagaggagagcggtaatgagacaaataaacctggcggcagcgcaaaagatg

SEQ ID NO: 85540 - DNA, 103 bp, Artificial Sequence
  Synthetic Polynucleotide
taatacgactcactatagggtgctgacgaaatgggcacgttgtatttgtcaacagaggagagacaaaatgaacgtgcccaacctggcggcagcgcaaaagatg

SEQ ID NO: 85541 - DNA, 103 bp, Artificial Sequence
  Synthetic Polynucleotide
taatacgactcactataggggcgcaatatctgctgacgaaatgggcacgtaacagaggagaacgtgcatgtttcgtcagaacctggcggcagcgcaaaagatg

SEQ ID NO: 85542 - DNA, 103 bp, Artificial Sequence
  Synthetic Polynucleotide
taatacgactcactatagggtcttggttctgcgcaatatctgctgacgaaaacagaggagattcgtcatgagatattgcaacctggcggcagcgcaaaagatg

SEQ ID NO: 85543 - DNA, 103 bp, Artificial Sequence
  Synthetic Polynucleotide
taatacgactcactatagggcttataaaattcttggttctgcgcaatatcaacagaggagagatattatgcagaaccaaaacctggcggcagcgcaaaagatg

SEQ ID NO: 85544 - DNA, 103 bp, Artificial Sequence
  Synthetic Polynucleotide
taatacgactcactatagggcttctgcgttcttataaaattcttggttctaacagaggagaagaaccatgaattttataaacctggcggcagcgcaaaagatg

SEQ ID NO: 85545 - DNA, 103 bp, Artificial Sequence
  Synthetic Polynucleotide
taatacgactcactatagggggtggtctaacttctgcgttcttataaaataacagaggagaattttaatggaacgcagaaacctggcggcagcgcaaaagatg

SEQ ID NO: 85546 - DNA, 103 bp, Artificial Sequence
  Synthetic Polynucleotide
taatacgactcactatagggatatgtaaatggtggtctaacttctgcgttaacagaggagaaacgcaatggttagaccaaacctggcggcagcgcaaaagatg

SEQ ID NO: 85547 - DNA, 103 bp, Artificial Sequence
  Synthetic Polynucleotide
taatacgactcactatagggcgtgggcgaggtcagctgccccgatgtccaaacagaggagatggacaatggggcagctgaacctggcggcagcgcaaaagatg

SEQ ID NO: 85548 - DNA, 103 bp, Artificial Sequence
  Synthetic Polynucleotide
taatacgactcactatagggttaaagatgcatatgtaaatggtggtctaaaacagaggagattagacatgcatttacataacctggcggcagcgcaaaagatg

SEQ ID NO: 85549 - DNA, 103 bp, Artificial Sequence
  Synthetic Polynucleotide
taatacgactcactataggggcctgcctaattaaagatgcatatgtaaataacagaggagaatttacatgtgcatctttaacctggcggcagcgcaaaagatg

SEQ ID NO: 85550 - DNA, 103 bp, Artificial Sequence
  Synthetic Polynucleotide
taatacgactcactatagggttcgagaatggcctgcctaattaaagatgcaacagaggagagcatctatgattaggcagaacctggcggcagcgcaaaagatg

SEQ ID NO: 85551 - DNA, 103 bp, Artificial Sequence
  Synthetic Polynucleotide
taatacgactcactatagggtttctggagattcgagaatggcctgcctaaaacagaggagattaggcatgccattctcgaacctggcggcagcgcaaaagatg

SEQ ID NO: 85552 - DNA, 103 bp, Artificial Sequence
  Synthetic Polynucleotide
taatacgactcactataggggttagctgcttttctggagattcgagaatgaacagaggagacattctatgatctccagaaacctggcggcagcgcaaaagatg

SEQ ID NO: 85553 - DNA, 103 bp, Artificial Sequence
  Synthetic Polynucleotide
taatacgactcactatagggctcatttagtgttagctgcttttctggagaaacagaggagatctccaatgaagcagctaaacctggcggcagcgcaaaagatg

SEQ ID NO: 85554 - DNA, 103 bp, Artificial Sequence
  Synthetic Polynucleotide
taatacgactcactatagggagttatagatctcatttagtgttagctgctaacagaggagaagcagcatgcactaaatgaacctggcggcagcgcaaaagatg

SEQ ID NO: 85555 - DNA, 103 bp, Artificial Sequence
  Synthetic Polynucleotide
taatacgactcactatagggcgtgtgaaccagttatagatctcatttagtaacagaggagaactaaaatggatctataaaacctggcggcagcgcaaaagatg

SEQ ID NO: 85556 - DNA, 103 bp, Artificial Sequence
  Synthetic Polynucleotide
taatacgactcactatagggagcaaacattcgtgtgaaccagttatagataacagaggagaatctatatgtggttcacaaacctggcggcagcgcaaaagatg

SEQ ID NO: 85557 - DNA, 103 bp, Artificial Sequence
  Synthetic Polynucleotide
taatacgactcactataggggtcggaagtaagcaaacattcgtgtgaaccaacagaggagaggttcaatggaatgtttgaacctggcggcagcgcaaaagatg

SEQ ID NO: 85558 - DNA, 103 bp, Artificial Sequence
  Synthetic Polynucleotide
taatacgactcactatagggtgctgctgggcgtgggcgaggtcagctgccaacagaggagaggcagcatgcctcgcccaaacctggcggcagcgcaaaagatg

SEQ ID NO: 85559 - DNA, 103 bp, Artificial Sequence
  Synthetic Polynucleotide
taatacgactcactataggggccgcgttgcgtcggaagtaagcaaacattaacagaggagaaatgttatgttacttccgaacctggcggcagcgcaaaagatg

SEQ ID NO: 85560 - DNA, 103 bp, Artificial Sequence
  Synthetic Polynucleotide
taatacgactcactatagggcttccacgtggccgcgttgcgtcggaagtaaacagaggagatacttcatgcgcaacgcgaacctggcggcagcgcaaaagatg

SEQ ID NO: 85561 - DNA, 103 bp, Artificial Sequence
  Synthetic Polynucleotide
taatacgactcactataggggcactgcattcttccacgtggccgcgttgcaacagaggagagcaacgatgccacgtggaaacctggcggcagcgcaaaagatg

SEQ ID NO: 85562 - DNA, 103 bp, Artificial Sequence
  Synthetic Polynucleotide
taatacgactcactatagggagattatgacgcactgcattcttccacgtgaacagaggagacacgtgatggaatgcagtaacctggcggcagcgcaaaagatg

SEQ ID NO: 85563 - DNA, 103 bp, Artificial Sequence
  Synthetic Polynucleotide
taatacgactcactataggggtgaagactaagattatgacgcactgcattaacagaggagaaatgcaatgcgtcataataacctggcggcagcgcaaaagatg

SEQ ID NO: 85564 - DNA, 103 bp, Artificial Sequence
  Synthetic Polynucleotide
taatacgactcactatagggcaaaacacttgtgaagactaagattatgacaacagaggagagtcataatgttagtcttcaacctggcggcagcgcaaaagatg

SEQ ID NO: 85565 - DNA, 103 bp, Artificial Sequence
  Synthetic Polynucleotide
taatacgactcactatagggtctactcgcacaaaacacttgtgaagactaaacagaggagatagtctatgcaagtgtttaacctggcggcagcgcaaaagatg

SEQ ID NO: 85566 - DNA, 103 bp, Artificial Sequence
  Synthetic Polynucleotide
taatacgactcactatagggtttaacgttttctactcgcacaaaacacttaacagaggagaaagtgtatggtgcgagtaaacctggcggcagcgcaaaagatg

SEQ ID NO: 85567 - DNA, 103 bp, Artificial Sequence
  Synthetic Polynucleotide
taatacgactcactatagggatactgcccctttaacgttttctactcgcaaacagaggagatgcgagatgaaaacgttaaacctggcggcagcgcaaaagatg

SEQ ID NO: 85568 - DNA, 103 bp, Artificial Sequence
  Synthetic Polynucleotide
taatacgactcactatagggtccactgtccatactgcccctttaacgtttaacagaggagaaaacgtatgaggggcagtaacctggcggcagcgcaaaagatg

SEQ ID NO: 85569 - DNA, 103 bp, Artificial Sequence
  Synthetic Polynucleotide
taatacgactcactatagggctgttgctgctgctgctgggcgtgggcgagaacagaggagactcgccatggcccagcagaacctggcggcagcgcaaaagatg

SEQ ID NO: 85570 - DNA, 103 bp, Artificial Sequence
  Synthetic Polynucleotide
taatacgactcactatagggttctacttcatccactgtccatactgccccaacagaggagaggggcaatgtggacagtgaacctggcggcagcgcaaaagatg

SEQ ID NO: 85571 - DNA, 103 bp, Artificial Sequence
  Synthetic Polynucleotide
taatacgactcactataggggtttttggaattctacttcatccactgtccaacagaggagaggacagatgatgaagtagaacctggcggcagcgcaaaagatg

SEQ ID NO: 85572 - DNA, 103 bp, Artificial Sequence
  Synthetic Polynucleotide
taatacgactcactatagggtgtggccttcgtttttggaattctacttcaaacagaggagatgaagtatgattccaaaaaacctggcggcagcgcaaaagatg

SEQ ID NO: 85573 - DNA, 103 bp, Artificial Sequence
  Synthetic Polynucleotide
taatacgactcactatagggactgatcttttgtggccttcgtttttggaaaacagaggagattccaaatgcgaaggccaaacctggcggcagcgcaaaagatg

SEQ ID NO: 85574 - DNA, 103 bp, Artificial Sequence
  Synthetic Polynucleotide
taatacgactcactatagggaagggttaccactgatcttttgtggccttcaacagaggagagaaggcatgaaaagatcaaacctggcggcagcgcaaaagatg

SEQ ID NO: 85575 - DNA, 103 bp, Artificial Sequence
  Synthetic Polynucleotide
taatacgactcactatagggttaataagggaagggttaccactgatctttaacagaggagaaaagatatgtggtaacccaacctggcggcagcgcaaaagatg

SEQ ID NO: 85576 - DNA, 103 bp, Artificial Sequence
  Synthetic Polynucleotide
taatacgactcactatagggctgcatgtttttaataagggaagggttaccaacagaggagaggtaacatgtcccttattaacctggcggcagcgcaaaagatg

SEQ ID NO: 85577 - DNA, 103 bp, Artificial Sequence
  Synthetic Polynucleotide
taatacgactcactatagggcgtggctgctctgcatgtttttaataagggaacagaggagacccttaatgaaaacatgcaacctggcggcagcgcaaaagatg

SEQ ID NO: 85578 - DNA, 103 bp, Artificial Sequence
  Synthetic Polynucleotide
taatacgactcactataggggtgcagtaggcgtggctgctctgcatgtttaacagaggagaaaacatatggagcagccaaacctggcggcagcgcaaaagatg

SEQ ID NO: 85579 - DNA, 103 bp, Artificial Sequence
  Synthetic Polynucleotide
taatacgactcactatagggattgagaggtgtgcagtaggcgtggctgctaacagaggagaagcagcatggcctactgcaacctggcggcagcgcaaaagatg

SEQ ID NO: 85580 - DNA, 103 bp, Artificial Sequence
  Synthetic Polynucleotide
taatacgactcactatagggcctgaagtgcctgttgctgctgctgctgggaacagaggagacccagcatgagcagcaacaacctggcggcagcgcaaaagatg

SEQ ID NO: 85581 - DNA, 103 bp, Artificial Sequence
  Synthetic Polynucleotide
taatacgactcactataggggtaaagctgcattgagaggtgtgcagtaggaacagaggagacctactatgcacctctcaaacctggcggcagcgcaaaagatg

SEQ ID NO: 85582 - DNA, 103 bp, Artificial Sequence
  Synthetic Polynucleotide
taatacgactcactatagggattgaagcctgtaaagctgcattgagaggtaacagaggagaacctctatgtgcagctttaacctggcggcagcgcaaaagatg

SEQ ID NO: 85583 - DNA, 103 bp, Artificial Sequence
  Synthetic Polynucleotide
taatacgactcactatagggattctcagccattgaagcctgtaaagctgcaacagaggagagcagctatgcaggcttcaaacctggcggcagcgcaaaagatg

SEQ ID NO: 85584 - DNA, 103 bp, Artificial Sequence
  Synthetic Polynucleotide
taatacgactcactataggggaggtatactattctcagccattgaagcctaacagaggagaaggcttatgtggctgagaaacctggcggcagcgcaaaagatg

SEQ ID NO: 85585 - DNA, 103 bp, Artificial Sequence
  Synthetic Polynucleotide
taatacgactcactataggggtagtgtatagaggtatactattctcagccaacagaggagaggctgaatgtagtataccaacctggcggcagcgcaaaagatg

SEQ ID NO: 85586 - DNA, 103 bp, Artificial Sequence
  Synthetic Polynucleotide
taatacgactcactatagggcatggaagcggtagtgtatagaggtatactaacagaggagaagtataatgctatacactaacctggcggcagcgcaaaagatg

SEQ ID NO: 85587 - DNA, 103 bp, Artificial Sequence
  Synthetic Polynucleotide
taatacgactcactatagggtgggatttcccatggaagcggtagtgtataaacagaggagatatacaatgccgcttccaaacctggcggcagcgcaaaagatg

SEQ ID NO: 85588 - DNA, 103 bp, Artificial Sequence
  Synthetic Polynucleotide
taatacgactcactatagggttgcccagagtgggatttcccatggaagcgaacagaggagacgcttcatggggaaatccaacctggcggcagcgcaaaagatg

SEQ ID NO: 85589 - DNA, 103 bp, Artificial Sequence
  Synthetic Polynucleotide
taatacgactcactataggggctggctaagttgcccagagtgggatttccaacagaggagaggaaatatgactctgggcaacctggcggcagcgcaaaagatg

SEQ ID NO: 85590 - DNA, 103 bp, Artificial Sequence
  Synthetic Polynucleotide
taatacgactcactatagggcccgtattgcgctggctaagttgcccagagaacagaggagactctggatgacttagccaaacctggcggcagcgcaaaagatg

SEQ ID NO: 85591 - DNA, 103 bp, Artificial Sequence
  Synthetic Polynucleotide
taatacgactcactatagggtgtcttgccacctgaagtgcctgttgctgcaacagaggagagcagcaatgggcacttcaaacctggcggcagcgcaaaagatg

SEQ ID NO: 85592 - DNA, 103 bp, Artificial Sequence
  Synthetic Polynucleotide
taatacgactcactatagggttcagctcttcccgtattgcgctggctaagaacagaggagacttagcatgcgcaatacgaacctggcggcagcgcaaaagatg

SEQ ID NO: 85593 - DNA, 103 bp, Artificial Sequence
  Synthetic Polynucleotide
taatacgactcactatagggcattgccccgttcagctcttcccgtattgcaacagaggagagcaataatggaagagctgaacctggcggcagcgcaaaagatg

SEQ ID NO: 85594 - DNA, 103 bp, Artificial Sequence
  Synthetic Polynucleotide
taatacgactcactatagggtggtatgctccattgccccgttcagctcttaacagaggagaaagagcatgacggggcaaaacctggcggcagcgcaaaagatg

SEQ ID NO: 85595 - DNA, 103 bp, Artificial Sequence
  Synthetic Polynucleotide
taatacgactcactatagggtcgttgctgttggtatgctccattgccccgaacagaggagacggggcatgggagcatacaacctggcggcagcgcaaaagatg

SEQ ID NO: 85596 - DNA, 103 bp, Artificial Sequence
  Synthetic Polynucleotide
taatacgactcactataggggctgtcactctcgttgctgttggtatgctcaacagaggagagagcatatgaacagcaacaacctggcggcagcgcaaaagatg

SEQ ID NO: 85597 - DNA, 103 bp, Artificial Sequence
  Synthetic Polynucleotide
taatacgactcactatagggtgcctggactgctgtcactctcgttgctgtaacagaggagaacagcaatgagagtgacaaacctggcggcagcgcaaaagatg

SEQ ID NO: 85598 - DNA, 103 bp, Artificial Sequence
  Synthetic Polynucleotide
taatacgactcactatagggataggagatctgcctggactgctgtcactcaacagaggagagagtgaatgcagtccaggaacctggcggcagcgcaaaagatg

SEQ ID NO: 85599 - DNA, 103 bp, Artificial Sequence
  Synthetic Polynucleotide
taatacgactcactatagggcacggcttgcataggagatctgcctggactaacagaggagaagtccaatgagatctcctaacctggcggcagcgcaaaagatg

SEQ ID NO: 85600 - DNA, 103 bp, Artificial Sequence
  Synthetic Polynucleotide
taatacgactcactataggggtacaggatgcacggcttgcataggagatcaacagaggagagatctcatgtgcaagccgaacctggcggcagcgcaaaagatg

SEQ ID NO: 85601 - DNA, 103 bp, Artificial Sequence
  Synthetic Polynucleotide
taatacgactcactatagggtctttgacgtgtacaggatgcacggcttgcaacagaggagagcaagcatggcatcctgtaacctggcggcagcgcaaaagatg

SEQ ID NO: 85602 - DNA, 103 bp, Artificial Sequence
  Synthetic Polynucleotide
taatacgactcactatagggaagaaggagctgtcttgccacctgaagtgcaacagaggagagcacttatggtggcaagaaacctggcggcagcgcaaaagatg

SEQ ID NO: 85603 - DNA, 103 bp, Artificial Sequence
  Synthetic Polynucleotide
taatacgactcactataggggaggggctcttctttgacgtgtacaggatgaacagaggagacatcctatgcacgtcaaaaacctggcggcagcgcaaaagatg

SEQ ID NO: 85604 - DNA, 103 bp, Artificial Sequence
  Synthetic Polynucleotide
taatacgactcactatagggcctctggatcgaggggctcttctttgacgtaacagaggagaacgtcaatgaagagccccaacctggcggcagcgcaaaagatg

SEQ ID NO: 85605 - DNA, 103 bp, Artificial Sequence
  Synthetic Polynucleotide
taatacgactcactatagggccttcagcttcctctggatcgaggggctctaacagaggagaagagccatgcgatccagaaacctggcggcagcgcaaaagatg

SEQ ID NO: 85606 - DNA, 103 bp, Artificial Sequence
  Synthetic Polynucleotide
taatacgactcactatagggggacaggggcccttcagcttcctctggatcaacagaggagagatccaatggaagctgaaaacctggcggcagcgcaaaagatg

SEQ ID NO: 85607 - DNA, 103 bp, Artificial Sequence
  Synthetic Polynucleotide
taatacgactcactatagggttgtcactaaggacaggggcccttcagcttaacagaggagaaagctgatgggcccctgtaacctggcggcagcgcaaaagatg

SEQ ID NO: 85608 - DNA, 103 bp, Artificial Sequence
  Synthetic Polynucleotide
taatacgactcactatagggtggttggctgttgtcactaaggacaggggcaacagaggagagcccctatgcttagtgacaacctggcggcagcgcaaaagatg

SEQ ID NO: 85609 - DNA, 103 bp, Artificial Sequence
  Synthetic Polynucleotide
taatacgactcactatagggatctggactgtggttggctgttgtcactaaaacagaggagattagtgatgacagccaacaacctggcggcagcgcaaaagatg

SEQ ID NO: 85610 - DNA, 103 bp, Artificial Sequence
  Synthetic Polynucleotide
taatacgactcactatagggcatggtcaaaatctggactgtggttggctgaacagaggagacagccaatgacagtccagaacctggcggcagcgcaaaagatg

SEQ ID NO: 85611 - DNA, 103 bp, Artificial Sequence
  Synthetic Polynucleotide
taatacgactcactatagggtaatctctgtcatggtcaaaatctggactgaacagaggagacagtccatgttttgaccaaacctggcggcagcgcaaaagatg

SEQ ID NO: 85612 - DNA, 103 bp, Artificial Sequence
  Synthetic Polynucleotide
taatacgactcactatagggttcatcttcgtaatctctgtcatggtcaaaaacagaggagatttgacatggacagagataacctggcggcagcgcaaaagatg

SEQ ID NO: 85613 - DNA, 103 bp, Artificial Sequence
  Synthetic Polynucleotide
taatacgactcactatagggaaccgttactttttgtctcagtcccagattaacagaggagaaatctgatgctgagacaaaacctggcggcagcgcaaaagatg

SEQ ID NO: 85614 - DNA, 103 bp, Artificial Sequence
  Synthetic Polynucleotide
taatacgactcactataggggttgctgctgaagaaggagctgtcttgccaaacagaggagatggcaaatgagctccttcaacctggcggcagcgcaaaagatg

SEQ ID NO: 85615 - DNA, 103 bp, Artificial Sequence
  Synthetic Polynucleotide
taatacgactcactatagggcgtttactggttcatcttcgtaatctctgtaacagaggagaacagagatgacgaagatgaacctggcggcagcgcaaaagatg

SEQ ID NO: 85616 - DNA, 103 bp, Artificial Sequence
  Synthetic Polynucleotide
taatacgactcactatagggtccatgtcctcgtttactggttcatcttcgaacagaggagacgaagaatgaccagtaaaaacctggcggcagcgcaaaagatg

SEQ ID NO: 85617 - DNA, 103 bp, Artificial Sequence
  Synthetic Polynucleotide
taatacgactcactatagggtgctgctgctgttgctgctgaagaaggagcaacagaggagagctcctatgtcagcagcaaacctggcggcagcgcaaaagatg

SEQ ID NO: 85618 - DNA, 103 bp, Artificial Sequence
  Synthetic Polynucleotide
taatacgactcactatagggtccactaacttgctgctgctgttgctgctgaacagaggagacagcagatgcagcagcagaacctggcggcagcgcaaaagatg

SEQ ID NO: 85619 - DNA, 103 bp, Artificial Sequence
  Synthetic Polynucleotide
taatacgactcactataggggagattttaatccactaacttgctgctgctaacagaggagaagcagcatgaagttagtgaacctggcggcagcgcaaaagatg

SEQ ID NO: 85620 - DNA, 103 bp, Artificial Sequence
  Synthetic Polynucleotide
taatacgactcactatagggttcctcttgggagattttaatccactaactaacagaggagaagttagatgattaaaatcaacctggcggcagcgcaaaagatg

SEQ ID NO: 85621 - DNA, 103 bp, Artificial Sequence
  Synthetic Polynucleotide
taatacgactcactatagggttgtttgtcattcctcttgggagattttaaaacagaggagattaaaaatgcccaagaggaacctggcggcagcgcaaaagatg

SEQ ID NO: 85622 - DNA, 103 bp, Artificial Sequence
  Synthetic Polynucleotide
taatacgactcactataggggaagagctggttgtttgtcattcctcttggaacagaggagaccaagaatgatgacaaacaacctggcggcagcgcaaaagatg

SEQ ID NO: 85623 - DNA, 103 bp, Artificial Sequence
  Synthetic Polynucleotide
taatacgactcactatagggacgggaacctgaagagctggttgtttgtcaaacagaggagatgacaaatgaccagctctaacctggcggcagcgcaaaagatg

SEQ ID NO: 85624 - DNA, 103 bp, Artificial Sequence
  Synthetic Polynucleotide
taatacgactcactatagggagccactgacacgggaacctgaagagctggaacagaggagaccagctatgcaggttcccaacctggcggcagcgcaaaagatg

SEQ ID NO: 85625 - DNA, 103 bp, Artificial Sequence
  Synthetic Polynucleotide
taatacgactcactataggggtgtcatcatagccactgacacgggaacctaacagaggagaaggttcatgtgtcagtggaacctggcggcagcgcaaaagatg

SEQ ID NO: 85626 - DNA, 103 bp, Artificial Sequence
  Synthetic Polynucleotide
taatacgactcactatagggtggatggctgaaccgttactttttgtctcaaacagaggagatgagacatgaagtaacggaacctggcggcagcgcaaaagatg

SEQ ID NO: 85627 - DNA, 103 bp, Artificial Sequence
  Synthetic Polynucleotide
taatacgactcactatagggataacttgaggtgtcatcatagccactgacaacagaggagagtcagtatgtatgatgacaacctggcggcagcgcaaaagatg

SEQ ID NO: 85628 - DNA, 103 bp, Artificial Sequence
  Synthetic Polynucleotide
taatacgactcactatagggctggggagtgataacttgaggtgtcatcataacagaggagaatgatgatgcctcaagttaacctggcggcagcgcaaaagatg

SEQ ID NO: 85629 - DNA, 103 bp, Artificial Sequence
  Synthetic Polynucleotide
taatacgactcactataggggctgcatttgctggggagtgataacttgagaacagaggagactcaagatgtcactccccaacctggcggcagcgcaaaagatg

SEQ ID NO: 85630 - DNA, 103 bp, Artificial Sequence
  Synthetic Polynucleotide
taatacgactcactatagggtggaggatctgctgcatttgctggggagtgaacagaggagacactccatggcaaatgcaaacctggcggcagcgcaaaagatg

SEQ ID NO: 85631 - DNA, 103 bp, Artificial Sequence
  Synthetic Polynucleotide
taatacgactcactatagggcacttgttgctggaggatctgctgcatttgaacagaggagacaaatgatgcagatcctcaacctggcggcagcgcaaaagatg

SEQ ID NO: 85632 - DNA, 103 bp, Artificial Sequence
  Synthetic Polynucleotide
taatacgactcactataggggagggctcagcacttgttgctggaggatctaacagaggagaagatccatgagcaacaagaacctggcggcagcgcaaaagatg

SEQ ID NO: 85633 - DNA, 103 bp, Artificial Sequence
  Synthetic Polynucleotide
taatacgactcactatagggtggagctgctgagggctcagcacttgttgcaacagaggagagcaacaatggctgagcccaacctggcggcagcgcaaaagatg

SEQ ID NO: 85634 - DNA, 103 bp, Artificial Sequence
  Synthetic Polynucleotide
taatacgactcactataggggaggagaacctggagctgctgagggctcagaacagaggagactgagcatgcagcagctcaacctggcggcagcgcaaaagatg

SEQ ID NO: 85635 - DNA, 103 bp, Artificial Sequence
  Synthetic Polynucleotide
taatacgactcactataggggctgctgctggaggagaacctggagctgctaacagaggagaagcagcatgaggttctccaacctggcggcagcgcaaaagatg

SEQ ID NO: 85636 - DNA, 103 bp, Artificial Sequence
  Synthetic Polynucleotide
taatacgactcactatagggatgagggcctgctgctgctggaggagaaccaacagaggagaggttctatgccagcagcaaacctggcggcagcgcaaaagatg

SEQ ID NO: 85637 - DNA, 103 bp, Artificial Sequence
  Synthetic Polynucleotide
taatacgactcactatagggcgacccattctggatggctgaaccgttactaacagaggagaagtaacatgtcagccatcaacctggcggcagcgcaaaagatg

SEQ ID NO: 85638 - DNA, 103 bp, Artificial Sequence
  Synthetic Polynucleotide
taatacgactcactatagggctgttgaagcatgagggcctgctgctgctgaacagaggagacagcagatgcaggccctcaacctggcggcagcgcaaaagatg

SEQ ID NO: 85639 - DNA, 103 bp, Artificial Sequence
  Synthetic Polynucleotide
taatacgactcactataggggaagctgctgctgttgaagcatgagggcctaacagaggagaaggcccatgtgcttcaacaacctggcggcagcgcaaaagatg

SEQ ID NO: 85640 - DNA, 103 bp, Artificial Sequence
  Synthetic Polynucleotide
taatacgactcactatagggtaaaactcttgaagctgctgctgttgaagcaacagaggagagcttcaatggcagcagctaacctggcggcagcgcaaaagatg

SEQ ID NO: 85641 - DNA, 103 bp, Artificial Sequence
  Synthetic Polynucleotide
taatacgactcactatagggttgttttttataaaactcttgaagctgctgaacagaggagacagcagatgcaagagtttaacctggcggcagcgcaaaagatg

SEQ ID NO: 85642 - DNA, 103 bp, Artificial Sequence
  Synthetic Polynucleotide
taatacgactcactatagggactgttcctgttgttttttataaaactcttaacagaggagaaagagtatgataaaaaacaacctggcggcagcgcaaaagatg

SEQ ID NO: 85643 - DNA, 103 bp, Artificial Sequence
  Synthetic Polynucleotide
taatacgactcactatagggtgaagctgcaactgttcctgttgttttttaaacagaggagataaaaaatgacaggaacaaacctggcggcagcgcaaaagatg

SEQ ID NO: 85644 - DNA, 103 bp, Artificial Sequence
  Synthetic Polynucleotide
taatacgactcactatagggttgtaaaagttgaagctgcaactgttcctgaacagaggagacaggaaatgttgcagcttaacctggcggcagcgcaaaagatg

SEQ ID NO: 85645 - DNA, 103 bp, Artificial Sequence
  Synthetic Polynucleotide
taatacgactcactatagggcatgttgttgttgtaaaagttgaagctgcaaacagaggagatgcagcatgaacttttacaacctggcggcagcgcaaaagatg

SEQ ID NO: 85646 - DNA, 103 bp, Artificial Sequence
  Synthetic Polynucleotide
taatacgactcactatagggtgttttccagcatgttgttgttgtaaaagtaacagaggagaacttttatgacaacaacaaacctggcggcagcgcaaaagatg

SEQ ID NO: 85647 - DNA, 103 bp, Artificial Sequence
  Synthetic Polynucleotide
taatacgactcactatagggctctttaggctgttttccagcatgttgttgaacagaggagacaacaaatggctggaaaaaacctggcggcagcgcaaaagatg

SEQ ID NO: 85648 - DNA, 103 bp, Artificial Sequence
  Synthetic Polynucleotide
taatacgactcactatagggtgctgccgcccgacccattctggatggctgaacagaggagacagccaatgagaatgggtaacctggcggcagcgcaaaagatg

SEQ ID NO: 85649 - DNA, 103 bp, Artificial Sequence
  Synthetic Polynucleotide
taatacgactcactatagggcctgctgttgctctttaggctgttttccagaacagaggagactggaaatgagcctaaagaacctggcggcagcgcaaaagatg

SEQ ID NO: 85650 - DNA, 103 bp, Artificial Sequence
  Synthetic Polynucleotide
taatacgactcactatagggtgggtagccacctgctgttgctctttaggcaacagaggagagcctaaatggcaacagcaaacctggcggcagcgcaaaagatg

SEQ ID NO: 85651 - DNA, 103 bp, Artificial Sequence
  Synthetic Polynucleotide
taatacgactcactatagggagccaactgctgggtagccacctgctgttgaacagaggagacaacagatggtggctaccaacctggcggcagcgcaaaagatg

SEQ ID NO: 85652 - DNA, 103 bp, Artificial Sequence
  Synthetic Polynucleotide
taatacgactcactataggggctgctgaaaagccaactgctgggtagccaaacagaggagatggctaatgagcagttggaacctggcggcagcgcaaaagatg

SEQ ID NO: 85653 - DNA, 103 bp, Artificial Sequence
  Synthetic Polynucleotide
taatacgactcactatagggtgtaaaagctgctgctgaaaagccaactgcaacagaggagagcagttatgttttcagcaaacctggcggcagcgcaaaagatg

SEQ ID NO: 85654 - DNA, 103 bp, Artificial Sequence
  Synthetic Polynucleotide
taatacgactcactatagggctgctgcatctgtaaaagctgctgctgaaaaacagaggagatttcagatgcagcttttaaacctggcggcagcgcaaaagatg

SEQ ID NO: 85655 - DNA, 103 bp, Artificial Sequence
  Synthetic Polynucleotide
taatacgactcactataggggctgctgtaactgctgcatctgtaaaagctaacagaggagaagctttatgagatgcagcaacctggcggcagcgcaaaagatg

SEQ ID NO: 85656 - DNA, 103 bp, Artificial Sequence
  Synthetic Polynucleotide
taatacgactcactatagggaggaggtgctgctgctgtaactgctgcatcaacagaggagagatgcaatggttacagcaaacctggcggcagcgcaaaagatg

SEQ ID NO: 85657 - DNA, 103 bp, Artificial Sequence
  Synthetic Polynucleotide
taatacgactcactatagggctgcaaagacaggaggtgctgctgctgtaaaacagaggagattacagatgcagcacctcaacctggcggcagcgcaaaagatg

SEQ ID NO: 85658 - DNA, 103 bp, Artificial Sequence
  Synthetic Polynucleotide
taatacgactcactatagggggccttggcgctgcaaagacaggaggtgctaacagaggagaagcaccatgtgtctttgcaacctggcggcagcgcaaaagatg

SEQ ID NO: 85659 - DNA, 103 bp, Artificial Sequence
  Synthetic Polynucleotide
taatacgactcactatagggagtaagtggttgctgccgcccgacccattcaacagaggagagaatggatggggcggcagaacctggcggcagcgcaaaagatg

SEQ ID NO: 85660 - DNA, 103 bp, Artificial Sequence
  Synthetic Polynucleotide
taatacgactcactatagggattgtcagaaggccttggcgctgcaaagacaacagaggagagtctttatggcgccaaggaacctggcggcagcgcaaaagatg

SEQ ID NO: 85661 - DNA, 103 bp, Artificial Sequence
  Synthetic Polynucleotide
taatacgactcactatagggcccgggctgaattgtcagaaggccttggcgaacagaggagacgccaaatgcttctgacaaacctggcggcagcgcaaaagatg

SEQ ID NO: 85662 - DNA, 103 bp, Artificial Sequence
  Synthetic Polynucleotide
taatacgactcactataggggggcaggctgcccgggctgaattgtcagaaaacagaggagattctgaatgttcagcccgaacctggcggcagcgcaaaagatg

SEQ ID NO: 85663 - DNA, 103 bp, Artificial Sequence
  Synthetic Polynucleotide
taatacgactcactatagggtgaaggggaagggcaggctgcccgggctgaaacagaggagatcagccatggcagcctgcaacctggcggcagcgcaaaagatg

SEQ ID NO: 85664 - DNA, 103 bp, Artificial Sequence
  Synthetic Polynucleotide
taatacgactcactatagggagcaagaggttgaaggggaagggcaggctgaacagaggagacagcctatgcttccccttaacctggcggcagcgcaaaagatg

SEQ ID NO: 85665 - DNA, 103 bp, Artificial Sequence
  Synthetic Polynucleotide
taatacgactcactatagggtcatgccttgagcaagaggttgaaggggaaaacagaggagattccccatgaacctcttgaacctggcggcagcgcaaaagatg

SEQ ID NO: 85666 - DNA, 103 bp, Artificial Sequence
  Synthetic Polynucleotide
taatacgactcactatagggtctgttggaatcatgccttgagcaagaggtaacagaggagaacctctatgtcaaggcataacctggcggcagcgcaaaagatg

SEQ ID NO: 85667 - DNA, 103 bp, Artificial Sequence
  Synthetic Polynucleotide
taatacgactcactatagggctgctgcagttctgttggaatcatgccttgaacagaggagacaaggcatgattccaacaaacctggcggcagcgcaaaagatg

SEQ ID NO: 85668 - DNA, 103 bp, Artificial Sequence
  Synthetic Polynucleotide
taatacgactcactatagggctttccagagctgctgcagttctgttggaaaacagaggagattccaaatgaactgcagcaacctggcggcagcgcaaaagatg

SEQ ID NO: 85669 - DNA, 103 bp, Artificial Sequence
  Synthetic Polynucleotide
taatacgactcactatagggcttgtcacttctttccagagctgctgcagtaacagaggagaactgcaatggctctggaaaacctggcggcagcgcaaaagatg

SEQ ID NO: 85670 - DNA, 103 bp, Artificial Sequence
  Synthetic Polynucleotide
taatacgactcactataggggccgcactctagtaagtggttgctgccgccaacagaggagaggcggcatgaaccacttaaacctggcggcagcgcaaaagatg

SEQ ID NO: 85671 - DNA, 103 bp, Artificial Sequence
  Synthetic Polynucleotide
taatacgactcactatagggagtatgagcacttgtcacttctttccagagaacagaggagactctggatggaagtgacaaacctggcggcagcgcaaaagatg

SEQ ID NO: 85672 - DNA, 103 bp, Artificial Sequence
  Synthetic Polynucleotide
taatacgactcactatagggtttcttctgcagtatgagcacttgtcacttaacagaggagaaagtgaatggtgctcataaacctggcggcagcgcaaaagatg

SEQ ID NO: 85673 - DNA, 103 bp, Artificial Sequence
  Synthetic Polynucleotide
taatacgactcactatagggttgcctgtggtttcttctgcagtatgagcaaacagaggagatgctcaatgtgcagaagaaacctggcggcagcgcaaaagatg

SEQ ID NO: 85674 - DNA, 103 bp, Artificial Sequence
  Synthetic Polynucleotide
taatacgactcactataggggctgtgattgttgcctgtggtttcttctgcaacagaggagagcagaaatgaccacaggcaacctggcggcagcgcaaaagatg

SEQ ID NO: 85675 - DNA, 103 bp, Artificial Sequence
  Synthetic Polynucleotide
taatacgactcactataggggatccaaactgctgtgattgttgcctgtggaacagaggagaccacagatgacaatcacaaacctggcggcagcgcaaaagatg

SEQ ID NO: 85676 - DNA, 103 bp, Artificial Sequence
  Synthetic Polynucleotide
taatacgactcactataggggtcgtggtcagatccaaactgctgtgattgaacagaggagacaatcaatgcagtttggaaacctggcggcagcgcaaaagatg

SEQ ID NO: 85677 - DNA, 103 bp, Artificial Sequence
  Synthetic Polynucleotide
taatacgactcactatagggggagacacatgtcgtggtcagatccaaactaacagaggagaagtttgatgctgaccacgaacctggcggcagcgcaaaagatg

SEQ ID NO: 85678 - DNA, 103 bp, Artificial Sequence
  Synthetic Polynucleotide
taatacgactcactataggggtgcagaggaggagacacatgtcgtggtcaaacagaggagatgaccaatgcatgtgtctaacctggcggcagcgcaaaagatg

SEQ ID NO: 85679 - DNA, 103 bp, Artificial Sequence
  Synthetic Polynucleotide
taatacgactcactataggggtcttggaaggtgcagaggaggagacacataacagaggagaatgtgtatgctcctctgcaacctggcggcagcgcaaaagatg

SEQ ID NO: 85680 - DNA, 103 bp, Artificial Sequence
  Synthetic Polynucleotide
taatacgactcactatagggtattaaggaggtcttggaaggtgcagaggaaacagaggagatcctctatgccttccaagaacctggcggcagcgcaaaagatg

SEQ ID NO: 85681 - DNA, 103 bp, Artificial Sequence
  Synthetic Polynucleotide
taatacgactcactatagggcccgaagaccgccgcactctagtaagtggtaacagaggagaaccactatgtagagtgcgaacctggcggcagcgcaaaagatg

SEQ ID NO: 85682 - DNA, 103 bp, Artificial Sequence
  Synthetic Polynucleotide
taatacgactcactataggggtgggttcattattaaggaggtcttggaagaacagaggagacttccaatgcctccttaaaacctggcggcagcgcaaaagatg

SEQ ID NO: 85683 - DNA, 103 bp, Artificial Sequence
  Synthetic Polynucleotide
taatacgactcactataggggtagaggcatgtgggttcattattaaggagaacagaggagactccttatgaatgaacccaacctggcggcagcgcaaaagatg

SEQ ID NO: 85684 - DNA, 103 bp, Artificial Sequence
  Synthetic Polynucleotide
taatacgactcactatagggctgtccattggtagaggcatgtgggttcataacagaggagaatgaacatgcatgcctctaacctggcggcagcgcaaaagatg

SEQ ID NO: 85685 - DNA, 103 bp, Artificial Sequence
  Synthetic Polynucleotide
taatacgactcactatagggggactgagagctgtccattggtagaggcataacagaggagaatgcctatgccaatggacaacctggcggcagcgcaaaagatg

SEQ ID NO: 85686 - DNA, 103 bp, Artificial Sequence
  Synthetic Polynucleotide
taatacgactcactatagggttgggagtgtggactgagagctgtccattgaacagaggagacaatggatggctctcagtaacctggcggcagcgcaaaagatg

SEQ ID NO: 85687 - DNA, 103 bp, Artificial Sequence
  Synthetic Polynucleotide
taatacgactcactatagggactttcccttttgggagtgtggactgagagaacagaggagactctcaatgcacactcccaacctggcggcagcgcaaaagatg

SEQ ID NO: 85688 - DNA, 103 bp, Artificial Sequence
  Synthetic Polynucleotide
taatacgactcactatagggcatgggacaaactttcccttttgggagtgtaacagaggagaacactcatgaaagggaaaaacctggcggcagcgcaaaagatg

SEQ ID NO: 85689 - DNA, 103 bp, Artificial Sequence
  Synthetic Polynucleotide
taatacgactcactataggggggtgctcctcatgggacaaactttcccttaacagaggagaaagggaatgtttgtcccaaacctggcggcagcgcaaaagatg

SEQ ID NO: 85690 - DNA, 103 bp, Artificial Sequence
  Synthetic Polynucleotide
taatacgactcactatagggatggctatgggggtgctcctcatgggacaaaacagaggagattgtccatggaggagcacaacctggcggcagcgcaaaagatg

SEQ ID NO: 85691 - DNA, 103 bp, Artificial Sequence
  Synthetic Polynucleotide
taatacgactcactatagggcatagagaggatggctatgggggtgctcctaacagaggagaaggagcatgcccatagccaacctggcggcagcgcaaaagatg

SEQ ID NO: 85692 - DNA, 103 bp, Artificial Sequence
  Synthetic Polynucleotide
taatacgactcactataggggaccgcccctcccgaagaccgccgcactctaacagaggagaagagtgatgcggtcttcgaacctggcggcagcgcaaaagatg

SEQ ID NO: 85693 - DNA, 103 bp, Artificial Sequence
  Synthetic Polynucleotide
taatacgactcactatagggacaccatgtccatagagaggatggctatggaacagaggagaccatagatgtcctctctaaacctggcggcagcgcaaaagatg

SEQ ID NO: 85694 - DNA, 103 bp, Artificial Sequence
  Synthetic Polynucleotide
taatacgactcactatagggccacttgcatacaccatgtccatagagaggaacagaggagacctctcatgggacatggtaacctggcggcagcgcaaaagatg

SEQ ID NO: 85695 - DNA, 103 bp, Artificial Sequence
  Synthetic Polynucleotide
taatacgactcactatagggcacagcctggccacttgcatacaccatgtcaacagaggagagacatgatgtatgcaagtaacctggcggcagcgcaaaagatg

SEQ ID NO: 85696 - DNA, 103 bp, Artificial Sequence
  Synthetic Polynucleotide
taatacgactcactatagggcacactgcttcacagcctggccacttgcataacagaggagaatgcaaatggccaggctgaacctggcggcagcgcaaaagatg

SEQ ID NO: 85697 - DNA, 103 bp, Artificial Sequence
  Synthetic Polynucleotide
taatacgactcactataggggaaatcttcgcacactgcttcacagcctggaacagaggagaccaggcatggaagcagtgaacctggcggcagcgcaaaagatg

SEQ ID NO: 85698 - DNA, 103 bp, Artificial Sequence
  Synthetic Polynucleotide
taatacgactcactataggggaaatgattggaaatcttcgcacactgcttaacagaggagaaagcagatggcgaagattaacctggcggcagcgcaaaagatg

SEQ ID NO: 85699 - DNA, 103 bp, Artificial Sequence
  Synthetic Polynucleotide
taatacgactcactatagggagatgttttagaaatgattggaaatcttcgaacagaggagacgaagaatgccaatcattaacctggcggcagcgcaaaagatg

SEQ ID NO: 85700 - DNA, 103 bp, Artificial Sequence
  Synthetic Polynucleotide
taatacgactcactatagggctcactgttgagatgttttagaaatgattgaacagaggagacaatcaatgctaaaacataacctggcggcagcgcaaaagatg

SEQ ID NO: 85701 - DNA, 103 bp, Artificial Sequence
  Synthetic Polynucleotide
taatacgactcactatagggccagcgcatgctcactgttgagatgttttaaacagaggagataaaacatgtcaacagtgaacctggcggcagcgcaaaagatg

SEQ ID NO: 85702 - DNA, 103 bp, Artificial Sequence
  Synthetic Polynucleotide
taatacgactcactatagggcttctatcgtccagcgcatgctcactgttgaacagaggagacaacagatggcatgcgctaacctggcggcagcgcaaaagatg

SEQ ID NO: 85703 - DNA, 103 bp, Artificial Sequence
  Synthetic Polynucleotide
taatacgactcactataggggacgacgagcgcggcgatatcatcatccataacagaggagaatggatatggatatcgccaacctggcggcagcgcaaaagatg

SEQ ID NO: 85704 - DNA, 103 bp, Artificial Sequence
  Synthetic Polynucleotide
taatacgactcactataggggtgcctggggcgccccacgatggaggggaaaacagaggagattccccatgatcgtggggaacctggcggcagcgcaaaagatg

SEQ ID NO: 85705 - DNA, 103 bp, Artificial Sequence
  Synthetic Polynucleotide
taatacgactcactatagggccacacggagtacttgcgctcaggaggagcaacagaggagagctcctatggagcgcaagaacctggcggcagcgcaaaagatg

SEQ ID NO: 85706 - DNA, 103 bp, Artificial Sequence
  Synthetic Polynucleotide
taatacgactcactatagggagccgccgatccacacggagtacttgcgctaacagaggagaagcgcaatgactccgtgtaacctggcggcagcgcaaaagatg

SEQ ID NO: 85707 - DNA, 103 bp, Artificial Sequence
  Synthetic Polynucleotide
taatacgactcactataggggccaggatggagccgccgatccacacggagaacagaggagactccgtatggatcggcggaacctggcggcagcgcaaaagatg

SEQ ID NO: 85708 - DNA, 103 bp, Artificial Sequence
  Synthetic Polynucleotide
taatacgactcactatagggggacagcgaggccaggatggagccgccgataacagaggagaatcggcatgtccatcctgaacctggcggcagcgcaaaagatg

SEQ ID NO: 85709 - DNA, 103 bp, Artificial Sequence
  Synthetic Polynucleotide
taatacgactcactataggggctggaaggtggacagcgaggccaggatggaacagaggagaccatccatgcctcgctgtaacctggcggcagcgcaaaagatg

SEQ ID NO: 85710 - DNA, 103 bp, Artificial Sequence
  Synthetic Polynucleotide
taatacgactcactatagggatccacatctgctggaaggtggacagcgagaacagaggagactcgctatgcaccttccaaacctggcggcagcgcaaaagatg

SEQ ID NO: 85711 - DNA, 103 bp, Artificial Sequence
  Synthetic Polynucleotide
taatacgactcactatagggctgcttgctgatccacatctgctggaaggtaacagaggagaaccttcatgcagatgtggaacctggcggcagcgcaaaagatg

SEQ ID NO: 85712 - DNA, 103 bp, Artificial Sequence
  Synthetic Polynucleotide
taatacgactcactatagggcgtcatactcctgcttgctgatccacatctaacagaggagaagatgtatgtcagcaagcaacctggcggcagcgcaaaagatg

SEQ ID NO: 85713 - DNA, 103 bp, Artificial Sequence
  Synthetic Polynucleotide
taatacgactcactataggggggccggactcgtcatactcctgcttgctgaacagaggagacagcaaatgggagtatgaaacctggcggcagcgcaaaagatg

SEQ ID NO: 85714 - DNA, 103 bp, Artificial Sequence
  Synthetic Polynucleotide
taatacgactcactataggggacgatggaggggccggactcgtcatactcaacagaggagagagtatatggagtccggcaacctggcggcagcgcaaaagatg

SEQ ID NO: 85715 - DNA, 103 bp, Artificial Sequence
  Synthetic Polynucleotide
taatacgactcactatagggtcacgccctggtgcctggggcgccccacgaaacagaggagatcgtggatggccccaggcaacctggcggcagcgcaaaagatg

SEQ ID NO: 85716 - DNA, 103 bp, Artificial Sequence
  Synthetic Polynucleotide
taatacgactcactatagggatttgcggtggacgatggaggggccggactaacagaggagaagtccgatgcctccatcgaacctggcggcagcgcaaaagatg

SEQ ID NO: 85717 - DNA, 103 bp, Artificial Sequence
  Synthetic Polynucleotide
taatacgactcactatagggatgcccaccatcacgccctggtgcctggggaacagaggagaccccagatgccagggcgtaacctggcggcagcgcaaaagatg

SEQ ID NO: 85718 - DNA, 103 bp, Artificial Sequence
  Synthetic Polynucleotide
taatacgactcactatagggcttctgacccatgcccaccatcacgccctgaacagaggagacagggcatgatggtgggcaacctggcggcagcgcaaaagatg

SEQ ID NO: 85719 - DNA, 103 bp, Artificial Sequence
  Synthetic Polynucleotide
taatacgactcactatagggcataggaatccttctgacccatgcccaccaaacagaggagatggtggatgtgggtcagaaacctggcggcagcgcaaaagatg

SEQ ID NO: 85720 - DNA, 103 bp, Artificial Sequence
  Synthetic Polynucleotide
taatacgactcactatagggtcgtcgcccacataggaatccttctgacccaacagaggagagggtcaatgggattcctaaacctggcggcagcgcaaaagatg

SEQ ID NO: 85721 - DNA, 103 bp, Artificial Sequence
  Synthetic Polynucleotide
taatacgactcactataggggctctgggcctcgtcgcccacataggaatcaacagaggagagattccatggtgggcgacaacctggcggcagcgcaaaagatg

SEQ ID NO: 85722 - DNA, 103 bp, Artificial Sequence
  Synthetic Polynucleotide
taatacgactcactatagggtgcctctcttgctctgggcctcgtcgcccaaacagaggagatgggcgatgaggcccagaaacctggcggcagcgcaaaagatg

SEQ ID NO: 85723 - DNA, 103 bp, Artificial Sequence
  Synthetic Polynucleotide
taatacgactcactatagggagggtgaggatgcctctcttgctctgggccaacagaggagaggcccaatgcaagagaggaacctggcggcagcgcaaaagatg

SEQ ID NO: 85724 - DNA, 103 bp, Artificial Sequence
  Synthetic Polynucleotide
taatacgactcactatagggggggtacttcagggtgaggatgcctctcttaacagaggagaaagagaatgatcctcaccaacctggcggcagcgcaaaagatg

SEQ ID NO: 85725 - DNA, 103 bp, Artificial Sequence
  Synthetic Polynucleotide
taatacgactcactatagggagccgttgtcgacgacgagcgcggcgatataacagaggagaatatcgatgcgctcgtcgaacctggcggcagcgcaaaagatg

SEQ ID NO: 85726 - DNA, 103 bp, Artificial Sequence
  Synthetic Polynucleotide
taatacgactcactatagggcgtgctcgatggggtacttcagggtgaggaaacagaggagatcctcaatgtgaagtaccaacctggcggcagcgcaaaagatg

SEQ ID NO: 85727 - DNA, 103 bp, Artificial Sequence
  Synthetic Polynucleotide
taatacgactcactataggggtgacgatgccgtgctcgatggggtacttcaacagaggagagaagtaatgcatcgagcaaacctggcggcagcgcaaaagatg

SEQ ID NO: 85728 - DNA, 103 bp, Artificial Sequence
  Synthetic Polynucleotide
taatacgactcactataggggtcccagttggtgacgatgccgtgctcgataacagaggagaatcgagatgggcatcgtcaacctggcggcagcgcaaaagatg

SEQ ID NO: 85729 - DNA, 103 bp, Artificial Sequence
  Synthetic Polynucleotide
taatacgactcactatagggtctccatgtcgtcccagttggtgacgatgcaacagaggagagcatcgatgccaactgggaacctggcggcagcgcaaaagatg

SEQ ID NO: 85730 - DNA, 103 bp, Artificial Sequence
  Synthetic Polynucleotide
taatacgactcactatagggtgccagattttctccatgtcgtcccagttgaacagaggagacaactgatgcgacatggaaacctggcggcagcgcaaaagatg

SEQ ID NO: 85731 - DNA, 103 bp, Artificial Sequence
  Synthetic Polynucleotide
taatacgactcactataggggaaggtgtggtgccagattttctccatgtcaacagaggagagacatgatgaaaatctggaacctggcggcagcgcaaaagatg

SEQ ID NO: 85732 - DNA, 103 bp, Artificial Sequence
  Synthetic Polynucleotide
taatacgactcactataggggctcattgtagaaggtgtggtgccagatttaacagaggagaaaatctatgaccacacctaacctggcggcagcgcaaaagatg

SEQ ID NO: 85733 - DNA, 103 bp, Artificial Sequence
  Synthetic Polynucleotide
taatacgactcactataggggccacacgcagctcattgtagaaggtgtggaacagaggagaccacacatgctacaatgaaacctggcggcagcgcaaaagatg

SEQ ID NO: 85734 - DNA, 103 bp, Artificial Sequence
  Synthetic Polynucleotide
taatacgactcactatagggctcctcgggagccacacgcagctcattgtaaacagaggagatacaatatgctgcgtgtgaacctggcggcagcgcaaaagatg

SEQ ID NO: 85735 - DNA, 103 bp, Artificial Sequence
  Synthetic Polynucleotide
taatacgactcactataggggcacggggtgctcctcgggagccacacgcaaacagaggagatgcgtgatgctcccgaggaacctggcggcagcgcaaaagatg

SEQ ID NO: 85736 - DNA, 103 bp, Artificial Sequence
  Synthetic Polynucleotide
taatacgactcactatagggcacatgccggagccgttgtcgacgacgagcaacagaggagagctcgtatgcgacaacggaacctggcggcagcgcaaaagatg

SEQ ID NO: 85737 - DNA, 103 bp, Artificial Sequence
  Synthetic Polynucleotide
taatacgactcactatagggtcggtcagcagcacggggtgctcctcgggaaacagaggagatcccgaatggcaccccgtaacctggcggcagcgcaaaagatg

SEQ ID NO: 85738 - DNA, 103 bp, Artificial Sequence
  Synthetic Polynucleotide
taatacgactcactatagggcaggggggcctcggtcagcagcacggggtgaacagaggagacaccccatgctgctgaccaacctggcggcagcgcaaaagatg

SEQ ID NO: 85739 - DNA, 103 bp, Artificial Sequence
  Synthetic Polynucleotide
taatacgactcactatagggccttggggttcaggggggcctcggtcagcaaacagaggagatgctgaatgaggccccccaacctggcggcagcgcaaaagatg

SEQ ID NO: 85740 - DNA, 103 bp, Artificial Sequence
  Synthetic Polynucleotide
taatacgactcactatagggtcgcggttggccttggggttcaggggggccaacagaggagaggccccatggaaccccaaaacctggcggcagcgcaaaagatg

SEQ ID NO: 85741 - DNA, 103 bp, Artificial Sequence
  Synthetic Polynucleotide
taatacgactcactatagggggtcatcttctcgcggttggccttggggttaacagaggagaaaccccatggccaaccgcaacctggcggcagcgcaaaagatg

SEQ ID NO: 85742 - DNA, 103 bp, Artificial Sequence
  Synthetic Polynucleotide
taatacgactcactatagggacatgatctgggtcatcttctcgcggttggaacagaggagaccaaccatgagaagatgaaacctggcggcagcgcaaaagatg

SEQ ID NO: 85743 - DNA, 103 bp, Artificial Sequence
  Synthetic Polynucleotide
taatacgactcactatagggaaggtctcaaacatgatctgggtcatcttcaacagaggagagaagatatgccagatcataacctggcggcagcgcaaaagatg

SEQ ID NO: 85744 - DNA, 103 bp, Artificial Sequence
  Synthetic Polynucleotide
taatacgactcactatagggtggggtgttgaaggtctcaaacatgatctgaacagaggagacagatcatgtttgagaccaacctggcggcagcgcaaaagatg

SEQ ID NO: 85745 - DNA, 103 bp, Artificial Sequence
  Synthetic Polynucleotide
taatacgactcactatagggcgtacatggctggggtgttgaaggtctcaaaacagaggagattgagaatgtcaacacccaacctggcggcagcgcaaaagatg

SEQ ID NO: 85746 - DNA, 103 bp, Artificial Sequence
  Synthetic Polynucleotide
taatacgactcactatagggtggatagcaacgtacatggctggggtgttgaacagaggagacaacacatgagccatgtaaacctggcggcagcgcaaaagatg

SEQ ID NO: 85747 - DNA, 103 bp, Artificial Sequence
  Synthetic Polynucleotide
taatacgactcactataggggccggccttgcacatgccggagccgttgtcaacagaggagagacaacatgtccggcatgaacctggcggcagcgcaaaagatg

SEQ ID NO: 85748 - DNA, 103 bp, Artificial Sequence
  Synthetic Polynucleotide
taatacgactcactatagggtagcacagcctggatagcaacgtacatggcaacagaggagagccatgatggttgctatcaacctggcggcagcgcaaaagatg

SEQ ID NO: 85749 - DNA, 103 bp, Artificial Sequence
  Synthetic Polynucleotide
taatacgactcactatagggcgtacagggatagcacagcctggatagcaaaacagaggagattgctaatgaggctgtgcaacctggcggcagcgcaaaagatg

SEQ ID NO: 85750 - DNA, 103 bp, Artificial Sequence
  Synthetic Polynucleotide
taatacgactcactatagggcggccagaggcgtacagggatagcacagccaacagaggagaggctgtatgatccctgtaaacctggcggcagcgcaaaagatg

SEQ ID NO: 85751 - DNA, 103 bp, Artificial Sequence
  Synthetic Polynucleotide
taatacgactcactataggggccagtggtacggccagaggcgtacagggaaacagaggagatccctgatggcctctggcaacctggcggcagcgcaaaagatg

SEQ ID NO: 85752 - DNA, 103 bp, Artificial Sequence
  Synthetic Polynucleotide
taatacgactcactatagggccatcacgatgccagtggtacggccagaggaacagaggagacctctgatggtaccactgaacctggcggcagcgcaaaagatg

SEQ ID NO: 85753 - DNA, 103 bp, Artificial Sequence
  Synthetic Polynucleotide
taatacgactcactatagggtcaccggagtccatcacgatgccagtggtaaacagaggagataccacatgcatcgtgataacctggcggcagcgcaaaagatg

SEQ ID NO: 85754 - DNA, 103 bp, Artificial Sequence
  Synthetic Polynucleotide
taatacgactcactatagggggtgaccccgtcaccggagtccatcacgataacagaggagaatcgtgatggactccggtaacctggcggcagcgcaaaagatg

SEQ ID NO: 85755 - DNA, 103 bp, Artificial Sequence
  Synthetic Polynucleotide
taatacgactcactataggggcacagtgtgggtgaccccgtcaccggagtaacagaggagaactccgatgacggggtcaaacctggcggcagcgcaaaagatg

SEQ ID NO: 85756 - DNA, 103 bp, Artificial Sequence
  Synthetic Polynucleotide
taatacgactcactatagggtcgtagatgggcacagtgtgggtgaccccgaacagaggagacggggtatgccacactgtaacctggcggcagcgcaaaagatg

SEQ ID NO: 85757 - DNA, 103 bp, Artificial Sequence
  Synthetic Polynucleotide
taatacgactcactatagggggcatacccctcgtagatgggcacagtgtgaacagaggagacacactatgcccatctacaacctggcggcagcgcaaaagatg

SEQ ID NO: 85758 - DNA, 103 bp, Artificial Sequence
  Synthetic Polynucleotide
taatacgactcactatagggcgcccgcgaagccggccttgcacatgccggaacagaggagaccggcaatggcaaggccgaacctggcggcagcgcaaaagatg

SEQ ID NO: 85759 - DNA, 103 bp, Artificial Sequence
  Synthetic Polynucleotide
taatacgactcactatagggcatgggggagggcatacccctcgtagatggaacagaggagaccatctatgaggggtatgaacctggcggcagcgcaaaagatg

SEQ ID NO: 85760 - DNA, 103 bp, Artificial Sequence
  Synthetic Polynucleotide
taatacgactcactatagggcgcaggatggcatgggggagggcataccccaacagaggagaggggtaatgcctcccccaaacctggcggcagcgcaaaagatg

SEQ ID NO: 85761 - DNA, 103 bp, Artificial Sequence
  Synthetic Polynucleotide
taatacgactcactatagggcaggtccagacgcaggatggcatgggggagaacagaggagactccccatggccatcctgaacctggcggcagcgcaaaagatg

SEQ ID NO: 85762 - DNA, 103 bp, Artificial Sequence
  Synthetic Polynucleotide
taatacgactcactatagggcccggccagccaggtccagacgcaggatggaacagaggagaccatccatggtctggaccaacctggcggcagcgcaaaagatg

SEQ ID NO: 85763 - DNA, 103 bp, Artificial Sequence
  Synthetic Polynucleotide
taatacgactcactatagggtcagtcaggtcccggccagccaggtccagaaacagaggagatctggaatgggctggccgaacctggcggcagcgcaaaagatg

SEQ ID NO: 85764 - DNA, 103 bp, Artificial Sequence
  Synthetic Polynucleotide
taatacgactcactatagggcatgaggtagtcagtcaggtcccggccagcaacagaggagagctggcatggacctgactaacctggcggcagcgcaaaagatg

SEQ ID NO: 85765 - DNA, 103 bp, Artificial Sequence
  Synthetic Polynucleotide
taatacgactcactatagggtgaggatcttcatgaggtagtcagtcaggtaacagaggagaacctgaatgactacctcaaacctggcggcagcgcaaaagatg

SEQ ID NO: 85766 - DNA, 103 bp, Artificial Sequence
  Synthetic Polynucleotide
taatacgactcactatagggccgcgctcggtgaggatcttcatgaggtagaacagaggagactacctatggaagatcctaacctggcggcagcgcaaaagatg

SEQ ID NO: 85767 - DNA, 103 bp, Artificial Sequence
  Synthetic Polynucleotide
taatacgactcactataggggaagctgtagccgcgctcggtgaggatcttaacagaggagaaagatcatgaccgagcgcaacctggcggcagcgcaaaagatg

SEQ ID NO: 85768 - DNA, 103 bp, Artificial Sequence
  Synthetic Polynucleotide
taatacgactcactatagggccgtggtggtgaagctgtagccgcgctcggaacagaggagaccgagcatggctacagctaacctggcggcagcgcaaaagatg

SEQ ID NO: 85769 - DNA, 103 bp, Artificial Sequence
  Synthetic Polynucleotide
taatacgactcactatagggggggcatcgtcgcccgcgaagccggccttgaacagaggagacaaggcatgcttcgcgggaacctggcggcagcgcaaaagatg

SEQ ID NO: 85770 - DNA, 103 bp, Artificial Sequence
  Synthetic Polynucleotide
taatacgactcactatagggtcccgctcggccgtggtggtgaagctgtagaacagaggagactacagatgcaccaccacaacctggcggcagcgcaaaagatg

SEQ ID NO: 85771 - DNA, 103 bp, Artificial Sequence
  Synthetic Polynucleotide
taatacgactcactatagggacgcacgatttcccgctcggccgtggtggtaacagaggagaaccaccatggccgagcggaacctggcggcagcgcaaaagatg

SEQ ID NO: 85772 - DNA, 103 bp, Artificial Sequence
  Synthetic Polynucleotide
taatacgactcactatagggccttaatgtcacgcacgatttcccgctcggaacagaggagaccgagcatgaaatcgtgcaacctggcggcagcgcaaaagatg

SEQ ID NO: 85773 - DNA, 103 bp, Artificial Sequence
  Synthetic Polynucleotide
taatacgactcactatagggcacagcttctccttaatgtcacgcacgattaacagaggagaaatcgtatgtgacattaaaacctggcggcagcgcaaaagatg

SEQ ID NO: 85774 - DNA, 103 bp, Artificial Sequence
  Synthetic Polynucleotide
taatacgactcactatagggggcgacgtagcacagcttctccttaatgtcaacagaggagagacattatggagaagctgaacctggcggcagcgcaaaagatg

SEQ ID NO: 85775 - DNA, 103 bp, Artificial Sequence
  Synthetic Polynucleotide
taatacgactcactatagggcgaagtccagggcgacgtagcacagcttctaacagaggagaagaagcatggctacgtcgaacctggcggcagcgcaaaagatg

SEQ ID NO: 85776 - DNA, 103 bp, Artificial Sequence
  Synthetic Polynucleotide
taatacgactcactatagggatctcttgctcgaagtccagggcgacgtagaacagaggagactacgtatgcctggacttaacctggcggcagcgcaaaagatg

SEQ ID NO: 85777 - DNA, 103 bp, Artificial Sequence
  Synthetic Polynucleotide
taatacgactcactatagggagccgtggccatctcttgctcgaagtccagaacagaggagactggacatggagcaagagaacctggcggcagcgcaaaagatg

SEQ ID NO: 85778 - DNA, 103 bp, Artificial Sequence
  Synthetic Polynucleotide
taatacgactcactatagggagctggaagcagccgtggccatctcttgctaacagaggagaagcaagatgtggccacggaacctggcggcagcgcaaaagatg

SEQ ID NO: 85779 - DNA, 103 bp, Artificial Sequence
  Synthetic Polynucleotide
taatacgactcactatagggtccagggaggagctggaagcagccgtggccaacagaggagaggccacatgtgcttccagaacctggcggcagcgcaaaagatg

SEQ ID NO: 85780 - DNA, 103 bp, Artificial Sequence
  Synthetic Polynucleotide
taatacgactcactataggggacggcccggggggcatcgtcgcccgcgaaaacagaggagattcgcgatggacgatgccaacctggcggcagcgcaaaagatg

SEQ ID NO: 85781 - DNA, 103 bp, Artificial Sequence
  Synthetic Polynucleotide
taatacgactcactataggggtagctcttctccagggaggagctggaagcaacagaggagagcttccatgtcctccctgaacctggcggcagcgcaaaagatg

SEQ ID NO: 85782 - DNA, 103 bp, Artificial Sequence
  Synthetic Polynucleotide
taatacgactcactatagggcaggcagctcgtagctcttctccagggaggaacagaggagacctcccatgagaagagctaacctggcggcagcgcaaaagatg

SEQ ID NO: 85783 - DNA, 103 bp, Artificial Sequence
  Synthetic Polynucleotide
taatacgactcactatagggacctggccgtcaggcagctcgtagctcttcaacagaggagagaagagatgcgagctgccaacctggcggcagcgcaaaagatg

SEQ ID NO: 85784 - DNA, 103 bp, Artificial Sequence
  Synthetic Polynucleotide
taatacgactcactatagggaatggtgatgacctggccgtcaggcagctcaacagaggagagagctgatggacggccagaacctggcggcagcgcaaaagatg

SEQ ID NO: 85785 - DNA, 103 bp, Artificial Sequence
  Synthetic Polynucleotide
taatacgactcactataggggctcattgccaatggtgatgacctggccgtaacagaggagaacggccatgtcatcaccaaacctggcggcagcgcaaaagatg

SEQ ID NO: 85786 - DNA, 103 bp, Artificial Sequence
  Synthetic Polynucleotide
taatacgactcactatagggcagcggaaccgctcattgccaatggtgatgaacagaggagacatcacatgtggcaatgaaacctggcggcagcgcaaaagatg

SEQ ID NO: 85787 - DNA, 103 bp, Artificial Sequence
  Synthetic Polynucleotide
taatacgactcactatagggtgcctcagggcagcggaaccgctcattgccaacagaggagaggcaatatgcggttccgcaacctggcggcagcgcaaaagatg

SEQ ID NO: 85788 - DNA, 103 bp, Artificial Sequence
  Synthetic Polynucleotide
taatacgactcactataggggctggaagagtgcctcagggcagcggaaccaacagaggagaggttccatggccctgaggaacctggcggcagcgcaaaagatg

SEQ ID NO: 85789 - DNA, 103 bp, Artificial Sequence
  Synthetic Polynucleotide
taatacgactcactatagggaggaaggaaggctggaagagtgcctcagggaacagaggagaccctgaatgactcttccaaacctggcggcagcgcaaaagatg

SEQ ID NO: 85790 - DNA, 103 bp, Artificial Sequence
  Synthetic Polynucleotide
taatacgactcactatagggctccatgcccaggaaggaaggctggaagagaacagaggagactcttcatgccttccttcaacctggcggcagcgcaaaagatg

SEQ ID NO: 85791 - DNA, 103 bp, Artificial Sequence
  Synthetic Polynucleotide
taatacgactcactatagggtggaggggaagacggcccggggggcatcgtaacagaggagaacgatgatgcccgggccgaacctggcggcagcgcaaaagatg

SEQ ID NO: 85792 - DNA, 103 bp, Artificial Sequence
  Synthetic Polynucleotide
taatacgactcactatagggtgccacaggactccatgcccaggaaggaagaacagaggagacttcctatgtgggcatggaacctggcggcagcgcaaaagatg

SEQ ID NO: 85793 - DNA, 103 bp, Artificial Sequence
  Synthetic Polynucleotide
taatacgactcactataggggtttcgtggatgccacaggactccatgcccaacagaggagagggcatatggtcctgtggaacctggcggcagcgcaaaagatg

SEQ ID NO: 85794 - DNA, 103 bp, Artificial Sequence
  Synthetic Polynucleotide
taatacgactcactataggggttgaaggtagtttcgtggatgccacaggaaacagaggagatcctgtatgatccacgaaaacctggcggcagcgcaaaagatg

SEQ ID NO: 85795 - DNA, 103 bp, Artificial Sequence
  Synthetic Polynucleotide
taatacgactcactatagggtcatgatggagttgaaggtagtttcgtggaaacagaggagatccacgatgctaccttcaaacctggcggcagcgcaaaagatg

SEQ ID NO: 85796 - DNA, 103 bp, Artificial Sequence
  Synthetic Polynucleotide
taatacgactcactatagggacgtcacacttcatgatggagttgaaggtaaacagaggagataccttatgctccatcataacctggcggcagcgcaaaagatg

SEQ ID NO: 85797 - DNA, 103 bp, Artificial Sequence
  Synthetic Polynucleotide
taatacgactcactataggggcggatgtccacgtcacacttcatgatggaaacagaggagatccatcatgaagtgtgacaacctggcggcagcgcaaaagatg

SEQ ID NO: 85798 - DNA, 103 bp, Artificial Sequence
  Synthetic Polynucleotide
taatacgactcactatagggacaggtctttgcggatgtccacgtcacactaacagaggagaagtgtgatgtggacatccaacctggcggcagcgcaaaagatg

SEQ ID NO: 85799 - DNA, 103 bp, Artificial Sequence
  Synthetic Polynucleotide
taatacgactcactataggggtgttggcgtacaggtctttgcggatgtccaacagaggagaggacatatgcaaagacctaacctggcggcagcgcaaaagatg

SEQ ID NO: 85800 - DNA, 103 bp, Artificial Sequence
  Synthetic Polynucleotide
taatacgactcactatagggagacagcactgtgttggcgtacaggtctttaacagaggagaaaagacatgtacgccaacaacctggcggcagcgcaaaagatg

SEQ ID NO: 85801 - DNA, 103 bp, Artificial Sequence
  Synthetic Polynucleotide
taatacgactcactatagggtggtgccgccagacagcactgtgttggcgtaacagaggagaacgccaatgcagtgctgtaacctggcggcagcgcaaaagatg

SEQ ID NO: 85802 - DNA, 103 bp, Artificial Sequence
  Synthetic Polynucleotide
taatacgactcactatagggcgccccacgatggaggggaagacggcccggaacagaggagaccgggcatgcttcccctcaacctggcggcagcgcaaaagatg

SEQ ID NO: 85803 - DNA, 103 bp, Artificial Sequence
  Synthetic Polynucleotide
taatacgactcactataggggggtacatggtggtgccgccagacagcactaacagaggagaagtgctatgtggcggcacaacctggcggcagcgcaaaagatg

SEQ ID NO: 85804 - DNA, 103 bp, Artificial Sequence
  Synthetic Polynucleotide
taatacgactcactatagggggcaatgccagggtacatggtggtgccgccaacagaggagaggcggcatgaccatgtacaacctggcggcagcgcaaaagatg

SEQ ID NO: 85805 - DNA, 103 bp, Artificial Sequence
  Synthetic Polynucleotide
taatacgactcactataggggcatcctgtcggcaatgccagggtacatggaacagaggagaccatgtatgctggcattgaacctggcggcagcgcaaaagatg

SEQ ID NO: 85806 - DNA, 103 bp, Artificial Sequence
  Synthetic Polynucleotide
taatacgactcactatagggatctccttctgcatcctgtcggcaatgccaaacagaggagatggcatatgcgacaggataacctggcggcagcgcaaaagatg

SEQ ID NO: 85807 - DNA, 103 bp, Artificial Sequence
  Synthetic Polynucleotide
taatacgactcactatagggcagggcagtgatctccttctgcatcctgtcaacagaggagagacaggatgcagaaggagaacctggcggcagcgcaaaagatg

SEQ ID NO: 85808 - DNA, 103 bp, Artificial Sequence
  Synthetic Polynucleotide
taatacgactcactatagggtgctgggtgccagggcagtgatctccttctaacagaggagaagaaggatgtcactgcccaacctggcggcagcgcaaaagatg

SEQ ID NO: 85809 - DNA, 103 bp, Artificial Sequence
  Synthetic Polynucleotide
taatacgactcactatagggatcttcattgtgctgggtgccagggcagtgaacagaggagacactgcatgggcacccagaacctggcggcagcgcaaaagatg

SEQ ID NO: 85810 - DNA, 103 bp, Artificial Sequence
  Synthetic Polynucleotide
taatacgactcactatagggaatgatcttgatcttcattgtgctgggtgcaacagaggagagcacccatgacaatgaagaacctggcggcagcgcaaaagatg

SEQ ID NO: 85811 - DNA, 103 bp, Artificial Sequence
  Synthetic Polynucleotide
taatacgactcactatagggcaggaggagcaatgatcttgatcttcattgaacagaggagacaatgaatgtcaagatcaaacctggcggcagcgcaaaagatg

SEQ ID NO: 85812 - DNA, 103 bp, Artificial Sequence
  Synthetic Polynucleotide
taatacgactcactatagggtacttgcgctcaggaggagcaatgatcttgaacagaggagacaagatatgtgctcctccaacctggcggcagcgcaaaagatg

SEQ ID NO: 85813 - DNA, 103 bp, Artificial Sequence
  Synthetic Polynucleotide
taatacgactcactatagggtgtgcttccgtcatctctttctaccaccataacagaggagaatggtgatggaaagagataacctggcggcagcgcaaaagatg

SEQ ID NO: 85814 - DNA, 103 bp, Artificial Sequence
  Synthetic Polynucleotide
taatacgactcactatagggcatattctccctcggaacacgcagagcattaacagaggagaaatgctatgcgtgttccgaacctggcggcagcgcaaaagatg

SEQ ID NO: 85815 - DNA, 103 bp, Artificial Sequence
  Synthetic Polynucleotide
taatacgactcactatagggtgcaatcaatttcaaccgcatacttggaggaacagaggagacctccaatgatgcggttgaacctggcggcagcgcaaaagatg

SEQ ID NO: 85816 - DNA, 103 bp, Artificial Sequence
  Synthetic Polynucleotide
taatacgactcactatagggttgtattatttgcaatcaatttcaaccgcaaacagaggagatgcggtatgaattgattgaacctggcggcagcgcaaaagatg

SEQ ID NO: 85817 - DNA, 103 bp, Artificial Sequence
  Synthetic Polynucleotide
taatacgactcactatagggcgttccactgttgtattatttgcaatcaataacagaggagaattgatatgaaataatacaacctggcggcagcgcaaaagatg

SEQ ID NO: 85818 - DNA, 103 bp, Artificial Sequence
  Synthetic Polynucleotide
taatacgactcactataggggctaaacctccgttccactgttgtattattaacagaggagaaataatatgacagtggaaaacctggcggcagcgcaaaagatg

SEQ ID NO: 85819 - DNA, 103 bp, Artificial Sequence
  Synthetic Polynucleotide
taatacgactcactatagggcaatccatgagctaaacctccgttccactgaacagaggagacagtggatgggaggtttaaacctggcggcagcgcaaaagatg

SEQ ID NO: 85820 - DNA, 103 bp, Artificial Sequence
  Synthetic Polynucleotide
taatacgactcactatagggatggagccgccaatccatgagctaaacctcaacagaggagagaggttatgctcatggataacctggcggcagcgcaaaagatg

SEQ ID NO: 85821 - DNA, 103 bp, Artificial Sequence
  Synthetic Polynucleotide
taatacgactcactatagggagaggctagaatggagccgccaatccatgaaacagaggagatcatggatgggcggctccaacctggcggcagcgcaaaagatg

SEQ ID NO: 85822 - DNA, 103 bp, Artificial Sequence
  Synthetic Polynucleotide
taatacgactcactatagggaggtacccaaagaggctagaatggagccgcaacagaggagagcggctatgttctagcctaacctggcggcagcgcaaaagatg

SEQ ID NO: 85823 - DNA, 103 bp, Artificial Sequence
  Synthetic Polynucleotide
taatacgactcactatagggatctgttgaaaggtacccaaagaggctagaaacagaggagatctagcatgtttgggtacaacctggcggcagcgcaaaagatg

SEQ ID NO: 85824 - DNA, 103 bp, Artificial Sequence
  Synthetic Polynucleotide
taatacgactcactatagggggaaatccacatctgttgaaaggtacccaaaacagaggagattgggtatgtttcaacagaacctggcggcagcgcaaaagatg

SEQ ID NO: 85825 - DNA, 103 bp, Artificial Sequence
  Synthetic Polynucleotide
taatacgactcactatagggaaatggcctccatattctccctcggaacacaacagaggagagtgttcatggggagaataaacctggcggcagcgcaaaagatg

SEQ ID NO: 85826 - DNA, 103 bp, Artificial Sequence
  Synthetic Polynucleotide
taatacgactcactatagggattcttgcttggaaatccacatctgttgaaaacagaggagattcaacatgtgtggatttaacctggcggcagcgcaaaagatg

SEQ ID NO: 85827 - DNA, 103 bp, Artificial Sequence
  Synthetic Polynucleotide
taatacgactcactatagggccttcttcatattcttgcttggaaatccacaacagaggagagtggatatgcaagcaagaaacctggcggcagcgcaaaagatg

SEQ ID NO: 85828 - DNA, 103 bp, Artificial Sequence
  Synthetic Polynucleotide
taatacgactcactatagggctgcttccctccttcttcatattcttgcttaacagaggagaaagcaaatgtatgaagaaaacctggcggcagcgcaaaagatg

SEQ ID NO: 85829 - DNA, 103 bp, Artificial Sequence
  Synthetic Polynucleotide
taatacgactcactatagggtttctacacactgcttccctccttcttcataacagaggagaatgaagatggagggaagcaacctggcggcagcgcaaaagatg

SEQ ID NO: 85830 - DNA, 103 bp, Artificial Sequence
  Synthetic Polynucleotide
taatacgactcactataggggggcattttctttctacacactgcttccctaacagaggagaagggaaatggtgtgtagaaacctggcggcagcgcaaaagatg

SEQ ID NO: 85831 - DNA, 103 bp, Artificial Sequence
  Synthetic Polynucleotide
taatacgactcactatagggtttagaggtgaaatggcctccatattctccaacagaggagaggagaaatgggaggccataacctggcggcagcgcaaaagatg

SEQ ID NO: 85832 - DNA, 103 bp, Artificial Sequence
  Synthetic Polynucleotide
taatacgactcactatagggcatcccattttttagaggtgaaatggcctcaacagaggagagaggccatgtcacctctaaacctggcggcagcgcaaaagatg

SEQ ID NO: 85833 - DNA, 103 bp, Artificial Sequence
  Synthetic Polynucleotide
taatacgactcactatagggagtcttcaaccatcccattttttagaggtgaacagaggagacacctcatgaaaatgggaaacctggcggcagcgcaaaagatg

SEQ ID NO: 85834 - DNA, 103 bp, Artificial Sequence
  Synthetic Polynucleotide
taatacgactcactatagggaaactatcccagtcttcaaccatcccatttaacagaggagaaaatggatgggttgaagaaacctggcggcagcgcaaaagatg

SEQ ID NO: 85835 - DNA, 103 bp, Artificial Sequence
  Synthetic Polynucleotide
taatacgactcactatagggaatagcttggaaactatcccagtcttcaacaacagaggagagttgaaatgtgggatagtaacctggcggcagcgcaaaagatg

SEQ ID NO: 85836 - DNA, 103 bp, Artificial Sequence
  Synthetic Polynucleotide
taatacgactcactatagggtatgatccaaaatagcttggaaactatcccaacagaggagagggataatgtccaagctaaacctggcggcagcgcaaaagatg

SEQ ID NO: 85837 - DNA, 103 bp, Artificial Sequence
  Synthetic Polynucleotide
taatacgactcactatagggattttgtaggtatgatccaaaatagcttggaacagaggagaccaagcatgtttggatcaaacctggcggcagcgcaaaagatg

SEQ ID NO: 85838 - DNA, 103 bp, Artificial Sequence
  Synthetic Polynucleotide
taatacgactcactatagggtttgacatgcattttgtaggtatgatccaaaacagaggagattggatatgacctacaaaaacctggcggcagcgcaaaagatg

SEQ ID NO: 85839 - DNA, 103 bp, Artificial Sequence
  Synthetic Polynucleotide
taatacgactcactatagggtttccattaatgtgcttccgtcatctctttaacagaggagaaaagagatgacggaagcaaacctggcggcagcgcaaaagatg

SEQ ID NO: 85840 - DNA, 103 bp, Artificial Sequence
  Synthetic Polynucleotide
taatacgactcactatagggtggcttctgatttgacatgcattttgtaggaacagaggagacctacaatgtgcatgtcaaacctggcggcagcgcaaaagatg

SEQ ID NO: 85841 - DNA, 103 bp, Artificial Sequence
  Synthetic Polynucleotide
taatacgactcactatagggggatggagactggcttctgatttgacatgcaacagaggagagcatgtatgatcagaagcaacctggcggcagcgcaaaagatg

SEQ ID NO: 85842 - DNA, 103 bp, Artificial Sequence
  Synthetic Polynucleotide
taatacgactcactatagggcatgagaacaggatggagactggcttctgaaacagaggagatcagaaatgagtctccataacctggcggcagcgcaaaagatg

SEQ ID NO: 85843 - DNA, 103 bp, Artificial Sequence
  Synthetic Polynucleotide
taatacgactcactataggggtgcctctgacatgagaacaggatggagacaacagaggagagtctccatgctgttctcaaacctggcggcagcgcaaaagatg

SEQ ID NO: 85844 - DNA, 103 bp, Artificial Sequence
  Synthetic Polynucleotide
taatacgactcactataggggtattccacggtgcctctgacatgagaacaaacagaggagatgttctatggtcagaggcaacctggcggcagcgcaaaagatg

SEQ ID NO: 85845 - DNA, 103 bp, Artificial Sequence
  Synthetic Polynucleotide
taatacgactcactatagggctttgctctagtattccacggtgcctctgaaacagaggagatcagagatgccgtggaataacctggcggcagcgcaaaagatg

SEQ ID NO: 85846 - DNA, 103 bp, Artificial Sequence
  Synthetic Polynucleotide
taatacgactcactataggggtttctctctctttgctctagtattccacgaacagaggagacgtggaatgctagagcaaaacctggcggcagcgcaaaagatg

SEQ ID NO: 85847 - DNA, 103 bp, Artificial Sequence
  Synthetic Polynucleotide
taatacgactcactatagggaactctgtcagtttctctctctttgctctaaacagaggagatagagcatggagagagaaaacctggcggcagcgcaaaagatg

SEQ ID NO: 85848 - DNA, 103 bp, Artificial Sequence
  Synthetic Polynucleotide
taatacgactcactatagggttcaaacattaactctgtcagtttctctctaacagaggagaagagagatgctgacagagaacctggcggcagcgcaaaagatg

SEQ ID NO: 85849 - DNA, 103 bp, Artificial Sequence
  Synthetic Polynucleotide
taatacgactcactatagggtgttgtagtgttcaaacattaactctgtcaaacagaggagatgacagatgtaatgtttgaacctggcggcagcgcaaaagatg

SEQ ID NO: 85850 - DNA, 103 bp, Artificial Sequence
  Synthetic Polynucleotide
taatacgactcactatagggtcgccatctatttccattaatgtgcttccgaacagaggagacggaagatgattaatggaaacctggcggcagcgcaaaagatg

SEQ ID NO: 85851 - DNA, 103 bp, Artificial Sequence
  Synthetic Polynucleotide
taatacgactcactatagggaaggcagggatgttgtagtgttcaaacattaacagaggagaaatgttatgacactacaaaacctggcggcagcgcaaaagatg

SEQ ID NO: 85852 - DNA, 103 bp, Artificial Sequence
  Synthetic Polynucleotide
taatacgactcactataggggcaaaggaagaaggcagggatgttgtagtgaacagaggagacactacatgatccctgccaacctggcggcagcgcaaaagatg

SEQ ID NO: 85853 - DNA, 103 bp, Artificial Sequence
  Synthetic Polynucleotide
taatacgactcactatagggctgcagttttgcaaaggaagaaggcagggaaacagaggagatccctgatgtcttcctttaacctggcggcagcgcaaaagatg

SEQ ID NO: 85854 - DNA, 103 bp, Artificial Sequence
  Synthetic Polynucleotide
taatacgactcactataggggctgtcaaaactgcagttttgcaaaggaagaacagaggagacttcctatgcaaaactgcaacctggcggcagcgcaaaagatg

SEQ ID NO: 85855 - DNA, 103 bp, Artificial Sequence
  Synthetic Polynucleotide
taatacgactcactatagggattagcaaatgctgtcaaaactgcagttttaacagaggagaaaaactatggttttgacaaacctggcggcagcgcaaaagatg

SEQ ID NO: 85856 - DNA, 103 bp, Artificial Sequence
  Synthetic Polynucleotide
taatacgactcactatagggtagaacgaccattagcaaatgctgtcaaaaaacagaggagattttgaatgcatttgctaaacctggcggcagcgcaaaagatg

SEQ ID NO: 85857 - DNA, 103 bp, Artificial Sequence
  Synthetic Polynucleotide
taatacgactcactatagggatcagcccagtagaacgaccattagcaaataacagaggagaatttgcatgtggtcgttcaacctggcggcagcgcaaaagatg

SEQ ID NO: 85858 - DNA, 103 bp, Artificial Sequence
  Synthetic Polynucleotide
taatacgactcactatagggactgtccaaaatcagcccagtagaacgaccaacagaggagaggtcgtatgactgggctgaacctggcggcagcgcaaaagatg

SEQ ID NO: 85859 - DNA, 103 bp, Artificial Sequence
  Synthetic Polynucleotide
taatacgactcactataggggagtggctccactgtccaaaatcagcccagaacagaggagactgggcatgttttggacaaacctggcggcagcgcaaaagatg

SEQ ID NO: 85860 - DNA, 103 bp, Artificial Sequence
  Synthetic Polynucleotide
taatacgactcactataggggcagtggtatgagtggctccactgtccaaaaacagaggagatttggaatgtggagccacaacctggcggcagcgcaaaagatg

SEQ ID NO: 85861 - DNA, 103 bp, Artificial Sequence
  Synthetic Polynucleotide
taatacgactcactatagggtttgcctttatcgccatctatttccattaaaacagaggagattaatgatgatagatggcaacctggcggcagcgcaaaagatg

SEQ ID NO: 85862 - DNA, 103 bp, Artificial Sequence
  Synthetic Polynucleotide
taatacgactcactataggggactggaattgcagtggtatgagtggctccaacagaggagaggagccatgcataccactaacctggcggcagcgcaaaagatg

SEQ ID NO: 85863 - DNA, 103 bp, Artificial Sequence
  Synthetic Polynucleotide
taatacgactcactatagggagccatcgtggactggaattgcagtggtataacagaggagaataccaatgcaattccagaacctggcggcagcgcaaaagatg

SEQ ID NO: 85864 - DNA, 103 bp, Artificial Sequence
  Synthetic Polynucleotide
taatacgactcactatagggtgaaggacatagccatcgtggactggaattaacagaggagaaattccatgccacgatggaacctggcggcagcgcaaaagatg

SEQ ID NO: 85865 - DNA, 103 bp, Artificial Sequence
  Synthetic Polynucleotide
taatacgactcactatagggaatgccttgttgaaggacatagccatcgtgaacagaggagacacgatatgtatgtccttaacctggcggcagcgcaaaagatg

SEQ ID NO: 85866 - DNA, 103 bp, Artificial Sequence
  Synthetic Polynucleotide
taatacgactcactataggggggatttcacaatgccttgttgaaggacataacagaggagaatgtccatgaacaaggcaaacctggcggcagcgcaaaagatg

SEQ ID NO: 85867 - DNA, 103 bp, Artificial Sequence
  Synthetic Polynucleotide
taatacgactcactatagggccagcaagaggggatttcacaatgccttgtaacagaggagaacaaggatgtgtgaaatcaacctggcggcagcgcaaaagatg

SEQ ID NO: 85868 - DNA, 103 bp, Artificial Sequence
  Synthetic Polynucleotide
taatacgactcactatagggaataaagtctccagcaagaggggatttcacaacagaggagagtgaaaatgcctcttgctaacctggcggcagcgcaaaagatg

SEQ ID NO: 85869 - DNA, 103 bp, Artificial Sequence
  Synthetic Polynucleotide
taatacgactcactatagggactgcatagtaataaagtctccagcaagagaacagaggagactcttgatggagactttaaacctggcggcagcgcaaaagatg

SEQ ID NO: 85870 - DNA, 103 bp, Artificial Sequence
  Synthetic Polynucleotide
taatacgactcactatagggagttctctgcactgcatagtaataaagtctaacagaggagaagacttatgtactatgcaaacctggcggcagcgcaaaagatg

SEQ ID NO: 85871 - DNA, 103 bp, Artificial Sequence
  Synthetic Polynucleotide
taatacgactcactatagggttcttggaagagttctctgcactgcatagtaacagaggagaactatgatgtgcagagaaaacctggcggcagcgcaaaagatg

SEQ ID NO: 85872 - DNA, 103 bp, Artificial Sequence
  Synthetic Polynucleotide
taatacgactcactataggggaccgccttgtttgcctttatcgccatctaaacagaggagatagatgatgataaaggcaaacctggcggcagcgcaaaagatg

SEQ ID NO: 85873 - DNA, 103 bp, Artificial Sequence
  Synthetic Polynucleotide
taatacgactcactatagggcaatattcatttcttggaagagttctctgcaacagaggagagcagagatgtcttccaagaacctggcggcagcgcaaaagatg

SEQ ID NO: 85874 - DNA, 103 bp, Artificial Sequence
  Synthetic Polynucleotide
taatacgactcactatagggggaaccaattcaatattcatttcttggaagaacagaggagacttccaatgaatgaatataacctggcggcagcgcaaaagatg

SEQ ID NO: 85875 - DNA, 103 bp, Artificial Sequence
  Synthetic Polynucleotide
taatacgactcactatagggcatatatggaggaaccaattcaatattcataacagaggagaatgaatatggaattggttaacctggcggcagcgcaaaagatg

SEQ ID NO: 85876 - DNA, 103 bp, Artificial Sequence
  Synthetic Polynucleotide
taatacgactcactatagggttgatgcaatcatatatggaggaaccaattaacagaggagaaattggatgctccatataaacctggcggcagcgcaaaagatg

SEQ ID NO: 85877 - DNA, 103 bp, Artificial Sequence
  Synthetic Polynucleotide
taatacgactcactatagggacagcttcttttgatgcaatcatatatggaaacagaggagatccataatggattgcatcaacctggcggcagcgcaaaagatg

SEQ ID NO: 85878 - DNA, 103 bp, Artificial Sequence
  Synthetic Polynucleotide
taatacgactcactatagggtccttcacgaacagcttcttttgatgcaataacagaggagaattgcaatgaaagaagctaacctggcggcagcgcaaaagatg

SEQ ID NO: 85879 - DNA, 103 bp, Artificial Sequence
  Synthetic Polynucleotide
taatacgactcactatagggttgctggagatccttcacgaacagcttcttaacagaggagaaagaagatgttcgtgaagaacctggcggcagcgcaaaagatg

SEQ ID NO: 85880 - DNA, 103 bp, Artificial Sequence
  Synthetic Polynucleotide
taatacgactcactatagggcttttccagtttgctggagatccttcacgaaacagaggagatcgtgaatgatctccagcaacctggcggcagcgcaaaagatg

SEQ ID NO: 85881 - DNA, 103 bp, Artificial Sequence
  Synthetic Polynucleotide
taatacgactcactatagggcttctcttttcttttccagtttgctggagaaacagaggagatctccaatgaactggaaaaacctggcggcagcgcaaaagatg

SEQ ID NO: 85882 - DNA, 103 bp, Artificial Sequence
  Synthetic Polynucleotide
taatacgactcactatagggcctgaggcaacttctcttttcttttccagtaacagaggagaactggaatggaaaagagaaacctggcggcagcgcaaaagatg

SEQ ID NO: 85883 - DNA, 103 bp, Artificial Sequence
  Synthetic Polynucleotide
taatacgactcactatagggtagtaggtgggaccgccttgtttgcctttaaacagaggagataaaggatgacaaggcggaacctggcggcagcgcaaaagatg

SEQ ID NO: 85884 - DNA, 103 bp, Artificial Sequence
  Synthetic Polynucleotide
taatacgactcactataggggacctcgtaacctgaggcaacttctcttttaacagaggagaaaaagaatggttgcctcaaacctggcggcagcgcaaaagatg

SEQ ID NO: 85885 - DNA, 103 bp, Artificial Sequence
  Synthetic Polynucleotide
taatacgactcactatagggattgtgccaagacctcgtaacctgaggcaaaacagaggagattgcctatggttacgaggaacctggcggcagcgcaaaagatg

SEQ ID NO: 85886 - DNA, 103 bp, Artificial Sequence
  Synthetic Polynucleotide
taatacgactcactatagggtacacatataattgtgccaagacctcgtaaaacagaggagattacgaatgcttggcacaaacctggcggcagcgcaaaagatg

SEQ ID NO: 85887 - DNA, 103 bp, Artificial Sequence
  Synthetic Polynucleotide
taatacgactcactatagggataacacaattacacatataattgtgccaaaacagaggagattggcaatgttatatgtgaacctggcggcagcgcaaaagatg

SEQ ID NO: 85888 - DNA, 103 bp, Artificial Sequence
  Synthetic Polynucleotide
taatacgactcactatagggaaaatcctggataacacaattacacatataaacagaggagatatatgatgaattgtgttaacctggcggcagcgcaaaagatg

SEQ ID NO: 85889 - DNA, 103 bp, Artificial Sequence
  Synthetic Polynucleotide
taatacgactcactatagggccgaagcttgaaaatcctggataacacaataacagaggagaattgtgatgtccaggattaacctggcggcagcgcaaaagatg

SEQ ID NO: 85890 - DNA, 103 bp, Artificial Sequence
  Synthetic Polynucleotide
taatacgactcactatagggacttgaagtaccgaagcttgaaaatcctggaacagaggagaccaggaatgtcaagcttcaacctggcggcagcgcaaaagatg

SEQ ID NO: 85891 - DNA, 103 bp, Artificial Sequence
  Synthetic Polynucleotide
taatacgactcactatagggtgaatctgacacttgaagtaccgaagcttgaacagaggagacaagctatggtacttcaaaacctggcggcagcgcaaaagatg

SEQ ID NO: 85892 - DNA, 103 bp, Artificial Sequence
  Synthetic Polynucleotide
taatacgactcactatagggcatcataagttgaatctgacacttgaagtaaacagaggagatacttcatgtgtcagattaacctggcggcagcgcaaaagatg

SEQ ID NO: 85893 - DNA, 103 bp, Artificial Sequence
  Synthetic Polynucleotide
taatacgactcactataggggccacttgttcatcataagttgaatctgacaacagaggagagtcagaatgaacttatgaaacctggcggcagcgcaaaagatg

SEQ ID NO: 85894 - DNA, 103 bp, Artificial Sequence
  Synthetic Polynucleotide
taatacgactcactatagggagtatctatgtagtaggtgggaccgccttgaacagaggagacaaggcatgcccacctacaacctggcggcagcgcaaaagatg

SEQ ID NO: 85895 - DNA, 103 bp, Artificial Sequence
  Synthetic Polynucleotide
taatacgactcactatagggcatctgtgcagccacttgttcatcataagtaacagaggagaacttatatggaacaagtgaacctggcggcagcgcaaaagatg

SEQ ID NO: 85896 - DNA, 103 bp, Artificial Sequence
  Synthetic Polynucleotide
taatacgactcactataggggaacagttggcatctgtgcagccacttgttaacagaggagaaacaagatgctgcacagaaacctggcggcagcgcaaaagatg

SEQ ID NO: 85897 - DNA, 103 bp, Artificial Sequence
  Synthetic Polynucleotide
taatacgactcactatagggaattcataatgaacagttggcatctgtgcaaacagaggagatgcacaatggccaactgtaacctggcggcagcgcaaaagatg

SEQ ID NO: 85898 - DNA, 103 bp, Artificial Sequence
  Synthetic Polynucleotide
taatacgactcactataggggccattggggaattcataatgaacagttggaacagaggagaccaactatgcattatgaaaacctggcggcagcgcaaaagatg

SEQ ID NO: 85899 - DNA, 103 bp, Artificial Sequence
  Synthetic Polynucleotide
taatacgactcactatagggcacaattgtagccattggggaattcataataacagaggagaattatgatgtccccaatgaacctggcggcagcgcaaaagatg

SEQ ID NO: 85900 - DNA, 103 bp, Artificial Sequence
  Synthetic Polynucleotide
taatacgactcactataggggcaccaaaatcacaattgtagccattggggaacagaggagaccccaaatgctacaattgaacctggcggcagcgcaaaagatg

SEQ ID NO: 85901 - DNA, 103 bp, Artificial Sequence
  Synthetic Polynucleotide
taatacgactcactatagggtagccgctctgcaccaaaatcacaattgtaaacagaggagatacaatatggattttggtaacctggcggcagcgcaaaagatg

SEQ ID NO: 85902 - DNA, 103 bp, Artificial Sequence
  Synthetic Polynucleotide
taatacgactcactatagggctggaatctttagccgctctgcaccaaaataacagaggagaattttgatgcagagcggcaacctggcggcagcgcaaaagatg

SEQ ID NO: 85903 - DNA, 103 bp, Artificial Sequence
  Synthetic Polynucleotide
taatacgactcactatagggaataatccttctggaatctttagccgctctaacagaggagaagagcgatgaaagattccaacctggcggcagcgcaaaagatg

SEQ ID NO: 85904 - DNA, 103 bp, Artificial Sequence
  Synthetic Polynucleotide
taatacgactcactatagggggaagggtcaaataatccttctggaatcttaacagaggagaaagattatggaaggattaaacctggcggcagcgcaaaagatg

SEQ ID NO: 85905 - DNA, 103 bp, Artificial Sequence
  Synthetic Polynucleotide
taatacgactcactataggggcagagcattagtatctatgtagtaggtggaacagaggagaccacctatgacatagataaacctggcggcagcgcaaaagatg

SEQ ID NO: 85906 - DNA, 103 bp, Artificial Sequence
  Synthetic Polynucleotide
taatacgactcactatagggcctttacattggaagggtcaaataatccttaacagaggagaaaggatatgttgacccttaacctggcggcagcgcaaaagatg

SEQ ID NO: 85907 - DNA, 103 bp, Artificial Sequence
  Synthetic Polynucleotide
taatacgactcactatagggcctgataacccctttacattggaagggtcaaacagaggagatgacccatgcaatgtaaaaacctggcggcagcgcaaaagatg

SEQ ID NO: 85908 - DNA, 103 bp, Artificial Sequence
  Synthetic Polynucleotide
taatacgactcactatagggcattgtgtttcctgataacccctttacattaacagaggagaaatgtaatggggttatcaaacctggcggcagcgcaaaagatg

SEQ ID NO: 85909 - DNA, 103 bp, Artificial Sequence
  Synthetic Polynucleotide
taatacgactcactatagggtgactcctaacattgtgtttcctgataaccaacagaggagaggttatatggaaacacaaaacctggcggcagcgcaaaagatg

SEQ ID NO: 85910 - DNA, 103 bp, Artificial Sequence
  Synthetic Polynucleotide
taatacgactcactatagggacaacatgactgactcctaacattgtgtttaacagaggagaaaacacatggttaggagtaacctggcggcagcgcaaaagatg

SEQ ID NO: 85911 - DNA, 103 bp, Artificial Sequence
  Synthetic Polynucleotide
taatacgactcactatagggacttgtggtgacaacatgactgactcctaaaacagaggagattaggaatgagtcatgttaacctggcggcagcgcaaaagatg

SEQ ID NO: 85912 - DNA, 103 bp, Artificial Sequence
  Synthetic Polynucleotide
taatacgactcactatagggacatcccaacacttgtggtgacaacatgacaacagaggagagtcatgatgtcaccacaaaacctggcggcagcgcaaaagatg

SEQ ID NO: 85913 - DNA, 103 bp, Artificial Sequence
  Synthetic Polynucleotide
taatacgactcactatagggtcaatatcacacatcccaacacttgtggtgaacagaggagacaccacatgtgttgggataacctggcggcagcgcaaaagatg

SEQ ID NO: 85914 - DNA, 103 bp, Artificial Sequence
  Synthetic Polynucleotide
taatacgactcactatagggtggtctgatgtcaatatcacacatcccaacaacagaggagagttgggatgtgtgatattaacctggcggcagcgcaaaagatg

SEQ ID NO: 85915 - DNA, 103 bp, Artificial Sequence
  Synthetic Polynucleotide
taatacgactcactatagggcatagagacctggtctgatgtcaatatcacaacagaggagagtgataatgacatcagacaacctggcggcagcgcaaaagatg

SEQ ID NO: 85916 - DNA, 103 bp, Artificial Sequence
  Synthetic Polynucleotide
taatacgactcactatagggctcggaacacgcagagcattagtatctatgaacagaggagacatagaatgtaatgctctaacctggcggcagcgcaaaagatg

SEQ ID NO: 85917 - DNA, 103 bp, Artificial Sequence
  Synthetic Polynucleotide
taatacgactcactatagggattacactgccatagagacctggtctgatgaacagaggagacatcagatgaggtctctaaacctggcggcagcgcaaaagatg

SEQ ID NO: 85918 - DNA, 103 bp, Artificial Sequence
  Synthetic Polynucleotide
taatacgactcactatagggtcctgccactattacactgccatagagaccaacagaggagaggtctcatgggcagtgtaaacctggcggcagcgcaaaagatg

SEQ ID NO: 85919 - DNA, 103 bp, Artificial Sequence
  Synthetic Polynucleotide
taatacgactcactataggggtgtgtttcctcctgccactattacactgcaacagaggagagcagtgatgtagtggcagaacctggcggcagcgcaaaagatg

SEQ ID NO: 85920 - DNA, 103 bp, Artificial Sequence
  Synthetic Polynucleotide
taatacgactcactatagggctctgtattagtgtgtttcctcctgccactaacagaggagaagtggcatgaggaaacacaacctggcggcagcgcaaaagatg

SEQ ID NO: 85921 - DNA, 103 bp, Artificial Sequence
  Synthetic Polynucleotide
taatacgactcactataggggtcagtaaaactctgtattagtgtgtttccaacagaggagaggaaacatgctaatacagaacctggcggcagcgcaaaagatg

SEQ ID NO: 85922 - DNA, 103 bp, Artificial Sequence
  Synthetic Polynucleotide
taatacgactcactatagggtattcaacctgtcagtaaaactctgtattaaacagaggagataatacatggttttactgaacctggcggcagcgcaaaagatg

SEQ ID NO: 85923 - DNA, 103 bp, Artificial Sequence
  Synthetic Polynucleotide
taatacgactcactataggggacagctctctattcaacctgtcagtaaaaaacagaggagattttacatgcaggttgaaaacctggcggcagcgcaaaagatg

SEQ ID NO: 85924 - DNA, 103 bp, Artificial Sequence
  Synthetic Polynucleotide
taatacgactcactatagggagttttctgagacagctctctattcaacctaacagaggagaaggttgatgagagagctgaacctggcggcagcgcaaaagatg

SEQ ID NO: 85925 - DNA, 103 bp, Artificial Sequence
  Synthetic Polynucleotide
taatacgactcactatagggtacttggaggagttttctgagacagctctcaacagaggagagagagcatgctcagaaaaaacctggcggcagcgcaaaagatg

SEQ ID NO: 85926 - DNA, 103 bp, Artificial Sequence
  Synthetic Polynucleotide
taatacgactcactatagggttcaaccgcatacttggaggagttttctgaaacagaggagatcagaaatgtcctccaagaacctggcggcagcgcaaaagatg

SEQ ID NO: 85927 - DNA, 103 bp, Artificial Sequence
  Synthetic Polynucleotide
taatacgactcactatagggcgactggttcgccgcgtggtagtccaccataacagaggagaatggtgatgtaccacgcgaacctggcggcagcgcaaaagatg

SEQ ID NO: 85928 - DNA, 103 bp, Artificial Sequence
  Synthetic Polynucleotide
taatacgactcactatagggccggtcccagtcgtcctcctgggccatgtaaacagaggagatacatgatgcaggaggacaacctggcggcagcgcaaaagatg

SEQ ID NO: 85929 - DNA, 103 bp, Artificial Sequence
  Synthetic Polynucleotide
taatacgactcactatagggacgccggtagtcgcggaagtcctccagcttaacagaggagaaagctgatggacttccgcaacctggcggcagcgcaaaagatg

SEQ ID NO: 85930 - DNA, 103 bp, Artificial Sequence
  Synthetic Polynucleotide
taatacgactcactataggggcttgtgcacacgccggtagtcgcggaagtaacagaggagaacttccatgactaccggcaacctggcggcagcgcaaaagatg

SEQ ID NO: 85931 - DNA, 103 bp, Artificial Sequence
  Synthetic Polynucleotide
taatacgactcactatagggaccttgggcggcttgtgcacacgccggtagaacagaggagactaccgatgtgtgcacaaaacctggcggcagcgcaaaagatg

SEQ ID NO: 85932 - DNA, 103 bp, Artificial Sequence
  Synthetic Polynucleotide
taatacgactcactatagggcttctcctgcaccttgggcggcttgtgcacaacagaggagagtgcacatgccgcccaagaacctggcggcagcgcaaaagatg

SEQ ID NO: 85933 - DNA, 103 bp, Artificial Sequence
  Synthetic Polynucleotide
taatacgactcactatagggccagctggcacttctcctgcaccttgggcgaacagaggagacgcccaatgtgcaggagaaacctggcggcagcgcaaaagatg

SEQ ID NO: 85934 - DNA, 103 bp, Artificial Sequence
  Synthetic Polynucleotide
taatacgactcactatagggaagttgatctccagctggcacttctcctgcaacagaggagagcaggaatggtgccagctaacctggcggcagcgcaaaagatg

SEQ ID NO: 85935 - DNA, 103 bp, Artificial Sequence
  Synthetic Polynucleotide
taatacgactcactatagggcagcgtgttgaagttgatctccagctggcaaacagaggagatgccagatggagatcaacaacctggcggcagcgcaaaagatg

SEQ ID NO: 85936 - DNA, 103 bp, Artificial Sequence
  Synthetic Polynucleotide
taatacgactcactataggggcttggtctgcagcgtgttgaagttgatctaacagaggagaagatcaatgtcaacacgcaacctggcggcagcgcaaaagatg

SEQ ID NO: 85937 - DNA, 103 bp, Artificial Sequence
  Synthetic Polynucleotide
taatacgactcactatagggctgaggcgcagcttggtctgcagcgtgttgaacagaggagacaacacatggcagaccaaaacctggcggcagcgcaaaagatg

SEQ ID NO: 85938 - DNA, 103 bp, Artificial Sequence
  Synthetic Polynucleotide
taatacgactcactataggggggccggttgctgaggcgcagcttggtctgaacagaggagacagaccatgctgcgcctcaacctggcggcagcgcaaaagatg

SEQ ID NO: 85939 - DNA, 103 bp, Artificial Sequence
  Synthetic Polynucleotide
taatacgactcactataggggcagcaggtcccggtcccagtcgtcctcctaacagaggagaaggaggatgactgggaccaacctggcggcagcgcaaaagatg

SEQ ID NO: 85940 - DNA, 103 bp, Artificial Sequence
  Synthetic Polynucleotide
taatacgactcactataggggcatgaaggcgggccggttgctgaggcgcaaacagaggagatgcgccatggcaaccggcaacctggcggcagcgcaaaagatg

SEQ ID NO: 85941 - DNA, 103 bp, Artificial Sequence
  Synthetic Polynucleotide
taatacgactcactatagggccctcggagggcatgaaggcgggccggttgaacagaggagacaaccgatgcgccttcataacctggcggcagcgcaaaagatg

SEQ ID NO: 85942 - DNA, 103 bp, Artificial Sequence
  Synthetic Polynucleotide
taatacgactcactataggggaccatcttgccctcggagggcatgaaggcaacagaggagagccttcatgccctccgagaacctggcggcagcgcaaaagatg

SEQ ID NO: 85943 - DNA, 103 bp, Artificial Sequence
  Synthetic Polynucleotide
taatacgactcactatagggtgatgtccgagaccatcttgccctcggaggaacagaggagacctccgatggcaagatggaacctggcggcagcgcaaaagatg

SEQ ID NO: 85944 - DNA, 103 bp, Artificial Sequence
  Synthetic Polynucleotide
taatacgactcactatagggcagccattgttgatgtccgagaccatcttgaacagaggagacaagatatgctcggacataacctggcggcagcgcaaaagatg

SEQ ID NO: 85945 - DNA, 103 bp, Artificial Sequence
  Synthetic Polynucleotide
taatacgactcactatagggcaagtgctgccagccattgttgatgtccgaaacagaggagatcggacatgaacaatggcaacctggcggcagcgcaaaagatg

SEQ ID NO: 85946 - DNA, 103 bp, Artificial Sequence
  Synthetic Polynucleotide
taatacgactcactatagggcagcctgctccaagtgctgccagccattgtaacagaggagaacaatgatgggcagcactaacctggcggcagcgcaaaagatg

SEQ ID NO: 85947 - DNA, 103 bp, Artificial Sequence
  Synthetic Polynucleotide
taatacgactcactatagggtagcccttctcagcctgctccaagtgctgcaacagaggagagcagcaatgggagcaggcaacctggcggcagcgcaaaagatg

SEQ ID NO: 85948 - DNA, 103 bp, Artificial Sequence
  Synthetic Polynucleotide
taatacgactcactatagggccactcctcgtagcccttctcagcctgctcaacagaggagagagcagatggagaagggcaacctggcggcagcgcaaaagatg

SEQ ID NO: 85949 - DNA, 103 bp, Artificial Sequence
  Synthetic Polynucleotide
taatacgactcactatagggcattcagcagccactcctcgtagcccttctaacagaggagaagaaggatgacgaggagtaacctggcggcagcgcaaaagatg

SEQ ID NO: 85950 - DNA, 103 bp, Artificial Sequence
  Synthetic Polynucleotide
taatacgactcactataggggccgggtccagcagcaggtcccggtcccagaacagaggagactgggaatgggacctgctaacctggcggcagcgcaaaagatg

SEQ ID NO: 85951 - DNA, 103 bp, Artificial Sequence
  Synthetic Polynucleotide
taatacgactcactatagggctgcggatctcattcagcagccactcctcgaacagaggagacgaggaatggctgctgaaaacctggcggcagcgcaaaagatg

SEQ ID NO: 85952 - DNA, 103 bp, Artificial Sequence
  Synthetic Polynucleotide
taatacgactcactatagggccgctccagcctgcggatctcattcagcagaacagaggagactgctgatggagatccgcaacctggcggcagcgcaaaagatg

SEQ ID NO: 85953 - DNA, 103 bp, Artificial Sequence
  Synthetic Polynucleotide
taatacgactcactatagggggtggtcgagccgctccagcctgcggatctaacagaggagaagatccatgggctggagcaacctggcggcagcgcaaaagatg

SEQ ID NO: 85954 - DNA, 103 bp, Artificial Sequence
  Synthetic Polynucleotide
taatacgactcactatagggttctctgccaggtggtcgagccgctccagcaacagaggagagctggaatggctcgaccaaacctggcggcagcgcaaaagatg

SEQ ID NO: 85955 - DNA, 103 bp, Artificial Sequence
  Synthetic Polynucleotide
taatacgactcactatagggctgccggaacttctctgccaggtggtcgagaacagaggagactcgacatgctggcagagaacctggcggcagcgcaaaagatg

SEQ ID NO: 85956 - DNA, 103 bp, Artificial Sequence
  Synthetic Polynucleotide
taatacgactcactatagggtggaggccttctgccggaacttctctgccaaacagaggagatggcagatgagttccggcaacctggcggcagcgcaaaagatg

SEQ ID NO: 85957 - DNA, 103 bp, Artificial Sequence
  Synthetic Polynucleotide
taatacgactcactataggggcctcgtggatggaggccttctgccggaacaacagaggagagttccgatggaaggcctcaacctggcggcagcgcaaaagatg

SEQ ID NO: 85958 - DNA, 103 bp, Artificial Sequence
  Synthetic Polynucleotide
taatacgactcactataggggtcagtccaggcctcgtggatggaggccttaacagaggagaaaggccatgatccacgagaacctggcggcagcgcaaaagatg

SEQ ID NO: 85959 - DNA, 103 bp, Artificial Sequence
  Synthetic Polynucleotide
taatacgactcactatagggcttccttcccgtcagtccaggcctcgtggaaacagaggagatccacgatgcctggactgaacctggcggcagcgcaaaagatg

SEQ ID NO: 85960 - DNA, 103 bp, Artificial Sequence
  Synthetic Polynucleotide
taatacgactcactatagggttcagcatggcttccttcccgtcagtccagaacagaggagactggacatgcgggaaggaaacctggcggcagcgcaaaagatg

SEQ ID NO: 85961 - DNA, 103 bp, Artificial Sequence
  Synthetic Polynucleotide
taatacgactcactatagggcttctcccaggccgggtccagcagcaggtcaacagaggagagacctgatgctggacccgaacctggcggcagcgcaaaagatg

SEQ ID NO: 85962 - DNA, 103 bp, Artificial Sequence
  Synthetic Polynucleotide
taatacgactcactataggggtcccggtgcttcagcatggcttccttcccaacagaggagagggaagatggccatgctgaacctggcggcagcgcaaaagatg

SEQ ID NO: 85963 - DNA, 103 bp, Artificial Sequence
  Synthetic Polynucleotide
taatacgactcactatagggccgtctcgtagtcccggtgcttcagcatggaacagaggagaccatgcatgagcaccgggaacctggcggcagcgcaaaagatg

SEQ ID NO: 85964 - DNA, 103 bp, Artificial Sequence
  Synthetic Polynucleotide
taatacgactcactataggggatagtgtggccgtctcgtagtcccggtgcaacagaggagagcaccgatgctacgagacaacctggcggcagcgcaaaagatg

SEQ ID NO: 85965 - DNA, 103 bp, Artificial Sequence
  Synthetic Polynucleotide
taatacgactcactatagggtttgatgtccgatagtgtggccgtctcgtaaacagaggagatacgagatggccacactaaacctggcggcagcgcaaaagatg

SEQ ID NO: 85966 - DNA, 103 bp, Artificial Sequence
  Synthetic Polynucleotide
taatacgactcactataggggaatgagggctttgatgtccgatagtgtggaacagaggagaccacacatgcggacatcaaacctggcggcagcgcaaaagatg

SEQ ID NO: 85967 - DNA, 103 bp, Artificial Sequence
  Synthetic Polynucleotide
taatacgactcactatagggtcgtgcttgcgaatgagggctttgatgtccaacagaggagaggacatatgagccctcataacctggcggcagcgcaaaagatg

SEQ ID NO: 85968 - DNA, 103 bp, Artificial Sequence
  Synthetic Polynucleotide
taatacgactcactatagggctcgaaggcctcgtgcttgcgaatgagggcaacagaggagagccctcatgcgcaagcacaacctggcggcagcgcaaaagatg

SEQ ID NO: 85969 - DNA, 103 bp, Artificial Sequence
  Synthetic Polynucleotide
taatacgactcactatagggccaggtcgctctcgaaggcctcgtgcttgcaacagaggagagcaagcatgaggccttcgaacctggcggcagcgcaaaagatg

SEQ ID NO: 85970 - DNA, 103 bp, Artificial Sequence
  Synthetic Polynucleotide
taatacgactcactatagggtggtgcgcagccaggtcgctctcgaaggccaacagaggagaggccttatggagcgacctaacctggcggcagcgcaaaagatg

SEQ ID NO: 85971 - DNA, 103 bp, Artificial Sequence
  Synthetic Polynucleotide
taatacgactcactatagggcacgcggtcctggtgcgcagccaggtcgctaacagaggagaagcgacatggctgcgcacaacctggcggcagcgcaaaagatg

SEQ ID NO: 85972 - DNA, 103 bp, Artificial Sequence
  Synthetic Polynucleotide
taatacgactcactatagggtgcgctgctgcttctcccaggccgggtccaaacagaggagatggaccatgcctgggagaaacctggcggcagcgcaaaagatg

SEQ ID NO: 85973 - DNA, 103 bp, Artificial Sequence
  Synthetic Polynucleotide
taatacgactcactatagggcgatctgctccacgcggtcctggtgcgcagaacagaggagactgcgcatgaggaccgcgaacctggcggcagcgcaaaagatg

SEQ ID NO: 85974 - DNA, 103 bp, Artificial Sequence
  Synthetic Polynucleotide
taatacgactcactataggggcaatggcggcgatctgctccacgcggtccaacagaggagaggaccgatgggagcagataacctggcggcagcgcaaaagatg

SEQ ID NO: 85975 - DNA, 103 bp, Artificial Sequence
  Synthetic Polynucleotide
taatacgactcactataggggagctcctgggcaatggcggcgatctgctcaacagaggagagagcagatggccgccattaacctggcggcagcgcaaaagatg

SEQ ID NO: 85976 - DNA, 103 bp, Artificial Sequence
  Synthetic Polynucleotide
taatacgactcactatagggccagctcgttgagctcctgggcaatggcggaacagaggagaccgccaatgcccaggagcaacctggcggcagcgcaaaagatg

SEQ ID NO: 85977 - DNA, 103 bp, Artificial Sequence
  Synthetic Polynucleotide
taatacgactcactatagggtcgtagtaatccagctcgttgagctcctggaacagaggagaccaggaatgcaacgagctaacctggcggcagcgcaaaagatg

SEQ ID NO: 85978 - DNA, 103 bp, Artificial Sequence
  Synthetic Polynucleotide
taatacgactcactatagggattgtgggagtcgtagtaatccagctcgttaacagaggagaaacgagatggattactacaacctggcggcagcgcaaaagatg

SEQ ID NO: 85979 - DNA, 103 bp, Artificial Sequence
  Synthetic Polynucleotide
taatacgactcactataggggggtgttgacattgtgggagtcgtagtaataacagaggagaattactatgactcccacaaacctggcggcagcgcaaaagatg

SEQ ID NO: 85980 - DNA, 103 bp, Artificial Sequence
  Synthetic Polynucleotide
taatacgactcactatagggttctggcaccgggtgttgacattgtgggagaacagaggagactcccaatgtgtcaacacaacctggcggcagcgcaaaagatg

SEQ ID NO: 85981 - DNA, 103 bp, Artificial Sequence
  Synthetic Polynucleotide
taatacgactcactataggggtcacagatcttctggcaccgggtgttgacaacagaggagagtcaacatgcggtgccagaacctggcggcagcgcaaaagatg

SEQ ID NO: 85982 - DNA, 103 bp, Artificial Sequence
  Synthetic Polynucleotide
taatacgactcactatagggcgtcccactggtcacagatcttctggcaccaacagaggagaggtgccatgagatctgtgaacctggcggcagcgcaaaagatg

SEQ ID NO: 85983 - DNA, 103 bp, Artificial Sequence
  Synthetic Polynucleotide
taatacgactcactataggggtgaaggtcttgcgctgctgcttctcccagaacagaggagactgggaatggcagcagcgaacctggcggcagcgcaaaagatg

SEQ ID NO: 85984 - DNA, 103 bp, Artificial Sequence
  Synthetic Polynucleotide
taatacgactcactataggggagccgagggcgtcccactggtcacagatcaacagaggagagatctgatgccagtgggaaacctggcggcagcgcaaaagatg

SEQ ID NO: 85985 - DNA, 103 bp, Artificial Sequence
  Synthetic Polynucleotide
taatacgactcactatagggatgtgtcagagagccgagggcgtcccactgaacagaggagacagtggatggccctcggcaacctggcggcagcgcaaaagatg

SEQ ID NO: 85986 - DNA, 103 bp, Artificial Sequence
  Synthetic Polynucleotide
taatacgactcactatagggccctgcgactatgtgtcagagagccgagggaacagaggagaccctcgatgctctgacacaacctggcggcagcgcaaaagatg

SEQ ID NO: 85987 - DNA, 103 bp, Artificial Sequence
  Synthetic Polynucleotide
taatacgactcactatagggtccagggcttccctgcgactatgtgtcagaaacagaggagatctgacatgtagtcgcagaacctggcggcagcgcaaaagatg

SEQ ID NO: 85988 - DNA, 103 bp, Artificial Sequence
  Synthetic Polynucleotide
taatacgactcactatagggctctgttttctccagggcttccctgcgactaacagaggagaagtcgcatggaagccctgaacctggcggcagcgcaaaagatg

SEQ ID NO: 85989 - DNA, 103 bp, Artificial Sequence
  Synthetic Polynucleotide
taatacgactcactatagggccagctgcttctctgttttctccagggcttaacagaggagaaagcccatgagaaaacagaacctggcggcagcgcaaaagatg

SEQ ID NO: 85990 - DNA, 103 bp, Artificial Sequence
  Synthetic Polynucleotide
taatacgactcactatagggtcgatggcctccagctgcttctctgttttcaacagaggagagaaaacatggaagcagctaacctggcggcagcgcaaaagatg

SEQ ID NO: 85991 - DNA, 103 bp, Artificial Sequence
  Synthetic Polynucleotide
taatacgactcactataggggtgcagctggtcgatggcctccagctgcttaacagaggagaaagcagatggaggccatcaacctggcggcagcgcaaaagatg

SEQ ID NO: 85992 - DNA, 103 bp, Artificial Sequence
  Synthetic Polynucleotide
taatacgactcactatagggcgtattccaggtgcagctggtcgatggcctaacagaggagaaggccaatgaccagctgcaacctggcggcagcgcaaaagatg

SEQ ID NO: 85993 - DNA, 103 bp, Artificial Sequence
  Synthetic Polynucleotide
taatacgactcactataggggcgcgcttggcgtattccaggtgcagctggaacagaggagaccagctatgcctggaataaacctggcggcagcgcaaaagatg

SEQ ID NO: 85994 - DNA, 103 bp, Artificial Sequence
  Synthetic Polynucleotide
taatacgactcactataggggcaccatgccgtgaaggtcttgcgctgctgaacagaggagacagcagatgaagaccttcaacctggcggcagcgcaaaagatg

SEQ ID NO: 85995 - DNA, 103 bp, Artificial Sequence
  Synthetic Polynucleotide
taatacgactcactataggggaagggggccgcgcgcttggcgtattccagaacagaggagactggaaatggccaagcgcaacctggcggcagcgcaaaagatg

SEQ ID NO: 85996 - DNA, 103 bp, Artificial Sequence
  Synthetic Polynucleotide
taatacgactcactatagggtccagttgttgaagggggccgcgcgcttggaacagaggagaccaagcatgcggccccctaacctggcggcagcgcaaaagatg

SEQ ID NO: 85997 - DNA, 103 bp, Artificial Sequence
  Synthetic Polynucleotide
taatacgactcactataggggcgctctccatccagttgttgaagggggccaacagaggagaggccccatgcaacaactgaacctggcggcagcgcaaaagatg

SEQ ID NO: 85998 - DNA, 103 bp, Artificial Sequence
  Synthetic Polynucleotide
taatacgactcactataggggtcctccatggcgctctccatccagttgttaacagaggagaaacaacatgatggagagcaacctggcggcagcgcaaaagatg

SEQ ID NO: 85999 - DNA, 103 bp, Artificial Sequence
  Synthetic Polynucleotide
taatacgactcactatagggtgtcctggaggtcctccatggcgctctccaaacagaggagatggagaatgccatggaggaacctggcggcagcgcaaaagatg

SEQ ID NO: 86000 - DNA, 103 bp, Artificial Sequence
  Synthetic Polynucleotide
taatacgactcactatagggacgatgaacatgtcctggaggtcctccatgaacagaggagacatggaatgcctccaggaaacctggcggcagcgcaaaagatg

SEQ ID NO: 86001 - DNA, 103 bp, Artificial Sequence
  Synthetic Polynucleotide
taatacgactcactataggggatggtatggacgatgaacatgtcctggagaacagaggagactccagatgatgttcatcaacctggcggcagcgcaaaagatg

SEQ ID NO: 86002 - DNA, 103 bp, Artificial Sequence
  Synthetic Polynucleotide
taatacgactcactatagggcaatctcctcgatggtatggacgatgaacaaacagaggagatgttcaatgtccataccaaacctggcggcagcgcaaaagatg

SEQ ID NO: 86003 - DNA, 103 bp, Artificial Sequence
  Synthetic Polynucleotide
taatacgactcactatagggatcaggccctcaatctcctcgatggtatggaacagaggagaccatacatgcgaggagataacctggcggcagcgcaaaagatg

SEQ ID NO: 86004 - DNA, 103 bp, Artificial Sequence
  Synthetic Polynucleotide
taatacgactcactatagggatgggctgagatcaggccctcaatctcctcaacagaggagagaggagatggagggcctgaacctggcggcagcgcaaaagatg

SEQ ID NO: 86005 - DNA, 103 bp, Artificial Sequence
  Synthetic Polynucleotide
taatacgactcactatagggggtgggagttgcaccatgccgtgaaggtctaacagaggagaagacctatgcggcatggtaacctggcggcagcgcaaaagatg

SEQ ID NO: 86006 - DNA, 103 bp, Artificial Sequence
  Synthetic Polynucleotide
taatacgactcactatagggtgaactggtcatgggctgagatcaggccctaacagaggagaagggccatgtctcagcccaacctggcggcagcgcaaaagatg

SEQ ID NO: 86007 - DNA, 103 bp, Artificial Sequence
  Synthetic Polynucleotide
taatacgactcactatagggagggtggacttgaactggtcatgggctgagaacagaggagactcagcatgtgaccagttaacctggcggcagcgcaaaagatg

SEQ ID NO: 86008 - DNA, 103 bp, Artificial Sequence
  Synthetic Polynucleotide
taatacgactcactatagggggcgtccggcagggtggacttgaactggtcaacagaggagagaccagatgaagtccaccaacctggcggcagcgcaaaagatg

SEQ ID NO: 86009 - DNA, 103 bp, Artificial Sequence
  Synthetic Polynucleotide
taatacgactcactataggggctccctatcggcgtccggcagggtggactaacagaggagaagtccaatgtgccggacgaacctggcggcagcgcaaaagatg

SEQ ID NO: 86010 - DNA, 103 bp, Artificial Sequence
  Synthetic Polynucleotide
taatacgactcactatagggatggcctcgcgctccctatcggcgtccggcaacagaggagagccggaatgcgatagggaaacctggcggcagcgcaaaagatg

SEQ ID NO: 86011 - DNA, 103 bp, Artificial Sequence
  Synthetic Polynucleotide
taatacgactcactataggggatggccaggatggcctcgcgctccctatcaacagaggagagataggatgcgcgaggccaacctggcggcagcgcaaaagatg

SEQ ID NO: 86012 - DNA, 103 bp, Artificial Sequence
  Synthetic Polynucleotide
taatacgactcactatagggcctccttgtggatggccaggatggcctcgcaacagaggagagcgaggatgtcctggccaaacctggcggcagcgcaaaagatg

SEQ ID NO: 86013 - DNA, 103 bp, Artificial Sequence
  Synthetic Polynucleotide
taatacgactcactatagggatcctctgggcctccttgtggatggccaggaacagaggagacctggcatgccacaaggaaacctggcggcagcgcaaaagatg

SEQ ID NO: 86014 - DNA, 103 bp, Artificial Sequence
  Synthetic Polynucleotide
taatacgactcactataggggctctcagcgatcctctgggcctccttgtgaacagaggagacacaagatggcccagaggaacctggcggcagcgcaaaagatg

SEQ ID NO: 86015 - DNA, 103 bp, Artificial Sequence
  Synthetic Polynucleotide
taatacgactcactatagggtgatgtggttgctctcagcgatcctctgggaacagaggagacccagaatgtcgctgagaaacctggcggcagcgcaaaagatg

SEQ ID NO: 86016 - DNA, 103 bp, Artificial Sequence
  Synthetic Polynucleotide
taatacgactcactataggggccttccgcaggtgggagttgcaccatgccaacagaggagaggcatgatgcaactcccaaacctggcggcagcgcaaaagatg

SEQ ID NO: 86017 - DNA, 103 bp, Artificial Sequence
  Synthetic Polynucleotide
taatacgactcactatagggcccgacagcttgatgtggttgctctcagcgaacagaggagacgctgaatgcaaccacataacctggcggcagcgcaaaagatg

SEQ ID NO: 86018 - DNA, 103 bp, Artificial Sequence
  Synthetic Polynucleotide
taatacgactcactatagggggggttgctgcccgacagcttgatgtggttaacagaggagaaaccacatgaagctgtcgaacctggcggcagcgcaaaagatg

SEQ ID NO: 86019 - DNA, 103 bp, Artificial Sequence
  Synthetic Polynucleotide
taatacgactcactatagggcggtggtgtaggggttgctgcccgacagctaacagaggagaagctgtatggcagcaaccaacctggcggcagcgcaaaagatg

SEQ ID NO: 86020 - DNA, 103 bp, Artificial Sequence
  Synthetic Polynucleotide
taatacgactcactatagggtgcggggtgacggtggtgtaggggttgctgaacagaggagacagcaaatgctacaccacaacctggcggcagcgcaaaagatg

SEQ ID NO: 86021 - DNA, 103 bp, Artificial Sequence
  Synthetic Polynucleotide
taatacgactcactataggggttgatgatttgcggggtgacggtggtgtaaacagaggagatacaccatggtcaccccgaacctggcggcagcgcaaaagatg

SEQ ID NO: 86022 - DNA, 103 bp, Artificial Sequence
  Synthetic Polynucleotide
taatacgactcactatagggcccacttggagttgatgatttgcggggtgaaacagaggagatcacccatgaaatcatcaaacctggcggcagcgcaaaagatg

SEQ ID NO: 86023 - DNA, 103 bp, Artificial Sequence
  Synthetic Polynucleotide
taatacgactcactatagggtgcaccttctcccacttggagttgatgattaacagaggagaaatcatatgctccaagtgaacctggcggcagcgcaaaagatg

SEQ ID NO: 86024 - DNA, 103 bp, Artificial Sequence
  Synthetic Polynucleotide
taatacgactcactatagggcaccagctgctgcaccttctcccacttggaaacagaggagatccaagatggagaaggtgaacctggcggcagcgcaaaagatg

SEQ ID NO: 86025 - DNA, 103 bp, Artificial Sequence
  Synthetic Polynucleotide
taatacgactcactatagggcccgttttggcaccagctgctgcaccttctaacagaggagaagaaggatgagcagctggaacctggcggcagcgcaaaagatg

SEQ ID NO: 86026 - DNA, 103 bp, Artificial Sequence
  Synthetic Polynucleotide
taatacgactcactatagggagggcatggtcccgttttggcaccagctgcaacagaggagagcagctatggccaaaacgaacctggcggcagcgcaaaagatg

SEQ ID NO: 86027 - DNA, 103 bp, Artificial Sequence
  Synthetic Polynucleotide
taatacgactcactatagggctgtgtgcctgccttccgcaggtgggagttaacagaggagaaactccatgctgcggaagaacctggcggcagcgcaaaagatg

SEQ ID NO: 86028 - DNA, 103 bp, Artificial Sequence
  Synthetic Polynucleotide
taatacgactcactatagggctcctccaggagggcatggtcccgttttggaacagaggagaccaaaaatggaccatgccaacctggcggcagcgcaaaagatg

SEQ ID NO: 86029 - DNA, 103 bp, Artificial Sequence
  Synthetic Polynucleotide
taatacgactcactataggggcttgctctgctcctccaggagggcatggtaacagaggagaaccatgatgtcctggaggaacctggcggcagcgcaaaagatg

SEQ ID NO: 86030 - DNA, 103 bp, Artificial Sequence
  Synthetic Polynucleotide
taatacgactcactatagggttggactgctgcttgctctgctcctccaggaacagaggagacctggaatggcagagcaaaacctggcggcagcgcaaaagatg

SEQ ID NO: 86031 - DNA, 103 bp, Artificial Sequence
  Synthetic Polynucleotide
taatacgactcactatagggcaggtgctcgttggactgctgcttgctctgaacagaggagacagagcatgcagcagtccaacctggcggcagcgcaaaagatg

SEQ ID NO: 86032 - DNA, 103 bp, Artificial Sequence
  Synthetic Polynucleotide
taatacgactcactatagggactggcggcgcaggtgctcgttggactgctaacagaggagaagcagtatgacgagcaccaacctggcggcagcgcaaaagatg

SEQ ID NO: 86033 - DNA, 103 bp, Artificial Sequence
  Synthetic Polynucleotide
taatacgactcactatagggtggctggcgaactggcggcgcaggtgctcgaacagaggagacgagcaatggcgccgccaaacctggcggcagcgcaaaagatg

SEQ ID NO: 86034 - DNA, 103 bp, Artificial Sequence
  Synthetic Polynucleotide
taatacgactcactatagggaacattggcctggctggcgaactggcggcgaacagaggagacgccgcatgttcgccagcaacctggcggcagcgcaaaagatg

SEQ ID NO: 86035 - DNA, 103 bp, Artificial Sequence
  Synthetic Polynucleotide
taatacgactcactatagggagggccccacaacattggcctggctggcgaaacagaggagatcgccaatgaggccaatgaacctggcggcagcgcaaaagatg

SEQ ID NO: 86036 - DNA, 103 bp, Artificial Sequence
  Synthetic Polynucleotide
taatacgactcactataggggtctggatccagggccccacaacattggccaacagaggagaggccaaatgtgtggggccaacctggcggcagcgcaaaagatg

SEQ ID NO: 86037 - DNA, 103 bp, Artificial Sequence
  Synthetic Polynucleotide
taatacgactcactatagggctccatcttggtctggatccagggccccacaacagaggagagtggggatgtggatccagaacctggcggcagcgcaaaagatg

SEQ ID NO: 86038 - DNA, 103 bp, Artificial Sequence
  Synthetic Polynucleotide
taatacgactcactatagggcgtactggtacgactggttcgccgcgtggtaacagaggagaaccacgatgcgaaccagtaacctggcggcagcgcaaaagatg

SEQ ID NO: 86039 - DNA, 103 bp, Artificial Sequence
  Synthetic Polynucleotide
taatacgactcactatagggtgttctcgatctgtgtgcctgccttccgcaaacagaggagatgcggaatgcaggcacacaacctggcggcagcgcaaaagatg

SEQ ID NO: 86040 - DNA, 103 bp, Artificial Sequence
  Synthetic Polynucleotide
taatacgactcactataggggcccgatctcctccatcttggtctggatccaacagaggagaggatccatgccaagatggaacctggcggcagcgcaaaagatg

SEQ ID NO: 86041 - DNA, 103 bp, Artificial Sequence
  Synthetic Polynucleotide
taatacgactcactatagggatggagatgcgcccgatctcctccatcttgaacagaggagacaagatatgggagatcggaacctggcggcagcgcaaaagatg

SEQ ID NO: 86042 - DNA, 103 bp, Artificial Sequence
  Synthetic Polynucleotide
taatacgactcactataggggttcatctcaatggagatgcgcccgatctcaacagaggagagagatcatgcgcatctccaacctggcggcagcgcaaaagatg

SEQ ID NO: 86043 - DNA, 103 bp, Artificial Sequence
  Synthetic Polynucleotide
taatacgactcactatagggccagggtcccgttcatctcaatggagatgcaacagaggagagcatctatgttgagatgaaacctggcggcagcgcaaaagatg

SEQ ID NO: 86044 - DNA, 103 bp, Artificial Sequence
  Synthetic Polynucleotide
taatacgactcactatagggagctggtcctccagggtcccgttcatctcaaacagaggagatgagatatgcgggaccctaacctggcggcagcgcaaaagatg

SEQ ID NO: 86045 - DNA, 103 bp, Artificial Sequence
  Synthetic Polynucleotide
taatacgactcactatagggcaggtggctcagctggtcctccagggtcccaacagaggagagggaccatggaggaccagaacctggcggcagcgcaaaagatg

SEQ ID NO: 86046 - DNA, 103 bp, Artificial Sequence
  Synthetic Polynucleotide
taatacgactcactatagggcatactgcttcaggtggctcagctggtcctaacagaggagaaggaccatgtgagccaccaacctggcggcagcgcaaaagatg

SEQ ID NO: 86047 - DNA, 103 bp, Artificial Sequence
  Synthetic Polynucleotide
taatacgactcactatagggatgctgcgttcatactgcttcaggtggctcaacagaggagagagccaatggaagcagtaaacctggcggcagcgcaaaagatg

SEQ ID NO: 86048 - DNA, 103 bp, Artificial Sequence
  Synthetic Polynucleotide
taatacgactcactataggggtagtccacgatgctgcgttcatactgcttaacagaggagaaagcagatggaacgcagcaacctggcggcagcgcaaaagatg

SEQ ID NO: 86049 - DNA, 103 bp, Artificial Sequence
  Synthetic Polynucleotide
taatacgactcactatagggggttgggcttgtagtccacgatgctgcgttaacagaggagaaacgcaatgtcgtggactaacctggcggcagcgcaaaagatg

SEQ ID NO: 86050 - DNA, 103 bp, Artificial Sequence
  Synthetic Polynucleotide
taatacgactcactatagggtcctcatcaatgttctcgatctgtgtgcctaacagaggagaaggcacatggatcgagaaaacctggcggcagcgcaaaagatg

SEQ ID NO: 86051 - DNA, 103 bp, Artificial Sequence
  Synthetic Polynucleotide
taatacgactcactatagggagcaggtccaggttgggcttgtagtccacgaacagaggagacgtggaatgcaagcccaaaacctggcggcagcgcaaaagatg

SEQ ID NO: 86052 - DNA, 103 bp, Artificial Sequence
  Synthetic Polynucleotide
taatacgactcactatagggctgctgctccagcaggtccaggttgggcttaacagaggagaaagcccatgctggacctgaacctggcggcagcgcaaaagatg

SEQ ID NO: 86053 - DNA, 103 bp, Artificial Sequence
  Synthetic Polynucleotide
taatacgactcactatagggtgagctggtgctgctgctccagcaggtccaaacagaggagatggaccatgtggagcagcaacctggcggcagcgcaaaagatg

SEQ ID NO: 86054 - DNA, 103 bp, Artificial Sequence
  Synthetic Polynucleotide
taatacgactcactataggggcctcctggatgagctggtgctgctgctccaacagaggagaggagcaatggcaccagctaacctggcggcagcgcaaaagatg

SEQ ID NO: 86055 - DNA, 103 bp, Artificial Sequence
  Synthetic Polynucleotide
taatacgactcactataggggaagatgagggcctcctggatgagctggtgaacagaggagacaccagatgatccaggagaacctggcggcagcgcaaaagatg

SEQ ID NO: 86056 - DNA, 103 bp, Artificial Sequence
  Synthetic Polynucleotide
taatacgactcactataggggcttgttgtcgaagatgagggcctcctggaaacagaggagatccaggatgccctcatctaacctggcggcagcgcaaaagatg

SEQ ID NO: 86057 - DNA, 103 bp, Artificial Sequence
  Synthetic Polynucleotide
taatacgactcactatagggtagttggtgtgcttgttgtcgaagatgaggaacagaggagacctcatatgcgacaacaaaacctggcggcagcgcaaaagatg

SEQ ID NO: 86058 - DNA, 103 bp, Artificial Sequence
  Synthetic Polynucleotide
taatacgactcactatagggctccatggtatagttggtgtgcttgttgtcaacagaggagagacaacatgcacaccaacaacctggcggcagcgcaaaagatg

SEQ ID NO: 86059 - DNA, 103 bp, Artificial Sequence
  Synthetic Polynucleotide
taatacgactcactatagggcgcggatgtgctccatggtatagttggtgtaacagaggagaacaccaatgataccatggaacctggcggcagcgcaaaagatg

SEQ ID NO: 86060 - DNA, 103 bp, Artificial Sequence
  Synthetic Polynucleotide
taatacgactcactatagggtcccagcccacgcggatgtgctccatggtaaacagaggagataccatatggcacatccgaacctggcggcagcgcaaaagatg

SEQ ID NO: 86061 - DNA, 103 bp, Artificial Sequence
  Synthetic Polynucleotide
taatacgactcactataggggtctcggaagtcctcatcaatgttctcgataacagaggagaatcgagatgattgatgagaacctggcggcagcgcaaaagatg

SEQ ID NO: 86062 - DNA, 103 bp, Artificial Sequence
  Synthetic Polynucleotide
taatacgactcactataggggagcagctgctcccagcccacgcggatgtgaacagaggagacacatcatggtgggctggaacctggcggcagcgcaaaagatg

SEQ ID NO: 86063 - DNA, 103 bp, Artificial Sequence
  Synthetic Polynucleotide
taatacgactcactatagggcaatggtggtgagcagctgctcccagcccaaacagaggagatgggctatgagcagctgcaacctggcggcagcgcaaaagatg

SEQ ID NO: 86064 - DNA, 103 bp, Artificial Sequence
  Synthetic Polynucleotide
taatacgactcactatagggatggtgcgggcaatggtggtgagcagctgcaacagaggagagcagctatgcaccaccataacctggcggcagcgcaaaagatg

SEQ ID NO: 86065 - DNA, 103 bp, Artificial Sequence
  Synthetic Polynucleotide
taatacgactcactatagggcacctcgttgatggtgcgggcaatggtggtaacagaggagaaccaccatggcccgcaccaacctggcggcagcgcaaaagatg

SEQ ID NO: 86066 - DNA, 103 bp, Artificial Sequence
  Synthetic Polynucleotide
taatacgactcactatagggtctggttctccacctcgttgatggtgcgggaacagaggagacccgcaatgtcaacgaggaacctggcggcagcgcaaaagatg

SEQ ID NO: 86067 - DNA, 103 bp, Artificial Sequence
  Synthetic Polynucleotide
taatacgactcactatagggcgggtgaggatctggttctccacctcgttgaacagaggagacaacgaatgggagaaccaaacctggcggcagcgcaaaagatg

SEQ ID NO: 86068 - DNA, 103 bp, Artificial Sequence
  Synthetic Polynucleotide
taatacgactcactatagggcttggcgtcgcgggtgaggatctggttctcaacagaggagagagaacatgatcctcaccaacctggcggcagcgcaaaagatg

SEQ ID NO: 86069 - DNA, 103 bp, Artificial Sequence
  Synthetic Polynucleotide
taatacgactcactatagggggctgatgcccttggcgtcgcgggtgaggaaacagaggagatcctcaatggcgacgccaaacctggcggcagcgcaaaagatg

SEQ ID NO: 86070 - DNA, 103 bp, Artificial Sequence
  Synthetic Polynucleotide
taatacgactcactatagggatctgctcctggctgatgcccttggcgtcgaacagaggagacgacgcatggggcatcagaacctggcggcagcgcaaaagatg

SEQ ID NO: 86071 - DNA, 103 bp, Artificial Sequence
  Synthetic Polynucleotide
taatacgactcactataggggaactcctgcatctgctcctggctgatgccaacagaggagaggcatcatgcaggagcagaacctggcggcagcgcaaaagatg

SEQ ID NO: 86072 - DNA, 103 bp, Artificial Sequence
  Synthetic Polynucleotide
taatacgactcactataggggcttgagcccgtctcggaagtcctcatcaaaacagaggagattgatgatgacttccgagaacctggcggcagcgcaaaagatg

SEQ ID NO: 86073 - DNA, 103 bp, Artificial Sequence
  Synthetic Polynucleotide
taatacgactcactatagggaggacgcccggaactcctgcatctgctcctaacagaggagaaggagcatgtgcaggagtaacctggcggcagcgcaaaagatg

SEQ ID NO: 86074 - DNA, 103 bp, Artificial Sequence
  Synthetic Polynucleotide
taatacgactcactatagggaagtggttgaaggacgcccggaactcctgcaacagaggagagcaggaatgccgggcgtcaacctggcggcagcgcaaaagatg

SEQ ID NO: 86075 - DNA, 103 bp, Artificial Sequence
  Synthetic Polynucleotide
taatacgactcactatagggatccttgtcgaagtggttgaaggacgcccgaacagaggagacgggcgatgttcaaccacaacctggcggcagcgcaaaagatg

SEQ ID NO: 86076 - DNA, 103 bp, Artificial Sequence
  Synthetic Polynucleotide
taatacgactcactatagggccccgccatgatccttgtcgaagtggttgaaacagaggagatcaaccatgtcgacaaggaacctggcggcagcgcaaaagatg

SEQ ID NO: 86077 - DNA, 103 bp, Artificial Sequence
  Synthetic Polynucleotide
taatacgactcactatagggggccccagcgccccgccatgatccttgtcgaacagaggagacgacaaatgtcatggcggaacctggcggcagcgcaaaagatg

SEQ ID NO: 86078 - DNA, 103 bp, Artificial Sequence
  Synthetic Polynucleotide
taatacgactcactataggggaactcctcgggccccagcgccccgccatgaacagaggagacatggcatggcgctggggaacctggcggcagcgcaaaagatg

SEQ ID NO: 86079 - DNA, 103 bp, Artificial Sequence
  Synthetic Polynucleotide
taatacgactcactatagggggcaggccttgaactcctcgggccccagcgaacagaggagacgctggatgccgaggagtaacctggcggcagcgcaaaagatg

SEQ ID NO: 86080 - DNA, 103 bp, Artificial Sequence
  Synthetic Polynucleotide
taatacgactcactatagggaggctgatgaggcaggccttgaactcctcgaacagaggagacgaggaatgcaaggcctgaacctggcggcagcgcaaaagatg

SEQ ID NO: 86081 - DNA, 103 bp, Artificial Sequence
  Synthetic Polynucleotide
taatacgactcactataggggtcgtagcccaggctgatgaggcaggccttaacagaggagaaaggccatgctcatcagcaacctggcggcagcgcaaaagatg

SEQ ID NO: 86082 - DNA, 103 bp, Artificial Sequence
  Synthetic Polynucleotide
taatacgactcactatagggcgttctccacgtcgtagcccaggctgatgaaacagaggagatcatcaatgtgggctacgaacctggcggcagcgcaaaagatg

SEQ ID NO: 86083 - DNA, 103 bp, Artificial Sequence
  Synthetic Polynucleotide
taatacgactcactatagggagcagcatgagcttgagcccgtctcggaagaacagaggagacttccgatgcgggctcaaaacctggcggcagcgcaaaagatg

SEQ ID NO: 86084 - DNA, 103 bp, Artificial Sequence
  Synthetic Polynucleotide
taatacgactcactatagggccctgccggtcgttctccacgtcgtagcccaacagaggagagggctaatgcgtggagaaaacctggcggcagcgcaaaagatg

SEQ ID NO: 86085 - DNA, 103 bp, Artificial Sequence
  Synthetic Polynucleotide
taatacgactcactatagggctcggcctcaccctgccggtcgttctccacaacagaggagagtggagatggaccggcagaacctggcggcagcgcaaaagatg

SEQ ID NO: 86086 - DNA, 103 bp, Artificial Sequence
  Synthetic Polynucleotide
taatacgactcactatagggtgcggttgaactcggcctcaccctgccggtaacagaggagaaccggcatggtgaggccgaacctggcggcagcgcaaaagatg

SEQ ID NO: 86087 - DNA, 103 bp, Artificial Sequence
  Synthetic Polynucleotide
taatacgactcactatagggaggctcatgatgcggttgaactcggcctcaaacagaggagatgaggcatggttcaaccgaacctggcggcagcgcaaaagatg

SEQ ID NO: 86088 - DNA, 103 bp, Artificial Sequence
  Synthetic Polynucleotide
taatacgactcactatagggggggtcgaccaggctcatgatgcggttgaaaacagaggagattcaacatgatcatgagcaacctggcggcagcgcaaaagatg

SEQ ID NO: 86089 - DNA, 103 bp, Artificial Sequence
  Synthetic Polynucleotide
taatacgactcactatagggcgctatggttggggtcgaccaggctcatgaaacagaggagatcatgaatgtggtcgaccaacctggcggcagcgcaaaagatg

SEQ ID NO: 86090 - DNA, 103 bp, Artificial Sequence
  Synthetic Polynucleotide
taatacgactcactataggggtcacaaggccgctatggttggggtcgaccaacagaggagaggtcgaatgcaaccatagaacctggcggcagcgcaaaagatg

SEQ ID NO: 86091 - DNA, 103 bp, Artificial Sequence
  Synthetic Polynucleotide
taatacgactcactatagggggcttggaaggtcacaaggccgctatggttaacagaggagaaaccatatgggccttgtgaacctggcggcagcgcaaaagatg

SEQ ID NO: 86092 - DNA, 103 bp, Artificial Sequence
  Synthetic Polynucleotide
taatacgactcactatagggagtcgatgaaggcttggaaggtcacaaggcaacagaggagagccttgatgccttccaagaacctggcggcagcgcaaaagatg

SEQ ID NO: 86093 - DNA, 103 bp, Artificial Sequence
  Synthetic Polynucleotide
taatacgactcactatagggcgcgacatgaagtcgatgaaggcttggaagaacagaggagacttccaatgcttcatcgaaacctggcggcagcgcaaaagatg

SEQ ID NO: 86094 - DNA, 103 bp, Artificial Sequence
  Synthetic Polynucleotide
taatacgactcactataggggacctccaggagcagcatgagcttgagcccaacagaggagagggctcatgctcatgctgaacctggcggcagcgcaaaagatg

SEQ ID NO: 86095 - DNA, 103 bp, Artificial Sequence
  Synthetic Polynucleotide
taatacgactcactatagggggtggtctcccgcgacatgaagtcgatgaaaacagaggagattcatcatgttcatgtcgaacctggcggcagcgcaaaagatg

SEQ ID NO: 86096 - DNA, 103 bp, Artificial Sequence
  Synthetic Polynucleotide
taatacgactcactatagggtgtccgtgtcggtggtctcccgcgacatgaaacagaggagatcatgtatggggagaccaaacctggcggcagcgcaaaagatg

SEQ ID NO: 86097 - DNA, 103 bp, Artificial Sequence
  Synthetic Polynucleotide
taatacgactcactatagggtggtcagccgtgtccgtgtcggtggtctccaacagaggagaggagacatgcgacacggaaacctggcggcagcgcaaaagatg

SEQ ID NO: 86098 - DNA, 103 bp, Artificial Sequence
  Synthetic Polynucleotide
taatacgactcactatagggagcgatgacctggtcagccgtgtccgtgtcaacagaggagagacacgatgacggctgacaacctggcggcagcgcaaaagatg

SEQ ID NO: 86099 - DNA, 103 bp, Artificial Sequence
  Synthetic Polynucleotide
taatacgactcactatagggccttgaaggaagcgatgacctggtcagccgaacagaggagacggctgatgaggtcatcgaacctggcggcagcgcaaaagatg

SEQ ID NO: 86100 - DNA, 103 bp, Artificial Sequence
  Synthetic Polynucleotide
taatacgactcactatagggcctgctaagaccttgaaggaagcgatgaccaacagaggagaggtcatatgttccttcaaaacctggcggcagcgcaaaagatg

SEQ ID NO: 86101 - DNA, 103 bp, Artificial Sequence
  Synthetic Polynucleotide
taatacgactcactataggggttcttgtcccctgctaagaccttgaaggaaacagaggagatccttcatggtcttagcaaacctggcggcagcgcaaaagatg

SEQ ID NO: 86102 - DNA, 103 bp, Artificial Sequence
  Synthetic Polynucleotide
taatacgactcactatagggctgtgatgaagttcttgtcccctgctaagaaacagaggagatcttagatggggacaagaaacctggcggcagcgcaaaagatg

SEQ ID NO: 86103 - DNA, 103 bp, Artificial Sequence
  Synthetic Polynucleotide
taatacgactcactatagggagctcctcagctgtgatgaagttcttgtccaacagaggagaggacaaatgcttcatcacaacctggcggcagcgcaaaagatg

SEQ ID NO: 86104 - DNA, 103 bp, Artificial Sequence
  Synthetic Polynucleotide
taatacgactcactatagggctctctccgcagctcctcagctgtgatgaaaacagaggagattcatcatggctgaggagaacctggcggcagcgcaaaagatg

SEQ ID NO: 86105 - DNA, 103 bp, Artificial Sequence
  Synthetic Polynucleotide
taatacgactcactatagggcccctgatatgacctccaggagcagcatgaaacagaggagatcatgcatgtcctggaggaacctggcggcagcgcaaaagatg

SEQ ID NO: 86106 - DNA, 103 bp, Artificial Sequence
  Synthetic Polynucleotide
taatacgactcactatagggcggggggcagctctctccgcagctcctcagaacagaggagactgaggatgtgcggagagaacctggcggcagcgcaaaagatg

SEQ ID NO: 86107 - DNA, 103 bp, Artificial Sequence
  Synthetic Polynucleotide
taatacgactcactatagggtcggcctggtcggggggcagctctctccgcaacagaggagagcggagatggctgcccccaacctggcggcagcgcaaaagatg

SEQ ID NO: 86108 - DNA, 103 bp, Artificial Sequence
  Synthetic Polynucleotide
taatacgactcactataggggatgcagtactcggcctggtcggggggcagaacagaggagactgcccatggaccaggccaacctggcggcagcgcaaaagatg

SEQ ID NO: 86109 - DNA, 103 bp, Artificial Sequence
  Synthetic Polynucleotide
taatacgactcactatagggccatgcgggcgatgcagtactcggcctggtaacagaggagaaccaggatgagtactgcaaacctggcggcagcgcaaaagatg

SEQ ID NO: 86110 - DNA, 103 bp, Artificial Sequence
  Synthetic Polynucleotide
taatacgactcactatagggtggtatggcgccatgcgggcgatgcagtacaacagaggagagtactgatgcgcccgcataacctggcggcagcgcaaaagatg

SEQ ID NO: 86111 - DNA, 103 bp, Artificial Sequence
  Synthetic Polynucleotide
taatacgactcactataggggtcagggccctggtatggcgccatgcgggcaacagaggagagcccgcatggcgccatacaacctggcggcagcgcaaaagatg

SEQ ID NO: 86112 - DNA, 103 bp, Artificial Sequence
  Synthetic Polynucleotide
taatacgactcactatagggcgggcacggcgtcagggccctggtatggcgaacagaggagacgccatatgagggccctgaacctggcggcagcgcaaaagatg

SEQ ID NO: 86113 - DNA, 103 bp, Artificial Sequence
  Synthetic Polynucleotide
taatacgactcactatagggtcgagggcaccgggcacggcgtcagggcccaacagaggagagggcccatgcgccgtgccaacctggcggcagcgcaaaagatg

SEQ ID NO: 86114 - DNA, 103 bp, Artificial Sequence
  Synthetic Polynucleotide
taatacgactcactatagggggacttgtagtcgagggcaccgggcacggcaacagaggagagccgtgatgggtgccctcaacctggcggcagcgcaaaagatg

SEQ ID NO: 86115 - DNA, 103 bp, Artificial Sequence
  Synthetic Polynucleotide
taatacgactcactatagggccgtggagaaggacttgtagtcgagggcacaacagaggagagtgcccatgactacaagtaacctggcggcagcgcaaaagatg

SEQ ID NO: 86116 - DNA, 103 bp, Artificial Sequence
  Synthetic Polynucleotide
taatacgactcactatagggggtaaccgctcccctgatatgacctccaggaacagaggagacctggaatgcatatcaggaacctggcggcagcgcaaaagatg

SEQ ID NO: 86117 - DNA, 103 bp, Artificial Sequence
  Synthetic Polynucleotide
taatacgactcactatagggccatacaaggccgtggagaaggacttgtagaacagaggagactacaaatgcttctccacaacctggcggcagcgcaaaagatg

SEQ ID NO: 86118 - DNA, 103 bp, Artificial Sequence
  Synthetic Polynucleotide
taatacgactcactataggggtcgctctcgccatacaaggccgtggagaaaacagaggagattctccatggccttgtataacctggcggcagcgcaaaagatg

SEQ ID NO: 86119 - DNA, 103 bp, Artificial Sequence
  Synthetic Polynucleotide
taatacgactcactatagggctccggcttaggtaaccgctcccctgatataacagaggagaatatcaatggagcggttaaacctggcggcagcgcaaaagatg

SEQ ID NO: 86120 - DNA, 103 bp, Artificial Sequence
  Synthetic Polynucleotide
taatacgactcactatagggtcttcccccgctccggcttaggtaaccgctaacagaggagaagcggtatgctaagccggaacctggcggcagcgcaaaagatg

SEQ ID NO: 86121 - DNA, 103 bp, Artificial Sequence
  Synthetic Polynucleotide
taatacgactcactatagggctgctggggccgtactggtacgactggttcaacagaggagagaaccaatggtaccagtaaacctggcggcagcgcaaaagatg

SEQ ID NO: 86122 - DNA, 103 bp, Artificial Sequence
  Synthetic Polynucleotide
taatacgactcactatagggtgcactctcatcttcccccgctccggcttaaacagaggagataagccatggcgggggaaaacctggcggcagcgcaaaagatg

SEQ ID NO: 86123 - DNA, 103 bp, Artificial Sequence
  Synthetic Polynucleotide
taatacgactcactataggggttgattttgtgcactctcatcttcccccgaacagaggagacgggggatgatgagagtgaacctggcggcagcgcaaaagatg

SEQ ID NO: 86124 - DNA, 103 bp, Artificial Sequence
  Synthetic Polynucleotide
taatacgactcactatagggtgttcacattgttgattttgtgcactctcaaacagaggagatgagagatgacaaaatcaaacctggcggcagcgcaaaagatg

SEQ ID NO: 86125 - DNA, 103 bp, Artificial Sequence
  Synthetic Polynucleotide
taatacgactcactatagggtccagcgctttgttcacattgttgattttgaacagaggagacaaaatatgcaatgtgaaaacctggcggcagcgcaaaagatg

SEQ ID NO: 86126 - DNA, 103 bp, Artificial Sequence
  Synthetic Polynucleotide
taatacgactcactatagggggcaataaagtccagcgctttgttcacattaacagaggagaaatgtgatgaaagcgctgaacctggcggcagcgcaaaagatg

SEQ ID NO: 86127 - DNA, 103 bp, Artificial Sequence
  Synthetic Polynucleotide
taatacgactcactatagggcgcctttgctggcaataaagtccagcgcttaacagaggagaaagcgcatgactttattgaacctggcggcagcgcaaaagatg

SEQ ID NO: 86128 - DNA, 103 bp, Artificial Sequence
  Synthetic Polynucleotide
taatacgactcactatagggaccagcttgacgcctttgctggcaataaagaacagaggagactttatatgcagcaaaggaacctggcggcagcgcaaaagatg

SEQ ID NO: 86129 - DNA, 103 bp, Artificial Sequence
  Synthetic Polynucleotide
taatacgactcactatagggcccgatggagaccagcttgacgcctttgctaacagaggagaagcaaaatggtcaagctgaacctggcggcagcgcaaaagatg

SEQ ID NO: 86130 - DNA, 103 bp, Artificial Sequence
  Synthetic Polynucleotide
taatacgactcactatagggtctcttctgccccgatggagaccagcttgaaacagaggagatcaagcatgtctccatcgaacctggcggcagcgcaaaagatg

SEQ ID NO: 86131 - DNA, 103 bp, Artificial Sequence
  Synthetic Polynucleotide
taatacgactcactatagggccgtccacaatctcttctgccccgatggagaacagaggagactccatatgggcagaagaaacctggcggcagcgcaaaagatg

SEQ ID NO: 86132 - DNA, 103 bp, Artificial Sequence
  Synthetic Polynucleotide
taatacgactcactatagggattgcccgcgctgctggggccgtactggtaaacagaggagataccagatgggccccagcaacctggcggcagcgcaaaagatg

SEQ ID NO: 86133 - DNA, 103 bp, Artificial Sequence
  Synthetic Polynucleotide
taatacgactcactatagggctttgcgttgccgtccacaatctcttctgcaacagaggagagcagaaatgattgtggacaacctggcggcagcgcaaaagatg

SEQ ID NO: 86134 - DNA, 103 bp, Artificial Sequence
  Synthetic Polynucleotide
taatacgactcactatagggccagggtcatctttgcgttgccgtccacaaaacagaggagattgtggatggcaacgcaaaacctggcggcagcgcaaaagatg

SEQ ID NO: 86135 - DNA, 103 bp, Artificial Sequence
  Synthetic Polynucleotide
taatacgactcactatagggcagatcattcccagggtcatctttgcgttgaacagaggagacaacgcatggatgaccctaacctggcggcagcgcaaaagatg

SEQ ID NO: 86136 - DNA, 103 bp, Artificial Sequence
  Synthetic Polynucleotide
taatacgactcactataggggatgatggtccagatcattcccagggtcataacagaggagaatgaccatgggaatgatcaacctggcggcagcgcaaaagatg

SEQ ID NO: 86137 - DNA, 103 bp, Artificial Sequence
  Synthetic Polynucleotide
taatacgactcactatagggcgaacctaaggatgatggtccagatcattcaacagaggagagaatgaatgggaccatcaaacctggcggcagcgcaaaagatg

SEQ ID NO: 86138 - DNA, 103 bp, Artificial Sequence
  Synthetic Polynucleotide
taatacgactcactatagggtcctggatggcgaacctaaggatgatggtcaacagaggagagaccatatgccttaggttaacctggcggcagcgcaaaagatg

SEQ ID NO: 86139 - DNA, 103 bp, Artificial Sequence
  Synthetic Polynucleotide
taatacgactcactatagggcacggagatgtcctggatggcgaacctaagaacagaggagacttaggatggccatccagaacctggcggcagcgcaaaagatg

SEQ ID NO: 86140 - DNA, 103 bp, Artificial Sequence
  Synthetic Polynucleotide
taatacgactcactatagggaggtctcttccacggagatgtcctggatggaacagaggagaccatccatgacatctccgaacctggcggcagcgcaaaagatg

SEQ ID NO: 86141 - DNA, 103 bp, Artificial Sequence
  Synthetic Polynucleotide
taatacgactcactatagggtccttggccgaggtctcttccacggagatgaacagaggagacatctcatgggaagagacaacctggcggcagcgcaaaagatg

SEQ ID NO: 86142 - DNA, 103 bp, Artificial Sequence
  Synthetic Polynucleotide
taatacgactcactatagggaaggagcccttccttggccgaggtctcttcaacagaggagagaagagatgtcggccaagaacctggcggcagcgcaaaagatg

SEQ ID NO: 86143 - DNA, 103 bp, Artificial Sequence
  Synthetic Polynucleotide
taatacgactcactatagggcgccagcgccattgcccgcgctgctggggcaacagaggagagccccaatggcgcgggcaaacctggcggcagcgcaaaagatg

SEQ ID NO: 86144 - DNA, 103 bp, Artificial Sequence
  Synthetic Polynucleotide
taatacgactcactatagggggcaccagagaaggagcccttccttggccgaacagaggagacggccaatgaagggctccaacctggcggcagcgcaaaagatg

SEQ ID NO: 86145 - DNA, 103 bp, Artificial Sequence
  Synthetic Polynucleotide
taatacgactcactataggggtctttctctggcaccagagaaggagccctaacagaggagaagggctatgtctctggtgaacctggcggcagcgcaaaagatg

SEQ ID NO: 86146 - DNA, 103 bp, Artificial Sequence
  Synthetic Polynucleotide
taatacgactcactatagggatacggggctgtctttctctggcaccagagaacagaggagactctggatgcagagaaagaacctggcggcagcgcaaaagatg

SEQ ID NO: 86147 - DNA, 103 bp, Artificial Sequence
  Synthetic Polynucleotide
taatacgactcactatagggtgacgttcttatacggggctgtctttctctaacagaggagaagagaaatgcagccccgtaacctggcggcagcgcaaaagatg

SEQ ID NO: 86148 - DNA, 103 bp, Artificial Sequence
  Synthetic Polynucleotide
taatacgactcactatagggttctgcacattgacgttcttatacggggctaacagaggagaagccccatgtaagaacgtaacctggcggcagcgcaaaagatg

SEQ ID NO: 86149 - DNA, 103 bp, Artificial Sequence
  Synthetic Polynucleotide
taatacgactcactataggggatgtggaagttctgcacattgacgttcttaacagaggagaaagaacatgaatgtgcagaacctggcggcagcgcaaaagatg

SEQ ID NO: 86150 - DNA, 103 bp, Artificial Sequence
  Synthetic Polynucleotide
taatacgactcactatagggccttccagctgatgtggaagttctgcacataacagaggagaatgtgcatgacttccacaaacctggcggcagcgcaaaagatg

SEQ ID NO: 86151 - DNA, 103 bp, Artificial Sequence
  Synthetic Polynucleotide
taatacgactcactataggggcaagaccatccttccagctgatgtggaagaacagaggagacttccaatgcagctggaaaacctggcggcagcgcaaaagatg

SEQ ID NO: 86152 - DNA, 103 bp, Artificial Sequence
  Synthetic Polynucleotide
taatacgactcactatagggggcattgaaggcaagaccatccttccagctaacagaggagaagctggatggatggtcttaacctggcggcagcgcaaaagatg

SEQ ID NO: 86153 - DNA, 103 bp, Artificial Sequence
  Synthetic Polynucleotide
taatacgactcactatagggggtggatcagggcattgaaggcaagaccataacagaggagaatggtcatgccttcaatgaacctggcggcagcgcaaaagatg

SEQ ID NO: 86154 - DNA, 103 bp, Artificial Sequence
  Synthetic Polynucleotide
taatacgactcactatagggctgcccccgccgccagcgccattgcccgcgaacagaggagacgcgggatgtggcgctggaacctggcggcagcgcaaaagatg

SEQ ID NO: 86155 - DNA, 103 bp, Artificial Sequence
  Synthetic Polynucleotide
taatacgactcactatagggggtctgtgccggtggatcagggcattgaagaacagaggagacttcaaatgcctgatccaaacctggcggcagcgcaaaagatg

SEQ ID NO: 86156 - DNA, 103 bp, Artificial Sequence
  Synthetic Polynucleotide
taatacgactcactatagggaatcagctctggtctgtgccggtggatcagaacagaggagactgatcatgcggcacagaaacctggcggcagcgcaaaagatg

SEQ ID NO: 86157 - DNA, 103 bp, Artificial Sequence
  Synthetic Polynucleotide
taatacgactcactatagggtgtcatactcaatcagctctggtctgtgccaacagaggagaggcacaatgcagagctgaaacctggcggcagcgcaaaagatg

SEQ ID NO: 86158 - DNA, 103 bp, Artificial Sequence
  Synthetic Polynucleotide
taatacgactcactatagggttcctcagcttgtcatactcaatcagctctaacagaggagaagagctatgtgagtatgaaacctggcggcagcgcaaaagatg

SEQ ID NO: 86159 - DNA, 103 bp, Artificial Sequence
  Synthetic Polynucleotide
taatacgactcactatagggagggtcgtccttcctcagcttgtcatactcaacagaggagagagtatatgaagctgaggaacctggcggcagcgcaaaagatg

SEQ ID NO: 86160 - DNA, 103 bp, Artificial Sequence
  Synthetic Polynucleotide
taatacgactcactatagggggttggtgacagggtcgtccttcctcagctaacagaggagaagctgaatgaggacgaccaacctggcggcagcgcaaaagatg

SEQ ID NO: 86161 - DNA, 103 bp, Artificial Sequence
  Synthetic Polynucleotide
taatacgactcactataggggcattgttcaggttggtgacagggtcgtccaacagaggagaggacgaatgtgtcaccaaaacctggcggcagcgcaaaagatg

SEQ ID NO: 86162 - DNA, 103 bp, Artificial Sequence
  Synthetic Polynucleotide
taatacgactcactatagggcacttcgaaggcattgttcaggttggtgacaacagaggagagtcaccatgctgaacaataacctggcggcagcgcaaaagatg

SEQ ID NO: 86163 - DNA, 103 bp, Artificial Sequence
  Synthetic Polynucleotide
taatacgactcactatagggatttctcagccacttcgaaggcattgttcaaacagaggagatgaacaatgccttcgaagaacctggcggcagcgcaaaagatg

SEQ ID NO: 86164 - DNA, 103 bp, Artificial Sequence
  Synthetic Polynucleotide
taatacgactcactatagggatgtcgaggtatttctcagccacttcgaagaacagaggagacttcgaatgggctgagaaaacctggcggcagcgcaaaagatg

SEQ ID NO: 86165 - DNA, 103 bp, Artificial Sequence
  Synthetic Polynucleotide
taatacgactcactataggggtcgcccatgctgcccccgccgccagcgccaacagaggagaggcgctatgggcgggggcaacctggcggcagcgcaaaagatg

SEQ ID NO: 86166 - DNA, 103 bp, Artificial Sequence
  Synthetic Polynucleotide
taatacgactcactatagggcatcttggggatgtcgaggtatttctcagcaacagaggagagctgagatgtacctcgacaacctggcggcagcgcaaaagatg

SEQ ID NO: 86167 - DNA, 103 bp, Artificial Sequence
  Synthetic Polynucleotide
taatacgactcactatagggctgcatccagcatcttggggatgtcgaggtaacagaggagaacctcgatgtccccaagaaacctggcggcagcgcaaaagatg

SEQ ID NO: 86168 - DNA, 103 bp, Artificial Sequence
  Synthetic Polynucleotide
taatacgactcactatagggacgatgtcctctgcatccagcatcttggggaacagaggagaccccaaatggctggatgcaacctggcggcagcgcaaaagatg

SEQ ID NO: 86169 - DNA, 103 bp, Artificial Sequence
  Synthetic Polynucleotide
taatacgactcactatagggggccgtgttcacgatgtcctctgcatccagaacagaggagactggatatggaggacatcaacctggcggcagcgcaaaagatg

SEQ ID NO: 86170 - DNA, 103 bp, Artificial Sequence
  Synthetic Polynucleotide
taatacgactcactatagggcgtcgggccgggccgtgttcacgatgtcctaacagaggagaaggacaatgtgaacacggaacctggcggcagcgcaaaagatg

SEQ ID NO: 86171 - DNA, 103 bp, Artificial Sequence
  Synthetic Polynucleotide
taatacgactcactatagggatggccttctcgtcgggccgggccgtgttcaacagaggagagaacacatgccggcccgaaacctggcggcagcgcaaaagatg

SEQ ID NO: 86172 - DNA, 103 bp, Artificial Sequence
  Synthetic Polynucleotide
taatacgactcactatagggataggtcattatggccttctcgtcgggccgaacagaggagacggcccatggagaaggccaacctggcggcagcgcaaaagatg

SEQ ID NO: 86173 - DNA, 103 bp, Artificial Sequence
  Synthetic Polynucleotide
taatacgactcactatagggagctggacacataggtcattatggccttctaacagaggagaagaaggatgtaatgacctaacctggcggcagcgcaaaagatg

SEQ ID NO: 86174 - DNA, 103 bp, Artificial Sequence
  Synthetic Polynucleotide
taatacgactcactataggggcatggtagaagctggacacataggtcattaacagaggagaaatgacatgtgtgtccagaacctggcggcagcgcaaaagatg

SEQ ID NO: 86175 - DNA, 103 bp, Artificial Sequence
  Synthetic Polynucleotide
taatacgactcactatagggtcctgaaaaggcatggtagaagctggacacaacagaggagagtgtccatgttctaccataacctggcggcagcgcaaaagatg

SEQ ID NO: 86176 - DNA, 103 bp, Artificial Sequence
  Synthetic Polynucleotide
taatacgactcactataggggggccatgtagtcgcccatgctgcccccgcaacagaggagagcggggatggcatgggcgaacctggcggcagcgcaaaagatg

SEQ ID NO: 86177 - DNA, 103 bp, Artificial Sequence
  Synthetic Polynucleotide
taatacgactcactatagggccttctgcgctcctgaaaaggcatggtagaaacagaggagatctaccatgccttttcagaacctggcggcagcgcaaaagatg

SEQ ID NO: 86178 - DNA, 103 bp, Artificial Sequence
  Synthetic Polynucleotide
taatacgactcactataggggcagtttcagccttctgcgctcctgaaaagaacagaggagacttttcatgagcgcagaaaacctggcggcagcgcaaaagatg

SEQ ID NO: 86179 - DNA, 103 bp, Artificial Sequence
  Synthetic Polynucleotide
taatacgactcactatagggccggttggcggcagtttcagccttctgcgcaacagaggagagcgcagatggctgaaactaacctggcggcagcgcaaaagatg

SEQ ID NO: 86180 - DNA, 103 bp, Artificial Sequence
  Synthetic Polynucleotide
taatacgactcactatagggccttacagatccggttggcggcagtttcagaacagaggagactgaaaatgccgccaaccaacctggcggcagcgcaaaagatg

SEQ ID NO: 86181 - DNA, 103 bp, Artificial Sequence
  Synthetic Polynucleotide
taatacgactcactatagggacagccagcaccttacagatccggttggcgaacagaggagacgccaaatggatctgtaaaacctggcggcagcgcaaaagatg

SEQ ID NO: 86182 - DNA, 103 bp, Artificial Sequence
  Synthetic Polynucleotide
taatacgactcactatagggctcttggttgacagccagcaccttacagataacagaggagaatctgtatggtgctggctaacctggcggcagcgcaaaagatg

SEQ ID NO: 86183 - DNA, 103 bp, Artificial Sequence
  Synthetic Polynucleotide
taatacgactcactatagggggtgctcgttctcttggttgacagccagcaaacagaggagatgctggatgtcaaccaagaacctggcggcagcgcaaaagatg

SEQ ID NO: 86184 - DNA, 103 bp, Artificial Sequence
  Synthetic Polynucleotide
taatacgactcactatagggtcctccatcaggtgctcgttctcttggttgaacagaggagacaaccaatggaacgagcaaacctggcggcagcgcaaaagatg

SEQ ID NO: 86185 - DNA, 103 bp, Artificial Sequence
  Synthetic Polynucleotide
taatacgactcactatagggcttctcgtagtcctccatcaggtgctcgttaacagaggagaaacgagatgctgatggagaacctggcggcagcgcaaaagatg

SEQ ID NO: 86186 - DNA, 103 bp, Artificial Sequence
  Synthetic Polynucleotide
taatacgactcactatagggcgctggccagcttctcgtagtcctccatcaaacagaggagatgatggatgactacgagaaacctggcggcagcgcaaaagatg

SEQ ID NO: 86187 - DNA, 103 bp, Artificial Sequence
  Synthetic Polynucleotide
taatacgactcactatagggtcgtcctcctgggccatgtagtcgcccatgaacagaggagacatgggatgctacatggcaacctggcggcagcgcaaaagatg

SEQ ID NO: 86188 - DNA, 103 bp, Artificial Sequence
  Synthetic Polynucleotide
taatacgactcactatagggtccaggaggtcgctggccagcttctcgtagaacagaggagactacgaatggctggccagaacctggcggcagcgcaaaagatg

SEQ ID NO: 86189 - DNA, 103 bp, Artificial Sequence
  Synthetic Polynucleotide
taatacgactcactatagggccggatccactccaggaggtcgctggccagaacagaggagactggccatggacctcctgaacctggcggcagcgcaaaagatg

SEQ ID NO: 86190 - DNA, 103 bp, Artificial Sequence
  Synthetic Polynucleotide
taatacgactcactatagggggatggtgcgccggatccactccaggaggtaacagaggagaacctccatgagtggatccaacctggcggcagcgcaaaagatg

SEQ ID NO: 86191 - DNA, 103 bp, Artificial Sequence
  Synthetic Polynucleotide
taatacgactcactatagggtccagccaggggatggtgcgccggatccacaacagaggagagtggatatggcgcaccataacctggcggcagcgcaaaagatg

SEQ ID NO: 86192 - DNA, 103 bp, Artificial Sequence
  Synthetic Polynucleotide
taatacgactcactatagggcacacggtcctccagccaggggatggtgcgaacagaggagacgcaccatgccctggctgaacctggcggcagcgcaaaagatg

SEQ ID NO: 86193 - DNA, 103 bp, Artificial Sequence
  Synthetic Polynucleotide
taatacgactcactatagggtcttttggggcacacggtcctccagccaggaacagaggagacctggcatgaggaccgtgaacctggcggcagcgcaaaagatg

SEQ ID NO: 86194 - DNA, 103 bp, Artificial Sequence
  Synthetic Polynucleotide
taatacgactcactatagggtcctggatagtcttttggggcacacggtccaacagaggagaggaccgatggccccaaaaaacctggcggcagcgcaaaagatg

SEQ ID NO: 86195 - DNA, 103 bp, Artificial Sequence
  Synthetic Polynucleotide
taatacgactcactatagggctgctgcatctcctggatagtcttttggggaacagaggagaccccaaatgactatccagaacctggcggcagcgcaaaagatg

SEQ ID NO: 86196 - DNA, 103 bp, Artificial Sequence
  Synthetic Polynucleotide
taatacgactcactatagggcctccagcttctgctgcatctcctggatagaacagaggagactatccatgagatgcagcaacctggcggcagcgcaaaagatg

SEQ ID NO: 86197 - DNA, 103 bp, Artificial Sequence
  Synthetic Polynucleotide
taatacgactcactatagggtcgcggaagtcctccagcttctgctgcatcaacagaggagagatgcaatggaagctggaaacctggcggcagcgcaaaagatg

SEQ ID NO: 86198 - DNA, 103 bp, Artificial Sequence
  Synthetic Polynucleotide
taatacgactcactataggggagcaggggcgccccgcgcacggccgccataacagaggagaatggcgatggtgcgcgggaacctggcggcagcgcaaaagatg

SEQ ID NO: 86199 - DNA, 103 bp, Artificial Sequence
  Synthetic Polynucleotide
taatacgactcactataggggccctcgaggaactcctcgatctcgtcgtcaacagaggagagacgacatgatcgaggagaacctggcggcagcgcaaaagatg

SEQ ID NO: 86200 - DNA, 103 bp, Artificial Sequence
  Synthetic Polynucleotide
taatacgactcactatagggcttcagctcctccttctcttcgtctgtctgaacagaggagacagacaatggaagagaagaacctggcggcagcgcaaaagatg

SEQ ID NO: 86201 - DNA, 103 bp, Artificial Sequence
  Synthetic Polynucleotide
taatacgactcactatagggttttgggtttcttcagctcctccttctcttaacagaggagaaagagaatgaggagctgaaacctggcggcagcgcaaaagatg

SEQ ID NO: 86202 - DNA, 103 bp, Artificial Sequence
  Synthetic Polynucleotide
taatacgactcactatagggctgtcctcctttttgggtttcttcagctccaacagaggagaggagctatggaaacccaaaacctggcggcagcgcaaaagatg

SEQ ID NO: 86203 - DNA, 103 bp, Artificial Sequence
  Synthetic Polynucleotide
taatacgactcactatagggcttggggctgctgtcctcctttttgggtttaacagaggagaaaacccatgaaggaggacaacctggcggcagcgcaaaagatg

SEQ ID NO: 86204 - DNA, 103 bp, Artificial Sequence
  Synthetic Polynucleotide
taatacgactcactatagggcggtctcctccttggggctgctgtcctcctaacagaggagaaggaggatggcagccccaaacctggcggcagcgcaaaagatg

SEQ ID NO: 86205 - DNA, 103 bp, Artificial Sequence
  Synthetic Polynucleotide
taatacgactcactataggggcccacttgtcggtctcctccttggggctgaacagaggagacagcccatgggaggagacaacctggcggcagcgcaaaagatg

SEQ ID NO: 86206 - DNA, 103 bp, Artificial Sequence
  Synthetic Polynucleotide
taatacgactcactatagggcttctccactgcccacttgtcggtctcctcaacagaggagagaggagatggacaagtggaacctggcggcagcgcaaaagatg

SEQ ID NO: 86207 - DNA, 103 bp, Artificial Sequence
  Synthetic Polynucleotide
taatacgactcactatagggggtccttgcccttctccactgcccacttgtaacagaggagaacaagtatgcagtggagaaacctggcggcagcgcaaaagatg

SEQ ID NO: 86208 - DNA, 103 bp, Artificial Sequence
  Synthetic Polynucleotide
taatacgactcactatagggggctctttgtggtccttgcccttctccactaacagaggagaagtggaatggggcaaggaaacctggcggcagcgcaaaagatg

SEQ ID NO: 86209 - DNA, 103 bp, Artificial Sequence
  Synthetic Polynucleotide
taatacgactcactataggggccctttcggggctctttgtggtccttgccaacagaggagaggcaagatgcacaaagagaacctggcggcagcgcaaaagatg

SEQ ID NO: 86210 - DNA, 103 bp, Artificial Sequence
  Synthetic Polynucleotide
taatacgactcactatagggctgacaggaagccctcgaggaactcctcgaaacagaggagatcgaggatgtcctcgaggaacctggcggcagcgcaaaagatg

SEQ ID NO: 86211 - DNA, 103 bp, Artificial Sequence
  Synthetic Polynucleotide
taatacgactcactatagggccaactcctcgccctttcggggctctttgtaacagaggagaacaaagatgcccgaaaggaacctggcggcagcgcaaaagatg

SEQ ID NO: 86212 - DNA, 103 bp, Artificial Sequence
  Synthetic Polynucleotide
taatacgactcactatagggcactcctcctccaactcctcgccctttcggaacagaggagaccgaaaatgcgaggagttaacctggcggcagcgcaaaagatg

SEQ ID NO: 86213 - DNA, 103 bp, Artificial Sequence
  Synthetic Polynucleotide
taatacgactcactatagggcgtaggcgtccactcctcctccaactcctcaacagaggagagaggagatggaggaggagaacctggcggcagcgcaaaagatg

SEQ ID NO: 86214 - DNA, 103 bp, Artificial Sequence
  Synthetic Polynucleotide
taatacgactcactatagggtgactttctccgtaggcgtccactcctcctaacagaggagaaggaggatgggacgcctaaacctggcggcagcgcaaaagatg

SEQ ID NO: 86215 - DNA, 103 bp, Artificial Sequence
  Synthetic Polynucleotide
taatacgactcactataggggggggacacttgactttctccgtaggcgtcaacagaggagagacgccatgggagaaagtaacctggcggcagcgcaaaagatg

SEQ ID NO: 86216 - DNA, 103 bp, Artificial Sequence
  Synthetic Polynucleotide
taatacgactcactatagggcatcccaatggggggacacttgactttctcaacagaggagagagaaaatgaagtgtcccaacctggcggcagcgcaaaagatg

SEQ ID NO: 86217 - DNA, 103 bp, Artificial Sequence
  Synthetic Polynucleotide
taatacgactcactatagggggtgtgactccatcccaatggggggacactaacagaggagaagtgtcatgccattgggaaacctggcggcagcgcaaaagatg

SEQ ID NO: 86218 - DNA, 103 bp, Artificial Sequence
  Synthetic Polynucleotide
taatacgactcactatagggtcctcaatacggtgtgactccatcccaatgaacagaggagacattggatgggagtcacaaacctggcggcagcgcaaaagatg

SEQ ID NO: 86219 - DNA, 103 bp, Artificial Sequence
  Synthetic Polynucleotide
taatacgactcactataggggatctggttgtcctcaatacggtgtgactcaacagaggagagagtcaatgcgtattgagaacctggcggcagcgcaaaagatg

SEQ ID NO: 86220 - DNA, 103 bp, Artificial Sequence
  Synthetic Polynucleotide
taatacgactcactatagggaggaggctcggatctggttgtcctcaatacaacagaggagagtattgatgacaaccagaaacctggcggcagcgcaaaagatg

SEQ ID NO: 86221 - DNA, 103 bp, Artificial Sequence
  Synthetic Polynucleotide
taatacgactcactatagggggttctagctctgacaggaagccctcgaggaacagaggagacctcgaatgcttcctgtcaacctggcggcagcgcaaaagatg

SEQ ID NO: 86222 - DNA, 103 bp, Artificial Sequence
  Synthetic Polynucleotide
taatacgactcactatagggcgcagcatggaggaggctcggatctggttgaacagaggagacaaccaatgccgagcctcaacctggcggcagcgcaaaagatg

SEQ ID NO: 86223 - DNA, 103 bp, Artificial Sequence
  Synthetic Polynucleotide
taatacgactcactatagggcaggccgtggcgcagcatggaggaggctcgaacagaggagacgagccatgtccatgctgaacctggcggcagcgcaaaagatg

SEQ ID NO: 86224 - DNA, 103 bp, Artificial Sequence
  Synthetic Polynucleotide
taatacgactcactataggggctgtgcccccaggccgtggcgcagcatggaacagaggagaccatgcatggccacggccaacctggcggcagcgcaaaagatg

SEQ ID NO: 86225 - DNA, 103 bp, Artificial Sequence
  Synthetic Polynucleotide
taatacgactcactatagggagccggccgcgctgtgcccccaggccgtggaacagaggagaccacggatggggggcacaaacctggcggcagcgcaaaagatg

SEQ ID NO: 86226 - DNA, 103 bp, Artificial Sequence
  Synthetic Polynucleotide
taatacgactcactatagggctgcatgttgagccggccgcgctgtgccccaacagaggagaggggcaatgcgcggccggaacctggcggcagcgcaaaagatg

SEQ ID NO: 86227 - DNA, 103 bp, Artificial Sequence
  Synthetic Polynucleotide
taatacgactcactatagggtggcaccggtctgcatgttgagccggccgcaacagaggagagcggccatgtcaacatgcaacctggcggcagcgcaaaagatg

SEQ ID NO: 86228 - DNA, 103 bp, Artificial Sequence
  Synthetic Polynucleotide
taatacgactcactatagggtcgtcctcagtggcaccggtctgcatgttgaacagaggagacaacatatggaccggtgcaacctggcggcagcgcaaaagatg

SEQ ID NO: 86229 - DNA, 103 bp, Artificial Sequence
  Synthetic Polynucleotide
taatacgactcactatagggatcatagtagtcgtcctcagtggcaccggtaacagaggagaaccggtatgactgaggacaacctggcggcagcgcaaaagatg

SEQ ID NO: 86230 - DNA, 103 bp, Artificial Sequence
  Synthetic Polynucleotide
taatacgactcactatagggaccacgcaccatcatagtagtcgtcctcagaacagaggagactgaggatgactactatgaacctggcggcagcgcaaaagatg

SEQ ID NO: 86231 - DNA, 103 bp, Artificial Sequence
  Synthetic Polynucleotide
taatacgactcactatagggtcctcggcacaccacgcaccatcatagtagaacagaggagactactaatgtggtgcgtgaacctggcggcagcgcaaaagatg

SEQ ID NO: 86232 - DNA, 103 bp, Artificial Sequence
  Synthetic Polynucleotide
taatacgactcactatagggccggggctcaggttctagctctgacaggaaaacagaggagattcctgatggagctagaaaacctggcggcagcgcaaaagatg

SEQ ID NO: 86233 - DNA, 103 bp, Artificial Sequence
  Synthetic Polynucleotide
taatacgactcactatagggcctggcatcgtcctcggcacaccacgcaccaacagaggagaggtgcgatgtgtgccgagaacctggcggcagcgcaaaagatg

SEQ ID NO: 86234 - DNA, 103 bp, Artificial Sequence
  Synthetic Polynucleotide
taatacgactcactatagggtccactgggtcctggcatcgtcctcggcacaacagaggagagtgccgatgacgatgccaaacctggcggcagcgcaaaagatg

SEQ ID NO: 86235 - DNA, 103 bp, Artificial Sequence
  Synthetic Polynucleotide
taatacgactcactatagggtccacctctatccactgggtcctggcatcgaacagaggagacgatgcatggacccagtgaacctggcggcagcgcaaaagatg

SEQ ID NO: 86236 - DNA, 103 bp, Artificial Sequence
  Synthetic Polynucleotide
taatacgactcactatagggcctcctggtgtccacctctatccactgggtaacagaggagaacccagatgatagaggtgaacctggcggcagcgcaaaagatg

SEQ ID NO: 86237 - DNA, 103 bp, Artificial Sequence
  Synthetic Polynucleotide
taatacgactcactatagggaccgggtagtcctcctggtgtccacctctaaacagaggagatagaggatgacaccaggaaacctggcggcagcgcaaaagatg

SEQ ID NO: 86238 - DNA, 103 bp, Artificial Sequence
  Synthetic Polynucleotide
taatacgactcactatagggacgcctgtgaaccgggtagtcctcctggtgaacagaggagacaccagatggactacccgaacctggcggcagcgcaaaagatg

SEQ ID NO: 86239 - DNA, 103 bp, Artificial Sequence
  Synthetic Polynucleotide
taatacgactcactatagggctgggtgatgacgcctgtgaaccgggtagtaacagaggagaactaccatgttcacaggcaacctggcggcagcgcaaaagatg

SEQ ID NO: 86240 - DNA, 103 bp, Artificial Sequence
  Synthetic Polynucleotide
taatacgactcactatagggagtctctgccctgggtgatgacgcctgtgaaacagaggagatcacagatgtcatcacccaacctggcggcagcgcaaaagatg

SEQ ID NO: 86241 - DNA, 103 bp, Artificial Sequence
  Synthetic Polynucleotide
taatacgactcactatagggtggatgctggagtctctgccctgggtgatgaacagaggagacatcacatggggcagagaaacctggcggcagcgcaaaagatg

SEQ ID NO: 86242 - DNA, 103 bp, Artificial Sequence
  Synthetic Polynucleotide
taatacgactcactatagggaaaatcgtcatggatgctggagtctctgccaacagaggagaggcagaatgtccagcatcaacctggcggcagcgcaaaagatg

SEQ ID NO: 86243 - DNA, 103 bp, Artificial Sequence
  Synthetic Polynucleotide
taatacgactcactatagggcgtcgtcctcccggggctcaggttctagctaacagaggagaagctagatgctgagccccaacctggcggcagcgcaaaagatg

SEQ ID NO: 86244 - DNA, 103 bp, Artificial Sequence
  Synthetic Polynucleotide
taatacgactcactatagggaggtggtcacaaaatcgtcatggatgctggaacagaggagaccagcaatgatgacgattaacctggcggcagcgcaaaagatg

SEQ ID NO: 86245 - DNA, 103 bp, Artificial Sequence
  Synthetic Polynucleotide
taatacgactcactatagggcccacgaagaaggtggtcacaaaatcgtcaaacagaggagatgacgaatgtgtgaccacaacctggcggcagcgcaaaagatg

SEQ ID NO: 86246 - DNA, 103 bp, Artificial Sequence
  Synthetic Polynucleotide
taatacgactcactatagggattgctgaagcccacgaagaaggtggtcacaacagaggagagtgaccatgttcttcgtgaacctggcggcagcgcaaaagatg

SEQ ID NO: 86247 - DNA, 103 bp, Artificial Sequence
  Synthetic Polynucleotide
taatacgactcactatagggtctggctgtcattgctgaagcccacgaagaaacagaggagatcttcgatggcttcagcaaacctggcggcagcgcaaaagatg

SEQ ID NO: 86248 - DNA, 103 bp, Artificial Sequence
  Synthetic Polynucleotide
taatacgactcactatagggatcacccatgtctggctgtcattgctgaagaacagaggagacttcagatgtgacagccaaacctggcggcagcgcaaaagatg

SEQ ID NO: 86249 - DNA, 103 bp, Artificial Sequence
  Synthetic Polynucleotide
taatacgactcactataggggttggtgtacatcacccatgtctggctgtcaacagaggagagacagcatgacatgggtgaacctggcggcagcgcaaaagatg

SEQ ID NO: 86250 - DNA, 103 bp, Artificial Sequence
  Synthetic Polynucleotide
taatacgactcactatagggcctcatagccgttggtgtacatcacccatgaacagaggagacatgggatgtgtacaccaaacctggcggcagcgcaaaagatg

SEQ ID NO: 86251 - DNA, 103 bp, Artificial Sequence
  Synthetic Polynucleotide
taatacgactcactatagggaaggtcatttcctcatagccgttggtgtacaacagaggagagtacacatgcggctatgaaacctggcggcagcgcaaaagatg

SEQ ID NO: 86252 - DNA, 103 bp, Artificial Sequence
  Synthetic Polynucleotide
taatacgactcactataggggttcccatgaaaggtcatttcctcatagccaacagaggagaggctatatggaaatgaccaacctggcggcagcgcaaaagatg

SEQ ID NO: 86253 - DNA, 103 bp, Artificial Sequence
  Synthetic Polynucleotide
taatacgactcactatagggccttgtccacgttcccatgaaaggtcatttaacagaggagaaaatgaatgttcatgggaaacctggcggcagcgcaaaagatg

SEQ ID NO: 86254 - DNA, 103 bp, Artificial Sequence
  Synthetic Polynucleotide
taatacgactcactatagggggggcctccacgtcgtcctcccggggctcaaacagaggagatgagccatgggaggacgaaacctggcggcagcgcaaaagatg

SEQ ID NO: 86255 - DNA, 103 bp, Artificial Sequence
  Synthetic Polynucleotide
taatacgactcactatagggacgggtgtgtccttgtccacgttcccatgaaacagaggagatcatggatgcgtggacaaaacctggcggcagcgcaaaagatg

SEQ ID NO: 86256 - DNA, 103 bp, Artificial Sequence
  Synthetic Polynucleotide
taatacgactcactatagggctcactcagcacgggtgtgtccttgtccacaacagaggagagtggacatggacacacccaacctggcggcagcgcaaaagatg

SEQ ID NO: 86257 - DNA, 103 bp, Artificial Sequence
  Synthetic Polynucleotide
taatacgactcactataggggctctgggagctcactcagcacgggtgtgtaacagaggagaacacacatgtgctgagtgaacctggcggcagcgcaaaagatg

SEQ ID NO: 86258 - DNA, 103 bp, Artificial Sequence
  Synthetic Polynucleotide
taatacgactcactataggggccaccaccggctctgggagctcactcagcaacagaggagagctgagatggctcccagaaacctggcggcagcgcaaaagatg

SEQ ID NO: 86259 - DNA, 103 bp, Artificial Sequence
  Synthetic Polynucleotide
taatacgactcactataggggatgaaacgagccaccaccggctctgggagaacagaggagactcccaatgccggtggtgaacctggcggcagcgcaaaagatg

SEQ ID NO: 86260 - DNA, 103 bp, Artificial Sequence
  Synthetic Polynucleotide
taatacgactcactatagggggtagatgcggatgaaacgagccaccaccgaacagaggagacggtggatgctcgtttcaaacctggcggcagcgcaaaagatg

SEQ ID NO: 86261 - DNA, 103 bp, Artificial Sequence
  Synthetic Polynucleotide
taatacgactcactatagggcaggtgagtgggtagatgcggatgaaacgaaacagaggagatcgtttatgccgcatctaaacctggcggcagcgcaaaagatg

SEQ ID NO: 86262 - DNA, 103 bp, Artificial Sequence
  Synthetic Polynucleotide
taatacgactcactataggggctgccattccaggtgagtgggtagatgcgaacagaggagacgcatcatgccactcaccaacctggcggcagcgcaaaagatg

SEQ ID NO: 86263 - DNA, 103 bp, Artificial Sequence
  Synthetic Polynucleotide
taatacgactcactataggggcatgcacaggctgccattccaggtgagtgaacagaggagacactcaatgggaatggcaaacctggcggcagcgcaaaagatg

SEQ ID NO: 86264 - DNA, 103 bp, Artificial Sequence
  Synthetic Polynucleotide
taatacgactcactatagggacctccaggcgcatgcacaggctgccattcaacagaggagagaatggatgcctgtgcataacctggcggcagcgcaaaagatg

SEQ ID NO: 86265 - DNA, 103 bp, Artificial Sequence
  Synthetic Polynucleotide
taatacgactcactataggggggaggcggcggggcctccacgtcgtcctcaacagaggagagaggacatggtggaggccaacctggcggcagcgcaaaagatg

SEQ ID NO: 86266 - DNA, 103 bp, Artificial Sequence
  Synthetic Polynucleotide
taatacgactcactataggggcaccccagcacctccaggcgcatgcacagaacagaggagactgtgcatgcgcctggagaacctggcggcagcgcaaaagatg

SEQ ID NO: 86267 - DNA, 103 bp, Artificial Sequence
  Synthetic Polynucleotide
taatacgactcactataggggggccacagagcaccccagcacctccaggcaacagaggagagcctggatgtgctggggtaacctggcggcagcgcaaaagatg

SEQ ID NO: 86268 - DNA, 103 bp, Artificial Sequence
  Synthetic Polynucleotide
taatacgactcactatagggctgtagacaggggccacagagcaccccagcaacagaggagagctgggatgctctgtggcaacctggcggcagcgcaaaagatg

SEQ ID NO: 86269 - DNA, 103 bp, Artificial Sequence
  Synthetic Polynucleotide
taatacgactcactatagggtgcgtagtagctgtagacaggggccacagaaacagaggagatctgtgatgcctgtctacaacctggcggcagcgcaaaagatg

SEQ ID NO: 86270 - DNA, 103 bp, Artificial Sequence
  Synthetic Polynucleotide
taatacgactcactatagggcctcattctgtgcgtagtagctgtagacagaacagaggagactgtctatggctactacgaacctggcggcagcgcaaaagatg

SEQ ID NO: 86271 - DNA, 103 bp, Artificial Sequence
  Synthetic Polynucleotide
taatacgactcactataggggtggccaccacctcattctgtgcgtagtagaacagaggagactactaatgacagaatgaaacctggcggcagcgcaaaagatg

SEQ ID NO: 86272 - DNA, 103 bp, Artificial Sequence
  Synthetic Polynucleotide
taatacgactcactatagggcaggtcatcggtggccaccacctcattctgaacagaggagacagaatatggtggtggccaacctggcggcagcgcaaaagatg

SEQ ID NO: 86273 - DNA, 103 bp, Artificial Sequence
  Synthetic Polynucleotide
taatacgactcactataggggccggaaatccaggtcatcggtggccaccaaacagaggagatggtggatgccgatgaccaacctggcggcagcgcaaaagatg

SEQ ID NO: 86274 - DNA, 103 bp, Artificial Sequence
  Synthetic Polynucleotide
taatacgactcactatagggtagctgtggtgccggaaatccaggtcatcgaacagaggagacgatgaatgggatttccgaacctggcggcagcgcaaaagatg

SEQ ID NO: 86275 - DNA, 103 bp, Artificial Sequence
  Synthetic Polynucleotide
taatacgactcactatagggcatgtccttgtagctgtggtgccggaaatcaacagaggagagatttcatgcaccacagcaacctggcggcagcgcaaaagatg

SEQ ID NO: 86276 - DNA, 103 bp, Artificial Sequence
  Synthetic Polynucleotide
taatacgactcactataggggggtgggctcgggaggcggcggggcctccaaacagaggagatggaggatgcgccgcctcaacctggcggcagcgcaaaagatg

SEQ ID NO: 86277 - DNA, 103 bp, Artificial Sequence
  Synthetic Polynucleotide
taatacgactcactatagggtgagctggcgcatgtccttgtagctgtggtaacagaggagaaccacaatgacaaggacaaacctggcggcagcgcaaaagatg

SEQ ID NO: 86278 - DNA, 103 bp, Artificial Sequence
  Synthetic Polynucleotide
taatacgactcactatagggaccaccttcatgagctggcgcatgtccttgaacagaggagacaaggaatggcgccagctaacctggcggcagcgcaaaagatg

SEQ ID NO: 86279 - DNA, 103 bp, Artificial Sequence
  Synthetic Polynucleotide
taatacgactcactatagggctcctcgttcaccaccttcatgagctggcgaacagaggagacgccagatgatgaaggtgaacctggcggcagcgcaaaagatg

SEQ ID NO: 86280 - DNA, 103 bp, Artificial Sequence
  Synthetic Polynucleotide
taatacgactcactatagggtggtggggcactcctcgttcaccaccttcaaacagaggagatgaaggatgtgaacgaggaacctggcggcagcgcaaaagatg

SEQ ID NO: 86281 - DNA, 103 bp, Artificial Sequence
  Synthetic Polynucleotide
taatacgactcactataggggtgcgggtgatggtggggcactcctcgttcaacagaggagagaacgaatggtgccccacaacctggcggcagcgcaaaagatg

SEQ ID NO: 86282 - DNA, 103 bp, Artificial Sequence
  Synthetic Polynucleotide
taatacgactcactatagggcaggctgtaagtgcgggtgatggtggggcaaacagaggagatgccccatgatcacccgcaacctggcggcagcgcaaaagatg

SEQ ID NO: 86283 - DNA, 103 bp, Artificial Sequence
  Synthetic Polynucleotide
taatacgactcactatagggagctcttgcccaggctgtaagtgcgggtgaaacagaggagatcacccatgcttacagccaacctggcggcagcgcaaaagatg

SEQ ID NO: 86284 - DNA, 103 bp, Artificial Sequence
  Synthetic Polynucleotide
taatacgactcactatagggaggcctcgtgagctcttgcccaggctgtaaaacagaggagattacagatggggcaagagaacctggcggcagcgcaaaagatg

SEQ ID NO: 86285 - DNA, 103 bp, Artificial Sequence
  Synthetic Polynucleotide
taatacgactcactatagggatagatcttgaggcctcgtgagctcttgccaacagaggagaggcaagatgtcacgaggcaacctggcggcagcgcaaaagatg

SEQ ID NO: 86286 - DNA, 103 bp, Artificial Sequence
  Synthetic Polynucleotide
taatacgactcactatagggtctccatggcatagatcttgaggcctcgtgaacagaggagacacgagatgtcaagatctaacctggcggcagcgcaaaagatg

SEQ ID NO: 86287 - DNA, 103 bp, Artificial Sequence
  Synthetic Polynucleotide
taatacgactcactatagggcggacccgcggggtgggctcgggaggcggcaacagaggagagccgccatgcgagcccacaacctggcggcagcgcaaaagatg

SEQ ID NO: 86288 - DNA, 103 bp, Artificial Sequence
  Synthetic Polynucleotide
taatacgactcactatagggttgtctgagatctccatggcatagatcttgaacagaggagacaagatatgtgccatggaaacctggcggcagcgcaaaagatg

SEQ ID NO: 86289 - DNA, 103 bp, Artificial Sequence
  Synthetic Polynucleotide
taatacgactcactatagggctccccagggttgtctgagatctccatggcaacagaggagagccatgatgatctcagacaacctggcggcagcgcaaaagatg

SEQ ID NO: 86290 - DNA, 103 bp, Artificial Sequence
  Synthetic Polynucleotide
taatacgactcactatagggccagttcatgctccccagggttgtctgagaaacagaggagatctcagatgaccctggggaacctggcggcagcgcaaaagatg

SEQ ID NO: 86291 - DNA, 103 bp, Artificial Sequence
  Synthetic Polynucleotide
taatacgactcactatagggtcgggctcccccagttcatgctccccagggaacagaggagaccctggatggcatgaactaacctggcggcagcgcaaaagatg

SEQ ID NO: 86292 - DNA, 103 bp, Artificial Sequence
  Synthetic Polynucleotide
taatacgactcactataggggtagcggaactcgggctcccccagttcatgaacagaggagacatgaaatgggggagcccaacctggcggcagcgcaaaagatg

SEQ ID NO: 86293 - DNA, 103 bp, Artificial Sequence
  Synthetic Polynucleotide
taatacgactcactatagggtcccagcagtgtagcggaactcgggctcccaacagaggagagggagcatgagttccgctaacctggcggcagcgcaaaagatg

SEQ ID NO: 86294 - DNA, 103 bp, Artificial Sequence
  Synthetic Polynucleotide
taatacgactcactatagggttgccatggatcccagcagtgtagcggaacaacagaggagagttccgatgcactgctggaacctggcggcagcgcaaaagatg

SEQ ID NO: 86295 - DNA, 103 bp, Artificial Sequence
  Synthetic Polynucleotide
taatacgactcactatagggcagcacctcgttgccatggatcccagcagtaacagaggagaactgctatgatccatggcaacctggcggcagcgcaaaagatg

SEQ ID NO: 86296 - DNA, 103 bp, Artificial Sequence
  Synthetic Polynucleotide
taatacgactcactataggggctctcggcccagcacctcgttgccatggaaacagaggagatccatgatgacgaggtgcaacctggcggcagcgcaaaagatg

SEQ ID NO: 86297 - DNA, 103 bp, Artificial Sequence
  Synthetic Polynucleotide
taatacgactcactatagggagcagcaacagctctcggcccagcacctcgaacagaggagacgaggtatggggccgagaaacctggcggcagcgcaaaagatg

SEQ ID NO: 86298 - DNA, 103 bp, Artificial Sequence
  Synthetic Polynucleotide
taatacgactcactatagggctgggcttttcggacccgcggggtgggctcaacagaggagagagcccatgccgcgggtcaacctggcggcagcgcaaaagatg

SEQ ID NO: 86299 - DNA, 103 bp, Artificial Sequence
  Synthetic Polynucleotide
taatacgactcactatagggctgcatgagcagcagcaacagctctcggccaacagaggagaggccgaatgctgttgctgaacctggcggcagcgcaaaagatg

SEQ ID NO: 86300 - DNA, 103 bp, Artificial Sequence
  Synthetic Polynucleotide
taatacgactcactatagggggcacaggtactgcatgagcagcagcaacaaacagaggagatgttgcatgtgctcatgcaacctggcggcagcgcaaaagatg

SEQ ID NO: 86301 - DNA, 103 bp, Artificial Sequence
  Synthetic Polynucleotide
taatacgactcactatagggcggtactctcggcacaggtactgcatgagcaacagaggagagctcatatggtacctgtgaacctggcggcagcgcaaaagatg

SEQ ID NO: 86302 - DNA, 103 bp, Artificial Sequence
  Synthetic Polynucleotide
taatacgactcactataggggttcccatcgcggtactctcggcacaggtaaacagaggagatacctgatgcgagagtacaacctggcggcagcgcaaaagatg

SEQ ID NO: 86303 - DNA, 103 bp, Artificial Sequence
  Synthetic Polynucleotide
taatacgactcactataggggcacacgtgggttcccatcgcggtactctcaacagaggagagagagtatggcgatgggaaacctggcggcagcgcaaaagatg

SEQ ID NO: 86304 - DNA, 103 bp, Artificial Sequence
  Synthetic Polynucleotide
taatacgactcactatagggaccaggctgcgcacacgtgggttcccatcgaacagaggagacgatggatgcccacgtgtaacctggcggcagcgcaaaagatg

SEQ ID NO: 86305 - DNA, 103 bp, Artificial Sequence
  Synthetic Polynucleotide
taatacgactcactatagggtgtgtcctgcaccaggctgcgcacacgtggaacagaggagaccacgtatgcgcagcctgaacctggcggcagcgcaaaagatg

SEQ ID NO: 86306 - DNA, 103 bp, Artificial Sequence
  Synthetic Polynucleotide
taatacgactcactatagggggtggatgcgtgtgtcctgcaccaggctgcaacagaggagagcagccatgtgcaggacaaacctggcggcagcgcaaaagatg

SEQ ID NO: 86307 - DNA, 103 bp, Artificial Sequence
  Synthetic Polynucleotide
taatacgactcactataggggagggcaccaggtggatgcgtgtgtcctgcaacagaggagagcaggaatgacgcatccaaacctggcggcagcgcaaaagatg

SEQ ID NO: 86308 - DNA, 103 bp, Artificial Sequence
  Synthetic Polynucleotide
taatacgactcactatagggagggttcagtgagggcaccaggtggatgcgaacagaggagacgcatcatgctggtgcccaacctggcggcagcgcaaaagatg

SEQ ID NO: 86309 - DNA, 103 bp, Artificial Sequence
  Synthetic Polynucleotide
taatacgactcactatagggggaggcagctgagcaggggcgccccgcgcaaacagaggagatgcgcgatgcgcccctgcaacctggcggcagcgcaaaagatg

SEQ ID NO: 86310 - DNA, 103 bp, Artificial Sequence
  Synthetic Polynucleotide
taatacgactcactatagggtgccccccgcctgggcttttcggacccgcgaacagaggagacgcgggatggaaaagcccaacctggcggcagcgcaaaagatg

SEQ ID NO: 86311 - DNA, 103 bp, Artificial Sequence
  Synthetic Polynucleotide
taatacgactcactatagggcgtagccatcagggttcagtgagggcaccaaacagaggagatggtgcatgcactgaaccaacctggcggcagcgcaaaagatg

SEQ ID NO: 86312 - DNA, 103 bp, Artificial Sequence
  Synthetic Polynucleotide
taatacgactcactataggggctgccacctcgtagccatcagggttcagtaacagaggagaactgaaatgtgatggctaaacctggcggcagcgcaaaagatg

SEQ ID NO: 86313 - DNA, 103 bp, Artificial Sequence
  Synthetic Polynucleotide
taatacgactcactataggggcccatctgcgctgccacctcgtagccatcaacagaggagagatggcatggaggtggcaaacctggcggcagcgcaaaagatg

SEQ ID NO: 86314 - DNA, 103 bp, Artificial Sequence
  Synthetic Polynucleotide
taatacgactcactatagggcaaactctgagcccatctgcgctgccacctaacagaggagaaggtggatgcgcagatggaacctggcggcagcgcaaaagatg

SEQ ID NO: 86315 - DNA, 103 bp, Artificial Sequence
  Synthetic Polynucleotide
taatacgactcactataggggcccagttcccaaactctgagcccatctgcaacagaggagagcagatatgctcagagttaacctggcggcagcgcaaaagatg

SEQ ID NO: 86316 - DNA, 103 bp, Artificial Sequence
  Synthetic Polynucleotide
taatacgactcactatagggcagtcccagcgcccagttcccaaactctgaaacagaggagatcagagatggggaactggaacctggcggcagcgcaaaagatg

SEQ ID NO: 86317 - DNA, 103 bp, Artificial Sequence
  Synthetic Polynucleotide
taatacgactcactatagggcctcagtccacagtcccagcgcccagttccaacagaggagaggaactatgcgctgggacaacctggcggcagcgcaaaagatg

SEQ ID NO: 86318 - DNA, 103 bp, Artificial Sequence
  Synthetic Polynucleotide
taatacgactcactatagggtcaaagccctcctcagtccacagtcccagcaacagaggagagctgggatggtggactgaaacctggcggcagcgcaaaagatg

SEQ ID NO: 86319 - DNA, 103 bp, Artificial Sequence
  Synthetic Polynucleotide
taatacgactcactatagggttcaaagatgtcaaagccctcctcagtccaaacagaggagatggactatggagggctttaacctggcggcagcgcaaaagatg

SEQ ID NO: 86320 - DNA, 103 bp, Artificial Sequence
  Synthetic Polynucleotide
taatacgactcactatagggccgggaaatcttcaaagatgtcaaagccctaacagaggagaagggctatgacatctttgaacctggcggcagcgcaaaagatg

SEQ ID NO: 86321 - DNA, 103 bp, Artificial Sequence
  Synthetic Polynucleotide
taatacgactcactatagggttccctggcttgccccccgcctgggcttttaacagaggagaaaaagcatgggcggggggaacctggcggcagcgcaaaagatg

SEQ ID NO: 86322 - DNA, 103 bp, Artificial Sequence
  Synthetic Polynucleotide
taatacgactcactataggggagttgagatccgggaaatcttcaaagatgaacagaggagacatcttatgagatttcccaacctggcggcagcgcaaaagatg

SEQ ID NO: 86323 - DNA, 103 bp, Artificial Sequence
  Synthetic Polynucleotide
taatacgactcactatagggccagagcacagagttgagatccgggaaatcaacagaggagagatttcatggatctcaacaacctggcggcagcgcaaaagatg

SEQ ID NO: 86324 - DNA, 103 bp, Artificial Sequence
  Synthetic Polynucleotide
taatacgactcactatagggcctcagctccccagagcacagagttgagataacagaggagaatctcaatgctgtgctctaacctggcggcagcgcaaaagatg

SEQ ID NO: 86325 - DNA, 103 bp, Artificial Sequence
  Synthetic Polynucleotide
taatacgactcactatagggcatttcctctcctcagctccccagagcacaaacagaggagatgtgctatggggagctgaaacctggcggcagcgcaaaagatg

SEQ ID NO: 86326 - DNA, 103 bp, Artificial Sequence
  Synthetic Polynucleotide
taatacgactcactataggggtaggggacccatttcctctcctcagctccaacagaggagaggagctatggagaggaaaaacctggcggcagcgcaaaagatg

SEQ ID NO: 86327 - DNA, 103 bp, Artificial Sequence
  Synthetic Polynucleotide
taatacgactcactatagggtggggacccggtaggggacccatttcctctaacagaggagaagaggaatggggtcccctaacctggcggcagcgcaaaagatg

SEQ ID NO: 86328 - DNA, 103 bp, Artificial Sequence
  Synthetic Polynucleotide
taatacgactcactatagggaagttattgttggggacccggtaggggaccaacagaggagaggtcccatgccgggtcccaacctggcggcagcgcaaaagatg

SEQ ID NO: 86329 - DNA, 103 bp, Artificial Sequence
  Synthetic Polynucleotide
taatacgactcactatagggagggatgggcaagttattgttggggacccgaacagaggagacgggtcatgaacaataacaacctggcggcagcgcaaaagatg

SEQ ID NO: 86330 - DNA, 103 bp, Artificial Sequence
  Synthetic Polynucleotide
taatacgactcactatagggggtagcgttcagggatgggcaagttattgtaacagaggagaacaataatgtgcccatccaacctggcggcagcgcaaaagatg

SEQ ID NO: 86331 - DNA, 103 bp, Artificial Sequence
  Synthetic Polynucleotide
taatacgactcactatagggtctggcgaaaggtagcgttcagggatgggcaacagaggagagcccatatgtgaacgctaaacctggcggcagcgcaaaagatg

SEQ ID NO: 86332 - DNA, 103 bp, Artificial Sequence
  Synthetic Polynucleotide
taatacgactcactatagggccctggccgcttccctggcttgccccccgcaacagaggagagcggggatgaagccagggaacctggcggcagcgcaaaagatg

SEQ ID NO: 86333 - DNA, 103 bp, Artificial Sequence
  Synthetic Polynucleotide
taatacgactcactatagggtaccgtggcatctggcgaaaggtagcgttcaacagaggagagaacgcatgctttcgccaaacctggcggcagcgcaaaagatg

SEQ ID NO: 86334 - DNA, 103 bp, Artificial Sequence
  Synthetic Polynucleotide
taatacgactcactatagggcctccgtggataccgtggcatctggcgaaaaacagaggagatttcgcatgatgccacggaacctggcggcagcgcaaaagatg

SEQ ID NO: 86335 - DNA, 103 bp, Artificial Sequence
  Synthetic Polynucleotide
taatacgactcactatagggatggcccggacctccgtggataccgtggcaaacagaggagatgccacatgatccacggaaacctggcggcagcgcaaaagatg

SEQ ID NO: 86336 - DNA, 103 bp, Artificial Sequence
  Synthetic Polynucleotide
taatacgactcactatagggccaggcaatgatggcccggacctccgtggaaacagaggagatccacgatggtccgggccaacctggcggcagcgcaaaagatg

SEQ ID NO: 86337 - DNA, 103 bp, Artificial Sequence
  Synthetic Polynucleotide
taatacgactcactatagggtcttctccatccaggcaatgatggcccggaaacagaggagatccgggatgtcattgcctaacctggcggcagcgcaaaagatg

SEQ ID NO: 86338 - DNA, 103 bp, Artificial Sequence
  Synthetic Polynucleotide
taatacgactcactatagggacgaaggggttcttctccatccaggcaatgaacagaggagacattgcatggatggagaaaacctggcggcagcgcaaaagatg

SEQ ID NO: 86339 - DNA, 103 bp, Artificial Sequence
  Synthetic Polynucleotide
taatacgactcactatagggtgctcccagcacgaaggggttcttctccataacagaggagaatggagatgaaccccttcaacctggcggcagcgcaaaagatg

SEQ ID NO: 86340 - DNA, 103 bp, Artificial Sequence
  Synthetic Polynucleotide
taatacgactcactatagggcgttcagatttgctcccagcacgaaggggtaacagaggagaacccctatgtgctgggagaacctggcggcagcgcaaaagatg

SEQ ID NO: 86341 - DNA, 103 bp, Artificial Sequence
  Synthetic Polynucleotide
taatacgactcactatagggcgctcgccgccgttcagatttgctcccagcaacagaggagagctgggatgaaatctgaaaacctggcggcagcgcaaaagatg

SEQ ID NO: 86342 - DNA, 103 bp, Artificial Sequence
  Synthetic Polynucleotide
taatacgactcactatagggggatactagccgctcgccgccgttcagattaacagaggagaaatctgatgggcggcgagaacctggcggcagcgcaaaagatg

SEQ ID NO: 86343 - DNA, 103 bp, Artificial Sequence
  Synthetic Polynucleotide
taatacgactcactatagggctgcggccgtccctggccgcttccctggctaacagaggagaagccagatgagcggccagaacctggcggcagcgcaaaagatg

SEQ ID NO: 86344 - DNA, 103 bp, Artificial Sequence
  Synthetic Polynucleotide
taatacgactcactatagggcgtaggggtaggatactagccgctcgccgcaacagaggagagcggcgatgggctagtataacctggcggcagcgcaaaagatg

SEQ ID NO: 86345 - DNA, 103 bp, Artificial Sequence
  Synthetic Polynucleotide
taatacgactcactatagggcgggccatatcgtaggggtaggatactagcaacagaggagagctagtatgctacccctaaacctggcggcagcgcaaaagatg

SEQ ID NO: 86346 - DNA, 103 bp, Artificial Sequence
  Synthetic Polynucleotide
taatacgactcactatagggggtaggcgtgcgggccatatcgtaggggtaaacagaggagataccccatggatatggccaacctggcggcagcgcaaaagatg

SEQ ID NO: 86347 - DNA, 103 bp, Artificial Sequence
  Synthetic Polynucleotide
taatacgactcactataggggctgctcctgggtaggcgtgcgggccatataacagaggagaatatggatggcacgcctaaacctggcggcagcgcaaaagatg

SEQ ID NO: 86348 - DNA, 103 bp, Artificial Sequence
  Synthetic Polynucleotide
taatacgactcactataggggcggccagcagctgctcctgggtaggcgtgaacagaggagacacgccatgccaggagcaaacctggcggcagcgcaaaagatg

SEQ ID NO: 86349 - DNA, 103 bp, Artificial Sequence
  Synthetic Polynucleotide
taatacgactcactatagggtgccatggctgcggccagcagctgctcctgaacagaggagacaggagatgctgctggccaacctggcggcagcgcaaaagatg

SEQ ID NO: 86350 - DNA, 103 bp, Artificial Sequence
  Synthetic Polynucleotide
taatacgactcactatagggcccgggctgctgccatggctgcggccagcaaacagaggagatgctggatgcagccatggaacctggcggcagcgcaaaagatg

SEQ ID NO: 86351 - DNA, 103 bp, Artificial Sequence
  Synthetic Polynucleotide
taatacgactcactatagggtcatcctccccccgggctgctgccatggctaacagaggagaagccatatgagcagcccgaacctggcggcagcgcaaaagatg

SEQ ID NO: 86352 - DNA, 103 bp, Artificial Sequence
  Synthetic Polynucleotide
taatacgactcactataggggacctcgtcctcatcctccccccgggctgcaacagaggagagcagccatgggggaggataacctggcggcagcgcaaaagatg

SEQ ID NO: 86353 - DNA, 103 bp, Artificial Sequence
  Synthetic Polynucleotide
taatacgactcactataggggggcctcggagacctcgtcctcatcctcccaacagaggagagggaggatgaggacgaggaacctggcggcagcgcaaaagatg

SEQ ID NO: 86354 - DNA, 103 bp, Artificial Sequence
  Synthetic Polynucleotide
taatacgactcactatagggggaggcacttctgcggccgtccctggccgcaacagaggagagcggccatggacggccgcaacctggcggcagcgcaaaagatg

SEQ ID NO: 86355 - DNA, 103 bp, Artificial Sequence
  Synthetic Polynucleotide
taatacgactcactatagggggagtctcctgggcctcggagacctcgtccaacagaggagaggacgaatgctccgaggcaacctggcggcagcgcaaaagatg

SEQ ID NO: 86356 - DNA, 103 bp, Artificial Sequence
  Synthetic Polynucleotide
taatacgactcactatagggggcgtggtctggagtctcctgggcctcggaaacagaggagatccgagatgcaggagactaacctggcggcagcgcaaaagatg

SEQ ID NO: 86357 - DNA, 103 bp, Artificial Sequence
  Synthetic Polynucleotide
taatacgactcactatagggaccggaagatggcgtggtctggagtctcctaacagaggagaaggagaatgcagaccacgaacctggcggcagcgcaaaagatg

SEQ ID NO: 86358 - DNA, 103 bp, Artificial Sequence
  Synthetic Polynucleotide
taatacgactcactatagggatggcaagccaccggaagatggcgtggtctaacagaggagaagaccaatgcatcttccgaacctggcggcagcgcaaaagatg

SEQ ID NO: 86359 - DNA, 103 bp, Artificial Sequence
  Synthetic Polynucleotide
taatacgactcactatagggggcgaaggagatggcaagccaccggaagataacagaggagaatcttcatgtggcttgccaacctggcggcagcgcaaaagatg

SEQ ID NO: 86360 - DNA, 103 bp, Artificial Sequence
  Synthetic Polynucleotide
taatacgactcactatagggggtgtgcggaggcgaaggagatggcaagccaacagaggagaggcttgatgtctccttcgaacctggcggcagcgcaaaagatg

SEQ ID NO: 86361 - DNA, 103 bp, Artificial Sequence
  Synthetic Polynucleotide
taatacgactcactataggggtcaaggtgaggtgtgcggaggcgaaggagaacagaggagactccttatgctccgcacaaacctggcggcagcgcaaaagatg

SEQ ID NO: 86362 - DNA, 103 bp, Artificial Sequence
  Synthetic Polynucleotide
taatacgactcactataggggtagggctcggtcaaggtgaggtgtgcggaaacagaggagatccgcaatgctcaccttgaacctggcggcagcgcaaaagatg

SEQ ID NO: 86363 - DNA, 103 bp, Artificial Sequence
  Synthetic Polynucleotide
taatacgactcactatagggagcctccgcggtagggctcggtcaaggtgaaacagaggagatcacctatgccgagccctaacctggcggcagcgcaaaagatg

SEQ ID NO: 86364 - DNA, 103 bp, Artificial Sequence
  Synthetic Polynucleotide
taatacgactcactatagggtgggcttggcagcctccgcggtagggctcgaacagaggagacgagccatgccgcggaggaacctggcggcagcgcaaaagatg

SEQ ID NO: 86365 - DNA, 103 bp, Artificial Sequence
  Synthetic Polynucleotide
taatacgactcactatagggggtcttttccggaggcacttctgcggccgtaacagaggagaacggccatggaagtgcctaacctggcggcagcgcaaaagatg

SEQ ID NO: 86366 - DNA, 103 bp, Artificial Sequence
  Synthetic Polynucleotide
taatacgactcactatagggggtgtagtcctgggcttggcagcctccgcgaacagaggagacgcggaatgtgccaagccaacctggcggcagcgcaaaagatg

SEQ ID NO: 86367 - DNA, 103 bp, Artificial Sequence
  Synthetic Polynucleotide
taatacgactcactatagggccatgccgccggtgtagtcctgggcttggcaacagaggagagccaagatgaggactacaaacctggcggcagcgcaaaagatg

SEQ ID NO: 86368 - DNA, 103 bp, Artificial Sequence
  Synthetic Polynucleotide
taatacgactcactatagggttgacgatgcccatgccgccggtgtagtccaacagaggagaggactaatgcggcggcataacctggcggcagcgcaaaagatg

SEQ ID NO: 86369 - DNA, 103 bp, Artificial Sequence
  Synthetic Polynucleotide
taatacgactcactatagggcttggccccgttgacgatgcccatgccgccaacagaggagaggcggcatgggcatcgtcaacctggcggcagcgcaaaagatg

SEQ ID NO: 86370 - DNA, 103 bp, Artificial Sequence
  Synthetic Polynucleotide
taatacgactcactataggggggggttccacttggccccgttgacgatgcaacagaggagagcatcgatgacggggccaaacctggcggcagcgcaaaagatg

SEQ ID NO: 86371 - DNA, 103 bp, Artificial Sequence
  Synthetic Polynucleotide
taatacgactcactataggggtcccggtccgggggttccacttggccccgaacagaggagacggggcatggtggaacccaacctggcggcagcgcaaaagatg

SEQ ID NO: 86372 - DNA, 103 bp, Artificial Sequence
  Synthetic Polynucleotide
taatacgactcactataggggtcattgatagtcccggtccgggggttccaaacagaggagatggaacatgcggaccgggaacctggcggcagcgcaaaagatg

SEQ ID NO: 86373 - DNA, 103 bp, Artificial Sequence
  Synthetic Polynucleotide
taatacgactcactatagggggtaactgaagtcattgatagtcccggtccaacagaggagaggaccgatgctatcaatgaacctggcggcagcgcaaaagatg

SEQ ID NO: 86374 - DNA, 103 bp, Artificial Sequence
  Synthetic Polynucleotide
taatacgactcactatagggttggtatgcaggtaactgaagtcattgataaacagaggagatatcaaatgcttcagttaaacctggcggcagcgcaaaagatg

SEQ ID NO: 86375 - DNA, 103 bp, Artificial Sequence
  Synthetic Polynucleotide
taatacgactcactatagggctccaggcagttggtatgcaggtaactgaaaacagaggagattcagtatgctgcataccaacctggcggcagcgcaaaagatg

SEQ ID NO: 86376 - DNA, 103 bp, Artificial Sequence
  Synthetic Polynucleotide
taatacgactcactatagggctttgtctttggtcttttccggaggcacttaacagaggagaaagtgcatgcggaaaagaaacctggcggcagcgcaaaagatg

SEQ ID NO: 86377 - DNA, 103 bp, Artificial Sequence
  Synthetic Polynucleotide
taatacgactcactatagggagaaggagagctccaggcagttggtatgcaaacagaggagatgcataatgactgcctggaacctggcggcagcgcaaaagatg

SEQ ID NO: 86378 - DNA, 103 bp, Artificial Sequence
  Synthetic Polynucleotide
taatacgactcactatagggcagcccaggtagaaggagagctccaggcagaacagaggagactgcctatggctctccttaacctggcggcagcgcaaaagatg

SEQ ID NO: 86379 - DNA, 103 bp, Artificial Sequence
  Synthetic Polynucleotide
taatacgactcactataggggaacttgtcacagcccaggtagaaggagagaacagaggagactctccatgtacctgggcaacctggcggcagcgcaaaagatg

SEQ ID NO: 86380 - DNA, 103 bp, Artificial Sequence
  Synthetic Polynucleotide
taatacgactcactatagggtctcatgagggaacttgtcacagcccaggtaacagaggagaacctggatggtgacaagtaacctggcggcagcgcaaaagatg

SEQ ID NO: 86381 - DNA, 103 bp, Artificial Sequence
  Synthetic Polynucleotide
taatacgactcactatagggggcagctcactctcatgagggaacttgtcaaacagaggagatgacaaatgccctcatgaaacctggcggcagcgcaaaagatg

SEQ ID NO: 86382 - DNA, 103 bp, Artificial Sequence
  Synthetic Polynucleotide
taatacgactcactatagggccactcgcggggcagctcactctcatgaggaacagaggagacctcatatgagtgagctgaacctggcggcagcgcaaaagatg

SEQ ID NO: 86383 - DNA, 103 bp, Artificial Sequence
  Synthetic Polynucleotide
taatacgactcactatagggtgttgttctcccactcgcggggcagctcacaacagaggagagtgagcatgcccgcgagtaacctggcggcagcgcaaaagatg

SEQ ID NO: 86384 - DNA, 103 bp, Artificial Sequence
  Synthetic Polynucleotide
taatacgactcactatagggagcgcctccttgttgttctcccactcgcggaacagaggagaccgcgaatgggagaacaaaacctggcggcagcgcaaaagatg

SEQ ID NO: 86385 - DNA, 103 bp, Artificial Sequence
  Synthetic Polynucleotide
taatacgactcactataggggaaggtgagcagcgcctccttgttgttctcaacagaggagagagaacatgaaggaggcgaacctggcggcagcgcaaaagatg

SEQ ID NO: 86386 - DNA, 103 bp, Artificial Sequence
  Synthetic Polynucleotide
taatacgactcactatagggcctgctccatgaaggtgagcagcgcctcctaacagaggagaaggaggatgtgctcacctaacctggcggcagcgcaaaagatg

SEQ ID NO: 86387 - DNA, 103 bp, Artificial Sequence
  Synthetic Polynucleotide
taatacgactcactatagggcctttcttccctttgtctttggtcttttccaacagaggagaggaaaaatgcaaagacaaaacctggcggcagcgcaaaagatg

SEQ ID NO: 86388 - DNA, 103 bp, Artificial Sequence
  Synthetic Polynucleotide
taatacgactcactatagggccgcggtgcacctgctccatgaaggtgagcaacagaggagagctcacatgcatggagcaaacctggcggcagcgcaaaagatg

SEQ ID NO: 86389 - DNA, 103 bp, Artificial Sequence
  Synthetic Polynucleotide
taatacgactcactatagggccccttaatgccgcggtgcacctgctccataacagaggagaatggagatggtgcaccgcaacctggcggcagcgcaaaagatg

SEQ ID NO: 86390 - DNA, 103 bp, Artificial Sequence
  Synthetic Polynucleotide
taatacgactcactatagggccgtcaccacccccttaatgccgcggtgcaaacagaggagatgcaccatggcattaaggaacctggcggcagcgcaaaagatg

SEQ ID NO: 86391 - DNA, 103 bp, Artificial Sequence
  Synthetic Polynucleotide
taatacgactcactatagggccttgctcgtccgtcaccacccccttaatgaacagaggagacattaaatgggtggtgacaacctggcggcagcgcaaaagatg

SEQ ID NO: 86392 - DNA, 103 bp, Artificial Sequence
  Synthetic Polynucleotide
taatacgactcactatagggaatggggatgccttgctcgtccgtcaccacaacagaggagagtggtgatggacgagcaaaacctggcggcagcgcaaaagatg

SEQ ID NO: 86393 - DNA, 103 bp, Artificial Sequence
  Synthetic Polynucleotide
taatacgactcactatagggtggcgttggcaatggggatgccttgctcgtaacagaggagaacgagcatggcatccccaaacctggcggcagcgcaaaagatg

SEQ ID NO: 86394 - DNA, 103 bp, Artificial Sequence
  Synthetic Polynucleotide
taatacgactcactatagggacagagatggtggcgttggcaatggggatgaacagaggagacatcccatgtgccaacgcaacctggcggcagcgcaaaagatg

SEQ ID NO: 86395 - DNA, 103 bp, Artificial Sequence
  Synthetic Polynucleotide
taatacgactcactatagggaatgccactcacagagatggtggcgttggcaacagaggagagccaacatgaccatctctaacctggcggcagcgcaaaagatg

SEQ ID NO: 86396 - DNA, 103 bp, Artificial Sequence
  Synthetic Polynucleotide
taatacgactcactatagggcgccgtgattaatgccactcacagagatggaacagaggagaccatctatgtgagtggcaaacctggcggcagcgcaaaagatg

SEQ ID NO: 86397 - DNA, 103 bp, Artificial Sequence
  Synthetic Polynucleotide
taatacgactcactataggggctgtcttcacgccgtgattaatgccactcaacagaggagagagtggatgtaatcacggaacctggcggcagcgcaaaagatg

SEQ ID NO: 86398 - DNA, 103 bp, Artificial Sequence
  Synthetic Polynucleotide
taatacgactcactataggggtctttcttgcctttcttccctttgtctttaacagaggagaaaagacatggggaagaaaaacctggcggcagcgcaaaagatg

SEQ ID NO: 86399 - DNA, 103 bp, Artificial Sequence
  Synthetic Polynucleotide
taatacgactcactatagggaccaccactggctgtcttcacgccgtgattaacagaggagaaatcacatggtgaagacaaacctggcggcagcgcaaaagatg

SEQ ID NO: 86400 - DNA, 103 bp, Artificial Sequence
  Synthetic Polynucleotide
taatacgactcactataggggccagtaatcaccaccactggctgtcttcaaacagaggagatgaagaatgccagtggtgaacctggcggcagcgcaaaagatg

SEQ ID NO: 86401 - DNA, 103 bp, Artificial Sequence
  Synthetic Polynucleotide
taatacgactcactatagggttcaagattcgccagtaatcaccaccactgaacagaggagacagtggatgtgattactgaacctggcggcagcgcaaaagatg

SEQ ID NO: 86402 - DNA, 103 bp, Artificial Sequence
  Synthetic Polynucleotide
taatacgactcactatagggctcacccgggttcaagattcgccagtaatcaacagaggagagattacatgcgaatcttgaacctggcggcagcgcaaaagatg

SEQ ID NO: 86403 - DNA, 103 bp, Artificial Sequence
  Synthetic Polynucleotide
taatacgactcactatagggtcacgcggtactcacccgggttcaagattcaacagaggagagaatctatgacccgggtgaacctggcggcagcgcaaaagatg

SEQ ID NO: 86404 - DNA, 103 bp, Artificial Sequence
  Synthetic Polynucleotide
taatacgactcactataggggcgtgggctgtcacgcggtactcacccgggaacagaggagacccgggatggtaccgcgtaacctggcggcagcgcaaaagatg

SEQ ID NO: 86405 - DNA, 103 bp, Artificial Sequence
  Synthetic Polynucleotide
taatacgactcactataggggtagccctccgcgtgggctgtcacgcggtaaacagaggagataccgcatgacagcccacaacctggcggcagcgcaaaagatg

SEQ ID NO: 86406 - DNA, 103 bp, Artificial Sequence
  Synthetic Polynucleotide
taatacgactcactatagggcgctcggggtgtagccctccgcgtgggctgaacagaggagacagcccatgcggagggctaacctggcggcagcgcaaaagatg

SEQ ID NO: 86407 - DNA, 103 bp, Artificial Sequence
  Synthetic Polynucleotide
taatacgactcactatagggcaggtcttggcgctcggggtgtagccctccaacagaggagaggagggatgcaccccgagaacctggcggcagcgcaaaagatg

SEQ ID NO: 86408 - DNA, 103 bp, Artificial Sequence
  Synthetic Polynucleotide
taatacgactcactataggggtcaacattgcaggtcttggcgctcggggtaacagaggagaaccccgatggccaagaccaacctggcggcagcgcaaaagatg

SEQ ID NO: 86409 - DNA, 103 bp, Artificial Sequence
  Synthetic Polynucleotide
taatacgactcactatagggtggggcctttgtctttcttgcctttcttccaacagaggagaggaagaatggcaagaaagaacctggcggcagcgcaaaagatg

SEQ ID NO: 86410 - DNA, 103 bp, Artificial Sequence
  Synthetic Polynucleotide
taatacgactcactatagggcgatgtcatagtcaacattgcaggtcttggaacagaggagaccaagaatggcaatgttgaacctggcggcagcgcaaaagatg

SEQ ID NO: 86411 - DNA, 103 bp, Artificial Sequence
  Synthetic Polynucleotide
taatacgactcactatagggtgagtggccccgatgtcatagtcaacattgaacagaggagacaatgtatgctatgacataacctggcggcagcgcaaaagatg

SEQ ID NO: 86412 - DNA, 103 bp, Artificial Sequence
  Synthetic Polynucleotide
taatacgactcactataggggaagttgcactgagtggccccgatgtcataaacagaggagatatgacatgggggccactaacctggcggcagcgcaaaagatg

SEQ ID NO: 86413 - DNA, 103 bp, Artificial Sequence
  Synthetic Polynucleotide
taatacgactcactataggggagccaggatgaagttgcactgagtggcccaacagaggagagggccaatgagtgcaactaacctggcggcagcgcaaaagatg

SEQ ID NO: 86414 - DNA, 103 bp, Artificial Sequence
  Synthetic Polynucleotide
taatacgactcactatagggcagttggagcgagccaggatgaagttgcacaacagaggagagtgcaaatgcatcctggcaacctggcggcagcgcaaaagatg

SEQ ID NO: 86415 - DNA, 103 bp, Artificial Sequence
  Synthetic Polynucleotide
taatacgactcactataggggatgcgcttccagttggagcgagccaggataacagaggagaatcctgatgcgctccaacaacctggcggcagcgcaaaagatg

SEQ ID NO: 86416 - DNA, 103 bp, Artificial Sequence
  Synthetic Polynucleotide
taatacgactcactatagggtgatctcccggatgcgcttccagttggagcaacagaggagagctccaatgggaagcgcaaacctggcggcagcgcaaaagatg

SEQ ID NO: 86417 - DNA, 103 bp, Artificial Sequence
  Synthetic Polynucleotide
taatacgactcactatagggttcatggccatgatctcccggatgcgcttcaacagaggagagaagcgatgccgggagataacctggcggcagcgcaaaagatg

SEQ ID NO: 86418 - DNA, 103 bp, Artificial Sequence
  Synthetic Polynucleotide
taatacgactcactatagggccggttcccgttcatggccatgatctcccgaacagaggagacgggagatgatggccatgaacctggcggcagcgcaaaagatg

SEQ ID NO: 86419 - DNA, 103 bp, Artificial Sequence
  Synthetic Polynucleotide
taatacgactcactataggggtgggataggccggttcccgttcatggccaaacagaggagatggccaatgacgggaaccaacctggcggcagcgcaaaagatg

SEQ ID NO: 86420 - DNA, 103 bp, Artificial Sequence
  Synthetic Polynucleotide
taatacgactcactatagggagcaacgccaggaggcagctgagcaggggcaacagaggagagcccctatgcagctgcctaacctggcggcagcgcaaaagatg

SEQ ID NO: 86421 - DNA, 103 bp, Artificial Sequence
  Synthetic Polynucleotide
taatacgactcactatagggttgggcaccttggggcctttgtctttcttgaacagaggagacaagaaatgcaaaggcccaacctggcggcagcgcaaaagatg

SEQ ID NO: 86422 - DNA, 103 bp, Artificial Sequence
  Synthetic Polynucleotide
taatacgactcactataggggggtctatgtgtgggataggccggttcccgaacagaggagacgggaaatggcctatcccaacctggcggcagcgcaaaagatg

SEQ ID NO: 86423 - DNA, 103 bp, Artificial Sequence
  Synthetic Polynucleotide
taatacgactcactatagggagggcgcgatgggtctatgtgtgggataggaacagaggagacctatcatgcacatagacaacctggcggcagcgcaaaagatg

SEQ ID NO: 86424 - DNA, 103 bp, Artificial Sequence
  Synthetic Polynucleotide
taatacgactcactatagggggggggtcatagggcgcgatgggtctatgtaacagaggagaacatagatgcatcgcgccaacctggcggcagcgcaaaagatg

SEQ ID NO: 86425 - DNA, 103 bp, Artificial Sequence
  Synthetic Polynucleotide
taatacgactcactatagggcgtcgctgttggggggtcatagggcgcgataacagaggagaatcgcgatgtatgaccccaacctggcggcagcgcaaaagatg

SEQ ID NO: 86426 - DNA, 103 bp, Artificial Sequence
  Synthetic Polynucleotide
taatacgactcactatagggctgctgcaggcgtcgctgttggggggtcataacagaggagaatgaccatgcaacagcgaaacctggcggcagcgcaaaagatg

SEQ ID NO: 86427 - DNA, 103 bp, Artificial Sequence
  Synthetic Polynucleotide
taatacgactcactataggggtaggcgtcgctgctgcaggcgtcgctgttaacagaggagaaacagcatggcctgcagcaacctggcggcagcgcaaaagatg

SEQ ID NO: 86428 - DNA, 103 bp, Artificial Sequence
  Synthetic Polynucleotide
taatacgactcactatagggaggcggtgttgtaggcgtcgctgctgcaggaacagaggagacctgcaatggcgacgcctaacctggcggcagcgcaaaagatg

SEQ ID NO: 86429 - DNA, 103 bp, Artificial Sequence
  Synthetic Polynucleotide
taatacgactcactatagggccgaagccgcaggcggtgttgtaggcgtcgaacagaggagacgacgcatgcaacaccgcaacctggcggcagcgcaaaagatg

SEQ ID NO: 86430 - DNA, 103 bp, Artificial Sequence
  Synthetic Polynucleotide
taatacgactcactataggggcatctgtgcccgaagccgcaggcggtgttaacagaggagaaacaccatgtgcggcttcaacctggcggcagcgcaaaagatg

SEQ ID NO: 86431 - DNA, 103 bp, Artificial Sequence
  Synthetic Polynucleotide
taatacgactcactatagggcgccgcagccgcatctgtgcccgaagccgcaacagaggagagcggctatgggcacagataacctggcggcagcgcaaaagatg

SEQ ID NO: 86432 - DNA, 103 bp, Artificial Sequence
  Synthetic Polynucleotide
taatacgactcactatagggcaaggactccttgggcaccttggggcctttaacagaggagaaaaggcatgaaggtgcccaacctggcggcagcgcaaaagatg

SEQ ID NO: 86433 - DNA, 103 bp, Artificial Sequence
  Synthetic Polynucleotide
taatacgactcactatagggggcgttgaggcgccgcagccgcatctgtgcaacagaggagagcacagatgcggctgcggaacctggcggcagcgcaaaagatg

SEQ ID NO: 86434 - DNA, 103 bp, Artificial Sequence
  Synthetic Polynucleotide
taatacgactcactataggggggtggtggtggcgttgaggcgccgcagccaacagaggagaggctgcatggcctcaacgaacctggcggcagcgcaaaagatg

SEQ ID NO: 86435 - DNA, 103 bp, Artificial Sequence
  Synthetic Polynucleotide
taatacgactcactatagggtgggggcctagggtggtggtggcgttgaggaacagaggagacctcaaatgcaccaccacaacctggcggcagcgcaaaagatg

SEQ ID NO: 86436 - DNA, 103 bp, Artificial Sequence
  Synthetic Polynucleotide
taatacgactcactatagggaggcacagtgtgggggcctagggtggtggtaacagaggagaaccaccatgctaggccccaacctggcggcagcgcaaaagatg

SEQ ID NO: 86437 - DNA, 103 bp, Artificial Sequence
  Synthetic Polynucleotide
taatacgactcactataggggcagcgtgggaggcacagtgtgggggcctaaacagaggagataggccatgacactgtgcaacctggcggcagcgcaaaagatg

SEQ ID NO: 86438 - DNA, 103 bp, Artificial Sequence
  Synthetic Polynucleotide
taatacgactcactatagggggggcagggggcagcgtgggaggcacagtgaacagaggagacactgtatgtcccacgctaacctggcggcagcgcaaaagatg

SEQ ID NO: 86439 - DNA, 103 bp, Artificial Sequence
  Synthetic Polynucleotide
taatacgactcactatagggggtggtggcaggggcagggggcagcgtgggaacagaggagacccacgatgccccctgccaacctggcggcagcgcaaaagatg

SEQ ID NO: 86440 - DNA, 103 bp, Artificial Sequence
  Synthetic Polynucleotide
taatacgactcactatagggtagtgctcagggtggtggcaggggcaggggaacagaggagacccctgatgctgccaccaaacctggcggcagcgcaaaagatg

SEQ ID NO: 86441 - DNA, 103 bp, Artificial Sequence
  Synthetic Polynucleotide
taatacgactcactatagggggctctatggtagtgctcagggtggtggcaaacagaggagatgccacatgcctgagcacaacctggcggcagcgcaaaagatg

SEQ ID NO: 86442 - DNA, 103 bp, Artificial Sequence
  Synthetic Polynucleotide
taatacgactcactataggggaggccccagggctctatggtagtgctcagaacagaggagactgagcatgaccatagagaacctggcggcagcgcaaaagatg

SEQ ID NO: 86443 - DNA, 103 bp, Artificial Sequence
  Synthetic Polynucleotide
taatacgactcactataggggggacccctccaaggactccttgggcacctaacagaggagaaggtgcatgaggagtcctaacctggcggcagcgcaaaagatg

SEQ ID NO: 86444 - DNA, 103 bp, Artificial Sequence
  Synthetic Polynucleotide
taatacgactcactatagggttggcggtatgaggccccagggctctatggaacagaggagaccatagatgcctggggccaacctggcggcagcgcaaaagatg

SEQ ID NO: 86445 - DNA, 103 bp, Artificial Sequence
  Synthetic Polynucleotide
taatacgactcactatagggccagcggtggttggcggtatgaggccccagaacagaggagactggggatgcataccgccaacctggcggcagcgcaaaagatg

SEQ ID NO: 86446 - DNA, 103 bp, Artificial Sequence
  Synthetic Polynucleotide
taatacgactcactatagggctcctcccagccagcggtggttggcggtataacagaggagaataccgatgaccaccgctaacctggcggcagcgcaaaagatg

SEQ ID NO: 86447 - DNA, 103 bp, Artificial Sequence
  Synthetic Polynucleotide
taatacgactcactatagggcagtctccgactcctcccagccagcggtggaacagaggagaccaccgatggctgggaggaacctggcggcagcgcaaaagatg

SEQ ID NO: 86448 - DNA, 103 bp, Artificial Sequence
  Synthetic Polynucleotide
taatacgactcactataggggtgtaggtctcagtctccgactcctcccagaacagaggagactgggaatggtcggagacaacctggcggcagcgcaaaagatg

SEQ ID NO: 86449 - DNA, 103 bp, Artificial Sequence
  Synthetic Polynucleotide
taatacgactcactatagggcaccacctctgtgtaggtctcagtctccgaaacagaggagatcggagatggagacctacaacctggcggcagcgcaaaagatg

SEQ ID NO: 86450 - DNA, 103 bp, Artificial Sequence
  Synthetic Polynucleotide
taatacgactcactatagggcaaactctgtcaccacctctgtgtaggtctaacagaggagaagacctatgcagaggtggaacctggcggcagcgcaaaagatg

SEQ ID NO: 86451 - DNA, 103 bp, Artificial Sequence
  Synthetic Polynucleotide
taatacgactcactatagggacctcggtcccaaactctgtcaccacctctaacagaggagaagaggtatggacagagttaacctggcggcagcgcaaaagatg

SEQ ID NO: 86452 - DNA, 103 bp, Artificial Sequence
  Synthetic Polynucleotide
taatacgactcactatagggctcgggctccacctcggtcccaaactctgtaacagaggagaacagagatggggaccgagaacctggcggcagcgcaaaagatg

SEQ ID NO: 86453 - DNA, 103 bp, Artificial Sequence
  Synthetic Polynucleotide
taatacgactcactatagggtggtcccaaactcgggctccacctcggtccaacagaggagaggaccgatgtggagcccgaacctggcggcagcgcaaaagatg

SEQ ID NO: 86454 - DNA, 103 bp, Artificial Sequence
  Synthetic Polynucleotide
taatacgactcactatagggggcggcctgggggacccctccaaggactccaacagaggagaggagtcatgggaggggtcaacctggcggcagcgcaaaagatg

SEQ ID NO: 86455 - DNA, 103 bp, Artificial Sequence
  Synthetic Polynucleotide
taatacgactcactatagggggctccaccttggtcccaaactcgggctccaacagaggagaggagccatggtttgggacaacctggcggcagcgcaaaagatg

SEQ ID NO: 86456 - DNA, 103 bp, Artificial Sequence
  Synthetic Polynucleotide
taatacgactcactatagggctcaaactcgggctccaccttggtcccaaaaacagaggagatttgggatgaaggtggagaacctggcggcagcgcaaaagatg

SEQ ID NO: 86457 - DNA, 103 bp, Artificial Sequence
  Synthetic Polynucleotide
taatacgactcactatagggccaactgggtctcaaactcgggctccacctaacagaggagaaggtggatgccgagtttgaacctggcggcagcgcaaaagatg

SEQ ID NO: 86458 - DNA, 103 bp, Artificial Sequence
  Synthetic Polynucleotide
taatacgactcactatagggaactcaggctccaactgggtctcaaactcgaacagaggagacgagttatggacccagttaacctggcggcagcgcaaaagatg

SEQ ID NO: 86459 - DNA, 103 bp, Artificial Sequence
  Synthetic Polynucleotide
taatacgactcactatagggctgggtctcaaactcaggctccaactgggtaacagaggagaacccagatggagcctgagaacctggcggcagcgcaaaagatg

SEQ ID NO: 86460 - DNA, 103 bp, Artificial Sequence
  Synthetic Polynucleotide
taatacgactcactatagggcgggttccagctgggtctcaaactcaggctaacagaggagaagcctgatgttgagacccaacctggcggcagcgcaaaagatg

SEQ ID NO: 86461 - DNA, 103 bp, Artificial Sequence
  Synthetic Polynucleotide
taatacgactcactatagggtcctcaaactcgggttccagctgggtctcaaacagaggagatgagacatggctggaaccaacctggcggcagcgcaaaagatg

SEQ ID NO: 86462 - DNA, 103 bp, Artificial Sequence
  Synthetic Polynucleotide
taatacgactcactatagggctcctcctcttcctcaaactcgggttccagaacagaggagactggaaatggagtttgagaacctggcggcagcgcaaaagatg

SEQ ID NO: 86463 - DNA, 103 bp, Artificial Sequence
  Synthetic Polynucleotide
taatacgactcactatagggctttctcctcctcctcctcttcctcaaactaacagaggagaagtttgatgaagaggaggaacctggcggcagcgcaaaagatg

SEQ ID NO: 86464 - DNA, 103 bp, Artificial Sequence
  Synthetic Polynucleotide
taatacgactcactatagggatctcctcctctttctcctcctcctcctctaacagaggagaagaggaatgggaggagaaaacctggcggcagcgcaaaagatg

SEQ ID NO: 86465 - DNA, 103 bp, Artificial Sequence
  Synthetic Polynucleotide
taatacgactcactatagggccccttcttgggcggcctgggggacccctcaacagaggagagaggggatgcccaggccgaacctggcggcagcgcaaaagatg

SEQ ID NO: 86466 - DNA, 103 bp, Artificial Sequence
  Synthetic Polynucleotide
taatacgactcactataggggccagtggctatctcctcctctttctcctcaacagaggagagaggagatggaggaggagaacctggcggcagcgcaaaagatg

SEQ ID NO: 86467 - DNA, 103 bp, Artificial Sequence
  Synthetic Polynucleotide
taatacgactcactatagggggaatgcctggccagtggctatctcctcctaacagaggagaaggaggatgtagccactgaacctggcggcagcgcaaaagatg

SEQ ID NO: 86468 - DNA, 103 bp, Artificial Sequence
  Synthetic Polynucleotide
taatacgactcactataggggttgtgaaggggaatgcctggccagtggctaacagaggagaagccacatgccaggcattaacctggcggcagcgcaaaagatg

SEQ ID NO: 86469 - DNA, 103 bp, Artificial Sequence
  Synthetic Polynucleotide
taatacgactcactatagggggtctctactgttgtgaaggggaatgcctgaacagaggagacaggcaatgcccttcacaaacctggcggcagcgcaaaagatg

SEQ ID NO: 86470 - DNA, 103 bp, Artificial Sequence
  Synthetic Polynucleotide
taatacgactcactatagggtcactgtgtaggtctctactgttgtgaaggaacagaggagaccttcaatgcagtagagaaacctggcggcagcgcaaaagatg

SEQ ID NO: 86471 - DNA, 103 bp, Artificial Sequence
  Synthetic Polynucleotide
taatacgactcactatagggtccccaaagttcactgtgtaggtctctactaacagaggagaagtagaatgctacacagtaacctggcggcagcgcaaaagatg

SEQ ID NO: 86472 - DNA, 103 bp, Artificial Sequence
  Synthetic Polynucleotide
taatacgactcactataggggcttctccttccccttcttgggcggcctggaacagaggagaccaggcatgccaagaaggaacctggcggcagcgcaaaagatg

SEQ ID NO: 86473 - DNA, 103 bp, Artificial Sequence
  Synthetic Polynucleotide
taatacgactcactataggggccttgggtggcttctccttccccttcttgaacagaggagacaagaaatggaaggagaaaacctggcggcagcgcaaaagatg

SEQ ID NO: 86474 - DNA, 103 bp, Artificial Sequence
  Synthetic Polynucleotide
taatacgactcactatagggcttcttggtggccttgggtggcttctccttaacagaggagaaaggagatgccacccaagaacctggcggcagcgcaaaagatg

SEQ ID NO: 86475 - DNA, 103 bp, Artificial Sequence
  Synthetic Polynucleotide
taatacgactcactatagggtctccttgggcttcttggtggccttgggtgaacagaggagacacccaatgccaccaagaaacctggcggcagcgcaaaagatg

SEQ ID NO: 86476 - DNA, 103 bp, Artificial Sequence
  Synthetic Polynucleotide
taatacgactcactatagggttaggtggcttctccttgggcttcttggtgaacagaggagacaccaaatggcccaaggaaacctggcggcagcgcaaaagatg

SEQ ID NO: 86477 - DNA, 103 bp, Artificial Sequence
  Synthetic Polynucleotide
taatacgactcactataggggcacagggccagcaacgccaggaggcagctaacagaggagaagctgcatgctggcgttgaacctggcggcagcgcaaaagatg

SEQ ID NO: 86478 - DNA, 103 bp, Artificial Sequence
  Synthetic Polynucleotide
taatacgactcactatagggcttggtggccttaggtggcttctccttgggaacagaggagacccaagatgaagccacctaacctggcggcagcgcaaaagatg

SEQ ID NO: 86479 - DNA, 103 bp, Artificial Sequence
  Synthetic Polynucleotide
taatacgactcactatagggccttgggcttcttggtggccttaggtggctaacagaggagaagccacatgaggccaccaaacctggcggcagcgcaaaagatg

SEQ ID NO: 86480 - DNA, 103 bp, Artificial Sequence
  Synthetic Polynucleotide
taatacgactcactatagggggtggcttctccttgggcttcttggtggccaacagaggagaggccacatggaagcccaaaacctggcggcagcgcaaaagatg

SEQ ID NO: 86481 - DNA, 103 bp, Artificial Sequence
  Synthetic Polynucleotide
taatacgactcactatagggggtggccttgggtggcttctccttgggcttaacagaggagaaagcccatggagaagccaaacctggcggcagcgcaaaagatg

SEQ ID NO: 86482 - DNA, 103 bp, Artificial Sequence
  Synthetic Polynucleotide
taatacgactcactatagggtgggcttcttggtggccttgggtggcttctaacagaggagaagaagcatgccaaggccaaacctggcggcagcgcaaaagatg

SEQ ID NO: 86483 - DNA, 103 bp, Artificial Sequence
  Synthetic Polynucleotide
taatacgactcactatagggggcttctctttgggcttcttggtggccttgaacagaggagacaaggcatgcaagaagccaacctggcggcagcgcaaaagatg

SEQ ID NO: 86484 - DNA, 103 bp, Artificial Sequence
  Synthetic Polynucleotide
taatacgactcactatagggggccttgggtggcttctctttgggcttcttaacagaggagaaagaagatgaaagagaagaacctggcggcagcgcaaaagatg

SEQ ID NO: 86485 - DNA, 103 bp, Artificial Sequence
  Synthetic Polynucleotide
taatacgactcactataggggcttcttggtggccttgggtggcttctcttaacagaggagaaagagaatgcacccaaggaacctggcggcagcgcaaaagatg

SEQ ID NO: 86486 - DNA, 103 bp, Artificial Sequence
  Synthetic Polynucleotide
taatacgactcactatagggcctgacgggggcttcttggtggccttgggtaacagaggagaacccaaatgcaccaagaaaacctggcggcagcgcaaaagatg

SEQ ID NO: 86487 - DNA, 103 bp, Artificial Sequence
  Synthetic Polynucleotide
taatacgactcactataggggggcctcttccctgacgggggcttcttggtaacagaggagaaccaagatgcccccgtcaaacctggcggcagcgcaaaagatg

SEQ ID NO: 86488 - DNA, 103 bp, Artificial Sequence
  Synthetic Polynucleotide
taatacgactcactataggggccctccagggcacagggccagcaacgccaaacagaggagatggcgtatgtggccctgtaacctggcggcagcgcaaaagatg

SEQ ID NO: 86489 - DNA, 103 bp, Artificial Sequence
  Synthetic Polynucleotide
taatacgactcactatagggccagaatggggggcctcttccctgacggggaacagaggagaccccgtatgggaagaggcaacctggcggcagcgcaaaagatg

SEQ ID NO: 86490 - DNA, 103 bp, Artificial Sequence
  Synthetic Polynucleotide
taatacgactcactatagggtctgagggagccagaatggggggcctcttcaacagaggagagaagagatgccccattctaacctggcggcagcgcaaaagatg

SEQ ID NO: 86491 - DNA, 103 bp, Artificial Sequence
  Synthetic Polynucleotide
taatacgactcactatagggctccagggtttctgagggagccagaatgggaacagaggagacccattatggctccctcaaacctggcggcagcgcaaaagatg

SEQ ID NO: 86492 - DNA, 103 bp, Artificial Sequence
  Synthetic Polynucleotide
taatacgactcactataggggcagtggccactccagggtttctgagggagaacagaggagactccctatgaaaccctggaacctggcggcagcgcaaaagatg

SEQ ID NO: 86493 - DNA, 103 bp, Artificial Sequence
  Synthetic Polynucleotide
taatacgactcactataggggggggtgggggcagtggccactccagggttaacagaggagaaaccctatggtggccactaacctggcggcagcgcaaaagatg

SEQ ID NO: 86494 - DNA, 103 bp, Artificial Sequence
  Synthetic Polynucleotide
taatacgactcactataggggccagggctggggggtgggggcagtggccaaacagaggagatggccaatgcccccacccaacctggcggcagcgcaaaagatg

SEQ ID NO: 86495 - DNA, 103 bp, Artificial Sequence
  Synthetic Polynucleotide
taatacgactcactataggggctcctcggggccagggctggggggtggggaacagaggagaccccacatgccagccctgaacctggcggcagcgcaaaagatg

SEQ ID NO: 86496 - DNA, 103 bp, Artificial Sequence
  Synthetic Polynucleotide
taatacgactcactatagggtcctggggtagctcctcggggccagggctgaacagaggagacagcccatgccccgaggaaacctggcggcagcgcaaaagatg

SEQ ID NO: 86497 - DNA, 103 bp, Artificial Sequence
  Synthetic Polynucleotide
taatacgactcactatagggcgcccctccctcctggggtagctcctcgggaacagaggagacccgagatgctaccccagaacctggcggcagcgcaaaagatg

SEQ ID NO: 86498 - DNA, 103 bp, Artificial Sequence
  Synthetic Polynucleotide
taatacgactcactatagggttgagaggggcgcccctccctcctggggtaaacagaggagataccccatgagggaggggaacctggcggcagcgcaaaagatg

SEQ ID NO: 86499 - DNA, 103 bp, Artificial Sequence
  Synthetic Polynucleotide
taatacgactcactataggggtctgcgggcgccctccagggcacagggccaacagaggagaggccctatgccctggaggaacctggcggcagcgcaaaagatg

SEQ ID NO: 86500 - DNA, 103 bp, Artificial Sequence
  Synthetic Polynucleotide
taatacgactcactatagggtgccagttatttgagaggggcgcccctcccaacagaggagagggaggatggcccctctcaacctggcggcagcgcaaaagatg

SEQ ID NO: 86501 - DNA, 103 bp, Artificial Sequence
  Synthetic Polynucleotide
taatacgactcactatagggtcctggattctgccagttatttgagaggggaacagaggagacccctcatgaataactggaacctggcggcagcgcaaaagatg

SEQ ID NO: 86502 - DNA, 103 bp, Artificial Sequence
  Synthetic Polynucleotide
taatacgactcactataggggggtctcctctcctggattctgccagttataacagaggagaataactatgagaatccagaacctggcggcagcgcaaaagatg

SEQ ID NO: 86503 - DNA, 103 bp, Artificial Sequence
  Synthetic Polynucleotide
taatacgactcactataggggcctccacatgggtctcctctcctggattcaacagaggagagaatccatgagaggagacaacctggcggcagcgcaaaagatg

SEQ ID NO: 86504 - DNA, 103 bp, Artificial Sequence
  Synthetic Polynucleotide
taatacgactcactataggggtgctcccgtgcctccacatgggtctcctcaacagaggagagaggagatgcatgtggagaacctggcggcagcgcaaaagatg

SEQ ID NO: 86505 - DNA, 103 bp, Artificial Sequence
  Synthetic Polynucleotide
taatacgactcactataggggctcaggctggtgctcccgtgcctccacataacagaggagaatgtggatgcacgggagcaacctggcggcagcgcaaaagatg

SEQ ID NO: 86506 - DNA, 103 bp, Artificial Sequence
  Synthetic Polynucleotide
taatacgactcactatagggtcctcctccggctcaggctggtgctcccgtaacagaggagaacgggaatgccagcctgaaacctggcggcagcgcaaaagatg

SEQ ID NO: 86507 - DNA, 103 bp, Artificial Sequence
  Synthetic Polynucleotide
taatacgactcactatagggttgctcggtctcctcctccggctcaggctgaacagaggagacagcctatgccggaggagaacctggcggcagcgcaaaagatg

SEQ ID NO: 86508 - DNA, 103 bp, Artificial Sequence
  Synthetic Polynucleotide
taatacgactcactatagggccagtgtgggttgctcggtctcctcctccgaacagaggagacggaggatgagaccgagcaacctggcggcagcgcaaaagatg

SEQ ID NO: 86509 - DNA, 103 bp, Artificial Sequence
  Synthetic Polynucleotide
taatacgactcactatagggtcattgtagtccagtgtgggttgctcggtcaacagaggagagaccgaatgacccacactaacctggcggcagcgcaaaagatg

SEQ ID NO: 86510 - DNA, 103 bp, Artificial Sequence
  Synthetic Polynucleotide
taatacgactcactatagggggtcagcaccgtctgcgggcgccctccaggaacagaggagacctggaatgcgcccgcagaacctggcggcagcgcaaaagatg

SEQ ID NO: 86511 - DNA, 103 bp, Artificial Sequence
  Synthetic Polynucleotide
taatacgactcactatagggctcgatctggtcattgtagtccagtgtgggaacagaggagacccacaatggactacaataacctggcggcagcgcaaaagatg

SEQ ID NO: 86512 - DNA, 103 bp, Artificial Sequence
  Synthetic Polynucleotide
taatacgactcactatagggagtcctccctctcgatctggtcattgtagtaacagaggagaactacaatgaccagatcgaacctggcggcagcgcaaaagatg

SEQ ID NO: 86513 - DNA, 103 bp, Artificial Sequence
  Synthetic Polynucleotide
taatacgactcactatagggaagtcctcatagtcctccctctcgatctggaacagaggagaccagatatggagggaggaaacctggcggcagcgcaaaagatg

SEQ ID NO: 86514 - DNA, 103 bp, Artificial Sequence
  Synthetic Polynucleotide
taatacgactcactatagggaatgtactcaaagtcctcatagtcctccctaacagaggagaagggagatgtatgaggacaacctggcggcagcgcaaaagatg

SEQ ID NO: 86515 - DNA, 103 bp, Artificial Sequence
  Synthetic Polynucleotide
taatacgactcactatagggtctggcgccgaatgtactcaaagtcctcataacagaggagaatgaggatgttgagtacaaacctggcggcagcgcaaaagatg

SEQ ID NO: 86516 - DNA, 103 bp, Artificial Sequence
  Synthetic Polynucleotide
taatacgactcactatagggctgggttgcttctggcgccgaatgtactcaaacagaggagatgagtaatgtcggcgccaaacctggcggcagcgcaaaagatg

SEQ ID NO: 86517 - DNA, 103 bp, Artificial Sequence
  Synthetic Polynucleotide
taatacgactcactatagggtgggggtggcctgggttgcttctggcgccgaacagaggagacggcgcatgaagcaacccaacctggcggcagcgcaaaagatg

SEQ ID NO: 86518 - DNA, 103 bp, Artificial Sequence
  Synthetic Polynucleotide
taatacgactcactatagggtccttctgcttgggggtggcctgggttgctaacagaggagaagcaacatgggccaccccaacctggcggcagcgcaaaagatg

SEQ ID NO: 86519 - DNA, 103 bp, Artificial Sequence
  Synthetic Polynucleotide
taatacgactcactatagggtcgggcctcctccttctgcttgggggtggcaacagaggagagccaccatgaagcagaagaacctggcggcagcgcaaaagatg

SEQ ID NO: 86520 - DNA, 103 bp, Artificial Sequence
  Synthetic Polynucleotide
taatacgactcactatagggccagacccgctcgggcctcctccttctgctaacagaggagaagcagaatgaggaggcccaacctggcggcagcgcaaaagatg

SEQ ID NO: 86521 - DNA, 103 bp, Artificial Sequence
  Synthetic Polynucleotide
taatacgactcactatagggtctcgtcgtcggtcagcaccgtctgcgggcaacagaggagagcccgcatgcggtgctgaaacctggcggcagcgcaaaagatg

SEQ ID NO: 86522 - DNA, 103 bp, Artificial Sequence
  Synthetic Polynucleotide
taatacgactcactatagggggggctctggccagacccgctcgggcctccaacagaggagaggaggcatgagcgggtctaacctggcggcagcgcaaaagatg

SEQ ID NO: 86523 - DNA, 103 bp, Artificial Sequence
  Synthetic Polynucleotide
taatacgactcactatagggttctcctcagggggctctggccagacccgcaacagaggagagcgggtatggccagagccaacctggcggcagcgcaaaagatg

SEQ ID NO: 86524 - DNA, 103 bp, Artificial Sequence
  Synthetic Polynucleotide
taatacgactcactatagggggccggggccttctcctcagggggctctggaacagaggagaccagagatgcctgaggagaacctggcggcagcgcaaaagatg

SEQ ID NO: 86525 - DNA, 103 bp, Artificial Sequence
  Synthetic Polynucleotide
taatacgactcactatagggccggggctggggccggggccttctcctcagaacagaggagactgaggatgaggccccggaacctggcggcagcgcaaaagatg

SEQ ID NO: 86526 - DNA, 103 bp, Artificial Sequence
  Synthetic Polynucleotide
taatacgactcactatagggatcctctcctccggggctggggccggggccaacagaggagaggccccatgcccagccccaacctggcggcagcgcaaaagatg

SEQ ID NO: 86527 - DNA, 103 bp, Artificial Sequence
  Synthetic Polynucleotide
taatacgactcactatagggaggaggctcaatcctctcctccggggctggaacagaggagaccagccatggaggagaggaacctggcggcagcgcaaaagatg

SEQ ID NO: 86528 - DNA, 103 bp, Artificial Sequence
  Synthetic Polynucleotide
taatacgactcactataggggaggcttcacaggaggctcaatcctctcctaacagaggagaaggagaatgttgagcctcaacctggcggcagcgcaaaagatg

SEQ ID NO: 86529 - DNA, 103 bp, Artificial Sequence
  Synthetic Polynucleotide
taatacgactcactataggggggggcagcagaggcttcacaggaggctcaaacagaggagatgagccatgtgtgaagccaacctggcggcagcgcaaaagatg

SEQ ID NO: 86530 - DNA, 103 bp, Artificial Sequence
  Synthetic Polynucleotide
taatacgactcactatagggagggggcagcgggggcagcagaggcttcacaacagaggagagtgaagatgctgctgcccaacctggcggcagcgcaaaagatg

SEQ ID NO: 86531 - DNA, 103 bp, Artificial Sequence
  Synthetic Polynucleotide
taatacgactcactatagggcaccatagtcagggggcagcgggggcagcaaacagaggagatgctgcatgcgctgccccaacctggcggcagcgcaaaagatg

SEQ ID NO: 86532 - DNA, 103 bp, Artificial Sequence
  Synthetic Polynucleotide
taatacgactcactatagggaactcctcgatctcgtcgtcggtcagcaccaacagaggagaggtgctatgcgacgacgaaacctggcggcagcgcaaaagatg

SEQ ID NO: 86533 - DNA, 103 bp, Artificial Sequence
  Synthetic Polynucleotide
taatacgactcactatagggacgtaaccatcaccatagtcagggggcagcaacagaggagagctgccatgtgactatggaacctggcggcagcgcaaaagatg

SEQ ID NO: 86534 - DNA, 103 bp, Artificial Sequence
  Synthetic Polynucleotide
taatacgactcactataggggttggggatcacgtaaccatcaccatagtcaacagaggagagactatatggatggttacaacctggcggcagcgcaaaagatg

SEQ ID NO: 86535 - DNA, 103 bp, Artificial Sequence
  Synthetic Polynucleotide
taatacgactcactatagggtgtcatcgtagttggggatcacgtaaccataacagaggagaatggttatgtgatccccaaacctggcggcagcgcaaaagatg

SEQ ID NO: 86536 - DNA, 103 bp, Artificial Sequence
  Synthetic Polynucleotide
taatacgactcactatagggtaatagtccatgtcatcgtagttggggatcaacagaggagagatcccatgctacgatgaaacctggcggcagcgcaaaagatg

SEQ ID NO: 86537 - DNA, 103 bp, Artificial Sequence
  Synthetic Polynucleotide
taatacgactcactatagggaggcccaaagtaatagtccatgtcatcgtaaacagaggagatacgatatgatggactataacctggcggcagcgcaaaagatg

SEQ ID NO: 86538 - DNA, 103 bp, Artificial Sequence
  Synthetic Polynucleotide
taatacgactcactatagggggggcggaggaggcccaaagtaatagtccaaacagaggagatggactatgactttgggcaacctggcggcagcgcaaaagatg

SEQ ID NO: 86539 - DNA, 103 bp, Artificial Sequence
  Synthetic Polynucleotide
taatacgactcactatagggtcgggcttctggggcggaggaggcccaaagaacagaggagactttggatgtcctccgccaacctggcggcagcgcaaaagatg

SEQ ID NO: 86540 - DNA, 103 bp, Artificial Sequence
  Synthetic Polynucleotide
taatacgactcactataggggcgctcagcatcgggcttctggggcggaggaacagaggagacctccgatgcagaagcccaacctggcggcagcgcaaaagatg

SEQ ID NO: 86541 - DNA, 103 bp, Artificial Sequence
  Synthetic Polynucleotide
taatacgactcactatagggcgtctgtctggcgctcagcatcgggcttctaacagaggagaagaagcatgatgctgagcaacctggcggcagcgcaaaagatg

SEQ ID NO: 86542 - DNA, 103 bp, Artificial Sequence
  Synthetic Polynucleotide
taatacgactcactatagggtccttctcttcgtctgtctggcgctcagcaaacagaggagatgctgaatgccagacagaaacctggcggcagcgcaaaagatg

SEQ ID NO: 86543 - DNA, 103 bp, Artificial Sequence
  Synthetic Polynucleotide
taatacgactcactataggggtcggccatgtcggtgatagcggcggccataacagaggagaatggccatggctatcaccaacctggcggcagcgcaaaagatg

SEQ ID NO: 86544 - DNA, 103 bp, Artificial Sequence
  Synthetic Polynucleotide
taatacgactcactatagggctcctcctcctcggggggctcagcccggccaacagaggagaggccggatggagccccccaacctggcggcagcgcaaaagatg

SEQ ID NO: 86545 - DNA, 103 bp, Artificial Sequence
  Synthetic Polynucleotide
taatacgactcactatagggagcaaagctggcattgcagccaccaacaacaacagaggagagttgttatgggctgcaataacctggcggcagcgcaaaagatg

SEQ ID NO: 86546 - DNA, 103 bp, Artificial Sequence
  Synthetic Polynucleotide
taatacgactcactatagggctccctgagaagcaaagctggcattgcagcaacagaggagagctgcaatgccagctttgaacctggcggcagcgcaaaagatg

SEQ ID NO: 86547 - DNA, 103 bp, Artificial Sequence
  Synthetic Polynucleotide
taatacgactcactatagggcgagctagccctccctgagaagcaaagctgaacagaggagacagcttatgttctcagggaacctggcggcagcgcaaaagatg

SEQ ID NO: 86548 - DNA, 103 bp, Artificial Sequence
  Synthetic Polynucleotide
taatacgactcactataggggggtacatgacgagctagccctccctgagaaacagaggagatctcagatggggctagctaacctggcggcagcgcaaaagatg

SEQ ID NO: 86549 - DNA, 103 bp, Artificial Sequence
  Synthetic Polynucleotide
taatacgactcactatagggtgaagtgtgtgggtacatgacgagctagccaacagaggagaggctagatggtcatgtacaacctggcggcagcgcaaaagatg

SEQ ID NO: 86550 - DNA, 103 bp, Artificial Sequence
  Synthetic Polynucleotide
taatacgactcactatagggttctgctgactgaagtgtgtgggtacatgaaacagaggagatcatgtatgcacacacttaacctggcggcagcgcaaaagatg

SEQ ID NO: 86551 - DNA, 103 bp, Artificial Sequence
  Synthetic Polynucleotide
taatacgactcactatagggttttgaggagttctgctgactgaagtgtgtaacagaggagaacacacatgagtcagcagaacctggcggcagcgcaaaagatg

SEQ ID NO: 86552 - DNA, 103 bp, Artificial Sequence
  Synthetic Polynucleotide
taatacgactcactatagggggctagaaacttttgaggagttctgctgacaacagaggagagtcagcatgactcctcaaaacctggcggcagcgcaaaagatg

SEQ ID NO: 86553 - DNA, 103 bp, Artificial Sequence
  Synthetic Polynucleotide
taatacgactcactataggggcctttggctggctagaaacttttgaggagaacagaggagactcctcatgagtttctagaacctggcggcagcgcaaaagatg

SEQ ID NO: 86554 - DNA, 103 bp, Artificial Sequence
  Synthetic Polynucleotide
taatacgactcactatagggttcttctttggcctttggctggctagaaacaacagaggagagtttctatgcagccaaagaacctggcggcagcgcaaaagatg

SEQ ID NO: 86555 - DNA, 103 bp, Artificial Sequence
  Synthetic Polynucleotide
taatacgactcactatagggcctcctcttcctcctcctcctcggggggctaacagaggagaagccccatgaggaggaggaacctggcggcagcgcaaaagatg

SEQ ID NO: 86556 - DNA, 103 bp, Artificial Sequence
  Synthetic Polynucleotide
taatacgactcactatagggtagaaggagattcttctttggcctttggctaacagaggagaagccaaatgccaaagaagaacctggcggcagcgcaaaagatg

SEQ ID NO: 86557 - DNA, 103 bp, Artificial Sequence
  Synthetic Polynucleotide
taatacgactcactatagggattccagctttagaaggagattcttctttgaacagaggagacaaagaatgatctccttcaacctggcggcagcgcaaaagatg

SEQ ID NO: 86558 - DNA, 103 bp, Artificial Sequence
  Synthetic Polynucleotide
taatacgactcactatagggccttttgttcattccagctttagaaggagaaacagaggagatctcctatgaaagctggaaacctggcggcagcgcaaaagatg

SEQ ID NO: 86559 - DNA, 103 bp, Artificial Sequence
  Synthetic Polynucleotide
taatacgactcactatagggttaatttcctccttttgttcattccagcttaacagaggagaaagctgatgtgaacaaaaaacctggcggcagcgcaaaagatg

SEQ ID NO: 86560 - DNA, 103 bp, Artificial Sequence
  Synthetic Polynucleotide
taatacgactcactatagggcttttgttctttaatttcctccttttgttcaacagaggagagaacaaatggaggaaattaacctggcggcagcgcaaaagatg

SEQ ID NO: 86561 - DNA, 103 bp, Artificial Sequence
  Synthetic Polynucleotide
taatacgactcactatagggtgagcgtcgtcttttgttctttaatttcctaacagaggagaaggaaaatgaagaacaaaaacctggcggcagcgcaaaagatg

SEQ ID NO: 86562 - DNA, 103 bp, Artificial Sequence
  Synthetic Polynucleotide
taatacgactcactataggggccgtggtaatgagcgtcgtcttttgttctaacagaggagaagaacaatggacgacgctaacctggcggcagcgcaaaagatg

SEQ ID NO: 86563 - DNA, 103 bp, Artificial Sequence
  Synthetic Polynucleotide
taatacgactcactatagggaaatcatgtggccgtggtaatgagcgtcgtaacagaggagaacgacgatgattaccacgaacctggcggcagcgcaaaagatg

SEQ ID NO: 86564 - DNA, 103 bp, Artificial Sequence
  Synthetic Polynucleotide
taatacgactcactatagggtgcatcgaagaaatcatgtggccgtggtaaaacagaggagattaccaatgccacatgataacctggcggcagcgcaaaagatg

SEQ ID NO: 86565 - DNA, 103 bp, Artificial Sequence
  Synthetic Polynucleotide
taatacgactcactatagggccagtgtttgtgcatcgaagaaatcatgtgaacagaggagacacatgatgtcttcgatgaacctggcggcagcgcaaaagatg

SEQ ID NO: 86566 - DNA, 103 bp, Artificial Sequence
  Synthetic Polynucleotide
taatacgactcactatagggtcttcctcctcctcctcttcctcctcctccaacagaggagaggaggaatgggaagaggaaacctggcggcagcgcaaaagatg

SEQ ID NO: 86567 - DNA, 103 bp, Artificial Sequence
  Synthetic Polynucleotide
taatacgactcactatagggcttatcgcatccagtgtttgtgcatcgaagaacagaggagacttcgaatgacaaacactaacctggcggcagcgcaaaagatg

SEQ ID NO: 86568 - DNA, 103 bp, Artificial Sequence
  Synthetic Polynucleotide
taatacgactcactatagggggctcgatgtcttatcgcatccagtgtttgaacagaggagacaaacaatggatgcgataaacctggcggcagcgcaaaagatg

SEQ ID NO: 86569 - DNA, 103 bp, Artificial Sequence
  Synthetic Polynucleotide
taatacgactcactatagggtaaagcatatggctcgatgtcttatcgcataacagaggagaatgcgaatggacatcgagaacctggcggcagcgcaaaagatg

SEQ ID NO: 86570 - DNA, 103 bp, Artificial Sequence
  Synthetic Polynucleotide
taatacgactcactataggggctgagaggttaaagcatatggctcgatgtaacagaggagaacatcgatgcatatgcttaacctggcggcagcgcaaaagatg

SEQ ID NO: 86571 - DNA, 103 bp, Artificial Sequence
  Synthetic Polynucleotide
taatacgactcactatagggttctatatgagctgagaggttaaagcatataacagaggagaatatgcatgaacctctcaaacctggcggcagcgcaaaagatg

SEQ ID NO: 86572 - DNA, 103 bp, Artificial Sequence
  Synthetic Polynucleotide
taatacgactcactatagggtccctaaactttctatatgagctgagaggtaacagaggagaacctctatgctcatatagaacctggcggcagcgcaaaagatg

SEQ ID NO: 86573 - DNA, 103 bp, Artificial Sequence
  Synthetic Polynucleotide
taatacgactcactatagggctgtgtcccttccctaaactttctatatgaaacagaggagatcatatatgaagtttaggaacctggcggcagcgcaaaagatg

SEQ ID NO: 86574 - DNA, 103 bp, Artificial Sequence
  Synthetic Polynucleotide
taatacgactcactatagggaaaaacaacactgtgtcccttccctaaactaacagaggagaagtttaatgaagggacacaacctggcggcagcgcaaaagatg

SEQ ID NO: 86575 - DNA, 103 bp, Artificial Sequence
  Synthetic Polynucleotide
taatacgactcactatagggcagtactatgaaaaacaacactgtgtccctaacagaggagaagggacatggtgttgtttaacctggcggcagcgcaaaagatg

SEQ ID NO: 86576 - DNA, 103 bp, Artificial Sequence
  Synthetic Polynucleotide
taatacgactcactatagggttagctattacagtactatgaaaaacaacaaacagaggagatgttgtatgtcatagtacaacctggcggcagcgcaaaagatg

SEQ ID NO: 86577 - DNA, 103 bp, Artificial Sequence
  Synthetic Polynucleotide
taatacgactcactatagggctccgcctcctcttcctcctcctcctcttcaacagaggagagaagagatggaggaggaaaacctggcggcagcgcaaaagatg

SEQ ID NO: 86578 - DNA, 103 bp, Artificial Sequence
  Synthetic Polynucleotide
taatacgactcactatagggttcttttctcttagctattacagtactatgaacagaggagacatagtatggtaatagctaacctggcggcagcgcaaaagatg

SEQ ID NO: 86579 - DNA, 103 bp, Artificial Sequence
  Synthetic Polynucleotide
taatacgactcactatagggtcccagaatcttcttttctcttagctattaaacagaggagataatagatgagagaaaagaacctggcggcagcgcaaaagatg

SEQ ID NO: 86580 - DNA, 103 bp, Artificial Sequence
  Synthetic Polynucleotide
taatacgactcactatagggagtttgatcttcccagaatcttcttttctcaacagaggagagagaaaatgagattctggaacctggcggcagcgcaaaagatg

SEQ ID NO: 86581 - DNA, 103 bp, Artificial Sequence
  Synthetic Polynucleotide
taatacgactcactatagggatgaagcaaaagtttgatcttcccagaatcaacagaggagagattctatgaagatcaaaaacctggcggcagcgcaaaagatg

SEQ ID NO: 86582 - DNA, 103 bp, Artificial Sequence
  Synthetic Polynucleotide
taatacgactcactatagggcaggcatccaatgaagcaaaagtttgatctaacagaggagaagatcaatgttttgcttcaacctggcggcagcgcaaaagatg

SEQ ID NO: 86583 - DNA, 103 bp, Artificial Sequence
  Synthetic Polynucleotide
taatacgactcactatagggagaatgtcttcaggcatccaatgaagcaaaaacagaggagatttgctatgttggatgccaacctggcggcagcgcaaaagatg

SEQ ID NO: 86584 - DNA, 103 bp, Artificial Sequence
  Synthetic Polynucleotide
taatacgactcactatagggcacatcaggcagaatgtcttcaggcatccaaacagaggagatggatgatggaagacattaacctggcggcagcgcaaaagatg

SEQ ID NO: 86585 - DNA, 103 bp, Artificial Sequence
  Synthetic Polynucleotide
taatacgactcactatagggcattcacccacacatcaggcagaatgtcttaacagaggagaaagacaatgtgcctgatgaacctggcggcagcgcaaaagatg

SEQ ID NO: 86586 - DNA, 103 bp, Artificial Sequence
  Synthetic Polynucleotide
taatacgactcactatagggcgttcactttcattcacccacacatcaggcaacagaggagagcctgaatggtgggtgaaaacctggcggcagcgcaaaagatg

SEQ ID NO: 86587 - DNA, 103 bp, Artificial Sequence
  Synthetic Polynucleotide
taatacgactcactatagggtaactgatgtcgttcactttcattcacccaaacagaggagatgggtgatggaaagtgaaaacctggcggcagcgcaaaagatg

SEQ ID NO: 86588 - DNA, 103 bp, Artificial Sequence
  Synthetic Polynucleotide
taatacgactcactatagggccgcctcggcctccgcctcctcttcctcctaacagaggagaaggaggatgaggaggcggaacctggcggcagcgcaaaagatg

SEQ ID NO: 86589 - DNA, 103 bp, Artificial Sequence
  Synthetic Polynucleotide
taatacgactcactatagggctttagtttttaactgatgtcgttcactttaacagaggagaaaagtgatggacatcagtaacctggcggcagcgcaaaagatg

SEQ ID NO: 86590 - DNA, 103 bp, Artificial Sequence
  Synthetic Polynucleotide
taatacgactcactatagggaaatgaactactttagtttttaactgatgtaacagaggagaacatcaatgaaaaactaaaacctggcggcagcgcaaaagatg

SEQ ID NO: 86591 - DNA, 103 bp, Artificial Sequence
  Synthetic Polynucleotide
taatacgactcactatagggtagctttgataaatgaactactttagttttaacagaggagaaaaactatggtagttcataacctggcggcagcgcaaaagatg

SEQ ID NO: 86592 - DNA, 103 bp, Artificial Sequence
  Synthetic Polynucleotide
taatacgactcactatagggtatctttgggtagctttgataaatgaactaaacagaggagatagttcatgtatcaaagcaacctggcggcagcgcaaaagatg

SEQ ID NO: 86593 - DNA, 103 bp, Artificial Sequence
  Synthetic Polynucleotide
taatacgactcactatagggagcaaggcagtatctttgggtagctttgataacagaggagaatcaaaatgacccaaagaaacctggcggcagcgcaaaagatg

SEQ ID NO: 86594 - DNA, 103 bp, Artificial Sequence
  Synthetic Polynucleotide
taatacgactcactatagggtgggtccaaaagcaaggcagtatctttgggaacagaggagacccaaaatgactgccttgaacctggcggcagcgcaaaagatg

SEQ ID NO: 86595 - DNA, 103 bp, Artificial Sequence
  Synthetic Polynucleotide
taatacgactcactatagggtgtatatgtttgggtccaaaagcaaggcagaacagaggagactgcctatgttttggaccaacctggcggcagcgcaaaagatg

SEQ ID NO: 86596 - DNA, 103 bp, Artificial Sequence
  Synthetic Polynucleotide
taatacgactcactatagggggcattgttctgtatatgtttgggtccaaaaacagaggagatttggaatgaaacatataaacctggcggcagcgcaaaagatg

SEQ ID NO: 86597 - DNA, 103 bp, Artificial Sequence
  Synthetic Polynucleotide
taatacgactcactatagggcctcttctgcggcattgttctgtatatgttaacagaggagaaacataatgagaacaatgaacctggcggcagcgcaaaagatg

SEQ ID NO: 86598 - DNA, 103 bp, Artificial Sequence
  Synthetic Polynucleotide
taatacgactcactatagggttctcttcaacctcttctgcggcattgttcaacagaggagagaacaaatgcgcagaagaaacctggcggcagcgcaaaagatg

SEQ ID NO: 86599 - DNA, 103 bp, Artificial Sequence
  Synthetic Polynucleotide
taatacgactcactatagggagcgccgccaccgcctcggcctccgcctccaacagaggagaggaggcatgggccgaggcaacctggcggcagcgcaaaagatg

SEQ ID NO: 86600 - DNA, 103 bp, Artificial Sequence
  Synthetic Polynucleotide
taatacgactcactatagggcttatcagagttctcttcaacctcttctgcaacagaggagagcagaaatggttgaagagaacctggcggcagcgcaaaagatg

SEQ ID NO: 86601 - DNA, 103 bp, Artificial Sequence
  Synthetic Polynucleotide
taatacgactcactataggggaacacttttcttatcagagttctcttcaaaacagaggagattgaagatgactctgataaacctggcggcagcgcaaaagatg

SEQ ID NO: 86602 - DNA, 103 bp, Artificial Sequence
  Synthetic Polynucleotide
taatacgactcactatagggaatacaaattgaacacttttcttatcagagaacagaggagactctgaatggaaaagtgtaacctggcggcagcgcaaaagatg

SEQ ID NO: 86603 - DNA, 103 bp, Artificial Sequence
  Synthetic Polynucleotide
taatacgactcactatagggtgtttgcttaaatacaaattgaacacttttaacagaggagaaaaagtatgcaatttgtaaacctggcggcagcgcaaaagatg

SEQ ID NO: 86604 - DNA, 103 bp, Artificial Sequence
  Synthetic Polynucleotide
taatacgactcactataggggttcagcagcagcgccgccaccgcctcggcaacagaggagagccgagatggtggcggcgaacctggcggcagcgcaaaagatg

SEQ ID NO: 86605 - DNA, 103 bp, Artificial Sequence
  Synthetic Polynucleotide
taatacgactcactatagggcgctgccgccgttcagcagcagcgccgccaaacagaggagatggcggatgtgctgctgaaacctggcggcagcgcaaaagatg

SEQ ID NO: 86606 - DNA, 103 bp, Artificial Sequence
  Synthetic Polynucleotide
taatacgactcactatagggccgcccccaccgctgccgccgttcagcagcaacagaggagagctgctatgcggcggcagaacctggcggcagcgcaaaagatg

SEQ ID NO: 86607 - DNA, 103 bp, Artificial Sequence
  Synthetic Polynucleotide
taatacgactcactataggggccgcctccgccgcccccaccgctgccgccaacagaggagaggcggcatgggtgggggcaacctggcggcagcgcaaaagatg

SEQ ID NO: 86608 - DNA, 103 bp, Artificial Sequence
  Synthetic Polynucleotide
taatacgactcactataggggctcctccaggtcggccatgtcggtgatagaacagaggagactatcaatgacatggccgaacctggcggcagcgcaaaagatg

SEQ ID NO: 86609 - DNA, 103 bp, Artificial Sequence
  Synthetic Polynucleotide
taatacgactcactatagggctcctccgccgccgcctccgccgcccccacaacagaggagagtggggatggcggaggcgaacctggcggcagcgcaaaagatg

SEQ ID NO: 86610 - DNA, 103 bp, Artificial Sequence
  Synthetic Polynucleotide
taatacgactcactatagggccgccccccactcctccgccgccgcctccgaacagaggagacggaggatgcggcggaggaacctggcggcagcgcaaaagatg

SEQ ID NO: 86611 - DNA, 103 bp, Artificial Sequence
  Synthetic Polynucleotide
taatacgactcactatagggctctgcctcgccgccccccactcctccgccaacagaggagaggcggaatggtggggggcaacctggcggcagcgcaaaagatg

SEQ ID NO: 86612 - DNA, 103 bp, Artificial Sequence
  Synthetic Polynucleotide
taatacgactcactatagggccgacatcgtctctgcctcgccgccccccaaacagaggagatgggggatggcgaggcagaacctggcggcagcgcaaaagatg

SEQ ID NO: 86613 - DNA, 103 bp, Artificial Sequence
  Synthetic Polynucleotide
taatacgactcactataggggggctcggctccgacatcgtctctgcctcgaacagaggagacgaggcatggacgatgtcaacctggcggcagcgcaaaagatg

SEQ ID NO: 86614 - DNA, 103 bp, Artificial Sequence
  Synthetic Polynucleotide
taatacgactcactatagggggcgctctcggggctcggctccgacatcgtaacagaggagaacgatgatggagccgagcaacctggcggcagcgcaaaagatg

SEQ ID NO: 86615 - DNA, 103 bp, Artificial Sequence
  Synthetic Polynucleotide
taatacgactcactatagggcggcctggctggcgctctcggggctcggctaacagaggagaagccgaatgccgagagcgaacctggcggcagcgcaaaagatg

SEQ ID NO: 86616 - DNA, 103 bp, Artificial Sequence
  Synthetic Polynucleotide
taatacgactcactatagggtcgtcctccccggcctggctggcgctctcgaacagaggagacgagagatgcagccaggcaacctggcggcagcgcaaaagatg

SEQ ID NO: 86617 - DNA, 103 bp, Artificial Sequence
  Synthetic Polynucleotide
taatacgactcactatagggctcctcgtcttcgtcctccccggcctggctaacagaggagaagccagatgggggaggacaacctggcggcagcgcaaaagatg

SEQ ID NO: 86618 - DNA, 103 bp, Artificial Sequence
  Synthetic Polynucleotide
taatacgactcactatagggcgtcgtcctcctcctcgtcttcgtcctcccaacagaggagagggaggatgaagacgaggaacctggcggcagcgcaaaagatg

SEQ ID NO: 86619 - DNA, 103 bp, Artificial Sequence
  Synthetic Polynucleotide
taatacgactcactatagggaggcgggagagctcctccaggtcggccatgaacagaggagacatggcatgcctggaggaaacctggcggcagcgcaaaagatg

SEQ ID NO: 86620 - DNA, 103 bp, Artificial Sequence
  Synthetic Polynucleotide
taatacgactcactatagggtcctcctcctcgtcgtcctcctcctcgtctaacagaggagaagacgaatgggaggacgaaacctggcggcagcgcaaaagatg

SEQ ID NO: 86621 - DNA, 103 bp, Artificial Sequence
  Synthetic Polynucleotide
taatacgactcactataggggctctcatcttcctcctcctcgtcgtcctcaacagaggagagaggacatggaggaggagaacctggcggcagcgcaaaagatg

SEQ ID NO: 86622 - DNA, 103 bp, Artificial Sequence
  Synthetic Polynucleotide
taatacgactcactatagggcgctgctgctgctctcatcttcctcctcctaacagaggagaaggaggatgaagatgagaaacctggcggcagcgcaaaagatg

SEQ ID NO: 86623 - DNA, 103 bp, Artificial Sequence
  Synthetic Polynucleotide
taatacgactcactatagggtcacccccgccgctgctgctgctctcatctaacagaggagaagatgaatgcagcagcagaacctggcggcagcgcaaaagatg

SEQ ID NO: 86624 - DNA, 103 bp, Artificial Sequence
  Synthetic Polynucleotide
taatacgactcactatagggactctcctcctcacccccgccgctgctgctaacagaggagaagcagcatgggcgggggtaacctggcggcagcgcaaaagatg

SEQ ID NO: 86625 - DNA, 103 bp, Artificial Sequence
  Synthetic Polynucleotide
taatacgactcactatagggtctcggcgctactctcctcctcacccccgcaacagaggagagcggggatgaggaggagaaacctggcggcagcgcaaaagatg

SEQ ID NO: 86626 - DNA, 103 bp, Artificial Sequence
  Synthetic Polynucleotide
taatacgactcactatagggcccaccaggctctcggcgctactctcctccaacagaggagaggaggaatgtagcgccgaaacctggcggcagcgcaaaagatg

SEQ ID NO: 86627 - DNA, 103 bp, Artificial Sequence
  Synthetic Polynucleotide
taatacgactcactataggggccgctgctgcccaccaggctctcggcgctaacagaggagaagcgccatgagcctggtgaacctggcggcagcgcaaaagatg

SEQ ID NO: 86628 - DNA, 103 bp, Artificial Sequence
  Synthetic Polynucleotide
taatacgactcactatagggtgctgctcccgccgctgctgcccaccaggcaacagaggagagcctggatggcagcagcgaacctggcggcagcgcaaaagatg

SEQ ID NO: 86629 - DNA, 103 bp, Artificial Sequence
  Synthetic Polynucleotide
taatacgactcactataggggtctcgtcgctgctgctcccgccgctgctgaacagaggagacagcagatgcgggagcagaacctggcggcagcgcaaaagatg

SEQ ID NO: 86630 - DNA, 103 bp, Artificial Sequence
  Synthetic Polynucleotide
taatacgactcactatagggcagagggctcaggcgggagagctcctccagaacagaggagactggagatgctctcccgcaacctggcggcagcgcaaaagatg

SEQ ID NO: 86631 - DNA, 103 bp, Artificial Sequence
  Synthetic Polynucleotide
taatacgactcactatagggcaacgagcgggtctcgtcgctgctgctcccaacagaggagagggagcatgagcgacgagaacctggcggcagcgcaaaagatg

SEQ ID NO: 86632 - DNA, 103 bp, Artificial Sequence
  Synthetic Polynucleotide
taatacgactcactatagggcgccggggctcaacgagcgggtctcgtcgcaacagaggagagcgacgatgcccgctcgtaacctggcggcagcgcaaaagatg

SEQ ID NO: 86633 - DNA, 103 bp, Artificial Sequence
  Synthetic Polynucleotide
taatacgactcactatagggctgctggcggcgccggggctcaacgagcggaacagaggagaccgctcatggagccccggaacctggcggcagcgcaaaagatg

SEQ ID NO: 86634 - DNA, 103 bp, Artificial Sequence
  Synthetic Polynucleotide
taatacgactcactatagggcccgctgctgctgctggcggcgccggggctaacagaggagaagccccatggccgccagcaacctggcggcagcgcaaaagatg

SEQ ID NO: 86635 - DNA, 103 bp, Artificial Sequence
  Synthetic Polynucleotide
taatacgactcactatagggcgtccccatccccgctgctgctgctggcggaacagaggagaccgccaatggcagcagcgaacctggcggcagcgcaaaagatg

SEQ ID NO: 86636 - DNA, 103 bp, Artificial Sequence
  Synthetic Polynucleotide
taatacgactcactatagggccctccttgccgtccccatccccgctgctgaacagaggagacagcagatgggatggggaaacctggcggcagcgcaaaagatg

SEQ ID NO: 86637 - DNA, 103 bp, Artificial Sequence
  Synthetic Polynucleotide
taatacgactcactatagggctcctccaggccctccttgccgtccccatcaacagaggagagatgggatgggcaaggagaacctggcggcagcgcaaaagatg

SEQ ID NO: 86638 - DNA, 103 bp, Artificial Sequence
  Synthetic Polynucleotide
taatacgactcactataggggtcccttgggctcctccaggccctccttgcaacagaggagagcaaggatggcctggaggaacctggcggcagcgcaaaagatg

SEQ ID NO: 86639 - DNA, 103 bp, Artificial Sequence
  Synthetic Polynucleotide
taatacgactcactatagggctgccccgcggtcccttgggctcctccaggaacagaggagacctggaatggcccaagggaacctggcggcagcgcaaaagatg

SEQ ID NO: 86640 - DNA, 103 bp, Artificial Sequence
  Synthetic Polynucleotide
taatacgactcactataggggccgccctggctgccccgcggtcccttgggaacagaggagacccaagatgccgcggggcaacctggcggcagcgcaaaagatg

SEQ ID NO: 86641 - DNA, 103 bp, Artificial Sequence
  Synthetic Polynucleotide
taatacgactcactatagggtgccggggggcagagggctcaggcgggagaaacagaggagatctcccatgtgagccctcaacctggcggcagcgcaaaagatg

SEQ ID NO: 86642 - DNA, 103 bp, Artificial Sequence
  Synthetic Polynucleotide
taatacgactcactatagggcgcccccgccgccgccctggctgccccgcgaacagaggagacgcgggatggccagggcgaacctggcggcagcgcaaaagatg

SEQ ID NO: 86643 - DNA, 103 bp, Artificial Sequence
  Synthetic Polynucleotide
taatacgactcactatagggctactgctgccgcccccgccgccgccctggaacagaggagaccagggatgcggcgggggaacctggcggcagcgcaaaagatg

SEQ ID NO: 86644 - DNA, 103 bp, Artificial Sequence
  Synthetic Polynucleotide
taatacgactcactatagggtacgctgctgctactgctgccgcccccgccaacagaggagaggcgggatgggcagcagtaacctggcggcagcgcaaaagatg

SEQ ID NO: 86645 - DNA, 103 bp, Artificial Sequence
  Synthetic Polynucleotide
taatacgactcactatagggcgctggagactacgctgctgctactgctgcaacagaggagagcagcaatggcagcagcgaacctggcggcagcgcaaaagatg

SEQ ID NO: 86646 - DNA, 103 bp, Artificial Sequence
  Synthetic Polynucleotide
taatacgactcactatagggtcgtcgccgccgctggagactacgctgctgaacagaggagacagcagatgagtctccagaacctggcggcagcgcaaaagatg

SEQ ID NO: 86647 - DNA, 103 bp, Artificial Sequence
  Synthetic Polynucleotide
taatacgactcactatagggcccgtagccctcgtcgccgccgctggagacaacagaggagagtctccatgggcggcgacaacctggcggcagcgcaaaagatg

SEQ ID NO: 86648 - DNA, 103 bp, Artificial Sequence
  Synthetic Polynucleotide
taatacgactcactatagggctcccccagtcccgtagccctcgtcgccgcaacagaggagagcggcgatgagggctacgaacctggcggcagcgcaaaagatg

SEQ ID NO: 86649 - DNA, 103 bp, Artificial Sequence
  Synthetic Polynucleotide
taatacgactcactatagggctgcttccgcctcccccagtcccgtagcccaacagaggagagggctaatggactgggggaacctggcggcagcgcaaaagatg

SEQ ID NO: 86650 - DNA, 103 bp, Artificial Sequence
  Synthetic Polynucleotide
taatacgactcactatagggggaggtcgcgctgcttccgcctcccccagtaacagaggagaactgggatgggcggaagcaacctggcggcagcgcaaaagatg

SEQ ID NO: 86651 - DNA, 103 bp, Artificial Sequence
  Synthetic Polynucleotide
taatacgactcactataggggccggcccccggaggtcgcgctgcttccgcaacagaggagagcggaaatggcgcgacctaacctggcggcagcgcaaaagatg

SEQ ID NO: 86652 - DNA, 103 bp, Artificial Sequence
  Synthetic Polynucleotide
taatacgactcactataggggaacccgggctgccggggggcagagggctcaacagaggagagagcccatggccccccggaacctggcggcagcgcaaaagatg

SEQ ID NO: 86653 - DNA, 103 bp, Artificial Sequence
  Synthetic Polynucleotide
taatacgactcactatagggaagctgccccgccggcccccggaggtcgcgaacagaggagacgcgacatgcgggggccgaacctggcggcagcgcaaaagatg

SEQ ID NO: 86654 - DNA, 103 bp, Artificial Sequence
  Synthetic Polynucleotide
taatacgactcactatagggcgacatctccaagctgccccgccggcccccaacagaggagagggggcatgcggggcagcaacctggcggcagcgcaaaagatg

SEQ ID NO: 86655 - DNA, 103 bp, Artificial Sequence
  Synthetic Polynucleotide
taatacgactcactatagggccccatccgacgacatctccaagctgccccaacagaggagaggggcaatgtggagatgtaacctggcggcagcgcaaaagatg

SEQ ID NO: 86656 - DNA, 103 bp, Artificial Sequence
  Synthetic Polynucleotide
taatacgactcactatagggctcaggggttccccatccgacgacatctccaacagaggagaggagatatggtcggatggaacctggcggcagcgcaaaagatg

SEQ ID NO: 86657 - DNA, 103 bp, Artificial Sequence
  Synthetic Polynucleotide
taatacgactcactataggggtccatgcggctcaggggttccccatccgaaacagaggagatcggatatggaacccctgaacctggcggcagcgcaaaagatg

SEQ ID NO: 86658 - DNA, 103 bp, Artificial Sequence
  Synthetic Polynucleotide
taatacgactcactatagggtgtcctccgagtccatgcggctcaggggttaacagaggagaaaccccatggccgcatggaacctggcggcagcgcaaaagatg

SEQ ID NO: 86659 - DNA, 103 bp, Artificial Sequence
  Synthetic Polynucleotide
taatacgactcactatagggctgcttatgctgtcctccgagtccatgcggaacagaggagaccgcatatgctcggaggaaacctggcggcagcgcaaaagatg

SEQ ID NO: 86660 - DNA, 103 bp, Artificial Sequence
  Synthetic Polynucleotide
taatacgactcactatagggcattatagtactgcttatgctgtcctccgaaacagaggagatcggagatgagcataagcaacctggcggcagcgcaaaagatg

SEQ ID NO: 86661 - DNA, 103 bp, Artificial Sequence
  Synthetic Polynucleotide
taatacgactcactatagggtgtctacatccattatagtactgcttatgcaacagaggagagcataaatggtactataaaacctggcggcagcgcaaaagatg

SEQ ID NO: 86662 - DNA, 103 bp, Artificial Sequence
  Synthetic Polynucleotide
taatacgactcactataggggaaattgtgctgtctacatccattatagtaaacagaggagatactatatgggatgtagaaacctggcggcagcgcaaaagatg

SEQ ID NO: 86663 - DNA, 103 bp, Artificial Sequence
  Synthetic Polynucleotide
taatacgactcactatagggccgcgccgccgaacccgggctgccggggggaacagaggagaccccccatgagcccgggtaacctggcggcagcgcaaaagatg

SEQ ID NO: 86664 - DNA, 103 bp, Artificial Sequence
  Synthetic Polynucleotide
taatacgactcactatagggacgcccactggaaattgtgctgtctacatcaacagaggagagatgtaatgagcacaattaacctggcggcagcgcaaaagatg

SEQ ID NO: 86665 - DNA, 103 bp, Artificial Sequence
  Synthetic Polynucleotide
taatacgactcactatagggctggagttgaacgcccactggaaattgtgcaacagaggagagcacaaatgccagtgggcaacctggcggcagcgcaaaagatg

SEQ ID NO: 86666 - DNA, 103 bp, Artificial Sequence
  Synthetic Polynucleotide
taatacgactcactatagggttcatcattgctggagttgaacgcccactgaacagaggagacagtggatgttcaactccaacctggcggcagcgcaaaagatg

SEQ ID NO: 86667 - DNA, 103 bp, Artificial Sequence
  Synthetic Polynucleotide
taatacgactcactatagggtccttgtccattcatcattgctggagttgaaacagaggagatcaactatggcaatgatgaacctggcggcagcgcaaaagatg

SEQ ID NO: 86668 - DNA, 103 bp, Artificial Sequence
  Synthetic Polynucleotide
taatacgactcactatagggaagtagtgcttccttgtccattcatcattgaacagaggagacaatgaatgatggacaagaacctggcggcagcgcaaaagatg

SEQ ID NO: 86669 - DNA, 103 bp, Artificial Sequence
  Synthetic Polynucleotide
taatacgactcactatagggttgcttgaagaagtagtgcttccttgtccaaacagaggagatggacaatgaagcactacaacctggcggcagcgcaaaagatg

SEQ ID NO: 86670 - DNA, 103 bp, Artificial Sequence
  Synthetic Polynucleotide
taatacgactcactatagggggcaatatttttgcttgaagaagtagtgctaacagaggagaagcactatgtcttcaagcaacctggcggcagcgcaaaagatg

SEQ ID NO: 86671 - DNA, 103 bp, Artificial Sequence
  Synthetic Polynucleotide
taatacgactcactatagggaacaattataggcaatatttttgcttgaagaacagaggagacttcaaatgaaaatattgaacctggcggcagcgcaaaagatg

SEQ ID NO: 86672 - DNA, 103 bp, Artificial Sequence
  Synthetic Polynucleotide
taatacgactcactatagggtggtcccaacaacaattataggcaatatttaacagaggagaaaatatatgctataattgaacctggcggcagcgcaaaagatg

SEQ ID NO: 86673 - DNA, 103 bp, Artificial Sequence
  Synthetic Polynucleotide
taatacgactcactatagggagcctggcactggtcccaacaacaattataaacagaggagatataatatgtgttgggacaacctggcggcagcgcaaaagatg

SEQ ID NO: 86674 - DNA, 103 bp, Artificial Sequence
  Synthetic Polynucleotide
taatacgactcactatagggcagcccggccccgcgccgccgaacccgggcaacagaggagagcccggatgcggcggcgcaacctggcggcagcgcaaaagatg

SEQ ID NO: 86675 - DNA, 103 bp, Artificial Sequence
  Synthetic Polynucleotide
taatacgactcactatagggagttgaagcaagcctggcactggtcccaacaacagaggagagttgggatgagtgccaggaacctggcggcagcgcaaaagatg

SEQ ID NO: 86676 - DNA, 103 bp, Artificial Sequence
  Synthetic Polynucleotide
taatacgactcactatagggtctgggctagagttgaagcaagcctggcacaacagaggagagtgccaatgttgcttcaaaacctggcggcagcgcaaaagatg

SEQ ID NO: 86677 - DNA, 103 bp, Artificial Sequence
  Synthetic Polynucleotide
taatacgactcactatagggatctgccagatctgggctagagttgaagcaaacagaggagatgcttcatgtctagcccaaacctggcggcagcgcaaaagatg

SEQ ID NO: 86678 - DNA, 103 bp, Artificial Sequence
  Synthetic Polynucleotide
taatacgactcactatagggaacggatgtgatctgccagatctgggctagaacagaggagactagccatgatctggcagaacctggcggcagcgcaaaagatg

SEQ ID NO: 86679 - DNA, 103 bp, Artificial Sequence
  Synthetic Polynucleotide
taatacgactcactatagggacatgtatggaacggatgtgatctgccagaaacagaggagatctggcatgtcacatccgaacctggcggcagcgcaaaagatg

SEQ ID NO: 86680 - DNA, 103 bp, Artificial Sequence
  Synthetic Polynucleotide
taatacgactcactatagggctgaccatctacatgtatggaacggatgtgaacagaggagacacatcatgtccatacataacctggcggcagcgcaaaagatg

SEQ ID NO: 86681 - DNA, 103 bp, Artificial Sequence
  Synthetic Polynucleotide
taatacgactcactatagggcccctcctcgctgaccatctacatgtatggaacagaggagaccatacatgtagatggtcaacctggcggcagcgcaaaagatg

SEQ ID NO: 86682 - DNA, 103 bp, Artificial Sequence
  Synthetic Polynucleotide
taatacgactcactatagggcaaacaaatacccctcctcgctgaccatctaacagaggagaagatggatggcgaggaggaacctggcggcagcgcaaaagatg

SEQ ID NO: 86683 - DNA, 103 bp, Artificial Sequence
  Synthetic Polynucleotide
taatacgactcactatagggtttccataagcaaacaaatacccctcctcgaacagaggagacgaggaatggtatttgttaacctggcggcagcgcaaaagatg

SEQ ID NO: 86684 - DNA, 103 bp, Artificial Sequence
  Synthetic Polynucleotide
taatacgactcactatagggctttacaacctttccataagcaaacaaataaacagaggagatatttgatggcttatggaaacctggcggcagcgcaaaagatg

SEQ ID NO: 86685 - DNA, 103 bp, Artificial Sequence
  Synthetic Polynucleotide
taatacgactcactatagggtcggggggctcagcccggccccgcgccgccaacagaggagaggcggcatggggccgggcaacctggcggcagcgcaaaagatg

SEQ ID NO: 86686 - DNA, 103 bp, Artificial Sequence
  Synthetic Polynucleotide
taatacgactcactataggggtgttatatactttacaacctttccataagaacagaggagacttatgatgaggttgtaaaacctggcggcagcgcaaaagatg

SEQ ID NO: 86687 - DNA, 103 bp, Artificial Sequence
  Synthetic Polynucleotide
taatacgactcactatagggggtagatggagtgttatatactttacaaccaacagaggagaggttgtatggtatataacaacctggcggcagcgcaaaagatg

SEQ ID NO: 86688 - DNA, 103 bp, Artificial Sequence
  Synthetic Polynucleotide
taatacgactcactatagggaactttgactggtagatggagtgttatataaacagaggagatatataatgctccatctaaacctggcggcagcgcaaaagatg

SEQ ID NO: 86689 - DNA, 103 bp, Artificial Sequence
  Synthetic Polynucleotide
taatacgactcactatagggctttgtaaccaactttgactggtagatggaaacagaggagatccatcatgcagtcaaagaacctggcggcagcgcaaaagatg

SEQ ID NO: 86690 - DNA, 103 bp, Artificial Sequence
  Synthetic Polynucleotide
taatacgactcactatagggcagcatatgcctttgtaaccaactttgactaacagaggagaagtcaaatgtggttacaaaacctggcggcagcgcaaaagatg

SEQ ID NO: 86691 - DNA, 103 bp, Artificial Sequence
  Synthetic Polynucleotide
taatacgactcactatagggcactgtgtgtcagcatatgcctttgtaaccaacagaggagaggttacatgggcatatgcaacctggcggcagcgcaaaagatg

SEQ ID NO: 86692 - DNA, 103 bp, Artificial Sequence
  Synthetic Polynucleotide
taatacgactcactatagggggtttgtctccactgtgtgtcagcatatgcaacagaggagagcatatatggacacacagaacctggcggcagcgcaaaagatg

SEQ ID NO: 86693 - DNA, 103 bp, Artificial Sequence
  Synthetic Polynucleotide
taatacgactcactatagggacacttgaaaggtttgtctccactgtgtgtaacagaggagaacacacatgggagacaaaaacctggcggcagcgcaaaagatg

SEQ ID NO: 86694 - DNA, 103 bp, Artificial Sequence
  Synthetic Polynucleotide
taatacgactcactatagggcaccaacaacacacttgaaaggtttgtctcaacagaggagagagacaatgctttcaagtaacctggcggcagcgcaaaagatg

SEQ ID NO: 86695 - DNA, 103 bp, Artificial Sequence
  Synthetic Polynucleotide
taatacgactcactataggggcattgcagccaccaacaacacacttgaaaaacagaggagatttcaaatgtgttgttggaacctggcggcagcgcaaaagatg

SEQ ID NO: 86696 - DNA, 103 bp, Artificial Sequence
  Synthetic Polynucleotide
taatacgactcactatagggcgcagctgctcccgagggtcccgcttccataacagaggagaatggaaatgggaccctcgaacctggcggcagcgcaaaagatg

SEQ ID NO: 86697 - DNA, 103 bp, Artificial Sequence
  Synthetic Polynucleotide
taatacgactcactatagggggccaggagcttgattggtttccccacagtaacagaggagaactgtgatgaaaccaatcaacctggcggcagcgcaaaagatg

SEQ ID NO: 86698 - DNA, 103 bp, Artificial Sequence
  Synthetic Polynucleotide
taatacgactcactatagggctctaggggaaggtaggtatgcttttgttcaacagaggagagaacaaatgcatacctacaacctggcggcagcgcaaaagatg

SEQ ID NO: 86699 - DNA, 103 bp, Artificial Sequence
  Synthetic Polynucleotide
taatacgactcactatagggtgttacagacctctaggggaaggtaggtataacagaggagaatacctatgttcccctagaacctggcggcagcgcaaaagatg

SEQ ID NO: 86700 - DNA, 103 bp, Artificial Sequence
  Synthetic Polynucleotide
taatacgactcactatagggccagccacaatgttacagacctctaggggaaacagaggagatcccctatgggtctgtaaaacctggcggcagcgcaaaagatg

SEQ ID NO: 86701 - DNA, 103 bp, Artificial Sequence
  Synthetic Polynucleotide
taatacgactcactatagggacagcgctgcccagccacaatgttacagacaacagaggagagtctgtatgattgtggctaacctggcggcagcgcaaaagatg

SEQ ID NO: 86702 - DNA, 103 bp, Artificial Sequence
  Synthetic Polynucleotide
taatacgactcactataggggctttttaatacagcgctgcccagccacaaaacagaggagattgtggatgggcagcgctaacctggcggcagcgcaaaagatg

SEQ ID NO: 86703 - DNA, 103 bp, Artificial Sequence
  Synthetic Polynucleotide
taatacgactcactatagggttgtcggtcagctttttaatacagcgctgcaacagaggagagcagcgatgtattaaaaaaacctggcggcagcgcaaaagatg

SEQ ID NO: 86704 - DNA, 103 bp, Artificial Sequence
  Synthetic Polynucleotide
taatacgactcactatagggcgaggtctggttgtcggtcagctttttaataacagaggagaattaaaatgctgaccgacaacctggcggcagcgcaaaagatg

SEQ ID NO: 86705 - DNA, 103 bp, Artificial Sequence
  Synthetic Polynucleotide
taatacgactcactatagggttatcatggtcgaggtctggttgtcggtcaaacagaggagatgaccgatgaccagacctaacctggcggcagcgcaaaagatg

SEQ ID NO: 86706 - DNA, 103 bp, Artificial Sequence
  Synthetic Polynucleotide
taatacgactcactataggggctgtggcctttatcatggtcgaggtctggaacagaggagaccagacatggaccatgataacctggcggcagcgcaaaagatg

SEQ ID NO: 86707 - DNA, 103 bp, Artificial Sequence
  Synthetic Polynucleotide
taatacgactcactatagggagcggatctagctgtggcctttatcatggtaacagaggagaaccatgatgaaggccacaaacctggcggcagcgcaaaagatg

SEQ ID NO: 86708 - DNA, 103 bp, Artificial Sequence
  Synthetic Polynucleotide
taatacgactcactatagggcaaagtaattggccaggagcttgattggttaacagaggagaaaccaaatgagctcctggaacctggcggcagcgcaaaagatg

SEQ ID NO: 86709 - DNA, 103 bp, Artificial Sequence
  Synthetic Polynucleotide
taatacgactcactataggggtctgtctggagcggatctagctgtggcctaacagaggagaaggccaatgctagatccgaacctggcggcagcgcaaaagatg

SEQ ID NO: 86710 - DNA, 103 bp, Artificial Sequence
  Synthetic Polynucleotide
taatacgactcactatagggatctcctcctgtctgtctggagcggatctaaacagaggagatagatcatgtccagacagaacctggcggcagcgcaaaagatg

SEQ ID NO: 86711 - DNA, 103 bp, Artificial Sequence
  Synthetic Polynucleotide
taatacgactcactatagggcaggcgactgatctcctcctgtctgtctggaacagaggagaccagacatgcaggaggagaacctggcggcagcgcaaaagatg

SEQ ID NO: 86712 - DNA, 103 bp, Artificial Sequence
  Synthetic Polynucleotide
taatacgactcactatagggcattcttcatcaggcgactgatctcctcctaacagaggagaaggaggatgtcagtcgccaacctggcggcagcgcaaaagatg

SEQ ID NO: 86713 - DNA, 103 bp, Artificial Sequence
  Synthetic Polynucleotide
taatacgactcactatagggttgtagctggcattcttcatcaggcgactgaacagaggagacagtcgatggatgaagaaaacctggcggcagcgcaaaagatg

SEQ ID NO: 86714 - DNA, 103 bp, Artificial Sequence
  Synthetic Polynucleotide
taatacgactcactataggggggatctaagttgtagctggcattcttcataacagaggagaatgaagatggccagctacaacctggcggcagcgcaaaagatg

SEQ ID NO: 86715 - DNA, 103 bp, Artificial Sequence
  Synthetic Polynucleotide
taatacgactcactatagggcctggatgtagggatctaagttgtagctggaacagaggagaccagctatgacttagatcaacctggcggcagcgcaaaagatg

SEQ ID NO: 86716 - DNA, 103 bp, Artificial Sequence
  Synthetic Polynucleotide
taatacgactcactatagggatcccaaattcctggatgtagggatctaagaacagaggagacttagaatgctacatccaaacctggcggcagcgcaaaagatg

SEQ ID NO: 86717 - DNA, 103 bp, Artificial Sequence
  Synthetic Polynucleotide
taatacgactcactatagggcttcactttgatcccaaattcctggatgtaaacagaggagatacatcatggaatttgggaacctggcggcagcgcaaaagatg

SEQ ID NO: 86718 - DNA, 103 bp, Artificial Sequence
  Synthetic Polynucleotide
taatacgactcactatagggtcatgtcatccttcactttgatcccaaattaacagaggagaaatttgatgtcaaagtgaaacctggcggcagcgcaaaagatg

SEQ ID NO: 86719 - DNA, 103 bp, Artificial Sequence
  Synthetic Polynucleotide
taatacgactcactatagggatgtccacctcaaagtaattggccaggagcaacagaggagagctcctatgcaattacttaacctggcggcagcgcaaaagatg

SEQ ID NO: 86720 - DNA, 103 bp, Artificial Sequence
  Synthetic Polynucleotide
taatacgactcactataggggtcacctccgtcatgtcatccttcactttgaacagaggagacaaagtatgggatgacataacctggcggcagcgcaaaagatg

SEQ ID NO: 86721 - DNA, 103 bp, Artificial Sequence
  Synthetic Polynucleotide
taatacgactcactatagggcactcgccctgtcacctccgtcatgtcatcaacagaggagagatgacatgacggaggtgaacctggcggcagcgcaaaagatg

SEQ ID NO: 86722 - DNA, 103 bp, Artificial Sequence
  Synthetic Polynucleotide
taatacgactcactataggggcgccggcagcactcgccctgtcacctccgaacagaggagacggaggatgcagggcgagaacctggcggcagcgcaaaagatg

SEQ ID NO: 86723 - DNA, 103 bp, Artificial Sequence
  Synthetic Polynucleotide
taatacgactcactatagggtgcaagatgggcgccggcagcactcgccctaacagaggagaagggcgatggctgccggcaacctggcggcagcgcaaaagatg

SEQ ID NO: 86724 - DNA, 103 bp, Artificial Sequence
  Synthetic Polynucleotide
taatacgactcactataggggccgccgtactgcaagatgggcgccggcagaacagaggagactgccgatgcccatcttgaacctggcggcagcgcaaaagatg

SEQ ID NO: 86725 - DNA, 103 bp, Artificial Sequence
  Synthetic Polynucleotide
taatacgactcactatagggcccggttccggccgccgtactgcaagatggaacagaggagaccatctatgagtacggcgaacctggcggcagcgcaaaagatg

SEQ ID NO: 86726 - DNA, 103 bp, Artificial Sequence
  Synthetic Polynucleotide
taatacgactcactataggggtggcaatggcccggttccggccgccgtacaacagaggagagtacggatgccggaaccgaacctggcggcagcgcaaaagatg

SEQ ID NO: 86727 - DNA, 103 bp, Artificial Sequence
  Synthetic Polynucleotide
taatacgactcactatagggctgattgggtgtggcaatggcccggttccgaacagaggagacggaacatggccattgccaacctggcggcagcgcaaaagatg

SEQ ID NO: 86728 - DNA, 103 bp, Artificial Sequence
  Synthetic Polynucleotide
taatacgactcactatagggcccagacaccctgattgggtgtggcaatggaacagaggagaccattgatgcacccaatcaacctggcggcagcgcaaaagatg

SEQ ID NO: 86729 - DNA, 103 bp, Artificial Sequence
  Synthetic Polynucleotide
taatacgactcactatagggccccgcatgtcccagacaccctgattgggtaacagaggagaacccaaatggggtgtctgaacctggcggcagcgcaaaagatg

SEQ ID NO: 86730 - DNA, 103 bp, Artificial Sequence
  Synthetic Polynucleotide
taatacgactcactataggggatcttagggatgtccacctcaaagtaattaacagaggagaaattacatggaggtggacaacctggcggcagcgcaaaagatg

SEQ ID NO: 86731 - DNA, 103 bp, Artificial Sequence
  Synthetic Polynucleotide
taatacgactcactataggggaactgtttcccccgcatgtcccagacaccaacagaggagaggtgtcatggacatgcggaacctggcggcagcgcaaaagatg

SEQ ID NO: 86732 - DNA, 103 bp, Artificial Sequence
  Synthetic Polynucleotide
taatacgactcactatagggtcccattgtagaactgtttcccccgcatgtaacagaggagaacatgcatgggaaacagtaacctggcggcagcgcaaaagatg

SEQ ID NO: 86733 - DNA, 103 bp, Artificial Sequence
  Synthetic Polynucleotide
taatacgactcactatagggttgatctcaatcccattgtagaactgtttcaacagaggagagaaacaatgctacaatggaacctggcggcagcgcaaaagatg

SEQ ID NO: 86734 - DNA, 103 bp, Artificial Sequence
  Synthetic Polynucleotide
taatacgactcactatagggggcccagactttgatctcaatcccattgtaaacagaggagatacaatatgattgagatcaacctggcggcagcgcaaaagatg

SEQ ID NO: 86735 - DNA, 103 bp, Artificial Sequence
  Synthetic Polynucleotide
taatacgactcactatagggagcaggcgatggcccagactttgatctcaaaacagaggagattgagaatgaagtctgggaacctggcggcagcgcaaaagatg

SEQ ID NO: 86736 - DNA, 103 bp, Artificial Sequence
  Synthetic Polynucleotide
taatacgactcactatagggtggggtgcgaagcaggcgatggcccagactaacagaggagaagtctgatgcatcgcctgaacctggcggcagcgcaaaagatg

SEQ ID NO: 86737 - DNA, 103 bp, Artificial Sequence
  Synthetic Polynucleotide
taatacgactcactatagggacactgtttttggggtgcgaagcaggcgataacagaggagaatcgccatgttcgcacccaacctggcggcagcgcaaaagatg

SEQ ID NO: 86738 - DNA, 103 bp, Artificial Sequence
  Synthetic Polynucleotide
taatacgactcactatagggcctcttctcgacactgtttttggggtgcgaaacagaggagatcgcacatgaaaaacagtaacctggcggcagcgcaaaagatg

SEQ ID NO: 86739 - DNA, 103 bp, Artificial Sequence
  Synthetic Polynucleotide
taatacgactcactatagggttcttgagcacctcttctcgacactgttttaacagaggagaaaaacaatgtcgagaagaaacctggcggcagcgcaaaagatg

SEQ ID NO: 86740 - DNA, 103 bp, Artificial Sequence
  Synthetic Polynucleotide
taatacgactcactataggggtctgtgaagttcttgagcacctcttctcgaacagaggagacgagaaatggtgctcaagaacctggcggcagcgcaaaagatg

SEQ ID NO: 86741 - DNA, 103 bp, Artificial Sequence
  Synthetic Polynucleotide
taatacgactcactatagggggtacacgtcgatcttagggatgtccacctaacagaggagaaggtggatgtccctaagaaacctggcggcagcgcaaaagatg

SEQ ID NO: 86742 - DNA, 103 bp, Artificial Sequence
  Synthetic Polynucleotide
taatacgactcactatagggtccgcagctggtctgtgaagttcttgagcaaacagaggagatgctcaatgacttcacagaacctggcggcagcgcaaaagatg

SEQ ID NO: 86743 - DNA, 103 bp, Artificial Sequence
  Synthetic Polynucleotide
taatacgactcactatagggttggaaatcttccgcagctggtctgtgaagaacagaggagacttcacatgccagctgcgaacctggcggcagcgcaaaagatg

SEQ ID NO: 86744 - DNA, 103 bp, Artificial Sequence
  Synthetic Polynucleotide
taatacgactcactatagggccccgcatccttggaaatcttccgcagctgaacagaggagacagctgatgaagatttccaacctggcggcagcgcaaaagatg

SEQ ID NO: 86745 - DNA, 103 bp, Artificial Sequence
  Synthetic Polynucleotide
taatacgactcactatagggggataggcatccccgcatccttggaaatctaacagaggagaagatttatgaggatgcggaacctggcggcagcgcaaaagatg

SEQ ID NO: 86746 - DNA, 103 bp, Artificial Sequence
  Synthetic Polynucleotide
taatacgactcactatagggggttgaccctggataggcatccccgcatccaacagaggagaggatgcatggatgcctataacctggcggcagcgcaaaagatg

SEQ ID NO: 86747 - DNA, 103 bp, Artificial Sequence
  Synthetic Polynucleotide
taatacgactcactataggggcagaaacaaggttgaccctggataggcataacagaggagaatgcctatgcagggtcaaaacctggcggcagcgcaaaagatg

SEQ ID NO: 86748 - DNA, 103 bp, Artificial Sequence
  Synthetic Polynucleotide
taatacgactcactataggggtgcatatttgcagaaacaaggttgaccctaacagaggagaagggtcatgcttgtttctaacctggcggcagcgcaaaagatg

SEQ ID NO: 86749 - DNA, 103 bp, Artificial Sequence
  Synthetic Polynucleotide
taatacgactcactatagggtctgccccctgtgcatatttgcagaaacaaaacagaggagattgtttatgcaaatatgcaacctggcggcagcgcaaaagatg

SEQ ID NO: 86750 - DNA, 103 bp, Artificial Sequence
  Synthetic Polynucleotide
taatacgactcactatagggctccacgctgtctgccccctgtgcatatttaacagaggagaaaatatatgcagggggcaaacctggcggcagcgcaaaagatg

SEQ ID NO: 86751 - DNA, 103 bp, Artificial Sequence
  Synthetic Polynucleotide
taatacgactcactatagggggaacataggctccacgctgtctgccccctaacagaggagaagggggatgacagcgtggaacctggcggcagcgcaaaagatg

SEQ ID NO: 86752 - DNA, 103 bp, Artificial Sequence
  Synthetic Polynucleotide
taatacgactcactatagggacctcgtagtggtacacgtcgatcttagggaacagaggagaccctaaatgcgacgtgtaaacctggcggcagcgcaaaagatg

SEQ ID NO: 86753 - DNA, 103 bp, Artificial Sequence
  Synthetic Polynucleotide
taatacgactcactatagggttgagatgccggaacataggctccacgctgaacagaggagacagcgtatggcctatgttaacctggcggcagcgcaaaagatg

SEQ ID NO: 86754 - DNA, 103 bp, Artificial Sequence
  Synthetic Polynucleotide
taatacgactcactataggggtaggtgttcttgagatgccggaacataggaacagaggagacctatgatgcggcatctcaacctggcggcagcgcaaaagatg

SEQ ID NO: 86755 - DNA, 103 bp, Artificial Sequence
  Synthetic Polynucleotide
taatacgactcactataggggcagccctgagtaggtgttcttgagatgccaacagaggagaggcatcatgagaacacctaacctggcggcagcgcaaaagatg

SEQ ID NO: 86756 - DNA, 103 bp, Artificial Sequence
  Synthetic Polynucleotide
taatacgactcactatagggataatgagctgcagccctgagtaggtgttcaacagaggagagaacacatgctcagggctaacctggcggcagcgcaaaagatg

SEQ ID NO: 86757 - DNA, 103 bp, Artificial Sequence
  Synthetic Polynucleotide
taatacgactcactatagggcaggatgacaataatgagctgcagccctgaaacagaggagatcagggatgcagctcattaacctggcggcagcgcaaaagatg

SEQ ID NO: 86758 - DNA, 103 bp, Artificial Sequence
  Synthetic Polynucleotide
taatacgactcactatagggtcttccctggcaggatgacaataatgagctaacagaggagaagctcaatgttgtcatccaacctggcggcagcgcaaaagatg

SEQ ID NO: 86759 - DNA, 103 bp, Artificial Sequence
  Synthetic Polynucleotide
taatacgactcactatagggtacaccggcgtcttccctggcaggatgacaaacagaggagatgtcatatggccagggaaaacctggcggcagcgcaaaagatg

SEQ ID NO: 86760 - DNA, 103 bp, Artificial Sequence
  Synthetic Polynucleotide
taatacgactcactatagggcacctcagcatacaccggcgtcttccctggaacagaggagaccagggatgacgccggtgaacctggcggcagcgcaaaagatg

SEQ ID NO: 86761 - DNA, 103 bp, Artificial Sequence
  Synthetic Polynucleotide
taatacgactcactatagggcgacacgtttcacctcagcatacaccggcgaacagaggagacgccggatgatgctgaggaacctggcggcagcgcaaaagatg

SEQ ID NO: 86762 - DNA, 103 bp, Artificial Sequence
  Synthetic Polynucleotide
taatacgactcactatagggagtgtatctccgacacgtttcacctcagcaaacagaggagatgctgaatggaaacgtgtaacctggcggcagcgcaaaagatg

SEQ ID NO: 86763 - DNA, 103 bp, Artificial Sequence
  Synthetic Polynucleotide
taatacgactcactatagggcttgatgtccacctcgtagtggtacacgtcaacagaggagagacgtgatgcactacgagaacctggcggcagcgcaaaagatg

SEQ ID NO: 86764 - DNA, 103 bp, Artificial Sequence
  Synthetic Polynucleotide
taatacgactcactatagggcattcccaagagtgtatctccgacacgtttaacagaggagaaaacgtatgggagatacaaacctggcggcagcgcaaaagatg

SEQ ID NO: 86765 - DNA, 103 bp, Artificial Sequence
  Synthetic Polynucleotide
taatacgactcactatagggactgcgtagccattcccaagagtgtatctcaacagaggagagagataatgtcttgggaaaacctggcggcagcgcaaaagatg

SEQ ID NO: 86766 - DNA, 103 bp, Artificial Sequence
  Synthetic Polynucleotide
taatacgactcactatagggacctgcacacactgcgtagccattcccaagaacagaggagacttgggatgggctacgcaaacctggcggcagcgcaaaagatg

SEQ ID NO: 86767 - DNA, 103 bp, Artificial Sequence
  Synthetic Polynucleotide
taatacgactcactatagggcacgttcttcacctgcacacactgcgtagcaacagaggagagctacgatgtgtgtgcagaacctggcggcagcgcaaaagatg

SEQ ID NO: 86768 - DNA, 103 bp, Artificial Sequence
  Synthetic Polynucleotide
taatacgactcactatagggaggtcttgaccacgttcttcacctgcacacaacagaggagagtgtgcatgtgaagaacgaacctggcggcagcgcaaaagatg

SEQ ID NO: 86769 - DNA, 103 bp, Artificial Sequence
  Synthetic Polynucleotide
taatacgactcactataggggtctgaggtgaggtcttgaccacgttcttcaacagaggagagaagaaatgggtcaagacaacctggcggcagcgcaaaagatg

SEQ ID NO: 86770 - DNA, 103 bp, Artificial Sequence
  Synthetic Polynucleotide
taatacgactcactataggggttggacagagtctgaggtgaggtcttgacaacagaggagagtcaagatgtcacctcagaacctggcggcagcgcaaaagatg

SEQ ID NO: 86771 - DNA, 103 bp, Artificial Sequence
  Synthetic Polynucleotide
taatacgactcactatagggtgaggcagaggttggacagagtctgaggtgaacagaggagacacctcatgctctgtccaaacctggcggcagcgcaaaagatg

SEQ ID NO: 86772 - DNA, 103 bp, Artificial Sequence
  Synthetic Polynucleotide
taatacgactcactatagggacattgatcttgaggcagaggttggacagaaacagaggagatctgtcatgcctctgcctaacctggcggcagcgcaaaagatg

SEQ ID NO: 86773 - DNA, 103 bp, Artificial Sequence
  Synthetic Polynucleotide
taatacgactcactatagggaccaagtttgacattgatcttgaggcagagaacagaggagactctgcatgaagatcaataacctggcggcagcgcaaaagatg

SEQ ID NO: 86774 - DNA, 103 bp, Artificial Sequence
  Synthetic Polynucleotide
taatacgactcactatagggacttatccggcttgatgtccacctcgtagtaacagaggagaactacgatgtggacatcaaacctggcggcagcgcaaaagatg

SEQ ID NO: 86775 - DNA, 103 bp, Artificial Sequence
  Synthetic Polynucleotide
taatacgactcactatagggtgttaatgccaccaagtttgacattgatctaacagaggagaagatcaatgtcaaacttgaacctggcggcagcgcaaaagatg

SEQ ID NO: 86776 - DNA, 103 bp, Artificial Sequence
  Synthetic Polynucleotide
taatacgactcactatagggactaggatgttgttaatgccaccaagtttgaacagaggagacaaactatgtggcattaaaacctggcggcagcgcaaaagatg

SEQ ID NO: 86777 - DNA, 103 bp, Artificial Sequence
  Synthetic Polynucleotide
taatacgactcactatagggctggtgtgggactaggatgttgttaatgccaacagaggagaggcattatgaacatcctaaacctggcggcagcgcaaaagatg

SEQ ID NO: 86778 - DNA, 103 bp, Artificial Sequence
  Synthetic Polynucleotide
taatacgactcactatagggcggcagagcgctggtgtgggactaggatgtaacagaggagaacatccatgtcccacaccaacctggcggcagcgcaaaagatg

SEQ ID NO: 86779 - DNA, 103 bp, Artificial Sequence
  Synthetic Polynucleotide
taatacgactcactatagggtgttgaaaaacggcagagcgctggtgtgggaacagaggagacccacaatggcgctctgcaacctggcggcagcgcaaaagatg

SEQ ID NO: 86780 - DNA, 103 bp, Artificial Sequence
  Synthetic Polynucleotide
taatacgactcactatagggtatcactggctgttgaaaaacggcagagcgaacagaggagacgctctatggtttttcaaaacctggcggcagcgcaaaagatg

SEQ ID NO: 86781 - DNA, 103 bp, Artificial Sequence
  Synthetic Polynucleotide
taatacgactcactatagggctcccaggaatatcactggctgttgaaaaaaacagaggagatttttcatgagccagtgaaacctggcggcagcgcaaaagatg

SEQ ID NO: 86782 - DNA, 103 bp, Artificial Sequence
  Synthetic Polynucleotide
taatacgactcactataggggtaacatctgctcccaggaatatcactggcaacagaggagagccagtatgattcctgggaacctggcggcagcgcaaaagatg

SEQ ID NO: 86783 - DNA, 103 bp, Artificial Sequence
  Synthetic Polynucleotide
taatacgactcactatagggtggggggtgtgtaacatctgctcccaggaaaacagaggagattcctgatggcagatgttaacctggcggcagcgcaaaagatg

SEQ ID NO: 86784 - DNA, 103 bp, Artificial Sequence
  Synthetic Polynucleotide
taatacgactcactatagggcatcccctgctggggggtgtgtaacatctgaacagaggagacagatgatgcacacccccaacctggcggcagcgcaaaagatg

SEQ ID NO: 86785 - DNA, 103 bp, Artificial Sequence
  Synthetic Polynucleotide
taatacgactcactatagggctacggggacacttatccggcttgatgtccaacagaggagaggacatatggccggataaaacctggcggcagcgcaaaagatg

SEQ ID NO: 86786 - DNA, 103 bp, Artificial Sequence
  Synthetic Polynucleotide
taatacgactcactatagggggttttttcccatcccctgctggggggtgtaacagaggagaacacccatgagcaggggaaacctggcggcagcgcaaaagatg

SEQ ID NO: 86787 - DNA, 103 bp, Artificial Sequence
  Synthetic Polynucleotide
taatacgactcactatagggtgtgatagaaggttttttcccatcccctgcaacagaggagagcagggatggggaaaaaaaacctggcggcagcgcaaaagatg

SEQ ID NO: 86788 - DNA, 103 bp, Artificial Sequence
  Synthetic Polynucleotide
taatacgactcactatagggctaccactgctgtgatagaaggttttttccaacagaggagaggaaaaatgcttctatcaaacctggcggcagcgcaaaagatg

SEQ ID NO: 86789 - DNA, 103 bp, Artificial Sequence
  Synthetic Polynucleotide
taatacgactcactatagggtccatactgcctaccactgctgtgatagaaaacagaggagattctatatgagcagtggtaacctggcggcagcgcaaaagatg

SEQ ID NO: 86790 - DNA, 103 bp, Artificial Sequence
  Synthetic Polynucleotide
taatacgactcactatagggggggtgggcatccatactgcctaccactgcaacagaggagagcagtgatgggcagtatgaacctggcggcagcgcaaaagatg

SEQ ID NO: 86791 - DNA, 103 bp, Artificial Sequence
  Synthetic Polynucleotide
taatacgactcactatagggagtatcggctggggtgggcatccatactgcaacagaggagagcagtaatgatgcccaccaacctggcggcagcgcaaaagatg

SEQ ID NO: 86792 - DNA, 103 bp, Artificial Sequence
  Synthetic Polynucleotide
taatacgactcactatagggacagtagcacagtatcggctggggtgggcaaacagaggagatgcccaatgcagccgataaacctggcggcagcgcaaaagatg

SEQ ID NO: 86793 - DNA, 103 bp, Artificial Sequence
  Synthetic Polynucleotide
taatacgactcactatagggctgtacccgcacagtagcacagtatcggctaacagaggagaagccgaatgtgtgctactaacctggcggcagcgcaaaagatg

SEQ ID NO: 86794 - DNA, 103 bp, Artificial Sequence
  Synthetic Polynucleotide
taatacgactcactataggggccgtggtcgctgtacccgcacagtagcacaacagaggagagtgctaatgtgcgggtacaacctggcggcagcgcaaaagatg

SEQ ID NO: 86795 - DNA, 103 bp, Artificial Sequence
  Synthetic Polynucleotide
taatacgactcactatagggatgatctcttgccgtggtcgctgtacccgcaacagaggagagcgggtatggcgaccacgaacctggcggcagcgcaaaagatg

SEQ ID NO: 86796 - DNA, 103 bp, Artificial Sequence
  Synthetic Polynucleotide
taatacgactcactatagggccggttgactctacggggacacttatccggaacagaggagaccggatatgtgtccccgtaacctggcggcagcgcaaaagatg

SEQ ID NO: 86797 - DNA, 103 bp, Artificial Sequence
  Synthetic Polynucleotide
taatacgactcactatagggcaagtcttcaatgatctcttgccgtggtcgaacagaggagacgaccaatgcaagagatcaacctggcggcagcgcaaaagatg

SEQ ID NO: 86798 - DNA, 103 bp, Artificial Sequence
  Synthetic Polynucleotide
taatacgactcactatagggccatgtaggacaagtcttcaatgatctcttaacagaggagaaagagaatgttgaagactaacctggcggcagcgcaaaagatg

SEQ ID NO: 86799 - DNA, 103 bp, Artificial Sequence
  Synthetic Polynucleotide
taatacgactcactatagggagctcacgcaccatgtaggacaagtcttcaaacagaggagatgaagaatggtcctacataacctggcggcagcgcaaaagatg

SEQ ID NO: 86800 - DNA, 103 bp, Artificial Sequence
  Synthetic Polynucleotide
taatacgactcactatagggttggatgaggagctcacgcaccatgtaggaaacagaggagatcctacatggtgcgtgagaacctggcggcagcgcaaaagatg

SEQ ID NO: 86801 - DNA, 103 bp, Artificial Sequence
  Synthetic Polynucleotide
taatacgactcactatagggacttgtagaattggatgaggagctcacgcaaacagaggagatgcgtgatgtcctcatccaacctggcggcagcgcaaaagatg

SEQ ID NO: 86802 - DNA, 103 bp, Artificial Sequence
  Synthetic Polynucleotide
taatacgactcactatagggaaacgggtggacttgtagaattggatgaggaacagaggagacctcatatgattctacaaaacctggcggcagcgcaaaagatg

SEQ ID NO: 86803 - DNA, 103 bp, Artificial Sequence
  Synthetic Polynucleotide
taatacgactcactatagggggtaggcttgaaacgggtggacttgtagaaaacagaggagattctacatgtccacccgtaacctggcggcagcgcaaaagatg

SEQ ID NO: 86804 - DNA, 103 bp, Artificial Sequence
  Synthetic Polynucleotide
taatacgactcactatagggagatgatgcgggtaggcttgaaacgggtggaacagaggagaccacccatgtcaagcctaaacctggcggcagcgcaaaagatg

SEQ ID NO: 86805 - DNA, 103 bp, Artificial Sequence
  Synthetic Polynucleotide
taatacgactcactatagggtctcggtagaagatgatgcgggtaggcttgaacagaggagacaagccatgccgcatcataacctggcggcagcgcaaaagatg

SEQ ID NO: 86806 - DNA, 103 bp, Artificial Sequence
  Synthetic Polynucleotide
taatacgactcactatagggaggcaccccatctcggtagaagatgatgcgaacagaggagacgcatcatgttctaccgaaacctggcggcagcgcaaaagatg

SEQ ID NO: 86807 - DNA, 103 bp, Artificial Sequence
  Synthetic Polynucleotide
taatacgactcactatagggggtaagcgcccgcagctgctcccgagggtcaacagaggagagaccctatggagcagctgaacctggcggcagcgcaaaagatg

SEQ ID NO: 86808 - DNA, 103 bp, Artificial Sequence
  Synthetic Polynucleotide
taatacgactcactatagggccaccacttcccggttgactctacggggacaacagaggagagtccccatggagtcaaccaacctggcggcagcgcaaaagatg

SEQ ID NO: 86809 - DNA, 103 bp, Artificial Sequence
  Synthetic Polynucleotide
taatacgactcactataggggctggccttcaggcaccccatctcggtagaaacagaggagatctaccatgatggggtgcaacctggcggcagcgcaaaagatg

SEQ ID NO: 86810 - DNA, 103 bp, Artificial Sequence
  Synthetic Polynucleotide
taatacgactcactatagggatctggggtagctggccttcaggcaccccaaacagaggagatggggtatgtgaaggccaaacctggcggcagcgcaaaagatg

SEQ ID NO: 86811 - DNA, 103 bp, Artificial Sequence
  Synthetic Polynucleotide
taatacgactcactatagggatagtggagtatctggggtagctggccttcaacagaggagagaaggcatgctaccccagaacctggcggcagcgcaaaagatg

SEQ ID NO: 86812 - DNA, 103 bp, Artificial Sequence
  Synthetic Polynucleotide
taatacgactcactatagggccagtagctcatagtggagtatctggggtaaacagaggagataccccatgtactccactaacctggcggcagcgcaaaagatg

SEQ ID NO: 86813 - DNA, 103 bp, Artificial Sequence
  Synthetic Polynucleotide
taatacgactcactatagggtcacgaatggccagtagctcatagtggagtaacagaggagaactccaatgtgagctactaacctggcggcagcgcaaaagatg

SEQ ID NO: 86814 - DNA, 103 bp, Artificial Sequence
  Synthetic Polynucleotide
taatacgactcactataggggatgcaggcatcacgaatggccagtagctcaacagaggagagagctaatggccattcgtaacctggcggcagcgcaaaagatg

SEQ ID NO: 86815 - DNA, 103 bp, Artificial Sequence
  Synthetic Polynucleotide
taatacgactcactatagggtttccagtttgatgcaggcatcacgaatggaacagaggagaccattcatgatgcctgcaaacctggcggcagcgcaaaagatg

SEQ ID NO: 86816 - DNA, 103 bp, Artificial Sequence
  Synthetic Polynucleotide
taatacgactcactatagggtggtagtccttttccagtttgatgcaggcaaacagaggagatgcctgatgcaaactggaaacctggcggcagcgcaaaagatg

SEQ ID NO: 86817 - DNA, 103 bp, Artificial Sequence
  Synthetic Polynucleotide
taatacgactcactataggggatcccaggctggtagtccttttccagtttaacagaggagaaaactgatgaaggactacaacctggcggcagcgcaaaagatg

SEQ ID NO: 86818 - DNA, 103 bp, Artificial Sequence
  Synthetic Polynucleotide
taatacgactcactatagggcaatataagtgatcccaggctggtagtcctaacagaggagaaggactatgagcctgggaaacctggcggcagcgcaaaagatg

SEQ ID NO: 86819 - DNA, 103 bp, Artificial Sequence
  Synthetic Polynucleotide
taatacgactcactatagggaccatgtattccaccacttcccggttgactaacagaggagaagtcaaatgggaagtggtaacctggcggcagcgcaaaagatg

SEQ ID NO: 86820 - DNA, 103 bp, Artificial Sequence
  Synthetic Polynucleotide
taatacgactcactatagggttctgcaccacaatataagtgatcccaggcaacagaggagagcctggatgcacttatataacctggcggcagcgcaaaagatg

SEQ ID NO: 86821 - DNA, 103 bp, Artificial Sequence
  Synthetic Polynucleotide
taatacgactcactataggggtgatggcgtttctgcaccacaatataagtaacagaggagaacttatatggtggtgcagaacctggcggcagcgcaaaagatg

SEQ ID NO: 86822 - DNA, 103 bp, Artificial Sequence
  Synthetic Polynucleotide
taatacgactcactatagggaaaggcgggtgtgatggcgtttctgcaccaaacagaggagatggtgcatgaacgccatcaacctggcggcagcgcaaaagatg

SEQ ID NO: 86823 - DNA, 103 bp, Artificial Sequence
  Synthetic Polynucleotide
taatacgactcactatagggtcagcacagaaaaggcgggtgtgatggcgtaacagaggagaacgccaatgcacccgcctaacctggcggcagcgcaaaagatg

SEQ ID NO: 86824 - DNA, 103 bp, Artificial Sequence
  Synthetic Polynucleotide
taatacgactcactatagggctcattcttgtcagcacagaaaaggcgggtaacagaggagaacccgcatgttctgtgctaacctggcggcagcgcaaaagatg

SEQ ID NO: 86825 - DNA, 103 bp, Artificial Sequence
  Synthetic Polynucleotide
taatacgactcactatagggtcccaattcgctcattcttgtcagcacagaaacagaggagatctgtgatgacaagaatgaacctggcggcagcgcaaaagatg

SEQ ID NO: 86826 - DNA, 103 bp, Artificial Sequence
  Synthetic Polynucleotide
taatacgactcactatagggttaccactcttcccaattcgctcattcttgaacagaggagacaagaaatggcgaattggaacctggcggcagcgcaaaagatg

SEQ ID NO: 86827 - DNA, 103 bp, Artificial Sequence
  Synthetic Polynucleotide
taatacgactcactatagggagctgggatgttaccactcttcccaattcgaacagaggagacgaattatgaagagtggtaacctggcggcagcgcaaaagatg

SEQ ID NO: 86828 - DNA, 103 bp, Artificial Sequence
  Synthetic Polynucleotide
taatacgactcactatagggctgtggtcccagctgggatgttaccactctaacagaggagaagagtgatgacatcccagaacctggcggcagcgcaaaagatg

SEQ ID NO: 86829 - DNA, 103 bp, Artificial Sequence
  Synthetic Polynucleotide
taatacgactcactatagggttggtgtccactgtggtcccagctgggatgaacagaggagacatcccatgtgggaccacaacctggcggcagcgcaaaagatg

SEQ ID NO: 86830 - DNA, 103 bp, Artificial Sequence
  Synthetic Polynucleotide
taatacgactcactataggggaaatgctggaccatgtattccaccacttcaacagaggagagaagtgatggaatacatgaacctggcggcagcgcaaaagatg

SEQ ID NO: 86831 - DNA, 103 bp, Artificial Sequence
  Synthetic Polynucleotide
taatacgactcactataggggtgggtgatgttggtgtccactgtggtcccaacagaggagagggaccatggtggacaccaacctggcggcagcgcaaaagatg

SEQ ID NO: 86832 - DNA, 103 bp, Artificial Sequence
  Synthetic Polynucleotide
taatacgactcactatagggactcaaatgggtgggtgatgttggtgtccaaacagaggagatggacaatgacatcacccaacctggcggcagcgcaaaagatg

SEQ ID NO: 86833 - DNA, 103 bp, Artificial Sequence
  Synthetic Polynucleotide
taatacgactcactatagggtagaagtcaaactcaaatgggtgggtgatgaacagaggagacatcacatgcccatttgaaacctggcggcagcgcaaaagatg

SEQ ID NO: 86834 - DNA, 103 bp, Artificial Sequence
  Synthetic Polynucleotide
taatacgactcactataggggctgcacagatagaagtcaaactcaaatggaacagaggagaccatttatgtttgacttcaacctggcggcagcgcaaaagatg

SEQ ID NO: 86835 - DNA, 103 bp, Artificial Sequence
  Synthetic Polynucleotide
taatacgactcactatagggtgcctgcgtggctgcacagatagaagtcaaaacagaggagattgactatgatctgtgcaaacctggcggcagcgcaaaagatg

SEQ ID NO: 86836 - DNA, 103 bp, Artificial Sequence
  Synthetic Polynucleotide
taatacgactcactataggggtgccctggatgcctgcgtggctgcacagaaacagaggagatctgtgatgccacgcaggaacctggcggcagcgcaaaagatg

SEQ ID NO: 86837 - DNA, 103 bp, Artificial Sequence
  Synthetic Polynucleotide
taatacgactcactatagggtggtcggctggtgccctggatgcctgcgtgaacagaggagacacgcaatgatccagggcaacctggcggcagcgcaaaagatg

SEQ ID NO: 86838 - DNA, 103 bp, Artificial Sequence
  Synthetic Polynucleotide
taatacgactcactatagggagtaatgggatggtcggctggtgccctggaaacagaggagatccaggatgccagccgacaacctggcggcagcgcaaaagatg

SEQ ID NO: 86839 - DNA, 103 bp, Artificial Sequence
  Synthetic Polynucleotide
taatacgactcactatagggcaaagaacatagtaatgggatggtcggctgaacagaggagacagccgatgatcccattaaacctggcggcagcgcaaaagatg

SEQ ID NO: 86840 - DNA, 103 bp, Artificial Sequence
  Synthetic Polynucleotide
taatacgactcactataggggttgtcatcccaaagaacatagtaatgggaaacagaggagatcccatatgtatgttcttaacctggcggcagcgcaaaagatg

SEQ ID NO: 86841 - DNA, 103 bp, Artificial Sequence
  Synthetic Polynucleotide
taatacgactcactatagggtctgaggcttgaaatgctggaccatgtattaacagaggagaaatacaatgtccagcattaacctggcggcagcgcaaaagatg

SEQ ID NO: 86842 - DNA, 103 bp, Artificial Sequence
  Synthetic Polynucleotide
taatacgactcactatagggctgtgaaacggttgtcatcccaaagaacataacagaggagaatgttcatggggatgacaaacctggcggcagcgcaaaagatg

SEQ ID NO: 86843 - DNA, 103 bp, Artificial Sequence
  Synthetic Polynucleotide
taatacgactcactatagggagctcatctgctgtgaaacggttgtcatccaacagaggagaggatgaatgccgtttcacaacctggcggcagcgcaaaagatg

SEQ ID NO: 86844 - DNA, 103 bp, Artificial Sequence
  Synthetic Polynucleotide
taatacgactcactatagggcaggatctggagctcatctgctgtgaaacgaacagaggagacgtttcatggcagatgagaacctggcggcagcgcaaaagatg

SEQ ID NO: 86845 - DNA, 103 bp, Artificial Sequence
  Synthetic Polynucleotide
taatacgactcactataggggctggtacgtcaggatctggagctcatctgaacagaggagacagatgatgtccagatccaacctggcggcagcgcaaaagatg

SEQ ID NO: 86846 - DNA, 103 bp, Artificial Sequence
  Synthetic Polynucleotide
taatacgactcactataggggtgtggcacagctggtacgtcaggatctggaacagaggagaccagatatggacgtaccaaacctggcggcagcgcaaaagatg

SEQ ID NO: 86847 - DNA, 103 bp, Artificial Sequence
  Synthetic Polynucleotide
taatacgactcactatagggtcgtacgtaagtgtggcacagctggtacgtaacagaggagaacgtacatgctgtgccacaacctggcggcagcgcaaaagatg

SEQ ID NO: 86848 - DNA, 103 bp, Artificial Sequence
  Synthetic Polynucleotide
taatacgactcactatagggagcgtgtgcatcgtacgtaagtgtggcacaaacagaggagatgtgccatgcttacgtacaacctggcggcagcgcaaaagatg

SEQ ID NO: 86849 - DNA, 103 bp, Artificial Sequence
  Synthetic Polynucleotide
taatacgactcactatagggatagagacagagcgtgtgcatcgtacgtaaaacagaggagattacgtatgatgcacacgaacctggcggcagcgcaaaagatg

SEQ ID NO: 86850 - DNA, 103 bp, Artificial Sequence
  Synthetic Polynucleotide
taatacgactcactatagggaggtgctgggatagagacagagcgtgtgcaaacagaggagatgcacaatgtctgtctctaacctggcggcagcgcaaaagatg

SEQ ID NO: 86851 - DNA, 103 bp, Artificial Sequence
  Synthetic Polynucleotide
taatacgactcactatagggcatagtaggcaggtgctgggatagagacagaacagaggagactgtctatgtcccagcacaacctggcggcagcgcaaaagatg

SEQ ID NO: 86852 - DNA, 103 bp, Artificial Sequence
  Synthetic Polynucleotide
taatacgactcactatagggtcaccaaagatctgaggcttgaaatgctggaacagaggagaccagcaatgcaagcctcaaacctggcggcagcgcaaaagatg

SEQ ID NO: 86853 - DNA, 103 bp, Artificial Sequence
  Synthetic Polynucleotide
taatacgactcactatagggaccaggcgggcatagtaggcaggtgctgggaacagaggagacccagcatgtgcctactaaacctggcggcagcgcaaaagatg

SEQ ID NO: 86854 - DNA, 103 bp, Artificial Sequence
  Synthetic Polynucleotide
taatacgactcactatagggccggaaagccaccaggcgggcatagtaggcaacagaggagagcctacatggcccgcctgaacctggcggcagcgcaaaagatg

SEQ ID NO: 86855 - DNA, 103 bp, Artificial Sequence
  Synthetic Polynucleotide
taatacgactcactatagggggtatcgtgcccggaaagccaccaggcgggaacagaggagacccgccatgtggctttccaacctggcggcagcgcaaaagatg

SEQ ID NO: 86856 - DNA, 103 bp, Artificial Sequence
  Synthetic Polynucleotide
taatacgactcactatagggtccaccaggtggtatcgtgcccggaaagccaacagaggagaggctttatgggcacgataaacctggcggcagcgcaaaagatg

SEQ ID NO: 86857 - DNA, 103 bp, Artificial Sequence
  Synthetic Polynucleotide
taatacgactcactatagggatgctccttgtccaccaggtggtatcgtgcaacagaggagagcacgaatgcacctggtgaacctggcggcagcgcaaaagatg

SEQ ID NO: 86858 - DNA, 103 bp, Artificial Sequence
  Synthetic Polynucleotide
taatacgactcactatagggctccactgtcatgctccttgtccaccaggtaacagaggagaacctggatgacaaggagcaacctggcggcagcgcaaaagatg

SEQ ID NO: 86859 - DNA, 103 bp, Artificial Sequence
  Synthetic Polynucleotide
taatacgactcactatagggtggctcccctctccactgtcatgctccttgaacagaggagacaaggaatgtgacagtggaacctggcggcagcgcaaaagatg

SEQ ID NO: 86860 - DNA, 103 bp, Artificial Sequence
  Synthetic Polynucleotide
taatacgactcactatagggccccgatatgtggctcccctctccactgtcaacagaggagagacagtatggaggggagcaacctggcggcagcgcaaaagatg

SEQ ID NO: 86861 - DNA, 103 bp, Artificial Sequence
  Synthetic Polynucleotide
taatacgactcactatagggcattgctctgccccgatatgtggctcccctaacagaggagaaggggaatgacatatcggaacctggcggcagcgcaaaagatg

SEQ ID NO: 86862 - DNA, 103 bp, Artificial Sequence
  Synthetic Polynucleotide
taatacgactcactataggggggtcccgcccattgctctgccccgatatgaacagaggagacatatcatggcagagcaaaacctggcggcagcgcaaaagatg

SEQ ID NO: 86863 - DNA, 103 bp, Artificial Sequence
  Synthetic Polynucleotide
taatacgactcactatagggaggcttgcgatcaccaaagatctgaggcttaacagaggagaaagcctatgatctttggtaacctggcggcagcgcaaaagatg

SEQ ID NO: 86864 - DNA, 103 bp, Artificial Sequence
  Synthetic Polynucleotide
taatacgactcactatagggcagggcctgggggtcccgcccattgctctgaacagaggagacagagcatggggcgggacaacctggcggcagcgcaaaagatg

SEQ ID NO: 86865 - DNA, 103 bp, Artificial Sequence
  Synthetic Polynucleotide
taatacgactcactatagggcggctttggccagggcctgggggtcccgccaacagaggagaggcgggatgcccaggcccaacctggcggcagcgcaaaagatg

SEQ ID NO: 86866 - DNA, 103 bp, Artificial Sequence
  Synthetic Polynucleotide
taatacgactcactatagggtgaacctgcacggctttggccagggcctggaacagaggagaccaggcatgggccaaagcaacctggcggcagcgcaaaagatg

SEQ ID NO: 86867 - DNA, 103 bp, Artificial Sequence
  Synthetic Polynucleotide
taatacgactcactatagggagtatcctggtgaacctgcacggctttggcaacagaggagagccaaaatggtgcaggttaacctggcggcagcgcaaaagatg

SEQ ID NO: 86868 - DNA, 103 bp, Artificial Sequence
  Synthetic Polynucleotide
taatacgactcactatagggtggtgcgcagagtatcctggtgaacctgcaaacagaggagatgcaggatgaccaggataaacctggcggcagcgcaaaagatg

SEQ ID NO: 86869 - DNA, 103 bp, Artificial Sequence
  Synthetic Polynucleotide
taatacgactcactataggggcgaagtacatggtgcgcagagtatcctggaacagaggagaccaggaatgtctgcgcacaacctggcggcagcgcaaaagatg

SEQ ID NO: 86870 - DNA, 103 bp, Artificial Sequence
  Synthetic Polynucleotide
taatacgactcactatagggcatcatacacaggcttgcgatcaccaaagaaacagaggagatctttgatgatcgcaagcaacctggcggcagcgcaaaagatg

SEQ ID NO: 86871 - DNA, 103 bp, Artificial Sequence
  Synthetic Polynucleotide
taatacgactcactatagggttcttctttccatcatacacaggcttgcgaaacagaggagatcgcaaatgtgtgtatgaaacctggcggcagcgcaaaagatg

SEQ ID NO: 86872 - DNA, 103 bp, Artificial Sequence
  Synthetic Polynucleotide
taatacgactcactatagggagtgtaaatgttcttctttccatcatacacaacagaggagagtgtatatgggaaagaagaacctggcggcagcgcaaaagatg

SEQ ID NO: 86873 - DNA, 103 bp, Artificial Sequence
  Synthetic Polynucleotide
taatacgactcactataggggtgctgtgacagtgtaaatgttcttctttcaacagaggagagaaagaatgacatttacaaacctggcggcagcgcaaaagatg

SEQ ID NO: 86874 - DNA, 103 bp, Artificial Sequence
  Synthetic Polynucleotide
taatacgactcactatagggagggggggcaggtaagcgcccgcagctgctaacagaggagaagcagcatggggcgcttaaacctggcggcagcgcaaaagatg

SEQ ID NO: 86875 - DNA, 103 bp, Artificial Sequence
  Synthetic Polynucleotide
taatacgactcactatagggccaatgggcagtgctgtgacagtgtaaatgaacagaggagacatttaatgtgtcacagcaacctggcggcagcgcaaaagatg

SEQ ID NO: 86876 - DNA, 103 bp, Artificial Sequence
  Synthetic Polynucleotide
taatacgactcactatagggccgttcgttgccaatgggcagtgctgtgacaacagaggagagtcacaatgctgcccattaacctggcggcagcgcaaaagatg

SEQ ID NO: 86877 - DNA, 103 bp, Artificial Sequence
  Synthetic Polynucleotide
taatacgactcactatagggcaaagtcgacccgttcgttgccaatgggcaaacagaggagatgcccaatggcaacgaacaacctggcggcagcgcaaaagatg

SEQ ID NO: 86878 - DNA, 103 bp, Artificial Sequence
  Synthetic Polynucleotide
taatacgactcactatagggattgtcacctcaaagtcgacccgttcgttgaacagaggagacaacgaatgggtcgacttaacctggcggcagcgcaaaagatg

SEQ ID NO: 86879 - DNA, 103 bp, Artificial Sequence
  Synthetic Polynucleotide
taatacgactcactatagggttccccagggattgtcacctcaaagtcgacaacagaggagagtcgacatggaggtgacaaacctggcggcagcgcaaaagatg

SEQ ID NO: 86880 - DNA, 103 bp, Artificial Sequence
  Synthetic Polynucleotide
taatacgactcactataggggatccttcccttccccagggattgtcacctaacagaggagaaggtgaatgtccctggggaacctggcggcagcgcaaaagatg

SEQ ID NO: 86881 - DNA, 103 bp, Artificial Sequence
  Synthetic Polynucleotide
taatacgactcactatagggttaaagattcgatccttcccttccccagggaacagaggagaccctggatgagggaaggaaacctggcggcagcgcaaaagatg

SEQ ID NO: 86882 - DNA, 103 bp, Artificial Sequence
  Synthetic Polynucleotide
taatacgactcactataggggatggagaccttaaagattcgatccttcccaacagaggagagggaagatgcgaatctttaacctggcggcagcgcaaaagatg

SEQ ID NO: 86883 - DNA, 103 bp, Artificial Sequence
  Synthetic Polynucleotide
taatacgactcactatagggctagccacttgatggagaccttaaagattcaacagaggagagaatctatgaggtctccaaacctggcggcagcgcaaaagatg

SEQ ID NO: 86884 - DNA, 103 bp, Artificial Sequence
  Synthetic Polynucleotide
taatacgactcactatagggctcacaatggctagccacttgatggagaccaacagaggagaggtctcatgcaagtggctaacctggcggcagcgcaaaagatg

SEQ ID NO: 86885 - DNA, 103 bp, Artificial Sequence
  Synthetic Polynucleotide
taatacgactcactatagggcacctgctgcagggggggcaggtaagcgccaacagaggagaggcgctatgctgccccccaacctggcggcagcgcaaaagatg

SEQ ID NO: 86886 - DNA, 103 bp, Artificial Sequence
  Synthetic Polynucleotide
taatacgactcactatagggcattcgccagctcacaatggctagccacttaacagaggagaaagtggatggccattgtgaacctggcggcagcgcaaaagatg

SEQ ID NO: 86887 - DNA, 103 bp, Artificial Sequence
  Synthetic Polynucleotide
taatacgactcactatagggcctcatgcagcattcgccagctcacaatggaacagaggagaccattgatggctggcgaaaacctggcggcagcgcaaaagatg

SEQ ID NO: 86888 - DNA, 103 bp, Artificial Sequence
  Synthetic Polynucleotide
taatacgactcactatagggctgaccagggcctcatgcagcattcgccagaacagaggagactggcgatggctgcatgaaacctggcggcagcgcaaaagatg

SEQ ID NO: 86889 - DNA, 103 bp, Artificial Sequence
  Synthetic Polynucleotide
taatacgactcactataggggatctggccgctgaccagggcctcatgcagaacagaggagactgcatatggccctggtcaacctggcggcagcgcaaaagatg

SEQ ID NO: 86890 - DNA, 103 bp, Artificial Sequence
  Synthetic Polynucleotide
taatacgactcactatagggagggaacagggatctggccgctgaccagggaacagaggagaccctggatggcggccagaaacctggcggcagcgcaaaagatg

SEQ ID NO: 86891 - DNA, 103 bp, Artificial Sequence
  Synthetic Polynucleotide
taatacgactcactatagggacagactccaagggaacagggatctggccgaacagaggagacggccaatgccctgttccaacctggcggcagcgcaaaagatg

SEQ ID NO: 86892 - DNA, 103 bp, Artificial Sequence
  Synthetic Polynucleotide
taatacgactcactatagggcagggcttgcacagactccaagggaacaggaacagaggagacctgttatgttggagtctaacctggcggcagcgcaaaagatg

SEQ ID NO: 86893 - DNA, 103 bp, Artificial Sequence
  Synthetic Polynucleotide
taatacgactcactatagggtggccacatccagggcttgcacagactccaaacagaggagatggagtatgtgcaagcccaacctggcggcagcgcaaaagatg

SEQ ID NO: 86894 - DNA, 103 bp, Artificial Sequence
  Synthetic Polynucleotide
taatacgactcactatagggaggtgcctcatggccacatccagggcttgcaacagaggagagcaagcatgggatgtggcaacctggcggcagcgcaaaagatg

SEQ ID NO: 86895 - DNA, 103 bp, Artificial Sequence
  Synthetic Polynucleotide
taatacgactcactatagggcatggatgccaggtgcctcatggccacatcaacagaggagagatgtgatgatgaggcacaacctggcggcagcgcaaaagatg

SEQ ID NO: 86896 - DNA, 103 bp, Artificial Sequence
  Synthetic Polynucleotide
taatacgactcactataggggtgcctggaacacctgctgcagggggggcaaacagaggagatgccccatgtgcagcaggaacctggcggcagcgcaaaagatg

SEQ ID NO: 86897 - DNA, 103 bp, Artificial Sequence
  Synthetic Polynucleotide
taatacgactcactataggggggtgtacctcatggatgccaggtgcctcaaacagaggagatgaggcatgtggcatccaaacctggcggcagcgcaaaagatg

SEQ ID NO: 86898 - DNA, 103 bp, Artificial Sequence
  Synthetic Polynucleotide
taatacgactcactatagggcggcccacaggggtgtacctcatggatgccaacagaggagaggcatcatggaggtacacaacctggcggcagcgcaaaagatg

SEQ ID NO: 86899 - DNA, 103 bp, Artificial Sequence
  Synthetic Polynucleotide
taatacgactcactataggggaagaaggagcggcccacaggggtgtacctaacagaggagaaggtacatgcctgtgggcaacctggcggcagcgcaaaagatg

SEQ ID NO: 86900 - DNA, 103 bp, Artificial Sequence
  Synthetic Polynucleotide
taatacgactcactatagggcaggcggtgagaagaaggagcggcccacagaacagaggagactgtggatggctccttctaacctggcggcagcgcaaaagatg

SEQ ID NO: 86901 - DNA, 103 bp, Artificial Sequence
  Synthetic Polynucleotide
taatacgactcactatagggtagtagccctcaggcggtgagaagaaggagaacagaggagactccttatgctcaccgccaacctggcggcagcgcaaaagatg

SEQ ID NO: 86902 - DNA, 103 bp, Artificial Sequence
  Synthetic Polynucleotide
taatacgactcactatagggcagcgggtggtagtagccctcaggcggtgaaacagaggagatcaccgatggagggctacaacctggcggcagcgcaaaagatg

SEQ ID NO: 86903 - DNA, 103 bp, Artificial Sequence
  Synthetic Polynucleotide
taatacgactcactataggggcccaccccccagcgggtggtagtagccctaacagaggagaagggctatgaccacccgcaacctggcggcagcgcaaaagatg

SEQ ID NO: 86904 - DNA, 103 bp, Artificial Sequence
  Synthetic Polynucleotide
taatacgactcactatagggcagacctcgcgcccaccccccagcgggtggaacagaggagaccacccatgggggggtggaacctggcggcagcgcaaaagatg

SEQ ID NO: 86905 - DNA, 103 bp, Artificial Sequence
  Synthetic Polynucleotide
taatacgactcactatagggaaagccgaaccagacctcgcgcccacccccaacagaggagagggggtatgcgcgaggtcaacctggcggcagcgcaaaagatg

SEQ ID NO: 86906 - DNA, 103 bp, Artificial Sequence
  Synthetic Polynucleotide
taatacgactcactatagggcagactggtgaaagccgaaccagacctcgcaacagaggagagcgaggatgggttcggctaacctggcggcagcgcaaaagatg

SEQ ID NO: 86907 - DNA, 103 bp, Artificial Sequence
  Synthetic Polynucleotide
taatacgactcactatagggggccggcgaggtgcctggaacacctgctgcaacagaggagagcagcaatggttccaggcaacctggcggcagcgcaaaagatg

SEQ ID NO: 86908 - DNA, 103 bp, Artificial Sequence
  Synthetic Polynucleotide
taatacgactcactataggggcagggcgcacagactggtgaaagccgaacaacagaggagagttcggatgtcaccagtcaacctggcggcagcgcaaaagatg

SEQ ID NO: 86909 - DNA, 103 bp, Artificial Sequence
  Synthetic Polynucleotide
taatacgactcactatagggcttccacatggcagggcgcacagactggtgaacagaggagacaccagatggtgcgccctaacctggcggcagcgcaaaagatg

SEQ ID NO: 86910 - DNA, 103 bp, Artificial Sequence
  Synthetic Polynucleotide
taatacgactcactatagggtgagcatcatcttccacatggcagggcgcaaacagaggagatgcgccatgccatgtggaaacctggcggcagcgcaaaagatg

SEQ ID NO: 86911 - DNA, 103 bp, Artificial Sequence
  Synthetic Polynucleotide
taatacgactcactatagggacatcaatgttgagcatcatcttccacatgaacagaggagacatgtgatggatgatgctaacctggcggcagcgcaaaagatg

SEQ ID NO: 86912 - DNA, 103 bp, Artificial Sequence
  Synthetic Polynucleotide
taatacgactcactatagggagtggctgagacatcaatgttgagcatcataacagaggagaatgatgatgaacattgataacctggcggcagcgcaaaagatg

SEQ ID NO: 86913 - DNA, 103 bp, Artificial Sequence
  Synthetic Polynucleotide
taatacgactcactatagggtataaaaggcagtggctgagacatcaatgtaacagaggagaacattgatgtctcagccaaacctggcggcagcgcaaaagatg

SEQ ID NO: 86914 - DNA, 103 bp, Artificial Sequence
  Synthetic Polynucleotide
taatacgactcactatagggggctgtgccttataaaaggcagtggctgagaacagaggagactcagcatgtgccttttaaacctggcggcagcgcaaaagatg

SEQ ID NO: 86915 - DNA, 103 bp, Artificial Sequence
  Synthetic Polynucleotide
taatacgactcactatagggctcaatcactggctgtgccttataaaaggcaacagaggagagcctttatgaaggcacagaacctggcggcagcgcaaaagatg

SEQ ID NO: 86916 - DNA, 103 bp, Artificial Sequence
  Synthetic Polynucleotide
taatacgactcactatagggcacacatgaactcaatcactggctgtgcctaacagaggagaaggcacatgcagtgattgaacctggcggcagcgcaaaagatg

SEQ ID NO: 86917 - DNA, 103 bp, Artificial Sequence
  Synthetic Polynucleotide
taatacgactcactatagggtccagcacctcacacatgaactcaatcactaacagaggagaagtgatatggttcatgtgaacctggcggcagcgcaaaagatg

SEQ ID NO: 86918 - DNA, 103 bp, Artificial Sequence
  Synthetic Polynucleotide
taatacgactcactataggggccaatgccaggccggcgaggtgcctggaaaacagaggagattccagatgcctcgccggaacctggcggcagcgcaaaagatg

SEQ ID NO: 86919 - DNA, 103 bp, Artificial Sequence
  Synthetic Polynucleotide
taatacgactcactataggggttcctgatgtccagcacctcacacatgaaaacagaggagattcatgatggaggtgctgaacctggcggcagcgcaaaagatg

SEQ ID NO: 86920 - DNA, 103 bp, Artificial Sequence
  Synthetic Polynucleotide
taatacgactcactataggggctcatctatgttcctgatgtccagcacctaacagaggagaaggtgcatgacatcaggaaacctggcggcagcgcaaaagatg

SEQ ID NO: 86921 - DNA, 103 bp, Artificial Sequence
  Synthetic Polynucleotide
taatacgactcactatagggggcttgggctgctcatctatgttcctgatgaacagaggagacatcagatgcatagatgaaacctggcggcagcgcaaaagatg

SEQ ID NO: 86922 - DNA, 103 bp, Artificial Sequence
  Synthetic Polynucleotide
taatacgactcactataggggtccgtgaggggcttgggctgctcatctataacagaggagaatagatatgcagcccaagaacctggcggcagcgcaaaagatg

SEQ ID NO: 86923 - DNA, 103 bp, Artificial Sequence
  Synthetic Polynucleotide
taatacgactcactatagggcgcgctgagagtccgtgaggggcttgggctaacagaggagaagcccaatgccctcacggaacctggcggcagcgcaaaagatg

SEQ ID NO: 86924 - DNA, 103 bp, Artificial Sequence
  Synthetic Polynucleotide
taatacgactcactataggggtgaagcgaacgcgctgagagtccgtgaggaacagaggagacctcacatgctctcagcgaacctggcggcagcgcaaaagatg

SEQ ID NO: 86925 - DNA, 103 bp, Artificial Sequence
  Synthetic Polynucleotide
taatacgactcactataggggatctccttggtgaagcgaacgcgctgagaaacagaggagatctcagatggttcgcttcaacctggcggcagcgcaaaagatg

SEQ ID NO: 86926 - DNA, 103 bp, Artificial Sequence
  Synthetic Polynucleotide
taatacgactcactatagggtcaggcccttgatctccttggtgaagcgaaaacagaggagattcgctatgccaaggagaaacctggcggcagcgcaaaagatg

SEQ ID NO: 86927 - DNA, 103 bp, Artificial Sequence
  Synthetic Polynucleotide
taatacgactcactatagggacttccaccttcaggcccttgatctccttgaacagaggagacaaggaatgcaagggcctaacctggcggcagcgcaaaagatg

SEQ ID NO: 86928 - DNA, 103 bp, Artificial Sequence
  Synthetic Polynucleotide
taatacgactcactatagggacagtgggtgacttccaccttcaggcccttaacagaggagaaagggcatgaaggtggaaaacctggcggcagcgcaaaagatg

SEQ ID NO: 86929 - DNA, 103 bp, Artificial Sequence
  Synthetic Polynucleotide
taatacgactcactatagggtccccacagtgccaatgccaggccggcgagaacagaggagactcgccatgctggcattgaacctggcggcagcgcaaaagatg

SEQ ID NO: 86930 - DNA, 103 bp, Artificial Sequence
  Synthetic Polynucleotide
taatacgactcactatagggtcatctgtccacagtgggtgacttccacctaacagaggagaaggtggatgtcacccactaacctggcggcagcgcaaaagatg

SEQ ID NO: 86931 - DNA, 103 bp, Artificial Sequence
  Synthetic Polynucleotide
taatacgactcactatagggtacttcctcttcatctgtccacagtgggtgaacagaggagacacccaatgtggacagataacctggcggcagcgcaaaagatg

SEQ ID NO: 86932 - DNA, 103 bp, Artificial Sequence
  Synthetic Polynucleotide
taatacgactcactatagggacacacgcggtacttcctcttcatctgtccaacagaggagaggacagatgaagaggaagaacctggcggcagcgcaaaagatg

SEQ ID NO: 86933 - DNA, 103 bp, Artificial Sequence
  Synthetic Polynucleotide
taatacgactcactataggggggtaacattacacacgcggtacttcctctaacagaggagaagaggaatgaccgcgtgtaacctggcggcagcgcaaaagatg

SEQ ID NO: 86934 - DNA, 103 bp, Artificial Sequence
  Synthetic Polynucleotide
taatacgactcactataggggcagggcgacgggtaacattacacacgcggaacagaggagaccgcgtatgtaatgttacaacctggcggcagcgcaaaagatg

SEQ ID NO: 86935 - DNA, 103 bp, Artificial Sequence
  Synthetic Polynucleotide
taatacgactcactatagggctgatggctagcagggcgacgggtaacattaacagaggagaaatgttatgcgtcgccctaacctggcggcagcgcaaaagatg

SEQ ID NO: 86936 - DNA, 103 bp, Artificial Sequence
  Synthetic Polynucleotide
taatacgactcactatagggaggggaatgtctgatggctagcagggcgacaacagaggagagtcgccatgctagccatcaacctggcggcagcgcaaaagatg

SEQ ID NO: 86937 - DNA, 103 bp, Artificial Sequence
  Synthetic Polynucleotide
taatacgactcactatagggtccagctgtaaggggaatgtctgatggctaaacagaggagatagccaatggacattcccaacctggcggcagcgcaaaagatg

SEQ ID NO: 86938 - DNA, 103 bp, Artificial Sequence
  Synthetic Polynucleotide
taatacgactcactatagggctgtccactctccagctgtaaggggaatgtaacagaggagaacattcatgttacagctgaacctggcggcagcgcaaaagatg

SEQ ID NO: 86939 - DNA, 103 bp, Artificial Sequence
  Synthetic Polynucleotide
taatacgactcactatagggactccacagtctgtccactctccagctgtaaacagaggagatacagcatgagagtggacaacctggcggcagcgcaaaagatg

SEQ ID NO: 86940 - DNA, 103 bp, Artificial Sequence
  Synthetic Polynucleotide
taatacgactcactatagggttgattggtttccccacagtgccaatgccaaacagaggagatggcatatgcactgtgggaacctggcggcagcgcaaaagatg

SEQ ID NO: 86941 - DNA, 103 bp, Artificial Sequence
  Synthetic Polynucleotide
taatacgactcactataggggccactgtgcactccacagtctgtccactcaacagaggagagagtggatggactgtggaaacctggcggcagcgcaaaagatg

SEQ ID NO: 86942 - DNA, 103 bp, Artificial Sequence
  Synthetic Polynucleotide
taatacgactcactataggggaaatactgtgccactgtgcactccacagtaacagaggagaactgtgatgtgcacagtgaacctggcggcagcgcaaaagatg

SEQ ID NO: 86943 - DNA, 103 bp, Artificial Sequence
  Synthetic Polynucleotide
taatacgactcactatagggatttctgcttgaaatactgtgccactgtgcaacagaggagagcacagatgcacagtattaacctggcggcagcgcaaaagatg

SEQ ID NO: 86944 - DNA, 103 bp, Artificial Sequence
  Synthetic Polynucleotide
taatacgactcactatagggtgaaggttatatttctgcttgaaatactgtaacagaggagaacagtaatgcaagcagaaaacctggcggcagcgcaaaagatg

SEQ ID NO: 86945 - DNA, 103 bp, Artificial Sequence
  Synthetic Polynucleotide
taatacgactcactatagggatacttgagctgaaggttatatttctgcttaacagaggagaaagcagatgtataaccttaacctggcggcagcgcaaaagatg

SEQ ID NO: 86946 - DNA, 103 bp, Artificial Sequence
  Synthetic Polynucleotide
taatacgactcactataggggcagatggggatacttgagctgaaggttataacagaggagaataaccatgagctcaagtaacctggcggcagcgcaaaagatg

SEQ ID NO: 86947 - DNA, 103 bp, Artificial Sequence
  Synthetic Polynucleotide
taatacgactcactatagggtgtaggcagggcagatggggatacttgagcaacagaggagagctcaaatgtccccatctaacctggcggcagcgcaaaagatg

SEQ ID NO: 86948 - DNA, 103 bp, Artificial Sequence
  Synthetic Polynucleotide
taatacgactcactatagggctggccaacttgtaggcagggcagatggggaacagaggagaccccatatgccctgcctaaacctggcggcagcgcaaaagatg

SEQ ID NO: 86949 - DNA, 103 bp, Artificial Sequence
  Synthetic Polynucleotide
taatacgactcactataggggcttttgttcctggccaacttgtaggcaggaacagaggagacctgccatgaagttggccaacctggcggcagcgcaaaagatg

SEQ ID NO: 86950 - DNA, 103 bp, Artificial Sequence
  Synthetic Polynucleotide
taatacgactcactatagggaggtaggtatgcttttgttcctggccaactaacagaggagaagttggatgggaacaaaaaacctggcggcagcgcaaaagatg

SEQ ID NO: 86951 - DNA, 103 bp, Artificial Sequence
  Synthetic Polynucleotide
taatacgactcactatagggtgcaagtgcggggccggctcccgagtacataacagaggagaatgtacatgggagccggcaacctggcggcagcgcaaaagatg

SEQ ID NO: 86952 - DNA, 103 bp, Artificial Sequence
  Synthetic Polynucleotide
taatacgactcactatagggtaatttgattgttctcccggaggtcccaaaaacagaggagatttgggatgtccgggagaaacctggcggcagcgcaaaagatg

SEQ ID NO: 86953 - DNA, 103 bp, Artificial Sequence
  Synthetic Polynucleotide
taatacgactcactataggggggaaggtaggtgtgtttctgctcctgtccaacagaggagaggacagatgcagaaacacaacctggcggcagcgcaaaagatg

SEQ ID NO: 86954 - DNA, 103 bp, Artificial Sequence
  Synthetic Polynucleotide
taatacgactcactatagggagacctccaggggaaggtaggtgtgtttctaacagaggagaagaaacatgcctaccttcaacctggcggcagcgcaaaagatg

SEQ ID NO: 86955 - DNA, 103 bp, Artificial Sequence
  Synthetic Polynucleotide
taatacgactcactatagggacaatgttacagacctccaggggaaggtagaacagaggagactacctatgcctggaggtaacctggcggcagcgcaaaagatg

SEQ ID NO: 86956 - DNA, 103 bp, Artificial Sequence
  Synthetic Polynucleotide
taatacgactcactatagggttgtcctgccacaatgttacagacctccagaacagaggagactggagatgtgtaacattaacctggcggcagcgcaaaagatg

SEQ ID NO: 86957 - DNA, 103 bp, Artificial Sequence
  Synthetic Polynucleotide
taatacgactcactatagggtaatacatctttgtcctgccacaatgttacaacagaggagagtaacaatgtggcaggacaacctggcggcagcgcaaaagatg

SEQ ID NO: 86958 - DNA, 103 bp, Artificial Sequence
  Synthetic Polynucleotide
taatacgactcactataggggttaattttttaatacatctttgtcctgccaacagaggagaggcaggatgaagatgtataacctggcggcagcgcaaaagatg

SEQ ID NO: 86959 - DNA, 103 bp, Artificial Sequence
  Synthetic Polynucleotide
taatacgactcactatagggctgattgtccgttaattttttaatacatctaacagaggagaagatgtatgaaaaaattaaacctggcggcagcgcaaaagatg

SEQ ID NO: 86960 - DNA, 103 bp, Artificial Sequence
  Synthetic Polynucleotide
taatacgactcactatagggtggttgaggtctgattgtccgttaatttttaacagaggagaaaaaatatgcggacaatcaacctggcggcagcgcaaaagatg

SEQ ID NO: 86961 - DNA, 103 bp, Artificial Sequence
  Synthetic Polynucleotide
taatacgactcactataggggctctgatcatggttgaggtctgattgtccaacagaggagaggacaaatggacctcaacaacctggcggcagcgcaaaagatg

SEQ ID NO: 86962 - DNA, 103 bp, Artificial Sequence
  Synthetic Polynucleotide
taatacgactcactatagggcctagcagtcgctctgatcatggttgaggtaacagaggagaacctcaatgatgatcagaaacctggcggcagcgcaaaagatg

SEQ ID NO: 86963 - DNA, 103 bp, Artificial Sequence
  Synthetic Polynucleotide
taatacgactcactatagggaattggcctgtaatttgattgttctcccggaacagaggagaccgggaatgcaatcaaataacctggcggcagcgcaaaagatg

SEQ ID NO: 86964 - DNA, 103 bp, Artificial Sequence
  Synthetic Polynucleotide
taatacgactcactatagggcgggcgccgacctagcagtcgctctgatcaaacagaggagatgatcaatgcgactgctaaacctggcggcagcgcaaaagatg

SEQ ID NO: 86965 - DNA, 103 bp, Artificial Sequence
  Synthetic Polynucleotide
taatacgactcactatagggtcttgccgatcgggcgccgacctagcagtcaacagaggagagactgcatggtcggcgccaacctggcggcagcgcaaaagatg

SEQ ID NO: 86966 - DNA, 103 bp, Artificial Sequence
  Synthetic Polynucleotide
taatacgactcactataggggctaatctcttcttgccgatcgggcgccgaaacagaggagatcggcgatggatcggcaaaacctggcggcagcgcaaaagatg

SEQ ID NO: 86967 - DNA, 103 bp, Artificial Sequence
  Synthetic Polynucleotide
taatacgactcactataggggcatcaatttgctaatctcttcttgccgataacagaggagaatcggcatgaagagattaaacctggcggcagcgcaaaagatg

SEQ ID NO: 86968 - DNA, 103 bp, Artificial Sequence
  Synthetic Polynucleotide
taatacgactcactatagggcttgcacttcgcatcaatttgctaatctctaacagaggagaagagatatgcaaattgataacctggcggcagcgcaaaagatg

SEQ ID NO: 86969 - DNA, 103 bp, Artificial Sequence
  Synthetic Polynucleotide
taatacgactcactatagggtgtgttgaaacttgcacttcgcatcaatttaacagaggagaaaattgatgcgaagtgcaaacctggcggcagcgcaaaagatg

SEQ ID NO: 86970 - DNA, 103 bp, Artificial Sequence
  Synthetic Polynucleotide
taatacgactcactatagggcgtatggatctgtgttgaaacttgcacttcaacagaggagagaagtgatggtttcaacaaacctggcggcagcgcaaaagatg

SEQ ID NO: 86971 - DNA, 103 bp, Artificial Sequence
  Synthetic Polynucleotide
taatacgactcactatagggaattcacggacgtatggatctgtgttgaaaaacagaggagatttcaaatgagatccataaacctggcggcagcgcaaaagatg

SEQ ID NO: 86972 - DNA, 103 bp, Artificial Sequence
  Synthetic Polynucleotide
taatacgactcactatagggcatgattccaaattcacggacgtatggatcaacagaggagagatccaatggtccgtgaaaacctggcggcagcgcaaaagatg

SEQ ID NO: 86973 - DNA, 103 bp, Artificial Sequence
  Synthetic Polynucleotide
taatacgactcactatagggcatctttgaccatgattccaaattcacggaaacagaggagatccgtgatgttggaatcaaacctggcggcagcgcaaaagatg

SEQ ID NO: 86974 - DNA, 103 bp, Artificial Sequence
  Synthetic Polynucleotide
taatacgactcactatagggatttcgaagaaattggcctgtaatttgattaacagaggagaaatcaaatgacaggccaaaacctggcggcagcgcaaaagatg

SEQ ID NO: 86975 - DNA, 103 bp, Artificial Sequence
  Synthetic Polynucleotide
taatacgactcactatagggtctgtcatctcatctttgaccatgattccaaacagaggagatggaatatgggtcaaagaaacctggcggcagcgcaaaagatg

SEQ ID NO: 86976 - DNA, 103 bp, Artificial Sequence
  Synthetic Polynucleotide
taatacgactcactatagggcccagtcacgtctgtcatctcatctttgacaacagaggagagtcaaaatggagatgacaaacctggcggcagcgcaaaagatg

SEQ ID NO: 86977 - DNA, 103 bp, Artificial Sequence
  Synthetic Polynucleotide
taatacgactcactataggggcagcacccgcccagtcacgtctgtcatctaacagaggagaagatgaatgacgtgactgaacctggcggcagcgcaaaagatg

SEQ ID NO: 86978 - DNA, 103 bp, Artificial Sequence
  Synthetic Polynucleotide
taatacgactcactataggggagggcggctgcagcacccgcccagtcacgaacagaggagacgtgacatggcgggtgctaacctggcggcagcgcaaaagatg

SEQ ID NO: 86979 - DNA, 103 bp, Artificial Sequence
  Synthetic Polynucleotide
taatacgactcactataggggtagaggatggagggcggctgcagcacccgaacagaggagacgggtgatgcagccgcccaacctggcggcagcgcaaaagatg

SEQ ID NO: 86980 - DNA, 103 bp, Artificial Sequence
  Synthetic Polynucleotide
taatacgactcactatagggtcctgcccccgtagaggatggagggcggctaacagaggagaagccgcatgccatcctctaacctggcggcagcgcaaaagatg

SEQ ID NO: 86981 - DNA, 103 bp, Artificial Sequence
  Synthetic Polynucleotide
taatacgactcactatagggatagctttattcctgcccccgtagaggatgaacagaggagacatcctatgcgggggcagaacctggcggcagcgcaaaagatg

SEQ ID NO: 86982 - DNA, 103 bp, Artificial Sequence
  Synthetic Polynucleotide
taatacgactcactatagggaggggtcgcaatagctttattcctgcccccaacagaggagagggggcatgaataaagctaacctggcggcagcgcaaaagatg

SEQ ID NO: 86983 - DNA, 103 bp, Artificial Sequence
  Synthetic Polynucleotide
taatacgactcactatagggcgccctggacaggggtcgcaatagctttataacagaggagaataaagatgttgcgacccaacctggcggcagcgcaaaagatg

SEQ ID NO: 86984 - DNA, 103 bp, Artificial Sequence
  Synthetic Polynucleotide
taatacgactcactatagggatgtcccagacgccctggacaggggtcgcaaacagaggagatgcgacatgtgtccagggaacctggcggcagcgcaaaagatg

SEQ ID NO: 86985 - DNA, 103 bp, Artificial Sequence
  Synthetic Polynucleotide
taatacgactcactatagggggggatgtccatttcgaagaaattggcctgaacagaggagacaggccatgttcttcgaaaacctggcggcagcgcaaaagatg

SEQ ID NO: 86986 - DNA, 103 bp, Artificial Sequence
  Synthetic Polynucleotide
taatacgactcactatagggcttgttccgcatgtcccagacgccctggacaacagaggagagtccagatggtctgggacaacctggcggcagcgcaaaagatg

SEQ ID NO: 86987 - DNA, 103 bp, Artificial Sequence
  Synthetic Polynucleotide
taatacgactcactatagggtgtggaactgcttgttccgcatgtcccagaaacagaggagatctgggatgtgcggaacaaacctggcggcagcgcaaaagatg

SEQ ID NO: 86988 - DNA, 103 bp, Artificial Sequence
  Synthetic Polynucleotide
taatacgactcactatagggtcgatgcccgtgtggaactgcttgttccgcaacagaggagagcggaaatggcagttccaaacctggcggcagcgcaaaagatg

SEQ ID NO: 86989 - DNA, 103 bp, Artificial Sequence
  Synthetic Polynucleotide
taatacgactcactatagggcaccttgatctcgatgcccgtgtggaactgaacagaggagacagttcatgacgggcatcaacctggcggcagcgcaaaagatg

SEQ ID NO: 86990 - DNA, 103 bp, Artificial Sequence
  Synthetic Polynucleotide
taatacgactcactatagggcaatggcccacaccttgatctcgatgcccgaacagaggagacgggcaatgagatcaaggaacctggcggcagcgcaaaagatg

SEQ ID NO: 86991 - DNA, 103 bp, Artificial Sequence
  Synthetic Polynucleotide
taatacgactcactataggggcgaagcacgcaatggcccacaccttgatcaacagaggagagatcaaatggtgggccataacctggcggcagcgcaaaagatg

SEQ ID NO: 86992 - DNA, 103 bp, Artificial Sequence
  Synthetic Polynucleotide
taatacgactcactataggggcgctggggggcgaagcacgcaatggcccaaacagaggagatgggccatggcgtgcttcaacctggcggcagcgcaaaagatg

SEQ ID NO: 86993 - DNA, 103 bp, Artificial Sequence
  Synthetic Polynucleotide
taatacgactcactatagggccgtgcactggcgctggggggcgaagcacgaacagaggagacgtgctatgccccccagcaacctggcggcagcgcaaaagatg

SEQ ID NO: 86994 - DNA, 103 bp, Artificial Sequence
  Synthetic Polynucleotide
taatacgactcactatagggagatggacttccgtgcactggcgctgggggaacagaggagacccccaatgccagtgcacaacctggcggcagcgcaaaagatg

SEQ ID NO: 86995 - DNA, 103 bp, Artificial Sequence
  Synthetic Polynucleotide
taatacgactcactataggggaaggacttcagatggacttccgtgcactgaacagaggagacagtgcatggaagtccataacctggcggcagcgcaaaagatg

SEQ ID NO: 86996 - DNA, 103 bp, Artificial Sequence
  Synthetic Polynucleotide
taatacgactcactatagggtgtcaattttggggatgtccatttcgaagaaacagaggagatcttcgatgtggacatccaacctggcggcagcgcaaaagatg

SEQ ID NO: 86997 - DNA, 103 bp, Artificial Sequence
  Synthetic Polynucleotide
taatacgactcactataggggctgctctgtgaaggacttcagatggacttaacagaggagaaagtccatgtgaagtcctaacctggcggcagcgcaaaagatg

SEQ ID NO: 86998 - DNA, 103 bp, Artificial Sequence
  Synthetic Polynucleotide
taatacgactcactatagggatctttctgagctgctctgtgaaggacttcaacagaggagagaagtcatgcacagagcaaacctggcggcagcgcaaaagatg

SEQ ID NO: 86999 - DNA, 103 bp, Artificial Sequence
  Synthetic Polynucleotide
taatacgactcactataggggtctctcgagatctttctgagctgctctgtaacagaggagaacagagatgctcagaaagaacctggcggcagcgcaaaagatg

SEQ ID NO: 87000 - DNA, 103 bp, Artificial Sequence
  Synthetic Polynucleotide
taatacgactcactataggggcatgccggcgtctctcgagatctttctgaaacagaggagatcagaaatgtctcgagagaacctggcggcagcgcaaaagatg

SEQ ID NO: 87001 - DNA, 103 bp, Artificial Sequence
  Synthetic Polynucleotide
taatacgactcactatagggccctggatgggcatgccggcgtctctcgagaacagaggagactcgagatgcgccggcataacctggcggcagcgcaaaagatg

SEQ ID NO: 87002 - DNA, 103 bp, Artificial Sequence
  Synthetic Polynucleotide
taatacgactcactataggggcacggctggccctggatgggcatgccggcaacagaggagagccggcatgcccatccagaacctggcggcagcgcaaaagatg

SEQ ID NO: 87003 - DNA, 103 bp, Artificial Sequence
  Synthetic Polynucleotide
taatacgactcactatagggatttgcagaagcacggctggccctggatggaacagaggagaccatccatggccagccgtaacctggcggcagcgcaaaagatg

SEQ ID NO: 87004 - DNA, 103 bp, Artificial Sequence
  Synthetic Polynucleotide
taatacgactcactatagggccctgcgcgtatttgcagaagcacggctggaacagaggagaccagccatgcttctgcaaaacctggcggcagcgcaaaagatg

SEQ ID NO: 87005 - DNA, 103 bp, Artificial Sequence
  Synthetic Polynucleotide
taatacgactcactataggggctgtccgccccctgcgcgtatttgcagaaaacagaggagattctgcatgtacgcgcagaacctggcggcagcgcaaaagatg

SEQ ID NO: 87006 - DNA, 103 bp, Artificial Sequence
  Synthetic Polynucleotide
taatacgactcactatagggtgggctccacgctgtccgccccctgcgcgtaacagaggagaacgcgcatggggcggacaaacctggcggcagcgcaaaagatg

SEQ ID NO: 87007 - DNA, 103 bp, Artificial Sequence
  Synthetic Polynucleotide
taatacgactcactatagggtaatgatagatgtcaattttggggatgtccaacagaggagaggacatatgcaaaattgaaacctggcggcagcgcaaaagatg

SEQ ID NO: 87008 - DNA, 103 bp, Artificial Sequence
  Synthetic Polynucleotide
taatacgactcactatagggtgccggaacatgggctccacgctgtccgccaacagaggagaggcggaatgcgtggagccaacctggcggcagcgcaaaagatg

SEQ ID NO: 87009 - DNA, 103 bp, Artificial Sequence
  Synthetic Polynucleotide
taatacgactcactataggggttcttcaggtgccggaacatgggctccacaacagaggagagtggagatgatgttccggaacctggcggcagcgcaaaagatg

SEQ ID NO: 87010 - DNA, 103 bp, Artificial Sequence
  Synthetic Polynucleotide
taatacgactcactatagggccgcatacgtgttcttcaggtgccggaacaaacagaggagatgttccatgacctgaagaaacctggcggcagcgcaaaagatg

SEQ ID NO: 87011 - DNA, 103 bp, Artificial Sequence
  Synthetic Polynucleotide
taatacgactcactatagggagctgcaggcccgcatacgtgttcttcaggaacagaggagacctgaaatgcacgtatgcaacctggcggcagcgcaaaagatg

SEQ ID NO: 87012 - DNA, 103 bp, Artificial Sequence
  Synthetic Polynucleotide
taatacgactcactataggggaccaccaccagctgcaggcccgcatacgtaacagaggagaacgtatatgggcctgcagaacctggcggcagcgcaaaagatg

SEQ ID NO: 87013 - DNA, 103 bp, Artificial Sequence
  Synthetic Polynucleotide
taatacgactcactatagggcgggcaggatgaccaccaccagctgcaggcaacagaggagagcctgcatgtggtggtggaacctggcggcagcgcaaaagatg

SEQ ID NO: 87014 - DNA, 103 bp, Artificial Sequence
  Synthetic Polynucleotide
taatacgactcactatagggggcgtcttgccgggcaggatgaccaccaccaacagaggagaggtggtatgcatcctgccaacctggcggcagcgcaaaagatg

SEQ ID NO: 87015 - DNA, 103 bp, Artificial Sequence
  Synthetic Polynucleotide
taatacgactcactatagggggcgtacacgggcgtcttgccgggcaggataacagaggagaatcctgatgggcaagacgaacctggcggcagcgcaaaagatg

SEQ ID NO: 87016 - DNA, 103 bp, Artificial Sequence
  Synthetic Polynucleotide
taatacgactcactataggggcttgacctcggcgtacacgggcgtcttgcaacagaggagagcaagaatgccgtgtacgaacctggcggcagcgcaaaagatg

SEQ ID NO: 87017 - DNA, 103 bp, Artificial Sequence
  Synthetic Polynucleotide
taatacgactcactatagggtctcccacgcgcttgacctcggcgtacacgaacagaggagacgtgtaatgcgaggtcaaaacctggcggcagcgcaaaagatg

SEQ ID NO: 87018 - DNA, 103 bp, Artificial Sequence
  Synthetic Polynucleotide
taatacgactcactatagggatccaattcataatgatagatgtcaattttaacagaggagaaaaattatgatctatcataacctggcggcagcgcaaaagatg

SEQ ID NO: 87019 - DNA, 103 bp, Artificial Sequence
  Synthetic Polynucleotide
taatacgactcactatagggcagcaccgtgtctcccacgcgcttgacctcaacagaggagagaggtcatgcgcgtgggaaacctggcggcagcgcaaaagatg

SEQ ID NO: 87020 - DNA, 103 bp, Artificial Sequence
  Synthetic Polynucleotide
taatacgactcactatagggtggccatccccagcaccgtgtctcccacgcaacagaggagagcgtggatgacacggtgcaacctggcggcagcgcaaaagatg

SEQ ID NO: 87021 - DNA, 103 bp, Artificial Sequence
  Synthetic Polynucleotide
taatacgactcactatagggacgcactgcgtggccatccccagcaccgtgaacagaggagacacggtatgggggatggcaacctggcggcagcgcaaaagatg

SEQ ID NO: 87022 - DNA, 103 bp, Artificial Sequence
  Synthetic Polynucleotide
taatacgactcactatagggcttcatctgcacgcactgcgtggccatcccaacagaggagagggatgatgacgcagtgcaacctggcggcagcgcaaaagatg

SEQ ID NO: 87023 - DNA, 103 bp, Artificial Sequence
  Synthetic Polynucleotide
taatacgactcactatagggtctgcacgttcttcatctgcacgcactgcgaacagaggagacgcagtatgtgcagatgaaacctggcggcagcgcaaaagatg

SEQ ID NO: 87024 - DNA, 103 bp, Artificial Sequence
  Synthetic Polynucleotide
taatacgactcactatagggggcgtggtcctctgcacgttcttcatctgcaacagaggagagcagatatggaacgtgcaaacctggcggcagcgcaaaagatg

SEQ ID NO: 87025 - DNA, 103 bp, Artificial Sequence
  Synthetic Polynucleotide
taatacgactcactatagggcagggtctgtggcgtggtcctctgcacgttaacagaggagaaacgtgatgaggaccacgaacctggcggcagcgcaaaagatg

SEQ ID NO: 87026 - DNA, 103 bp, Artificial Sequence
  Synthetic Polynucleotide
taatacgactcactatagggagaggttggacagggtctgtggcgtggtccaacagaggagaggaccaatgcacagacccaacctggcggcagcgcaaaagatg

SEQ ID NO: 87027 - DNA, 103 bp, Artificial Sequence
  Synthetic Polynucleotide
taatacgactcactatagggatcttcaggcagaggttggacagggtctgtaacagaggagaacagacatggtccaacctaacctggcggcagcgcaaaagatg

SEQ ID NO: 87028 - DNA, 103 bp, Artificial Sequence
  Synthetic Polynucleotide
taatacgactcactatagggcttgacgttgatcttcaggcagaggttggaaacagaggagatccaacatgtgcctgaagaacctggcggcagcgcaaaagatg

SEQ ID NO: 87029 - DNA, 103 bp, Artificial Sequence
  Synthetic Polynucleotide
taatacgactcactatagggctggcttgatatccaattcataatgatagaaacagaggagatctatcatgatgaattggaacctggcggcagcgcaaaagatg

SEQ ID NO: 87030 - DNA, 103 bp, Artificial Sequence
  Synthetic Polynucleotide
taatacgactcactatagggcgcctcccagcttgacgttgatcttcaggcaacagaggagagcctgaatgtcaacgtcaaacctggcggcagcgcaaaagatg

SEQ ID NO: 87031 - DNA, 103 bp, Artificial Sequence
  Synthetic Polynucleotide
taatacgactcactatagggatgttgttcacgcctcccagcttgacgttgaacagaggagacaacgtatggctgggaggaacctggcggcagcgcaaaagatg

SEQ ID NO: 87032 - DNA, 103 bp, Artificial Sequence
  Synthetic Polynucleotide
taatacgactcactataggggggcagcaggatgttgttcacgcctcccagaacagaggagactgggaatggtgaacaacaacctggcggcagcgcaaaagatg

SEQ ID NO: 87033 - DNA, 103 bp, Artificial Sequence
  Synthetic Polynucleotide
taatacgactcactataggggcctgccctggggcagcaggatgttgttcaaacagaggagatgaacaatgtcctgctgcaacctggcggcagcgcaaaagatg

SEQ ID NO: 87034 - DNA, 103 bp, Artificial Sequence
  Synthetic Polynucleotide
taatacgactcactatagggaacaccggcggcctgccctggggcagcaggaacagaggagacctgctatgccagggcagaacctggcggcagcgcaaaagatg

SEQ ID NO: 87035 - DNA, 103 bp, Artificial Sequence
  Synthetic Polynucleotide
taatacgactcactataggggggctgctggaacaccggcggcctgccctgaacagaggagacagggcatgccgccggtgaacctggcggcagcgcaaaagatg

SEQ ID NO: 87036 - DNA, 103 bp, Artificial Sequence
  Synthetic Polynucleotide
taatacgactcactataggggaaagatgacgggctgctggaacaccggcgaacagaggagacgccggatgtccagcagcaacctggcggcagcgcaaaagatg

SEQ ID NO: 87037 - DNA, 103 bp, Artificial Sequence
  Synthetic Polynucleotide
taatacgactcactatagggtctgctcccagaaagatgacgggctgctggaacagaggagaccagcaatgcgtcatcttaacctggcggcagcgcaaaagatg

SEQ ID NO: 87038 - DNA, 103 bp, Artificial Sequence
  Synthetic Polynucleotide
taatacgactcactataggggtgagtgacgtctgctcccagaaagatgacaacagaggagagtcatcatgctgggagcaaacctggcggcagcgcaaaagatg

SEQ ID NO: 87039 - DNA, 103 bp, Artificial Sequence
  Synthetic Polynucleotide
taatacgactcactatagggcggcgggggggtgagtgacgtctgctcccaaacagaggagatgggagatgacgtcactcaacctggcggcagcgcaaaagatg

SEQ ID NO: 87040 - DNA, 103 bp, Artificial Sequence
  Synthetic Polynucleotide
taatacgactcactataggggggcacttctctggcttgatatccaattcaaacagaggagatgaattatgtatcaagccaacctggcggcagcgcaaaagatg

SEQ ID NO: 87041 - DNA, 103 bp, Artificial Sequence
  Synthetic Polynucleotide
taatacgactcactatagggttcccatccccggcgggggggtgagtgacgaacagaggagacgtcacatgcccccccgcaacctggcggcagcgcaaaagatg

SEQ ID NO: 87042 - DNA, 103 bp, Artificial Sequence
  Synthetic Polynucleotide
taatacgactcactatagggggagggcttcttcccatccccggcggggggaacagaggagaccccccatgggggatgggaacctggcggcagcgcaaaagatg

SEQ ID NO: 87043 - DNA, 103 bp, Artificial Sequence
  Synthetic Polynucleotide
taatacgactcactatagggcggcggcaatggagggcttcttcccatcccaacagaggagagggatgatgagaagccctaacctggcggcagcgcaaaagatg

SEQ ID NO: 87044 - DNA, 103 bp, Artificial Sequence
  Synthetic Polynucleotide
taatacgactcactatagggctgcccaccacggcggcaatggagggcttcaacagaggagagaagccatgcattgccgcaacctggcggcagcgcaaaagatg

SEQ ID NO: 87045 - DNA, 103 bp, Artificial Sequence
  Synthetic Polynucleotide
taatacgactcactatagggggcgtccatgctgcccaccacggcggcaataacagaggagaattgccatggtggtgggcaacctggcggcagcgcaaaagatg

SEQ ID NO: 87046 - DNA, 103 bp, Artificial Sequence
  Synthetic Polynucleotide
taatacgactcactataggggattggggtgggcgtccatgctgcccaccaaacagaggagatggtggatggcatggacgaacctggcggcagcgcaaaagatg

SEQ ID NO: 87047 - DNA, 103 bp, Artificial Sequence
  Synthetic Polynucleotide
taatacgactcactataggggcgcagtagcgattggggtgggcgtccatgaacagaggagacatggaatgccaccccaaaacctggcggcagcgcaaaagatg

SEQ ID NO: 87048 - DNA, 103 bp, Artificial Sequence
  Synthetic Polynucleotide
taatacgactcactataggggcgcacggtggcgcagtagcgattggggtgaacagaggagacaccccatgcgctactgcaacctggcggcagcgcaaaagatg

SEQ ID NO: 87049 - DNA, 103 bp, Artificial Sequence
  Synthetic Polynucleotide
taatacgactcactataggggctgctgcacgcgcacggtggcgcagtagcaacagaggagagctactatgccaccgtgcaacctggcggcagcgcaaaagatg

SEQ ID NO: 87050 - DNA, 103 bp, Artificial Sequence
  Synthetic Polynucleotide
taatacgactcactatagggtcctgccggtgctgctgcacgcgcacggtgaacagaggagacaccgtatgcgtgcagcaaacctggcggcagcgcaaaagatg

SEQ ID NO: 87051 - DNA, 103 bp, Artificial Sequence
  Synthetic Polynucleotide
taatacgactcactatagggaactctcctcgggcacttctctggcttgataacagaggagaatcaagatggagaagtgcaacctggcggcagcgcaaaagatg

SEQ ID NO: 87052 - DNA, 103 bp, Artificial Sequence
  Synthetic Polynucleotide
taatacgactcactatagggttgtatgatctcctgccggtgctgctgcacaacagaggagagtgcagatgcaccggcagaacctggcggcagcgcaaaagatg

SEQ ID NO: 87053 - DNA, 103 bp, Artificial Sequence
  Synthetic Polynucleotide
taatacgactcactatagggcggccaggtcttgtatgatctcctgccggtaacagaggagaaccggcatgagatcatacaacctggcggcagcgcaaaagatg

SEQ ID NO: 87054 - DNA, 103 bp, Artificial Sequence
  Synthetic Polynucleotide
taatacgactcactatagggcggaccatggcggccaggtcttgtatgatcaacagaggagagatcatatgagacctggcaacctggcggcagcgcaaaagatg

SEQ ID NO: 87055 - DNA, 103 bp, Artificial Sequence
  Synthetic Polynucleotide
taatacgactcactataggggaggagctcgcggaccatggcggccaggtcaacagaggagagacctgatggccatggtcaacctggcggcagcgcaaaagatg

SEQ ID NO: 87056 - DNA, 103 bp, Artificial Sequence
  Synthetic Polynucleotide
taatacgactcactatagggagaactggatgaggagctcgcggaccatggaacagaggagaccatggatggcgagctccaacctggcggcagcgcaaaagatg

SEQ ID NO: 87057 - DNA, 103 bp, Artificial Sequence
  Synthetic Polynucleotide
taatacgactcactataggggtggacttgtagaactggatgaggagctcgaacagaggagacgagctatgcatccagttaacctggcggcagcgcaaaagatg

SEQ ID NO: 87058 - DNA, 103 bp, Artificial Sequence
  Synthetic Polynucleotide
taatacgactcactatagggcttgaagcgcgtggacttgtagaactggataacagaggagaatccagatgtacaagtccaacctggcggcagcgcaaaagatg

SEQ ID NO: 87059 - DNA, 103 bp, Artificial Sequence
  Synthetic Polynucleotide
taatacgactcactatagggtgcgggtgggcttgaagcgcgtggacttgtaacagaggagaacaagtatgcgcgcttcaaacctggcggcagcgcaaaagatg

SEQ ID NO: 87060 - DNA, 103 bp, Artificial Sequence
  Synthetic Polynucleotide
taatacgactcactatagggtagaagatgatgcgggtgggcttgaagcgcaacagaggagagcgcttatggcccacccgaacctggcggcagcgcaaaagatg

SEQ ID NO: 87061 - DNA, 103 bp, Artificial Sequence
  Synthetic Polynucleotide
taatacgactcactatagggaccgtcgcggtagaagatgatgcgggtgggaacagaggagacccaccatgatcatcttcaacctggcggcagcgcaaaagatg

SEQ ID NO: 87062 - DNA, 103 bp, Artificial Sequence
  Synthetic Polynucleotide
taatacgactcactataggggcgcaggaggtgcaagtgcggggccggctcaacagaggagagagccgatgccgcacttgaacctggcggcagcgcaaaagatg

SEQ ID NO: 87063 - DNA, 103 bp, Artificial Sequence
  Synthetic Polynucleotide
taatacgactcactatagggtttccctgttaactctcctcgggcacttctaacagaggagaagaagtatgcgaggagagaacctggcggcagcgcaaaagatg

SEQ ID NO: 87064 - DNA, 103 bp, Artificial Sequence
  Synthetic Polynucleotide
taatacgactcactatagggcttcagagacaccgtcgcggtagaagatgaaacagaggagatcatctatgaccgcgacgaacctggcggcagcgcaaaagatg

SEQ ID NO: 87065 - DNA, 103 bp, Artificial Sequence
  Synthetic Polynucleotide
taatacgactcactatagggtggaactggccttcagagacaccgtcgcggaacagaggagaccgcgaatgtgtctctgaaacctggcggcagcgcaaaagatg

SEQ ID NO: 87066 - DNA, 103 bp, Artificial Sequence
  Synthetic Polynucleotide
taatacgactcactataggggagaacctgctggaactggccttcagagacaacagaggagagtctctatgggccagttcaacctggcggcagcgcaaaagatg

SEQ ID NO: 87067 - DNA, 103 bp, Artificial Sequence
  Synthetic Polynucleotide
taatacgactcactatagggactcgtggtggagaacctgctggaactggcaacagaggagagccagtatgagcaggttcaacctggcggcagcgcaaaagatg

SEQ ID NO: 87068 - DNA, 103 bp, Artificial Sequence
  Synthetic Polynucleotide
taatacgactcactatagggatggccagcaactcgtggtggagaacctgcaacagaggagagcaggtatgccaccacgaaacctggcggcagcgcaaaagatg

SEQ ID NO: 87069 - DNA, 103 bp, Artificial Sequence
  Synthetic Polynucleotide
taatacgactcactatagggggcctcacggatggccagcaactcgtggtgaacagaggagacaccacatgttgctggccaacctggcggcagcgcaaaagatg

SEQ ID NO: 87070 - DNA, 103 bp, Artificial Sequence
  Synthetic Polynucleotide
taatacgactcactataggggcttgatacaggcctcacggatggccagcaaacagaggagatgctggatgtccgtgaggaacctggcggcagcgcaaaagatg

SEQ ID NO: 87071 - DNA, 103 bp, Artificial Sequence
  Synthetic Polynucleotide
taatacgactcactatagggtctttttctagcttgatacaggcctcacggaacagaggagaccgtgaatgctgtatcaaaacctggcggcagcgcaaaagatg

SEQ ID NO: 87072 - DNA, 103 bp, Artificial Sequence
  Synthetic Polynucleotide
taatacgactcactataggggggctggtagtctttttctagcttgatacaaacagaggagatgtatcatgctagaaaaaaacctggcggcagcgcaaaagatg

SEQ ID NO: 87073 - DNA, 103 bp, Artificial Sequence
  Synthetic Polynucleotide
taatacgactcactatagggaggtgatcccgggctggtagtctttttctaaacagaggagatagaaaatgactaccagcaacctggcggcagcgcaaaagatg

SEQ ID NO: 87074 - DNA, 103 bp, Artificial Sequence
  Synthetic Polynucleotide
taatacgactcactatagggtgttccacgatttccctgttaactctcctcaacagaggagagaggagatgtaacagggaaacctggcggcagcgcaaaagatg

SEQ ID NO: 87075 - DNA, 103 bp, Artificial Sequence
  Synthetic Polynucleotide
taatacgactcactatagggaccacgatgaaggtgatcccgggctggtagaacagaggagactaccaatgcgggatcacaacctggcggcagcgcaaaagatg

SEQ ID NO: 87076 - DNA, 103 bp, Artificial Sequence
  Synthetic Polynucleotide
taatacgactcactatagggcctcttctgcaccacgatgaaggtgatcccaacagaggagagggatcatgttcatcgtgaacctggcggcagcgcaaaagatg

SEQ ID NO: 87077 - DNA, 103 bp, Artificial Sequence
  Synthetic Polynucleotide
taatacgactcactataggggggtgtggtgcctcttctgcaccacgatgaaacagaggagatcatcgatgtgcagaagaaacctggcggcagcgcaaaagatg

SEQ ID NO: 87078 - DNA, 103 bp, Artificial Sequence
  Synthetic Polynucleotide
taatacgactcactatagggcagaagagccgggtgtggtgcctcttctgcaacagaggagagcagaaatggcaccacacaacctggcggcagcgcaaaagatg

SEQ ID NO: 87079 - DNA, 103 bp, Artificial Sequence
  Synthetic Polynucleotide
taatacgactcactatagggcttgtcagtgcagaagagccgggtgtggtgaacagaggagacaccacatgcggctcttcaacctggcggcagcgcaaaagatg

SEQ ID NO: 87080 - DNA, 103 bp, Artificial Sequence
  Synthetic Polynucleotide
taatacgactcactatagggcccgctcgttcttgtcagtgcagaagagccaacagaggagaggctctatggcactgacaaacctggcggcagcgcaaaagatg

SEQ ID NO: 87081 - DNA, 103 bp, Artificial Sequence
  Synthetic Polynucleotide
taatacgactcactatagggcttttcccaacccgctcgttcttgtcagtgaacagaggagacactgaatggaacgagcgaacctggcggcagcgcaaaagatg

SEQ ID NO: 87082 - DNA, 103 bp, Artificial Sequence
  Synthetic Polynucleotide
taatacgactcactatagggaatgtttccacttttcccaacccgctcgttaacagaggagaaacgagatggttgggaaaaacctggcggcagcgcaaaagatg

SEQ ID NO: 87083 - DNA, 103 bp, Artificial Sequence
  Synthetic Polynucleotide
taatacgactcactatagggtgcctgctggaatgtttccacttttcccaaaacagaggagattgggaatggtggaaacaaacctggcggcagcgcaaaagatg

SEQ ID NO: 87084 - DNA, 103 bp, Artificial Sequence
  Synthetic Polynucleotide
taatacgactcactatagggtccacagtcgtgcctgctggaatgtttccaaacagaggagatggaaaatgtccagcaggaacctggcggcagcgcaaaagatg

SEQ ID NO: 87085 - DNA, 103 bp, Artificial Sequence
  Synthetic Polynucleotide
taatacgactcactatagggctggaccatgtgttccacgatttccctgttaacagaggagaaacaggatgatcgtggaaaacctggcggcagcgcaaaagatg

SEQ ID NO: 87086 - DNA, 103 bp, Artificial Sequence
  Synthetic Polynucleotide
taatacgactcactataggggattttcgtgtccacagtcgtgcctgctggaacagaggagaccagcaatgacgactgtgaacctggcggcagcgcaaaagatg

SEQ ID NO: 87087 - DNA, 103 bp, Artificial Sequence
  Synthetic Polynucleotide
taatacgactcactatagggtggggtgggtgattttcgtgtccacagtcgaacagaggagacgactgatgacacgaaaaaacctggcggcagcgcaaaagatg

SEQ ID NO: 87088 - DNA, 103 bp, Artificial Sequence
  Synthetic Polynucleotide
taatacgactcactatagggtcgaactcggtggggtgggtgattttcgtgaacagaggagacacgaaatgcacccacccaacctggcggcagcgcaaaagatg

SEQ ID NO: 87089 - DNA, 103 bp, Artificial Sequence
  Synthetic Polynucleotide
taatacgactcactatagggcaggtagaagtcgaactcggtggggtgggtaacagaggagaacccacatgaccgagttcaacctggcggcagcgcaaaagatg

SEQ ID NO: 87090 - DNA, 103 bp, Artificial Sequence
  Synthetic Polynucleotide
taatacgactcactatagggcgtgactacacaggtagaagtcgaactcggaacagaggagaccgagtatgacttctaccaacctggcggcagcgcaaaagatg

SEQ ID NO: 87091 - DNA, 103 bp, Artificial Sequence
  Synthetic Polynucleotide
taatacgactcactatagggtggatgccagcgtgactacacaggtagaagaacagaggagacttctaatggtgtagtcaaacctggcggcagcgcaaaagatg

SEQ ID NO: 87092 - DNA, 103 bp, Artificial Sequence
  Synthetic Polynucleotide
taatacgactcactataggggcttgtcccctggatgccagcgtgactacaaacagaggagatgtagtatggctggcatcaacctggcggcagcgcaaaagatg

SEQ ID NO: 87093 - DNA, 103 bp, Artificial Sequence
  Synthetic Polynucleotide
taatacgactcactataggggcgaaggcctgcttgtcccctggatgccagaacagaggagactggcaatgaggggacaaaacctggcggcagcgcaaaagatg

SEQ ID NO: 87094 - DNA, 103 bp, Artificial Sequence
  Synthetic Polynucleotide
taatacgactcactatagggacgtgatagtgcgaaggcctgcttgtccccaacagaggagaggggacatgcaggccttcaacctggcggcagcgcaaaagatg

SEQ ID NO: 87095 - DNA, 103 bp, Artificial Sequence
  Synthetic Polynucleotide
taatacgactcactataggggtcccagaggacgtgatagtgcgaaggcctaacagaggagaaggcctatgcactatcacaacctggcggcagcgcaaaagatg

SEQ ID NO: 87096 - DNA, 103 bp, Artificial Sequence
  Synthetic Polynucleotide
taatacgactcactatagggttttaaagtgctggaccatgtgttccacgaaacagaggagatcgtggatgacatggtccaacctggcggcagcgcaaaagatg

SEQ ID NO: 87097 - DNA, 103 bp, Artificial Sequence
  Synthetic Polynucleotide
taatacgactcactatagggaacgattgtcgtcccagaggacgtgatagtaacagaggagaactatcatgtcctctgggaacctggcggcagcgcaaaagatg

SEQ ID NO: 87098 - DNA, 103 bp, Artificial Sequence
  Synthetic Polynucleotide
taatacgactcactatagggtcagaggagaaacgattgtcgtcccagaggaacagaggagacctctgatgcgacaatcgaacctggcggcagcgcaaaagatg

SEQ ID NO: 87099 - DNA, 103 bp, Artificial Sequence
  Synthetic Polynucleotide
taatacgactcactatagggctgcagctcatcagaggagaaacgattgtcaacagaggagagacaatatgttctcctctaacctggcggcagcgcaaaagatg

SEQ ID NO: 87100 - DNA, 103 bp, Artificial Sequence
  Synthetic Polynucleotide
taatacgactcactatagggaggttaggatctgcagctcatcagaggagaaacagaggagatctcctatgatgagctgcaacctggcggcagcgcaaaagatg

SEQ ID NO: 87101 - DNA, 103 bp, Artificial Sequence
  Synthetic Polynucleotide
taatacgactcactatagggcacagctggtaggttaggatctgcagctcaaacagaggagatgagctatggatcctaacaacctggcggcagcgcaaaagatg

SEQ ID NO: 87102 - DNA, 103 bp, Artificial Sequence
  Synthetic Polynucleotide
taatacgactcactataggggtaggtgtgacacagctggtaggttaggataacagaggagaatcctaatgtaccagctgaacctggcggcagcgcaaaagatg

SEQ ID NO: 87103 - DNA, 103 bp, Artificial Sequence
  Synthetic Polynucleotide
taatacgactcactatagggtgcagcgcacgtaggtgtgacacagctggtaacagaggagaaccagcatggtcacacctaacctggcggcagcgcaaaagatg

SEQ ID NO: 87104 - DNA, 103 bp, Artificial Sequence
  Synthetic Polynucleotide
taatacgactcactatagggacggagcgtgtgcagcgcacgtaggtgtgaaacagaggagatcacacatgcgtgcgctgaacctggcggcagcgcaaaagatg

SEQ ID NO: 87105 - DNA, 103 bp, Artificial Sequence
  Synthetic Polynucleotide
taatacgactcactatagggtgggatggacacggagcgtgtgcagcgcacaacagaggagagtgcgcatgacacgctccaacctggcggcagcgcaaaagatg

SEQ ID NO: 87106 - DNA, 103 bp, Artificial Sequence
  Synthetic Polynucleotide
taatacgactcactatagggatgctggcgctgggatggacacggagcgtgaacagaggagacacgctatgtgtccatccaacctggcggcagcgcaaaagatg

SEQ ID NO: 87107 - DNA, 103 bp, Artificial Sequence
  Synthetic Polynucleotide
taatacgactcactatagggaagatctgtgttttaaagtgctggaccatgaacagaggagacatggtatggcactttaaaacctggcggcagcgcaaaagatg

SEQ ID NO: 87108 - DNA, 103 bp, Artificial Sequence
  Synthetic Polynucleotide
taatacgactcactatagggtgagcgtagtatgctggcgctgggatggacaacagaggagagtccatatgagcgccagcaacctggcggcagcgcaaaagatg

SEQ ID NO: 87109 - DNA, 103 bp, Artificial Sequence
  Synthetic Polynucleotide
taatacgactcactatagggggccaccaggtgagcgtagtatgctggcgcaacagaggagagcgccaatgtactacgctaacctggcggcagcgcaaaagatg

SEQ ID NO: 87110 - DNA, 103 bp, Artificial Sequence
  Synthetic Polynucleotide
taatacgactcactatagggtggcccggaaggccaccaggtgagcgtagtaacagaggagaactacgatgacctggtggaacctggcggcagcgcaaaagatg

SEQ ID NO: 87111 - DNA, 103 bp, Artificial Sequence
  Synthetic Polynucleotide
taatacgactcactatagggaggtggtacctggcccggaaggccaccaggaacagaggagacctggtatgcttccgggcaacctggcggcagcgcaaaagatg

SEQ ID NO: 87112 - DNA, 103 bp, Artificial Sequence
  Synthetic Polynucleotide
taatacgactcactatagggcttatccaccaggtggtacctggcccggaaaacagaggagattccggatgaggtaccacaacctggcggcagcgcaaaagatg

SEQ ID NO: 87113 - DNA, 103 bp, Artificial Sequence
  Synthetic Polynucleotide
taatacgactcactatagggtgtcatgttccttatccaccaggtggtaccaacagaggagaggtaccatgtggtggataaacctggcggcagcgcaaaagatg

SEQ ID NO: 87114 - DNA, 103 bp, Artificial Sequence
  Synthetic Polynucleotide
taatacgactcactatagggccttcagcactgtcatgttccttatccaccaacagaggagaggtggaatgggaacatgaaacctggcggcagcgcaaaagatg

SEQ ID NO: 87115 - DNA, 103 bp, Artificial Sequence
  Synthetic Polynucleotide
taatacgactcactatagggggtatggcttccttcagcactgtcatgttcaacagaggagagaacatatgagtgctgaaaacctggcggcagcgcaaaagatg

SEQ ID NO: 87116 - DNA, 103 bp, Artificial Sequence
  Synthetic Polynucleotide
taatacgactcactatagggtctgcccagaggtatggcttccttcagcacaacagaggagagtgctgatggaagccataaacctggcggcagcgcaaaagatg

SEQ ID NO: 87117 - DNA, 103 bp, Artificial Sequence
  Synthetic Polynucleotide
taatacgactcactatagggcgcccgttactctgcccagaggtatggcttaacagaggagaaagccaatgctctgggcaaacctggcggcagcgcaaaagatg

SEQ ID NO: 87118 - DNA, 103 bp, Artificial Sequence
  Synthetic Polynucleotide
taatacgactcactatagggccgatccccaaagatctgtgttttaaagtgaacagaggagacactttatgacacagatcaacctggcggcagcgcaaaagatg

SEQ ID NO: 87119 - DNA, 103 bp, Artificial Sequence
  Synthetic Polynucleotide
taatacgactcactatagggttggtggtctcgcccgttactctgcccagaaacagaggagatctgggatgagtaacgggaacctggcggcagcgcaaaagatg

SEQ ID NO: 87120 - DNA, 103 bp, Artificial Sequence
  Synthetic Polynucleotide
taatacgactcactatagggtggccagtgcttggtggtctcgcccgttacaacagaggagagtaacgatggagaccaccaacctggcggcagcgcaaaagatg

SEQ ID NO: 87121 - DNA, 103 bp, Artificial Sequence
  Synthetic Polynucleotide
taatacgactcactatagggtggaccgccttggccagtgcttggtggtctaacagaggagaagaccaatgagcactggcaacctggcggcagcgcaaaagatg

SEQ ID NO: 87122 - DNA, 103 bp, Artificial Sequence
  Synthetic Polynucleotide
taatacgactcactatagggttggtgaacctggaccgccttggccagtgcaacagaggagagcactgatgaaggcggtcaacctggcggcagcgcaaaagatg

SEQ ID NO: 87123 - DNA, 103 bp, Artificial Sequence
  Synthetic Polynucleotide
taatacgactcactataggggcagagtgtcttggtgaacctggaccgcctaacagaggagaaggcggatgaggttcaccaacctggcggcagcgcaaaagatg

SEQ ID NO: 87124 - DNA, 103 bp, Artificial Sequence
  Synthetic Polynucleotide
taatacgactcactatagggtacatggtgcgcagagtgtcttggtgaaccaacagaggagaggttcaatgagacactctaacctggcggcagcgcaaaagatg

SEQ ID NO: 87125 - DNA, 103 bp, Artificial Sequence
  Synthetic Polynucleotide
taatacgactcactatagggtcaagcaaagtacatggtgcgcagagtgtcaacagaggagagacactatgcgcaccatgaacctggcggcagcgcaaaagatg

SEQ ID NO: 87126 - DNA, 103 bp, Artificial Sequence
  Synthetic Polynucleotide
taatacgactcactatagggacacgggcttccgatccccaaagatctgtgaacagaggagacacagaatgttggggatcaacctggcggcagcgcaaaagatg

SEQ ID NO: 87127 - DNA, 103 bp, Artificial Sequence
  Synthetic Polynucleotide
taatacgactcactatagggctgccgtcaaacacgggcttccgatccccaaacagaggagatggggaatggaagcccgtaacctggcggcagcgcaaaagatg

SEQ ID NO: 87128 - DNA, 103 bp, Artificial Sequence
  Synthetic Polynucleotide
taatacgactcactatagggtagattcttcctgccgtcaaacacgggcttaacagaggagaaagcccatgtttgacggcaacctggcggcagcgcaaaagatg

SEQ ID NO: 87129 - DNA, 103 bp, Artificial Sequence
  Synthetic Polynucleotide
taatacgactcactatagggtggctgtgtatagattcttcctgccgtcaaaacagaggagattgacgatgggaagaatcaacctggcggcagcgcaaaagatg

SEQ ID NO: 87130 - DNA, 103 bp, Artificial Sequence
  Synthetic Polynucleotide
taatacgactcactataggggggggcggcggcgcaggaggtgcaagtgcgaacagaggagacgcactatgacctcctgcaacctggcggcagcgcaaaagatg

SEQ ID NO: 87131 - DNA, 103 bp, Artificial Sequence
  Synthetic Polynucleotide
taatacgactcactatagggggaaggggcatggctgtgtatagattcttcaacagaggagagaagaaatgatacacagcaacctggcggcagcgcaaaagatg

SEQ ID NO: 87132 - DNA, 103 bp, Artificial Sequence
  Synthetic Polynucleotide
taatacgactcactatagggcctcccaatcggaaggggcatggctgtgtaaacagaggagatacacaatgatgccccttaacctggcggcagcgcaaaagatg

SEQ ID NO: 87133 - DNA, 103 bp, Artificial Sequence
  Synthetic Polynucleotide
taatacgactcactatagggccaccttgtccctcccaatcggaaggggcaaacagaggagatgccccatgcgattgggaaacctggcggcagcgcaaaagatg

SEQ ID NO: 87134 - DNA, 103 bp, Artificial Sequence
  Synthetic Polynucleotide
taatacgactcactatagggacctccagctccaccttgtccctcccaatcaacagaggagagattggatgggacaaggtaacctggcggcagcgcaaaagatg

SEQ ID NO: 87135 - DNA, 103 bp, Artificial Sequence
  Synthetic Polynucleotide
taatacgactcactatagggtggcagcgtgacctccagctccaccttgtcaacagaggagagacaagatggagctggagaacctggcggcagcgcaaaagatg

SEQ ID NO: 87136 - DNA, 103 bp, Artificial Sequence
  Synthetic Polynucleotide
taatacgactcactatagggtgccttctcctggcagcgtgacctccagctaacagaggagaagctggatgtcacgctgcaacctggcggcagcgcaaaagatg

SEQ ID NO: 87137 - DNA, 103 bp, Artificial Sequence
  Synthetic Polynucleotide
taatacgactcactatagggatgcgatccttgccttctcctggcagcgtgaacagaggagacacgctatgaggagaaggaacctggcggcagcgcaaaagatg

SEQ ID NO: 87138 - DNA, 103 bp, Artificial Sequence
  Synthetic Polynucleotide
taatacgactcactatagggcaccttgaagatgcgatccttgccttctccaacagaggagaggagaaatgaaggatcgcaacctggcggcagcgcaaaagatg

SEQ ID NO: 87139 - DNA, 103 bp, Artificial Sequence
  Synthetic Polynucleotide
taatacgactcactatagggacttgatggacaccttgaagatgcgatcctaacagaggagaaggatcatgtcttcaaggaacctggcggcagcgcaaaagatg

SEQ ID NO: 87140 - DNA, 103 bp, Artificial Sequence
  Synthetic Polynucleotide
taatacgactcactatagggcaggacacccacttgatggacaccttgaagaacagaggagacttcaaatggtccatcaaaacctggcggcagcgcaaaagatg

SEQ ID NO: 87141 - DNA, 103 bp, Artificial Sequence
  Synthetic Polynucleotide
taatacgactcactatagggtccttggatggggggcggcggcgcaggaggaacagaggagacctcctatgccgccgcccaacctggcggcagcgcaaaagatg

SEQ ID NO: 87142 - DNA, 103 bp, Artificial Sequence
  Synthetic Polynucleotide
taatacgactcactatagggcaagctcacgcaggacacccacttgatggaaacagaggagatccatcatgtgggtgtccaacctggcggcagcgcaaaagatg

SEQ ID NO: 87143 - DNA, 103 bp, Artificial Sequence
  Synthetic Polynucleotide
taatacgactcactataggggtaacgcctgcaagctcacgcaggacacccaacagaggagagggtgtatggcgtgagctaacctggcggcagcgcaaaagatg

SEQ ID NO: 87144 - DNA, 103 bp, Artificial Sequence
  Synthetic Polynucleotide
taatacgactcactatagggagtgcatcgtgtaacgcctgcaagctcacgaacagaggagacgtgagatggcaggcgttaacctggcggcagcgcaaaagatg

SEQ ID NO: 87145 - DNA, 103 bp, Artificial Sequence
  Synthetic Polynucleotide
taatacgactcactatagggccgccctgaaagtgcatcgtgtaacgcctgaacagaggagacaggcgatgcacgatgcaaacctggcggcagcgcaaaagatg

SEQ ID NO: 87146 - DNA, 103 bp, Artificial Sequence
  Synthetic Polynucleotide
taatacgactcactatagggcgctgggcagccgccctgaaagtgcatcgtaacagaggagaacgatgatgtttcagggcaacctggcggcagcgcaaaagatg

SEQ ID NO: 87147 - DNA, 103 bp, Artificial Sequence
  Synthetic Polynucleotide
taatacgactcactatagggtcaaaagggacgctgggcagccgccctgaaaacagaggagattcaggatggctgcccagaacctggcggcagcgcaaaagatg

SEQ ID NO: 87148 - DNA, 103 bp, Artificial Sequence
  Synthetic Polynucleotide
taatacgactcactatagggctggatcgtctcaaaagggacgctgggcagaacagaggagactgcccatggtcccttttaacctggcggcagcgcaaaagatg

SEQ ID NO: 87149 - DNA, 103 bp, Artificial Sequence
  Synthetic Polynucleotide
taatacgactcactatagggcgtccagggcctggatcgtctcaaaagggaaacagaggagatcccttatgagacgatccaacctggcggcagcgcaaaagatg

SEQ ID NO: 87150 - DNA, 103 bp, Artificial Sequence
  Synthetic Polynucleotide
taatacgactcactatagggctcatgaccacgtccagggcctggatcgtcaacagaggagagacgatatgggccctggaaacctggcggcagcgcaaaagatg

SEQ ID NO: 87151 - DNA, 103 bp, Artificial Sequence
  Synthetic Polynucleotide
taatacgactcactatagggtggcaagtgcctcatgaccacgtccagggcaacagaggagagccctgatggtggtcatgaacctggcggcagcgcaaaagatg

SEQ ID NO: 87152 - DNA, 103 bp, Artificial Sequence
  Synthetic Polynucleotide
taatacgactcactatagggtgaaggcatatccttggatggggggcggcgaacagaggagacgccgcatgccatccaagaacctggcggcagcgcaaaagatg

SEQ ID NO: 87153 - DNA, 103 bp, Artificial Sequence
  Synthetic Polynucleotide
taatacgactcactatagggacctcatggatggcaagtgcctcatgaccaaacagaggagatggtcaatgggcacttgcaacctggcggcagcgcaaaagatg

SEQ ID NO: 87154 - DNA, 103 bp, Artificial Sequence
  Synthetic Polynucleotide
taatacgactcactatagggacgggggtgtacctcatggatggcaagtgcaacagaggagagcacttatgatccatgagaacctggcggcagcgcaaaagatg

SEQ ID NO: 87155 - DNA, 103 bp, Artificial Sequence
  Synthetic Polynucleotide
taatacgactcactatagggggagcggcccacgggggtgtacctcatggaaacagaggagatccatgatgtacacccccaacctggcggcagcgcaaaagatg

SEQ ID NO: 87156 - DNA, 103 bp, Artificial Sequence
  Synthetic Polynucleotide
taatacgactcactatagggcggtgaagaaggagcggcccacgggggtgtaacagaggagaacacccatgtgggccgctaacctggcggcagcgcaaaagatg

SEQ ID NO: 87157 - DNA, 103 bp, Artificial Sequence
  Synthetic Polynucleotide
taatacgactcactatagggccttcggacgcggtgaagaaggagcggcccaacagaggagagggccgatgcttcttcacaacctggcggcagcgcaaaagatg

SEQ ID NO: 87158 - DNA, 103 bp, Artificial Sequence
  Synthetic Polynucleotide
taatacgactcactataggggttagagcagccttcggacgcggtgaagaaaacagaggagattcttcatggcgtccgaaaacctggcggcagcgcaaaagatg

SEQ ID NO: 87159 - DNA, 103 bp, Artificial Sequence
  Synthetic Polynucleotide
taatacgactcactatagggcgccaagagggttagagcagccttcggacgaacagaggagacgtccgatggctgctctaaacctggcggcagcgcaaaagatg

SEQ ID NO: 87160 - DNA, 103 bp, Artificial Sequence
  Synthetic Polynucleotide
taatacgactcactatagggtctcggcccccgccaagagggttagagcagaacagaggagactgctcatgccctcttggaacctggcggcagcgcaaaagatg

SEQ ID NO: 87161 - DNA, 103 bp, Artificial Sequence
  Synthetic Polynucleotide
taatacgactcactatagggaaaccacacttctcggcccccgccaagaggaacagaggagacctcttatggggggccgaaacctggcggcagcgcaaaagatg

SEQ ID NO: 87162 - DNA, 103 bp, Artificial Sequence
  Synthetic Polynucleotide
taatacgactcactataggggatggaagccaaaccacacttctcggccccaacagaggagaggggccatgaagtgtggtaacctggcggcagcgcaaaagatg

SEQ ID NO: 87163 - DNA, 103 bp, Artificial Sequence
  Synthetic Polynucleotide
taatacgactcactatagggggtggaggcttgaaggcatatccttggatgaacagaggagacatccaatgatatgccttaacctggcggcagcgcaaaagatg

SEQ ID NO: 87164 - DNA, 103 bp, Artificial Sequence
  Synthetic Polynucleotide
taatacgactcactatagggcggacggactgatggaagccaaaccacactaacagaggagaagtgtgatgtggcttccaaacctggcggcagcgcaaaagatg

SEQ ID NO: 87165 - DNA, 103 bp, Artificial Sequence
  Synthetic Polynucleotide
taatacgactcactataggggagagaaggccggacggactgatggaagccaacagaggagaggcttcatgcagtccgtcaacctggcggcagcgcaaaagatg

SEQ ID NO: 87166 - DNA, 103 bp, Artificial Sequence
  Synthetic Polynucleotide
taatacgactcactatagggtcattttccagagagaaggccggacggactaacagaggagaagtccgatgggccttctcaacctggcggcagcgcaaaagatg

SEQ ID NO: 87167 - DNA, 103 bp, Artificial Sequence
  Synthetic Polynucleotide
taatacgactcactatagggatattcagcatcattttccagagagaaggcaacagaggagagccttcatgctggaaaataacctggcggcagcgcaaaagatg

SEQ ID NO: 87168 - DNA, 103 bp, Artificial Sequence
  Synthetic Polynucleotide
taatacgactcactatagggtgacacatcaatattcagcatcattttccaaacagaggagatggaaaatgatgctgaataacctggcggcagcgcaaaagatg

SEQ ID NO: 87169 - DNA, 103 bp, Artificial Sequence
  Synthetic Polynucleotide
taatacgactcactatagggacgctgttgctgacacatcaatattcagcaaacagaggagatgctgaatgttgatgtgtaacctggcggcagcgcaaaagatg

SEQ ID NO: 87170 - DNA, 103 bp, Artificial Sequence
  Synthetic Polynucleotide
taatacgactcactataggggccttgtaaaacgctgttgctgacacatcaaacagaggagatgatgtatgagcaacagcaacctggcggcagcgcaaaagatg

SEQ ID NO: 87171 - DNA, 103 bp, Artificial Sequence
  Synthetic Polynucleotide
taatacgactcactatagggtactggctgtgccttgtaaaacgctgttgcaacagaggagagcaacaatgttttacaagaacctggcggcagcgcaaaagatg

SEQ ID NO: 87172 - DNA, 103 bp, Artificial Sequence
  Synthetic Polynucleotide
taatacgactcactatagggcaaactcgattactggctgtgccttgtaaaaacagaggagatttacaatgcacagccagaacctggcggcagcgcaaaagatg

SEQ ID NO: 87173 - DNA, 103 bp, Artificial Sequence
  Synthetic Polynucleotide
taatacgactcactatagggacttcacaaacaaactcgattactggctgtaacagaggagaacagccatgaatcgagttaacctggcggcagcgcaaaagatg

SEQ ID NO: 87174 - DNA, 103 bp, Artificial Sequence
  Synthetic Polynucleotide
taatacgactcactataggggtcgggtctaggtggaggcttgaaggcataaacagaggagatatgccatgaagcctccaaacctggcggcagcgcaaaagatg

SEQ ID NO: 87175 - DNA, 103 bp, Artificial Sequence
  Synthetic Polynucleotide
taatacgactcactatagggaaaatccaaaacttcacaaacaaactcgataacagaggagaatcgagatggtttgtgaaaacctggcggcagcgcaaaagatg

SEQ ID NO: 87176 - DNA, 103 bp, Artificial Sequence
  Synthetic Polynucleotide
taatacgactcactatagggcaatacttttaaaatccaaaacttcacaaaaacagaggagatttgtgatgttttggattaacctggcggcagcgcaaaagatg

SEQ ID NO: 87177 - DNA, 103 bp, Artificial Sequence
  Synthetic Polynucleotide
taatacgactcactatagggtgttgttcttcaatacttttaaaatccaaaaacagaggagatttggaatgtaaaagtataacctggcggcagcgcaaaagatg

SEQ ID NO: 87178 - DNA, 103 bp, Artificial Sequence
  Synthetic Polynucleotide
taatacgactcactatagggcagaggtttttgttgttcttcaatacttttaacagaggagaaaaagtatggaagaacaaaacctggcggcagcgcaaaagatg

SEQ ID NO: 87179 - DNA, 103 bp, Artificial Sequence
  Synthetic Polynucleotide
taatacgactcactataggggggaatctgtcagaggtttttgttgttcttaacagaggagaaagaacatgaaaaacctcaacctggcggcagcgcaaaagatg

SEQ ID NO: 87180 - DNA, 103 bp, Artificial Sequence
  Synthetic Polynucleotide
taatacgactcactatagggtttaccctttgggaatctgtcagaggttttaacagaggagaaaaaccatggacagattcaacctggcggcagcgcaaaagatg

SEQ ID NO: 87181 - DNA, 103 bp, Artificial Sequence
  Synthetic Polynucleotide
taatacgactcactatagggtttggtaaactttaccctttgggaatctgtaacagaggagaacagatatgcaaagggtaaacctggcggcagcgcaaaagatg

SEQ ID NO: 87182 - DNA, 103 bp, Artificial Sequence
  Synthetic Polynucleotide
taatacgactcactatagggctttaatttctttggtaaactttaccctttaacagaggagaaaagggatgagtttaccaaacctggcggcagcgcaaaagatg

SEQ ID NO: 87183 - DNA, 103 bp, Artificial Sequence
  Synthetic Polynucleotide
taatacgactcactatagggacctttagacctttaatttctttggtaaacaacagaggagagtttacatgagaaattaaaacctggcggcagcgcaaaagatg

SEQ ID NO: 87184 - DNA, 103 bp, Artificial Sequence
  Synthetic Polynucleotide
taatacgactcactatagggcgttatctccacctttagacctttaatttcaacagaggagagaaattatgggtctaaagaacctggcggcagcgcaaaagatg

SEQ ID NO: 87185 - DNA, 103 bp, Artificial Sequence
  Synthetic Polynucleotide
taatacgactcactatagggaggtcccaaagtcgggtctaggtggaggctaacagaggagaagcctcatgctagacccgaacctggcggcagcgcaaaagatg

SEQ ID NO: 87186 - DNA, 103 bp, Artificial Sequence
  Synthetic Polynucleotide
taatacgactcactataggggcccacagtgcgttatctccacctttagacaacagaggagagtctaaatgtggagataaaacctggcggcagcgcaaaagatg

SEQ ID NO: 87187 - DNA, 103 bp, Artificial Sequence
  Synthetic Polynucleotide
taatacgactcactatagggctcttcatctgcccacagtgcgttatctccaacagaggagaggagatatggcactgtggaacctggcggcagcgcaaaagatg

SEQ ID NO: 87188 - DNA, 103 bp, Artificial Sequence
  Synthetic Polynucleotide
taatacgactcactataggggcggtacttcctcttcatctgcccacagtgaacagaggagacactgtatgcagatgaagaacctggcggcagcgcaaaagatg

SEQ ID NO: 87189 - DNA, 103 bp, Artificial Sequence
  Synthetic Polynucleotide
taatacgactcactatagggcattgcagacgcggtacttcctcttcatctaacagaggagaagatgaatgggaagtaccaacctggcggcagcgcaaaagatg

SEQ ID NO: 87190 - DNA, 103 bp, Artificial Sequence
  Synthetic Polynucleotide
taatacgactcactatagggcgccgggtcacattgcagacgcggtacttcaacagaggagagaagtaatgcgtctgcaaaacctggcggcagcgcaaaagatg

SEQ ID NO: 87191 - DNA, 103 bp, Artificial Sequence
  Synthetic Polynucleotide
taatacgactcactatagggactggcgggccgccgggtcacattgcagacaacagaggagagtctgcatggtgacccggaacctggcggcagcgcaaaagatg

SEQ ID NO: 87192 - DNA, 103 bp, Artificial Sequence
  Synthetic Polynucleotide
taatacgactcactatagggatgtttggtgactggcgggccgccgggtcaaacagaggagatgacccatgggcccgccaaacctggcggcagcgcaaaagatg

SEQ ID NO: 87193 - DNA, 103 bp, Artificial Sequence
  Synthetic Polynucleotide
taatacgactcactatagggtgcagcgggaatgtttggtgactggcgggcaacagaggagagcccgcatgtcaccaaacaacctggcggcagcgcaaaagatg

SEQ ID NO: 87194 - DNA, 103 bp, Artificial Sequence
  Synthetic Polynucleotide
taatacgactcactataggggctctcctgctgcagcgggaatgtttggtgaacagaggagacaccaaatgttcccgctgaacctggcggcagcgcaaaagatg

SEQ ID NO: 87195 - DNA, 103 bp, Artificial Sequence
  Synthetic Polynucleotide
taatacgactcactatagggccgtctgcccgctctcctgctgcagcgggaaacagaggagatcccgcatgagcaggagaaacctggcggcagcgcaaaagatg

SEQ ID NO: 87196 - DNA, 103 bp, Artificial Sequence
  Synthetic Polynucleotide
taatacgactcactataggggttctcccggaggtcccaaagtcgggtctaaacagaggagatagaccatgctttgggacaacctggcggcagcgcaaaagatg

SEQ ID NO: 87197 - DNA, 103 bp, Artificial Sequence
  Synthetic Polynucleotide
taatacgactcactataggggtgcactccaccgtctgcccgctctcctgcaacagaggagagcaggaatgcgggcagacaacctggcggcagcgcaaaagatg

SEQ ID NO: 87198 - DNA, 103 bp, Artificial Sequence
  Synthetic Polynucleotide
taatacgactcactatagggctgggccaccgtgcactccaccgtctgcccaacagaggagagggcagatggtggagtgcaacctggcggcagcgcaaaagatg

SEQ ID NO: 87199 - DNA, 103 bp, Artificial Sequence
  Synthetic Polynucleotide
taatacgactcactatagggccttgaaatactgggccaccgtgcactccaaacagaggagatggagtatgcggtggcccaacctggcggcagcgcaaaagatg

SEQ ID NO: 87200 - DNA, 103 bp, Artificial Sequence
  Synthetic Polynucleotide
taatacgactcactatagggttgtgcctgtccttgaaatactgggccaccaacagaggagaggtggcatggtatttcaaaacctggcggcagcgcaaaagatg

SEQ ID NO: 87201 - DNA, 103 bp, Artificial Sequence
  Synthetic Polynucleotide
taatacgactcactatagggcagaaccaacttgtgcctgtccttgaaataaacagaggagatatttcatggacaggcacaacctggcggcagcgcaaaagatg

SEQ ID NO: 87202 - DNA, 103 bp, Artificial Sequence
  Synthetic Polynucleotide
taatacgactcactataggggggggtagcgcagaaccaacttgtgcctgtaacagaggagaacaggcatgagttggttcaacctggcggcagcgcaaaagatg

SEQ ID NO: 87203 - DNA, 103 bp, Artificial Sequence
  Synthetic Polynucleotide
taatacgactcactatagggcatgggaggtgggggtagcgcagaaccaacaacagaggagagttggtatggcgctacccaacctggcggcagcgcaaaagatg

SEQ ID NO: 87204 - DNA, 103 bp, Artificial Sequence
  Synthetic Polynucleotide
taatacgactcactataggggacttgtaaacatgggaggtgggggtagcgaacagaggagacgctacatgcacctcccaaacctggcggcagcgcaaaagatg

SEQ ID NO: 87205 - DNA, 103 bp, Artificial Sequence
  Synthetic Polynucleotide
taatacgactcactataggggctcctgtccgacttgtaaacatgggaggtaacagaggagaacctccatggtttacaagaacctggcggcagcgcaaaagatg

SEQ ID NO: 87206 - DNA, 103 bp, Artificial Sequence
  Synthetic Polynucleotide
taatacgactcactataggggtgtgtttctgctcctgtccgacttgtaaaaacagaggagatttacaatgcggacaggaaacctggcggcagcgcaaaagatg

SEQ ID NO: 87207 - DNA, 103 bp, Artificial Sequence
  Synthetic Polynucleotide
taatacgactcactataggggtaggtgatgttggcgctgctgctgttcataacagaggagaatgaacatgagcagcgccaacctggcggcagcgcaaaagatg

SEQ ID NO: 87208 - DNA, 103 bp, Artificial Sequence
  Synthetic Polynucleotide
taatacgactcactatagggtctatgccgcttggaaggatttgacttgataacagaggagaatcaagatgaatccttccaacctggcggcagcgcaaaagatg

SEQ ID NO: 87209 - DNA, 103 bp, Artificial Sequence
  Synthetic Polynucleotide
taatacgactcactatagggcattcggatatgggactcggcacaataaagaacagaggagactttatatggccgagtccaacctggcggcagcgcaaaagatg

SEQ ID NO: 87210 - DNA, 103 bp, Artificial Sequence
  Synthetic Polynucleotide
taatacgactcactatagggcagtcttaatcattcggatatgggactcggaacagaggagaccgagtatgatatccgaaaacctggcggcagcgcaaaagatg

SEQ ID NO: 87211 - DNA, 103 bp, Artificial Sequence
  Synthetic Polynucleotide
taatacgactcactatagggccactttctccagtcttaatcattcggataaacagaggagatatccgatggattaagacaacctggcggcagcgcaaaagatg

SEQ ID NO: 87212 - DNA, 103 bp, Artificial Sequence
  Synthetic Polynucleotide
taatacgactcactatagggaactatcatgccactttctccagtcttaataacagaggagaattaagatgggagaaagtaacctggcggcagcgcaaaagatg

SEQ ID NO: 87213 - DNA, 103 bp, Artificial Sequence
  Synthetic Polynucleotide
taatacgactcactataggggaagccggaaaactatcatgccactttctcaacagaggagagagaaaatggcatgatagaacctggcggcagcgcaaaagatg

SEQ ID NO: 87214 - DNA, 103 bp, Artificial Sequence
  Synthetic Polynucleotide
taatacgactcactatagggttttttgtaagaagccggaaaactatcatgaacagaggagacatgatatgtttccggctaacctggcggcagcgcaaaagatg

SEQ ID NO: 87215 - DNA, 103 bp, Artificial Sequence
  Synthetic Polynucleotide
taatacgactcactatagggccatcggttgttttttgtaagaagccggaaaacagaggagattccggatgcttacaaaaaacctggcggcagcgcaaaagatg

SEQ ID NO: 87216 - DNA, 103 bp, Artificial Sequence
  Synthetic Polynucleotide
taatacgactcactatagggggacccaagtccatcggttgttttttgtaaaacagaggagattacaaatgacaaccgataacctggcggcagcgcaaaagatg

SEQ ID NO: 87217 - DNA, 103 bp, Artificial Sequence
  Synthetic Polynucleotide
taatacgactcactataggggcattagactggacccaagtccatcggttgaacagaggagacaaccgatggacttgggtaacctggcggcagcgcaaaagatg

SEQ ID NO: 87218 - DNA, 103 bp, Artificial Sequence
  Synthetic Polynucleotide
taatacgactcactatagggaagcaggcgtgcattagactggacccaagtaacagaggagaacttggatgcagtctaataacctggcggcagcgcaaaagatg

SEQ ID NO: 87219 - DNA, 103 bp, Artificial Sequence
  Synthetic Polynucleotide
taatacgactcactatagggtaagtcggtctctatgccgcttggaaggataacagaggagaatccttatgagcggcataaacctggcggcagcgcaaaagatg

SEQ ID NO: 87220 - DNA, 103 bp, Artificial Sequence
  Synthetic Polynucleotide
taatacgactcactatagggcatttttataaagcaggcgtgcattagactaacagaggagaagtctaatgcacgcctgcaacctggcggcagcgcaaaagatg

SEQ ID NO: 87221 - DNA, 103 bp, Artificial Sequence
  Synthetic Polynucleotide
taatacgactcactatagggtctggtcttccatttttataaagcaggcgtaacagaggagaacgcctatgttataaaaaaacctggcggcagcgcaaaagatg

SEQ ID NO: 87222 - DNA, 103 bp, Artificial Sequence
  Synthetic Polynucleotide
taatacgactcactatagggaatgatataatctggtcttccatttttataaacagaggagatataaaatgggaagaccaaacctggcggcagcgcaaaagatg

SEQ ID NO: 87223 - DNA, 103 bp, Artificial Sequence
  Synthetic Polynucleotide
taatacgactcactatagggtctgagttacaatgatataatctggtcttcaacagaggagagaagacatgattatatcaaacctggcggcagcgcaaaagatg

SEQ ID NO: 87224 - DNA, 103 bp, Artificial Sequence
  Synthetic Polynucleotide
taatacgactcactataggggttagtggtctctgagttacaatgatataaaacagaggagattatatatgtgtaactcaaacctggcggcagcgcaaaagatg

SEQ ID NO: 87225 - DNA, 103 bp, Artificial Sequence
  Synthetic Polynucleotide
taatacgactcactatagggttcctcatctgttagtggtctctgagttacaacagaggagagtaactatgagaccactaaacctggcggcagcgcaaaagatg

SEQ ID NO: 87226 - DNA, 103 bp, Artificial Sequence
  Synthetic Polynucleotide
taatacgactcactataggggctctgttccttcctcatctgttagtggtcaacagaggagagaccacatgcagatgaggaacctggcggcagcgcaaaagatg

SEQ ID NO: 87227 - DNA, 103 bp, Artificial Sequence
  Synthetic Polynucleotide
taatacgactcactatagggtttcgtaaatgctctgttccttcctcatctaacagaggagaagatgaatgaggaacagaaacctggcggcagcgcaaaagatg

SEQ ID NO: 87228 - DNA, 103 bp, Artificial Sequence
  Synthetic Polynucleotide
taatacgactcactatagggcgtatttcgttttcgtaaatgctctgttccaacagaggagaggaacaatgcatttacgaaacctggcggcagcgcaaaagatg

SEQ ID NO: 87229 - DNA, 103 bp, Artificial Sequence
  Synthetic Polynucleotide
taatacgactcactatagggaaggcaacttcgtatttcgttttcgtaaataacagaggagaatttacatgaacgaaataaacctggcggcagcgcaaaagatg

SEQ ID NO: 87230 - DNA, 103 bp, Artificial Sequence
  Synthetic Polynucleotide
taatacgactcactatagggaactctgtattaagtcggtctctatgccgcaacagaggagagcggcaatgagaccgactaacctggcggcagcgcaaaagatg

SEQ ID NO: 87231 - DNA, 103 bp, Artificial Sequence
  Synthetic Polynucleotide
taatacgactcactataggggtaaacataaaaggcaacttcgtatttcgtaacagaggagaacgaaaatggaagttgccaacctggcggcagcgcaaaagatg

SEQ ID NO: 87232 - DNA, 103 bp, Artificial Sequence
  Synthetic Polynucleotide
taatacgactcactatagggttctccagtggtaaacataaaaggcaacttaacagaggagaaagttgatgtttatgtttaacctggcggcagcgcaaaagatg

SEQ ID NO: 87233 - DNA, 103 bp, Artificial Sequence
  Synthetic Polynucleotide
taatacgactcactatagggacaacacagcttctccagtggtaaacataaaacagaggagattatgtatgccactggagaacctggcggcagcgcaaaagatg

SEQ ID NO: 87234 - DNA, 103 bp, Artificial Sequence
  Synthetic Polynucleotide
taatacgactcactataggggttgcctcatacaacacagcttctccagtgaacagaggagacactggatgagctgtgttaacctggcggcagcgcaaaagatg

SEQ ID NO: 87235 - DNA, 103 bp, Artificial Sequence
  Synthetic Polynucleotide
taatacgactcactatagggaaaagggttggttgcctcatacaacacagcaacagaggagagctgtgatgtatgaggcaaacctggcggcagcgcaaaagatg

SEQ ID NO: 87236 - DNA, 103 bp, Artificial Sequence
  Synthetic Polynucleotide
taatacgactcactatagggttatggcaggaaaagggttggttgcctcataacagaggagaatgaggatgccaacccttaacctggcggcagcgcaaaagatg

SEQ ID NO: 87237 - DNA, 103 bp, Artificial Sequence
  Synthetic Polynucleotide
taatacgactcactatagggaagggatccattatggcaggaaaagggttgaacagaggagacaacccatgtcctgccataacctggcggcagcgcaaaagatg

SEQ ID NO: 87238 - DNA, 103 bp, Artificial Sequence
  Synthetic Polynucleotide
taatacgactcactatagggccttagtggtaagggatccattatggcaggaacagaggagacctgccatgatggatcccaacctggcggcagcgcaaaagatg

SEQ ID NO: 87239 - DNA, 103 bp, Artificial Sequence
  Synthetic Polynucleotide
taatacgactcactatagggcatttttagtccttagtggtaagggatccaaacagaggagatggatcatgtaccactaaaacctggcggcagcgcaaaagatg

SEQ ID NO: 87240 - DNA, 103 bp, Artificial Sequence
  Synthetic Polynucleotide
taatacgactcactatagggccactagtgccatttttagtccttagtggtaacagaggagaaccactatggactaaaaaaacctggcggcagcgcaaaagatg

SEQ ID NO: 87241 - DNA, 103 bp, Artificial Sequence
  Synthetic Polynucleotide
taatacgactcactatagggcaaacggtccaactctgtattaagtcggtcaacagaggagagaccgaatgaatacagagaacctggcggcagcgcaaaagatg

SEQ ID NO: 87242 - DNA, 103 bp, Artificial Sequence
  Synthetic Polynucleotide
taatacgactcactatagggagagtcttttccactagtgccatttttagtaacagaggagaactaaaatgggcactagtaacctggcggcagcgcaaaagatg

SEQ ID NO: 87243 - DNA, 103 bp, Artificial Sequence
  Synthetic Polynucleotide
taatacgactcactatagggatgtggtagcagagtcttttccactagtgcaacagaggagagcactaatggaaaagactaacctggcggcagcgcaaaagatg

SEQ ID NO: 87244 - DNA, 103 bp, Artificial Sequence
  Synthetic Polynucleotide
taatacgactcactatagggcttagagtggatgtggtagcagagtcttttaacagaggagaaaaagaatgtgctaccacaacctggcggcagcgcaaaagatg

SEQ ID NO: 87245 - DNA, 103 bp, Artificial Sequence
  Synthetic Polynucleotide
taatacgactcactatagggagagtccttgcttagagtggatgtggtagcaacagaggagagctaccatgtccactctaaacctggcggcagcgcaaaagatg

SEQ ID NO: 87246 - DNA, 103 bp, Artificial Sequence
  Synthetic Polynucleotide
taatacgactcactatagggtaggattgagagagtccttgcttagagtggaacagaggagaccactcatggcaaggactaacctggcggcagcgcaaaagatg

SEQ ID NO: 87247 - DNA, 103 bp, Artificial Sequence
  Synthetic Polynucleotide
taatacgactcactatagggaggagggaactaggattgagagagtccttgaacagaggagacaaggaatgtctcaatccaacctggcggcagcgcaaaagatg

SEQ ID NO: 87248 - DNA, 103 bp, Artificial Sequence
  Synthetic Polynucleotide
taatacgactcactatagggcatggcagccaggagggaactaggattgagaacagaggagactcaatatgagttccctcaacctggcggcagcgcaaaagatg

SEQ ID NO: 87249 - DNA, 103 bp, Artificial Sequence
  Synthetic Polynucleotide
taatacgactcactatagggcttgttgcatcatggcagccaggagggaacaacagaggagagttcccatgtggctgccaaacctggcggcagcgcaaaagatg

SEQ ID NO: 87250 - DNA, 103 bp, Artificial Sequence
  Synthetic Polynucleotide
taatacgactcactatagggatagactcatcttgttgcatcatggcagccaacagaggagaggctgcatggatgcaacaaacctggcggcagcgcaaaagatg

SEQ ID NO: 87251 - DNA, 103 bp, Artificial Sequence
  Synthetic Polynucleotide
taatacgactcactatagggatagagataaatagactcatcttgttgcataacagaggagaatgcaaatggatgagtctaacctggcggcagcgcaaaagatg

SEQ ID NO: 87252 - DNA, 103 bp, Artificial Sequence
  Synthetic Polynucleotide
taatacgactcactataggggcaggctagccaaacggtccaactctgtataacagaggagaatacagatgtggaccgttaacctggcggcagcgcaaaagatg

SEQ ID NO: 87253 - DNA, 103 bp, Artificial Sequence
  Synthetic Polynucleotide
taatacgactcactatagggttgaagcaggatagagataaatagactcataacagaggagaatgagtatgtttatctctaacctggcggcagcgcaaaagatg

SEQ ID NO: 87254 - DNA, 103 bp, Artificial Sequence
  Synthetic Polynucleotide
taatacgactcactatagggcttgaagtacttgaagcaggatagagataaaacagaggagattatctatgtcctgcttcaacctggcggcagcgcaaaagatg

SEQ ID NO: 87255 - DNA, 103 bp, Artificial Sequence
  Synthetic Polynucleotide
taatacgactcactatagggaggtgcagtacttgaagtacttgaagcaggaacagaggagacctgctatgagtacttcaaacctggcggcagcgcaaaagatg

SEQ ID NO: 87256 - DNA, 103 bp, Artificial Sequence
  Synthetic Polynucleotide
taatacgactcactatagggtgttttcaaaaggtgcagtacttgaagtacaacagaggagagtacttatggtactgcacaacctggcggcagcgcaaaagatg

SEQ ID NO: 87257 - DNA, 103 bp, Artificial Sequence
  Synthetic Polynucleotide
taatacgactcactatagggttgaaaaagttgttttcaaaaggtgcagtaaacagaggagatactgcatgttttgaaaaaacctggcggcagcgcaaaagatg

SEQ ID NO: 87258 - DNA, 103 bp, Artificial Sequence
  Synthetic Polynucleotide
taatacgactcactatagggcatagattcgttgaaaaagttgttttcaaaaacagaggagatttgaaatgaactttttcaacctggcggcagcgcaaaagatg

SEQ ID NO: 87259 - DNA, 103 bp, Artificial Sequence
  Synthetic Polynucleotide
taatacgactcactatagggtgcattcattcatagattcgttgaaaaagtaacagaggagaacttttatgacgaatctaaacctggcggcagcgcaaaagatg

SEQ ID NO: 87260 - DNA, 103 bp, Artificial Sequence
  Synthetic Polynucleotide
taatacgactcactatagggtgccaatttctgcattcattcatagattcgaacagaggagacgaatcatggaatgaatgaacctggcggcagcgcaaaagatg

SEQ ID NO: 87261 - DNA, 103 bp, Artificial Sequence
  Synthetic Polynucleotide
taatacgactcactatagggagtattatcttgccaatttctgcattcattaacagaggagaaatgaaatgagaaattggaacctggcggcagcgcaaaagatg

SEQ ID NO: 87262 - DNA, 103 bp, Artificial Sequence
  Synthetic Polynucleotide
taatacgactcactatagggccatcggtgcagtattatcttgccaatttcaacagaggagagaaattatgaagataataaacctggcggcagcgcaaaagatg

SEQ ID NO: 87263 - DNA, 103 bp, Artificial Sequence
  Synthetic Polynucleotide
taatacgactcactataggggggaaaggcagcaggctagccaaacggtccaacagaggagaggaccgatgggctagcctaacctggcggcagcgcaaaagatg

SEQ ID NO: 87264 - DNA, 103 bp, Artificial Sequence
  Synthetic Polynucleotide
taatacgactcactataggggtatcatttcccatcggtgcagtattatctaacagaggagaagataaatgtgcaccgataacctggcggcagcgcaaaagatg

SEQ ID NO: 87265 - DNA, 103 bp, Artificial Sequence
  Synthetic Polynucleotide
taatacgactcactatagggtttcaggatagtatcatttcccatcggtgcaacagaggagagcaccgatgggaaatgataacctggcggcagcgcaaaagatg

SEQ ID NO: 87266 - DNA, 103 bp, Artificial Sequence
  Synthetic Polynucleotide
taatacgactcactatagggtttgctcatgtttcaggatagtatcatttcaacagaggagagaaatgatgctatcctgaaacctggcggcagcgcaaaagatg

SEQ ID NO: 87267 - DNA, 103 bp, Artificial Sequence
  Synthetic Polynucleotide
taatacgactcactatagggggctggtcaatttgctcatgtttcaggataaacagaggagatatcctatgacatgagcaaacctggcggcagcgcaaaagatg

SEQ ID NO: 87268 - DNA, 103 bp, Artificial Sequence
  Synthetic Polynucleotide
taatacgactcactatagggcacatcctgaggctggtcaatttgctcatgaacagaggagacatgagatgattgaccagaacctggcggcagcgcaaaagatg

SEQ ID NO: 87269 - DNA, 103 bp, Artificial Sequence
  Synthetic Polynucleotide
taatacgactcactatagggcaaatgagttcacatcctgaggctggtcaaaacagaggagattgaccatgctcaggatgaacctggcggcagcgcaaaagatg

SEQ ID NO: 87270 - DNA, 103 bp, Artificial Sequence
  Synthetic Polynucleotide
taatacgactcactatagggtgacctccagcaaatgagttcacatcctgaaacagaggagatcaggaatggaactcattaacctggcggcagcgcaaaagatg

SEQ ID NO: 87271 - DNA, 103 bp, Artificial Sequence
  Synthetic Polynucleotide
taatacgactcactataggggagccctgggtgacctccagcaaatgagttaacagaggagaaactcaatggctggaggtaacctggcggcagcgcaaaagatg

SEQ ID NO: 87272 - DNA, 103 bp, Artificial Sequence
  Synthetic Polynucleotide
taatacgactcactatagggtatcttgaaagagccctgggtgacctccagaacagaggagactggagatgacccagggcaacctggcggcagcgcaaaagatg

SEQ ID NO: 87273 - DNA, 103 bp, Artificial Sequence
  Synthetic Polynucleotide
taatacgactcactatagggctgtttttactatcttgaaagagccctgggaacagaggagacccaggatgctttcaagaaacctggcggcagcgcaaaagatg

SEQ ID NO: 87274 - DNA, 103 bp, Artificial Sequence
  Synthetic Polynucleotide
taatacgactcactatagggaacatcttgtgggaaaggcagcaggctagcaacagaggagagctagcatgctgcctttcaacctggcggcagcgcaaaagatg

SEQ ID NO: 87275 - DNA, 103 bp, Artificial Sequence
  Synthetic Polynucleotide
taatacgactcactataggggtacaagtcactgtttttactatcttgaaaaacagaggagatttcaaatgagtaaaaacaacctggcggcagcgcaaaagatg

SEQ ID NO: 87276 - DNA, 103 bp, Artificial Sequence
  Synthetic Polynucleotide
taatacgactcactatagggtcattatgctgtacaagtcactgtttttacaacagaggagagtaaaaatggtgacttgtaacctggcggcagcgcaaaagatg

SEQ ID NO: 87277 - DNA, 103 bp, Artificial Sequence
  Synthetic Polynucleotide
taatacgactcactatagggcctaggtttttcattatgctgtacaagtcaaacagaggagatgacttatgcagcataataacctggcggcagcgcaaaagatg

SEQ ID NO: 87278 - DNA, 103 bp, Artificial Sequence
  Synthetic Polynucleotide
taatacgactcactatagggaaaatcaatgcctaggtttttcattatgctaacagaggagaagcataatgaaaaacctaaacctggcggcagcgcaaaagatg

SEQ ID NO: 87279 - DNA, 103 bp, Artificial Sequence
  Synthetic Polynucleotide
taatacgactcactatagggtgatgtcttcaaaatcaatgcctaggttttaacagaggagaaaaaccatggcattgattaacctggcggcagcgcaaaagatg

SEQ ID NO: 87280 - DNA, 103 bp, Artificial Sequence
  Synthetic Polynucleotide
taatacgactcactatagggtgcatgtgtctgatgtcttcaaaatcaatgaacagaggagacattgaatgtgaagacataacctggcggcagcgcaaaagatg

SEQ ID NO: 87281 - DNA, 103 bp, Artificial Sequence
  Synthetic Polynucleotide
taatacgactcactatagggtttttcattctgcatgtgtctgatgtcttcaacagaggagagaagacatgagacacatgaacctggcggcagcgcaaaagatg

SEQ ID NO: 87282 - DNA, 103 bp, Artificial Sequence
  Synthetic Polynucleotide
taatacgactcactatagggttctgaaaaatttttcattctgcatgtgtcaacagaggagagacacaatgagaatgaaaaacctggcggcagcgcaaaagatg

SEQ ID NO: 87283 - DNA, 103 bp, Artificial Sequence
  Synthetic Polynucleotide
taatacgactcactataggggaaaaatcatttctgaaaaatttttcattcaacagaggagagaatgaatgatttttcagaacctggcggcagcgcaaaagatg

SEQ ID NO: 87284 - DNA, 103 bp, Artificial Sequence
  Synthetic Polynucleotide
taatacgactcactatagggaacctcaccagaaaaatcatttctgaaaaaaacagaggagatttttcatgaatgattttaacctggcggcagcgcaaaagatg

SEQ ID NO: 87285 - DNA, 103 bp, Artificial Sequence
  Synthetic Polynucleotide
taatacgactcactatagggacttattaataacatcttgtgggaaaggcaaacagaggagatgccttatgcacaagatgaacctggcggcagcgcaaaagatg

SEQ ID NO: 87286 - DNA, 103 bp, Artificial Sequence
  Synthetic Polynucleotide
taatacgactcactatagggctctgaagtcaacctcaccagaaaaatcataacagaggagaatgattatgctggtgaggaacctggcggcagcgcaaaagatg

SEQ ID NO: 87287 - DNA, 103 bp, Artificial Sequence
  Synthetic Polynucleotide
taatacgactcactatagggaagtcaatgtctctgaagtcaacctcaccaaacagaggagatggtgaatgtgacttcagaacctggcggcagcgcaaaagatg

SEQ ID NO: 87288 - DNA, 103 bp, Artificial Sequence
  Synthetic Polynucleotide
taatacgactcactatagggttcatccgttaagtcaatgtctctgaagtcaacagaggagagacttcatggacattgacaacctggcggcagcgcaaaagatg

SEQ ID NO: 87289 - DNA, 103 bp, Artificial Sequence
  Synthetic Polynucleotide
taatacgactcactatagggacgtcaggatttcatccgttaagtcaatgtaacagaggagaacattgatgtaacggatgaacctggcggcagcgcaaaagatg

SEQ ID NO: 87290 - DNA, 103 bp, Artificial Sequence
  Synthetic Polynucleotide
taatacgactcactatagggtcttggacatacgtcaggatttcatccgttaacagaggagaaacggaatgaatcctgacaacctggcggcagcgcaaaagatg

SEQ ID NO: 87291 - DNA, 103 bp, Artificial Sequence
  Synthetic Polynucleotide
taatacgactcactatagggacttaaagaatcttggacatacgtcaggataacagaggagaatcctgatgtatgtccaaaacctggcggcagcgcaaaagatg

SEQ ID NO: 87292 - DNA, 103 bp, Artificial Sequence
  Synthetic Polynucleotide
taatacgactcactatagggagggagacttacttaaagaatcttggacataacagaggagaatgtccatgattctttaaaacctggcggcagcgcaaaagatg

SEQ ID NO: 87293 - DNA, 103 bp, Artificial Sequence
  Synthetic Polynucleotide
taatacgactcactataggggaaggtatgaagggagacttacttaaagaaaacagaggagattctttatgtaagtctccaacctggcggcagcgcaaaagatg

SEQ ID NO: 87294 - DNA, 103 bp, Artificial Sequence
  Synthetic Polynucleotide
taatacgactcactatagggttgataatctgaaggtatgaagggagacttaacagaggagaaagtctatgttcatacctaacctggcggcagcgcaaaagatg

SEQ ID NO: 87295 - DNA, 103 bp, Artificial Sequence
  Synthetic Polynucleotide
taatacgactcactatagggactgttgctgttgataatctgaaggtatgaaacagaggagatcatacatgcagattatcaacctggcggcagcgcaaaagatg

SEQ ID NO: 87296 - DNA, 103 bp, Artificial Sequence
  Synthetic Polynucleotide
taatacgactcactatagggagtttgtccaacttattaataacatcttgtaacagaggagaacaagaatgtattaataaaacctggcggcagcgcaaaagatg

SEQ ID NO: 87297 - DNA, 103 bp, Artificial Sequence
  Synthetic Polynucleotide
taatacgactcactatagggagagccaaggactgttgctgttgataatctaacagaggagaagattaatgacagcaacaaacctggcggcagcgcaaaagatg

SEQ ID NO: 87298 - DNA, 103 bp, Artificial Sequence
  Synthetic Polynucleotide
taatacgactcactataggggcttgagttcagagccaaggactgttgctgaacagaggagacagcaaatgtccttggctaacctggcggcagcgcaaaagatg

SEQ ID NO: 87299 - DNA, 103 bp, Artificial Sequence
  Synthetic Polynucleotide
taatacgactcactataggggtaccatacagcttgagttcagagccaaggaacagaggagaccttggatgtgaactcaaaacctggcggcagcgcaaaagatg

SEQ ID NO: 87300 - DNA, 103 bp, Artificial Sequence
  Synthetic Polynucleotide
taatacgactcactatagggaggtgttcctgtaccatacagcttgagttcaacagaggagagaactcatgctgtatggtaacctggcggcagcgcaaaagatg

SEQ ID NO: 87301 - DNA, 103 bp, Artificial Sequence
  Synthetic Polynucleotide
taatacgactcactatagggttctagatgtaggtgttcctgtaccatacaaacagaggagatgtatgatgcaggaacacaacctggcggcagcgcaaaagatg

SEQ ID NO: 87302 - DNA, 103 bp, Artificial Sequence
  Synthetic Polynucleotide
taatacgactcactataggggctgttgctgttctagatgtaggtgttcctaacagaggagaaggaacatgtacatctagaacctggcggcagcgcaaaagatg

SEQ ID NO: 87303 - DNA, 103 bp, Artificial Sequence
  Synthetic Polynucleotide
taatacgactcactatagggtggtgatgttgctgttgctgttctagatgtaacagaggagaacatctatgacagcaacaaacctggcggcagcgcaaaagatg

SEQ ID NO: 87304 - DNA, 103 bp, Artificial Sequence
  Synthetic Polynucleotide
taatacgactcactatagggtacttgcttttggtgatgttgctgttgctgaacagaggagacagcaaatgcaacatcacaacctggcggcagcgcaaaagatg

SEQ ID NO: 87305 - DNA, 103 bp, Artificial Sequence
  Synthetic Polynucleotide
taatacgactcactataggggctccactactacttgcttttggtgatgttaacagaggagaaacatcatgaaaagcaagaacctggcggcagcgcaaaagatg

SEQ ID NO: 87306 - DNA, 103 bp, Artificial Sequence
  Synthetic Polynucleotide
taatacgactcactatagggtgttgctgtggctccactactacttgctttaacagaggagaaaagcaatgagtagtggaaacctggcggcagcgcaaaagatg

SEQ ID NO: 87307 - DNA, 103 bp, Artificial Sequence
  Synthetic Polynucleotide
taatacgactcactatagggaagaactgaaagtttgtccaacttattaataacagaggagaattaatatgttggacaaaaacctggcggcagcgcaaaagatg

SEQ ID NO: 87308 - DNA, 103 bp, Artificial Sequence
  Synthetic Polynucleotide
taatacgactcactatagggctgacacagctgttgctgtggctccactacaacagaggagagtagtgatgccacagcaaaacctggcggcagcgcaaaagatg

SEQ ID NO: 87309 - DNA, 103 bp, Artificial Sequence
  Synthetic Polynucleotide
taatacgactcactataggggcttcatcttctgacacagctgttgctgtgaacagaggagacacagcatgagctgtgtcaacctggcggcagcgcaaaagatg

SEQ ID NO: 87310 - DNA, 103 bp, Artificial Sequence
  Synthetic Polynucleotide
taatacgactcactatagggacttgcatgtgcttcatcttctgacacagcaacagaggagagctgtgatggaagatgaaaacctggcggcagcgcaaaagatg

SEQ ID NO: 87311 - DNA, 103 bp, Artificial Sequence
  Synthetic Polynucleotide
taatacgactcactatagggcatgccattaacttgcatgtgcttcatcttaacagaggagaaagatgatgcacatgcaaaacctggcggcagcgcaaaagatg

SEQ ID NO: 87312 - DNA, 103 bp, Artificial Sequence
  Synthetic Polynucleotide
taatacgactcactatagggaattttcaaacatgccattaacttgcatgtaacagaggagaacatgcatgttaatggcaaacctggcggcagcgcaaaagatg

SEQ ID NO: 87313 - DNA, 103 bp, Artificial Sequence
  Synthetic Polynucleotide
taatacgactcactatagggttagagttccaattttcaaacatgccattaaacagaggagataatggatggtttgaaaaaacctggcggcagcgcaaaagatg

SEQ ID NO: 87314 - DNA, 103 bp, Artificial Sequence
  Synthetic Polynucleotide
taatacgactcactatagggcacgaattggttagagttccaattttcaaaaacagaggagatttgaaatgtggaactctaacctggcggcagcgcaaaagatg

SEQ ID NO: 87315 - DNA, 103 bp, Artificial Sequence
  Synthetic Polynucleotide
taatacgactcactatagggaattgaaaggcacgaattggttagagttccaacagaggagaggaactatgaccaattcgaacctggcggcagcgcaaaagatg

SEQ ID NO: 87316 - DNA, 103 bp, Artificial Sequence
  Synthetic Polynucleotide
taatacgactcactatagggtgctgtggacaattgaaaggcacgaattggaacagaggagaccaattatggcctttcaaaacctggcggcagcgcaaaagatg

SEQ ID NO: 87317 - DNA, 103 bp, Artificial Sequence
  Synthetic Polynucleotide
taatacgactcactatagggttgtgggtcttgctgtggacaattgaaaggaacagaggagacctttcatgtgtccacagaacctggcggcagcgcaaaagatg

SEQ ID NO: 87318 - DNA, 103 bp, Artificial Sequence
  Synthetic Polynucleotide
taatacgactcactatagggtgcgactggcgtaggtgatgttggcgctgcaacagaggagagcagcgatgacatcacctaacctggcggcagcgcaaaagatg

SEQ ID NO: 87319 - DNA, 103 bp, Artificial Sequence
  Synthetic Polynucleotide
taatacgactcactatagggcgctgagcctaagaactgaaagtttgtccaaacagaggagatggacaatgtttcagttcaacctggcggcagcgcaaaagatg

SEQ ID NO: 87320 - DNA, 103 bp, Artificial Sequence
  Synthetic Polynucleotide
taatacgactcactatagggcattatattgttgtgggtcttgctgtggacaacagaggagagtccacatgaagacccacaacctggcggcagcgcaaaagatg

SEQ ID NO: 87321 - DNA, 103 bp, Artificial Sequence
  Synthetic Polynucleotide
taatacgactcactatagggtctgtaaagacattatattgttgtgggtctaacagaggagaagacccatgacaatataaaacctggcggcagcgcaaaagatg

SEQ ID NO: 87322 - DNA, 103 bp, Artificial Sequence
  Synthetic Polynucleotide
taatacgactcactatagggcccatgtaagtctgtaaagacattatattgaacagaggagacaatatatggtctttacaaacctggcggcagcgcaaaagatg

SEQ ID NO: 87323 - DNA, 103 bp, Artificial Sequence
  Synthetic Polynucleotide
taatacgactcactatagggcttgactgatcccatgtaagtctgtaaagaaacagaggagatctttaatgacttacatgaacctggcggcagcgcaaaagatg

SEQ ID NO: 87324 - DNA, 103 bp, Artificial Sequence
  Synthetic Polynucleotide
taatacgactcactatagggtaggggaactcttgactgatcccatgtaagaacagaggagacttacaatggatcagtcaaacctggcggcagcgcaaaagatg

SEQ ID NO: 87325 - DNA, 103 bp, Artificial Sequence
  Synthetic Polynucleotide
taatacgactcactatagggttcagatttgtaggggaactcttgactgataacagaggagaatcagtatggagttccccaacctggcggcagcgcaaaagatg

SEQ ID NO: 87326 - DNA, 103 bp, Artificial Sequence
  Synthetic Polynucleotide
taatacgactcactatagggtagaatccatttcagatttgtaggggaactaacagaggagaagttccatgacaaatctgaacctggcggcagcgcaaaagatg

SEQ ID NO: 87327 - DNA, 103 bp, Artificial Sequence
  Synthetic Polynucleotide
taatacgactcactataggggtataaggcatagaatccatttcagatttgaacagaggagacaaatcatgaatggattcaacctggcggcagcgcaaaagatg

SEQ ID NO: 87328 - DNA, 103 bp, Artificial Sequence
  Synthetic Polynucleotide
taatacgactcactatagggaaagttctgtgtataaggcatagaatccataacagaggagaatggatatgatgccttataacctggcggcagcgcaaaagatg

SEQ ID NO: 87329 - DNA, 103 bp, Artificial Sequence
  Synthetic Polynucleotide
taatacgactcactatagggtacaggaaataaagttctgtgtataaggcaaacagaggagatgccttatgcacagaactaacctggcggcagcgcaaaagatg

SEQ ID NO: 87330 - DNA, 103 bp, Artificial Sequence
  Synthetic Polynucleotide
taatacgactcactatagggaggtaactgacgctgagcctaagaactgaaaacagaggagattcagtatgtaggctcagaacctggcggcagcgcaaaagatg

SEQ ID NO: 87331 - DNA, 103 bp, Artificial Sequence
  Synthetic Polynucleotide
taatacgactcactatagggacaggctgattacaggaaataaagttctgtaacagaggagaacagaaatgtatttcctgaacctggcggcagcgcaaaagatg

SEQ ID NO: 87332 - DNA, 103 bp, Artificial Sequence
  Synthetic Polynucleotide
taatacgactcactatagggttgtggtaatacaggctgattacaggaaataacagaggagaatttccatgaatcagcctaacctggcggcagcgcaaaagatg

SEQ ID NO: 87333 - DNA, 103 bp, Artificial Sequence
  Synthetic Polynucleotide
taatacgactcactatagggatttggaatgttgtggtaatacaggctgataacagaggagaatcagcatgtattaccacaacctggcggcagcgcaaaagatg

SEQ ID NO: 87334 - DNA, 103 bp, Artificial Sequence
  Synthetic Polynucleotide
taatacgactcactatagggagctctgtacatttggaatgttgtggtaataacagaggagaattaccatgacattccaaaacctggcggcagcgcaaaagatg

SEQ ID NO: 87335 - DNA, 103 bp, Artificial Sequence
  Synthetic Polynucleotide
taatacgactcactatagggagggtagtccagctctgtacatttggaatgaacagaggagacattccatgtgtacagagaacctggcggcagcgcaaaagatg

SEQ ID NO: 87336 - DNA, 103 bp, Artificial Sequence
  Synthetic Polynucleotide
taatacgactcactatagggaactccccatagggtagtccagctctgtacaacagaggagagtacagatgtggactaccaacctggcggcagcgcaaaagatg

SEQ ID NO: 87337 - DNA, 103 bp, Artificial Sequence
  Synthetic Polynucleotide
taatacgactcactataggggatggttcaaaactccccatagggtagtccaacagaggagaggactaatgtatggggagaacctggcggcagcgcaaaagatg

SEQ ID NO: 87338 - DNA, 103 bp, Artificial Sequence
  Synthetic Polynucleotide
taatacgactcactatagggggggtatggggatggttcaaaactccccataacagaggagaatggggatgtttgaaccaaacctggcggcagcgcaaaagatg

SEQ ID NO: 87339 - DNA, 103 bp, Artificial Sequence
  Synthetic Polynucleotide
taatacgactcactatagggtagaagtagtggggtatggggatggttcaaaacagaggagattgaacatgccccataccaacctggcggcagcgcaaaagatg

SEQ ID NO: 87340 - DNA, 103 bp, Artificial Sequence
  Synthetic Polynucleotide
taatacgactcactatagggtcttctaaactagaagtagtggggtatgggaacagaggagacccataatgcactacttcaacctggcggcagcgcaaaagatg

SEQ ID NO: 87341 - DNA, 103 bp, Artificial Sequence
  Synthetic Polynucleotide
taatacgactcactatagggcttggctctcaggtaactgacgctgagcctaacagaggagaaggctcatggtcagttacaacctggcggcagcgcaaaagatg

SEQ ID NO: 87342 - DNA, 103 bp, Artificial Sequence
  Synthetic Polynucleotide
taatacgactcactatagggagtgacaaaatcttctaaactagaagtagtaacagaggagaactactatgagtttagaaaacctggcggcagcgcaaaagatg

SEQ ID NO: 87343 - DNA, 103 bp, Artificial Sequence
  Synthetic Polynucleotide
taatacgactcactataggggttgtaaacaagtgacaaaatcttctaaacaacagaggagagtttagatgattttgtcaaacctggcggcagcgcaaaagatg

SEQ ID NO: 87344 - DNA, 103 bp, Artificial Sequence
  Synthetic Polynucleotide
taatacgactcactatagggttttcaggaagttgtaaacaagtgacaaaaaacagaggagattttgtatgttgtttacaaacctggcggcagcgcaaaagatg

SEQ ID NO: 87345 - DNA, 103 bp, Artificial Sequence
  Synthetic Polynucleotide
taatacgactcactatagggatgcttttggttttcaggaagttgtaaacaaacagaggagatgtttaatgcttcctgaaaacctggcggcagcgcaaaagatg

SEQ ID NO: 87346 - DNA, 103 bp, Artificial Sequence
  Synthetic Polynucleotide
taatacgactcactataggggatttaatccatgcttttggttttcaggaaaacagaggagattcctgatgaccaaaagcaacctggcggcagcgcaaaagatg

SEQ ID NO: 87347 - DNA, 103 bp, Artificial Sequence
  Synthetic Polynucleotide
taatacgactcactataggggctgactgtggatttaatccatgcttttggaacagaggagaccaaaaatgtggattaaaaacctggcggcagcgcaaaagatg

SEQ ID NO: 87348 - DNA, 103 bp, Artificial Sequence
  Synthetic Polynucleotide
taatacgactcactatagggagttattatggctgactgtggatttaatccaacagaggagaggattaatgccacagtcaaacctggcggcagcgcaaaagatg

SEQ ID NO: 87349 - DNA, 103 bp, Artificial Sequence
  Synthetic Polynucleotide
taatacgactcactatagggatgtctgaggagttattatggctgactgtgaacagaggagacacagtatgccataataaaacctggcggcagcgcaaaagatg

SEQ ID NO: 87350 - DNA, 103 bp, Artificial Sequence
  Synthetic Polynucleotide
taatacgactcactatagggccagcataacatgtctgaggagttattatgaacagaggagacataatatgtcctcagacaacctggcggcagcgcaaaagatg

SEQ ID NO: 87351 - DNA, 103 bp, Artificial Sequence
  Synthetic Polynucleotide
taatacgactcactatagggcgacacggccccagcataacatgtctgaggaacagaggagacctcagatgtgttatgctaacctggcggcagcgcaaaagatg

SEQ ID NO: 87352 - DNA, 103 bp, Artificial Sequence
  Synthetic Polynucleotide
taatacgactcactatagggcaaagaagctcttggctctcaggtaactgaaacagaggagatcagttatgtgagagccaaacctggcggcagcgcaaaagatg

SEQ ID NO: 87353 - DNA, 103 bp, Artificial Sequence
  Synthetic Polynucleotide
taatacgactcactatagggactgatacatcgacacggccccagcataacaacagaggagagttatgatggggccgtgtaacctggcggcagcgcaaaagatg

SEQ ID NO: 87354 - DNA, 103 bp, Artificial Sequence
  Synthetic Polynucleotide
taatacgactcactatagggtctggctggcactgatacatcgacacggccaacagaggagaggccgtatggatgtatcaaacctggcggcagcgcaaaagatg

SEQ ID NO: 87355 - DNA, 103 bp, Artificial Sequence
  Synthetic Polynucleotide
taatacgactcactataggggtgctgaggttctggctggcactgatacataacagaggagaatgtatatgtgccagccaaacctggcggcagcgcaaaagatg

SEQ ID NO: 87356 - DNA, 103 bp, Artificial Sequence
  Synthetic Polynucleotide
taatacgactcactatagggccacgtgggtgtgctgaggttctggctggcaacagaggagagccagcatgaacctcagcaacctggcggcagcgcaaaagatg

SEQ ID NO: 87357 - DNA, 103 bp, Artificial Sequence
  Synthetic Polynucleotide
taatacgactcactatagggtgcatctgacccacgtgggtgtgctgaggtaacagaggagaacctcaatgcacccacgtaacctggcggcagcgcaaaagatg

SEQ ID NO: 87358 - DNA, 103 bp, Artificial Sequence
  Synthetic Polynucleotide
taatacgactcactatagggtggattgtactgcatctgacccacgtgggtaacagaggagaacccacatgggtcagatgaacctggcggcagcgcaaaagatg

SEQ ID NO: 87359 - DNA, 103 bp, Artificial Sequence
  Synthetic Polynucleotide
taatacgactcactatagggctggcagtactggattgtactgcatctgacaacagaggagagtcagaatgagtacaatcaacctggcggcagcgcaaaagatg

SEQ ID NO: 87360 - DNA, 103 bp, Artificial Sequence
  Synthetic Polynucleotide
taatacgactcactataggggcctgttggcctggcagtactggattgtacaacagaggagagtacaaatgagtactgccaacctggcggcagcgcaaaagatg

SEQ ID NO: 87361 - DNA, 103 bp, Artificial Sequence
  Synthetic Polynucleotide
taatacgactcactataggggtttaaaaatgcctgttggcctggcagtacaacagaggagagtactgatgggccaacagaacctggcggcagcgcaaaagatg

SEQ ID NO: 87362 - DNA, 103 bp, Artificial Sequence
  Synthetic Polynucleotide
taatacgactcactatagggtctgaaacttgtttaaaaatgcctgttggcaacagaggagagccaacatgcatttttaaaacctggcggcagcgcaaaagatg

SEQ ID NO: 87363 - DNA, 103 bp, Artificial Sequence
  Synthetic Polynucleotide
taatacgactcactatagggaatgcaacatcaaagaagctcttggctctcaacagaggagagagagcatggagcttcttaacctggcggcagcgcaaaagatg

SEQ ID NO: 87364 - DNA, 103 bp, Artificial Sequence
  Synthetic Polynucleotide
taatacgactcactatagggaaaactccattctgaaacttgtttaaaaataacagaggagaatttttatgcaagtttcaaacctggcggcagcgcaaaagatg

SEQ ID NO: 87365 - DNA, 103 bp, Artificial Sequence
  Synthetic Polynucleotide
taatacgactcactatagggtgtttcatttaaaactccattctgaaacttaacagaggagaaagtttatgaatggagttaacctggcggcagcgcaaaagatg

SEQ ID NO: 87366 - DNA, 103 bp, Artificial Sequence
  Synthetic Polynucleotide
taatacgactcactatagggcagctggatatgtttcatttaaaactccataacagaggagaatggagatgtaaatgaaaaacctggcggcagcgcaaaagatg

SEQ ID NO: 87367 - DNA, 103 bp, Artificial Sequence
  Synthetic Polynucleotide
taatacgactcactatagggttatttaattcagctggatatgtttcatttaacagaggagaaaatgaatgatatccagcaacctggcggcagcgcaaaagatg

SEQ ID NO: 87368 - DNA, 103 bp, Artificial Sequence
  Synthetic Polynucleotide
taatacgactcactataggggttatttatgttatttaattcagctggataaacagaggagatatccaatggaattaaataacctggcggcagcgcaaaagatg

SEQ ID NO: 87369 - DNA, 103 bp, Artificial Sequence
  Synthetic Polynucleotide
taatacgactcactatagggtagtctgagtgttatttatgttatttaattaacagaggagaaattaaatgacataaataaacctggcggcagcgcaaaagatg

SEQ ID NO: 87370 - DNA, 103 bp, Artificial Sequence
  Synthetic Polynucleotide
taatacgactcactatagggagatgtgtggtagtctgagtgttatttatgaacagaggagacataaaatgcactcagacaacctggcggcagcgcaaaagatg

SEQ ID NO: 87371 - DNA, 103 bp, Artificial Sequence
  Synthetic Polynucleotide
taatacgactcactatagggaagtggctgaagatgtgtggtagtctgagtaacagaggagaactcagatgaccacacataacctggcggcagcgcaaaagatg

SEQ ID NO: 87372 - DNA, 103 bp, Artificial Sequence
  Synthetic Polynucleotide
taatacgactcactatagggacggatgatgaagtggctgaagatgtgtggaacagaggagaccacacatgttcagccacaacctggcggcagcgcaaaagatg

SEQ ID NO: 87373 - DNA, 103 bp, Artificial Sequence
  Synthetic Polynucleotide
taatacgactcactatagggctggcttctgacggatgatgaagtggctgaaacagaggagatcagccatgtcatcatccaacctggcggcagcgcaaaagatg

SEQ ID NO: 87374 - DNA, 103 bp, Artificial Sequence
  Synthetic Polynucleotide
taatacgactcactatagggggaggattttaatgcaacatcaaagaagctaacagaggagaagcttcatggatgttgcaaacctggcggcagcgcaaaagatg

SEQ ID NO: 87375 - DNA, 103 bp, Artificial Sequence
  Synthetic Polynucleotide
taatacgactcactatagggaggaaaaggtctggcttctgacggatgatgaacagaggagacatcatatgtcagaagccaacctggcggcagcgcaaaagatg

SEQ ID NO: 87376 - DNA, 103 bp, Artificial Sequence
  Synthetic Polynucleotide
taatacgactcactatagggatgtcaaatcaggaaaaggtctggcttctgaacagaggagacagaagatggaccttttcaacctggcggcagcgcaaaagatg

SEQ ID NO: 87377 - DNA, 103 bp, Artificial Sequence
  Synthetic Polynucleotide
taatacgactcactatagggaatccactggatgtcaaatcaggaaaaggtaacagaggagaacctttatgtgatttgacaacctggcggcagcgcaaaagatg

SEQ ID NO: 87378 - DNA, 103 bp, Artificial Sequence
  Synthetic Polynucleotide
taatacgactcactatagggtttcagtaggggaggattttaatgcaacataacagaggagaatgttgatgtaaaatcctaacctggcggcagcgcaaaagatg

SEQ ID NO: 87379 - DNA, 103 bp, Artificial Sequence
  Synthetic Polynucleotide
taatacgactcactatagggcctccgtttctttcagtaggggaggattttaacagaggagaaaaatcatgccctactgaaacctggcggcagcgcaaaagatg

SEQ ID NO: 87380 - DNA, 103 bp, Artificial Sequence
  Synthetic Polynucleotide
taatacgactcactataggggttatcctggcctccgtttctttcagtaggaacagaggagacctactatgagaaacggaaacctggcggcagcgcaaaagatg

SEQ ID NO: 87381 - DNA, 103 bp, Artificial Sequence
  Synthetic Polynucleotide
taatacgactcactatagggctgctctacagttatcctggcctccgtttcaacagaggagagaaacgatggccaggataaacctggcggcagcgcaaaagatg

SEQ ID NO: 87382 - DNA, 103 bp, Artificial Sequence
  Synthetic Polynucleotide
taatacgactcactatagggttccgccgcttgcgactggcgtaggtgatgaacagaggagacatcacatgcgccagtcgaacctggcggcagcgcaaaagatg

SEQ ID NO: 87383 - DNA, 103 bp, Artificial Sequence
  Synthetic Polynucleotide
taatacgactcactatagggctgaaatttgctgctctacagttatcctggaacagaggagaccaggaatgctgtagagcaacctggcggcagcgcaaaagatg

SEQ ID NO: 87384 - DNA, 103 bp, Artificial Sequence
  Synthetic Polynucleotide
taatacgactcactatagggcaggccttctctgaaatttgctgctctacaaacagaggagatgtagaatggcaaatttcaacctggcggcagcgcaaaagatg

SEQ ID NO: 87385 - DNA, 103 bp, Artificial Sequence
  Synthetic Polynucleotide
taatacgactcactatagggcttgtaagttcaggccttctctgaaatttgaacagaggagacaaattatggagaaggccaacctggcggcagcgcaaaagatg

SEQ ID NO: 87386 - DNA, 103 bp, Artificial Sequence
  Synthetic Polynucleotide
taatacgactcactatagggaattctccttcttgtaagttcaggccttctaacagaggagaagaaggatggaacttacaaacctggcggcagcgcaaaagatg

SEQ ID NO: 87387 - DNA, 103 bp, Artificial Sequence
  Synthetic Polynucleotide
taatacgactcactatagggctgtaataagaattctccttcttgtaagttaacagaggagaaacttaatggaaggagaaaacctggcggcagcgcaaaagatg

SEQ ID NO: 87388 - DNA, 103 bp, Artificial Sequence
  Synthetic Polynucleotide
taatacgactcactatagggcattcagagcctgtaataagaattctccttaacagaggagaaaggagatgtcttattacaacctggcggcagcgcaaaagatg

SEQ ID NO: 87389 - DNA, 103 bp, Artificial Sequence
  Synthetic Polynucleotide
taatacgactcactatagggaatacaaagccattcagagcctgtaataagaacagaggagacttattatgggctctgaaaacctggcggcagcgcaaaagatg

SEQ ID NO: 87390 - DNA, 103 bp, Artificial Sequence
  Synthetic Polynucleotide
taatacgactcactatagggagtgacaactaatacaaagccattcagagcaacagaggagagctctgatgggctttgtaaacctggcggcagcgcaaaagatg

SEQ ID NO: 87391 - DNA, 103 bp, Artificial Sequence
  Synthetic Polynucleotide
taatacgactcactatagggaagcatctgtagtgacaactaatacaaagcaacagaggagagctttgatgtagttgtcaaacctggcggcagcgcaaaagatg

SEQ ID NO: 87392 - DNA, 103 bp, Artificial Sequence
  Synthetic Polynucleotide
taatacgactcactatagggtaaaagaccaaagcatctgtagtgacaactaacagaggagaagttgtatgtacagatgcaacctggcggcagcgcaaaagatg

SEQ ID NO: 87393 - DNA, 103 bp, Artificial Sequence
  Synthetic Polynucleotide
taatacgactcactatagggctgcaccggcttccgccgcttgcgactggcaacagaggagagccagtatgaagcggcggaacctggcggcagcgcaaaagatg

SEQ ID NO: 87394 - DNA, 103 bp, Artificial Sequence
  Synthetic Polynucleotide
taatacgactcactatagggagaagaagcataaaagaccaaagcatctgtaacagaggagaacagatatgttggtctttaacctggcggcagcgcaaaagatg

SEQ ID NO: 87395 - DNA, 103 bp, Artificial Sequence
  Synthetic Polynucleotide
taatacgactcactatagggcttgtatagtagaagaagcataaaagaccaaacagaggagatggtctatgatgcttcttaacctggcggcagcgcaaaagatg

SEQ ID NO: 87396 - DNA, 103 bp, Artificial Sequence
  Synthetic Polynucleotide
taatacgactcactatagggcctagataatcttgtatagtagaagaagcaaacagaggagatgcttcatgtactatacaaacctggcggcagcgcaaaagatg

SEQ ID NO: 87397 - DNA, 103 bp, Artificial Sequence
  Synthetic Polynucleotide
taatacgactcactatagggctgctgaaaccctagataatcttgtatagtaacagaggagaactataatggattatctaaacctggcggcagcgcaaaagatg

SEQ ID NO: 87398 - DNA, 103 bp, Artificial Sequence
  Synthetic Polynucleotide
taatacgactcactatagggtgacatcagactgctgaaaccctagataataacagaggagaattatcatgggtttcagcaacctggcggcagcgcaaaagatg

SEQ ID NO: 87399 - DNA, 103 bp, Artificial Sequence
  Synthetic Polynucleotide
taatacgactcactatagggctctgatgtatgacatcagactgctgaaacaacagaggagagtttcaatggtctgatgtaacctggcggcagcgcaaaagatg

SEQ ID NO: 87400 - DNA, 103 bp, Artificial Sequence
  Synthetic Polynucleotide
taatacgactcactatagggttcatatacactctgatgtatgacatcagaaacagaggagatctgatatgatacatcagaacctggcggcagcgcaaaagatg

SEQ ID NO: 87401 - DNA, 103 bp, Artificial Sequence
  Synthetic Polynucleotide
taatacgactcactatagggtatggataagttcatatacactctgatgtaaacagaggagatacatcatggtgtatatgaacctggcggcagcgcaaaagatg

SEQ ID NO: 87402 - DNA, 103 bp, Artificial Sequence
  Synthetic Polynucleotide
taatacgactcactatagggcggtcttcggtatggataagttcatatacaaacagaggagatgtataatgacttatccaaacctggcggcagcgcaaaagatg

SEQ ID NO: 87403 - DNA, 103 bp, Artificial Sequence
  Synthetic Polynucleotide
taatacgactcactatagggaaattcagctcggtcttcggtatggataagaacagaggagacttatcatgaccgaagacaacctggcggcagcgcaaaagatg

SEQ ID NO: 87404 - DNA, 103 bp, Artificial Sequence
  Synthetic Polynucleotide
taatacgactcactatagggttactgttttctgcaccggcttccgccgctaacagaggagaagcggcatgagccggtgcaacctggcggcagcgcaaaagatg

SEQ ID NO: 87405 - DNA, 103 bp, Artificial Sequence
  Synthetic Polynucleotide
taatacgactcactataggggctgacgctgaaattcagctcggtcttcggaacagaggagaccgaagatggagctgaataacctggcggcagcgcaaaagatg

SEQ ID NO: 87406 - DNA, 103 bp, Artificial Sequence
  Synthetic Polynucleotide
taatacgactcactataggggcccagtgtagctgacgctgaaattcagctaacagaggagaagctgaatgtcagcgtcaaacctggcggcagcgcaaaagatg

SEQ ID NO: 87407 - DNA, 103 bp, Artificial Sequence
  Synthetic Polynucleotide
taatacgactcactatagggaggatttaatgcccagtgtagctgacgctgaacagaggagacagcgtatgctacactggaacctggcggcagcgcaaaagatg

SEQ ID NO: 87408 - DNA, 103 bp, Artificial Sequence
  Synthetic Polynucleotide
taatacgactcactatagggtacactgagaaggatttaatgcccagtgtaaacagaggagatacactatgcattaaatcaacctggcggcagcgcaaaagatg

SEQ ID NO: 87409 - DNA, 103 bp, Artificial Sequence
  Synthetic Polynucleotide
taatacgactcactatagggccagactctgtacactgagaaggatttaataacagaggagaattaaaatgttctcagtgaacctggcggcagcgcaaaagatg

SEQ ID NO: 87410 - DNA, 103 bp, Artificial Sequence
  Synthetic Polynucleotide
taatacgactcactatagggaattccttgtccagactctgtacactgagaaacagaggagatctcagatgacagagtctaacctggcggcagcgcaaaagatg

SEQ ID NO: 87411 - DNA, 103 bp, Artificial Sequence
  Synthetic Polynucleotide
taatacgactcactatagggtggcttcttcaattccttgtccagactctgaacagaggagacagagtatggacaaggaaaacctggcggcagcgcaaaagatg

SEQ ID NO: 87412 - DNA, 103 bp, Artificial Sequence
  Synthetic Polynucleotide
taatacgactcactataggggggagaccagtggcttcttcaattccttgtaacagaggagaacaaggatgtgaagaagcaacctggcggcagcgcaaaagatg

SEQ ID NO: 87413 - DNA, 103 bp, Artificial Sequence
  Synthetic Polynucleotide
taatacgactcactatagggtactgtctgggggagaccagtggcttcttcaacagaggagagaagaaatgactggtctcaacctggcggcagcgcaaaagatg

SEQ ID NO: 87414 - DNA, 103 bp, Artificial Sequence
  Synthetic Polynucleotide
taatacgactcactatagggtataacagactactgtctgggggagaccagaacagaggagactggtcatgcccagacagaacctggcggcagcgcaaaagatg

SEQ ID NO: 87415 - DNA, 103 bp, Artificial Sequence
  Synthetic Polynucleotide
taatacgactcactataggggggattggctttactgttttctgcaccggcaacagaggagagccggtatggaaaacagtaacctggcggcagcgcaaaagatg

SEQ ID NO: 87416 - DNA, 103 bp, Artificial Sequence
  Synthetic Polynucleotide
taatacgactcactatagggtggtctgggttataacagactactgtctggaacagaggagaccagacatgagtctgttaaacctggcggcagcgcaaaagatg

SEQ ID NO: 87417 - DNA, 103 bp, Artificial Sequence
  Synthetic Polynucleotide
taatacgactcactatagggtggaggaatctggtctgggttataacagacaacagaggagagtctgtatgaacccagacaacctggcggcagcgcaaaagatg

SEQ ID NO: 87418 - DNA, 103 bp, Artificial Sequence
  Synthetic Polynucleotide
taatacgactcactataggggagagttttctggaggaatctggtctgggtaacagaggagaacccagatgagattcctcaacctggcggcagcgcaaaagatg

SEQ ID NO: 87419 - DNA, 103 bp, Artificial Sequence
  Synthetic Polynucleotide
taatacgactcactatagggtccattaaaggagagttttctggaggaatcaacagaggagagattccatgagaaaactcaacctggcggcagcgcaaaagatg

SEQ ID NO: 87420 - DNA, 103 bp, Artificial Sequence
  Synthetic Polynucleotide
taatacgactcactataggggaagcacctctccattaaaggagagttttcaacagaggagagaaaacatgcctttaatgaacctggcggcagcgcaaaagatg

SEQ ID NO: 87421 - DNA, 103 bp, Artificial Sequence
  Synthetic Polynucleotide
taatacgactcactataggggacgacatatgaagcacctctccattaaagaacagaggagactttaaatgagaggtgctaacctggcggcagcgcaaaagatg

SEQ ID NO: 87422 - DNA, 103 bp, Artificial Sequence
  Synthetic Polynucleotide
taatacgactcactatagggagacaccttagacgacatatgaagcacctcaacagaggagagaggtgatgcatatgtcgaacctggcggcagcgcaaaagatg

SEQ ID NO: 87423 - DNA, 103 bp, Artificial Sequence
  Synthetic Polynucleotide
taatacgactcactatagggattatccagcagacaccttagacgacatataacagaggagaatatgtatgctaaggtgtaacctggcggcagcgcaaaagatg

SEQ ID NO: 87424 - DNA, 103 bp, Artificial Sequence
  Synthetic Polynucleotide
taatacgactcactatagggaaccagatgaattatccagcagacaccttaaacagaggagataaggtatgtgctggataaacctggcggcagcgcaaaagatg

SEQ ID NO: 87425 - DNA, 103 bp, Artificial Sequence
  Synthetic Polynucleotide
taatacgactcactatagggattgccagaaaaccagatgaattatccagcaacagaggagagctggaatgttcatctggaacctggcggcagcgcaaaagatg

SEQ ID NO: 87426 - DNA, 103 bp, Artificial Sequence
  Synthetic Polynucleotide
taatacgactcactatagggtccttcagctgggattggctttactgttttaacagaggagaaaaacaatgaagccaatcaacctggcggcagcgcaaaagatg

SEQ ID NO: 87427 - DNA, 103 bp, Artificial Sequence
  Synthetic Polynucleotide
taatacgactcactatagggttggaaattcattgccagaaaaccagatgaaacagaggagatcatctatgtttctggcaaacctggcggcagcgcaaaagatg

SEQ ID NO: 87428 - DNA, 103 bp, Artificial Sequence
  Synthetic Polynucleotide
taatacgactcactatagggttaacttcccttggaaattcattgccagaaaacagaggagattctggatgtgaatttccaacctggcggcagcgcaaaagatg

SEQ ID NO: 87429 - DNA, 103 bp, Artificial Sequence
  Synthetic Polynucleotide
taatacgactcactatagggtgaagatactttaacttcccttggaaattcaacagaggagagaatttatgagggaagttaacctggcggcagcgcaaaagatg

SEQ ID NO: 87430 - DNA, 103 bp, Artificial Sequence
  Synthetic Polynucleotide
taatacgactcactatagggtttctgtccatgaagatactttaacttcccaacagaggagagggaagatgaagtatcttaacctggcggcagcgcaaaagatg

SEQ ID NO: 87431 - DNA, 103 bp, Artificial Sequence
  Synthetic Polynucleotide
taatacgactcactatagggtccctttctttttctgtccatgaagatactaacagaggagaagtatcatgatggacagaaacctggcggcagcgcaaaagatg

SEQ ID NO: 87432 - DNA, 103 bp, Artificial Sequence
  Synthetic Polynucleotide
taatacgactcactataggggatccatctttccctttctttttctgtccaaacagaggagatggacaatgaaagaaaggaacctggcggcagcgcaaaagatg

SEQ ID NO: 87433 - DNA, 103 bp, Artificial Sequence
  Synthetic Polynucleotide
taatacgactcactatagggtggaagtattgatccatctttccctttcttaacagaggagaaagaaaatgaaagatggaaacctggcggcagcgcaaaagatg

SEQ ID NO: 87434 - DNA, 103 bp, Artificial Sequence
  Synthetic Polynucleotide
taatacgactcactatagggccaactgaggtggaagtattgatccatcttaacagaggagaaagatgatgcaatacttcaacctggcggcagcgcaaaagatg

SEQ ID NO: 87435 - DNA, 103 bp, Artificial Sequence
  Synthetic Polynucleotide
taatacgactcactataggggcaaacaaagccaactgaggtggaagtattaacagaggagaaatactatgacctcagttaacctggcggcagcgcaaaagatg

SEQ ID NO: 87436 - DNA, 103 bp, Artificial Sequence
  Synthetic Polynucleotide
taatacgactcactatagggagtagctatcgcaaacaaagccaactgaggaacagaggagacctcagatggctttgtttaacctggcggcagcgcaaaagatg

SEQ ID NO: 87437 - DNA, 103 bp, Artificial Sequence
  Synthetic Polynucleotide
taatacgactcactatagggttgacttgattccttcagctgggattggctaacagaggagaagccaaatgcagctgaagaacctggcggcagcgcaaaagatg

SEQ ID NO: 87438 - DNA, 103 bp, Artificial Sequence
  Synthetic Polynucleotide
taatacgactcactataggggctgaagtggagtagctatcgcaaacaaagaacagaggagactttgtatgcgatagctaaacctggcggcagcgcaaaagatg

SEQ ID NO: 87439 - DNA, 103 bp, Artificial Sequence
  Synthetic Polynucleotide
taatacgactcactatagggatggatggtggctgaagtggagtagctatcaacagaggagagatagcatgtccacttcaaacctggcggcagcgcaaaagatg

SEQ ID NO: 87440 - DNA, 103 bp, Artificial Sequence
  Synthetic Polynucleotide
taatacgactcactataggggatttcaagtatggatggtggctgaagtggaacagaggagaccacttatgccaccatccaacctggcggcagcgcaaaagatg

SEQ ID NO: 87441 - DNA, 103 bp, Artificial Sequence
  Synthetic Polynucleotide
taatacgactcactatagggttttggtccggatttcaagtatggatggtgaacagaggagacaccatatgtacttgaaaaacctggcggcagcgcaaaagatg

SEQ ID NO: 87442 - DNA, 103 bp, Artificial Sequence
  Synthetic Polynucleotide
taatacgactcactatagggaagataaaatttttggtccggatttcaagtaacagaggagaacttgaatgccggaccaaaacctggcggcagcgcaaaagatg

SEQ ID NO: 87443 - DNA, 103 bp, Artificial Sequence
  Synthetic Polynucleotide
taatacgactcactatagggtttggttctaaagataaaatttttggtccgaacagaggagacggaccatgaattttatcaacctggcggcagcgcaaaagatg

SEQ ID NO: 87444 - DNA, 103 bp, Artificial Sequence
  Synthetic Polynucleotide
taatacgactcactatagggctagtttgtgtttggttctaaagataaaataacagaggagaattttaatgttagaaccaaacctggcggcagcgcaaaagatg

SEQ ID NO: 87445 - DNA, 103 bp, Artificial Sequence
  Synthetic Polynucleotide
taatacgactcactatagggggtgtgaagtctagtttgtgtttggttctaaacagaggagatagaacatgacacaaactaacctggcggcagcgcaaaagatg

SEQ ID NO: 87446 - DNA, 103 bp, Artificial Sequence
  Synthetic Polynucleotide
taatacgactcactatagggacaaccaataggtgtgaagtctagtttgtgaacagaggagacacaaaatggacttcacaaacctggcggcagcgcaaaagatg

SEQ ID NO: 87447 - DNA, 103 bp, Artificial Sequence
  Synthetic Polynucleotide
taatacgactcactatagggctttggcatcacaaccaataggtgtgaagtaacagaggagaacttcaatgctattggttaacctggcggcagcgcaaaagatg

SEQ ID NO: 87448 - DNA, 103 bp, Artificial Sequence
  Synthetic Polynucleotide
taatacgactcactatagggttggaaggatttgacttgattccttcagctaacagaggagaagctgaatgaatcaagtcaacctggcggcagcgcaaaagatg

SEQ ID NO: 87449 - DNA, 103 bp, Artificial Sequence
  Synthetic Polynucleotide
taatacgactcactatagggacaattcttcctttggcatcacaaccaataaacagaggagatattggatgtgatgccaaaacctggcggcagcgcaaaagatg

SEQ ID NO: 87450 - DNA, 103 bp, Artificial Sequence
  Synthetic Polynucleotide
taatacgactcactatagggatatcctaaaacaattcttcctttggcatcaacagaggagagatgccatgggaagaattaacctggcggcagcgcaaaagatg

SEQ ID NO: 87451 - DNA, 103 bp, Artificial Sequence
  Synthetic Polynucleotide
taatacgactcactatagggctgcttcagtatatcctaaaacaattcttcaacagaggagagaagaaatgttttaggataacctggcggcagcgcaaaagatg

SEQ ID NO: 87452 - DNA, 103 bp, Artificial Sequence
  Synthetic Polynucleotide
taatacgactcactataggggtgcacagctctgcttcagtatatcctaaaaacagaggagatttaggatgtactgaagcaacctggcggcagcgcaaaagatg

SEQ ID NO: 87453 - DNA, 103 bp, Artificial Sequence
  Synthetic Polynucleotide
taatacgactcactatagggtgagcctctcgtgcacagctctgcttcagtaacagaggagaactgaaatggagctgtgcaacctggcggcagcgcaaaagatg

SEQ ID NO: 87454 - DNA, 103 bp, Artificial Sequence
  Synthetic Polynucleotide
taatacgactcactatagggactgataacctgagcctctcgtgcacagctaacagaggagaagctgtatgcgagaggctaacctggcggcagcgcaaaagatg

SEQ ID NO: 87455 - DNA, 103 bp, Artificial Sequence
  Synthetic Polynucleotide
taatacgactcactataggggcatgaataaactgataacctgagcctctcaacagaggagagagaggatgaggttatcaaacctggcggcagcgcaaaagatg

SEQ ID NO: 87456 - DNA, 103 bp, Artificial Sequence
  Synthetic Polynucleotide
taatacgactcactatagggcatatcagctgcatgaataaactgataaccaacagaggagaggttatatgtttattcataacctggcggcagcgcaaaagatg

SEQ ID NO: 87457 - DNA, 103 bp, Artificial Sequence
  Synthetic Polynucleotide
taatacgactcactatagggcacaataaagcatatcagctgcatgaataaaacagaggagattattcatgcagctgataaacctggcggcagcgcaaaagatg

SEQ ID NO: 87458 - DNA, 103 bp, Artificial Sequence
  Synthetic Polynucleotide
taatacgactcactatagggtgggactcggcacaataaagcatatcagctaacagaggagaagctgaatggctttattgaacctggcggcagcgcaaaagatg

SEQ ID NO: 87459 - DNA, 103 bp, Artificial Sequence
  Synthetic Polynucleotide
taatacgactcactatagggaagccggcgtagcgccgcgtccgtcgccataacagaggagaatggcgatggacgcggcgaacctggcggcagcgcaaaagatg

SEQ ID NO: 87460 - DNA, 103 bp, Artificial Sequence
  Synthetic Polynucleotide
taatacgactcactatagggctcggggaccacgtcgtggtcagccagcgcaacagaggagagcgctgatggaccacgacaacctggcggcagcgcaaaagatg

SEQ ID NO: 87461 - DNA, 103 bp, Artificial Sequence
  Synthetic Polynucleotide
taatacgactcactataggggcagctggagcacctccaggtcccactgggaacagaggagacccagtatgacctggaggaacctggcggcagcgcaaaagatg

SEQ ID NO: 87462 - DNA, 103 bp, Artificial Sequence
  Synthetic Polynucleotide
taatacgactcactatagggttgcctgcaggcagctggagcacctccaggaacagaggagacctggaatggctccagctaacctggcggcagcgcaaaagatg

SEQ ID NO: 87463 - DNA, 103 bp, Artificial Sequence
  Synthetic Polynucleotide
taatacgactcactatagggtcctggactgttgcctgcaggcagctggagaacagaggagactccagatgcctgcaggcaacctggcggcagcgcaaaagatg

SEQ ID NO: 87464 - DNA, 103 bp, Artificial Sequence
  Synthetic Polynucleotide
taatacgactcactataggggggctgcacctcctggactgttgcctgcagaacagaggagactgcagatgacagtccagaacctggcggcagcgcaaaagatg

SEQ ID NO: 87465 - DNA, 103 bp, Artificial Sequence
  Synthetic Polynucleotide
taatacgactcactatagggcctctgcccggggctgcacctcctggactgaacagaggagacagtccatgaggtgcagcaacctggcggcagcgcaaaagatg

SEQ ID NO: 87466 - DNA, 103 bp, Artificial Sequence
  Synthetic Polynucleotide
taatacgactcactatagggggccggggctcctctgcccggggctgcaccaacagaggagaggtgcaatgccgggcagaaacctggcggcagcgcaaaagatg

SEQ ID NO: 87467 - DNA, 103 bp, Artificial Sequence
  Synthetic Polynucleotide
taatacgactcactatagggtggctcctggggccggggctcctctgcccgaacagaggagacgggcaatggagccccggaacctggcggcagcgcaaaagatg

SEQ ID NO: 87468 - DNA, 103 bp, Artificial Sequence
  Synthetic Polynucleotide
taatacgactcactatagggtctccacgggtggctcctggggccggggctaacagaggagaagccccatgcccaggagcaacctggcggcagcgcaaaagatg

SEQ ID NO: 87469 - DNA, 103 bp, Artificial Sequence
  Synthetic Polynucleotide
taatacgactcactataggggggagcggggtctccacgggtggctcctggaacagaggagaccaggaatgacccgtggaaacctggcggcagcgcaaaagatg

SEQ ID NO: 87470 - DNA, 103 bp, Artificial Sequence
  Synthetic Polynucleotide
taatacgactcactatagggaagccccggggggagcggggtctccacgggaacagaggagacccgtgatgaccccgctcaacctggcggcagcgcaaaagatg

SEQ ID NO: 87471 - DNA, 103 bp, Artificial Sequence
  Synthetic Polynucleotide
taatacgactcactataggggaaacttgtcctcggggaccacgtcgtggtaacagaggagaaccacgatgtggtccccgaacctggcggcagcgcaaaagatg

SEQ ID NO: 87472 - DNA, 103 bp, Artificial Sequence
  Synthetic Polynucleotide
taatacgactcactatagggccgccgacctaagccccggggggagcggggaacagaggagaccccgcatgccccggggcaacctggcggcagcgcaaaagatg

SEQ ID NO: 87473 - DNA, 103 bp, Artificial Sequence
  Synthetic Polynucleotide
taatacgactcactatagggacctcctctcccgccgacctaagccccgggaacagaggagacccgggatgtaggtcggcaacctggcggcagcgcaaaagatg

SEQ ID NO: 87474 - DNA, 103 bp, Artificial Sequence
  Synthetic Polynucleotide
taatacgactcactatagggtggacctcttacctcctctcccgccgacctaacagaggagaaggtcgatgggagaggagaacctggcggcagcgcaaaagatg

SEQ ID NO: 87475 - DNA, 103 bp, Artificial Sequence
  Synthetic Polynucleotide
taatacgactcactataggggttccccaggtggacctcttacctcctctcaacagaggagagagaggatgtaagaggtcaacctggcggcagcgcaaaagatg

SEQ ID NO: 87476 - DNA, 103 bp, Artificial Sequence
  Synthetic Polynucleotide
taatacgactcactatagggccggctaggggttccccaggtggacctcttaacagaggagaaagaggatgacctggggaaacctggcggcagcgcaaaagatg

SEQ ID NO: 87477 - DNA, 103 bp, Artificial Sequence
  Synthetic Polynucleotide
taatacgactcactatagggcgtgtccatgccggctaggggttccccaggaacagaggagacctgggatgcccctagccaacctggcggcagcgcaaaagatg

SEQ ID NO: 87478 - DNA, 103 bp, Artificial Sequence
  Synthetic Polynucleotide
taatacgactcactatagggagacaagagtcgtgtccatgccggctagggaacagaggagaccctagatggcatggacaaacctggcggcagcgcaaaagatg

SEQ ID NO: 87479 - DNA, 103 bp, Artificial Sequence
  Synthetic Polynucleotide
taatacgactcactatagggaggtgcttgtagacaagagtcgtgtccatgaacagaggagacatggaatggactcttgtaacctggcggcagcgcaaaagatg

SEQ ID NO: 87480 - DNA, 103 bp, Artificial Sequence
  Synthetic Polynucleotide
taatacgactcactatagggcggagccggcaggtgcttgtagacaagagtaacagaggagaactcttatgtacaagcacaacctggcggcagcgcaaaagatg

SEQ ID NO: 87481 - DNA, 103 bp, Artificial Sequence
  Synthetic Polynucleotide
taatacgactcactatagggctgcagaaggcggagccggcaggtgcttgtaacagaggagaacaagcatgtgccggctcaacctggcggcagcgcaaaagatg

SEQ ID NO: 87482 - DNA, 103 bp, Artificial Sequence
  Synthetic Polynucleotide
taatacgactcactatagggagcgtctcctgaaacttgtcctcggggaccaacagaggagaggtcccatgggacaagttaacctggcggcagcgcaaaagatg

SEQ ID NO: 87483 - DNA, 103 bp, Artificial Sequence
  Synthetic Polynucleotide
taatacgactcactatagggggcagcggggctgcagaaggcggagccggcaacagaggagagccggcatggccttctgcaacctggcggcagcgcaaaagatg

SEQ ID NO: 87484 - DNA, 103 bp, Artificial Sequence
  Synthetic Polynucleotide
taatacgactcactataggggtccagccctggcagcggggctgcagaaggaacagaggagaccttctatggccccgctgaacctggcggcagcgcaaaagatg

SEQ ID NO: 87485 - DNA, 103 bp, Artificial Sequence
  Synthetic Polynucleotide
taatacgactcactataggggggccgaggagtccagccctggcagcggggaacagaggagaccccgcatgcagggctggaacctggcggcagcgcaaaagatg

SEQ ID NO: 87486 - DNA, 103 bp, Artificial Sequence
  Synthetic Polynucleotide
taatacgactcactatagggagggggtgcagggccgaggagtccagccctaacagaggagaagggctatgctcctcggcaacctggcggcagcgcaaaagatg

SEQ ID NO: 87487 - DNA, 103 bp, Artificial Sequence
  Synthetic Polynucleotide
taatacgactcactatagggcacacacagtagggggtgcagggccgaggaaacagaggagatcctcgatgctgcaccccaacctggcggcagcgcaaaagatg

SEQ ID NO: 87488 - DNA, 103 bp, Artificial Sequence
  Synthetic Polynucleotide
taatacgactcactatagggcctcaggacccacacacagtagggggtgcaaacagaggagatgcaccatgtactgtgtgaacctggcggcagcgcaaaagatg

SEQ ID NO: 87489 - DNA, 103 bp, Artificial Sequence
  Synthetic Polynucleotide
taatacgactcactatagggttctgctgaccctcaggacccacacacagtaacagaggagaactgtgatggggtcctgaaacctggcggcagcgcaaaagatg

SEQ ID NO: 87490 - DNA, 103 bp, Artificial Sequence
  Synthetic Polynucleotide
taatacgactcactatagggaggagccaggttctgctgaccctcaggaccaacagaggagaggtcctatgggtcagcagaacctggcggcagcgcaaaagatg

SEQ ID NO: 87491 - DNA, 103 bp, Artificial Sequence
  Synthetic Polynucleotide
taatacgactcactatagggaacgcgcaccaggagccaggttctgctgacaacagaggagagtcagcatgacctggctcaacctggcggcagcgcaaaagatg

SEQ ID NO: 87492 - DNA, 103 bp, Artificial Sequence
  Synthetic Polynucleotide
taatacgactcactatagggcacaccccgcaacgcgcaccaggagccaggaacagaggagacctggcatgtggtgcgcgaacctggcggcagcgcaaaagatg

SEQ ID NO: 87493 - DNA, 103 bp, Artificial Sequence
  Synthetic Polynucleotide
taatacgactcactatagggcttcagatgaagcgtctcctgaaacttgtcaacagaggagagacaagatgcaggagacgaacctggcggcagcgcaaaagatg

SEQ ID NO: 87494 - DNA, 103 bp, Artificial Sequence
  Synthetic Polynucleotide
taatacgactcactatagggaccatctccgcacaccccgcaacgcgcaccaacagaggagaggtgcgatgtgcggggtgaacctggcggcagcgcaaaagatg

SEQ ID NO: 87495 - DNA, 103 bp, Artificial Sequence
  Synthetic Polynucleotide
taatacgactcactataggggcacgtccgtaccatctccgcacaccccgcaacagaggagagcggggatggcggagatgaacctggcggcagcgcaaaagatg

SEQ ID NO: 87496 - DNA, 103 bp, Artificial Sequence
  Synthetic Polynucleotide
taatacgactcactataggggtacaccgcagcacgtccgtaccatctccgaacagaggagacggagaatgtacggacgtaacctggcggcagcgcaaaagatg

SEQ ID NO: 87497 - DNA, 103 bp, Artificial Sequence
  Synthetic Polynucleotide
taatacgactcactatagggggcgcagtgagtacaccgcagcacgtccgtaacagaggagaacggacatgctgcggtgtaacctggcggcagcgcaaaagatg

SEQ ID NO: 87498 - DNA, 103 bp, Artificial Sequence
  Synthetic Polynucleotide
taatacgactcactatagggggaaggcagcggcgcagtgagtacaccgcaaacagaggagatgcggtatgctcactgcgaacctggcggcagcgcaaaagatg

SEQ ID NO: 87499 - DNA, 103 bp, Artificial Sequence
  Synthetic Polynucleotide
taatacgactcactatagggcagcgccagtggaaggcagcggcgcagtgaaacagaggagatcactgatgcgctgccttaacctggcggcagcgcaaaagatg

SEQ ID NO: 87500 - DNA, 103 bp, Artificial Sequence
  Synthetic Polynucleotide
taatacgactcactatagggtgggaagtggcagcgccagtggaaggcagcaacagaggagagctgccatgcactggcgcaacctggcggcagcgcaaaagatg

SEQ ID NO: 87501 - DNA, 103 bp, Artificial Sequence
  Synthetic Polynucleotide
taatacgactcactatagggaggtgccggctgggaagtggcagcgccagtaacagaggagaactggcatggccacttccaacctggcggcagcgcaaaagatg

SEQ ID NO: 87502 - DNA, 103 bp, Artificial Sequence
  Synthetic Polynucleotide
taatacgactcactatagggccgggccgggaggtgccggctgggaagtggaacagaggagaccacttatgagccggcacaacctggcggcagcgcaaaagatg

SEQ ID NO: 87503 - DNA, 103 bp, Artificial Sequence
  Synthetic Polynucleotide
taatacgactcactatagggcaggcccgtcccgggccgggaggtgccggcaacagaggagagccggcatgtcccggcccaacctggcggcagcgcaaaagatg

SEQ ID NO: 87504 - DNA, 103 bp, Artificial Sequence
  Synthetic Polynucleotide
taatacgactcactatagggcctccttttccttcagatgaagcgtctcctaacagaggagaaggagaatgttcatctgaaacctggcggcagcgcaaaagatg

SEQ ID NO: 87505 - DNA, 103 bp, Artificial Sequence
  Synthetic Polynucleotide
taatacgactcactatagggatctgcagcgcaggcccgtcccgggccgggaacagaggagacccggcatgggacgggccaacctggcggcagcgcaaaagatg

SEQ ID NO: 87506 - DNA, 103 bp, Artificial Sequence
  Synthetic Polynucleotide
taatacgactcactatagggcctgagcaggatctgcagcgcaggcccgtcaacagaggagagacgggatggcgctgcagaacctggcggcagcgcaaaagatg

SEQ ID NO: 87507 - DNA, 103 bp, Artificial Sequence
  Synthetic Polynucleotide
taatacgactcactatagggggtcacgtctcctgagcaggatctgcagcgaacagaggagacgctgcatgtcctgctcaaacctggcggcagcgcaaaagatg

SEQ ID NO: 87508 - DNA, 103 bp, Artificial Sequence
  Synthetic Polynucleotide
taatacgactcactatagggcaggggctggggtcacgtctcctgagcaggaacagaggagacctgctatggagacgtgaaacctggcggcagcgcaaaagatg

SEQ ID NO: 87509 - DNA, 103 bp, Artificial Sequence
  Synthetic Polynucleotide
taatacgactcactatagggaccccctccacaggggctggggtcacgtctaacagaggagaagacgtatgcccagccccaacctggcggcagcgcaaaagatg

SEQ ID NO: 87510 - DNA, 103 bp, Artificial Sequence
  Synthetic Polynucleotide
taatacgactcactataggggggggccagcaccccctccacaggggctggaacagaggagaccagccatggtggaggggaacctggcggcagcgcaaaagatg

SEQ ID NO: 87511 - DNA, 103 bp, Artificial Sequence
  Synthetic Polynucleotide
taatacgactcactataggggggcggggctgggggccagcaccccctccaaacagaggagatggaggatgtgctggcccaacctggcggcagcgcaaaagatg

SEQ ID NO: 87512 - DNA, 103 bp, Artificial Sequence
  Synthetic Polynucleotide
taatacgactcactatagggggggccaggcgggcggggctgggggccagcaacagaggagagctggcatgcagccccgcaacctggcggcagcgcaaaagatg

SEQ ID NO: 87513 - DNA, 103 bp, Artificial Sequence
  Synthetic Polynucleotide
taatacgactcactatagggggcaggcccaggggccaggcgggcggggctaacagaggagaagccccatgcgcctggccaacctggcggcagcgcaaaagatg

SEQ ID NO: 87514 - DNA, 103 bp, Artificial Sequence
  Synthetic Polynucleotide
taatacgactcactatagggtgtcatccttggcaggcccaggggccaggcaacagaggagagcctggatgctgggcctgaacctggcggcagcgcaaaagatg

SEQ ID NO: 87515 - DNA, 103 bp, Artificial Sequence
  Synthetic Polynucleotide
taatacgactcactatagggtgggggcagccctccttttccttcagatgaaacagaggagatcatctatgggaaaaggaaacctggcggcagcgcaaaagatg

SEQ ID NO: 87516 - DNA, 103 bp, Artificial Sequence
  Synthetic Polynucleotide
taatacgactcactatagggtgactggcagtgtcatccttggcaggcccaaacagaggagatgggccatgcaaggatgaaacctggcggcagcgcaaaagatg

SEQ ID NO: 87517 - DNA, 103 bp, Artificial Sequence
  Synthetic Polynucleotide
taatacgactcactatagggagcgggctcgtgactggcagtgtcatccttaacagaggagaaaggatatgactgccagtaacctggcggcagcgcaaaagatg

SEQ ID NO: 87518 - DNA, 103 bp, Artificial Sequence
  Synthetic Polynucleotide
taatacgactcactatagggccctgtgcagagcgggctcgtgactggcagaacagaggagactgccaatgacgagcccgaacctggcggcagcgcaaaagatg

SEQ ID NO: 87519 - DNA, 103 bp, Artificial Sequence
  Synthetic Polynucleotide
taatacgactcactatagggtccaggtcatccctgtgcagagcgggctcgaacagaggagacgagccatgtctgcacagaacctggcggcagcgcaaaagatg

SEQ ID NO: 87520 - DNA, 103 bp, Artificial Sequence
  Synthetic Polynucleotide
taatacgactcactatagggcagaagggactccaggtcatccctgtgcagaacagaggagactgcacatggatgacctgaacctggcggcagcgcaaaagatg

SEQ ID NO: 87521 - DNA, 103 bp, Artificial Sequence
  Synthetic Polynucleotide
taatacgactcactatagggtgtgctcgctcagaagggactccaggtcataacagaggagaatgaccatgagtcccttcaacctggcggcagcgcaaaagatg

SEQ ID NO: 87522 - DNA, 103 bp, Artificial Sequence
  Synthetic Polynucleotide
taatacgactcactatagggccatcgaaggtgtgctcgctcagaagggacaacagaggagagtccctatggagcgagcaaacctggcggcagcgcaaaagatg

SEQ ID NO: 87523 - DNA, 103 bp, Artificial Sequence
  Synthetic Polynucleotide
taatacgactcactatagggctgcaggatgccatcgaaggtgtgctcgctaacagaggagaagcgagatgaccttcgataacctggcggcagcgcaaaagatg

SEQ ID NO: 87524 - DNA, 103 bp, Artificial Sequence
  Synthetic Polynucleotide
taatacgactcactatagggggatggcccactgcaggatgccatcgaaggaacagaggagaccttcgatggcatcctgcaacctggcggcagcgcaaaagatg

SEQ ID NO: 87525 - DNA, 103 bp, Artificial Sequence
  Synthetic Polynucleotide
taatacgactcactataggggccatgctctggatggcccactgcaggatgaacagaggagacatcctatggtgggccataacctggcggcagcgcaaaagatg

SEQ ID NO: 87526 - DNA, 103 bp, Artificial Sequence
  Synthetic Polynucleotide
taatacgactcactataggggtggaaggcctgggggcagccctccttttcaacagaggagagaaaagatgggctgccccaacctggcggcagcgcaaaagatg

SEQ ID NO: 87527 - DNA, 103 bp, Artificial Sequence
  Synthetic Polynucleotide
taatacgactcactatagggcgccggacgggccatgctctggatggcccaaacagaggagatgggccatgcagagcatgaacctggcggcagcgcaaaagatg

SEQ ID NO: 87528 - DNA, 103 bp, Artificial Sequence
  Synthetic Polynucleotide
taatacgactcactatagggggaagggggccgccggacgggccatgctctaacagaggagaagagcaatgcccgtccggaacctggcggcagcgcaaaagatg

SEQ ID NO: 87529 - DNA, 103 bp, Artificial Sequence
  Synthetic Polynucleotide
taatacgactcactatagggacaggagggcgtggaaggcctgggggcagcaacagaggagagctgccatgaggccttccaacctggcggcagcgcaaaagatg

SEQ ID NO: 87530 - DNA, 103 bp, Artificial Sequence
  Synthetic Polynucleotide
taatacgactcactatagggagcagccaggacaggagggcgtggaaggccaacagaggagaggccttatgcgccctcctaacctggcggcagcgcaaaagatg

SEQ ID NO: 87531 - DNA, 103 bp, Artificial Sequence
  Synthetic Polynucleotide
taatacgactcactataggggtcctgggtcagcagccaggacaggagggcaacagaggagagccctcatgtcctggctgaacctggcggcagcgcaaaagatg

SEQ ID NO: 87532 - DNA, 103 bp, Artificial Sequence
  Synthetic Polynucleotide
taatacgactcactataggggcagcctcagaagccggcgtagcgccgcgtaacagaggagaacgcggatgtacgccggcaacctggcggcagcgcaaaagatg

SEQ ID NO: 87533 - DNA, 103 bp, Artificial Sequence
  Synthetic Polynucleotide
taatacgactcactatagggtggctgtggagtcctgggtcagcagccaggaacagaggagacctggcatgtgacccaggaacctggcggcagcgcaaaagatg

SEQ ID NO: 87534 - DNA, 103 bp, Artificial Sequence
  Synthetic Polynucleotide
taatacgactcactatagggaagtccaggatggctgtggagtcctgggtcaacagaggagagacccaatgctccacagcaacctggcggcagcgcaaaagatg

SEQ ID NO: 87535 - DNA, 103 bp, Artificial Sequence
  Synthetic Polynucleotide
taatacgactcactatagggcaccctccagaagtccaggatggctgtggaaacagaggagatccacaatgatcctggacaacctggcggcagcgcaaaagatg

SEQ ID NO: 87536 - DNA, 103 bp, Artificial Sequence
  Synthetic Polynucleotide
taatacgactcactatagggccttgaacagcaccctccagaagtccaggaaacagaggagatcctggatgtctggagggaacctggcggcagcgcaaaagatg

SEQ ID NO: 87537 - DNA, 103 bp, Artificial Sequence
  Synthetic Polynucleotide
taatacgactcactatagggaggttgtagtccttgaacagcaccctccagaacagaggagactggagatggctgttcaaaacctggcggcagcgcaaaagatg

SEQ ID NO: 87538 - DNA, 103 bp, Artificial Sequence
  Synthetic Polynucleotide
taatacgactcactatagggatagcgctccaggttgtagtccttgaacagaacagaggagactgttcatggactacaacaacctggcggcagcgcaaaagatg

SEQ ID NO: 87539 - DNA, 103 bp, Artificial Sequence
  Synthetic Polynucleotide
taatacgactcactataggggcagccggccatagcgctccaggttgtagtaacagaggagaactacaatgtggagcgctaacctggcggcagcgcaaaagatg

SEQ ID NO: 87540 - DNA, 103 bp, Artificial Sequence
  Synthetic Polynucleotide
taatacgactcactatagggaggatgggctgcagccggccatagcgctccaacagaggagaggagcgatgtggccggctaacctggcggcagcgcaaaagatg

SEQ ID NO: 87541 - DNA, 103 bp, Artificial Sequence
  Synthetic Polynucleotide
taatacgactcactataggggaagctgtccaggatgggctgcagccggccaacagaggagaggccggatgcagcccatcaacctggcggcagcgcaaaagatg

SEQ ID NO: 87542 - DNA, 103 bp, Artificial Sequence
  Synthetic Polynucleotide
taatacgactcactatagggcatctttggggaagctgtccaggatgggctaacagaggagaagcccaatgtggacagctaacctggcggcagcgcaaaagatg

SEQ ID NO: 87543 - DNA, 103 bp, Artificial Sequence
  Synthetic Polynucleotide
taatacgactcactatagggtccgtgcggtgcagcctcagaagccggcgtaacagaggagaacgccgatgtctgaggctaacctggcggcagcgcaaaagatg

SEQ ID NO: 87544 - DNA, 103 bp, Artificial Sequence
  Synthetic Polynucleotide
taatacgactcactatagggctgaggtccacatctttggggaagctgtccaacagaggagaggacagatgccccaaagaaacctggcggcagcgcaaaagatg

SEQ ID NO: 87545 - DNA, 103 bp, Artificial Sequence
  Synthetic Polynucleotide
taatacgactcactatagggccggggctggctgaggtccacatctttgggaacagaggagacccaaaatggtggacctcaacctggcggcagcgcaaaagatg

SEQ ID NO: 87546 - DNA, 103 bp, Artificial Sequence
  Synthetic Polynucleotide
taatacgactcactatagggtcctccccttccggggctggctgaggtccaaacagaggagatggaccatggccagccccaacctggcggcagcgcaaaagatg

SEQ ID NO: 87547 - DNA, 103 bp, Artificial Sequence
  Synthetic Polynucleotide
taatacgactcactataggggccgggggcttcctccccttccggggctggaacagaggagaccagccatggaaggggagaacctggcggcagcgcaaaagatg

SEQ ID NO: 87548 - DNA, 103 bp, Artificial Sequence
  Synthetic Polynucleotide
taatacgactcactatagggcttggggacggccgggggcttcctccccttaacagaggagaaaggggatgaagcccccgaacctggcggcagcgcaaaagatg

SEQ ID NO: 87549 - DNA, 103 bp, Artificial Sequence
  Synthetic Polynucleotide
taatacgactcactataggggtaccaaagccttggggacggccgggggctaacagaggagaagccccatgccgtccccaaacctggcggcagcgcaaaagatg

SEQ ID NO: 87550 - DNA, 103 bp, Artificial Sequence
  Synthetic Polynucleotide
taatacgactcactatagggctgggtggcggtaccaaagccttggggacgaacagaggagacgtcccatgggctttggtaacctggcggcagcgcaaaagatg

SEQ ID NO: 87551 - DNA, 103 bp, Artificial Sequence
  Synthetic Polynucleotide
taatacgactcactatagggggtggggagtctgggtggcggtaccaaagcaacagaggagagctttgatgccgccacccaacctggcggcagcgcaaaagatg

SEQ ID NO: 87552 - DNA, 103 bp, Artificial Sequence
  Synthetic Polynucleotide
taatacgactcactatagggccttcctcttggtggggagtctgggtggcgaacagaggagacgccacatggactccccaaacctggcggcagcgcaaaagatg

SEQ ID NO: 87553 - DNA, 103 bp, Artificial Sequence
  Synthetic Polynucleotide
taatacgactcactatagggtcttctgaggccttcctcttggtggggagtaacagaggagaactcccatgcaagaggaaaacctggcggcagcgcaaaagatg

SEQ ID NO: 87554 - DNA, 103 bp, Artificial Sequence
  Synthetic Polynucleotide
taatacgactcactatagggcaccgcgatctccgtgcggtgcagcctcagaacagaggagactgaggatgcaccgcacgaacctggcggcagcgcaaaagatg

SEQ ID NO: 87555 - DNA, 103 bp, Artificial Sequence
  Synthetic Polynucleotide
taatacgactcactatagggagctcgagcctcttctgaggccttcctcttaacagaggagaaagaggatggcctcagaaaacctggcggcagcgcaaaagatg

SEQ ID NO: 87556 - DNA, 103 bp, Artificial Sequence
  Synthetic Polynucleotide
taatacgactcactatagggctggcgcggcagctcgagcctcttctgaggaacagaggagacctcagatgaggctcgagaacctggcggcagcgcaaaagatg

SEQ ID NO: 87557 - DNA, 103 bp, Artificial Sequence
  Synthetic Polynucleotide
taatacgactcactataggggtcagggctgctggcgcggcagctcgagccaacagaggagaggctcgatgtgccgcgccaacctggcggcagcgcaaaagatg

SEQ ID NO: 87558 - DNA, 103 bp, Artificial Sequence
  Synthetic Polynucleotide
taatacgactcactataggggccccttggagtcagggctgctggcgcggcaacagaggagagccgcgatggcagccctgaacctggcggcagcgcaaaagatg

SEQ ID NO: 87559 - DNA, 103 bp, Artificial Sequence
  Synthetic Polynucleotide
taatacgactcactatagggggctggcggtgccccttggagtcagggctgaacagaggagacagcccatgctccaagggaacctggcggcagcgcaaaagatg

SEQ ID NO: 87560 - DNA, 103 bp, Artificial Sequence
  Synthetic Polynucleotide
taatacgactcactatagggtgagagcctgggctggcggtgccccttggaaacagaggagatccaagatgcaccgccagaacctggcggcagcgcaaaagatg

SEQ ID NO: 87561 - DNA, 103 bp, Artificial Sequence
  Synthetic Polynucleotide
taatacgactcactatagggggccttcagttgagagcctgggctggcggtaacagaggagaaccgccatgccaggctctaacctggcggcagcgcaaaagatg

SEQ ID NO: 87562 - DNA, 103 bp, Artificial Sequence
  Synthetic Polynucleotide
taatacgactcactatagggtggggggcttggccttcagttgagagcctgaacagaggagacaggctatgaactgaaggaacctggcggcagcgcaaaagatg

SEQ ID NO: 87563 - DNA, 103 bp, Artificial Sequence
  Synthetic Polynucleotide
taatacgactcactatagggtccggcttcttggggggcttggccttcagtaacagaggagaactgaaatgcaagcccccaacctggcggcagcgcaaaagatg

SEQ ID NO: 87564 - DNA, 103 bp, Artificial Sequence
  Synthetic Polynucleotide
taatacgactcactatagggtgcgctgctctccggcttcttggggggcttaacagaggagaaagcccatgaagaagccgaacctggcggcagcgcaaaagatg

SEQ ID NO: 87565 - DNA, 103 bp, Artificial Sequence
  Synthetic Polynucleotide
taatacgactcactatagggtgtccacggccaccgcgatctccgtgcggtaacagaggagaaccgcaatgagatcgcggaacctggcggcagcgcaaaagatg

SEQ ID NO: 87566 - DNA, 103 bp, Artificial Sequence
  Synthetic Polynucleotide
taatacgactcactataggggctgctgctctgcgctgctctccggcttctaacagaggagaagaagcatgagagcagcgaacctggcggcagcgcaaaagatg

SEQ ID NO: 87567 - DNA, 103 bp, Artificial Sequence
  Synthetic Polynucleotide
taatacgactcactatagggagtggaaggcgctgctgctctgcgctgctcaacagaggagagagcagatgagagcagcaaacctggcggcagcgcaaaagatg

SEQ ID NO: 87568 - DNA, 103 bp, Artificial Sequence
  Synthetic Polynucleotide
taatacgactcactatagggcccgttcccgagtggaaggcgctgctgctcaacagaggagagagcagatgcgccttccaaacctggcggcagcgcaaaagatg

SEQ ID NO: 87569 - DNA, 103 bp, Artificial Sequence
  Synthetic Polynucleotide
taatacgactcactatagggtggtctgaatcccgttcccgagtggaaggcaacagaggagagccttcatgtcgggaacgaacctggcggcagcgcaaaagatg

SEQ ID NO: 87570 - DNA, 103 bp, Artificial Sequence
  Synthetic Polynucleotide
taatacgactcactataggggaagctgacatggtctgaatcccgttcccgaacagaggagacgggaaatggattcagacaacctggcggcagcgcaaaagatg

SEQ ID NO: 87571 - DNA, 103 bp, Artificial Sequence
  Synthetic Polynucleotide
taatacgactcactatagggtctctggactgaagctgacatggtctgaataacagaggagaattcagatgatgtcagctaacctggcggcagcgcaaaagatg

SEQ ID NO: 87572 - DNA, 103 bp, Artificial Sequence
  Synthetic Polynucleotide
taatacgactcactatagggtggccacagctctctggactgaagctgacaaacagaggagatgtcagatgcagtccagaaacctggcggcagcgcaaaagatg

SEQ ID NO: 87573 - DNA, 103 bp, Artificial Sequence
  Synthetic Polynucleotide
taatacgactcactatagggccggaggacatggccacagctctctggactaacagaggagaagtccaatgagctgtggcaacctggcggcagcgcaaaagatg

SEQ ID NO: 87574 - DNA, 103 bp, Artificial Sequence
  Synthetic Polynucleotide
taatacgactcactatagggcgggacgtccccggaggacatggccacagcaacagaggagagctgtgatgatgtcctccaacctggcggcagcgcaaaagatg

SEQ ID NO: 87575 - DNA, 103 bp, Artificial Sequence
  Synthetic Polynucleotide
taatacgactcactatagggctcgggctcccgggacgtccccggaggacaaacagaggagatgtcctatggggacgtccaacctggcggcagcgcaaaagatg

SEQ ID NO: 87576 - DNA, 103 bp, Artificial Sequence
  Synthetic Polynucleotide
taatacgactcactataggggggaaggcgctgtccacggccaccgcgatcaacagaggagagatcgcatgggccgtggaaacctggcggcagcgcaaaagatg

SEQ ID NO: 87577 - DNA, 103 bp, Artificial Sequence
  Synthetic Polynucleotide
taatacgactcactatagggtccacggcccctcgggctcccgggacgtccaacagaggagaggacgtatggggagcccgaacctggcggcagcgcaaaagatg

SEQ ID NO: 87578 - DNA, 103 bp, Artificial Sequence
  Synthetic Polynucleotide
taatacgactcactataggggaggatcccctccacggcccctcgggctccaacagaggagaggagccatgggggccgtgaacctggcggcagcgcaaaagatg

SEQ ID NO: 87579 - DNA, 103 bp, Artificial Sequence
  Synthetic Polynucleotide
taatacgactcactatagggcctgctggatgaggatcccctccacggcccaacagaggagagggccgatgaggggatccaacctggcggcagcgcaaaagatg

SEQ ID NO: 87580 - DNA, 103 bp, Artificial Sequence
  Synthetic Polynucleotide
taatacgactcactataggggactcaaacacctgctggatgaggatccccaacagaggagaggggatatgcatccagcaaacctggcggcagcgcaaaagatg

SEQ ID NO: 87581 - DNA, 103 bp, Artificial Sequence
  Synthetic Polynucleotide
taatacgactcactatagggggagccgcctgactcaaacacctgctggataacagaggagaatccagatggtgtttgagaacctggcggcagcgcaaaagatg

SEQ ID NO: 87582 - DNA, 103 bp, Artificial Sequence
  Synthetic Polynucleotide
taatacgactcactatagggtgcacttcttggagccgcctgactcaaacaaacagaggagatgtttgatgcaggcggctaacctggcggcagcgcaaaagatg

SEQ ID NO: 87583 - DNA, 103 bp, Artificial Sequence
  Synthetic Polynucleotide
taatacgactcactatagggccaacctggatgcacttcttggagccgcctaacagaggagaaggcggatgcaagaagtgaacctggcggcagcgcaaaagatg

SEQ ID NO: 87584 - DNA, 103 bp, Artificial Sequence
  Synthetic Polynucleotide
taatacgactcactataggggaactccccgccaacctggatgcacttcttaacagaggagaaagaagatgatccaggttaacctggcggcagcgcaaaagatg

SEQ ID NO: 87585 - DNA, 103 bp, Artificial Sequence
  Synthetic Polynucleotide
taatacgactcactatagggtgggagtgtagaactccccgccaacctggaaacagaggagatccaggatggcggggagtaacctggcggcagcgcaaaagatg

SEQ ID NO: 87586 - DNA, 103 bp, Artificial Sequence
  Synthetic Polynucleotide
taatacgactcactatagggtcgaacttgctgggagtgtagaactccccgaacagaggagacggggaatgctacactccaacctggcggcagcgcaaaagatg

SEQ ID NO: 87587 - DNA, 103 bp, Artificial Sequence
  Synthetic Polynucleotide
taatacgactcactataggggtgcagcagtgggaaggcgctgtccacggcaacagaggagagccgtgatgagcgccttcaacctggcggcagcgcaaaagatg

SEQ ID NO: 87588 - DNA, 103 bp, Artificial Sequence
  Synthetic Polynucleotide
taatacgactcactataggggccggagtcttcgaacttgctgggagtgtaaacagaggagatacactatgagcaagttcaacctggcggcagcgcaaaagatg

SEQ ID NO: 87589 - DNA, 103 bp, Artificial Sequence
  Synthetic Polynucleotide
taatacgactcactatagggtcttcccactgccggagtcttcgaacttgcaacagaggagagcaagtatgaagactccgaacctggcggcagcgcaaaagatg

SEQ ID NO: 87590 - DNA, 103 bp, Artificial Sequence
  Synthetic Polynucleotide
taatacgactcactatagggcgggccttgttcttcccactgccggagtctaacagaggagaagactcatgcagtgggaaaacctggcggcagcgcaaaagatg

SEQ ID NO: 87591 - DNA, 103 bp, Artificial Sequence
  Synthetic Polynucleotide
taatacgactcactatagggactgctgctgcgggccttgttcttcccactaacagaggagaagtgggatgaacaaggccaacctggcggcagcgcaaaagatg

SEQ ID NO: 87592 - DNA, 103 bp, Artificial Sequence
  Synthetic Polynucleotide
taatacgactcactataggggcttcgggccactgctgctgcgggccttgtaacagaggagaacaaggatggcagcagcaaacctggcggcagcgcaaaagatg

SEQ ID NO: 87593 - DNA, 103 bp, Artificial Sequence
  Synthetic Polynucleotide
taatacgactcactatagggcgaaccagaggcttcgggccactgctgctgaacagaggagacagcagatgtggcccgaaaacctggcggcagcgcaaaagatg

SEQ ID NO: 87594 - DNA, 103 bp, Artificial Sequence
  Synthetic Polynucleotide
taatacgactcactatagggtcccttggctcgaaccagaggcttcgggccaacagaggagaggcccgatgcctctggttaacctggcggcagcgcaaaagatg

SEQ ID NO: 87595 - DNA, 103 bp, Artificial Sequence
  Synthetic Polynucleotide
taatacgactcactatagggcgccctgggctcccttggctcgaaccagagaacagaggagactctggatggagccaaggaacctggcggcagcgcaaaagatg

SEQ ID NO: 87596 - DNA, 103 bp, Artificial Sequence
  Synthetic Polynucleotide
taatacgactcactatagggccgggggcagcgccctgggctcccttggctaacagaggagaagccaaatgagcccagggaacctggcggcagcgcaaaagatg

SEQ ID NO: 87597 - DNA, 103 bp, Artificial Sequence
  Synthetic Polynucleotide
taatacgactcactatagggctcacctccaccgggggcagcgccctgggcaacagaggagagcccagatggctgcccccaacctggcggcagcgcaaaagatg

SEQ ID NO: 87598 - DNA, 103 bp, Artificial Sequence
  Synthetic Polynucleotide
taatacgactcactatagggcagccagcgcgtgcagcagtgggaaggcgcaacagaggagagcgcctatgcactgctgcaacctggcggcagcgcaaaagatg

SEQ ID NO: 87599 - DNA, 103 bp, Artificial Sequence
  Synthetic Polynucleotide
taatacgactcactatagggccagcctagcctcacctccaccgggggcagaacagaggagactgcccatggtggaggtgaacctggcggcagcgcaaaagatg

SEQ ID NO: 87600 - DNA, 103 bp, Artificial Sequence
  Synthetic Polynucleotide
taatacgactcactatagggccctgctggcccagcctagcctcacctccaaacagaggagatggaggatgggctaggctaacctggcggcagcgcaaaagatg

SEQ ID NO: 87601 - DNA, 103 bp, Artificial Sequence
  Synthetic Polynucleotide
taatacgactcactataggggggaacgctgccctgctggcccagcctagcaacagaggagagctaggatgggccagcagaacctggcggcagcgcaaaagatg

SEQ ID NO: 87602 - DNA, 103 bp, Artificial Sequence
  Synthetic Polynucleotide
taatacgactcactatagggccagaggggcgggaacgctgccctgctggcaacagaggagagccagcatggcagcgttcaacctggcggcagcgcaaaagatg

SEQ ID NO: 87603 - DNA, 103 bp, Artificial Sequence
  Synthetic Polynucleotide
taatacgactcactatagggctggggagggccagaggggcgggaacgctgaacagaggagacagcgtatgcgcccctctaacctggcggcagcgcaaaagatg

SEQ ID NO: 87604 - DNA, 103 bp, Artificial Sequence
  Synthetic Polynucleotide
taatacgactcactatagggctgggggtcactggggagggccagaggggcaacagaggagagcccctatggccctccccaacctggcggcagcgcaaaagatg

SEQ ID NO: 87605 - DNA, 103 bp, Artificial Sequence
  Synthetic Polynucleotide
taatacgactcactatagggtctggtggagctgggggtcactggggagggaacagaggagaccctccatggtgacccccaacctggcggcagcgcaaaagatg

SEQ ID NO: 87606 - DNA, 103 bp, Artificial Sequence
  Synthetic Polynucleotide
taatacgactcactatagggtcctcattcttctggtggagctgggggtcaaacagaggagatgacccatggctccaccaaacctggcggcagcgcaaaagatg

SEQ ID NO: 87607 - DNA, 103 bp, Artificial Sequence
  Synthetic Polynucleotide
taatacgactcactatagggggcacactcgtcctcattcttctggtggagaacagaggagactccacatgaagaatgagaacctggcggcagcgcaaaagatg

SEQ ID NO: 87608 - DNA, 103 bp, Artificial Sequence
  Synthetic Polynucleotide
taatacgactcactatagggcccgacacacggcacactcgtcctcattctaacagaggagaagaatgatgacgagtgtgaacctggcggcagcgcaaaagatg

SEQ ID NO: 87609 - DNA, 103 bp, Artificial Sequence
  Synthetic Polynucleotide
taatacgactcactatagggacgtcgtggtcagccagcgcgtgcagcagtaacagaggagaactgctatgcgcgctggcaacctggcggcagcgcaaaagatg

SEQ ID NO: 87610 - DNA, 103 bp, Artificial Sequence
  Synthetic Polynucleotide
taatacgactcactatagggtccccgccgtcccgacacacggcacactcgaacagaggagacgagtgatgcgtgtgtcgaacctggcggcagcgcaaaagatg

SEQ ID NO: 87611 - DNA, 103 bp, Artificial Sequence
  Synthetic Polynucleotide
taatacgactcactataggggcagatgagctccccgccgtcccgacacacaacagaggagagtgtgtatggacggcgggaacctggcggcagcgcaaaagatg

SEQ ID NO: 87612 - DNA, 103 bp, Artificial Sequence
  Synthetic Polynucleotide
taatacgactcactatagggagccgtcacagcagatgagctccccgccgtaacagaggagaacggcgatgagctcatctaacctggcggcagcgcaaaagatg

SEQ ID NO: 87613 - DNA, 103 bp, Artificial Sequence
  Synthetic Polynucleotide
taatacgactcactataggggcccgagggcagccgtcacagcagatgagcaacagaggagagctcatatgctgtgacggaacctggcggcagcgcaaaagatg

SEQ ID NO: 87614 - DNA, 103 bp, Artificial Sequence
  Synthetic Polynucleotide
taatacgactcactatagggcaggtggaaggcccgagggcagccgtcacaaacagaggagatgtgacatgtgccctcggaacctggcggcagcgcaaaagatg

SEQ ID NO: 87615 - DNA, 103 bp, Artificial Sequence
  Synthetic Polynucleotide
taatacgactcactatagggacaggcaggccaggtggaaggcccgagggcaacagaggagagccctcatgccttccaccaacctggcggcagcgcaaaagatg

SEQ ID NO: 87616 - DNA, 103 bp, Artificial Sequence
  Synthetic Polynucleotide
taatacgactcactatagggagcggaggggacaggcaggccaggtggaagaacagaggagacttccaatgggcctgcctaacctggcggcagcgcaaaagatg

SEQ ID NO: 87617 - DNA, 103 bp, Artificial Sequence
  Synthetic Polynucleotide
taatacgactcactataggggatctcccggagcggaggggacaggcaggcaacagaggagagcctgcatgtcccctccgaacctggcggcagcgcaaaagatg

SEQ ID NO: 87618 - DNA, 103 bp, Artificial Sequence
  Synthetic Polynucleotide
taatacgactcactatagggtcccactggggatctcccggagcggaggggaacagaggagacccctcatgtccgggagaaacctggcggcagcgcaaaagatg

SEQ ID NO: 87619 - DNA, 103 bp, Artificial Sequence
  Synthetic Polynucleotide
taatacgactcactatagggcacctccaggtcccactggggatctcccggaacagaggagaccgggaatgccccagtggaacctggcggcagcgcaaaagatg

SEQ ID NO: 87620 - DNA, 103 bp, Artificial Sequence
  Synthetic Polynucleotide
taatacgactcactataggggttctccggaagccaccccagggtgggcataacagaggagaatgcccatgctggggtggaacctggcggcagcgcaaaagatg

SEQ ID NO: 87621 - DNA, 103 bp, Artificial Sequence
  Synthetic Polynucleotide
taatacgactcactatagggaaaggactccaccttggccaggaactggctaacagaggagaagccagatgctggccaagaacctggcggcagcgcaaaagatg

SEQ ID NO: 87622 - DNA, 103 bp, Artificial Sequence
  Synthetic Polynucleotide
taatacgactcactatagggtgcggacttggtgcctggagggtggggtggaacagaggagaccacccatgcctccaggcaacctggcggcagcgcaaaagatg

SEQ ID NO: 87623 - DNA, 103 bp, Artificial Sequence
  Synthetic Polynucleotide
taatacgactcactatagggggtgggatgctgcggacttggtgcctggagaacagaggagactccagatgccaagtccgaacctggcggcagcgcaaaagatg

SEQ ID NO: 87624 - DNA, 103 bp, Artificial Sequence
  Synthetic Polynucleotide
taatacgactcactatagggatactactttggtgggatgctgcggacttgaacagaggagacaagtcatgagcatcccaaacctggcggcagcgcaaaagatg

SEQ ID NO: 87625 - DNA, 103 bp, Artificial Sequence
  Synthetic Polynucleotide
taatacgactcactatagggcaggctggtcatactactttggtgggatgcaacagaggagagcatccatgcaaagtagtaacctggcggcagcgcaaaagatg

SEQ ID NO: 87626 - DNA, 103 bp, Artificial Sequence
  Synthetic Polynucleotide
taatacgactcactatagggcgcttccctccaggctggtcatactactttaacagaggagaaaagtaatgtgaccagccaacctggcggcagcgcaaaagatg

SEQ ID NO: 87627 - DNA, 103 bp, Artificial Sequence
  Synthetic Polynucleotide
taatacgactcactatagggtcagagatgccgcttccctccaggctggtcaacagaggagagaccagatgggagggaagaacctggcggcagcgcaaaagatg

SEQ ID NO: 87628 - DNA, 103 bp, Artificial Sequence
  Synthetic Polynucleotide
taatacgactcactatagggtggaaggcgctcagagatgccgcttccctcaacagaggagagagggaatgggcatctctaacctggcggcagcgcaaaagatg

SEQ ID NO: 87629 - DNA, 103 bp, Artificial Sequence
  Synthetic Polynucleotide
taatacgactcactatagggaaggcttctgtggaaggcgctcagagatgcaacagaggagagcatctatgagcgccttcaacctggcggcagcgcaaaagatg

SEQ ID NO: 87630 - DNA, 103 bp, Artificial Sequence
  Synthetic Polynucleotide
taatacgactcactatagggcctcggtgcaaaggcttctgtggaaggcgcaacagaggagagcgcctatgacagaagccaacctggcggcagcgcaaaagatg

SEQ ID NO: 87631 - DNA, 103 bp, Artificial Sequence
  Synthetic Polynucleotide
taatacgactcactataggggggcccaccgcctcggtgcaaaggcttctgaacagaggagacagaagatgttgcaccgaaacctggcggcagcgcaaaagatg

SEQ ID NO: 87632 - DNA, 103 bp, Artificial Sequence
  Synthetic Polynucleotide
taatacgactcactatagggtcagtctttcaaaggactccaccttggccaaacagaggagatggccaatgtggagtcctaacctggcggcagcgcaaaagatg

SEQ ID NO: 87633 - DNA, 103 bp, Artificial Sequence
  Synthetic Polynucleotide
taatacgactcactatagggcctccaggtggggcccaccgcctcggtgcaaacagaggagatgcaccatggcggtgggcaacctggcggcagcgcaaaagatg

SEQ ID NO: 87634 - DNA, 103 bp, Artificial Sequence
  Synthetic Polynucleotide
taatacgactcactatagggatccaggtctcctccaggtggggcccaccgaacagaggagacggtggatgccacctggaaacctggcggcagcgcaaaagatg

SEQ ID NO: 87635 - DNA, 103 bp, Artificial Sequence
  Synthetic Polynucleotide
taatacgactcactatagggtggggacgccatccaggtctcctccaggtgaacagaggagacacctgatggagacctggaacctggcggcagcgcaaaagatg

SEQ ID NO: 87636 - DNA, 103 bp, Artificial Sequence
  Synthetic Polynucleotide
taatacgactcactatagggtgtctgtctctggggacgccatccaggtctaacagaggagaagacctatgtggcgtcccaacctggcggcagcgcaaaagatg

SEQ ID NO: 87637 - DNA, 103 bp, Artificial Sequence
  Synthetic Polynucleotide
taatacgactcactatagggacaaagccactgtctgtctctggggacgccaacagaggagaggcgtcatgagagacagaaacctggcggcagcgcaaaagatg

SEQ ID NO: 87638 - DNA, 103 bp, Artificial Sequence
  Synthetic Polynucleotide
taatacgactcactatagggttctgagcccacaaagccactgtctgtctcaacagaggagagagacaatgagtggctttaacctggcggcagcgcaaaagatg

SEQ ID NO: 87639 - DNA, 103 bp, Artificial Sequence
  Synthetic Polynucleotide
taatacgactcactatagggctctgcttgtttctgagcccacaaagccacaacagaggagagtggctatgtgggctcagaacctggcggcagcgcaaaagatg

SEQ ID NO: 87640 - DNA, 103 bp, Artificial Sequence
  Synthetic Polynucleotide
taatacgactcactatagggaggggtgaaactctgcttgtttctgagcccaacagaggagagggctcatgaacaagcagaacctggcggcagcgcaaaagatg

SEQ ID NO: 87641 - DNA, 103 bp, Artificial Sequence
  Synthetic Polynucleotide
taatacgactcactatagggagtctgggtgaggggtgaaactctgcttgtaacagaggagaacaagcatggtttcacccaacctggcggcagcgcaaaagatg

SEQ ID NO: 87642 - DNA, 103 bp, Artificial Sequence
  Synthetic Polynucleotide
taatacgactcactatagggggtgctctggagtctgggtgaggggtgaaaaacagaggagatttcacatgtcacccagaaacctggcggcagcgcaaaagatg

SEQ ID NO: 87643 - DNA, 103 bp, Artificial Sequence
  Synthetic Polynucleotide
taatacgactcactatagggcctgcctgtatcagtctttcaaaggactccaacagaggagaggagtcatgtgaaagactaacctggcggcagcgcaaaagatg

SEQ ID NO: 87644 - DNA, 103 bp, Artificial Sequence
  Synthetic Polynucleotide
taatacgactcactatagggtgggagagccggtgctctggagtctgggtgaacagaggagacacccaatgtccagagcaaacctggcggcagcgcaaaagatg

SEQ ID NO: 87645 - DNA, 103 bp, Artificial Sequence
  Synthetic Polynucleotide
taatacgactcactatagggtgtgctgatgtgggagagccggtgctctggaacagaggagaccagagatgcggctctccaacctggcggcagcgcaaaagatg

SEQ ID NO: 87646 - DNA, 103 bp, Artificial Sequence
  Synthetic Polynucleotide
taatacgactcactatagggatgttcctgctgtgctgatgtgggagagccaacagaggagaggctctatgacatcagcaaacctggcggcagcgcaaaagatg

SEQ ID NO: 87647 - DNA, 103 bp, Artificial Sequence
  Synthetic Polynucleotide
taatacgactcactatagggggctgggctaatgttcctgctgtgctgatgaacagaggagacatcagatgagcaggaacaacctggcggcagcgcaaaagatg

SEQ ID NO: 87648 - DNA, 103 bp, Artificial Sequence
  Synthetic Polynucleotide
taatacgactcactatagggtgcagcaaagggctgggctaatgttcctgcaacagaggagagcaggaatgttagcccagaacctggcggcagcgcaaaagatg

SEQ ID NO: 87649 - DNA, 103 bp, Artificial Sequence
  Synthetic Polynucleotide
taatacgactcactatagggtgggcacagatgcagcaaagggctgggctaaacagaggagatagcccatgcctttgctgaacctggcggcagcgcaaaagatg

SEQ ID NO: 87650 - DNA, 103 bp, Artificial Sequence
  Synthetic Polynucleotide
taatacgactcactataggggctccatccctgggcacagatgcagcaaagaacagaggagactttgcatgatctgtgccaacctggcggcagcgcaaaagatg

SEQ ID NO: 87651 - DNA, 103 bp, Artificial Sequence
  Synthetic Polynucleotide
taatacgactcactatagggggggtaggaagctccatccctgggcacagaaacagaggagatctgtgatgagggatggaaacctggcggcagcgcaaaagatg

SEQ ID NO: 87652 - DNA, 103 bp, Artificial Sequence
  Synthetic Polynucleotide
taatacgactcactatagggccctggccttggggtaggaagctccatcccaacagaggagagggatgatgcttcctaccaacctggcggcagcgcaaaagatg

SEQ ID NO: 87653 - DNA, 103 bp, Artificial Sequence
  Synthetic Polynucleotide
taatacgactcactatagggatcagagaacccctggccttggggtaggaaaacagaggagattcctaatgcaaggccagaacctggcggcagcgcaaaagatg

SEQ ID NO: 87654 - DNA, 103 bp, Artificial Sequence
  Synthetic Polynucleotide
taatacgactcactatagggcatgagacgtcctgcctgtatcagtctttcaacagaggagagaaagaatgatacaggcaaacctggcggcagcgcaaaagatg

SEQ ID NO: 87655 - DNA, 103 bp, Artificial Sequence
  Synthetic Polynucleotide
taatacgactcactatagggtcttctgggaatcagagaacccctggccttaacagaggagaaaggccatgggttctctgaacctggcggcagcgcaaaagatg

SEQ ID NO: 87656 - DNA, 103 bp, Artificial Sequence
  Synthetic Polynucleotide
taatacgactcactataggggctctgtggctcttctgggaatcagagaacaacagaggagagttctcatgttcccagaaaacctggcggcagcgcaaaagatg

SEQ ID NO: 87657 - DNA, 103 bp, Artificial Sequence
  Synthetic Polynucleotide
taatacgactcactatagggggtgtgctgggctctgtggctcttctgggaaacagaggagatcccagatgagccacagaaacctggcggcagcgcaaaagatg

SEQ ID NO: 87658 - DNA, 103 bp, Artificial Sequence
  Synthetic Polynucleotide
taatacgactcactatagggttggctccggggtgtgctgggctctgtggcaacagaggagagccacaatgcccagcacaaacctggcggcagcgcaaaagatg

SEQ ID NO: 87659 - DNA, 103 bp, Artificial Sequence
  Synthetic Polynucleotide
taatacgactcactatagggacctctgtgcttggctccggggtgtgctggaacagaggagaccagcaatgcccggagccaacctggcggcagcgcaaaagatg

SEQ ID NO: 87660 - DNA, 103 bp, Artificial Sequence
  Synthetic Polynucleotide
taatacgactcactatagggctggagaggtacctctgtgcttggctccggaacagaggagaccggagatgagcacagagaacctggcggcagcgcaaaagatg

SEQ ID NO: 87661 - DNA, 103 bp, Artificial Sequence
  Synthetic Polynucleotide
taatacgactcactatagggcccacttgggctggagaggtacctctgtgcaacagaggagagcacagatgtacctctccaacctggcggcagcgcaaaagatg

SEQ ID NO: 87662 - DNA, 103 bp, Artificial Sequence
  Synthetic Polynucleotide
taatacgactcactataggggccggagaggcccacttgggctggagaggtaacagaggagaacctctatggcccaagtgaacctggcggcagcgcaaaagatg

SEQ ID NO: 87663 - DNA, 103 bp, Artificial Sequence
  Synthetic Polynucleotide
taatacgactcactatagggggtgccctctgccggagaggcccacttgggaacagaggagacccaagatggcctctccgaacctggcggcagcgcaaaagatg

SEQ ID NO: 87664 - DNA, 103 bp, Artificial Sequence
  Synthetic Polynucleotide
taatacgactcactataggggctgaagttgggtgccctctgccggagaggaacagaggagacctctcatgcagagggcaaacctggcggcagcgcaaaagatg

SEQ ID NO: 87665 - DNA, 103 bp, Artificial Sequence
  Synthetic Polynucleotide
taatacgactcactatagggggtcctggggcatgagacgtcctgcctgtaaacagaggagatacaggatggacgtctcaaacctggcggcagcgcaaaagatg

SEQ ID NO: 87666 - DNA, 103 bp, Artificial Sequence
  Synthetic Polynucleotide
taatacgactcactatagggtccgctccaggctgaagttgggtgccctctaacagaggagaagagggatgccaacttcaaacctggcggcagcgcaaaagatg

SEQ ID NO: 87667 - DNA, 103 bp, Artificial Sequence
  Synthetic Polynucleotide
taatacgactcactataggggctgccagtgtccgctccaggctgaagttgaacagaggagacaacttatgcctggagcgaacctggcggcagcgcaaaagatg

SEQ ID NO: 87668 - DNA, 103 bp, Artificial Sequence
  Synthetic Polynucleotide
taatacgactcactatagggcgccatctcggctgccagtgtccgctccagaacagaggagactggagatgacactggcaaacctggcggcagcgcaaaagatg

SEQ ID NO: 87669 - DNA, 103 bp, Artificial Sequence
  Synthetic Polynucleotide
taatacgactcactatagggagccaggaaccgccatctcggctgccagtgaacagaggagacactggatgccgagatggaacctggcggcagcgcaaaagatg

SEQ ID NO: 87670 - DNA, 103 bp, Artificial Sequence
  Synthetic Polynucleotide
taatacgactcactatagggtcaaactctgagccaggaaccgccatctcgaacagaggagacgagatatgggttcctggaacctggcggcagcgcaaaagatg

SEQ ID NO: 87671 - DNA, 103 bp, Artificial Sequence
  Synthetic Polynucleotide
taatacgactcactatagggtttgtgcccctcaaactctgagccaggaacaacagaggagagttcctatgtcagagtttaacctggcggcagcgcaaaagatg

SEQ ID NO: 87672 - DNA, 103 bp, Artificial Sequence
  Synthetic Polynucleotide
taatacgactcactatagggcagaaatccgtttgtgcccctcaaactctgaacagaggagacagagtatgaggggcacaaacctggcggcagcgcaaaagatg

SEQ ID NO: 87673 - DNA, 103 bp, Artificial Sequence
  Synthetic Polynucleotide
taatacgactcactatagggaggggctgttcagaaatccgtttgtgccccaacagaggagaggggcaatgacggatttcaacctggcggcagcgcaaaagatg

SEQ ID NO: 87674 - DNA, 103 bp, Artificial Sequence
  Synthetic Polynucleotide
taatacgactcactatagggcttgttgggaaggggctgttcagaaatccgaacagaggagacggattatggaacagcccaacctggcggcagcgcaaaagatg

SEQ ID NO: 87675 - DNA, 103 bp, Artificial Sequence
  Synthetic Polynucleotide
taatacgactcactatagggggctgattgtcttgttgggaaggggctgttaacagaggagaaacagcatgttcccaacaaacctggcggcagcgcaaaagatg

SEQ ID NO: 87676 - DNA, 103 bp, Artificial Sequence
  Synthetic Polynucleotide
taatacgactcactatagggcccttgacttggtcctggggcatgagacgtaacagaggagaacgtctatggccccaggaaacctggcggcagcgcaaaagatg

SEQ ID NO: 87677 - DNA, 103 bp, Artificial Sequence
  Synthetic Polynucleotide
taatacgactcactataggggctgggggtgggctgattgtcttgttgggaaacagaggagatcccaaatggacaatcagaacctggcggcagcgcaaaagatg

SEQ ID NO: 87678 - DNA, 103 bp, Artificial Sequence
  Synthetic Polynucleotide
taatacgactcactatagggaggggcgggggctgggggtgggctgattgtaacagaggagaacaatcatgccacccccaaacctggcggcagcgcaaaagatg

SEQ ID NO: 87679 - DNA, 103 bp, Artificial Sequence
  Synthetic Polynucleotide
taatacgactcactataggggcgcagcggcaggggcgggggctgggggtgaacagaggagacaccccatgcccccgcccaacctggcggcagcgcaaaagatg

SEQ ID NO: 87680 - DNA, 103 bp, Artificial Sequence
  Synthetic Polynucleotide
taatacgactcactatagggcagggtagaggcgcagcggcaggggcggggaacagaggagaccccgcatgtgccgctgcaacctggcggcagcgcaaaagatg

SEQ ID NO: 87681 - DNA, 103 bp, Artificial Sequence
  Synthetic Polynucleotide
taatacgactcactatagggtgttggtccacagggtagaggcgcagcggcaacagaggagagccgctatgcctctacccaacctggcggcagcgcaaaagatg

SEQ ID NO: 87682 - DNA, 103 bp, Artificial Sequence
  Synthetic Polynucleotide
taatacgactcactatagggggatggtctctgttggtccacagggtagagaacagaggagactctacatggtggaccaaaacctggcggcagcgcaaaagatg

SEQ ID NO: 87683 - DNA, 103 bp, Artificial Sequence
  Synthetic Polynucleotide
taatacgactcactatagggaggaagctggggatggtctctgttggtccaaacagaggagatggaccatgagagaccataacctggcggcagcgcaaaagatg

SEQ ID NO: 87684 - DNA, 103 bp, Artificial Sequence
  Synthetic Polynucleotide
taatacgactcactatagggcctggtgagcaggaagctggggatggtctcaacagaggagagagaccatgcccagcttcaacctggcggcagcgcaaaagatg

SEQ ID NO: 87685 - DNA, 103 bp, Artificial Sequence
  Synthetic Polynucleotide
taatacgactcactatagggctcgccctgccctggtgagcaggaagctggaacagaggagaccagctatgtgctcaccaaacctggcggcagcgcaaaagatg

SEQ ID NO: 87686 - DNA, 103 bp, Artificial Sequence
  Synthetic Polynucleotide
taatacgactcactatagggatggcctggtctcgccctgccctggtgagcaacagaggagagctcacatgggcagggcgaacctggcggcagcgcaaaagatg

SEQ ID NO: 87687 - DNA, 103 bp, Artificial Sequence
  Synthetic Polynucleotide
taatacgactcactatagggccgctggaagcccttgacttggtcctggggaacagaggagaccccagatgcaagtcaagaacctggcggcagcgcaaaagatg

SEQ ID NO: 87688 - DNA, 103 bp, Artificial Sequence
  Synthetic Polynucleotide
taatacgactcactatagggcagctcacagatggcctggtctcgccctgcaacagaggagagcagggatggaccaggccaacctggcggcagcgcaaaagatg

SEQ ID NO: 87689 - DNA, 103 bp, Artificial Sequence
  Synthetic Polynucleotide
taatacgactcactatagggcctcttcttgcagctcacagatggcctggtaacagaggagaaccaggatgtctgtgagcaacctggcggcagcgcaaaagatg

SEQ ID NO: 87690 - DNA, 103 bp, Artificial Sequence
  Synthetic Polynucleotide
taatacgactcactatagggagccgggacacctcttcttgcagctcacagaacagaggagactgtgaatggcaagaagaaacctggcggcagcgcaaaagatg

SEQ ID NO: 87691 - DNA, 103 bp, Artificial Sequence
  Synthetic Polynucleotide
taatacgactcactatagggccgcagacgaagccgggacacctcttcttgaacagaggagacaagaaatggtgtcccggaacctggcggcagcgcaaaagatg

SEQ ID NO: 87692 - DNA, 103 bp, Artificial Sequence
  Synthetic Polynucleotide
taatacgactcactatagggtgtcttccagccgcagacgaagccgggacaaacagaggagatgtcccatgttcgtctgcaacctggcggcagcgcaaaagatg

SEQ ID NO: 87693 - DNA, 103 bp, Artificial Sequence
  Synthetic Polynucleotide
taatacgactcactatagggtggtgcaggctgtcttccagccgcagacgaaacagaggagatcgtctatggctggaagaaacctggcggcagcgcaaaagatg

SEQ ID NO: 87694 - DNA, 103 bp, Artificial Sequence
  Synthetic Polynucleotide
taatacgactcactatagggctggagtggctggtgcaggctgtcttccagaacagaggagactggaaatgagcctgcacaacctggcggcagcgcaaaagatg

SEQ ID NO: 87695 - DNA, 103 bp, Artificial Sequence
  Synthetic Polynucleotide
taatacgactcactatagggtcgggctgccctggagtggctggtgcaggcaacagaggagagcctgcatgagccactccaacctggcggcagcgcaaaagatg

SEQ ID NO: 87696 - DNA, 103 bp, Artificial Sequence
  Synthetic Polynucleotide
taatacgactcactataggggctgggcgtgtcgggctgccctggagtggcaacagaggagagccactatggggcagcccaacctggcggcagcgcaaaagatg

SEQ ID NO: 87697 - DNA, 103 bp, Artificial Sequence
  Synthetic Polynucleotide
taatacgactcactatagggaaaggcagatgctgggcgtgtcgggctgccaacagaggagaggcagcatgacacgcccaaacctggcggcagcgcaaaagatg

SEQ ID NO: 87698 - DNA, 103 bp, Artificial Sequence
  Synthetic Polynucleotide
taatacgactcactatagggcagccttcagccgctggaagcccttgacttaacagaggagaaagtcaatggcttccagcaacctggcggcagcgcaaaagatg

SEQ ID NO: 87699 - DNA, 103 bp, Artificial Sequence
  Synthetic Polynucleotide
taatacgactcactatagggcggggcggtcaaaggcagatgctgggcgtgaacagaggagacacgccatgcatctgcctaacctggcggcagcgcaaaagatg

SEQ ID NO: 87700 - DNA, 103 bp, Artificial Sequence
  Synthetic Polynucleotide
taatacgactcactatagggcgggtccgggcggggcggtcaaaggcagataacagaggagaatctgcatgtgaccgcccaacctggcggcagcgcaaaagatg

SEQ ID NO: 87701 - DNA, 103 bp, Artificial Sequence
  Synthetic Polynucleotide
taatacgactcactatagggtggccggccgcgggtccgggcggggcggtcaacagaggagagaccgcatggcccggaccaacctggcggcagcgcaaaagatg

SEQ ID NO: 87702 - DNA, 103 bp, Artificial Sequence
  Synthetic Polynucleotide
taatacgactcactataggggggagtctgctggccggccgcgggtccgggaacagaggagacccggaatggcggccggcaacctggcggcagcgcaaaagatg

SEQ ID NO: 87703 - DNA, 103 bp, Artificial Sequence
  Synthetic Polynucleotide
taatacgactcactatagggcaggtggctggggagtctgctggccggccgaacagaggagacggccgatgagcagactcaacctggcggcagcgcaaaagatg

SEQ ID NO: 87704 - DNA, 103 bp, Artificial Sequence
  Synthetic Polynucleotide
taatacgactcactatagggatgggagccccaggtggctggggagtctgcaacagaggagagcagacatgccagccaccaacctggcggcagcgcaaaagatg

SEQ ID NO: 87705 - DNA, 103 bp, Artificial Sequence
  Synthetic Polynucleotide
taatacgactcactatagggtactgccataatgggagccccaggtggctgaacagaggagacagccaatgggggctcccaacctggcggcagcgcaaaagatg

SEQ ID NO: 87706 - DNA, 103 bp, Artificial Sequence
  Synthetic Polynucleotide
taatacgactcactatagggtctgtggatttactgccataatgggagcccaacagaggagagggctcatgttatggcagaacctggcggcagcgcaaaagatg

SEQ ID NO: 87707 - DNA, 103 bp, Artificial Sequence
  Synthetic Polynucleotide
taatacgactcactatagggaggcaatctctctgtggatttactgccataaacagaggagatatggcatgaaatccacaaacctggcggcagcgcaaaagatg

SEQ ID NO: 87708 - DNA, 103 bp, Artificial Sequence
  Synthetic Polynucleotide
taatacgactcactatagggtaggctcaccaggcaatctctctgtggattaacagaggagaaatccaatgagagattgcaacctggcggcagcgcaaaagatg

SEQ ID NO: 87709 - DNA, 103 bp, Artificial Sequence
  Synthetic Polynucleotide
taatacgactcactataggggccgcgtgggcagccttcagccgctggaagaacagaggagacttccaatggctgaaggcaacctggcggcagcgcaaaagatg

SEQ ID NO: 87710 - DNA, 103 bp, Artificial Sequence
  Synthetic Polynucleotide
taatacgactcactatagggtcttcacctctaggctcaccaggcaatctcaacagaggagagagattatgtggtgagccaacctggcggcagcgcaaaagatg

SEQ ID NO: 87711 - DNA, 103 bp, Artificial Sequence
  Synthetic Polynucleotide
taatacgactcactataggggacaatctgctcttcacctctaggctcaccaacagaggagaggtgagatgagaggtgaaaacctggcggcagcgcaaaagatg

SEQ ID NO: 87712 - DNA, 103 bp, Artificial Sequence
  Synthetic Polynucleotide
taatacgactcactatagggttcctggagggacaatctgctcttcacctcaacagaggagagaggtgatgagcagattgaacctggcggcagcgcaaaagatg

SEQ ID NO: 87713 - DNA, 103 bp, Artificial Sequence
  Synthetic Polynucleotide
taatacgactcactataggggctcgctgccttcctggagggacaatctgcaacagaggagagcagatatgccctccaggaacctggcggcagcgcaaaagatg

SEQ ID NO: 87714 - DNA, 103 bp, Artificial Sequence
  Synthetic Polynucleotide
taatacgactcactatagggggaagacctggctcgctgccttcctggaggaacagaggagacctccaatgaggcagcgaaacctggcggcagcgcaaaagatg

SEQ ID NO: 87715 - DNA, 103 bp, Artificial Sequence
  Synthetic Polynucleotide
taatacgactcactataggggaggcactgaggaagacctggctcgctgccaacagaggagaggcagcatgccaggtcttaacctggcggcagcgcaaaagatg

SEQ ID NO: 87716 - DNA, 103 bp, Artificial Sequence
  Synthetic Polynucleotide
taatacgactcactatagggagcacctcccgaggcactgaggaagacctgaacagaggagacaggtcatgctcagtgccaacctggcggcagcgcaaaagatg

SEQ ID NO: 87717 - DNA, 103 bp, Artificial Sequence
  Synthetic Polynucleotide
taatacgactcactatagggggacagtcggagcacctcccgaggcactgaaacagaggagatcagtgatgcgggaggtgaacctggcggcagcgcaaaagatg

SEQ ID NO: 87718 - DNA, 103 bp, Artificial Sequence
  Synthetic Polynucleotide
taatacgactcactatagggctgaactcagggacagtcggagcacctcccaacagaggagagggaggatgtccgactgtaacctggcggcagcgcaaaagatg

SEQ ID NO: 87719 - DNA, 103 bp, Artificial Sequence
  Synthetic Polynucleotide
taatacgactcactatagggagctcagattctgaactcagggacagtcggaacagaggagaccgactatgcctgagttcaacctggcggcagcgcaaaagatg

SEQ ID NO: 87720 - DNA, 103 bp, Artificial Sequence
  Synthetic Polynucleotide
taatacgactcactatagggctcctctagggccgcgtgggcagccttcagaacagaggagactgaagatggcccacgcgaacctggcggcagcgcaaaagatg

SEQ ID NO: 87721 - DNA, 103 bp, Artificial Sequence
  Synthetic Polynucleotide
taatacgactcactatagggtagggagggcagctcagattctgaactcagaacagaggagactgagtatggaatctgagaacctggcggcagcgcaaaagatg

SEQ ID NO: 87722 - DNA, 103 bp, Artificial Sequence
  Synthetic Polynucleotide
taatacgactcactatagggagaacagtggtagggagggcagctcagattaacagaggagaaatctgatgtgccctcccaacctggcggcagcgcaaaagatg

SEQ ID NO: 87723 - DNA, 103 bp, Artificial Sequence
  Synthetic Polynucleotide
taatacgactcactatagggctcttctcagagaacagtggtagggagggcaacagaggagagccctcatgaccactgttaacctggcggcagcgcaaaagatg

SEQ ID NO: 87724 - DNA, 103 bp, Artificial Sequence
  Synthetic Polynucleotide
taatacgactcactatagggggtggtcttgctcttctcagagaacagtggaacagaggagaccactgatgtctgagaagaacctggcggcagcgcaaaagatg

SEQ ID NO: 87725 - DNA, 103 bp, Artificial Sequence
  Synthetic Polynucleotide
taatacgactcactataggggactgtccttggtggtcttgctcttctcagaacagaggagactgagaatggcaagaccaaacctggcggcagcgcaaaagatg

SEQ ID NO: 87726 - DNA, 103 bp, Artificial Sequence
  Synthetic Polynucleotide
taatacgactcactataggggctgcctgtggactgtccttggtggtcttgaacagaggagacaagacatgcaaggacagaacctggcggcagcgcaaaagatg

SEQ ID NO: 87727 - DNA, 103 bp, Artificial Sequence
  Synthetic Polynucleotide
taatacgactcactatagggtccatcccgagctgcctgtggactgtccttaacagaggagaaaggacatgccacaggcaaacctggcggcagcgcaaaagatg

SEQ ID NO: 87728 - DNA, 103 bp, Artificial Sequence
  Synthetic Polynucleotide
taatacgactcactatagggcccctctctttccatcccgagctgcctgtgaacagaggagacacaggatgctcgggatgaacctggcggcagcgcaaaagatg

SEQ ID NO: 87729 - DNA, 103 bp, Artificial Sequence
  Synthetic Polynucleotide
taatacgactcactataggggcactgcccacccctctctttccatcccgaaacagaggagatcgggaatgaaagagaggaacctggcggcagcgcaaaagatg

SEQ ID NO: 87730 - DNA, 103 bp, Artificial Sequence
  Synthetic Polynucleotide
taatacgactcactatagggtggccatccagcactgcccacccctctcttaacagaggagaaagagaatggtgggcagtaacctggcggcagcgcaaaagatg

SEQ ID NO: 87731 - DNA, 103 bp, Artificial Sequence
  Synthetic Polynucleotide
taatacgactcactatagggagatgtcccggttctccggaagccaccccaaacagaggagatggggtatgttccggagaaacctggcggcagcgcaaaagatg

SEQ ID NO: 87732 - DNA, 103 bp, Artificial Sequence
  Synthetic Polynucleotide
taatacgactcactatagggtcaggtactcctcctctagggccgcgtgggaacagaggagacccacgatgccctagaggaacctggcggcagcgcaaaagatg

SEQ ID NO: 87733 - DNA, 103 bp, Artificial Sequence
  Synthetic Polynucleotide
taatacgactcactatagggtgaccctgtctggccatccagcactgcccaaacagaggagatgggcaatgctggatggcaacctggcggcagcgcaaaagatg

SEQ ID NO: 87734 - DNA, 103 bp, Artificial Sequence
  Synthetic Polynucleotide
taatacgactcactatagggccccggaaggtgaccctgtctggccatccaaacagaggagatggatgatgagacagggtaacctggcggcagcgcaaaagatg

SEQ ID NO: 87735 - DNA, 103 bp, Artificial Sequence
  Synthetic Polynucleotide
taatacgactcactatagggtgtgtattggccccggaaggtgaccctgtcaacagaggagagacaggatgaccttccggaacctggcggcagcgcaaaagatg

SEQ ID NO: 87736 - DNA, 103 bp, Artificial Sequence
  Synthetic Polynucleotide
taatacgactcactatagggattcgtggcctgtgtattggccccggaaggaacagaggagaccttccatggccaatacaaacctggcggcagcgcaaaagatg

SEQ ID NO: 87737 - DNA, 103 bp, Artificial Sequence
  Synthetic Polynucleotide
taatacgactcactatagggagaacatggtattcgtggcctgtgtattggaacagaggagaccaataatgaggccacgaaacctggcggcagcgcaaaagatg

SEQ ID NO: 87738 - DNA, 103 bp, Artificial Sequence
  Synthetic Polynucleotide
taatacgactcactatagggcttaggggacagaacatggtattcgtggccaacagaggagaggccacatgtaccatgttaacctggcggcagcgcaaaagatg

SEQ ID NO: 87739 - DNA, 103 bp, Artificial Sequence
  Synthetic Polynucleotide
taatacgactcactatagggttgggaccgccttaggggacagaacatggtaacagaggagaaccatgatgtgtcccctaaacctggcggcagcgcaaaagatg

SEQ ID NO: 87740 - DNA, 103 bp, Artificial Sequence
  Synthetic Polynucleotide
taatacgactcactatagggccattgccttttgggaccgccttaggggacaacagaggagagtccccatgggcggtcccaacctggcggcagcgcaaaagatg

SEQ ID NO: 87741 - DNA, 103 bp, Artificial Sequence
  Synthetic Polynucleotide
taatacgactcactatagggggagactgtgccattgccttttgggaccgcaacagaggagagcggtcatgaaaggcaataacctggcggcagcgcaaaagatg

SEQ ID NO: 87742 - DNA, 103 bp, Artificial Sequence
  Synthetic Polynucleotide
taatacgactcactatagggagtggggacaggagactgtgccattgccttaacagaggagaaaggcaatggcacagtctaacctggcggcagcgcaaaagatg

SEQ ID NO: 87743 - DNA, 103 bp, Artificial Sequence
  Synthetic Polynucleotide
taatacgactcactatagggcgacaagccttcaggtactcctcctctaggaacagaggagacctagaatgggagtacctaacctggcggcagcgcaaaagatg

SEQ ID NO: 87744 - DNA, 103 bp, Artificial Sequence
  Synthetic Polynucleotide
taatacgactcactatagggatgggccggcagtggggacaggagactgtgaacagaggagacacagtatgctgtccccaaacctggcggcagcgcaaaagatg

SEQ ID NO: 87745 - DNA, 103 bp, Artificial Sequence
  Synthetic Polynucleotide
taatacgactcactatagggctgggtcctaatgggccggcagtggggacaaacagaggagatgtcccatgtgccggcccaacctggcggcagcgcaaaagatg

SEQ ID NO: 87746 - DNA, 103 bp, Artificial Sequence
  Synthetic Polynucleotide
taatacgactcactatagggcacccgcatcctgggtcctaatgggccggcaacagaggagagccggcatgttaggacccaacctggcggcagcgcaaaagatg

SEQ ID NO: 87747 - DNA, 103 bp, Artificial Sequence
  Synthetic Polynucleotide
taatacgactcactataggggtgacagcaccacccgcatcctgggtcctaaacagaggagataggacatgggatgcgggaacctggcggcagcgcaaaagatg

SEQ ID NO: 87748 - DNA, 103 bp, Artificial Sequence
  Synthetic Polynucleotide
taatacgactcactatagggtgggtcccctgtgacagcaccacccgcatcaacagaggagagatgcgatgggtgctgtcaacctggcggcagcgcaaaagatg

SEQ ID NO: 87749 - DNA, 103 bp, Artificial Sequence
  Synthetic Polynucleotide
taatacgactcactataggggcggtcccagtgggtcccctgtgacagcacaacagaggagagtgctgatgcaggggaccaacctggcggcagcgcaaaagatg

SEQ ID NO: 87750 - DNA, 103 bp, Artificial Sequence
  Synthetic Polynucleotide
taatacgactcactatagggtcagcgggaggcggtcccagtgggtcccctaacagaggagaaggggaatgactgggaccaacctggcggcagcgcaaaagatg

SEQ ID NO: 87751 - DNA, 103 bp, Artificial Sequence
  Synthetic Polynucleotide
taatacgactcactatagggctgaagggtatcagcgggaggcggtcccagaacagaggagactgggaatgcctcccgctaacctggcggcagcgcaaaagatg

SEQ ID NO: 87752 - DNA, 103 bp, Artificial Sequence
  Synthetic Polynucleotide
taatacgactcactatagggacaggggacactgaagggtatcagcgggagaacagaggagactcccgatgatacccttcaacctggcggcagcgcaaaagatg

SEQ ID NO: 87753 - DNA, 103 bp, Artificial Sequence
  Synthetic Polynucleotide
taatacgactcactatagggacttgaccacacaggggacactgaagggtaaacagaggagataccctatggtgtcccctaacctggcggcagcgcaaaagatg

SEQ ID NO: 87754 - DNA, 103 bp, Artificial Sequence
  Synthetic Polynucleotide
taatacgactcactataggggtgttgctcccgacaagccttcaggtactcaacagaggagagagtacatgaaggcttgtaacctggcggcagcgcaaaagatg

SEQ ID NO: 87755 - DNA, 103 bp, Artificial Sequence
  Synthetic Polynucleotide
taatacgactcactataggggggagacccaacttgaccacacaggggacaaacagaggagatgtcccatgtgtggtcaaaacctggcggcagcgcaaaagatg

SEQ ID NO: 87756 - DNA, 103 bp, Artificial Sequence
  Synthetic Polynucleotide
taatacgactcactatagggctgcctctgggggagacccaacttgaccacaacagaggagagtggtcatgttgggtctcaacctggcggcagcgcaaaagatg

SEQ ID NO: 87757 - DNA, 103 bp, Artificial Sequence
  Synthetic Polynucleotide
taatacgactcactatagggcctggaccatctgcctctgggggagacccaaacagaggagatgggtcatgcccagaggcaacctggcggcagcgcaaaagatg

SEQ ID NO: 87758 - DNA, 103 bp, Artificial Sequence
  Synthetic Polynucleotide
taatacgactcactatagggggtggctgagcctggaccatctgcctctggaacagaggagaccagagatggatggtccaaacctggcggcagcgcaaaagatg

SEQ ID NO: 87759 - DNA, 103 bp, Artificial Sequence
  Synthetic Polynucleotide
taatacgactcactatagggctgccccagaggtggctgagcctggaccataacagaggagaatggtcatggctcagccaaacctggcggcagcgcaaaagatg

SEQ ID NO: 87760 - DNA, 103 bp, Artificial Sequence
  Synthetic Polynucleotide
taatacgactcactataggggtggccttctctgccccagaggtggctgagaacagaggagactcagcatgctctggggcaacctggcggcagcgcaaaagatg

SEQ ID NO: 87761 - DNA, 103 bp, Artificial Sequence
  Synthetic Polynucleotide
taatacgactcactatagggtctcctcgtggtggccttctctgccccagaaacagaggagatctgggatggagaaggccaacctggcggcagcgcaaaagatg

SEQ ID NO: 87762 - DNA, 103 bp, Artificial Sequence
  Synthetic Polynucleotide
taatacgactcactatagggaagatgcttttctcctcgtggtggccttctaacagaggagaagaaggatgccacgaggaaacctggcggcagcgcaaaagatg

SEQ ID NO: 87763 - DNA, 103 bp, Artificial Sequence
  Synthetic Polynucleotide
taatacgactcactatagggctgggagttgaagatgcttttctcctcgtgaacagaggagacacgagatgaaaagcatcaacctggcggcagcgcaaaagatg

SEQ ID NO: 87764 - DNA, 103 bp, Artificial Sequence
  Synthetic Polynucleotide
taatacgactcactatagggctgcttggggctgggagttgaagatgctttaacagaggagaaaagcaatgtcaactcccaacctggcggcagcgcaaaagatg

SEQ ID NO: 87765 - DNA, 103 bp, Artificial Sequence
  Synthetic Polynucleotide
taatacgactcactataggggctgggcagggtgttgctcccgacaagcctaacagaggagaaggcttatggggagcaacaacctggcggcagcgcaaaagatg

SEQ ID NO: 87766 - DNA, 103 bp, Artificial Sequence
  Synthetic Polynucleotide
taatacgactcactataggggcttgctcctctgcttggggctgggagttgaacagaggagacaactcatggccccaagcaacctggcggcagcgcaaaagatg

SEQ ID NO: 87767 - DNA, 103 bp, Artificial Sequence
  Synthetic Polynucleotide
taatacgactcactataggggaccccgcctgcttgctcctctgcttggggaacagaggagaccccaaatggaggagcaaaacctggcggcagcgcaaaagatg

SEQ ID NO: 87768 - DNA, 103 bp, Artificial Sequence
  Synthetic Polynucleotide
taatacgactcactataggggcgtggcgacgaccccgcctgcttgctcctaacagaggagaaggagcatgcaggcggggaacctggcggcagcgcaaaagatg

SEQ ID NO: 87769 - DNA, 103 bp, Artificial Sequence
  Synthetic Polynucleotide
taatacgactcactatagggcggggggtgggcgtggcgacgaccccgcctaacagaggagaaggcggatgcgtcgccacaacctggcggcagcgcaaaagatg

SEQ ID NO: 87770 - DNA, 103 bp, Artificial Sequence
  Synthetic Polynucleotide
taatacgactcactatagggtaccacagtccggggggtgggcgtggcgacaacagaggagagtcgccatgcccacccccaacctggcggcagcgcaaaagatg

SEQ ID NO: 87771 - DNA, 103 bp, Artificial Sequence
  Synthetic Polynucleotide
taatacgactcactatagggtgttgccagataccacagtccggggggtggaacagaggagaccacccatgggactgtggaacctggcggcagcgcaaaagatg

SEQ ID NO: 87772 - DNA, 103 bp, Artificial Sequence
  Synthetic Polynucleotide
taatacgactcactatagggctgggggcgctgttgccagataccacagtcaacagaggagagactgtatgatctggcaaaacctggcggcagcgcaaaagatg

SEQ ID NO: 87773 - DNA, 103 bp, Artificial Sequence
  Synthetic Polynucleotide
taatacgactcactatagggggggctggtgctgggggcgctgttgccagaaacagaggagatctggcatgagcgcccccaacctggcggcagcgcaaaagatg

SEQ ID NO: 87774 - DNA, 103 bp, Artificial Sequence
  Synthetic Polynucleotide
taatacgactcactatagggaaaggctggaggggctggtgctgggggcgcaacagaggagagcgcccatggcaccagccaacctggcggcagcgcaaaagatg

SEQ ID NO: 87775 - DNA, 103 bp, Artificial Sequence
  Synthetic Polynucleotide
taatacgactcactatagggagatgtaggcaaaggctggaggggctggtgaacagaggagacaccagatgctccagcctaacctggcggcagcgcaaaagatg

SEQ ID NO: 87776 - DNA, 103 bp, Artificial Sequence
  Synthetic Polynucleotide
taatacgactcactatagggccggcaagcggctgggcagggtgttgctccaacagaggagaggagcaatgccctgcccaaacctggcggcagcgcaaaagatg

SEQ ID NO: 87777 - DNA, 103 bp, Artificial Sequence
  Synthetic Polynucleotide
taatacgactcactatagggggaaccgaggagatgtaggcaaaggctggaaacagaggagatccagcatgtgcctacataacctggcggcagcgcaaaagatg

SEQ ID NO: 87778 - DNA, 103 bp, Artificial Sequence
  Synthetic Polynucleotide
taatacgactcactatagggaggcatgatgggaaccgaggagatgtaggcaacagaggagagcctacatgtcctcggttaacctggcggcagcgcaaaagatg

SEQ ID NO: 87779 - DNA, 103 bp, Artificial Sequence
  Synthetic Polynucleotide
taatacgactcactatagggcaggtggataaggcatgatgggaaccgaggaacagaggagacctcggatgccatcatgcaacctggcggcagcgcaaaagatg

SEQ ID NO: 87780 - DNA, 103 bp, Artificial Sequence
  Synthetic Polynucleotide
taatacgactcactatagggtacacagcggcaggtggataaggcatgatgaacagaggagacatcatatgttatccaccaacctggcggcagcgcaaaagatg

SEQ ID NO: 87781 - DNA, 103 bp, Artificial Sequence
  Synthetic Polynucleotide
taatacgactcactatagggaggcgcatagtacacagcggcaggtggataaacagaggagatatccaatggccgctgtgaacctggcggcagcgcaaaagatg

SEQ ID NO: 87782 - DNA, 103 bp, Artificial Sequence
  Synthetic Polynucleotide
taatacgactcactatagggtaggtcctgcaggcgcatagtacacagcggaacagaggagaccgctgatgactatgcgcaacctggcggcagcgcaaaagatg

SEQ ID NO: 87783 - DNA, 103 bp, Artificial Sequence
  Synthetic Polynucleotide
taatacgactcactatagggtgggctgaggtaggtcctgcaggcgcatagaacagaggagactatgcatgtgcaggaccaacctggcggcagcgcaaaagatg

SEQ ID NO: 87784 - DNA, 103 bp, Artificial Sequence
  Synthetic Polynucleotide
taatacgactcactatagggggcagctggttgggctgaggtaggtcctgcaacagaggagagcaggaatgacctcagccaacctggcggcagcgcaaaagatg

SEQ ID NO: 87785 - DNA, 103 bp, Artificial Sequence
  Synthetic Polynucleotide
taatacgactcactataggggcggccacttggcagctggttgggctgaggaacagaggagacctcagatgaaccagctgaacctggcggcagcgcaaaagatg

SEQ ID NO: 87786 - DNA, 103 bp, Artificial Sequence
  Synthetic Polynucleotide
taatacgactcactataggggaggctgtgggcggccacttggcagctggtaacagaggagaaccagcatgcaagtggccaacctggcggcagcgcaaaagatg

SEQ ID NO: 87787 - DNA, 103 bp, Artificial Sequence
  Synthetic Polynucleotide
taatacgactcactatagggccccttggagccggcaagcggctgggcaggaacagaggagacctgccatgccgcttgccaacctggcggcagcgcaaaagatg

SEQ ID NO: 87788 - DNA, 103 bp, Artificial Sequence
  Synthetic Polynucleotide
taatacgactcactatagggtggtgggggagaggctgtgggcggccacttaacagaggagaaagtggatgcccacagccaacctggcggcagcgcaaaagatg

SEQ ID NO: 87789 - DNA, 103 bp, Artificial Sequence
  Synthetic Polynucleotide
taatacgactcactataggggtctccgggctggtgggggagaggctgtggaacagaggagaccacagatgctcccccacaacctggcggcagcgcaaaagatg

SEQ ID NO: 87790 - DNA, 103 bp, Artificial Sequence
  Synthetic Polynucleotide
taatacgactcactataggggagtgccggtgtctccgggctggtgggggaaacagaggagatcccccatgagcccggagaacctggcggcagcgcaaaagatg

SEQ ID NO: 87791 - DNA, 103 bp, Artificial Sequence
  Synthetic Polynucleotide
taatacgactcactataggggagctggatggagtgccggtgtctccgggcaacagaggagagcccggatgcaccggcacaacctggcggcagcgcaaaagatg

SEQ ID NO: 87792 - DNA, 103 bp, Artificial Sequence
  Synthetic Polynucleotide
taatacgactcactatagggcgcccaggtcgagctggatggagtgccggtaacagaggagaaccggcatgccatccagcaacctggcggcagcgcaaaagatg

SEQ ID NO: 87793 - DNA, 103 bp, Artificial Sequence
  Synthetic Polynucleotide
taatacgactcactatagggtcctctaggtcgcccaggtcgagctggatgaacagaggagacatccaatgcgacctgggaacctggcggcagcgcaaaagatg

SEQ ID NO: 87794 - DNA, 103 bp, Artificial Sequence
  Synthetic Polynucleotide
taatacgactcactatagggcttgttgagctcctctaggtcgcccaggtcaacagaggagagacctgatggacctagagaacctggcggcagcgcaaaagatg

SEQ ID NO: 87795 - DNA, 103 bp, Artificial Sequence
  Synthetic Polynucleotide
taatacgactcactatagggggctcagggccttgttgagctcctctaggtaacagaggagaacctagatgagctcaacaaacctggcggcagcgcaaaagatg

SEQ ID NO: 87796 - DNA, 103 bp, Artificial Sequence
  Synthetic Polynucleotide
taatacgactcactatagggtgcacggcccggctcagggccttgttgagcaacagaggagagctcaaatgggccctgagaacctggcggcagcgcaaaagatg

SEQ ID NO: 87797 - DNA, 103 bp, Artificial Sequence
  Synthetic Polynucleotide
taatacgactcactatagggctcggcagcctgcacggcccggctcagggcaacagaggagagccctgatgcgggccgtgaacctggcggcagcgcaaaagatg

SEQ ID NO: 87798 - DNA, 103 bp, Artificial Sequence
  Synthetic Polynucleotide
taatacgactcactatagggttccaggcgtccccttggagccggcaagcgaacagaggagacgcttgatggctccaaggaacctggcggcagcgcaaaagatg

SEQ ID NO: 87799 - DNA, 103 bp, Artificial Sequence
  Synthetic Polynucleotide
taatacgactcactatagggagcggacgctctcggcagcctgcacggcccaacagaggagagggccgatgaggctgccgaacctggcggcagcgcaaaagatg

SEQ ID NO: 87800 - DNA, 103 bp, Artificial Sequence
  Synthetic Polynucleotide
taatacgactcactatagggctggtggtagagcggacgctctcggcagccaacagaggagaggctgcatggagcgtccgaacctggcggcagcgcaaaagatg

SEQ ID NO: 87801 - DNA, 103 bp, Artificial Sequence
  Synthetic Polynucleotide
taatacgactcactatagggtctcatctgcctggtggtagagcggacgctaacagaggagaagcgtcatgtctaccaccaacctggcggcagcgcaaaagatg

SEQ ID NO: 87802 - DNA, 103 bp, Artificial Sequence
  Synthetic Polynucleotide
taatacgactcactatagggacagcgagcttctcatctgcctggtggtagaacagaggagactaccaatgggcagatgaaacctggcggcagcgcaaaagatg

SEQ ID NO: 87803 - DNA, 103 bp, Artificial Sequence
  Synthetic Polynucleotide
taatacgactcactatagggaggtcggctgacagcgagcttctcatctgcaacagaggagagcagatatgaagctcgctaacctggcggcagcgcaaaagatg

SEQ ID NO: 87804 - DNA, 103 bp, Artificial Sequence
  Synthetic Polynucleotide
taatacgactcactatagggagcctggcgcaggtcggctgacagcgagctaacagaggagaagctcgatgtcagccgacaacctggcggcagcgcaaaagatg

SEQ ID NO: 87805 - DNA, 103 bp, Artificial Sequence
  Synthetic Polynucleotide
taatacgactcactataggggcaggctgtgagcctggcgcaggtcggctgaacagaggagacagccgatgtgcgccaggaacctggcggcagcgcaaaagatg

SEQ ID NO: 87806 - DNA, 103 bp, Artificial Sequence
  Synthetic Polynucleotide
taatacgactcactatagggcaggagccccgcaggctgtgagcctggcgcaacagaggagagcgccaatgtcacagcctaacctggcggcagcgcaaaagatg

SEQ ID NO: 87807 - DNA, 103 bp, Artificial Sequence
  Synthetic Polynucleotide
taatacgactcactatagggtcagaagaggcaggagccccgcaggctgtgaacagaggagacacagcatgcggggctccaacctggcggcagcgcaaaagatg

SEQ ID NO: 87808 - DNA, 103 bp, Artificial Sequence
  Synthetic Polynucleotide
taatacgactcactatagggggatcaaatcttccaggcgtccccttggagaacagaggagactccaaatggacgcctggaacctggcggcagcgcaaaagatg

SEQ ID NO: 87809 - DNA, 103 bp, Artificial Sequence
  Synthetic Polynucleotide
taatacgactcactatagggctccctgcgaggatcaaatcttccaggcgtaacagaggagaacgcctatgagatttgataacctggcggcagcgcaaaagatg

SEQ ID NO: 87810 - DNA, 103 bp, Artificial Sequence
  Synthetic Polynucleotide
taatacgactcactatagggctgcctccagctccctgcgaggatcaaatcaacagaggagagatttgatgctcgcagggaacctggcggcagcgcaaaagatg

SEQ ID NO: 87811 - DNA, 103 bp, Artificial Sequence
  Synthetic Polynucleotide
taatacgactcactatagggtggtcctcagagatgtcccggttctccggaaacagaggagatccggaatgccgggacataacctggcggcagcgcaaaagatg

SEQ ID NO: 87812 - DNA, 103 bp, Artificial Sequence
  Synthetic Polynucleotide
taatacgactcactatagggcggtatatctctgcctccagctccctgcgaaacagaggagatcgcagatggctggaggcaacctggcggcagcgcaaaagatg

SEQ ID NO: 87813 - DNA, 103 bp, Artificial Sequence
  Synthetic Polynucleotide
taatacgactcactataggggcttcccagacggtatatctctgcctccagaacagaggagactggagatggagatatacaacctggcggcagcgcaaaagatg

SEQ ID NO: 87814 - DNA, 103 bp, Artificial Sequence
  Synthetic Polynucleotide
taatacgactcactatagggcttccaggcagcttcccagacggtatatctaacagaggagaagatatatggtctgggaaaacctggcggcagcgcaaaagatg

SEQ ID NO: 87815 - DNA, 103 bp, Artificial Sequence
  Synthetic Polynucleotide
taatacgactcactatagggtccttcagctcttccaggcagcttcccagaaacagaggagatctgggatgctgcctggaaacctggcggcagcgcaaaagatg

SEQ ID NO: 87816 - DNA, 103 bp, Artificial Sequence
  Synthetic Polynucleotide
taatacgactcactataggggtctatgtgttccttcagctcttccaggcaaacagaggagatgcctgatggagctgaagaacctggcggcagcgcaaaagatg

SEQ ID NO: 87817 - DNA, 103 bp, Artificial Sequence
  Synthetic Polynucleotide
taatacgactcactataggggctgggtctggtctatgtgttccttcagctaacagaggagaagctgaatgaacacatagaacctggcggcagcgcaaaagatg

SEQ ID NO: 87818 - DNA, 103 bp, Artificial Sequence
  Synthetic Polynucleotide
taatacgactcactatagggtcaggctcttgctgggtctggtctatgtgtaacagaggagaacacatatgccagacccaaacctggcggcagcgcaaaagatg

SEQ ID NO: 87819 - DNA, 103 bp, Artificial Sequence
  Synthetic Polynucleotide
taatacgactcactatagggcccgggcggctcaggctcttgctgggtctgaacagaggagacagaccatgcaagagcctaacctggcggcagcgcaaaagatg

SEQ ID NO: 87820 - DNA, 103 bp, Artificial Sequence
  Synthetic Polynucleotide
taatacgactcactatagggctgagtctgacccgggcggctcaggctcttaacagaggagaaagagcatgagccgcccgaacctggcggcagcgcaaaagatg

SEQ ID NO: 87821 - DNA, 103 bp, Artificial Sequence
  Synthetic Polynucleotide
taatacgactcactatagggctgtccagagctgagtctgacccgggcggcaacagaggagagccgccatggtcagactcaacctggcggcagcgcaaaagatg

SEQ ID NO: 87822 - DNA, 103 bp, Artificial Sequence
  Synthetic Polynucleotide
taatacgactcactatagggtgctgaggactggtcctcagagatgtcccgaacagaggagacgggacatgtctgaggacaacctggcggcagcgcaaaagatg

SEQ ID NO: 87823 - DNA, 103 bp, Artificial Sequence
  Synthetic Polynucleotide
taatacgactcactatagggggctggggtgctgtccagagctgagtctgaaacagaggagatcagacatggctctggacaacctggcggcagcgcaaaagatg

SEQ ID NO: 87824 - DNA, 103 bp, Artificial Sequence
  Synthetic Polynucleotide
taatacgactcactatagggggcagggcagggctggggtgctgtccagagaacagaggagactctggatggcaccccagaacctggcggcagcgcaaaagatg

SEQ ID NO: 87825 - DNA, 103 bp, Artificial Sequence
  Synthetic Polynucleotide
taatacgactcactatagggggctgatggaggcagggcagggctggggtgaacagaggagacaccccatgcctgccctgaacctggcggcagcgcaaaagatg

SEQ ID NO: 87826 - DNA, 103 bp, Artificial Sequence
  Synthetic Polynucleotide
taatacgactcactatagggcaggtgcgttggctgatggaggcagggcagaacagaggagactgcccatgctccatcagaacctggcggcagcgcaaaagatg

SEQ ID NO: 87827 - DNA, 103 bp, Artificial Sequence
  Synthetic Polynucleotide
taatacgactcactatagggaaggagcaggcaggtgcgttggctgatggaaacagaggagatccatcatgcaacgcaccaacctggcggcagcgcaaaagatg

SEQ ID NO: 87828 - DNA, 103 bp, Artificial Sequence
  Synthetic Polynucleotide
taatacgactcactataggggcttgtccagaaggagcaggcaggtgcgttaacagaggagaaacgcaatggcctgctccaacctggcggcagcgcaaaagatg

SEQ ID NO: 87829 - DNA, 103 bp, Artificial Sequence
  Synthetic Polynucleotide
taatacgactcactatagggtggcatgggggcttgtccagaaggagcaggaacagaggagacctgctatgtctggacaaaacctggcggcagcgcaaaagatg

SEQ ID NO: 87830 - DNA, 103 bp, Artificial Sequence
  Synthetic Polynucleotide
taatacgactcactatagggtcttgatggctggcatgggggcttgtccagaacagaggagactggacatgcccccatgcaacctggcggcagcgcaaaagatg

SEQ ID NO: 87831 - DNA, 103 bp, Artificial Sequence
  Synthetic Polynucleotide
taatacgactcactataggggggcaggaggtcttgatggctggcatggggaacagaggagaccccatatgagccatcaaaacctggcggcagcgcaaaagatg

SEQ ID NO: 87832 - DNA, 103 bp, Artificial Sequence
  Synthetic Polynucleotide
taatacgactcactatagggagcaggctcagggcaggaggtcttgatggcaacagaggagagccatcatgacctcctgcaacctggcggcagcgcaaaagatg

SEQ ID NO: 87833 - DNA, 103 bp, Artificial Sequence
  Synthetic Polynucleotide
taatacgactcactataggggggtctgctctgctgaggactggtcctcagaacagaggagactgaggatgagtcctcagaacctggcggcagcgcaaaagatg

SEQ ID NO: 87834 - DNA, 103 bp, Artificial Sequence
  Synthetic Polynucleotide
taatacgactcactatagggcagtggtggtagcaggctcagggcaggaggaacagaggagacctcctatgctgagcctgaacctggcggcagcgcaaaagatg

SEQ ID NO: 87835 - DNA, 103 bp, Artificial Sequence
  Synthetic Polynucleotide
taatacgactcactatagggctggcggcggcagtggtggtagcaggctcaaacagaggagatgagccatgtaccaccacaacctggcggcagcgcaaaagatg

SEQ ID NO: 87836 - DNA, 103 bp, Artificial Sequence
  Synthetic Polynucleotide
taatacgactcactatagggggggccagtgctggcggcggcagtggtggtaacagaggagaaccaccatggccgccgccaacctggcggcagcgcaaaagatg

SEQ ID NO: 87837 - DNA, 103 bp, Artificial Sequence
  Synthetic Polynucleotide
taatacgactcactataggggcaatgggcaggggccagtgctggcggcggaacagaggagaccgccgatggcactggccaacctggcggcagcgcaaaagatg

SEQ ID NO: 87838 - DNA, 103 bp, Artificial Sequence
  Synthetic Polynucleotide
taatacgactcactatagggacatttacgtgcaatgggcaggggccagtgaacagaggagacactggatgctgcccattaacctggcggcagcgcaaaagatg

SEQ ID NO: 87839 - DNA, 103 bp, Artificial Sequence
  Synthetic Polynucleotide
taatacgactcactataggggctcacctccacatttacgtgcaatgggcaaacagaggagatgcccaatgcacgtaaataacctggcggcagcgcaaaagatg

SEQ ID NO: 87840 - DNA, 103 bp, Artificial Sequence
  Synthetic Polynucleotide
taatacgactcactatagggtgttgccagagctcacctccacatttacgtaacagaggagaacgtaaatgtggaggtgaaacctggcggcagcgcaaaagatg

SEQ ID NO: 87841 - DNA, 103 bp, Artificial Sequence
  Synthetic Polynucleotide
taatacgactcactatagggtccacctcactgttgccagagctcacctccaacagaggagaggaggtatgctctggcaaaacctggcggcagcgcaaaagatg

SEQ ID NO: 87842 - DNA, 103 bp, Artificial Sequence
  Synthetic Polynucleotide
taatacgactcactatagggtggcctgtcctccacctcactgttgccagaaacagaggagatctggcatgagtgaggtgaacctggcggcagcgcaaaagatg

SEQ ID NO: 87843 - DNA, 103 bp, Artificial Sequence
  Synthetic Polynucleotide
taatacgactcactataggggggggtcctgtggcctgtcctccacctcacaacagaggagagtgaggatgaggacaggcaacctggcggcagcgcaaaagatg

SEQ ID NO: 87844 - DNA, 103 bp, Artificial Sequence
  Synthetic Polynucleotide
taatacgactcactataggggccagtgcctgggtctgctctgctgaggacaacagaggagagtcctcatgagagcagacaacctggcggcagcgcaaaagatg

SEQ ID NO: 87845 - DNA, 103 bp, Artificial Sequence
  Synthetic Polynucleotide
taatacgactcactatagggagtcgggccagggggtcctgtggcctgtccaacagaggagaggacagatgacaggacccaacctggcggcagcgcaaaagatg

SEQ ID NO: 87846 - DNA, 103 bp, Artificial Sequence
  Synthetic Polynucleotide
taatacgactcactatagggcttgtgcctgagtcgggccagggggtcctgaacagaggagacaggacatgctggcccgaaacctggcggcagcgcaaaagatg

SEQ ID NO: 87847 - DNA, 103 bp, Artificial Sequence
  Synthetic Polynucleotide
taatacgactcactatagggtctgcagctccttgtgcctgagtcgggccaaacagaggagatggcccatgtcaggcacaaacctggcggcagcgcaaaagatg

SEQ ID NO: 87848 - DNA, 103 bp, Artificial Sequence
  Synthetic Polynucleotide
taatacgactcactatagggacttgctccatctgcagctccttgtgcctgaacagaggagacaggcaatgggagctgcaaacctggcggcagcgcaaaagatg

SEQ ID NO: 87849 - DNA, 103 bp, Artificial Sequence
  Synthetic Polynucleotide
taatacgactcactataggggccatggtaaacttgctccatctgcagctcaacagaggagagagctgatgatggagcaaaacctggcggcagcgcaaaagatg

SEQ ID NO: 87850 - DNA, 103 bp, Artificial Sequence
  Synthetic Polynucleotide
taatacgactcactataggggctccatgaggccatggtaaacttgctccaaacagaggagatggagcatgtttaccatgaacctggcggcagcgcaaaagatg

SEQ ID NO: 87851 - DNA, 103 bp, Artificial Sequence
  Synthetic Polynucleotide
taatacgactcactatagggctgaggtaccgctccatgaggccatggtaaaacagaggagattaccaatgcctcatggaaacctggcggcagcgcaaaagatg

SEQ ID NO: 87852 - DNA, 103 bp, Artificial Sequence
  Synthetic Polynucleotide
taatacgactcactatagggagacttcacactgaggtaccgctccatgagaacagaggagactcatgatgcggtacctcaacctggcggcagcgcaaaagatg

SEQ ID NO: 87853 - DNA, 103 bp, Artificial Sequence
  Synthetic Polynucleotide
taatacgactcactatagggcttctgggagagacttcacactgaggtaccaacagaggagaggtaccatggtgtgaagtaacctggcggcagcgcaaaagatg

SEQ ID NO: 87854 - DNA, 103 bp, Artificial Sequence
  Synthetic Polynucleotide
taatacgactcactatagggattctcatggcttctgggagagacttcacaaacagaggagatgtgaaatgtctcccagaaacctggcggcagcgcaaaagatg

SEQ ID NO: 87855 - DNA, 103 bp, Artificial Sequence
  Synthetic Polynucleotide
taatacgactcactatagggggcctgagaagccagtgcctgggtctgctcaacagaggagagagcagatgcaggcactgaacctggcggcagcgcaaaagatg

SEQ ID NO: 87856 - DNA, 103 bp, Artificial Sequence
  Synthetic Polynucleotide
taatacgactcactatagggctcctcctccattctcatggcttctgggagaacagaggagactcccaatggccatgagaaacctggcggcagcgcaaaagatg

SEQ ID NO: 87857 - DNA, 103 bp, Artificial Sequence
  Synthetic Polynucleotide
taatacgactcactatagggctccttcttcctcctcctccattctcatggaacagaggagaccatgaatgtggaggaggaacctggcggcagcgcaaaagatg

SEQ ID NO: 87858 - DNA, 103 bp, Artificial Sequence
  Synthetic Polynucleotide
taatacgactcactatagggtcctcctcctctccttcttcctcctcctccaacagaggagaggaggaatgggaagaaggaacctggcggcagcgcaaaagatg

SEQ ID NO: 87859 - DNA, 103 bp, Artificial Sequence
  Synthetic Polynucleotide
taatacgactcactatagggctcttcctcctcctcctcctctccttcttcaacagaggagagaagaaatggaggaggagaacctggcggcagcgcaaaagatg

SEQ ID NO: 87860 - DNA, 103 bp, Artificial Sequence
  Synthetic Polynucleotide
taatacgactcactatagggcacctcccccctcttcctcctcctcctcctaacagaggagaaggaggatgaggaggaagaacctggcggcagcgcaaaagatg

SEQ ID NO: 87861 - DNA, 103 bp, Artificial Sequence
  Synthetic Polynucleotide
taatacgactcactatagggtccagggagtcacctcccccctcttcctccaacagaggagaggaggaatgggggggaggaacctggcggcagcgcaaaagatg

SEQ ID NO: 87862 - DNA, 103 bp, Artificial Sequence
  Synthetic Polynucleotide
taatacgactcactatagggcccatcaacttccagggagtcacctcccccaacagaggagagggggaatggactccctgaacctggcggcagcgcaaaagatg

SEQ ID NO: 87863 - DNA, 103 bp, Artificial Sequence
  Synthetic Polynucleotide
taatacgactcactatagggttgcagccaccccatcaacttccagggagtaacagaggagaactcccatgaagttgatgaacctggcggcagcgcaaaagatg

SEQ ID NO: 87864 - DNA, 103 bp, Artificial Sequence
  Synthetic Polynucleotide
taatacgactcactatagggttccctggagttgcagccaccccatcaactaacagaggagaagttgaatgggtggctgcaacctggcggcagcgcaaaagatg

SEQ ID NO: 87865 - DNA, 103 bp, Artificial Sequence
  Synthetic Polynucleotide
taatacgactcactatagggggcctctgctttccctggagttgcagccacaacagaggagagtggctatgactccagggaacctggcggcagcgcaaaagatg

SEQ ID NO: 87866 - DNA, 103 bp, Artificial Sequence
  Synthetic Polynucleotide
taatacgactcactatagggggaactggctggcctgagaagccagtgcctaacagaggagaaggcacatgcttctcaggaacctggcggcagcgcaaaagatg

SEQ ID NO: 87867 - DNA, 103 bp, Artificial Sequence
  Synthetic Polynucleotide
taatacgactcactatagggggaccctggtggcctctgctttccctggagaacagaggagactccagatgaagcagaggaacctggcggcagcgcaaaagatg

SEQ ID NO: 87868 - DNA, 103 bp, Artificial Sequence
  Synthetic Polynucleotide
taatacgactcactatagggtgccttgggaggaccctggtggcctctgctaacagaggagaagcagaatgcaccagggtaacctggcggcagcgcaaaagatg

SEQ ID NO: 87869 - DNA, 103 bp, Artificial Sequence
  Synthetic Polynucleotide
taatacgactcactatagggcaccgggcactgccttgggaggaccctggtaacagaggagaaccaggatgctcccaaggaacctggcggcagcgcaaaagatg

SEQ ID NO: 87870 - DNA, 103 bp, Artificial Sequence
  Synthetic Polynucleotide
taatacgactcactatagggtctcagcctgcaccgggcactgccttgggaaacagaggagatcccaaatgagtgcccggaacctggcggcagcgcaaaagatg

SEQ ID NO: 87871 - DNA, 103 bp, Artificial Sequence
  Synthetic Polynucleotide
taatacgactcactatagggccatgacttttctcagcctgcaccgggcacaacagaggagagtgcccatggcaggctgaaacctggcggcagcgcaaaagatg

SEQ ID NO: 87872 - DNA, 103 bp, Artificial Sequence
  Synthetic Polynucleotide
taatacgactcactatagggcaggggagccccatgacttttctcagcctgaacagaggagacaggctatgaaaagtcataacctggcggcagcgcaaaagatg

SEQ ID NO: 87873 - DNA, 103 bp, Artificial Sequence
  Synthetic Polynucleotide
taatacgactcactatagggtggcctcctccaggggagccccatgactttaacagaggagaaaagtcatggggctccccaacctggcggcagcgcaaaagatg

SEQ ID NO: 87874 - DNA, 103 bp, Artificial Sequence
  Synthetic Polynucleotide
taatacgactcactatagggatcttctccgtggcctcctccaggggagccaacagaggagaggctccatgggaggaggcaacctggcggcagcgcaaaagatg

SEQ ID NO: 87875 - DNA, 103 bp, Artificial Sequence
  Synthetic Polynucleotide
taatacgactcactatagggcatagataccatcttctccgtggcctcctcaacagaggagagaggagatgacggagaagaacctggcggcagcgcaaaagatg

SEQ ID NO: 87876 - DNA, 103 bp, Artificial Sequence
  Synthetic Polynucleotide
taatacgactcactatagggctggtggcttcatagataccatcttctccgaacagaggagacggagaatgtggtatctaaacctggcggcagcgcaaaagatg

SEQ ID NO: 87877 - DNA, 103 bp, Artificial Sequence
  Synthetic Polynucleotide
taatacgactcactatagggaccttggccaggaactggctggcctgagaaaacagaggagattctcaatgcagccagttaacctggcggcagcgcaaaagatg

SEQ ID NO: 87878 - DNA, 103 bp, Artificial Sequence
  Synthetic Polynucleotide
taatacgactcactataggggcctggaaacctggtggcttcatagataccaacagaggagaggtatcatggaagccaccaacctggcggcagcgcaaaagatg

SEQ ID NO: 87879 - DNA, 103 bp, Artificial Sequence
  Synthetic Polynucleotide
taatacgactcactatagggagccagggatgcctggaaacctggtggcttaacagaggagaaagccaatgggtttccagaacctggcggcagcgcaaaagatg

SEQ ID NO: 87880 - DNA, 103 bp, Artificial Sequence
  Synthetic Polynucleotide
taatacgactcactataggggcccgtctctagccagggatgcctggaaacaacagaggagagtttccatgcatccctggaacctggcggcagcgcaaaagatg

SEQ ID NO: 87881 - DNA, 103 bp, Artificial Sequence
  Synthetic Polynucleotide
taatacgactcactatagggcctgacatgtgcccgtctctagccagggataacagaggagaatccctatgtagagacggaacctggcggcagcgcaaaagatg

SEQ ID NO: 87882 - DNA, 103 bp, Artificial Sequence
  Synthetic Polynucleotide
taatacgactcactatagggcttgcccaggcctgacatgtgcccgtctctaacagaggagaagagacatgcacatgtcaaacctggcggcagcgcaaaagatg

SEQ ID NO: 87883 - DNA, 103 bp, Artificial Sequence
  Synthetic Polynucleotide
taatacgactcactatagggctgcctcagccttgcccaggcctgacatgtaacagaggagaacatgtatggcctgggcaaacctggcggcagcgcaaaagatg

SEQ ID NO: 87884 - DNA, 103 bp, Artificial Sequence
  Synthetic Polynucleotide
taatacgactcactatagggcctggaggggctgcctcagccttgcccaggaacagaggagacctgggatgggctgaggcaacctggcggcagcgcaaaagatg

SEQ ID NO: 87885 - DNA, 103 bp, Artificial Sequence
  Synthetic Polynucleotide
taatacgactcactatagggcacgccagggcctggaggggctgcctcagcaacagaggagagctgagatggcccctccaaacctggcggcagcgcaaaagatg

SEQ ID NO: 87886 - DNA, 103 bp, Artificial Sequence
  Synthetic Polynucleotide
taatacgactcactatagggggtggggtggcacgccagggcctggaggggaacagaggagacccctcatggccctggcgaacctggcggcagcgcaaaagatg

SEQ ID NO: 87887 - DNA, 103 bp, Artificial Sequence
  Synthetic Polynucleotide
taatacgactcactataggggtgcctggagggtggggtggcacgccagggaacagaggagaccctggatggccaccccaaacctggcggcagcgcaaaagatg

SEQ ID NO: 87888 - DNA, 103 bp, Artificial Sequence
  Synthetic Polynucleotide
taatacgactcactatagggctcttcctcttcctcttcctcctcctcttcaacagaggagagaagagatggaggaagagaacctggcggcagcgcaaaagatg

SEQ ID NO: 87889 - DNA, 103 bp, Artificial Sequence
  Synthetic Polynucleotide
taatacgactcactatagggttctgggccccggagctcaggggccttctgaacagaggagacagaagatgcctgagctcaacctggcggcagcgcaaaagatg

SEQ ID NO: 87890 - DNA, 103 bp, Artificial Sequence
  Synthetic Polynucleotide
taatacgactcactatagggggcagtggcagccatgtgtgcagcctcggcaacagaggagagccgagatggcacacatgaacctggcggcagcgcaaaagatg

SEQ ID NO: 87891 - DNA, 103 bp, Artificial Sequence
  Synthetic Polynucleotide
taatacgactcactatagggggttcaggatggcagtggcagccatgtgtgaacagaggagacacacaatgctgccactgaacctggcggcagcgcaaaagatg

SEQ ID NO: 87892 - DNA, 103 bp, Artificial Sequence
  Synthetic Polynucleotide
taatacgactcactatagggcgcgtggagaggttcaggatggcagtggcaaacagaggagatgccacatgcatcctgaaaacctggcggcagcgcaaaagatg

SEQ ID NO: 87893 - DNA, 103 bp, Artificial Sequence
  Synthetic Polynucleotide
taatacgactcactatagggctcccagcagcgcgtggagaggttcaggataacagaggagaatcctgatgctctccacgaacctggcggcagcgcaaaagatg

SEQ ID NO: 87894 - DNA, 103 bp, Artificial Sequence
  Synthetic Polynucleotide
taatacgactcactatagggtctcaggcatctcccagcagcgcgtggagaaacagaggagatctccaatggctgctgggaacctggcggcagcgcaaaagatg

SEQ ID NO: 87895 - DNA, 103 bp, Artificial Sequence
  Synthetic Polynucleotide
taatacgactcactataggggtgctgaggttctcaggcatctcccagcagaacagaggagactgctgatggatgcctgaaacctggcggcagcgcaaaagatg

SEQ ID NO: 87896 - DNA, 103 bp, Artificial Sequence
  Synthetic Polynucleotide
taatacgactcactatagggctgtggcttcgtgctgaggttctcaggcataacagaggagaatgcctatgaacctcagcaacctggcggcagcgcaaaagatg

SEQ ID NO: 87897 - DNA, 103 bp, Artificial Sequence
  Synthetic Polynucleotide
taatacgactcactatagggtggggaggtcctgtggcttcgtgctgaggtaacagaggagaacctcaatgcgaagccacaacctggcggcagcgcaaaagatg

SEQ ID NO: 87898 - DNA, 103 bp, Artificial Sequence
  Synthetic Polynucleotide
taatacgactcactatagggacagacttgctggggaggtcctgtggcttcaacagaggagagaagccatgggacctcccaacctggcggcagcgcaaaagatg

SEQ ID NO: 87899 - DNA, 103 bp, Artificial Sequence
  Synthetic Polynucleotide
taatacgactcactatagggctcgatatccacagacttgctggggaggtcaacagaggagagacctcatgagcaagtctaacctggcggcagcgcaaaagatg

SEQ ID NO: 87900 - DNA, 103 bp, Artificial Sequence
  Synthetic Polynucleotide
taatacgactcactataggggactgggtgattctgggccccggagctcagaacagaggagactgagcatgggggcccagaacctggcggcagcgcaaaagatg

SEQ ID NO: 87901 - DNA, 103 bp, Artificial Sequence
  Synthetic Polynucleotide
taatacgactcactatagggtttcgtctacctcgatatccacagacttgcaacagaggagagcaagtatgtggatatcgaacctggcggcagcgcaaaagatg

SEQ ID NO: 87902 - DNA, 103 bp, Artificial Sequence
  Synthetic Polynucleotide
taatacgactcactatagggagggttccattttcgtctacctcgatatccaacagaggagaggatatatgggtagacgaaacctggcggcagcgcaaaagatg

SEQ ID NO: 87903 - DNA, 103 bp, Artificial Sequence
  Synthetic Polynucleotide
taatacgactcactataggggctcaagtccagggttccattttcgtctacaacagaggagagtagacatgaatggaaccaacctggcggcagcgcaaaagatg

SEQ ID NO: 87904 - DNA, 103 bp, Artificial Sequence
  Synthetic Polynucleotide
taatacgactcactataggggtttgtgcatgctcaagtccagggttccataacagaggagaatggaaatgtggacttgaaacctggcggcagcgcaaaagatg

SEQ ID NO: 87905 - DNA, 103 bp, Artificial Sequence
  Synthetic Polynucleotide
taatacgactcactatagggcgtttgcggtgtttgtgcatgctcaagtccaacagaggagaggacttatgcatgcacaaaacctggcggcagcgcaaaagatg

SEQ ID NO: 87906 - DNA, 103 bp, Artificial Sequence
  Synthetic Polynucleotide
taatacgactcactatagggagcattttctcgtttgcggtgtttgtgcataacagaggagaatgcacatgcaccgcaaaaacctggcggcagcgcaaaagatg

SEQ ID NO: 87907 - DNA, 103 bp, Artificial Sequence
  Synthetic Polynucleotide
taatacgactcactatagggtgctggggaaagcattttctcgtttgcggtaacagaggagaaccgcaatggagaaaatgaacctggcggcagcgcaaaagatg

SEQ ID NO: 87908 - DNA, 103 bp, Artificial Sequence
  Synthetic Polynucleotide
taatacgactcactatagggcagctgctgctgctggggaaagcattttctaacagaggagaagaaaaatgtttccccagaacctggcggcagcgcaaaagatg

SEQ ID NO: 87909 - DNA, 103 bp, Artificial Sequence
  Synthetic Polynucleotide
taatacgactcactataggggctgctgctgcagctgctgctgctggggaaaacagaggagattccccatgagcagcagcaacctggcggcagcgcaaaagatg

SEQ ID NO: 87910 - DNA, 103 bp, Artificial Sequence
  Synthetic Polynucleotide
taatacgactcactatagggtcacaccggggctgctgctgcagctgctgcaacagaggagagcagcaatggcagcagcaaacctggcggcagcgcaaaagatg

SEQ ID NO: 87911 - DNA, 103 bp, Artificial Sequence
  Synthetic Polynucleotide
taatacgactcactatagggtcaggcttgggactgggtgattctgggcccaacagaggagagggcccatgatcacccagaacctggcggcagcgcaaaagatg

SEQ ID NO: 87912 - DNA, 103 bp, Artificial Sequence
  Synthetic Polynucleotide
taatacgactcactatagggtcgggagacttcacaccggggctgctgctgaacagaggagacagcagatgccccggtgtaacctggcggcagcgcaaaagatg

SEQ ID NO: 87913 - DNA, 103 bp, Artificial Sequence
  Synthetic Polynucleotide
taatacgactcactatagggctgggaggcgtcgggagacttcacaccgggaacagaggagacccggtatgaagtctcccaacctggcggcagcgcaaaagatg

SEQ ID NO: 87914 - DNA, 103 bp, Artificial Sequence
  Synthetic Polynucleotide
taatacgactcactatagggtgctgtggcgctgggaggcgtcgggagactaacagaggagaagtctcatgacgcctcccaacctggcggcagcgcaaaagatg

SEQ ID NO: 87915 - DNA, 103 bp, Artificial Sequence
  Synthetic Polynucleotide
taatacgactcactataggggcgctggtgctgctgtggcgctgggaggcgaacagaggagacgcctcatggcgccacagaacctggcggcagcgcaaaagatg

SEQ ID NO: 87916 - DNA, 103 bp, Artificial Sequence
  Synthetic Polynucleotide
taatacgactcactataggggctgctgggggcgctggtgctgctgtggcgaacagaggagacgccacatgagcaccagcaacctggcggcagcgcaaaagatg

SEQ ID NO: 87917 - DNA, 103 bp, Artificial Sequence
  Synthetic Polynucleotide
taatacgactcactatagggaggtcatggagctgctgggggcgctggtgcaacagaggagagcaccaatgcccccagcaaacctggcggcagcgcaaaagatg

SEQ ID NO: 87918 - DNA, 103 bp, Artificial Sequence
  Synthetic Polynucleotide
taatacgactcactataggggactggggagaggtcatggagctgctggggaacagaggagaccccagatgctccatgacaacctggcggcagcgcaaaagatg

SEQ ID NO: 87919 - DNA, 103 bp, Artificial Sequence
  Synthetic Polynucleotide
taatacgactcactatagggggcctggctggactggggagaggtcatggaaacagaggagatccatgatgtctccccagaacctggcggcagcgcaaaagatg

SEQ ID NO: 87920 - DNA, 103 bp, Artificial Sequence
  Synthetic Polynucleotide
taatacgactcactatagggcctggcgggaggcctggctggactggggagaacagaggagactccccatgccagccaggaacctggcggcagcgcaaaagatg

SEQ ID NO: 87921 - DNA, 103 bp, Artificial Sequence
  Synthetic Polynucleotide
taatacgactcactatagggtcccactcgtcctggcgggaggcctggctgaacagaggagacagccaatgctcccgccaaacctggcggcagcgcaaaagatg

SEQ ID NO: 87922 - DNA, 103 bp, Artificial Sequence
  Synthetic Polynucleotide
taatacgactcactatagggaacagagtactcaggcttgggactgggtgaaacagaggagatcacccatgcccaagcctaacctggcggcagcgcaaaagatg

SEQ ID NO: 87923 - DNA, 103 bp, Artificial Sequence
  Synthetic Polynucleotide
taatacgactcactatagggcaggggccggtcccactcgtcctggcgggaaacagaggagatcccgcatggacgagtggaacctggcggcagcgcaaaagatg

SEQ ID NO: 87924 - DNA, 103 bp, Artificial Sequence
  Synthetic Polynucleotide
taatacgactcactatagggtggtgtagtccaggggccggtcccactcgtaacagaggagaacgagtatgaccggccccaacctggcggcagcgcaaaagatg

SEQ ID NO: 87925 - DNA, 103 bp, Artificial Sequence
  Synthetic Polynucleotide
taatacgactcactatagggcggctaggcttggtgtagtccaggggccggaacagaggagaccggccatgggactacacaacctggcggcagcgcaaaagatg

SEQ ID NO: 87926 - DNA, 103 bp, Artificial Sequence
  Synthetic Polynucleotide
taatacgactcactatagggctctctcaggcggctaggcttggtgtagtcaacagaggagagactacatgaagcctagcaacctggcggcagcgcaaaagatg

SEQ ID NO: 87927 - DNA, 103 bp, Artificial Sequence
  Synthetic Polynucleotide
taatacgactcactatagggcaggttcctcctctctcaggcggctaggctaacagaggagaagcctaatggcctgagagaacctggcggcagcgcaaaagatg

SEQ ID NO: 87928 - DNA, 103 bp, Artificial Sequence
  Synthetic Polynucleotide
taatacgactcactatagggtctgactcctcaggttcctcctctctcaggaacagaggagacctgagatgggaggaaccaacctggcggcagcgcaaaagatg

SEQ ID NO: 87929 - DNA, 103 bp, Artificial Sequence
  Synthetic Polynucleotide
taatacgactcactatagggggctgctggctctgactcctcaggttcctcaacagaggagagaggaaatggaggagtcaaacctggcggcagcgcaaaagatg

SEQ ID NO: 87930 - DNA, 103 bp, Artificial Sequence
  Synthetic Polynucleotide
taatacgactcactatagggcaaaagaatgggctgctggctctgactcctaacagaggagaaggagtatgagccagcagaacctggcggcagcgcaaaagatg

SEQ ID NO: 87931 - DNA, 103 bp, Artificial Sequence
  Synthetic Polynucleotide
taatacgactcactatagggtcagaagaagcaaaagaatgggctgctggcaacagaggagagccagcatgccattctttaacctggcggcagcgcaaaagatg

SEQ ID NO: 87932 - DNA, 103 bp, Artificial Sequence
  Synthetic Polynucleotide
taatacgactcactataggggtcatctgcttcagaagaagcaaaagaatgaacagaggagacattctatggcttcttctaacctggcggcagcgcaaaagatg

SEQ ID NO: 87933 - DNA, 103 bp, Artificial Sequence
  Synthetic Polynucleotide
taatacgactcactatagggcctccacaataacagagtactcaggcttggaacagaggagaccaagcatgagtactctgaacctggcggcagcgcaaaagatg

SEQ ID NO: 87934 - DNA, 103 bp, Artificial Sequence
  Synthetic Polynucleotide
taatacgactcactatagggacacttcctggtcatctgcttcagaagaagaacagaggagacttcttatgaagcagatgaacctggcggcagcgcaaaagatg

SEQ ID NO: 87935 - DNA, 103 bp, Artificial Sequence
  Synthetic Polynucleotide
taatacgactcactatagggttctcttccgacacttcctggtcatctgctaacagaggagaagcagaatgccaggaagtaacctggcggcagcgcaaaagatg

SEQ ID NO: 87936 - DNA, 103 bp, Artificial Sequence
  Synthetic Polynucleotide
taatacgactcactatagggctcctcaaaattctcttccgacacttcctgaacagaggagacaggaaatgtcggaagagaacctggcggcagcgcaaaagatg

SEQ ID NO: 87937 - DNA, 103 bp, Artificial Sequence
  Synthetic Polynucleotide
taatacgactcactataggggatacttccgctcctcaaaattctcttccgaacagaggagacggaagatgattttgaggaacctggcggcagcgcaaaagatg

SEQ ID NO: 87938 - DNA, 103 bp, Artificial Sequence
  Synthetic Polynucleotide
taatacgactcactatagggacttcccccggatacttccgctcctcaaaaaacagaggagattttgaatggcggaagtaaacctggcggcagcgcaaaagatg

SEQ ID NO: 87939 - DNA, 103 bp, Artificial Sequence
  Synthetic Polynucleotide
taatacgactcactatagggggtcagggtgacttcccccggatacttccgaacagaggagacggaagatgccgggggaaaacctggcggcagcgcaaaagatg

SEQ ID NO: 87940 - DNA, 103 bp, Artificial Sequence
  Synthetic Polynucleotide
taatacgactcactataggggcttaaagttggtcagggtgacttcccccgaacagaggagacgggggatgtcaccctgaaacctggcggcagcgcaaaagatg

SEQ ID NO: 87941 - DNA, 103 bp, Artificial Sequence
  Synthetic Polynucleotide
taatacgactcactatagggagaaacttcagcttaaagttggtcagggtgaacagaggagacaccctatgcaactttaaaacctggcggcagcgcaaaagatg

SEQ ID NO: 87942 - DNA, 103 bp, Artificial Sequence
  Synthetic Polynucleotide
taatacgactcactataggggtccttggagagaaacttcagcttaaagttaacagaggagaaactttatgctgaagtttaacctggcggcagcgcaaaagatg

SEQ ID NO: 87943 - DNA, 103 bp, Artificial Sequence
  Synthetic Polynucleotide
taatacgactcactatagggccttctttatgtccttggagagaaacttcaaacagaggagatgaagtatgtctccaaggaacctggcggcagcgcaaaagatg

SEQ ID NO: 87944 - DNA, 103 bp, Artificial Sequence
  Synthetic Polynucleotide
taatacgactcactatagggtccgagcggacctccacaataacagagtacaacagaggagagtactcatgtattgtggaaacctggcggcagcgcaaaagatg

SEQ ID NO: 87945 - DNA, 103 bp, Artificial Sequence
  Synthetic Polynucleotide
taatacgactcactataggggtgagcagctccttctttatgtccttggagaacagaggagactccaaatgcataaagaaaacctggcggcagcgcaaaagatg

SEQ ID NO: 87946 - DNA, 103 bp, Artificial Sequence
  Synthetic Polynucleotide
taatacgactcactatagggggtgggacaggtgagcagctccttctttataacagaggagaataaagatggagctgctcaacctggcggcagcgcaaaagatg

SEQ ID NO: 87947 - DNA, 103 bp, Artificial Sequence
  Synthetic Polynucleotide
taatacgactcactatagggcacagccaggggtgggacaggtgagcagctaacagaggagaagctgcatgcctgtcccaaacctggcggcagcgcaaaagatg

SEQ ID NO: 87948 - DNA, 103 bp, Artificial Sequence
  Synthetic Polynucleotide
taatacgactcactatagggccgctgccgtcacagccaggggtgggacagaacagaggagactgtccatgccctggctgaacctggcggcagcgcaaaagatg

SEQ ID NO: 87949 - DNA, 103 bp, Artificial Sequence
  Synthetic Polynucleotide
taatacgactcactatagggggtgatgtggccgctgccgtcacagccaggaacagaggagacctggcatggacggcagcaacctggcggcagcgcaaaagatg

SEQ ID NO: 87950 - DNA, 103 bp, Artificial Sequence
  Synthetic Polynucleotide
taatacgactcactatagggcgtagttcccggtgatgtggccgctgccgtaacagaggagaacggcaatggccacatcaaacctggcggcagcgcaaaagatg

SEQ ID NO: 87951 - DNA, 103 bp, Artificial Sequence
  Synthetic Polynucleotide
taatacgactcactatagggcggtgggaggcgtagttcccggtgatgtggaacagaggagaccacatatgcgggaactaaacctggcggcagcgcaaaagatg

SEQ ID NO: 87952 - DNA, 103 bp, Artificial Sequence
  Synthetic Polynucleotide
taatacgactcactatagggagagaggctgcggtgggaggcgtagttcccaacagaggagagggaacatggcctcccacaacctggcggcagcgcaaaagatg

SEQ ID NO: 87953 - DNA, 103 bp, Artificial Sequence
  Synthetic Polynucleotide
taatacgactcactataggggagggcaaccagagaggctgcggtgggaggaacagaggagacctcccatggcagcctctaacctggcggcagcgcaaaagatg

SEQ ID NO: 87954 - DNA, 103 bp, Artificial Sequence
  Synthetic Polynucleotide
taatacgactcactatagggttgtcagcaagagggcaaccagagaggctgaacagaggagacagcctatgtggttgcccaacctggcggcagcgcaaaagatg

SEQ ID NO: 87955 - DNA, 103 bp, Artificial Sequence
  Synthetic Polynucleotide
taatacgactcactatagggcttgtcatcatccgagcggacctccacaataacagaggagaattgtgatggtccgctcgaacctggcggcagcgcaaaagatg

SEQ ID NO: 87956 - DNA, 103 bp, Artificial Sequence
  Synthetic Polynucleotide
taatacgactcactatagggtctgaggctcttgtcagcaagagggcaaccaacagaggagaggttgcatgcttgctgacaacctggcggcagcgcaaaagatg

SEQ ID NO: 87957 - DNA, 103 bp, Artificial Sequence
  Synthetic Polynucleotide
taatacgactcactatagggccatgaggtttctgaggctcttgtcagcaaaacagaggagattgctgatgagagcctcaaacctggcggcagcgcaaaagatg

SEQ ID NO: 87958 - DNA, 103 bp, Artificial Sequence
  Synthetic Polynucleotide
taatacgactcactataggggagtgggcagccatgaggtttctgaggctcaacagaggagagagcctatgaaacctcataacctggcggcagcgcaaaagatg

SEQ ID NO: 87959 - DNA, 103 bp, Artificial Sequence
  Synthetic Polynucleotide
taatacgactcactataggggaggtcagcagagtgggcagccatgaggttaacagaggagaaacctcatggctgcccacaacctggcggcagcgcaaaagatg

SEQ ID NO: 87960 - DNA, 103 bp, Artificial Sequence
  Synthetic Polynucleotide
taatacgactcactatagggtggggcacttgaggtcagcagagtgggcagaacagaggagactgcccatgctgctgaccaacctggcggcagcgcaaaagatg

SEQ ID NO: 87961 - DNA, 103 bp, Artificial Sequence
  Synthetic Polynucleotide
taatacgactcactatagggcagccgggcgtggggcacttgaggtcagcaaacagaggagatgctgaatgcaagtgcccaacctggcggcagcgcaaaagatg

SEQ ID NO: 87962 - DNA, 103 bp, Artificial Sequence
  Synthetic Polynucleotide
taatacgactcactatagggagagccgtcacagccgggcgtggggcacttaacagaggagaaagtgcatgacgcccggcaacctggcggcagcgcaaaagatg

SEQ ID NO: 87963 - DNA, 103 bp, Artificial Sequence
  Synthetic Polynucleotide
taatacgactcactatagggtgatgtggccagagccgtcacagccgggcgaacagaggagacgcccgatggtgacggctaacctggcggcagcgcaaaagatg

SEQ ID NO: 87964 - DNA, 103 bp, Artificial Sequence
  Synthetic Polynucleotide
taatacgactcactatagggtagttccctgtgatgtggccagagccgtcaaacagaggagatgacggatgtggccacataacctggcggcagcgcaaaagatg

SEQ ID NO: 87965 - DNA, 103 bp, Artificial Sequence
  Synthetic Polynucleotide
taatacgactcactataggggtgtgaagcgtagttccctgtgatgtggccaacagaggagaggccacatgacagggaacaacctggcggcagcgcaaaagatg

SEQ ID NO: 87966 - DNA, 103 bp, Artificial Sequence
  Synthetic Polynucleotide
taatacgactcactatagggtgtcctcgtccttgtcatcatccgagcggaaacagaggagatccgctatgatgatgacaaacctggcggcagcgcaaaagatg

SEQ ID NO: 87967 - DNA, 103 bp, Artificial Sequence
  Synthetic Polynucleotide
taatacgactcactatagggacaagctccggtgtgaagcgtagttccctgaacagaggagacagggaatgacgcttcacaacctggcggcagcgcaaaagatg

SEQ ID NO: 87968 - DNA, 103 bp, Artificial Sequence
  Synthetic Polynucleotide
taatacgactcactataggggggcagccggacaagctccggtgtgaagcgaacagaggagacgcttcatgccggagcttaacctggcggcagcgcaaaagatg

SEQ ID NO: 87969 - DNA, 103 bp, Artificial Sequence
  Synthetic Polynucleotide
taatacgactcactatagggctttgcacgagggcagccggacaagctccgaacagaggagacggagcatgtccggctgcaacctggcggcagcgcaaaagatg

SEQ ID NO: 87970 - DNA, 103 bp, Artificial Sequence
  Synthetic Polynucleotide
taatacgactcactatagggctccacttttctttgcacgagggcagccggaacagaggagaccggctatgctcgtgcaaaacctggcggcagcgcaaaagatg

SEQ ID NO: 87971 - DNA, 103 bp, Artificial Sequence
  Synthetic Polynucleotide
taatacgactcactataggggccaccttgactccacttttctttgcacgaaacagaggagatcgtgcatggaaaagtggaacctggcggcagcgcaaaagatg

SEQ ID NO: 87972 - DNA, 103 bp, Artificial Sequence
  Synthetic Polynucleotide
taatacgactcactatagggcttggtgggtgccaccttgactccacttttaacagaggagaaaaagtatggtcaaggtgaacctggcggcagcgcaaaagatg

SEQ ID NO: 87973 - DNA, 103 bp, Artificial Sequence
  Synthetic Polynucleotide
taatacgactcactatagggccttgtcgtccttggtgggtgccaccttgaaacagaggagatcaaggatgcacccaccaaacctggcggcagcgcaaaagatg

SEQ ID NO: 87974 - DNA, 103 bp, Artificial Sequence
  Synthetic Polynucleotide
taatacgactcactatagggtcggggtcctccttgtcgtccttggtgggtaacagaggagaacccacatgggacgacaaaacctggcggcagcgcaaaagatg

SEQ ID NO: 87975 - DNA, 103 bp, Artificial Sequence
  Synthetic Polynucleotide
taatacgactcactatagggcttcatcagctcggggtcctccttgtcgtcaacagaggagagacgacatggaggaccccaacctggcggcagcgcaaaagatg

SEQ ID NO: 87976 - DNA, 103 bp, Artificial Sequence
  Synthetic Polynucleotide
taatacgactcactataggggaactgggcacttcatcagctcggggtcctaacagaggagaaggaccatgagctgatgaaacctggcggcagcgcaaaagatg

SEQ ID NO: 87977 - DNA, 103 bp, Artificial Sequence
  Synthetic Polynucleotide
taatacgactcactatagggcgggagtgggtgtcctcgtccttgtcatcaaacagaggagatgatgaatgggacgaggaaacctggcggcagcgcaaaagatg

SEQ ID NO: 87978 - DNA, 103 bp, Artificial Sequence
  Synthetic Polynucleotide
taatacgactcactatagggacacagcctggaactgggcacttcatcagcaacagaggagagctgatatggtgcccagtaacctggcggcagcgcaaaagatg

SEQ ID NO: 87979 - DNA, 103 bp, Artificial Sequence
  Synthetic Polynucleotide
taatacgactcactatagggaccgagccccacacagcctggaactgggcaaacagaggagatgcccaatgccaggctgtaacctggcggcagcgcaaaagatg

SEQ ID NO: 87980 - DNA, 103 bp, Artificial Sequence
  Synthetic Polynucleotide
taatacgactcactatagggcgctgatgtgaccgagccccacacagcctgaacagaggagacaggctatgtggggctcgaacctggcggcagcgcaaaagatg

SEQ ID NO: 87981 - DNA, 103 bp, Artificial Sequence
  Synthetic Polynucleotide
taatacgactcactataggggcgtatttcccgctgatgtgaccgagccccaacagaggagaggggctatgtcacatcagaacctggcggcagcgcaaaagatg

SEQ ID NO: 87982 - DNA, 103 bp, Artificial Sequence
  Synthetic Polynucleotide
taatacgactcactatagggcctgtgagaggcgtatttcccgctgatgtgaacagaggagacacatcatggggaaatacaacctggcggcagcgcaaaagatg

SEQ ID NO: 87983 - DNA, 103 bp, Artificial Sequence
  Synthetic Polynucleotide
taatacgactcactatagggcggatgcgctcctgtgagaggcgtatttccaacagaggagaggaaatatgcctctcacaaacctggcggcagcgcaaaagatg

SEQ ID NO: 87984 - DNA, 103 bp, Artificial Sequence
  Synthetic Polynucleotide
taatacgactcactatagggagtgggcagccggatgcgctcctgtgagagaacagaggagactctcaatggagcgcatcaacctggcggcagcgcaaaagatg

SEQ ID NO: 87985 - DNA, 103 bp, Artificial Sequence
  Synthetic Polynucleotide
taatacgactcactataggggcgggcggccagtgggcagccggatgcgctaacagaggagaagcgcaatgggctgcccaaacctggcggcagcgcaaaagatg

SEQ ID NO: 87986 - DNA, 103 bp, Artificial Sequence
  Synthetic Polynucleotide
taatacgactcactatagggccttctgcctgcgggcggccagtgggcagcaacagaggagagctgccatgtggccgcccaacctggcggcagcgcaaaagatg

SEQ ID NO: 87987 - DNA, 103 bp, Artificial Sequence
  Synthetic Polynucleotide
taatacgactcactatagggagggacccttccttctgcctgcgggcggccaacagaggagaggccgcatgcaggcagaaaacctggcggcagcgcaaaagatg

SEQ ID NO: 87988 - DNA, 103 bp, Artificial Sequence
  Synthetic Polynucleotide
taatacgactcactatagggtgttgacttccgggagtgggtgtcctcgtcaacagaggagagacgagatgacccactccaacctggcggcagcgcaaaagatg

SEQ ID NO: 87989 - DNA, 103 bp, Artificial Sequence
  Synthetic Polynucleotide
taatacgactcactatagggcgagccattgagggacccttccttctgcctaacagaggagaaggcagatggaagggtccaacctggcggcagcgcaaaagatg

SEQ ID NO: 87990 - DNA, 103 bp, Artificial Sequence
  Synthetic Polynucleotide
taatacgactcactatagggaggagaatgacgagccattgagggacccttaacagaggagaaagggtatgtcaatggctaacctggcggcagcgcaaaagatg

SEQ ID NO: 87991 - DNA, 103 bp, Artificial Sequence
  Synthetic Polynucleotide
taatacgactcactatagggagggacttccaggagaatgacgagccattgaacagaggagacaatggatggtcattctcaacctggcggcagcgcaaaagatg

SEQ ID NO: 87992 - DNA, 103 bp, Artificial Sequence
  Synthetic Polynucleotide
taatacgactcactatagggttcattcttcagggacttccaggagaatgaaacagaggagatcattcatgtggaagtccaacctggcggcagcgcaaaagatg

SEQ ID NO: 87993 - DNA, 103 bp, Artificial Sequence
  Synthetic Polynucleotide
taatacgactcactatagggaggtcggtccttcattcttcagggacttccaacagaggagaggaagtatgtgaagaatgaacctggcggcagcgcaaaagatg

SEQ ID NO: 87994 - DNA, 103 bp, Artificial Sequence
  Synthetic Polynucleotide
taatacgactcactatagggggggtggggcaggtcggtccttcattcttcaacagaggagagaagaaatgaggaccgacaacctggcggcagcgcaaaagatg

SEQ ID NO: 87995 - DNA, 103 bp, Artificial Sequence
  Synthetic Polynucleotide
taatacgactcactataggggtcacagcccggggtggggcaggtcggtccaacagaggagaggaccgatgtgccccaccaacctggcggcagcgcaaaagatg

SEQ ID NO: 87996 - DNA, 103 bp, Artificial Sequence
  Synthetic Polynucleotide
taatacgactcactatagggggccagagccgtcacagcccggggtggggcaacagaggagagccccaatgcgggctgtgaacctggcggcagcgcaaaagatg

SEQ ID NO: 87997 - DNA, 103 bp, Artificial Sequence
  Synthetic Polynucleotide
taatacgactcactatagggccattggcgtggccagagccgtcacagcccaacagaggagagggctgatgcggctctggaacctggcggcagcgcaaaagatg

SEQ ID NO: 87998 - DNA, 103 bp, Artificial Sequence
  Synthetic Polynucleotide
taatacgactcactataggggaggaaactcccattggcgtggccagagccaacagaggagaggctctatgcacgccaataacctggcggcagcgcaaaagatg

SEQ ID NO: 87999 - DNA, 103 bp, Artificial Sequence
  Synthetic Polynucleotide
taatacgactcactatagggcctcctcctcctcttcctcttcctcttcctaacagaggagaaggaagatgaagaggaagaacctggcggcagcgcaaaagatg

SEQ ID NO: 88000 - DNA, 103 bp, Artificial Sequence
  Synthetic Polynucleotide
taatacgactcactatagggcgtcagtgactgttgacttccgggagtgggaacagaggagacccactatgggaagtcaaaacctggcggcagcgcaaaagatg

SEQ ID NO: 88001 - DNA, 103 bp, Artificial Sequence
  Synthetic Polynucleotide
taatacgactcactatagggtccggtgggtgaggaaactcccattggcgtaacagaggagaacgccaatgggagtttccaacctggcggcagcgcaaaagatg

SEQ ID NO: 88002 - DNA, 103 bp, Artificial Sequence
  Synthetic Polynucleotide
taatacgactcactatagggcctgacaaactccggtgggtgaggaaactcaacagaggagagagtttatgcacccaccgaacctggcggcagcgcaaaagatg

SEQ ID NO: 88003 - DNA, 103 bp, Artificial Sequence
  Synthetic Polynucleotide
taatacgactcactatagggtctgggacagcctgacaaactccggtgggtaacagaggagaacccacatgagtttgtcaaacctggcggcagcgcaaaagatg

SEQ ID NO: 88004 - DNA, 103 bp, Artificial Sequence
  Synthetic Polynucleotide
taatacgactcactatagggcaaaggttgctctgggacagcctgacaaacaacagaggagagtttgtatggctgtcccaaacctggcggcagcgcaaaagatg

SEQ ID NO: 88005 - DNA, 103 bp, Artificial Sequence
  Synthetic Polynucleotide
taatacgactcactatagggttctttccagcaaaggttgctctgggacagaacagaggagactgtccatgagcaaccttaacctggcggcagcgcaaaagatg

SEQ ID NO: 88006 - DNA, 103 bp, Artificial Sequence
  Synthetic Polynucleotide
taatacgactcactatagggcagttttcccttctttccagcaaaggttgcaacagaggagagcaaccatggctggaaagaacctggcggcagcgcaaaagatg

SEQ ID NO: 88007 - DNA, 103 bp, Artificial Sequence
  Synthetic Polynucleotide
taatacgactcactatagggcatcccctgacagttttcccttctttccagaacagaggagactggaaatgagggaaaacaacctggcggcagcgcaaaagatg

SEQ ID NO: 88008 - DNA, 103 bp, Artificial Sequence
  Synthetic Polynucleotide
taatacgactcactatagggctgaggacctcatcccctgacagttttcccaacagaggagagggaaaatggtcaggggaaacctggcggcagcgcaaaagatg

SEQ ID NO: 88009 - DNA, 103 bp, Artificial Sequence
  Synthetic Polynucleotide
taatacgactcactataggggaactttggactgaggacctcatcccctgaaacagaggagatcagggatggaggtcctcaacctggcggcagcgcaaaagatg

SEQ ID NO: 88010 - DNA, 103 bp, Artificial Sequence
  Synthetic Polynucleotide
taatacgactcactatagggcgctagtcttgaactttggactgaggacctaacagaggagaaggtccatggtccaaagtaacctggcggcagcgcaaaagatg

SEQ ID NO: 88011 - DNA, 103 bp, Artificial Sequence
  Synthetic Polynucleotide
taatacgactcactatagggatctccgactcgtcagtgactgttgacttcaacagaggagagaagtcatgagtcactgaaacctggcggcagcgcaaaagatg

SEQ ID NO: 88012 - DNA, 103 bp, Artificial Sequence
  Synthetic Polynucleotide
taatacgactcactatagggtccaacacgtcgctagtcttgaactttggaaacagaggagatccaaaatgcaagactagaacctggcggcagcgcaaaagatg

SEQ ID NO: 88013 - DNA, 103 bp, Artificial Sequence
  Synthetic Polynucleotide
taatacgactcactatagggctcatcattctccaacacgtcgctagtcttaacagaggagaaagactatggacgtgttgaacctggcggcagcgcaaaagatg

SEQ ID NO: 88014 - DNA, 103 bp, Artificial Sequence
  Synthetic Polynucleotide
taatacgactcactataggggcttgatctcctcatcattctccaacacgtaacagaggagaacgtgtatgagaatgatgaacctggcggcagcgcaaaagatg

SEQ ID NO: 88015 - DNA, 103 bp, Artificial Sequence
  Synthetic Polynucleotide
taatacgactcactatagggtggttcagctgcttgatctcctcatcattcaacagaggagagaatgaatgggagatcaaaacctggcggcagcgcaaaagatg

SEQ ID NO: 88016 - DNA, 103 bp, Artificial Sequence
  Synthetic Polynucleotide
taatacgactcactatagggtcggatctcctggttcagctgcttgatctcaacagaggagagagatcatgcagctgaacaacctggcggcagcgcaaaagatg

SEQ ID NO: 88017 - DNA, 103 bp, Artificial Sequence
  Synthetic Polynucleotide
taatacgactcactatagggcgttcaggtctcggatctcctggttcagctaacagaggagaagctgaatgaggagatccaacctggcggcagcgcaaaagatg

SEQ ID NO: 88018 - DNA, 103 bp, Artificial Sequence
  Synthetic Polynucleotide
taatacgactcactataggggagttggactcgttcaggtctcggatctccaacagaggagaggagatatgagacctgaaaacctggcggcagcgcaaaagatg

SEQ ID NO: 88019 - DNA, 103 bp, Artificial Sequence
  Synthetic Polynucleotide
taatacgactcactatagggctccatctccgagttggactcgttcaggtcaacagaggagagacctgatggagtccaacaacctggcggcagcgcaaaagatg

SEQ ID NO: 88020 - DNA, 103 bp, Artificial Sequence
  Synthetic Polynucleotide
taatacgactcactatagggccatggcagcctccatctccgagttggactaacagaggagaagtccaatgcggagatggaacctggcggcagcgcaaaagatg

SEQ ID NO: 88021 - DNA, 103 bp, Artificial Sequence
  Synthetic Polynucleotide
taatacgactcactatagggtgcagctgcaccatggcagcctccatctccaacagaggagaggagatatgggctgccataacctggcggcagcgcaaaagatg

SEQ ID NO: 88022 - DNA, 103 bp, Artificial Sequence
  Synthetic Polynucleotide
taatacgactcactatagggcatgtcctgcatctccgactcgtcagtgacaacagaggagagtcactatggagtcggagaacctggcggcagcgcaaaagatg

SEQ ID NO: 88023 - DNA, 103 bp, Artificial Sequence
  Synthetic Polynucleotide
taatacgactcactataggggatctgggactgcagctgcaccatggcagcaacagaggagagctgccatggtgcagctgaacctggcggcagcgcaaaagatg

SEQ ID NO: 88024 - DNA, 103 bp, Artificial Sequence
  Synthetic Polynucleotide
taatacgactcactatagggccatggaggagatctgggactgcagctgcaaacagaggagatgcagcatgagtcccagaaacctggcggcagcgcaaaagatg

SEQ ID NO: 88025 - DNA, 103 bp, Artificial Sequence
  Synthetic Polynucleotide
taatacgactcactatagggaggttcttctccatggaggagatctgggacaacagaggagagtcccaatgctcctccataacctggcggcagcgcaaaagatg

SEQ ID NO: 88026 - DNA, 103 bp, Artificial Sequence
  Synthetic Polynucleotide
taatacgactcactataggggatgttcttcaggttcttctccatggaggaaacagaggagatcctccatggagaagaacaacctggcggcagcgcaaaagatg

SEQ ID NO: 88027 - DNA, 103 bp, Artificial Sequence
  Synthetic Polynucleotide
taatacgactcactatagggtctcctcctcgatgttcttcaggttcttctaacagaggagaagaagaatgtgaagaacaaacctggcggcagcgcaaaagatg

SEQ ID NO: 88028 - DNA, 103 bp, Artificial Sequence
  Synthetic Polynucleotide
taatacgactcactatagggatgagcttgttctcctcctcgatgttcttcaacagaggagagaagaaatgcgaggaggaaacctggcggcagcgcaaaagatg

SEQ ID NO: 88029 - DNA, 103 bp, Artificial Sequence
  Synthetic Polynucleotide
taatacgactcactatagggctgctcctcaatgagcttgttctcctcctcaacagaggagagaggagatgaacaagctcaacctggcggcagcgcaaaagatg

SEQ ID NO: 88030 - DNA, 103 bp, Artificial Sequence
  Synthetic Polynucleotide
taatacgactcactataggggggcttcattctgctcctcaatgagcttgtaacagaggagaacaagcatgttgaggagcaacctggcggcagcgcaaaagatg

SEQ ID NO: 88031 - DNA, 103 bp, Artificial Sequence
  Synthetic Polynucleotide
taatacgactcactatagggtccagaaacagggcttcattctgctcctcaaacagaggagatgaggaatggaatgaagcaacctggcggcagcgcaaaagatg

SEQ ID NO: 88032 - DNA, 103 bp, Artificial Sequence
  Synthetic Polynucleotide
taatacgactcactataggggccggacagctccagaaacagggcttcattaacagaggagaaatgaaatgctgtttctgaacctggcggcagcgcaaaagatg

SEQ ID NO: 88033 - DNA, 103 bp, Artificial Sequence
  Synthetic Polynucleotide
taatacgactcactatagggcccgggtcatcatgtcctgcatctccgactaacagaggagaagtcggatgtgcaggacaaacctggcggcagcgcaaaagatg

SEQ ID NO: 88034 - DNA, 103 bp, Artificial Sequence
  Synthetic Polynucleotide
taatacgactcactatagggcctggctcaggccggacagctccagaaacaaacagaggagatgtttcatgagctgtccgaacctggcggcagcgcaaaagatg

SEQ ID NO: 88035 - DNA, 103 bp, Artificial Sequence
  Synthetic Polynucleotide
taatacgactcactatagggtggatgagggcctggctcaggccggacagcaacagaggagagctgtcatgcctgagccaaacctggcggcagcgcaaaagatg

SEQ ID NO: 88036 - DNA, 103 bp, Artificial Sequence
  Synthetic Polynucleotide
taatacgactcactatagggggcgagactttggatgagggcctggctcagaacagaggagactgagcatggccctcatcaacctggcggcagcgcaaaagatg

SEQ ID NO: 88037 - DNA, 103 bp, Artificial Sequence
  Synthetic Polynucleotide
taatacgactcactatagggggcggatattggcgagactttggatgagggaacagaggagaccctcaatgaaagtctcgaacctggcggcagcgcaaaagatg

SEQ ID NO: 88038 - DNA, 103 bp, Artificial Sequence
  Synthetic Polynucleotide
taatacgactcactatagggatgtgcggaaggcggatattggcgagacttaacagaggagaaagtctatgcaatatccgaacctggcggcagcgcaaaagatg

SEQ ID NO: 88039 - DNA, 103 bp, Artificial Sequence
  Synthetic Polynucleotide
taatacgactcactatagggtattggctccatgtgcggaaggcggatattaacagaggagaaatatcatgcttccgcacaacctggcggcagcgcaaaagatg

SEQ ID NO: 88040 - DNA, 103 bp, Artificial Sequence
  Synthetic Polynucleotide
taatacgactcactatagggtctgttcgcatattggctccatgtgcggaaaacagaggagattccgcatgtggagccaaaacctggcggcagcgcaaaagatg

SEQ ID NO: 88041 - DNA, 103 bp, Artificial Sequence
  Synthetic Polynucleotide
taatacgactcactataggggcatcgaaattctgttcgcatattggctccaacagaggagaggagccatgatgcgaacaaacctggcggcagcgcaaaagatg

SEQ ID NO: 88042 - DNA, 103 bp, Artificial Sequence
  Synthetic Polynucleotide
taatacgactcactataggggctcacataggcatcgaaattctgttcgcaaacagaggagatgcgaaatgaatttcgataacctggcggcagcgcaaaagatg

SEQ ID NO: 88043 - DNA, 103 bp, Artificial Sequence
  Synthetic Polynucleotide
taatacgactcactatagggcggtgagggtgctcacataggcatcgaaataacagaggagaatttcgatgcctatgtgaaacctggcggcagcgcaaaagatg

SEQ ID NO: 88044 - DNA, 103 bp, Artificial Sequence
  Synthetic Polynucleotide
taatacgactcactatagggcccaggtttccccgggtcatcatgtcctgcaacagaggagagcaggaatggatgacccgaacctggcggcagcgcaaaagatg

SEQ ID NO: 88045 - DNA, 103 bp, Artificial Sequence
  Synthetic Polynucleotide
taatacgactcactataggggagtacatgtcggtgagggtgctcacatagaacagaggagactatgtatgcaccctcacaacctggcggcagcgcaaaagatg

SEQ ID NO: 88046 - DNA, 103 bp, Artificial Sequence
  Synthetic Polynucleotide
taatacgactcactataggggtcctggttggagtacatgtcggtgagggtaacagaggagaaccctcatggacatgtacaacctggcggcagcgcaaaagatg

SEQ ID NO: 88047 - DNA, 103 bp, Artificial Sequence
  Synthetic Polynucleotide
taatacgactcactatagggtgttctccgggtcctggttggagtacatgtaacagaggagaacatgtatgccaaccaggaacctggcggcagcgcaaaagatg

SEQ ID NO: 88048 - DNA, 103 bp, Artificial Sequence
  Synthetic Polynucleotide
taatacgactcactatagggaggaggtccttgttctccgggtcctggttgaacagaggagacaaccaatgcccggagaaaacctggcggcagcgcaaaagatg

SEQ ID NO: 88049 - DNA, 103 bp, Artificial Sequence
  Synthetic Polynucleotide
taatacgactcactataggggatgctctccaggaggtccttgttctccggaacagaggagaccggagatgaaggacctcaacctggcggcagcgcaaaagatg

SEQ ID NO: 88050 - DNA, 103 bp, Artificial Sequence
  Synthetic Polynucleotide
taatacgactcactatagggcagcctgcttgatgctctccaggaggtcctaacagaggagaaggaccatgtggagagcaaacctggcggcagcgcaaaagatg

SEQ ID NO: 88051 - DNA, 103 bp, Artificial Sequence
  Synthetic Polynucleotide
taatacgactcactatagggatgcccctcacagcctgcttgatgctctccaacagaggagaggagagatgcaagcaggcaacctggcggcagcgcaaaagatg

SEQ ID NO: 88052 - DNA, 103 bp, Artificial Sequence
  Synthetic Polynucleotide
taatacgactcactatagggctagacctggatgcccctcacagcctgcttaacagaggagaaagcagatggtgaggggcaacctggcggcagcgcaaaagatg

SEQ ID NO: 88053 - DNA, 103 bp, Artificial Sequence
  Synthetic Polynucleotide
taatacgactcactatagggctccaggaggcccaggtttccccgggtcataacagaggagaatgaccatgggaaacctgaacctggcggcagcgcaaaagatg

SEQ ID NO: 88054 - DNA, 103 bp, Artificial Sequence
  Synthetic Polynucleotide
taatacgactcactatagggcgatggcctgctccaggaggcccaggtttcaacagaggagagaaaccatggcctcctggaacctggcggcagcgcaaaagatg

SEQ ID NO: 88055 - DNA, 103 bp, Artificial Sequence
  Synthetic Polynucleotide
taatacgactcactataggggccttcagggcgatggcctgctccaggaggaacagaggagacctcctatggcaggccataacctggcggcagcgcaaaagatg

SEQ ID NO: 88056 - DNA, 103 bp, Artificial Sequence
  Synthetic Polynucleotide
taatacgactcactatagggcacctgttcagccttcagggcgatggcctgaacagaggagacaggccatggccctgaagaacctggcggcagcgcaaaagatg

SEQ ID NO: 88057 - DNA, 103 bp, Artificial Sequence
  Synthetic Polynucleotide
taatacgactcactatagggagactgtgcgcacctgttcagccttcagggaacagaggagaccctgaatgctgaacaggaacctggcggcagcgcaaaagatg

SEQ ID NO: 88058 - DNA, 103 bp, Artificial Sequence
  Synthetic Polynucleotide
taatacgactcactatagggggagctgcctcctcctcctcctcttcctctaacagaggagaagaggaatgggaggaggaaacctggcggcagcgcaaaagatg

SEQ ID NO: 88059 - DNA, 103 bp, Artificial Sequence
  Synthetic Polynucleotide
taatacgactcactatagggcccggctcgcagactgtgcgcacctgttcaaacagaggagatgaacaatggcgcacagtaacctggcggcagcgcaaaagatg

SEQ ID NO: 88060 - DNA, 103 bp, Artificial Sequence
  Synthetic Polynucleotide
taatacgactcactatagggaggcgggcagcccggctcgcagactgtgcgaacagaggagacgcacaatgtgcgagccgaacctggcggcagcgcaaaagatg

SEQ ID NO: 88061 - DNA, 103 bp, Artificial Sequence
  Synthetic Polynucleotide
taatacgactcactatagggtctgctcggcaggcgggcagcccggctcgcaacagaggagagcgagcatggctgcccgcaacctggcggcagcgcaaaagatg

SEQ ID NO: 88062 - DNA, 103 bp, Artificial Sequence
  Synthetic Polynucleotide
taatacgactcactatagggcccagctggctctgctcggcaggcgggcagaacagaggagactgcccatgtgccgagcaaacctggcggcagcgcaaaagatg

SEQ ID NO: 88063 - DNA, 103 bp, Artificial Sequence
  Synthetic Polynucleotide
taatacgactcactatagggctctcccaggcccagctggctctgctcggcaacagaggagagccgagatgagccagctgaacctggcggcagcgcaaaagatg

SEQ ID NO: 88064 - DNA, 103 bp, Artificial Sequence
  Synthetic Polynucleotide
taatacgactcactatagggccttccctggctctcccaggcccagctggcaacagaggagagccagcatggcctgggagaacctggcggcagcgcaaaagatg

SEQ ID NO: 88065 - DNA, 103 bp, Artificial Sequence
  Synthetic Polynucleotide
taatacgactcactatagggggctttgctgccttccctggctctcccaggaacagaggagacctgggatggccagggaaaacctggcggcagcgcaaaagatg

SEQ ID NO: 88066 - DNA, 103 bp, Artificial Sequence
  Synthetic Polynucleotide
taatacgactcactatagggagtgtccaggggctttgctgccttccctggaacagaggagaccagggatggcagcaaagaacctggcggcagcgcaaaagatg

SEQ ID NO: 88067 - DNA, 103 bp, Artificial Sequence
  Synthetic Polynucleotide
taatacgactcactatagggtcttccgcacagtgtccaggggctttgctgaacagaggagacagcaaatgccctggacaaacctggcggcagcgcaaaagatg

SEQ ID NO: 88068 - DNA, 103 bp, Artificial Sequence
  Synthetic Polynucleotide
taatacgactcactatagggctgtagtaactcttccgcacagtgtccaggaacagaggagacctggaatgtgtgcggaaaacctggcggcagcgcaaaagatg

SEQ ID NO: 88069 - DNA, 103 bp, Artificial Sequence
  Synthetic Polynucleotide
taatacgactcactataggggatcacatcaggagctgcctcctcctcctcaacagaggagagaggagatggaggcagctaacctggcggcagcgcaaaagatg

SEQ ID NO: 88070 - DNA, 103 bp, Artificial Sequence
  Synthetic Polynucleotide
taatacgactcactatagggaggatctttactgtagtaactcttccgcacaacagaggagagtgcggatgagttactacaacctggcggcagcgcaaaagatg

SEQ ID NO: 88071 - DNA, 103 bp, Artificial Sequence
  Synthetic Polynucleotide
taatacgactcactatagggcagctcttgaaggatctttactgtagtaacaacagaggagagttactatggtaaagatcaacctggcggcagcgcaaaagatg

SEQ ID NO: 88072 - DNA, 103 bp, Artificial Sequence
  Synthetic Polynucleotide
taatacgactcactatagggtcacgcttctcagctcttgaaggatctttaaacagaggagataaagaatgttcaagagcaacctggcggcagcgcaaaagatg

SEQ ID NO: 88073 - DNA, 103 bp, Artificial Sequence
  Synthetic Polynucleotide
taatacgactcactatagggacacttgatctcacgcttctcagctcttgaaacagaggagatcaagaatggagaagcgtaacctggcggcagcgcaaaagatg

SEQ ID NO: 88074 - DNA, 103 bp, Artificial Sequence
  Synthetic Polynucleotide
taatacgactcactatagggctggtgttggacacttgatctcacgcttctaacagaggagaagaagcatgagatcaagtaacctggcggcagcgcaaaagatg

SEQ ID NO: 88075 - DNA, 103 bp, Artificial Sequence
  Synthetic Polynucleotide
taatacgactcactatagggccatcacagcctggtgttggacacttgatcaacagaggagagatcaaatgtccaacaccaacctggcggcagcgcaaaagatg

SEQ ID NO: 88076 - DNA, 103 bp, Artificial Sequence
  Synthetic Polynucleotide
taatacgactcactataggggtggccagtgccatcacagcctggtgttggaacagaggagaccaacaatgggctgtgataacctggcggcagcgcaaaagatg

SEQ ID NO: 88077 - DNA, 103 bp, Artificial Sequence
  Synthetic Polynucleotide
taatacgactcactatagggacccggtaacgtggccagtgccatcacagcaacagaggagagctgtgatggcactggccaacctggcggcagcgcaaaagatg

SEQ ID NO: 88078 - DNA, 103 bp, Artificial Sequence
  Synthetic Polynucleotide
taatacgactcactatagggtgagggtacaacccggtaacgtggccagtgaacagaggagacactggatgcgttaccggaacctggcggcagcgcaaaagatg

SEQ ID NO: 88079 - DNA, 103 bp, Artificial Sequence
  Synthetic Polynucleotide
taatacgactcactataggggctgcggtggtgagggtacaacccggtaacaacagaggagagttaccatgttgtaccctaacctggcggcagcgcaaaagatg

SEQ ID NO: 88080 - DNA, 103 bp, Artificial Sequence
  Synthetic Polynucleotide
taatacgactcactatagggcttcctgaaagatcacatcaggagctgcctaacagaggagaaggcagatgctgatgtgaaacctggcggcagcgcaaaagatg

SEQ ID NO: 88081 - DNA, 103 bp, Artificial Sequence
  Synthetic Polynucleotide
taatacgactcactatagggagccagaaaggctgcggtggtgagggtacaaacagaggagatgtaccatgaccaccgcaaacctggcggcagcgcaaaagatg

SEQ ID NO: 88082 - DNA, 103 bp, Artificial Sequence
  Synthetic Polynucleotide
taatacgactcactatagggttgtggggacagccagaaaggctgcggtggaacagaggagaccaccgatgcctttctggaacctggcggcagcgcaaaagatg

SEQ ID NO: 88083 - DNA, 103 bp, Artificial Sequence
  Synthetic Polynucleotide
taatacgactcactataggggatcctatccttgtggggacagccagaaagaacagaggagactttctatgtgtccccacaacctggcggcagcgcaaaagatg

SEQ ID NO: 88084 - DNA, 103 bp, Artificial Sequence
  Synthetic Polynucleotide
taatacgactcactatagggtctctggggggatcctatccttgtggggacaacagaggagagtccccatgaggataggaaacctggcggcagcgcaaaagatg

SEQ ID NO: 88085 - DNA, 103 bp, Artificial Sequence
  Synthetic Polynucleotide
taatacgactcactatagggatggctaagatctctggggggatcctatccaacagaggagaggatagatgccccccagaaacctggcggcagcgcaaaagatg

SEQ ID NO: 88086 - DNA, 103 bp, Artificial Sequence
  Synthetic Polynucleotide
taatacgactcactataggggttctcatgcatggctaagatctctgggggaacagaggagacccccaatgatcttagccaacctggcggcagcgcaaaagatg

SEQ ID NO: 88087 - DNA, 103 bp, Artificial Sequence
  Synthetic Polynucleotide
taatacgactcactatagggacttcagcacgttctcatgcatggctaagaaacagaggagatcttagatgtgcatgagaaacctggcggcagcgcaaaagatg

SEQ ID NO: 88088 - DNA, 103 bp, Artificial Sequence
  Synthetic Polynucleotide
taatacgactcactatagggggagtggggcacttcagcacgttctcatgcaacagaggagagcatgaatgcgtgctgaaaacctggcggcagcgcaaaagatg

SEQ ID NO: 88089 - DNA, 103 bp, Artificial Sequence
  Synthetic Polynucleotide
taatacgactcactatagggtgtgcagccaggagtggggcacttcagcacaacagaggagagtgctgatgtgccccactaacctggcggcagcgcaaaagatg

SEQ ID NO: 88090 - DNA, 103 bp, Artificial Sequence
  Synthetic Polynucleotide
taatacgactcactataggggaccctggcctgtgcagccaggagtggggcaacagaggagagccccaatgctggctgcaaacctggcggcagcgcaaaagatg

SEQ ID NO: 88091 - DNA, 103 bp, Artificial Sequence
  Synthetic Polynucleotide
taatacgactcactatagggtgagaggtgtcttcctgaaagatcacatcaaacagaggagatgatgtatgctttcaggaaacctggcggcagcgcaaaagatg

SEQ ID NO: 88092 - DNA, 103 bp, Artificial Sequence
  Synthetic Polynucleotide
taatacgactcactatagggctgttcacgtgaccctggcctgtgcagccaaacagaggagatggctgatgaggccagggaacctggcggcagcgcaaaagatg

SEQ ID NO: 88093 - DNA, 103 bp, Artificial Sequence
  Synthetic Polynucleotide
taatacgactcactataggggttgcggttgctgttcacgtgaccctggccaacagaggagaggccagatgcacgtgaacaacctggcggcagcgcaaaagatg

SEQ ID NO: 88094 - DNA, 103 bp, Artificial Sequence
  Synthetic Polynucleotide
taatacgactcactatagggttctgtgcgtgttgcggttgctgttcacgtaacagaggagaacgtgaatggcaaccgcaaacctggcggcagcgcaaaagatg

SEQ ID NO: 88095 - DNA, 103 bp, Artificial Sequence
  Synthetic Polynucleotide
taatacgactcactatagggccagacaaacttctgtgcgtgttgcggttgaacagaggagacaaccgatgcacgcacagaacctggcggcagcgcaaaagatg

SEQ ID NO: 88096 - DNA, 103 bp, Artificial Sequence
  Synthetic Polynucleotide
taatacgactcactatagggaatgggacacccagacaaacttctgtgcgtaacagaggagaacgcacatgagtttgtctaacctggcggcagcgcaaaagatg

SEQ ID NO: 88097 - DNA, 103 bp, Artificial Sequence
  Synthetic Polynucleotide
taatacgactcactatagggcggcggcagcaatgggacacccagacaaacaacagaggagagtttgtatgggtgtcccaaacctggcggcagcgcaaaagatg

SEQ ID NO: 88098 - DNA, 103 bp, Artificial Sequence
  Synthetic Polynucleotide
taatacgactcactataggggctaatttttcggcggcagcaatgggacacaacagaggagagtgtccatgtgctgccgcaacctggcggcagcgcaaaagatg

SEQ ID NO: 88099 - DNA, 103 bp, Artificial Sequence
  Synthetic Polynucleotide
taatacgactcactatagggatgggatttggctaatttttcggcggcagcaacagaggagagctgccatggaaaaattaaacctggcggcagcgcaaaagatg

SEQ ID NO: 88100 - DNA, 103 bp, Artificial Sequence
  Synthetic Polynucleotide
taatacgactcactataggggctgcttctcatgggatttggctaatttttaacagaggagaaaaaatatgccaaatcccaacctggcggcagcgcaaaagatg

SEQ ID NO: 88101 - DNA, 103 bp, Artificial Sequence
  Synthetic Polynucleotide
taatacgactcactataggggtctgcggctgctgcttctcatgggatttgaacagaggagacaaatcatgtgagaagcaaacctggcggcagcgcaaaagatg

SEQ ID NO: 88102 - DNA, 103 bp, Artificial Sequence
  Synthetic Polynucleotide
taatacgactcactatagggggcagaggtgtgagaggtgtcttcctgaaaaacagaggagatttcagatggacacctctaacctggcggcagcgcaaaagatg

SEQ ID NO: 88103 - DNA, 103 bp, Artificial Sequence
  Synthetic Polynucleotide
taatacgactcactatagggaggatctcctgtctgcggctgctgcttctcaacagaggagagagaagatgcagccgcagaacctggcggcagcgcaaaagatg

SEQ ID NO: 88104 - DNA, 103 bp, Artificial Sequence
  Synthetic Polynucleotide
taatacgactcactatagggtactcttggaaggatctcctgtctgcggctaacagaggagaagccgcatgcaggagatcaacctggcggcagcgcaaaagatg

SEQ ID NO: 88105 - DNA, 103 bp, Artificial Sequence
  Synthetic Polynucleotide
taatacgactcactataggggaattggagctactcttggaaggatctcctaacagaggagaaggagaatgttccaagagaacctggcggcagcgcaaaagatg

SEQ ID NO: 88106 - DNA, 103 bp, Artificial Sequence
  Synthetic Polynucleotide
taatacgactcactataggggatccgatcggaattggagctactcttggaaacagaggagatccaagatgagctccaataacctggcggcagcgcaaaagatg

SEQ ID NO: 88107 - DNA, 103 bp, Artificial Sequence
  Synthetic Polynucleotide
taatacgactcactatagggtgggcctgaggatccgatcggaattggagcaacagaggagagctccaatgccgatcggaaacctggcggcagcgcaaaagatg

SEQ ID NO: 88108 - DNA, 103 bp, Artificial Sequence
  Synthetic Polynucleotide
taatacgactcactatagggacgaagcacatgggcctgaggatccgatcgaacagaggagacgatcgatgcctcaggccaacctggcggcagcgcaaaagatg

SEQ ID NO: 88109 - DNA, 103 bp, Artificial Sequence
  Synthetic Polynucleotide
taatacgactcactataggggagctgcttcacgaagcacatgggcctgagaacagaggagactcaggatgatgtgcttcaacctggcggcagcgcaaaagatg

SEQ ID NO: 88110 - DNA, 103 bp, Artificial Sequence
  Synthetic Polynucleotide
taatacgactcactataggggagggacctcgagctgcttcacgaagcacaaacagaggagatgtgctatgtgaagcagcaacctggcggcagcgcaaaagatg

SEQ ID NO: 88111 - DNA, 103 bp, Artificial Sequence
  Synthetic Polynucleotide
taatacgactcactatagggctcccatatggagggacctcgagctgcttcaacagaggagagaagcaatgcgaggtcccaacctggcggcagcgcaaaagatg

SEQ ID NO: 88112 - DNA, 103 bp, Artificial Sequence
  Synthetic Polynucleotide
taatacgactcactataggggggccggtagctcccatatggagggacctcaacagaggagagaggtcatgccatatgggaacctggcggcagcgcaaaagatg

SEQ ID NO: 88113 - DNA, 103 bp, Artificial Sequence
  Synthetic Polynucleotide
taatacgactcactataggggggccttctgggcagaggtgtgagaggtgtaacagaggagaacacctatgacacctctgaacctggcggcagcgcaaaagatg

SEQ ID NO: 88114 - DNA, 103 bp, Artificial Sequence
  Synthetic Polynucleotide
taatacgactcactataggggggccacgttgggccggtagctcccatatgaacagaggagacatatgatggctaccggcaacctggcggcagcgcaaaagatg

SEQ ID NO: 88115 - DNA, 103 bp, Artificial Sequence
  Synthetic Polynucleotide
taatacgactcactatagggggtgtggcgggggccacgttgggccggtagaacagaggagactaccgatgcaacgtggcaacctggcggcagcgcaaaagatg

SEQ ID NO: 88116 - DNA, 103 bp, Artificial Sequence
  Synthetic Polynucleotide
taatacgactcactataggggttggccctgggtgtggcgggggccacgttaacagaggagaaacgtgatgcccgccacaaacctggcggcagcgcaaaagatg

SEQ ID NO: 88117 - DNA, 103 bp, Artificial Sequence
  Synthetic Polynucleotide
taatacgactcactatagggccttggccaagttggccctgggtgtggcggaacagaggagaccgccaatgccagggccaaacctggcggcagcgcaaaagatg

SEQ ID NO: 88118 - DNA, 103 bp, Artificial Sequence
  Synthetic Polynucleotide
taatacgactcactatagggttctccagctccttggccaagttggccctgaacagaggagacagggcatgcttggccaaaacctggcggcagcgcaaaagatg

SEQ ID NO: 88119 - DNA, 103 bp, Artificial Sequence
  Synthetic Polynucleotide
taatacgactcactatagggcttggagaacttctccagctccttggccaaaacagaggagattggccatggagctggagaacctggcggcagcgcaaaagatg

SEQ ID NO: 88120 - DNA, 103 bp, Artificial Sequence
  Synthetic Polynucleotide
taatacgactcactatagggcaaaggtgaccttggagaacttctccagctaacagaggagaagctggatgagttctccaaacctggcggcagcgcaaaagatg

SEQ ID NO: 88121 - DNA, 103 bp, Artificial Sequence
  Synthetic Polynucleotide
taatacgactcactatagggcttgcgtagtcaaaggtgaccttggagaacaacagaggagagttctcatgggtcaccttaacctggcggcagcgcaaaagatg

SEQ ID NO: 88122 - DNA, 103 bp, Artificial Sequence
  Synthetic Polynucleotide
taatacgactcactatagggagcatcgaaacttgcgtagtcaaaggtgacaacagaggagagtcaccatggactacgcaaacctggcggcagcgcaaaagatg

SEQ ID NO: 88123 - DNA, 103 bp, Artificial Sequence
  Synthetic Polynucleotide
taatacgactcactatagggcaaaaacctgagcatcgaaacttgcgtagtaacagaggagaactacgatggtttcgatgaacctggcggcagcgcaaaagatg

SEQ ID NO: 88124 - DNA, 103 bp, Artificial Sequence
  Synthetic Polynucleotide
taatacgactcactatagggcggagctcaggggccttctgggcagaggtgaacagaggagacacctcatgccagaaggcaacctggcggcagcgcaaaagatg

SEQ ID NO: 88125 - DNA, 103 bp, Artificial Sequence
  Synthetic Polynucleotide
taatacgactcactatagggatgcgtttgccaaaaacctgagcatcgaaaaacagaggagatttcgaatgtcaggttttaacctggcggcagcgcaaaagatg

SEQ ID NO: 88126 - DNA, 103 bp, Artificial Sequence
  Synthetic Polynucleotide
taatacgactcactatagggtggggcaagcatgcgtttgccaaaaacctgaacagaggagacaggttatgggcaaacgcaacctggcggcagcgcaaaagatg

SEQ ID NO: 88127 - DNA, 103 bp, Artificial Sequence
  Synthetic Polynucleotide
taatacgactcactatagggtctgaatctttggggcaagcatgcgtttgcaacagaggagagcaaacatgtgcttgcccaacctggcggcagcgcaaaagatg

SEQ ID NO: 88128 - DNA, 103 bp, Artificial Sequence
  Synthetic Polynucleotide
taatacgactcactataggggtttcgctggtctgaatctttggggcaagcaacagaggagagcttgcatgaaagattcaaacctggcggcagcgcaaaagatg

SEQ ID NO: 88129 - DNA, 103 bp, Artificial Sequence
  Synthetic Polynucleotide
taatacgactcactatagggtttaggtgaggtttcgctggtctgaatcttaacagaggagaaagattatgaccagcgaaaacctggcggcagcgcaaaagatg

SEQ ID NO: 88130 - DNA, 103 bp, Artificial Sequence
  Synthetic Polynucleotide
taatacgactcactatagggattgaaaggctttaggtgaggtttcgctggaacagaggagaccagcgatgcctcacctaaacctggcggcagcgcaaaagatg

SEQ ID NO: 88131 - DNA, 103 bp, Artificial Sequence
  Synthetic Polynucleotide
taatacgactcactatagggtagtcaaagcattgaaaggctttaggtgagaacagaggagactcaccatgagcctttcaaacctggcggcagcgcaaaagatg

SEQ ID NO: 88132 - DNA, 103 bp, Artificial Sequence
  Synthetic Polynucleotide
taatacgactcactataggggtcctgcgagtagtcaaagcattgaaaggcaacagaggagagcctttatgtgctttgacaacctggcggcagcgcaaaagatg

SEQ ID NO: 88133 - DNA, 103 bp, Artificial Sequence
  Synthetic Polynucleotide
taatacgactcactatagggcagcctcggcgtcctgcgagtagtcaaagcaacagaggagagctttgatgactcgcaggaacctggcggcagcgcaaaagatg

SEQ ID NO: 88134 - DNA, 103 bp, Artificial Sequence
  Synthetic Polynucleotide
taatacgactcactataggggccatgtgtgcagcctcggcgtcctgcgagaacagaggagactcgcaatgcgccgaggcaacctggcggcagcgcaaaagatg

SEQ ID NO: 88135 - DNA, 103 bp, Artificial Sequence
  Synthetic Polynucleotide
taatacgactcactataggggagggcaaacttctcgctcagaaactccataacagaggagaatggagatgctgagcgagaacctggcggcagcgcaaaagatg

SEQ ID NO: 88136 - DNA, 103 bp, Artificial Sequence
  Synthetic Polynucleotide
taatacgactcactatagggaaaggactcattgtccagcgtctccataacaacagaggagagttatgatgacgctggacaacctggcggcagcgcaaaagatg

SEQ ID NO: 88137 - DNA, 103 bp, Artificial Sequence
  Synthetic Polynucleotide
taatacgactcactatagggctttgctgtaaaaggactcattgtccagcgaacagaggagacgctggatgatgagtcctaacctggcggcagcgcaaaagatg

SEQ ID NO: 88138 - DNA, 103 bp, Artificial Sequence
  Synthetic Polynucleotide
taatacgactcactatagggcctgcagacgctttgctgtaaaaggactcaaacagaggagatgagtcatgttacagcaaaacctggcggcagcgcaaaagatg

SEQ ID NO: 88139 - DNA, 103 bp, Artificial Sequence
  Synthetic Polynucleotide
taatacgactcactatagggcacgcatttgcctgcagacgctttgctgtaaacagaggagatacagcatggcgtctgcaaacctggcggcagcgcaaaagatg

SEQ ID NO: 88140 - DNA, 103 bp, Artificial Sequence
  Synthetic Polynucleotide
taatacgactcactatagggcgaaggcctgcacgcatttgcctgcagacgaacagaggagacgtctgatggcaaatgcgaacctggcggcagcgcaaaagatg

SEQ ID NO: 88141 - DNA, 103 bp, Artificial Sequence
  Synthetic Polynucleotide
taatacgactcactatagggggcaggggtccgaaggcctgcacgcatttgaacagaggagacaaatgatggcaggccttaacctggcggcagcgcaaaagatg

SEQ ID NO: 88142 - DNA, 103 bp, Artificial Sequence
  Synthetic Polynucleotide
taatacgactcactatagggctcggcgcggggcaggggtccgaaggcctgaacagaggagacaggccatgggacccctgaacctggcggcagcgcaaaagatg

SEQ ID NO: 88143 - DNA, 103 bp, Artificial Sequence
  Synthetic Polynucleotide
taatacgactcactataggggcacgtgatgctcggcgcggggcaggggtcaacagaggagagaccccatgcccgcgccgaacctggcggcagcgcaaaagatg

SEQ ID NO: 88144 - DNA, 103 bp, Artificial Sequence
  Synthetic Polynucleotide
taatacgactcactatagggctctccaagcgcacgtgatgctcggcgcggaacagaggagaccgcgcatggcatcacgtaacctggcggcagcgcaaaagatg

SEQ ID NO: 88145 - DNA, 103 bp, Artificial Sequence
  Synthetic Polynucleotide
taatacgactcactataggggggcgaggtcctctccaagcgcacgtgatgaacagaggagacatcacatgcgcttggagaacctggcggcagcgcaaaagatg

SEQ ID NO: 88146 - DNA, 103 bp, Artificial Sequence
  Synthetic Polynucleotide
taatacgactcactataggggagggctcttgagggcaaacttctcgctcaaacagaggagatgagcgatgagtttgcccaacctggcggcagcgcaaaagatg

SEQ ID NO: 88147 - DNA, 103 bp, Artificial Sequence
  Synthetic Polynucleotide
taatacgactcactatagggtgtcctgacagggcgaggtcctctccaagcaacagaggagagcttggatgggacctcgcaacctggcggcagcgcaaaagatg

SEQ ID NO: 88148 - DNA, 103 bp, Artificial Sequence
  Synthetic Polynucleotide
taatacgactcactatagggttcacgctgctgtcctgacagggcgaggtcaacagaggagagacctcatgctgtcaggaaacctggcggcagcgcaaaagatg

SEQ ID NO: 88149 - DNA, 103 bp, Artificial Sequence
  Synthetic Polynucleotide
taatacgactcactataggggatcccatagttcacgctgctgtcctgacaaacagaggagatgtcagatgagcagcgtgaacctggcggcagcgcaaaagatg

SEQ ID NO: 88150 - DNA, 103 bp, Artificial Sequence
  Synthetic Polynucleotide
taatacgactcactatagggctactttagtgatcccatagttcacgctgcaacagaggagagcagcgatgactatgggaaacctggcggcagcgcaaaagatg

SEQ ID NO: 88151 - DNA, 103 bp, Artificial Sequence
  Synthetic Polynucleotide
taatacgactcactatagggggctgtccttctactttagtgatcccatagaacagaggagactatggatgcactaaagtaacctggcggcagcgcaaaagatg

SEQ ID NO: 88152 - DNA, 103 bp, Artificial Sequence
  Synthetic Polynucleotide
taatacgactcactatagggggtgtgaaggggctgtccttctactttagtaacagaggagaactaaaatggaaggacagaacctggcggcagcgcaaaagatg

SEQ ID NO: 88153 - DNA, 103 bp, Artificial Sequence
  Synthetic Polynucleotide
taatacgactcactatagggtattcagttcggtgtgaaggggctgtccttaacagaggagaaaggacatgcccttcacaaacctggcggcagcgcaaaagatg

SEQ ID NO: 88154 - DNA, 103 bp, Artificial Sequence
  Synthetic Polynucleotide
taatacgactcactatagggtccatagctctattcagttcggtgtgaaggaacagaggagaccttcaatgcgaactgaaaacctggcggcagcgcaaaagatg

SEQ ID NO: 88155 - DNA, 103 bp, Artificial Sequence
  Synthetic Polynucleotide
taatacgactcactataggggttacagttgtccatagctctattcagttcaacagaggagagaactgatgagagctatgaacctggcggcagcgcaaaagatg

SEQ ID NO: 88156 - DNA, 103 bp, Artificial Sequence
  Synthetic Polynucleotide
taatacgactcactatagggttcggagactgttacagttgtccatagctcaacagaggagagagctaatgacaactgtaaacctggcggcagcgcaaaagatg

SEQ ID NO: 88157 - DNA, 103 bp, Artificial Sequence
  Synthetic Polynucleotide
taatacgactcactatagggtttttactcggagggctcttgagggcaaacaacagaggagagtttgcatgcaagagcccaacctggcggcagcgcaaaagatg

SEQ ID NO: 88158 - DNA, 103 bp, Artificial Sequence
  Synthetic Polynucleotide
taatacgactcactatagggacgggagacattcggagactgttacagttgaacagaggagacaactgatgcagtctccgaacctggcggcagcgcaaaagatg

SEQ ID NO: 88159 - DNA, 103 bp, Artificial Sequence
  Synthetic Polynucleotide
taatacgactcactatagggcatccctttcacgggagacattcggagactaacagaggagaagtctcatgatgtctcccaacctggcggcagcgcaaaagatg

SEQ ID NO: 88160 - DNA, 103 bp, Artificial Sequence
  Synthetic Polynucleotide
taatacgactcactatagggccttctcttgcatccctttcacgggagacaaacagaggagatgtctcatgtgaaagggaaacctggcggcagcgcaaaagatg

SEQ ID NO: 88161 - DNA, 103 bp, Artificial Sequence
  Synthetic Polynucleotide
taatacgactcactatagggtccagctctcccttctcttgcatccctttcaacagaggagagaaaggatggcaagagaaaacctggcggcagcgcaaaagatg

SEQ ID NO: 88162 - DNA, 103 bp, Artificial Sequence
  Synthetic Polynucleotide
taatacgactcactatagggcccaagttcatccagctctcccttctcttgaacagaggagacaagagatgggagagctgaacctggcggcagcgcaaaagatg

SEQ ID NO: 88163 - DNA, 103 bp, Artificial Sequence
  Synthetic Polynucleotide
taatacgactcactatagggcacatttatccccaagttcatccagctctcaacagaggagagagagcatgatgaacttgaacctggcggcagcgcaaaagatg

SEQ ID NO: 88164 - DNA, 103 bp, Artificial Sequence
  Synthetic Polynucleotide
taatacgactcactatagggacattgctatcacatttatccccaagttcaaacagaggagatgaactatgggataaatgaacctggcggcagcgcaaaagatg

SEQ ID NO: 88165 - DNA, 103 bp, Artificial Sequence
  Synthetic Polynucleotide
taatacgactcactatagggactgctggatacattgctatcacatttatcaacagaggagagataaaatggatagcaataacctggcggcagcgcaaaagatg

SEQ ID NO: 88166 - DNA, 103 bp, Artificial Sequence
  Synthetic Polynucleotide
taatacgactcactatagggtccgtttcttactgctggatacattgctataacagaggagaatagcaatgtatccagcaaacctggcggcagcgcaaaagatg

SEQ ID NO: 88167 - DNA, 103 bp, Artificial Sequence
  Synthetic Polynucleotide
taatacgactcactataggggttcggtgcctccgtttcttactgctggataacagaggagaatccagatgtaagaaacgaacctggcggcagcgcaaaagatg

SEQ ID NO: 88168 - DNA, 103 bp, Artificial Sequence
  Synthetic Polynucleotide
taatacgactcactatagggaaagtcactgtttttactcggagggctcttaacagaggagaaagagcatgccgagtaaaaacctggcggcagcgcaaaagatg

SEQ ID NO: 88169 - DNA, 103 bp, Artificial Sequence
  Synthetic Polynucleotide
taatacgactcactatagggggtgaaggtggttcggtgcctccgtttcttaacagaggagaaagaaaatgaggcaccgaaacctggcggcagcgcaaaagatg

SEQ ID NO: 88170 - DNA, 103 bp, Artificial Sequence
  Synthetic Polynucleotide
taatacgactcactataggggctgcaaactggtgaaggtggttcggtgccaacagaggagaggcaccatgccaccttcaaacctggcggcagcgcaaaagatg

SEQ ID NO: 88171 - DNA, 103 bp, Artificial Sequence
  Synthetic Polynucleotide
taatacgactcactatagggagctcctctagctgcaaactggtgaaggtgaacagaggagacaccttatgcagtttgcaaacctggcggcagcgcaaaagatg

SEQ ID NO: 88172 - DNA, 103 bp, Artificial Sequence
  Synthetic Polynucleotide
taatacgactcactataggggactttctccagctcctctagctgcaaactaacagaggagaagtttgatgctagaggagaacctggcggcagcgcaaaagatg

SEQ ID NO: 88173 - DNA, 103 bp, Artificial Sequence
  Synthetic Polynucleotide
taatacgactcactatagggttttctgaaagactttctccagctcctctaaacagaggagatagaggatgtggagaaagaacctggcggcagcgcaaaagatg

SEQ ID NO: 88174 - DNA, 103 bp, Artificial Sequence
  Synthetic Polynucleotide
taatacgactcactataggggggtaatgagttttctgaaagactttctccaacagaggagaggagaaatgctttcagaaaacctggcggcagcgcaaaagatg

SEQ ID NO: 88175 - DNA, 103 bp, Artificial Sequence
  Synthetic Polynucleotide
taatacgactcactatagggatacacatccgggtaatgagttttctgaaaaacagaggagatttcagatgactcattacaacctggcggcagcgcaaaagatg

SEQ ID NO: 88176 - DNA, 103 bp, Artificial Sequence
  Synthetic Polynucleotide
taatacgactcactataggggttctctgacatacacatccgggtaatgagaacagaggagactcattatgcggatgtgtaacctggcggcagcgcaaaagatg

SEQ ID NO: 88177 - DNA, 103 bp, Artificial Sequence
  Synthetic Polynucleotide
taatacgactcactatagggagagcaagctgttctctgacatacacatccaacagaggagaggatgtatgtgtcagagaaacctggcggcagcgcaaaagatg

SEQ ID NO: 88178 - DNA, 103 bp, Artificial Sequence
  Synthetic Polynucleotide
taatacgactcactatagggctctgtcctcagagcaagctgttctctgacaacagaggagagtcagaatgcagcttgctaacctggcggcagcgcaaaagatg

SEQ ID NO: 88179 - DNA, 103 bp, Artificial Sequence
  Synthetic Polynucleotide
taatacgactcactatagggcgcccatgtaaaagtcactgtttttactcgaacagaggagacgagtaatgacagtgactaacctggcggcagcgcaaaagatg

SEQ ID NO: 88180 - DNA, 103 bp, Artificial Sequence
  Synthetic Polynucleotide
taatacgactcactatagggcctcagtgagctctgtcctcagagcaagctaacagaggagaagcttgatgtgaggacagaacctggcggcagcgcaaaagatg

SEQ ID NO: 88181 - DNA, 103 bp, Artificial Sequence
  Synthetic Polynucleotide
taatacgactcactatagggtggaccctggcctcagtgagctctgtcctcaacagaggagagaggacatggctcactgaaacctggcggcagcgcaaaagatg

SEQ ID NO: 88182 - DNA, 103 bp, Artificial Sequence
  Synthetic Polynucleotide
taatacgactcactatagggaaaccaaacctggaccctggcctcagtgagaacagaggagactcactatggccagggtcaacctggcggcagcgcaaaagatg

SEQ ID NO: 88183 - DNA, 103 bp, Artificial Sequence
  Synthetic Polynucleotide
taatacgactcactatagggttcgattttgaaaccaaacctggaccctggaacagaggagaccagggatgaggtttggtaacctggcggcagcgcaaaagatg

SEQ ID NO: 88184 - DNA, 103 bp, Artificial Sequence
  Synthetic Polynucleotide
taatacgactcactatagggcatttggcccttcgattttgaaaccaaaccaacagaggagaggtttgatgtcaaaatcgaacctggcggcagcgcaaaagatg

SEQ ID NO: 88185 - DNA, 103 bp, Artificial Sequence
  Synthetic Polynucleotide
taatacgactcactatagggcctttttctccatttggcccttcgattttgaacagaggagacaaaatatgagggccaaaaacctggcggcagcgcaaaagatg

SEQ ID NO: 88186 - DNA, 103 bp, Artificial Sequence
  Synthetic Polynucleotide
taatacgactcactatagggcataacgttccctttttctccatttggcccaacagaggagagggccaatgggagaaaaaaacctggcggcagcgcaaaagatg

SEQ ID NO: 88187 - DNA, 103 bp, Artificial Sequence
  Synthetic Polynucleotide
taatacgactcactatagggtgtatttggccataacgttccctttttctcaacagaggagagagaaaatgggaacgttaaacctggcggcagcgcaaaagatg

SEQ ID NO: 88188 - DNA, 103 bp, Artificial Sequence
  Synthetic Polynucleotide
taatacgactcactatagggtttcgcttgttgtatttggccataacgttcaacagaggagagaacgtatgggccaaataaacctggcggcagcgcaaaagatg

SEQ ID NO: 88189 - DNA, 103 bp, Artificial Sequence
  Synthetic Polynucleotide
taatacgactcactatagggcaaaatggcttttcgcttgttgtatttggcaacagaggagagccaaaatgaacaagcgaaacctggcggcagcgcaaaagatg

SEQ ID NO: 88190 - DNA, 103 bp, Artificial Sequence
  Synthetic Polynucleotide
taatacgactcactatagggggacctcctgcgcccatgtaaaagtcactgaacagaggagacagtgaatgttacatgggaacctggcggcagcgcaaaagatg

SEQ ID NO: 88191 - DNA, 103 bp, Artificial Sequence
  Synthetic Polynucleotide
taatacgactcactatagggtaggtggcagcaaaatggcttttcgcttgtaacagaggagaacaagcatgaagccatttaacctggcggcagcgcaaaagatg

SEQ ID NO: 88192 - DNA, 103 bp, Artificial Sequence
  Synthetic Polynucleotide
taatacgactcactatagggtgatatatcataggtggcagcaaaatggctaacagaggagaagccatatggctgccaccaacctggcggcagcgcaaaagatg

SEQ ID NO: 88193 - DNA, 103 bp, Artificial Sequence
  Synthetic Polynucleotide
taatacgactcactatagggttggcaaaactgatatatcataggtggcagaacagaggagactgccaatgatgatatataacctggcggcagcgcaaaagatg

SEQ ID NO: 88194 - DNA, 103 bp, Artificial Sequence
  Synthetic Polynucleotide
taatacgactcactatagggctgtcagtccttggcaaaactgatatatcaaacagaggagatgatatatgagttttgccaacctggcggcagcgcaaaagatg

SEQ ID NO: 88195 - DNA, 103 bp, Artificial Sequence
  Synthetic Polynucleotide
taatacgactcactatagggctgtgggtagctgtcagtccttggcaaaacaacagaggagagttttgatgaggactgacaacctggcggcagcgcaaaagatg

SEQ ID NO: 88196 - DNA, 103 bp, Artificial Sequence
  Synthetic Polynucleotide
taatacgactcactatagggtgttctgaatctgtgggtagctgtcagtccaacagaggagaggactgatggctacccacaacctggcggcagcgcaaaagatg

SEQ ID NO: 88197 - DNA, 103 bp, Artificial Sequence
  Synthetic Polynucleotide
taatacgactcactataggggcccacaaattgttctgaatctgtgggtagaacagaggagactacccatggattcagaaaacctggcggcagcgcaaaagatg

SEQ ID NO: 88198 - DNA, 103 bp, Artificial Sequence
  Synthetic Polynucleotide
taatacgactcactatagggtgcatttcctgcccacaaattgttctgaataacagaggagaattcagatgaatttgtggaacctggcggcagcgcaaaagatg

SEQ ID NO: 88199 - DNA, 103 bp, Artificial Sequence
  Synthetic Polynucleotide
taatacgactcactatagggaaccaccacttgcatttcctgcccacaaataacagaggagaatttgtatgcaggaaatgaacctggcggcagcgcaaaagatg

SEQ ID NO: 88200 - DNA, 103 bp, Artificial Sequence
  Synthetic Polynucleotide
taatacgactcactataggggtaaccacagaaccaccacttgcatttcctaacagaggagaaggaaaatgaagtggtggaacctggcggcagcgcaaaagatg

SEQ ID NO: 88201 - DNA, 103 bp, Artificial Sequence
  Synthetic Polynucleotide
taatacgactcactataggggtgctccagaggacctcctgcgcccatgtaaacagaggagatacatgatggcaggaggtaacctggcggcagcgcaaaagatg

SEQ ID NO: 88202 - DNA, 103 bp, Artificial Sequence
  Synthetic Polynucleotide
taatacgactcactatagggcatgcatgaagtaaccacagaaccaccactaacagaggagaagtggtatgtctgtggttaacctggcggcagcgcaaaagatg

SEQ ID NO: 88203 - DNA, 103 bp, Artificial Sequence
  Synthetic Polynucleotide
taatacgactcactatagggcacgtggtaacatgcatgaagtaaccacagaacagaggagactgtggatgcttcatgcaaacctggcggcagcgcaaaagatg

SEQ ID NO: 88204 - DNA, 103 bp, Artificial Sequence
  Synthetic Polynucleotide
taatacgactcactataggggaggaagtgtcacgtggtaacatgcatgaaaacagaggagattcatgatggttaccacgaacctggcggcagcgcaaaagatg

SEQ ID NO: 88205 - DNA, 103 bp, Artificial Sequence
  Synthetic Polynucleotide
taatacgactcactatagggtgtcatacaggaggaagtgtcacgtggtaaaacagaggagattaccaatggacacttccaacctggcggcagcgcaaaagatg

SEQ ID NO: 88206 - DNA, 103 bp, Artificial Sequence
  Synthetic Polynucleotide
taatacgactcactataggggagaataaggtgtcatacaggaggaagtgtaacagaggagaacacttatgcctgtatgaaacctggcggcagcgcaaaagatg

SEQ ID NO: 88207 - DNA, 103 bp, Artificial Sequence
  Synthetic Polynucleotide
taatacgactcactatagggcgaggcgagtgagaataaggtgtcatacagaacagaggagactgtatatgaccttattcaacctggcggcagcgcaaaagatg

SEQ ID NO: 88208 - DNA, 103 bp, Artificial Sequence
  Synthetic Polynucleotide
taatacgactcactatagggggaatctgtccgaggcgagtgagaataaggaacagaggagaccttatatgcactcgcctaacctggcggcagcgcaaaagatg

SEQ ID NO: 88209 - DNA, 103 bp, Artificial Sequence
  Synthetic Polynucleotide
taatacgactcactatagggccgtgtaactggaatctgtccgaggcgagtaacagaggagaactcgcatgggacagattaacctggcggcagcgcaaaagatg

SEQ ID NO: 88210 - DNA, 103 bp, Artificial Sequence
  Synthetic Polynucleotide
taatacgactcactatagggtttgaaaaccccgtgtaactggaatctgtcaacagaggagagacagaatgcagttacacaacctggcggcagcgcaaaagatg

SEQ ID NO: 88211 - DNA, 103 bp, Artificial Sequence
  Synthetic Polynucleotide
taatacgactcactataggggttctggtggtttgaaaaccccgtgtaactaacagaggagaagttacatggggttttcaaacctggcggcagcgcaaaagatg

SEQ ID NO: 88212 - DNA, 103 bp, Artificial Sequence
  Synthetic Polynucleotide
taatacgactcactatagggtctccataacgtgctccagaggacctcctgaacagaggagacaggagatgctctggagcaacctggcggcagcgcaaaagatg

SEQ ID NO: 88213 - DNA, 103 bp, Artificial Sequence
  Synthetic Polynucleotide
taatacgactcactatagggggctgaactggttctggtggtttgaaaaccaacagaggagaggttttatgaccaccagaaacctggcggcagcgcaaaagatg

SEQ ID NO: 88214 - DNA, 103 bp, Artificial Sequence
  Synthetic Polynucleotide
taatacgactcactatagggaggggcacgtggctgaactggttctggtggaacagaggagaccaccaatgccagttcagaacctggcggcagcgcaaaagatg

SEQ ID NO: 88215 - DNA, 103 bp, Artificial Sequence
  Synthetic Polynucleotide
taatacgactcactatagggaaaattgttgaggggcacgtggctgaactgaacagaggagacagttcatgcacgtgcccaacctggcggcagcgcaaaagatg

SEQ ID NO: 88216 - DNA, 103 bp, Artificial Sequence
  Synthetic Polynucleotide
taatacgactcactatagggagtcagtgaaaaaattgttgaggggcacgtaacagaggagaacgtgcatgtcaacaattaacctggcggcagcgcaaaagatg

SEQ ID NO: 88217 - DNA, 103 bp, Artificial Sequence
  Synthetic Polynucleotide
taatacgactcactataggggtaagaagagagtcagtgaaaaaattgttgaacagaggagacaacaaatgtttcactgaaacctggcggcagcgcaaaagatg

SEQ ID NO: 88218 - DNA, 103 bp, Artificial Sequence
  Synthetic Polynucleotide
taatacgactcactatagggggttgccccagtaagaagagagtcagtgaaaacagaggagattcactatgtctcttcttaacctggcggcagcgcaaaagatg

SEQ ID NO: 88219 - DNA, 103 bp, Artificial Sequence
  Synthetic Polynucleotide
taatacgactcactatagggcatgtccattggttgccccagtaagaagagaacagaggagactcttcatgctggggcaaaacctggcggcagcgcaaaagatg

SEQ ID NO: 88220 - DNA, 103 bp, Artificial Sequence
  Synthetic Polynucleotide
taatacgactcactataggggtttcaaatgcatgtccattggttgccccaaacagaggagatggggcatgcaatggacaaacctggcggcagcgcaaaagatg

SEQ ID NO: 88221 - DNA, 103 bp, Artificial Sequence
  Synthetic Polynucleotide
taatacgactcactatagggctctggctttgtttcaaatgcatgtccattaacagaggagaaatggaatggcatttgaaaacctggcggcagcgcaaaagatg

SEQ ID NO: 88222 - DNA, 103 bp, Artificial Sequence
  Synthetic Polynucleotide
taatacgactcactatagggtcctttcaaactctggctttgtttcaaatgaacagaggagacatttgatgcaaagccagaacctggcggcagcgcaaaagatg

SEQ ID NO: 88223 - DNA, 103 bp, Artificial Sequence
  Synthetic Polynucleotide
taatacgactcactatagggttgtccagcgtctccataacgtgctccagaaacagaggagatctggaatgcgttatggaaacctggcggcagcgcaaaagatg

SEQ ID NO: 88224 - DNA, 103 bp, Artificial Sequence
  Synthetic Polynucleotide
taatacgactcactatagggctggaagacctcctttcaaactctggctttaacagaggagaaaagccatggtttgaaagaacctggcggcagcgcaaaagatg

SEQ ID NO: 88225 - DNA, 103 bp, Artificial Sequence
  Synthetic Polynucleotide
taatacgactcactatagggaactgcgatactggaagacctcctttcaaaaacagaggagatttgaaatgaggtcttccaacctggcggcagcgcaaaagatg

SEQ ID NO: 88226 - DNA, 103 bp, Artificial Sequence
  Synthetic Polynucleotide
taatacgactcactatagggtcattcgaagaactgcgatactggaagaccaacagaggagaggtcttatggtatcgcagaacctggcggcagcgcaaaagatg

SEQ ID NO: 88227 - DNA, 103 bp, Artificial Sequence
  Synthetic Polynucleotide
taatacgactcactatagggtccttggctttcattcgaagaactgcgataaacagaggagatatcgcatgtcttcgaataacctggcggcagcgcaaaagatg

SEQ ID NO: 88228 - DNA, 103 bp, Artificial Sequence
  Synthetic Polynucleotide
taatacgactcactatagggggcggtgtgctccttggctttcattcgaagaacagaggagacttcgaatgaaagccaagaacctggcggcagcgcaaaagatg

SEQ ID NO: 88229 - DNA, 103 bp, Artificial Sequence
  Synthetic Polynucleotide
taatacgactcactatagggatgaaatattggcggtgtgctccttggcttaacagaggagaaagccaatgagcacaccgaacctggcggcagcgcaaaagatg

SEQ ID NO: 88230 - DNA, 103 bp, Artificial Sequence
  Synthetic Polynucleotide
taatacgactcactatagggtacatggcccatgaaatattggcggtgtgcaacagaggagagcacacatgcaatatttcaacctggcggcagcgcaaaagatg

SEQ ID NO: 88231 - DNA, 103 bp, Artificial Sequence
  Synthetic Polynucleotide
taatacgactcactataggggcagtaagagacgcaagtctcagcattcataacagaggagaatgaatatggagacttgcaacctggcggcagcgcaaaagatg

SEQ ID NO: 88232 - DNA, 103 bp, Artificial Sequence
  Synthetic Polynucleotide
taatacgactcactataggggcctccgggaaatgccctaaaaggcgacgaaacagaggagatcgtcgatgtttagggcaaacctggcggcagcgcaaaagatg

SEQ ID NO: 88233 - DNA, 103 bp, Artificial Sequence
  Synthetic Polynucleotide
taatacgactcactataggggccaggggggtgggcatgaggggacatgcaaacagaggagatgcatgatgcctcatgccaacctggcggcagcgcaaaagatg

SEQ ID NO: 88234 - DNA, 103 bp, Artificial Sequence
  Synthetic Polynucleotide
taatacgactcactatagggtggccccagagccaggggggtgggcatgagaacagaggagactcatgatgacccccctgaacctggcggcagcgcaaaagatg

SEQ ID NO: 88235 - DNA, 103 bp, Artificial Sequence
  Synthetic Polynucleotide
taatacgactcactataggggtgacgctgctggccccagagccaggggggaacagaggagaccccccatgctctggggcaacctggcggcagcgcaaaagatg

SEQ ID NO: 88236 - DNA, 103 bp, Artificial Sequence
  Synthetic Polynucleotide
taatacgactcactatagggcaggaagtcggtgacgctgctggccccagaaacagaggagatctgggatgagcagcgtcaacctggcggcagcgcaaaagatg

SEQ ID NO: 88237 - DNA, 103 bp, Artificial Sequence
  Synthetic Polynucleotide
taatacgactcactatagggcagacacactcaggaagtcggtgacgctgcaacagaggagagcagcgatgccgacttccaacctggcggcagcgcaaaagatg

SEQ ID NO: 88238 - DNA, 103 bp, Artificial Sequence
  Synthetic Polynucleotide
taatacgactcactatagggctgccagccccagacacactcaggaagtcgaacagaggagacgacttatggagtgtgtcaacctggcggcagcgcaaaagatg

SEQ ID NO: 88239 - DNA, 103 bp, Artificial Sequence
  Synthetic Polynucleotide
taatacgactcactataggggcccacgtgactgccagccccagacacactaacagaggagaagtgtgatgggggctggcaacctggcggcagcgcaaaagatg

SEQ ID NO: 88240 - DNA, 103 bp, Artificial Sequence
  Synthetic Polynucleotide
taatacgactcactatagggtgtgcgtctggcccacgtgactgccagcccaacagaggagagggctgatggtcacgtggaacctggcggcagcgcaaaagatg

SEQ ID NO: 88241 - DNA, 103 bp, Artificial Sequence
  Synthetic Polynucleotide
taatacgactcactatagggaggctgcccatgtgcgtctggcccacgtgaaacagaggagatcacgtatgccagacgcaaacctggcggcagcgcaaaagatg

SEQ ID NO: 88242 - DNA, 103 bp, Artificial Sequence
  Synthetic Polynucleotide
taatacgactcactatagggtgctccaaacaggctgcccatgtgcgtctgaacagaggagacagacgatgatgggcagcaacctggcggcagcgcaaaagatg

SEQ ID NO: 88243 - DNA, 103 bp, Artificial Sequence
  Synthetic Polynucleotide
taatacgactcactatagggcgaacttgtcgcctccgggaaatgccctaaaacagaggagattagggatgttcccggagaacctggcggcagcgcaaaagatg

SEQ ID NO: 88244 - DNA, 103 bp, Artificial Sequence
  Synthetic Polynucleotide
taatacgactcactatagggtgaggctggctgctccaaacaggctgcccaaacagaggagatgggcaatgtgtttggagaacctggcggcagcgcaaaagatg

SEQ ID NO: 88245 - DNA, 103 bp, Artificial Sequence
  Synthetic Polynucleotide
taatacgactcactatagggaggcctgggctgaggctggctgctccaaacaacagaggagagtttggatgagccagcctaacctggcggcagcgcaaaagatg

SEQ ID NO: 88246 - DNA, 103 bp, Artificial Sequence
  Synthetic Polynucleotide
taatacgactcactataggggtagccattgaggcctgggctgaggctggcaacagaggagagccagcatgagcccaggcaacctggcggcagcgcaaaagatg

SEQ ID NO: 88247 - DNA, 103 bp, Artificial Sequence
  Synthetic Polynucleotide
taatacgactcactatagggcgttgagctcgtagccattgaggcctgggcaacagaggagagcccagatgtcaatggctaacctggcggcagcgcaaaagatg

SEQ ID NO: 88248 - DNA, 103 bp, Artificial Sequence
  Synthetic Polynucleotide
taatacgactcactatagggtccggctcgccgttgagctcgtagccattgaacagaggagacaatggatgcgagctcaaaacctggcggcagcgcaaaagatg

SEQ ID NO: 88249 - DNA, 103 bp, Artificial Sequence
  Synthetic Polynucleotide
taatacgactcactatagggggtcttgcggtccggctcgccgttgagctcaacagaggagagagctcatgggcgagccgaacctggcggcagcgcaaaagatg

SEQ ID NO: 88250 - DNA, 103 bp, Artificial Sequence
  Synthetic Polynucleotide
taatacgactcactatagggcgatgctcgaggtcttgcggtccggctcgcaacagaggagagcgagcatgaccgcaagaaacctggcggcagcgcaaaagatg

SEQ ID NO: 88251 - DNA, 103 bp, Artificial Sequence
  Synthetic Polynucleotide
taatacgactcactatagggcggagggccgcgatgctcgaggtcttgcggaacagaggagaccgcaaatgctcgagcataacctggcggcagcgcaaaagatg

SEQ ID NO: 88252 - DNA, 103 bp, Artificial Sequence
  Synthetic Polynucleotide
taatacgactcactatagggggccttcatgcggagggccgcgatgctcgaaacagaggagatcgagcatggcggccctcaacctggcggcagcgcaaaagatg

SEQ ID NO: 88253 - DNA, 103 bp, Artificial Sequence
  Synthetic Polynucleotide
taatacgactcactatagggtgtgctccttggccttcatgcggagggccgaacagaggagacggcccatggcatgaaggaacctggcggcagcgcaaaagatg

SEQ ID NO: 88254 - DNA, 103 bp, Artificial Sequence
  Synthetic Polynucleotide
taatacgactcactatagggaaagttgtgccgaacttgtcgcctccgggaaacagaggagatcccggatgcgacaagttaacctggcggcagcgcaaaagatg

SEQ ID NO: 88255 - DNA, 103 bp, Artificial Sequence
  Synthetic Polynucleotide
taatacgactcactatagggatggccgcactgtgctccttggccttcatgaacagaggagacatgaaatgcaaggagcaaacctggcggcagcgcaaaagatg

SEQ ID NO: 88256 - DNA, 103 bp, Artificial Sequence
  Synthetic Polynucleotide
taatacgactcactatagggggcccaggaaatggccgcactgtgctccttaacagaggagaaaggagatgagtgcggccaacctggcggcagcgcaaaagatg

SEQ ID NO: 88257 - DNA, 103 bp, Artificial Sequence
  Synthetic Polynucleotide
taatacgactcactatagggggccgacaggaaagttgtgccgaacttgtcaacagaggagagacaagatgggcacaactaacctggcggcagcgcaaaagatg

SEQ ID NO: 88258 - DNA, 103 bp, Artificial Sequence
  Synthetic Polynucleotide
taatacgactcactatagggctttggcggcggccgacaggaaagttgtgcaacagaggagagcacaaatgtcctgtcggaacctggcggcagcgcaaaagatg

SEQ ID NO: 88259 - DNA, 103 bp, Artificial Sequence
  Synthetic Polynucleotide
taatacgactcactatagggaatccctgtgctttggcggcggccgacaggaacagaggagacctgtcatgcgccgccaaaacctggcggcagcgcaaaagatg

SEQ ID NO: 88260 - DNA, 103 bp, Artificial Sequence
  Synthetic Polynucleotide
taatacgactcactatagggggcgtccccgaatccctgtgctttggcggcaacagaggagagccgccatggcacagggaaacctggcggcagcgcaaaagatg

SEQ ID NO: 88261 - DNA, 103 bp, Artificial Sequence
  Synthetic Polynucleotide
taatacgactcactatagggcccggctcttggcgtccccgaatccctgtgaacagaggagacacaggatgtcggggacgaacctggcggcagcgcaaaagatg

SEQ ID NO: 88262 - DNA, 103 bp, Artificial Sequence
  Synthetic Polynucleotide
taatacgactcactatagggccgtaacgggcccggctcttggcgtccccgaacagaggagacggggaatgcaagagccgaacctggcggcagcgcaaaagatg

SEQ ID NO: 88263 - DNA, 103 bp, Artificial Sequence
  Synthetic Polynucleotide
taatacgactcactatagggctgcccagcgccgtaacgggcccggctcttaacagaggagaaagagcatggcccgttacaacctggcggcagcgcaaaagatg

SEQ ID NO: 88264 - DNA, 103 bp, Artificial Sequence
  Synthetic Polynucleotide
taatacgactcactatagggccggcgactcgcagtaagagacgcaagtctaacagaggagaagacttatgtctcttactaacctggcggcagcgcaaaagatg

SEQ ID NO: 88265 - DNA, 103 bp, Artificial Sequence
  Synthetic Polynucleotide
taatacgactcactatagggccaggtcctgctgcccagcgccgtaacgggaacagaggagacccgttatggcgctgggcaacctggcggcagcgcaaaagatg

SEQ ID NO: 88266 - DNA, 103 bp, Artificial Sequence
  Synthetic Polynucleotide
taatacgactcactatagggaggggtgtcgccaggtcctgctgcccagcgaacagaggagacgctggatggcaggacctaacctggcggcagcgcaaaagatg

SEQ ID NO: 88267 - DNA, 103 bp, Artificial Sequence
  Synthetic Polynucleotide
taatacgactcactatagggtccactctccaggggtgtcgccaggtcctgaacagaggagacaggacatggcgacacccaacctggcggcagcgcaaaagatg

SEQ ID NO: 88268 - DNA, 103 bp, Artificial Sequence
  Synthetic Polynucleotide
taatacgactcactataggggcgccccagctccactctccaggggtgtcgaacagaggagacgacacatgtggagagtgaacctggcggcagcgcaaaagatg

SEQ ID NO: 88269 - DNA, 103 bp, Artificial Sequence
  Synthetic Polynucleotide
taatacgactcactatagggaaggagccccgcgccccagctccactctccaacagaggagaggagagatgagctggggcaacctggcggcagcgcaaaagatg

SEQ ID NO: 88270 - DNA, 103 bp, Artificial Sequence
  Synthetic Polynucleotide
taatacgactcactataggggaacttgttaaaggagccccgcgccccagcaacagaggagagctgggatgcggggctccaacctggcggcagcgcaaaagatg

SEQ ID NO: 88271 - DNA, 103 bp, Artificial Sequence
  Synthetic Polynucleotide
taatacgactcactataggggctggggctggaacttgttaaaggagccccaacagaggagaggggctatgttaacaagtaacctggcggcagcgcaaaagatg

SEQ ID NO: 88272 - DNA, 103 bp, Artificial Sequence
  Synthetic Polynucleotide
taatacgactcactatagggggggtcgacggctggggctggaacttgttaaacagaggagataacaaatgccagccccaaacctggcggcagcgcaaaagatg

SEQ ID NO: 88273 - DNA, 103 bp, Artificial Sequence
  Synthetic Polynucleotide
taatacgactcactatagggctggggctgcggggtcgacggctggggctgaacagaggagacagcccatgccgtcgaccaacctggcggcagcgcaaaagatg

SEQ ID NO: 88274 - DNA, 103 bp, Artificial Sequence
  Synthetic Polynucleotide
taatacgactcactataggggcggcggcggctggggctgcggggtcgacgaacagaggagacgtcgaatgcgcagccccaacctggcggcagcgcaaaagatg

SEQ ID NO: 88275 - DNA, 103 bp, Artificial Sequence
  Synthetic Polynucleotide
taatacgactcactatagggatggcagcggccggcgactcgcagtaagagaacagaggagactcttaatgcgagtcgccaacctggcggcagcgcaaaagatg

SEQ ID NO: 88276 - DNA, 103 bp, Artificial Sequence
  Synthetic Polynucleotide
taatacgactcactatagggggctgcggctgcggcggcggctggggctgcaacagaggagagcagccatggccgccgccaacctggcggcagcgcaaaagatg

SEQ ID NO: 88277 - DNA, 103 bp, Artificial Sequence
  Synthetic Polynucleotide
taatacgactcactatagggctgctgctgcggctgcggctgcggcggcggaacagaggagaccgccgatgcagccgcagaacctggcggcagcgcaaaagatg

SEQ ID NO: 88278 - DNA, 103 bp, Artificial Sequence
  Synthetic Polynucleotide
taatacgactcactataggggctgcggctgctgctgctgcggctgcggctaacagaggagaagccgcatgcgcagcagcaacctggcggcagcgcaaaagatg

SEQ ID NO: 88279 - DNA, 103 bp, Artificial Sequence
  Synthetic Polynucleotide
taatacgactcactatagggggcggctggggctgcggctgctgctgctgcaacagaggagagcagcaatggcagccgcaaacctggcggcagcgcaaaagatg

SEQ ID NO: 88280 - DNA, 103 bp, Artificial Sequence
  Synthetic Polynucleotide
taatacgactcactatagggcggttgcgcgggcggctggggctgcggctgaacagaggagacagccgatgccccagccgaacctggcggcagcgcaaaagatg

SEQ ID NO: 88281 - DNA, 103 bp, Artificial Sequence
  Synthetic Polynucleotide
taatacgactcactatagggagtaaagatgcggttgcgcgggcggctgggaacagaggagacccagcatgccgcgcaacaacctggcggcagcgcaaaagatg

SEQ ID NO: 88282 - DNA, 103 bp, Artificial Sequence
  Synthetic Polynucleotide
taatacgactcactatagggcctcgctgcaagtaaagatgcggttgcgcgaacagaggagacgcgcaatggcatctttaaacctggcggcagcgcaaaagatg

SEQ ID NO: 88283 - DNA, 103 bp, Artificial Sequence
  Synthetic Polynucleotide
taatacgactcactatagggcttgcaggcgcctcgctgcaagtaaagatgaacagaggagacatcttatgttgcagcgaaacctggcggcagcgcaaaagatg

SEQ ID NO: 88284 - DNA, 103 bp, Artificial Sequence
  Synthetic Polynucleotide
taatacgactcactatagggccgggggcgtcttgcaggcgcctcgctgcaaacagaggagatgcagcatggcgcctgcaaacctggcggcagcgcaaaagatg

SEQ ID NO: 88285 - DNA, 103 bp, Artificial Sequence
  Synthetic Polynucleotide
taatacgactcactatagggaggctgccgtccgggggcgtcttgcaggcgaacagaggagacgcctgatggacgcccccaacctggcggcagcgcaaaagatg

SEQ ID NO: 88286 - DNA, 103 bp, Artificial Sequence
  Synthetic Polynucleotide
taatacgactcactataggggtaggcgtccatggcagcggccggcgactcaacagaggagagagtcgatggccgctgccaacctggcggcagcgcaaaagatg

SEQ ID NO: 88287 - DNA, 103 bp, Artificial Sequence
  Synthetic Polynucleotide
taatacgactcactatagggctggagtttgaggctgccgtccgggggcgtaacagaggagaacgcccatggacggcagcaacctggcggcagcgcaaaagatg

SEQ ID NO: 88288 - DNA, 103 bp, Artificial Sequence
  Synthetic Polynucleotide
taatacgactcactatagggtgctgccttcctggagtttgaggctgccgtaacagaggagaacggcaatgtcaaactccaacctggcggcagcgcaaaagatg

SEQ ID NO: 88289 - DNA, 103 bp, Artificial Sequence
  Synthetic Polynucleotide
taatacgactcactatagggctgtggccgctgctgccttcctggagtttgaacagaggagacaaactatgggaaggcagaacctggcggcagcgcaaaagatg

SEQ ID NO: 88290 - DNA, 103 bp, Artificial Sequence
  Synthetic Polynucleotide
taatacgactcactatagggcaaggccgcgctgtggccgctgctgccttcaacagaggagagaaggcatgagcggccacaacctggcggcagcgcaaaagatg

SEQ ID NO: 88291 - DNA, 103 bp, Artificial Sequence
  Synthetic Polynucleotide
taatacgactcactatagggagggaacctgcaaggccgcgctgtggccgcaacagaggagagcggccatggcgcggcctaacctggcggcagcgcaaaagatg

SEQ ID NO: 88292 - DNA, 103 bp, Artificial Sequence
  Synthetic Polynucleotide
taatacgactcactatagggttagcgtagcagggaacctgcaaggccgcgaacagaggagacgcggcatggcaggttccaacctggcggcagcgcaaaagatg

SEQ ID NO: 88293 - DNA, 103 bp, Artificial Sequence
  Synthetic Polynucleotide
taatacgactcactatagggggagctctctttagcgtagcagggaacctgaacagaggagacaggttatgtgctacgctaacctggcggcagcgcaaaagatg

SEQ ID NO: 88294 - DNA, 103 bp, Artificial Sequence
  Synthetic Polynucleotide
taatacgactcactataggggctcacccagggagctctctttagcgtagcaacagaggagagctacgatgaagagagctaacctggcggcagcgcaaaagatg

SEQ ID NO: 88295 - DNA, 103 bp, Artificial Sequence
  Synthetic Polynucleotide
taatacgactcactatagggggtaactctggctcacccagggagctctctaacagaggagaagagagatgcctgggtgaaacctggcggcagcgcaaaagatg

SEQ ID NO: 88296 - DNA, 103 bp, Artificial Sequence
  Synthetic Polynucleotide
taatacgactcactatagggagagtcagggggtaactctggctcacccagaacagaggagactgggtatgccagagttaaacctggcggcagcgcaaaagatg

SEQ ID NO: 88297 - DNA, 103 bp, Artificial Sequence
  Synthetic Polynucleotide
taatacgactcactatagggccgggctgtagtaggcgtccatggcagcggaacagaggagaccgctgatgtggacgcctaacctggcggcagcgcaaaagatg

SEQ ID NO: 88298 - DNA, 103 bp, Artificial Sequence
  Synthetic Polynucleotide
taatacgactcactatagggccacagtgtcagagtcagggggtaactctgaacagaggagacagagtatgcccctgactaacctggcggcagcgcaaaagatg

SEQ ID NO: 88299 - DNA, 103 bp, Artificial Sequence
  Synthetic Polynucleotide
taatacgactcactatagggctgtccatccccacagtgtcagagtcagggaacagaggagaccctgaatgtgacactgtaacctggcggcagcgcaaaagatg

SEQ ID NO: 88300 - DNA, 103 bp, Artificial Sequence
  Synthetic Polynucleotide
taatacgactcactatagggcaggtagctgctgtccatccccacagtgtcaacagaggagagacactatggggatggacaacctggcggcagcgcaaaagatg

SEQ ID NO: 88301 - DNA, 103 bp, Artificial Sequence
  Synthetic Polynucleotide
taatacgactcactatagggccttgacactcaggtagctgctgtccatccaacagaggagaggatggatggcagctaccaacctggcggcagcgcaaaagatg

SEQ ID NO: 88302 - DNA, 103 bp, Artificial Sequence
  Synthetic Polynucleotide
taatacgactcactatagggaccccagcctccttgacactcaggtagctgaacagaggagacagctaatggagtgtcaaaacctggcggcagcgcaaaagatg

SEQ ID NO: 88303 - DNA, 103 bp, Artificial Sequence
  Synthetic Polynucleotide
taatacgactcactataggggggccccttcaccccagcctccttgacactaacagaggagaagtgtcatggaggctgggaacctggcggcagcgcaaaagatg

SEQ ID NO: 88304 - DNA, 103 bp, Artificial Sequence
  Synthetic Polynucleotide
taatacgactcactatagggcccggtcctggggccccttcaccccagcctaacagaggagaaggctgatgtgaaggggcaacctggcggcagcgcaaaagatg

SEQ ID NO: 88305 - DNA, 103 bp, Artificial Sequence
  Synthetic Polynucleotide
taatacgactcactatagggtctgagctggcccggtcctggggccccttcaacagaggagagaagggatgccaggaccgaacctggcggcagcgcaaaagatg

SEQ ID NO: 88306 - DNA, 103 bp, Artificial Sequence
  Synthetic Polynucleotide
taatacgactcactataggggctggggaggtctgagctggcccggtcctgaacagaggagacaggacatggccagctcaaacctggcggcagcgcaaaagatg

SEQ ID NO: 88307 - DNA, 103 bp, Artificial Sequence
  Synthetic Polynucleotide
taatacgactcactatagggtctccaatgggctggggaggtctgagctggaacagaggagaccagctatgacctccccaaacctggcggcagcgcaaaagatg

SEQ ID NO: 88308 - DNA, 103 bp, Artificial Sequence
  Synthetic Polynucleotide
taatacgactcactatagggctctgcgacaccgggctgtagtaggcgtccaacagaggagaggacgcatgctacagcccaacctggcggcagcgcaaaagatg

SEQ ID NO: 88309 - DNA, 103 bp, Artificial Sequence
  Synthetic Polynucleotide
taatacgactcactataggggagtcggccttctccaatgggctggggaggaacagaggagacctcccatgcccattggaaacctggcggcagcgcaaaagatg

SEQ ID NO: 88310 - DNA, 103 bp, Artificial Sequence
  Synthetic Polynucleotide
taatacgactcactataggggttgctctctgagtcggccttctccaatggaacagaggagaccattgatgaaggccgacaacctggcggcagcgcaaaagatg

SEQ ID NO: 88311 - DNA, 103 bp, Artificial Sequence
  Synthetic Polynucleotide
taatacgactcactatagggtcttgcccttgttgctctctgagtcggcctaacagaggagaaggccgatgcagagagcaaacctggcggcagcgcaaaagatg

SEQ ID NO: 88312 - DNA, 103 bp, Artificial Sequence
  Synthetic Polynucleotide
taatacgactcactatagggttccgccgcttcttgcccttgttgctctctaacagaggagaagagagatgcaagggcaaaacctggcggcagcgcaaaagatg

SEQ ID NO: 88313 - DNA, 103 bp, Artificial Sequence
  Synthetic Polynucleotide
taatacgactcactatagggggtggtccggttccgccgcttcttgcccttaacagaggagaaagggcatgaagcggcggaacctggcggcagcgcaaaagatg

SEQ ID NO: 88314 - DNA, 103 bp, Artificial Sequence
  Synthetic Polynucleotide
taatacgactcactatagggagctggtgaaggtggtccggttccgccgctaacagaggagaagcggcatgaccggaccaaacctggcggcagcgcaaaagatg

SEQ ID NO: 88315 - DNA, 103 bp, Artificial Sequence
  Synthetic Polynucleotide
taatacgactcactatagggtccagctggtagctggtgaaggtggtccggaacagaggagaccggacatgcttcaccagaacctggcggcagcgcaaaagatg

SEQ ID NO: 88316 - DNA, 103 bp, Artificial Sequence
  Synthetic Polynucleotide
taatacgactcactatagggctccagctcctccagctggtagctggtgaaaacagaggagattcaccatgtaccagctgaacctggcggcagcgcaaaagatg

SEQ ID NO: 88317 - DNA, 103 bp, Artificial Sequence
  Synthetic Polynucleotide
taatacgactcactatagggggaagaccttctccagctcctccagctggtaacagaggagaaccagcatgaggagctggaacctggcggcagcgcaaaagatg

SEQ ID NO: 88318 - DNA, 103 bp, Artificial Sequence
  Synthetic Polynucleotide
taatacgactcactatagggtgggtcttctggaagaccttctccagctccaacagaggagaggagctatggaaggtcttaacctggcggcagcgcaaaagatg

SEQ ID NO: 88319 - DNA, 103 bp, Artificial Sequence
  Synthetic Polynucleotide
taatacgactcactataggggccctcccgactctgcgacaccgggctgtaaacagaggagatacagcatggtgtcgcagaacctggcggcagcgcaaaagatg

SEQ ID NO: 88320 - DNA, 103 bp, Artificial Sequence
  Synthetic Polynucleotide
taatacgactcactataggggtctgggtagtgggtcttctggaagaccttaacagaggagaaaggtcatgcagaagaccaacctggcggcagcgcaaaagatg

SEQ ID NO: 88321 - DNA, 103 bp, Artificial Sequence
  Synthetic Polynucleotide
taatacgactcactataggggcgcatacacgtctgggtagtgggtcttctaacagaggagaagaagaatgactacccagaacctggcggcagcgcaaaagatg

SEQ ID NO: 88322 - DNA, 103 bp, Artificial Sequence
  Synthetic Polynucleotide
taatacgactcactatagggagctgttcccgcgcatacacgtctgggtagaacagaggagactacccatgcgtgtatgcaacctggcggcagcgcaaaagatg

SEQ ID NO: 88323 - DNA, 103 bp, Artificial Sequence
  Synthetic Polynucleotide
taatacgactcactatagggcctcatggccagctgttcccgcgcatacacaacagaggagagtgtatatgcgggaacagaacctggcggcagcgcaaaagatg

SEQ ID NO: 88324 - DNA, 103 bp, Artificial Sequence
  Synthetic Polynucleotide
taatacgactcactatagggtgaggtctgtcctcatggccagctgttcccaacagaggagagggaacatgtggccatgaaacctggcggcagcgcaaaagatg

SEQ ID NO: 88325 - DNA, 103 bp, Artificial Sequence
  Synthetic Polynucleotide
taatacgactcactatagggcgggcctcagtgaggtctgtcctcatggccaacagaggagaggccatatggacagacctaacctggcggcagcgcaaaagatg

SEQ ID NO: 88326 - DNA, 103 bp, Artificial Sequence
  Synthetic Polynucleotide
taatacgactcactataggggacctgcacgcgggcctcagtgaggtctgtaacagaggagaacagacatgactgaggccaacctggcggcagcgcaaaagatg

SEQ ID NO: 88327 - DNA, 103 bp, Artificial Sequence
  Synthetic Polynucleotide
taatacgactcactatagggtctggaaccagacctgcacgcgggcctcagaacagaggagactgaggatggcgtgcaggaacctggcggcagcgcaaaagatg

SEQ ID NO: 88328 - DNA, 103 bp, Artificial Sequence
  Synthetic Polynucleotide
taatacgactcactataggggcccttcggttctggaaccagacctgcacgaacagaggagacgtgcaatgctggttccaaacctggcggcagcgcaaaagatg

SEQ ID NO: 88329 - DNA, 103 bp, Artificial Sequence
  Synthetic Polynucleotide
taatacgactcactatagggcctccacttggcccttcggttctggaaccaaacagaggagatggttcatgaaccgaaggaacctggcggcagcgcaaaagatg

SEQ ID NO: 88330 - DNA, 103 bp, Artificial Sequence
  Synthetic Polynucleotide
taatacgactcactatagggaaggcgacgagccctcccgactctgcgacaaacagaggagatgtcgcatggtcgggaggaacctggcggcagcgcaaaagatg

SEQ ID NO: 88331 - DNA, 103 bp, Artificial Sequence
  Synthetic Polynucleotide
taatacgactcactataggggctcccgcttcctccacttggcccttcggtaacagaggagaaccgaaatgccaagtggaaacctggcggcagcgcaaaagatg

SEQ ID NO: 88332 - DNA, 103 bp, Artificial Sequence
  Synthetic Polynucleotide
taatacgactcactatagggtgcccaaaacgctcccgcttcctccacttgaacagaggagacaagtgatggaagcgggaaacctggcggcagcgcaaaagatg

SEQ ID NO: 88333 - DNA, 103 bp, Artificial Sequence
  Synthetic Polynucleotide
taatacgactcactatagggctgctgcatctgcccaaaacgctcccgcttaacagaggagaaagcggatgcgttttgggaacctggcggcagcgcaaaagatg

SEQ ID NO: 88334 - DNA, 103 bp, Artificial Sequence
  Synthetic Polynucleotide
taatacgactcactataggggggttcgaacctgctgcatctgcccaaaacaacagaggagagttttgatgagatgcagcaacctggcggcagcgcaaaagatg

SEQ ID NO: 88335 - DNA, 103 bp, Artificial Sequence
  Synthetic Polynucleotide
taatacgactcactataggggtggagaagtgggttcgaacctgctgcatcaacagaggagagatgcaatgggttcgaacaacctggcggcagcgcaaaagatg

SEQ ID NO: 88336 - DNA, 103 bp, Artificial Sequence
  Synthetic Polynucleotide
taatacgactcactatagggctcatatgcagtggagaagtgggttcgaacaacagaggagagttcgaatgcacttctccaacctggcggcagcgcaaaagatg

SEQ ID NO: 88337 - DNA, 103 bp, Artificial Sequence
  Synthetic Polynucleotide
taatacgactcactatagggggaggggcagctcatatgcagtggagaagtaacagaggagaacttctatgctgcatatgaacctggcggcagcgcaaaagatg

SEQ ID NO: 88338 - DNA, 103 bp, Artificial Sequence
  Synthetic Polynucleotide
taatacgactcactataggggctcgggtgaggaggggcagctcatatgcaaacagaggagatgcataatggctgcccctaacctggcggcagcgcaaaagatg

SEQ ID NO: 88339 - DNA, 103 bp, Artificial Sequence
  Synthetic Polynucleotide
taatacgactcactataggggtagttctcagctcgggtgaggaggggcagaacagaggagactgcccatgctcacccgaaacctggcggcagcgcaaaagatg

SEQ ID NO: 88340 - DNA, 103 bp, Artificial Sequence
  Synthetic Polynucleotide
taatacgactcactataggggaatctgggcgtagttctcagctcgggtgaaacagaggagatcacccatgctgagaactaacctggcggcagcgcaaaagatg

SEQ ID NO: 88341 - DNA, 103 bp, Artificial Sequence
  Synthetic Polynucleotide
taatacgactcactatagggaatgccctaaaaggcgacgagccctcccgaaacagaggagatcgggaatgctcgtcgccaacctggcggcagcgcaaaagatg

SEQ ID NO: 88342 - DNA, 103 bp, Artificial Sequence
  Synthetic Polynucleotide
taatacgactcactataggggacgggttctgaatctgggcgtagttctcaaacagaggagatgagaaatgcgcccagataacctggcggcagcgcaaaagatg

SEQ ID NO: 88343 - DNA, 103 bp, Artificial Sequence
  Synthetic Polynucleotide
taatacgactcactataggggccgagccaggacgggttctgaatctgggcaacagaggagagcccagatgcagaacccgaacctggcggcagcgcaaaagatg

SEQ ID NO: 88344 - DNA, 103 bp, Artificial Sequence
  Synthetic Polynucleotide
taatacgactcactatagggccccgttgttgccgagccaggacgggttctaacagaggagaagaaccatgcctggctcgaacctggcggcagcgcaaaagatg

SEQ ID NO: 88345 - DNA, 103 bp, Artificial Sequence
  Synthetic Polynucleotide
taatacgactcactatagggggtgaggcagccccgttgttgccgagccagaacagaggagactggctatgcaacaacggaacctggcggcagcgcaaaagatg

SEQ ID NO: 88346 - DNA, 103 bp, Artificial Sequence
  Synthetic Polynucleotide
taatacgactcactatagggggctggcactggtgaggcagccccgttgttaacagaggagaaacaacatggctgcctcaaacctggcggcagcgcaaaagatg

SEQ ID NO: 88347 - DNA, 103 bp, Artificial Sequence
  Synthetic Polynucleotide
taatacgactcactatagggggaccacgcaggctggcactggtgaggcagaacagaggagactgcctatgcagtgccagaacctggcggcagcgcaaaagatg

SEQ ID NO: 88348 - DNA, 103 bp, Artificial Sequence
  Synthetic Polynucleotide
taatacgactcactataggggggtcgcaggggaccacgcaggctggcactaacagaggagaagtgccatgctgcgtggtaacctggcggcagcgcaaaagatg

SEQ ID NO: 88349 - DNA, 103 bp, Artificial Sequence
  Synthetic Polynucleotide
taatacgactcactatagggggcaggcaccgggtcgcaggggaccacgcaaacagaggagatgcgtgatgccctgcgacaacctggcggcagcgcaaaagatg

SEQ ID NO: 88350 - DNA, 103 bp, Artificial Sequence
  Synthetic Polynucleotide
taatacgactcactataggggggacatgcaggcaggcaccgggtcgcaggaacagaggagacctgcgatgcggtgcctgaacctggcggcagcgcaaaagatg

SEQ ID NO: 88351 - DNA, 103 bp, Artificial Sequence
  Synthetic Polynucleotide
taatacgactcactatagggtgggcatgaggggacatgcaggcaggcaccaacagaggagaggtgccatgctgcatgtcaacctggcggcagcgcaaaagatg

SEQ ID NO: 88352 - DNA, 103 bp, Artificial Sequence
  Synthetic Polynucleotide
taatacgactcactatagggctccttcagcagagtcaggaagctctgcataacagaggagaatgcagatgttcctgactaacctggcggcagcgcaaaagatg

SEQ ID NO: 88353 - DNA, 103 bp, Artificial Sequence
  Synthetic Polynucleotide
taatacgactcactatagggctgcagttgggcaaggtcatcctggaagtcaacagaggagagacttcatggatgaccttaacctggcggcagcgcaaaagatg

SEQ ID NO: 88354 - DNA, 103 bp, Artificial Sequence
  Synthetic Polynucleotide
taatacgactcactatagggggcagacacagggccggggaaggcagatggaacagaggagaccatctatgttccccggcaacctggcggcagcgcaaaagatg

SEQ ID NO: 88355 - DNA, 103 bp, Artificial Sequence
  Synthetic Polynucleotide
taatacgactcactatagggtcagctccatggcagacacagggccggggaaacagaggagatccccgatgctgtgtctgaacctggcggcagcgcaaaagatg

SEQ ID NO: 88356 - DNA, 103 bp, Artificial Sequence
  Synthetic Polynucleotide
taatacgactcactatagggagggcctggctcagctccatggcagacacaaacagaggagatgtgtcatgcatggagctaacctggcggcagcgcaaaagatg

SEQ ID NO: 88357 - DNA, 103 bp, Artificial Sequence
  Synthetic Polynucleotide
taatacgactcactataggggctggagggcagggcctggctcagctccataacagaggagaatggagatgagccaggccaacctggcggcagcgcaaaagatg

SEQ ID NO: 88358 - DNA, 103 bp, Artificial Sequence
  Synthetic Polynucleotide
taatacgactcactatagggactgcacctggctggagggcagggcctggcaacagaggagagccaggatgtgccctccaaacctggcggcagcgcaaaagatg

SEQ ID NO: 88359 - DNA, 103 bp, Artificial Sequence
  Synthetic Polynucleotide
taatacgactcactatagggctatcagaacactgcacctggctggagggcaacagaggagagccctcatgccaggtgcaaacctggcggcagcgcaaaagatg

SEQ ID NO: 88360 - DNA, 103 bp, Artificial Sequence
  Synthetic Polynucleotide
taatacgactcactatagggagaggcctggctatcagaacactgcacctgaacagaggagacaggtgatgtgttctgataacctggcggcagcgcaaaagatg

SEQ ID NO: 88361 - DNA, 103 bp, Artificial Sequence
  Synthetic Polynucleotide
taatacgactcactatagggaggcatcaccagaggcctggctatcagaacaacagaggagagttctgatggccaggcctaacctggcggcagcgcaaaagatg

SEQ ID NO: 88362 - DNA, 103 bp, Artificial Sequence
  Synthetic Polynucleotide
taatacgactcactataggggctccccagaaggcatcaccagaggcctggaacagaggagaccaggcatgtggtgatgcaacctggcggcagcgcaaaagatg

SEQ ID NO: 88363 - DNA, 103 bp, Artificial Sequence
  Synthetic Polynucleotide
taatacgactcactataggggagcatcctggctccccagaaggcatcaccaacagaggagaggtgatatgttctggggaaacctggcggcagcgcaaaagatg

SEQ ID NO: 88364 - DNA, 103 bp, Artificial Sequence
  Synthetic Polynucleotide
taatacgactcactatagggtgaccaaaggctgcagttgggcaaggtcataacagaggagaatgaccatgcccaactgcaacctggcggcagcgcaaaagatg

SEQ ID NO: 88365 - DNA, 103 bp, Artificial Sequence
  Synthetic Polynucleotide
taatacgactcactatagggaaaactcaaggagcatcctggctccccagaaacagaggagatctgggatgccaggatgcaacctggcggcagcgcaaaagatg

SEQ ID NO: 88366 - DNA, 103 bp, Artificial Sequence
  Synthetic Polynucleotide
taatacgactcactatagggctgctccctgaaaactcaaggagcatcctgaacagaggagacaggatatgccttgagttaacctggcggcagcgcaaaagatg

SEQ ID NO: 88367 - DNA, 103 bp, Artificial Sequence
  Synthetic Polynucleotide
taatacgactcactatagggtcagcccaggctgctccctgaaaactcaagaacagaggagacttgagatgtcagggagcaacctggcggcagcgcaaaagatg

SEQ ID NO: 88368 - DNA, 103 bp, Artificial Sequence
  Synthetic Polynucleotide
taatacgactcactatagggagaatggctgtgaccaaaggctgcagttggaacagaggagaccaactatggcctttggtaacctggcggcagcgcaaaagatg

SEQ ID NO: 88369 - DNA, 103 bp, Artificial Sequence
  Synthetic Polynucleotide
taatacgactcactatagggctggctgtccagaatggctgtgaccaaaggaacagaggagacctttgatgacagccattaacctggcggcagcgcaaaagatg

SEQ ID NO: 88370 - DNA, 103 bp, Artificial Sequence
  Synthetic Polynucleotide
taatacgactcactataggggcaggcggagctggctgtccagaatggctgaacagaggagacagccaatgtggacagccaacctggcggcagcgcaaaagatg

SEQ ID NO: 88371 - DNA, 103 bp, Artificial Sequence
  Synthetic Polynucleotide
taatacgactcactatagggtccaggagatgcaggcggagctggctgtccaacagaggagaggacagatggctccgcctaacctggcggcagcgcaaaagatg

SEQ ID NO: 88372 - DNA, 103 bp, Artificial Sequence
  Synthetic Polynucleotide
taatacgactcactatagggatctgcgttgtccaggagatgcaggcggagaacagaggagactccgcatgcatctcctgaacctggcggcagcgcaaaagatg

SEQ ID NO: 88373 - DNA, 103 bp, Artificial Sequence
  Synthetic Polynucleotide
taatacgactcactatagggccagggccacatctgcgttgtccaggagataacagaggagaatctccatgacaacgcagaacctggcggcagcgcaaaagatg

SEQ ID NO: 88374 - DNA, 103 bp, Artificial Sequence
  Synthetic Polynucleotide
taatacgactcactatagggcgggcgcacgccagggccacatctgcgttgaacagaggagacaacgcatgtgtggccctaacctggcggcagcgcaaaagatg

SEQ ID NO: 88375 - DNA, 103 bp, Artificial Sequence
  Synthetic Polynucleotide
taatacgactcactataggggtccaggacacgggcgcacgccagggccacaacagaggagagtggccatggcgtgcgccaacctggcggcagcgcaaaagatg

SEQ ID NO: 88376 - DNA, 103 bp, Artificial Sequence
  Synthetic Polynucleotide
taatacgactcactatagggtgtcctcatgctccttcagcagagtcaggaaacagaggagatcctgaatgtgctgaaggaacctggcggcagcgcaaaagatg

SEQ ID NO: 88377 - DNA, 103 bp, Artificial Sequence
  Synthetic Polynucleotide
taatacgactcactataggggctcctgctggtccaggacacgggcgcacgaacagaggagacgtgcgatggtgtcctggaacctggcggcagcgcaaaagatg

SEQ ID NO: 88378 - DNA, 103 bp, Artificial Sequence
  Synthetic Polynucleotide
taatacgactcactataggggcctgctgctgctcctgctggtccaggacaaacagaggagatgtcctatgccagcaggaaacctggcggcagcgcaaaagatg

SEQ ID NO: 88379 - DNA, 103 bp, Artificial Sequence
  Synthetic Polynucleotide
taatacgactcactataggggcggcaagccgcctgctgctgctcctgctgaacagaggagacagcagatgcagcagcagaacctggcggcagcgcaaaagatg

SEQ ID NO: 88380 - DNA, 103 bp, Artificial Sequence
  Synthetic Polynucleotide
taatacgactcactatagggcctccaggaggcggcaagccgcctgctgctaacagaggagaagcagcatgcggcttgccaacctggcggcagcgcaaaagatg

SEQ ID NO: 88381 - DNA, 103 bp, Artificial Sequence
  Synthetic Polynucleotide
taatacgactcactatagggacctggcacccctccaggaggcggcaagccaacagaggagaggcttgatgcctcctggaaacctggcggcagcgcaaaagatg

SEQ ID NO: 88382 - DNA, 103 bp, Artificial Sequence
  Synthetic Polynucleotide
taatacgactcactataggggcctcccggcacctggcacccctccaggagaacagaggagactcctgatggggtgccagaacctggcggcagcgcaaaagatg

SEQ ID NO: 88383 - DNA, 103 bp, Artificial Sequence
  Synthetic Polynucleotide
taatacgactcactatagggactcctggctgcctcccggcacctggcaccaacagaggagaggtgccatgtgccgggagaacctggcggcagcgcaaaagatg

SEQ ID NO: 88384 - DNA, 103 bp, Artificial Sequence
  Synthetic Polynucleotide
taatacgactcactatagggagctgcactaactcctggctgcctcccggcaacagaggagagccgggatgcagccaggaaacctggcggcagcgcaaaagatg

SEQ ID NO: 88385 - DNA, 103 bp, Artificial Sequence
  Synthetic Polynucleotide
taatacgactcactataggggtcgttccagagctgcactaactcctggctaacagaggagaagccagatgttagtgcagaacctggcggcagcgcaaaagatg

SEQ ID NO: 88386 - DNA, 103 bp, Artificial Sequence
  Synthetic Polynucleotide
taatacgactcactatagggggtagtggatgtcgttccagagctgcactaaacagaggagatagtgcatgtctggaacgaacctggcggcagcgcaaaagatg

SEQ ID NO: 88387 - DNA, 103 bp, Artificial Sequence
  Synthetic Polynucleotide
taatacgactcactatagggggtgcacaggtgtcctcatgctccttcagcaacagaggagagctgaaatggcatgaggaaacctggcggcagcgcaaaagatg

SEQ ID NO: 88388 - DNA, 103 bp, Artificial Sequence
  Synthetic Polynucleotide
taatacgactcactatagggatgaccagacggtagtggatgtcgttccagaacagaggagactggaaatgcatccactaaacctggcggcagcgcaaaagatg

SEQ ID NO: 88389 - DNA, 103 bp, Artificial Sequence
  Synthetic Polynucleotide
taatacgactcactatagggcagcctcctcatgaccagacggtagtggataacagaggagaatccacatgcgtctggtcaacctggcggcagcgcaaaagatg

SEQ ID NO: 88390 - DNA, 103 bp, Artificial Sequence
  Synthetic Polynucleotide
taatacgactcactatagggcagccacgcccagcctcctcatgaccagacaacagaggagagtctggatgtgaggaggcaacctggcggcagcgcaaaagatg

SEQ ID NO: 88391 - DNA, 103 bp, Artificial Sequence
  Synthetic Polynucleotide
taatacgactcactatagggggggtgagcgcagccacgcccagcctcctcaacagaggagagaggagatggggcgtggcaacctggcggcagcgcaaaagatg

SEQ ID NO: 88392 - DNA, 103 bp, Artificial Sequence
  Synthetic Polynucleotide
taatacgactcactatagggcttctgcaccggggtgagcgcagccacgccaacagaggagaggcgtgatggcgctcaccaacctggcggcagcgcaaaagatg

SEQ ID NO: 88393 - DNA, 103 bp, Artificial Sequence
  Synthetic Polynucleotide
taatacgactcactatagggtgcagcggaacttctgcaccggggtgagcgaacagaggagacgctcaatgcggtgcagaaacctggcggcagcgcaaaagatg

SEQ ID NO: 88394 - DNA, 103 bp, Artificial Sequence
  Synthetic Polynucleotide
taatacgactcactatagggttcctcttcctgcagcggaacttctgcaccaacagaggagaggtgcaatggttccgctgaacctggcggcagcgcaaaagatg

SEQ ID NO: 88395 - DNA, 103 bp, Artificial Sequence
  Synthetic Polynucleotide
taatacgactcactataggggggcggggggttcctcttcctgcagcggaaaacagaggagattccgcatgaggaagaggaacctggcggcagcgcaaaagatg

SEQ ID NO: 88396 - DNA, 103 bp, Artificial Sequence
  Synthetic Polynucleotide
taatacgactcactatagggagagggaggggggcggggggttcctcttccaacagaggagaggaagaatgaccccccgcaacctggcggcagcgcaaaagatg

SEQ ID NO: 88397 - DNA, 103 bp, Artificial Sequence
  Synthetic Polynucleotide
taatacgactcactatagggccctctgggcagagggaggggggcggggggaacagaggagaccccccatgcccctccctaacctggcggcagcgcaaaagatg

SEQ ID NO: 88398 - DNA, 103 bp, Artificial Sequence
  Synthetic Polynucleotide
taatacgactcactatagggctccgccgggggtgcacaggtgtcctcatgaacagaggagacatgagatgacctgtgcaaacctggcggcagcgcaaaagatg

SEQ ID NO: 88399 - DNA, 103 bp, Artificial Sequence
  Synthetic Polynucleotide
taatacgactcactataggggctcttcagcccctctgggcagagggagggaacagaggagaccctccatgtgcccagagaacctggcggcagcgcaaaagatg

SEQ ID NO: 88400 - DNA, 103 bp, Artificial Sequence
  Synthetic Polynucleotide
taatacgactcactatagggggaagttccggctcttcagcccctctgggcaacagaggagagcccagatgggctgaagaaacctggcggcagcgcaaaagatg

SEQ ID NO: 88401 - DNA, 103 bp, Artificial Sequence
  Synthetic Polynucleotide
taatacgactcactatagggacctctctggggaagttccggctcttcagcaacagaggagagctgaaatgccggaacttaacctggcggcagcgcaaaagatg

SEQ ID NO: 88402 - DNA, 103 bp, Artificial Sequence
  Synthetic Polynucleotide
taatacgactcactatagggcttctcacgaacctctctggggaagttccgaacagaggagacggaacatgcccagagagaacctggcggcagcgcaaaagatg

SEQ ID NO: 88403 - DNA, 103 bp, Artificial Sequence
  Synthetic Polynucleotide
taatacgactcactatagggaattgtgcagcttctcacgaacctctctggaacagaggagaccagagatgttcgtgagaaacctggcggcagcgcaaaagatg

SEQ ID NO: 88404 - DNA, 103 bp, Artificial Sequence
  Synthetic Polynucleotide
taatacgactcactatagggcccacagcgaaattgtgcagcttctcacgaaacagaggagatcgtgaatggctgcacaaaacctggcggcagcgcaaaagatg

SEQ ID NO: 88405 - DNA, 103 bp, Artificial Sequence
  Synthetic Polynucleotide
taatacgactcactatagggggtgttcacccccacagcgaaattgtgcagaacagaggagactgcacatgttcgctgtgaacctggcggcagcgcaaaagatg

SEQ ID NO: 88406 - DNA, 103 bp, Artificial Sequence
  Synthetic Polynucleotide
taatacgactcactatagggtgctggggttggtgttcacccccacagcgaaacagaggagatcgctgatggggtgaacaaacctggcggcagcgcaaaagatg

SEQ ID NO: 88407 - DNA, 103 bp, Artificial Sequence
  Synthetic Polynucleotide
taatacgactcactatagggctctcagccttgctggggttggtgttcaccaacagaggagaggtgaaatgcaaccccagaacctggcggcagcgcaaaagatg

SEQ ID NO: 88408 - DNA, 103 bp, Artificial Sequence
  Synthetic Polynucleotide
taatacgactcactatagggcaagttctccctctcagccttgctggggttaacagaggagaaaccccatgaaggctgagaacctggcggcagcgcaaaagatg

SEQ ID NO: 88409 - DNA, 103 bp, Artificial Sequence
  Synthetic Polynucleotide
taatacgactcactataggggggtcaccagctccgccgggggtgcacaggaacagaggagacctgtgatgccccggcggaacctggcggcagcgcaaaagatg

SEQ ID NO: 88410 - DNA, 103 bp, Artificial Sequence
  Synthetic Polynucleotide
taatacgactcactatagggtctccaatgccaagttctccctctcagcctaacagaggagaaggctgatggggagaactaacctggcggcagcgcaaaagatg

SEQ ID NO: 88411 - DNA, 103 bp, Artificial Sequence
  Synthetic Polynucleotide
taatacgactcactataggggtcaagctcgtctccaatgccaagttctccaacagaggagaggagaaatgggcattggaaacctggcggcagcgcaaaagatg

SEQ ID NO: 88412 - DNA, 103 bp, Artificial Sequence
  Synthetic Polynucleotide
taatacgactcactatagggctgctcaggggtcaagctcgtctccaatgcaacagaggagagcattgatgacgagcttgaacctggcggcagcgcaaaagatg

SEQ ID NO: 88413 - DNA, 103 bp, Artificial Sequence
  Synthetic Polynucleotide
taatacgactcactatagggagttgtacacctgctcaggggtcaagctcgaacagaggagacgagctatgcccctgagcaacctggcggcagcgcaaaagatg

SEQ ID NO: 88414 - DNA, 103 bp, Artificial Sequence
  Synthetic Polynucleotide
taatacgactcactatagggttggcaaaccagttgtacacctgctcagggaacagaggagaccctgaatgggtgtacaaaacctggcggcagcgcaaaagatg

SEQ ID NO: 88415 - DNA, 103 bp, Artificial Sequence
  Synthetic Polynucleotide
taatacgactcactataggggcgccggtaattggcaaaccagttgtacacaacagaggagagtgtacatgtggtttgccaacctggcggcagcgcaaaagatg

SEQ ID NO: 88416 - DNA, 103 bp, Artificial Sequence
  Synthetic Polynucleotide
taatacgactcactatagggctctttggcggcgccggtaattggcaaaccaacagaggagaggtttgatgattaccggcaacctggcggcagcgcaaaagatg

SEQ ID NO: 88417 - DNA, 103 bp, Artificial Sequence
  Synthetic Polynucleotide
taatacgactcactatagggtggggaagggctctttggcggcgccggtaaaacagaggagattaccgatgccgccaaagaacctggcggcagcgcaaaagatg

SEQ ID NO: 88418 - DNA, 103 bp, Artificial Sequence
  Synthetic Polynucleotide
taatacgactcactatagggcttcatgtgctggggaagggctctttggcgaacagaggagacgccaaatggcccttcccaacctggcggcagcgcaaaagatg

SEQ ID NO: 88419 - DNA, 103 bp, Artificial Sequence
  Synthetic Polynucleotide
taatacgactcactataggggctgggctggcttcatgtgctggggaagggaacagaggagacccttcatgagcacatgaaacctggcggcagcgcaaaagatg

SEQ ID NO: 88420 - DNA, 103 bp, Artificial Sequence
  Synthetic Polynucleotide
taatacgactcactatagggctgcccgcaagggtcaccagctccgccgggaacagaggagacccggcatggctggtgacaacctggcggcagcgcaaaagatg

SEQ ID NO: 88421 - DNA, 103 bp, Artificial Sequence
  Synthetic Polynucleotide
taatacgactcactataggggctgtggcctgctgggctggcttcatgtgcaacagaggagagcacatatggccagcccaaacctggcggcagcgcaaaagatg

SEQ ID NO: 88422 - DNA, 103 bp, Artificial Sequence
  Synthetic Polynucleotide
taatacgactcactatagggagggtcttcagctgtggcctgctgggctggaacagaggagaccagccatgcaggccacaaacctggcggcagcgcaaaagatg

SEQ ID NO: 88423 - DNA, 103 bp, Artificial Sequence
  Synthetic Polynucleotide
taatacgactcactatagggccctcgcaccagggtcttcagctgtggcctaacagaggagaaggccaatgctgaagaccaacctggcggcagcgcaaaagatg

SEQ ID NO: 88424 - DNA, 103 bp, Artificial Sequence
  Synthetic Polynucleotide
taatacgactcactatagggggacccctctccctcgcaccagggtcttcaaacagaggagatgaagaatgtggtgcgagaacctggcggcagcgcaaaagatg

SEQ ID NO: 88425 - DNA, 103 bp, Artificial Sequence
  Synthetic Polynucleotide
taatacgactcactatagggcaggaggtcaggacccctctccctcgcaccaacagaggagaggtgcgatggagaggggtaacctggcggcagcgcaaaagatg

SEQ ID NO: 88426 - DNA, 103 bp, Artificial Sequence
  Synthetic Polynucleotide
taatacgactcactatagggctgagggctgcaggaggtcaggacccctctaacagaggagaagagggatgctgacctccaacctggcggcagcgcaaaagatg

SEQ ID NO: 88427 - DNA, 103 bp, Artificial Sequence
  Synthetic Polynucleotide
taatacgactcactatagggcgggggttgcctgagggctgcaggaggtcaaacagaggagatgacctatggcagccctcaacctggcggcagcgcaaaagatg

SEQ ID NO: 88428 - DNA, 103 bp, Artificial Sequence
  Synthetic Polynucleotide
taatacgactcactatagggagagtcaacacgggggttgcctgagggctgaacagaggagacagcccatgggcaaccccaacctggcggcagcgcaaaagatg

SEQ ID NO: 88429 - DNA, 103 bp, Artificial Sequence
  Synthetic Polynucleotide
taatacgactcactatagggccacaaacccagagtcaacacgggggttgcaacagaggagagcaaccatggtgttgactaacctggcggcagcgcaaaagatg

SEQ ID NO: 88430 - DNA, 103 bp, Artificial Sequence
  Synthetic Polynucleotide
taatacgactcactatagggtgaggcctgtccacaaacccagagtcaacaaacagaggagatgttgaatgtgggtttgtaacctggcggcagcgcaaaagatg

SEQ ID NO: 88431 - DNA, 103 bp, Artificial Sequence
  Synthetic Polynucleotide
taatacgactcactatagggccggcacagtctgcccgcaagggtcaccagaacagaggagactggtgatgcttgcgggcaacctggcggcagcgcaaaagatg

SEQ ID NO: 88432 - DNA, 103 bp, Artificial Sequence
  Synthetic Polynucleotide
taatacgactcactatagggctctgaccactgaggcctgtccacaaacccaacagaggagagggtttatggacaggcctaacctggcggcagcgcaaaagatg

SEQ ID NO: 88433 - DNA, 103 bp, Artificial Sequence
  Synthetic Polynucleotide
taatacgactcactatagggcctcacgttcctctgaccactgaggcctgtaacagaggagaacaggcatgagtggtcagaacctggcggcagcgcaaaagatg

SEQ ID NO: 88434 - DNA, 103 bp, Artificial Sequence
  Synthetic Polynucleotide
taatacgactcactatagggggccccttttcctcacgttcctctgaccacaacagaggagagtggtcatgggaacgtgaaacctggcggcagcgcaaaagatg

SEQ ID NO: 88435 - DNA, 103 bp, Artificial Sequence
  Synthetic Polynucleotide
taatacgactcactatagggggactgtggaggccccttttcctcacgttcaacagaggagagaacgtatggaaaaggggaacctggcggcagcgcaaaagatg

SEQ ID NO: 88436 - DNA, 103 bp, Artificial Sequence
  Synthetic Polynucleotide
taatacgactcactatagggtggtctgtggggactgtggaggccccttttaacagaggagaaaaaggatgctccacagtaacctggcggcagcgcaaaagatg

SEQ ID NO: 88437 - DNA, 103 bp, Artificial Sequence
  Synthetic Polynucleotide
taatacgactcactatagggggtccttgggtggtctgtggggactgtggaaacagaggagatccacaatgcccacagacaacctggcggcagcgcaaaagatg

SEQ ID NO: 88438 - DNA, 103 bp, Artificial Sequence
  Synthetic Polynucleotide
taatacgactcactatagggtggctcccatggtccttgggtggtctgtggaacagaggagaccacagatgacccaaggaaacctggcggcagcgcaaaagatg

SEQ ID NO: 88439 - DNA, 103 bp, Artificial Sequence
  Synthetic Polynucleotide
taatacgactcactatagggctaaggccagtggctcccatggtccttgggaacagaggagacccaagatgcatgggagcaacctggcggcagcgcaaaagatg

SEQ ID NO: 88440 - DNA, 103 bp, Artificial Sequence
  Synthetic Polynucleotide
taatacgactcactatagggaagtccggggctaaggccagtggctcccataacagaggagaatgggaatgactggccttaacctggcggcagcgcaaaagatg

SEQ ID NO: 88441 - DNA, 103 bp, Artificial Sequence
  Synthetic Polynucleotide
taatacgactcactatagggatctgcgggaaagtccggggctaaggccagaacagaggagactggccatggccccggacaacctggcggcagcgcaaaagatg

SEQ ID NO: 88442 - DNA, 103 bp, Artificial Sequence
  Synthetic Polynucleotide
taatacgactcactatagggcctggaagtcccggcacagtctgcccgcaaaacagaggagattgcggatggactgtgccaacctggcggcagcgcaaaagatg

SEQ ID NO: 88443 - DNA, 103 bp, Artificial Sequence
  Synthetic Polynucleotide
taatacgactcactatagggagactgtctcatctgcgggaaagtccggggaacagaggagaccccggatgttcccgcagaacctggcggcagcgcaaaagatg

SEQ ID NO: 88444 - DNA, 103 bp, Artificial Sequence
  Synthetic Polynucleotide
taatacgactcactatagggagtggctttgagactgtctcatctgcgggaaacagaggagatcccgcatgtgagacagtaacctggcggcagcgcaaaagatg

SEQ ID NO: 88445 - DNA, 103 bp, Artificial Sequence
  Synthetic Polynucleotide
taatacgactcactataggggctgacatccagtggctttgagactgtctcaacagaggagagagacaatgtcaaagccaaacctggcggcagcgcaaaagatg

SEQ ID NO: 88446 - DNA, 103 bp, Artificial Sequence
  Synthetic Polynucleotide
taatacgactcactatagggggggatggccgctgacatccagtggctttgaacagaggagacaaagcatgtggatgtcaaacctggcggcagcgcaaaagatg

SEQ ID NO: 88447 - DNA, 103 bp, Artificial Sequence
  Synthetic Polynucleotide
taatacgactcactatagggtgcacgctctggggatggccgctgacatccaacagaggagaggatgtatgcggccatccaacctggcggcagcgcaaaagatg

SEQ ID NO: 88448 - DNA, 103 bp, Artificial Sequence
  Synthetic Polynucleotide
taatacgactcactatagggctcctccaattgcacgctctggggatggccaacagaggagaggccatatgcagagcgtgaacctggcggcagcgcaaaagatg

SEQ ID NO: 88449 - DNA, 103 bp, Artificial Sequence
  Synthetic Polynucleotide
taatacgactcactatagggtgcccagaccctcctccaattgcacgctctaacagaggagaagagcgatgaattggaggaacctggcggcagcgcaaaagatg

SEQ ID NO: 88450 - DNA, 103 bp, Artificial Sequence
  Synthetic Polynucleotide
taatacgactcactatagggccactgcttgtgcccagaccctcctccaataacagaggagaattggaatggggtctgggaacctggcggcagcgcaaaagatg

SEQ ID NO: 88451 - DNA, 103 bp, Artificial Sequence
  Synthetic Polynucleotide
taatacgactcactatagggctctgtccgtccactgcttgtgcccagaccaacagaggagaggtctgatgacaagcagtaacctggcggcagcgcaaaagatg

SEQ ID NO: 88452 - DNA, 103 bp, Artificial Sequence
  Synthetic Polynucleotide
taatacgactcactatagggccacccgtagctctgtccgtccactgcttgaacagaggagacaagcaatggacggacagaacctggcggcagcgcaaaagatg

SEQ ID NO: 88453 - DNA, 103 bp, Artificial Sequence
  Synthetic Polynucleotide
taatacgactcactataggggcaaggtcatcctggaagtcccggcacagtaacagaggagaactgtgatgggacttccaaacctggcggcagcgcaaaagatg

SEQ ID NO: 88454 - DNA, 103 bp, Artificial Sequence
  Synthetic Polynucleotide
taatacgactcactatagggaggaagctgcccacccgtagctctgtccgtaacagaggagaacggacatggctacgggtaacctggcggcagcgcaaaagatg

SEQ ID NO: 88455 - DNA, 103 bp, Artificial Sequence
  Synthetic Polynucleotide
taatacgactcactatagggctgtgtcaccaggaagctgcccacccgtagaacagaggagactacggatgggcagcttcaacctggcggcagcgcaaaagatg

SEQ ID NO: 88456 - DNA, 103 bp, Artificial Sequence
  Synthetic Polynucleotide
taatacgactcactataggggcagtgggggctgtgtcaccaggaagctgcaacagaggagagcagctatgtggtgacacaacctggcggcagcgcaaaagatg

SEQ ID NO: 88457 - DNA, 103 bp, Artificial Sequence
  Synthetic Polynucleotide
taatacgactcactatagggtcaggagcttgcagtgggggctgtgtcaccaacagaggagaggtgacatggcccccactaacctggcggcagcgcaaaagatg

SEQ ID NO: 88458 - DNA, 103 bp, Artificial Sequence
  Synthetic Polynucleotide
taatacgactcactataggggaggatgaattcaggagcttgcagtgggggaacagaggagacccccaatgcaagctcctaacctggcggcagcgcaaaagatg

SEQ ID NO: 88459 - DNA, 103 bp, Artificial Sequence
  Synthetic Polynucleotide
taatacgactcactatagggggctctgggtgaggatgaattcaggagcttaacagaggagaaagctcatgaattcatccaacctggcggcagcgcaaaagatg

SEQ ID NO: 88460 - DNA, 103 bp, Artificial Sequence
  Synthetic Polynucleotide
taatacgactcactatagggagctctggagggctctgggtgaggatgaataacagaggagaattcatatgcacccagagaacctggcggcagcgcaaaagatg

SEQ ID NO: 88461 - DNA, 103 bp, Artificial Sequence
  Synthetic Polynucleotide
taatacgactcactatagggggctggggccagctctggagggctctgggtaacagaggagaacccagatgcctccagagaacctggcggcagcgcaaaagatg

SEQ ID NO: 88462 - DNA, 103 bp, Artificial Sequence
  Synthetic Polynucleotide
taatacgactcactatagggaggcagatggggctggggccagctctggagaacagaggagactccagatgtggccccagaacctggcggcagcgcaaaagatg

SEQ ID NO: 88463 - DNA, 103 bp, Artificial Sequence
  Synthetic Polynucleotide
taatacgactcactataggggggccggggaaggcagatggggctggggccaacagaggagaggccccatgcccatctgcaacctggcggcagcgcaaaagatg

SEQ ID NO: 88464 - DNA, 103 bp, Artificial Sequence
  Synthetic Polynucleotide
taatacgactcactataggggacccttcccagccctaactgcacttccataacagaggagaatggaaatgcagttagggaacctggcggcagcgcaaaagatg

SEQ ID NO: 88465 - DNA, 103 bp, Artificial Sequence
  Synthetic Polynucleotide
taatacgactcactatagggcctggggcccgggttctggatcacttcgcgaacagaggagacgcgaaatgatccagaacaacctggcggcagcgcaaaagatg

SEQ ID NO: 88466 - DNA, 103 bp, Artificial Sequence
  Synthetic Polynucleotide
taatacgactcactatagggttcaagtgtcccggagctccctgctgcagcaacagaggagagctgcaatggggagctccaacctggcggcagcgcaaaagatg

SEQ ID NO: 88467 - DNA, 103 bp, Artificial Sequence
  Synthetic Polynucleotide
taatacgactcactatagggtagacggcagttcaagtgtcccggagctccaacagaggagaggagctatgggacacttgaacctggcggcagcgcaaaagatg

SEQ ID NO: 88468 - DNA, 103 bp, Artificial Sequence
  Synthetic Polynucleotide
taatacgactcactatagggagagacagggtagacggcagttcaagtgtcaacagaggagagacactatgactgccgtcaacctggcggcagcgcaaaagatg

SEQ ID NO: 88469 - DNA, 103 bp, Artificial Sequence
  Synthetic Polynucleotide
taatacgactcactatagggggacttgtagagagacagggtagacggcagaacagaggagactgccgatgaccctgtctaacctggcggcagcgcaaaagatg

SEQ ID NO: 88470 - DNA, 103 bp, Artificial Sequence
  Synthetic Polynucleotide
taatacgactcactatagggccagtgctccggacttgtagagagacagggaacagaggagaccctgtatgtctacaagtaacctggcggcagcgcaaaagatg

SEQ ID NO: 88471 - DNA, 103 bp, Artificial Sequence
  Synthetic Polynucleotide
taatacgactcactataggggctgcctcgtccagtgctccggacttgtagaacagaggagactacaaatgcggagcactaacctggcggcagcgcaaaagatg

SEQ ID NO: 88472 - DNA, 103 bp, Artificial Sequence
  Synthetic Polynucleotide
taatacgactcactatagggctggtacgcagctgcctcgtccagtgctccaacagaggagaggagcaatggacgaggcaaacctggcggcagcgcaaaagatg

SEQ ID NO: 88473 - DNA, 103 bp, Artificial Sequence
  Synthetic Polynucleotide
taatacgactcactatagggagtcgcgactctggtacgcagctgcctcgtaacagaggagaacgaggatgctgcgtaccaacctggcggcagcgcaaaagatg

SEQ ID NO: 88474 - DNA, 103 bp, Artificial Sequence
  Synthetic Polynucleotide
taatacgactcactatagggaagttgtagtagtcgcgactctggtacgcaaacagaggagatgcgtaatggagtcgcgaaacctggcggcagcgcaaaagatg

SEQ ID NO: 88475 - DNA, 103 bp, Artificial Sequence
  Synthetic Polynucleotide
taatacgactcactatagggagccagtggaaagttgtagtagtcgcgactaacagaggagaagtcgcatgtactacaacaacctggcggcagcgcaaaagatg

SEQ ID NO: 88476 - DNA, 103 bp, Artificial Sequence
  Synthetic Polynucleotide
taatacgactcactatagggcctctgggtgcctggggcccgggttctggaaacagaggagatccagaatgcgggccccaaacctggcggcagcgcaaaagatg

SEQ ID NO: 88477 - DNA, 103 bp, Artificial Sequence
  Synthetic Polynucleotide
taatacgactcactataggggtccggccagagccagtggaaagttgtagtaacagaggagaactacaatgttccactggaacctggcggcagcgcaaaagatg

SEQ ID NO: 88478 - DNA, 103 bp, Artificial Sequence
  Synthetic Polynucleotide
taatacgactcactataggggggggcggcggtccggccagagccagtggaaacagaggagatccactatgtctggccggaacctggcggcagcgcaaaagatg

SEQ ID NO: 88479 - DNA, 103 bp, Artificial Sequence
  Synthetic Polynucleotide
taatacgactcactatagggaggcggcggagggggcggcggtccggccagaacagaggagactggccatgccgccgcccaacctggcggcagcgcaaaagatg

SEQ ID NO: 88480 - DNA, 103 bp, Artificial Sequence
  Synthetic Polynucleotide
taatacgactcactatagggggggatggggaggcggcggagggggcggcgaacagaggagacgccgcatgctccgccgcaacctggcggcagcgcaaaagatg

SEQ ID NO: 88481 - DNA, 103 bp, Artificial Sequence
  Synthetic Polynucleotide
taatacgactcactatagggatgcgagcgtggggatggggaggcggcggaaacagaggagatccgccatgtccccatccaacctggcggcagcgcaaaagatg

SEQ ID NO: 88482 - DNA, 103 bp, Artificial Sequence
  Synthetic Polynucleotide
taatacgactcactatagggctccagcttgatgcgagcgtggggatggggaacagaggagaccccatatgcacgctcgcaacctggcggcagcgcaaaagatg

SEQ ID NO: 88483 - DNA, 103 bp, Artificial Sequence
  Synthetic Polynucleotide
taatacgactcactatagggccagcgggttctccagcttgatgcgagcgtaacagaggagaacgctcatgtcaagctggaacctggcggcagcgcaaaagatg

SEQ ID NO: 88484 - DNA, 103 bp, Artificial Sequence
  Synthetic Polynucleotide
taatacgactcactatagggctgccgtagtccagcgggttctccagcttgaacagaggagacaagctatggaacccgctaacctggcggcagcgcaaaagatg

SEQ ID NO: 88485 - DNA, 103 bp, Artificial Sequence
  Synthetic Polynucleotide
taatacgactcactatagggcgcccaggcgctgccgtagtccagcgggttaacagaggagaaacccgatggactacggcaacctggcggcagcgcaaaagatg

SEQ ID NO: 88486 - DNA, 103 bp, Artificial Sequence
  Synthetic Polynucleotide
taatacgactcactatagggccgccgcagccgcccaggcgctgccgtagtaacagaggagaactacgatggcgcctgggaacctggcggcagcgcaaaagatg

SEQ ID NO: 88487 - DNA, 103 bp, Artificial Sequence
  Synthetic Polynucleotide
taatacgactcactataggggcgctcgcggcctctgggtgcctggggcccaacagaggagagggcccatggcacccagaaacctggcggcagcgcaaaagatg

SEQ ID NO: 88488 - DNA, 103 bp, Artificial Sequence
  Synthetic Polynucleotide
taatacgactcactatagggcggcactgcgccgccgcagccgcccaggcgaacagaggagacgcctgatgggctgcggcaacctggcggcagcgcaaaagatg

SEQ ID NO: 88489 - DNA, 103 bp, Artificial Sequence
  Synthetic Polynucleotide
taatacgactcactataggggtccccatagcggcactgcgccgccgcagcaacagaggagagctgcgatggcgcagtgcaacctggcggcagcgcaaaagatg

SEQ ID NO: 88490 - DNA, 103 bp, Artificial Sequence
  Synthetic Polynucleotide
taatacgactcactatagggggctcgccaggtccccatagcggcactgcgaacagaggagacgcagtatggctatggggaacctggcggcagcgcaaaagatg

SEQ ID NO: 88491 - DNA, 103 bp, Artificial Sequence
  Synthetic Polynucleotide
taatacgactcactataggggcgccatgcaggctcgccaggtccccatagaacagaggagactatggatgcctggcgagaacctggcggcagcgcaaaagatg

SEQ ID NO: 88492 - DNA, 103 bp, Artificial Sequence
  Synthetic Polynucleotide
taatacgactcactatagggcgctgcacccgcgccatgcaggctcgccagaacagaggagactggcgatgctgcatggcaacctggcggcagcgcaaaagatg

SEQ ID NO: 88493 - DNA, 103 bp, Artificial Sequence
  Synthetic Polynucleotide
taatacgactcactatagggaaccgggtcccgctgcacccgcgccatgcaaacagaggagatgcatgatgcgggtgcagaacctggcggcagcgcaaaagatg

SEQ ID NO: 88494 - DNA, 103 bp, Artificial Sequence
  Synthetic Polynucleotide
taatacgactcactatagggggtgacccagaaccgggtcccgctgcacccaacagaggagagggtgcatggggacccggaacctggcggcagcgcaaaagatg

SEQ ID NO: 88495 - DNA, 103 bp, Artificial Sequence
  Synthetic Polynucleotide
taatacgactcactatagggggcggctgagggtgacccagaaccgggtccaacagaggagaggacccatgtctgggtcaaacctggcggcagcgcaaaagatg

SEQ ID NO: 88496 - DNA, 103 bp, Artificial Sequence
  Synthetic Polynucleotide
taatacgactcactatagggatgaggaagcggcggctgagggtgacccagaacagaggagactgggtatgcctcagccgaacctggcggcagcgcaaaagatg

SEQ ID NO: 88497 - DNA, 103 bp, Artificial Sequence
  Synthetic Polynucleotide
taatacgactcactataggggtgtgccaggatgaggaagcggcggctgagaacagaggagactcagcatgcgcttcctcaacctggcggcagcgcaaaagatg

SEQ ID NO: 88498 - DNA, 103 bp, Artificial Sequence
  Synthetic Polynucleotide
taatacgactcactataggggggaggtgctgcgctcgcggcctctgggtgaacagaggagacacccaatggccgcgagcaacctggcggcagcgcaaaagatg

SEQ ID NO: 88499 - DNA, 103 bp, Artificial Sequence
  Synthetic Polynucleotide
taatacgactcactatagggtgtgaagagagtgtgccaggatgaggaagcaacagaggagagcttccatgtcctggcacaacctggcggcagcgcaaaagatg

SEQ ID NO: 88500 - DNA, 103 bp, Artificial Sequence
  Synthetic Polynucleotide
taatacgactcactatagggcttcttcggctgtgaagagagtgtgccaggaacagaggagacctggcatgctctcttcaaacctggcggcagcgcaaaagatg

SEQ ID NO: 88501 - DNA, 103 bp, Artificial Sequence
  Synthetic Polynucleotide
taatacgactcactatagggtacaactggccttcttcggctgtgaagagaaacagaggagatctcttatgagccgaagaaacctggcggcagcgcaaaagatg

SEQ ID NO: 88502 - DNA, 103 bp, Artificial Sequence
  Synthetic Polynucleotide
taatacgactcactatagggacacggtccatacaactggccttcttcggcaacagaggagagccgaaatgggccagttgaacctggcggcagcgcaaaagatg

SEQ ID NO: 88503 - DNA, 103 bp, Artificial Sequence
  Synthetic Polynucleotide
taatacgactcactatagggcaccaccaccacacggtccatacaactggcaacagaggagagccagtatgatggaccgtaacctggcggcagcgcaaaagatg

SEQ ID NO: 88504 - DNA, 103 bp, Artificial Sequence
  Synthetic Polynucleotide
taatacgactcactatagggccaccacccccaccaccaccacacggtccaaacagaggagatggaccatgtggtggtggaacctggcggcagcgcaaaagatg

SEQ ID NO: 88505 - DNA, 103 bp, Artificial Sequence
  Synthetic Polynucleotide
taatacgactcactataggggccgccgccgccaccacccccaccaccaccaacagaggagaggtggtatggggggtggtaacctggcggcagcgcaaaagatg

SEQ ID NO: 88506 - DNA, 103 bp, Artificial Sequence
  Synthetic Polynucleotide
taatacgactcactatagggcgccgccgccgccgccgccgccaccaccccaacagaggagaggggtgatggcggcggcgaacctggcggcagcgcaaaagatg

SEQ ID NO: 88507 - DNA, 103 bp, Artificial Sequence
  Synthetic Polynucleotide
taatacgactcactatagggccgccgccgccgccgccgccgccgccgccgaacagaggagacggcggatgcggcggcggaacctggcggcagcgcaaaagatg

SEQ ID NO: 88508 - DNA, 103 bp, Artificial Sequence
  Synthetic Polynucleotide
taatacgactcactataggggccgccgccgccgccgccgccgccgccgccaacagaggagaggcggcatgggcggcggcaacctggcggcagcgcaaaagatg

SEQ ID NO: 88509 - DNA, 103 bp, Artificial Sequence
  Synthetic Polynucleotide
taatacgactcactatagggaactggcgccgggaggtgctgcgctcgcggaacagaggagaccgcgaatgcagcacctcaacctggcggcagcgcaaaagatg

SEQ ID NO: 88510 - DNA, 103 bp, Artificial Sequence
  Synthetic Polynucleotide
taatacgactcactatagggcgccgccgccgccgccgccgccgccgccgcaacagaggagagcggcgatggcggcggcgaacctggcggcagcgcaaaagatg

SEQ ID NO: 88511 - DNA, 103 bp, Artificial Sequence
  Synthetic Polynucleotide
taatacgactcactataggggctcccgcctcgccgccgccgccgccgccgaacagaggagacggcggatgcggcggcggaacctggcggcagcgcaaaagatg

SEQ ID NO: 88512 - DNA, 103 bp, Artificial Sequence
  Synthetic Polynucleotide
taatacgactcactataggggggggctacagctcccgcctcgccgccgccaacagaggagaggcggcatggaggcgggaaacctggcggcagcgcaaaagatg

SEQ ID NO: 88513 - DNA, 103 bp, Artificial Sequence
  Synthetic Polynucleotide
taatacgactcactatagggtgtagccgtagggggctacagctcccgcctaacagaggagaaggcggatgctgtagcccaacctggcggcagcgcaaaagatg

SEQ ID NO: 88514 - DNA, 103 bp, Artificial Sequence
  Synthetic Polynucleotide
taatacgactcactataggggggggccgagtgtagccgtagggggctacaaacagaggagatgtagcatgctacggctaaacctggcggcagcgcaaaagatg

SEQ ID NO: 88515 - DNA, 103 bp, Artificial Sequence
  Synthetic Polynucleotide
taatacgactcactatagggcagcccctgagggggccgagtgtagccgtaaacagaggagatacggcatgactcggcccaacctggcggcagcgcaaaagatg

SEQ ID NO: 88516 - DNA, 103 bp, Artificial Sequence
  Synthetic Polynucleotide
taatacgactcactatagggcctggcccgccagcccctgagggggccgagaacagaggagactcggcatgctcaggggcaacctggcggcagcgcaaaagatg

SEQ ID NO: 88517 - DNA, 103 bp, Artificial Sequence
  Synthetic Polynucleotide
taatacgactcactatagggaagtcgctttcctggcccgccagcccctgaaacagaggagatcagggatgggcgggccaaacctggcggcagcgcaaaagatg

SEQ ID NO: 88518 - DNA, 103 bp, Artificial Sequence
  Synthetic Polynucleotide
taatacgactcactatagggaggtgcggtgaagtcgctttcctggcccgcaacagaggagagcgggcatggaaagcgacaacctggcggcagcgcaaaagatg

SEQ ID NO: 88519 - DNA, 103 bp, Artificial Sequence
  Synthetic Polynucleotide
taatacgactcactatagggaccacacatcaggtgcggtgaagtcgctttaacagaggagaaaagcgatgtcaccgcacaacctggcggcagcgcaaaagatg

SEQ ID NO: 88520 - DNA, 103 bp, Artificial Sequence
  Synthetic Polynucleotide
taatacgactcactatagggagcagcagcaaactggcgccgggaggtgctaacagaggagaagcaccatgcggcgccagaacctggcggcagcgcaaaagatg

SEQ ID NO: 88521 - DNA, 103 bp, Artificial Sequence
  Synthetic Polynucleotide
taatacgactcactatagggccgccagggtaccacacatcaggtgcggtgaacagaggagacaccgcatgtgatgtgtgaacctggcggcagcgcaaaagatg

SEQ ID NO: 88522 - DNA, 103 bp, Artificial Sequence
  Synthetic Polynucleotide
taatacgactcactataggggctcaccatgccgccagggtaccacacatcaacagaggagagatgtgatgtaccctggcaacctggcggcagcgcaaaagatg

SEQ ID NO: 88523 - DNA, 103 bp, Artificial Sequence
  Synthetic Polynucleotide
taatacgactcactatagggagggcactctgctcaccatgccgccagggtaacagaggagaaccctgatggcatggtgaaacctggcggcagcgcaaaagatg

SEQ ID NO: 88524 - DNA, 103 bp, Artificial Sequence
  Synthetic Polynucleotide
taatacgactcactatagggggactgggatagggcactctgctcaccatgaacagaggagacatggtatgcagagtgccaacctggcggcagcgcaaaagatg

SEQ ID NO: 88525 - DNA, 103 bp, Artificial Sequence
  Synthetic Polynucleotide
taatacgactcactataggggacacaagtgggactgggatagggcactctaacagaggagaagagtgatgtatcccagtaacctggcggcagcgcaaaagatg

SEQ ID NO: 88526 - DNA, 103 bp, Artificial Sequence
  Synthetic Polynucleotide
taatacgactcactatagggtttcgcttttgacacaagtgggactgggataacagaggagaatcccaatgccacttgtgaacctggcggcagcgcaaaagatg

SEQ ID NO: 88527 - DNA, 103 bp, Artificial Sequence
  Synthetic Polynucleotide
taatacgactcactatagggcaggggcccatttcgcttttgacacaagtgaacagaggagacacttgatgcaaaagcgaaacctggcggcagcgcaaaagatg

SEQ ID NO: 88528 - DNA, 103 bp, Artificial Sequence
  Synthetic Polynucleotide
taatacgactcactataggggctatccatccaggggcccatttcgcttttaacagaggagaaaaagcatgatgggccccaacctggcggcagcgcaaaagatg

SEQ ID NO: 88529 - DNA, 103 bp, Artificial Sequence
  Synthetic Polynucleotide
taatacgactcactataggggtccggagtagctatccatccaggggcccaaacagaggagatgggccatgggatggataaacctggcggcagcgcaaaagatg

SEQ ID NO: 88530 - DNA, 103 bp, Artificial Sequence
  Synthetic Polynucleotide
taatacgactcactatagggtccccgtaaggtccggagtagctatccatcaacagaggagagatggaatgctactccggaacctggcggcagcgcaaaagatg

SEQ ID NO: 88531 - DNA, 103 bp, Artificial Sequence
  Synthetic Polynucleotide
taatacgactcactatagggctgctgctgcagcagcagcaaactggcgccaacagaggagaggcgccatgttgctgctgaacctggcggcagcgcaaaagatg

SEQ ID NO: 88532 - DNA, 103 bp, Artificial Sequence
  Synthetic Polynucleotide
taatacgactcactatagggcaaacgcatgtccccgtaaggtccggagtaaacagaggagatactccatgccttacgggaacctggcggcagcgcaaaagatg

SEQ ID NO: 88533 - DNA, 103 bp, Artificial Sequence
  Synthetic Polynucleotide
taatacgactcactatagggtggcagtctccaaacgcatgtccccgtaagaacagaggagacttacgatgacatgcgttaacctggcggcagcgcaaaagatg

SEQ ID NO: 88534 - DNA, 103 bp, Artificial Sequence
  Synthetic Polynucleotide
taatacgactcactatagggacatggtccctggcagtctccaaacgcatgaacagaggagacatgcgatgggagactgcaacctggcggcagcgcaaaagatg

SEQ ID NO: 88535 - DNA, 103 bp, Artificial Sequence
  Synthetic Polynucleotide
taatacgactcactatagggaatgggcaaaacatggtccctggcagtctcaacagaggagagagactatgagggaccataacctggcggcagcgcaaaagatg

SEQ ID NO: 88536 - DNA, 103 bp, Artificial Sequence
  Synthetic Polynucleotide
taatacgactcactatagggagtaatagtcaatgggcaaaacatggtcccaacagaggagagggaccatgttttgcccaaacctggcggcagcgcaaaagatg

SEQ ID NO: 88537 - DNA, 103 bp, Artificial Sequence
  Synthetic Polynucleotide
taatacgactcactatagggtggggtggaaagtaatagtcaatgggcaaaaacagaggagatttgccatgtgactattaaacctggcggcagcgcaaaagatg

SEQ ID NO: 88538 - DNA, 103 bp, Artificial Sequence
  Synthetic Polynucleotide
taatacgactcactataggggcaggtcttctggggtggaaagtaatagtcaacagaggagagactatatgtttccacccaacctggcggcagcgcaaaagatg

SEQ ID NO: 88539 - DNA, 103 bp, Artificial Sequence
  Synthetic Polynucleotide
taatacgactcactatagggcacagatcaggcaggtcttctggggtggaaaacagaggagattccacatgagaagacctaacctggcggcagcgcaaaagatg

SEQ ID NO: 88540 - DNA, 103 bp, Artificial Sequence
  Synthetic Polynucleotide
taatacgactcactataggggcttcatctccacagatcaggcaggtcttcaacagaggagagaagacatgcctgatctgaacctggcggcagcgcaaaagatg

SEQ ID NO: 88541 - DNA, 103 bp, Artificial Sequence
  Synthetic Polynucleotide
taatacgactcactatagggacacccagaagcttcatctccacagatcagaacagaggagactgatcatgggagatgaaaacctggcggcagcgcaaaagatg

SEQ ID NO: 88542 - DNA, 103 bp, Artificial Sequence
  Synthetic Polynucleotide
taatacgactcactataggggctgctgctgctgctgctgcagcagcagcaaacagaggagatgctgcatgtgcagcagcaacctggcggcagcgcaaaagatg

SEQ ID NO: 88543 - DNA, 103 bp, Artificial Sequence
  Synthetic Polynucleotide
taatacgactcactatagggctccatagtgacacccagaagcttcatctcaacagaggagagagatgatgcttctgggtaacctggcggcagcgcaaaagatg

SEQ ID NO: 88544 - DNA, 103 bp, Artificial Sequence
  Synthetic Polynucleotide
taatacgactcactatagggcatgtgagagctccatagtgacacccagaaaacagaggagattctggatgtcactatggaacctggcggcagcgcaaaagatg

SEQ ID NO: 88545 - DNA, 103 bp, Artificial Sequence
  Synthetic Polynucleotide
taatacgactcactataggggcagcttccacatgtgagagctccatagtgaacagaggagacactatatggctctcacaaacctggcggcagcgcaaaagatg

SEQ ID NO: 88546 - DNA, 103 bp, Artificial Sequence
  Synthetic Polynucleotide
taatacgactcactatagggagaagaccttgcagcttccacatgtgagagaacagaggagactctcaatggtggaagctaacctggcggcagcgcaaaagatg

SEQ ID NO: 88547 - DNA, 103 bp, Artificial Sequence
  Synthetic Polynucleotide
taatacgactcactataggggctcttttgaagaagaccttgcagcttccaaacagaggagatggaagatgcaaggtcttaacctggcggcagcgcaaaagatg

SEQ ID NO: 88548 - DNA, 103 bp, Artificial Sequence
  Synthetic Polynucleotide
taatacgactcactatagggcccttcagcggctcttttgaagaagaccttaacagaggagaaaggtcatgttcaaaagaaacctggcggcagcgcaaaagatg

SEQ ID NO: 88549 - DNA, 103 bp, Artificial Sequence
  Synthetic Polynucleotide
taatacgactcactatagggacttctgtttcccttcagcggctcttttgaaacagaggagatcaaaaatgccgctgaagaacctggcggcagcgcaaaagatg

SEQ ID NO: 88550 - DNA, 103 bp, Artificial Sequence
  Synthetic Polynucleotide
taatacgactcactataggggcgcacaggtacttctgtttcccttcagcgaacagaggagacgctgaatggaaacagaaaacctggcggcagcgcaaaagatg

SEQ ID NO: 88551 - DNA, 103 bp, Artificial Sequence
  Synthetic Polynucleotide
taatacgactcactatagggatttctgctggcgcacaggtacttctgtttaacagaggagaaaacagatgtacctgtgcaacctggcggcagcgcaaaagatg

SEQ ID NO: 88552 - DNA, 103 bp, Artificial Sequence
  Synthetic Polynucleotide
taatacgactcactatagggtagtgcaatcatttctgctggcgcacaggtaacagaggagaacctgtatgccagcagaaaacctggcggcagcgcaaaagatg

SEQ ID NO: 88553 - DNA, 103 bp, Artificial Sequence
  Synthetic Polynucleotide
taatacgactcactatagggtgctgctgctgctgctgctgctgctgctgcaacagaggagagcagcaatggcagcagcaaacctggcggcagcgcaaaagatg

SEQ ID NO: 88554 - DNA, 103 bp, Artificial Sequence
  Synthetic Polynucleotide
taatacgactcactatagggaatttatcaatagtgcaatcatttctgctgaacagaggagacagcagatgtgattgcacaacctggcggcagcgcaaaagatg

SEQ ID NO: 88555 - DNA, 103 bp, Artificial Sequence
  Synthetic Polynucleotide
taatacgactcactatagggtttccttcggaatttatcaatagtgcaatcaacagaggagagattgcatgattgataaaaacctggcggcagcgcaaaagatg

SEQ ID NO: 88556 - DNA, 103 bp, Artificial Sequence
  Synthetic Polynucleotide
taatacgactcactatagggatggacaatttttccttcggaatttatcaaaacagaggagattgataatgtccgaaggaaacctggcggcagcgcaaaagatg

SEQ ID NO: 88557 - DNA, 103 bp, Artificial Sequence
  Synthetic Polynucleotide
taatacgactcactatagggagacgacaagatggacaatttttccttcggaacagaggagaccgaagatgaaattgtccaacctggcggcagcgcaaaagatg

SEQ ID NO: 88558 - DNA, 103 bp, Artificial Sequence
  Synthetic Polynucleotide
taatacgactcactatagggacatttccgaagacgacaagatggacaattaacagaggagaaattgtatgtcttgtcgtaacctggcggcagcgcaaaagatg

SEQ ID NO: 88559 - DNA, 103 bp, Artificial Sequence
  Synthetic Polynucleotide
taatacgactcactatagggctgcttcataacatttccgaagacgacaagaacagaggagacttgtcatgttcggaaataacctggcggcagcgcaaaagatg

SEQ ID NO: 88560 - DNA, 103 bp, Artificial Sequence
  Synthetic Polynucleotide
taatacgactcactatagggagagtcatccctgcttcataacatttccgaaacagaggagatcggaaatgttatgaagcaacctggcggcagcgcaaaagatg

SEQ ID NO: 88561 - DNA, 103 bp, Artificial Sequence
  Synthetic Polynucleotide
taatacgactcactatagggccgggctcccagagtcatccctgcttcataaacagaggagatatgaaatggggatgactaacctggcggcagcgcaaaagatg

SEQ ID NO: 88562 - DNA, 103 bp, Artificial Sequence
  Synthetic Polynucleotide
taatacgactcactatagggtcttcagcttccgggctcccagagtcatccaacagaggagaggatgaatgtgggagcccaacctggcggcagcgcaaaagatg

SEQ ID NO: 88563 - DNA, 103 bp, Artificial Sequence
  Synthetic Polynucleotide
taatacgactcactatagggttaccaagtttcttcagcttccgggctcccaacagaggagagggagcatggaagctgaaaacctggcggcagcgcaaaagatg

SEQ ID NO: 88564 - DNA, 103 bp, Artificial Sequence
  Synthetic Polynucleotide
taatacgactcactatagggctgctgctgctgctgctgctgctgctgctgaacagaggagacagcagatgcagcagcagaacctggcggcagcgcaaaagatg

SEQ ID NO: 88565 - DNA, 103 bp, Artificial Sequence
  Synthetic Polynucleotide
taatacgactcactatagggtagtttcagattaccaagtttcttcagcttaacagaggagaaagctgatgaaacttggtaacctggcggcagcgcaaaagatg

SEQ ID NO: 88566 - DNA, 103 bp, Artificial Sequence
  Synthetic Polynucleotide
taatacgactcactatagggcttcctcctgtagtttcagattaccaagttaacagaggagaaacttgatgatctgaaacaacctggcggcagcgcaaaagatg

SEQ ID NO: 88567 - DNA, 103 bp, Artificial Sequence
  Synthetic Polynucleotide
taatacgactcactataggggaagcctctccttcctcctgtagtttcagaaacagaggagatctgaaatgacaggaggaaacctggcggcagcgcaaaagatg

SEQ ID NO: 88568 - DNA, 103 bp, Artificial Sequence
  Synthetic Polynucleotide
taatacgactcactatagggggtggtgctggaagcctctccttcctcctgaacagaggagacaggagatgggagaggctaacctggcggcagcgcaaaagatg

SEQ ID NO: 88569 - DNA, 103 bp, Artificial Sequence
  Synthetic Polynucleotide
taatacgactcactatagggcagtggggctggtggtgctggaagcctctcaacagaggagagagaggatgccagcaccaaacctggcggcagcgcaaaagatg

SEQ ID NO: 88570 - DNA, 103 bp, Artificial Sequence
  Synthetic Polynucleotide
taatacgactcactataggggttgtctcctcagtggggctggtggtgctgaacagaggagacagcacatgcagccccacaacctggcggcagcgcaaaagatg

SEQ ID NO: 88571 - DNA, 103 bp, Artificial Sequence
  Synthetic Polynucleotide
taatacgactcactatagggcagcttctgggttgtctcctcagtggggctaacagaggagaagccccatggaggagacaaacctggcggcagcgcaaaagatg

SEQ ID NO: 88572 - DNA, 103 bp, Artificial Sequence
  Synthetic Polynucleotide
taatacgactcactataggggtgacactgtcagcttctgggttgtctcctaacagaggagaaggagaatgcccagaagcaacctggcggcagcgcaaaagatg

SEQ ID NO: 88573 - DNA, 103 bp, Artificial Sequence
  Synthetic Polynucleotide
taatacgactcactatagggccttcaatgtgtgacactgtcagcttctggaacagaggagaccagaaatggacagtgtcaacctggcggcagcgcaaaagatg

SEQ ID NO: 88574 - DNA, 103 bp, Artificial Sequence
  Synthetic Polynucleotide
taatacgactcactatagggacattcatagccttcaatgtgtgacactgtaacagaggagaacagtgatgcacattgaaaacctggcggcagcgcaaaagatg

SEQ ID NO: 88575 - DNA, 103 bp, Artificial Sequence
  Synthetic Polynucleotide
taatacgactcactataggggccgagggtagacccttcccagccctaactaacagaggagaagttagatgtgggaagggaacctggcggcagcgcaaaagatg

SEQ ID NO: 88576 - DNA, 103 bp, Artificial Sequence
  Synthetic Polynucleotide
taatacgactcactataggggctgctgctgctgctgctgctgctgctgctaacagaggagaagcagcatgagcagcagcaacctggcggcagcgcaaaagatg

SEQ ID NO: 88577 - DNA, 103 bp, Artificial Sequence
  Synthetic Polynucleotide
taatacgactcactatagggagatgggctgacattcatagccttcaatgtaacagaggagaacattgatggctatgaataacctggcggcagcgcaaaagatg

SEQ ID NO: 88578 - DNA, 103 bp, Artificial Sequence
  Synthetic Polynucleotide
taatacgactcactatagggacattcagaaagatgggctgacattcatagaacagaggagactatgaatgtcagcccataacctggcggcagcgcaaaagatg

SEQ ID NO: 88579 - DNA, 103 bp, Artificial Sequence
  Synthetic Polynucleotide
taatacgactcactatagggggcttccaggacattcagaaagatgggctgaacagaggagacagcccatgtttctgaataacctggcggcagcgcaaaagatg

SEQ ID NO: 88580 - DNA, 103 bp, Artificial Sequence
  Synthetic Polynucleotide
taatacgactcactatagggctggctcaatggcttccaggacattcagaaaacagaggagattctgaatgtcctggaagaacctggcggcagcgcaaaagatg

SEQ ID NO: 88581 - DNA, 103 bp, Artificial Sequence
  Synthetic Polynucleotide
taatacgactcactatagggcacactacacctggctcaatggcttccaggaacagaggagacctggaatgcattgagccaacctggcggcagcgcaaaagatg

SEQ ID NO: 88582 - DNA, 103 bp, Artificial Sequence
  Synthetic Polynucleotide
taatacgactcactataggggtgtccagcacacactacacctggctcaataacagaggagaattgagatgggtgtagtgaacctggcggcagcgcaaaagatg

SEQ ID NO: 88583 - DNA, 103 bp, Artificial Sequence
  Synthetic Polynucleotide
taatacgactcactatagggggttgttgtcgtgtccagcacacactacacaacagaggagagtgtagatggtgctggacaacctggcggcagcgcaaaagatg

SEQ ID NO: 88584 - DNA, 103 bp, Artificial Sequence
  Synthetic Polynucleotide
taatacgactcactataggggagtcgggctggttgttgtcgtgtccagcaaacagaggagatgctggatgcgacaacaaaacctggcggcagcgcaaaagatg

SEQ ID NO: 88585 - DNA, 103 bp, Artificial Sequence
  Synthetic Polynucleotide
taatacgactcactatagggggctgcaaaggagtcgggctggttgttgtcaacagaggagagacaacatgcagcccgacaacctggcggcagcgcaaaagatg

SEQ ID NO: 88586 - DNA, 103 bp, Artificial Sequence
  Synthetic Polynucleotide
taatacgactcactatagggtagagagcaaggctgcaaaggagtcgggctaacagaggagaagcccgatgcctttgcagaacctggcggcagcgcaaaagatg

SEQ ID NO: 88587 - DNA, 103 bp, Artificial Sequence; identical to SEQ ID NO: 88553
  Synthetic Polynucleotide

SEQ ID NO: 88588 - DNA, 103 bp, Artificial Sequence
  Synthetic Polynucleotide
taatacgactcactatagggtcattgaggctagagagcaaggctgcaaagaacagaggagactttgcatgcttgctctcaacctggcggcagcgcaaaagatg

SEQ ID NO: 88589 - DNA, 103 bp, Artificial Sequence
  Synthetic Polynucleotide
taatacgactcactatagggctctcccagttcattgaggctagagagcaaaacagaggagattgctcatgagcctcaataacctggcggcagcgcaaaagatg

SEQ ID NO: 88590 - DNA, 103 bp, Artificial Sequence
  Synthetic Polynucleotide
taatacgactcactatagggcaagctgtctctctcccagttcattgaggcaacagaggagagcctcaatgaactgggagaacctggcggcagcgcaaaagatg

SEQ ID NO: 88591 - DNA, 103 bp, Artificial Sequence
  Synthetic Polynucleotide
taatacgactcactatagggaccacgtgtacaagctgtctctctcccagtaacagaggagaactgggatggagacagctaacctggcggcagcgcaaaagatg

SEQ ID NO: 88592 - DNA, 103 bp, Artificial Sequence
  Synthetic Polynucleotide
taatacgactcactatagggggcccacttgaccacgtgtacaagctgtctaacagaggagaagacagatggtacacgtgaacctggcggcagcgcaaaagatg

SEQ ID NO: 88593 - DNA, 103 bp, Artificial Sequence
  Synthetic Polynucleotide
taatacgactcactataggggcaaggccttggcccacttgaccacgtgtaaacagaggagatacacgatgtcaagtgggaacctggcggcagcgcaaaagatg

SEQ ID NO: 88594 - DNA, 103 bp, Artificial Sequence
  Synthetic Polynucleotide
taatacgactcactatagggcggaagccaggcaaggccttggcccacttgaacagaggagacaagtgatgcaaggccttaacctggcggcagcgcaaaagatg

SEQ ID NO: 88595 - DNA, 103 bp, Artificial Sequence
  Synthetic Polynucleotide
taatacgactcactataggggtgtaagttgcggaagccaggcaaggccttaacagaggagaaaggccatgcctggcttcaacctggcggcagcgcaaaagatg

SEQ ID NO: 88596 - DNA, 103 bp, Artificial Sequence
  Synthetic Polynucleotide
taatacgactcactatagggggtcgtccacgtgtaagttgcggaagccagaacagaggagactggctatggcaacttacaacctggcggcagcgcaaaagatg

SEQ ID NO: 88597 - DNA, 103 bp, Artificial Sequence
  Synthetic Polynucleotide
taatacgactcactatagggacagccatctggtcgtccacgtgtaagttgaacagaggagacaacttatgcgtggacgaaacctggcggcagcgcaaaagatg

SEQ ID NO: 88598 - DNA, 103 bp, Artificial Sequence
  Synthetic Polynucleotide
taatacgactcactatagggttgctgctgctgctgctgctgctgctgctgaacagaggagacagcagatgcagcagcagaacctggcggcagcgcaaaagatg

SEQ ID NO: 88599 - DNA, 103 bp, Artificial Sequence
  Synthetic Polynucleotide
taatacgactcactataggggtactgaatgacagccatctggtcgtccacaacagaggagagtggacatgcagatggctaacctggcggcagcgcaaaagatg

SEQ ID NO: 88600 - DNA, 103 bp, Artificial Sequence
  Synthetic Polynucleotide
taatacgactcactatagggccatccaggagtactgaatgacagccatctaacagaggagaagatggatgtcattcagtaacctggcggcagcgcaaaagatg

SEQ ID NO: 88601 - DNA, 103 bp, Artificial Sequence
  Synthetic Polynucleotide
taatacgactcactatagggaccatgagccccatccaggagtactgaatgaacagaggagacattcaatgctcctggataacctggcggcagcgcaaaagatg

SEQ ID NO: 88602 - DNA, 103 bp, Artificial Sequence
  Synthetic Polynucleotide
taatacgactcactatagggcatggcaaacaccatgagccccatccaggaaacagaggagatcctggatggggctcatgaacctggcggcagcgcaaaagatg

SEQ ID NO: 88603 - DNA, 103 bp, Artificial Sequence
  Synthetic Polynucleotide
taatacgactcactatagggatcgccagcccatggcaaacaccatgagccaacagaggagaggctcaatgtgtttgccaaacctggcggcagcgcaaaagatg

SEQ ID NO: 88604 - DNA, 103 bp, Artificial Sequence
  Synthetic Polynucleotide
taatacgactcactatagggttggtgaaggatcgccagcccatggcaaacaacagaggagagtttgcatggggctggcgaacctggcggcagcgcaaaagatg

SEQ ID NO: 88605 - DNA, 103 bp, Artificial Sequence
  Synthetic Polynucleotide
taatacgactcactatagggggagttgacattggtgaaggatcgccagccaacagaggagaggctggatgtccttcaccaacctggcggcagcgcaaaagatg

SEQ ID NO: 88606 - DNA, 103 bp, Artificial Sequence
  Synthetic Polynucleotide
taatacgactcactatagggagagcatcctggagttgacattggtgaaggaacagaggagaccttcaatgatgtcaactaacctggcggcagcgcaaaagatg

SEQ ID NO: 88607 - DNA, 103 bp, Artificial Sequence
  Synthetic Polynucleotide
taatacgactcactatagggggggcgaagtagagcatcctggagttgacaaacagaggagatgtcaaatgcaggatgctaacctggcggcagcgcaaaagatg

SEQ ID NO: 88608 - DNA, 103 bp, Artificial Sequence
  Synthetic Polynucleotide
taatacgactcactatagggaaccagatcaggggcgaagtagagcatcctaacagaggagaaggatgatgtacttcgccaacctggcggcagcgcaaaagatg

SEQ ID NO: 88609 - DNA, 103 bp, Artificial Sequence
  Synthetic Polynucleotide
taatacgactcactatagggggctagtctcttgctgctgctgctgctgctaacagaggagaagcagcatgagcagcagcaacctggcggcagcgcaaaagatg

SEQ ID NO: 88610 - DNA, 103 bp, Artificial Sequence
  Synthetic Polynucleotide
taatacgactcactatagggactcattgaaaaccagatcaggggcgaagtaacagaggagaacttcgatgctgatctggaacctggcggcagcgcaaaagatg

SEQ ID NO: 88611 - DNA, 103 bp, Artificial Sequence
  Synthetic Polynucleotide
taatacgactcactatagggtgcatgcggtactcattgaaaaccagatcaaacagaggagatgatctatgtttcaatgaaacctggcggcagcgcaaaagatg

SEQ ID NO: 88612 - DNA, 103 bp, Artificial Sequence
  Synthetic Polynucleotide
taatacgactcactatagggccgggacttgtgcatgcggtactcattgaaaacagaggagattcaatatgtaccgcatgaacctggcggcagcgcaaaagatg

SEQ ID NO: 88613 - DNA, 103 bp, Artificial Sequence
  Synthetic Polynucleotide
taatacgactcactatagggggctgtacatccgggacttgtgcatgcggtaacagaggagaaccgcaatgacaagtcccaacctggcggcagcgcaaaagatg

SEQ ID NO: 88614 - DNA, 103 bp, Artificial Sequence
  Synthetic Polynucleotide
taatacgactcactatagggcggacacactggctgtacatccgggacttgaacagaggagacaagtcatggatgtacagaacctggcggcagcgcaaaagatg

SEQ ID NO: 88615 - DNA, 103 bp, Artificial Sequence
  Synthetic Polynucleotide
taatacgactcactataggggtgcctcattcggacacactggctgtacataacagaggagaatgtacatgcagtgtgtcaacctggcggcagcgcaaaagatg

SEQ ID NO: 88616 - DNA, 103 bp, Artificial Sequence
  Synthetic Polynucleotide
taatacgactcactatagggcttgagagaggtgcctcattcggacacactaacagaggagaagtgtgatggaatgaggcaacctggcggcagcgcaaaagatg

SEQ ID NO: 88617 - DNA, 103 bp, Artificial Sequence
  Synthetic Polynucleotide
taatacgactcactatagggcatccaaactcttgagagaggtgcctcattaacagaggagaaatgagatgcctctctcaaacctggcggcagcgcaaaagatg

SEQ ID NO: 88618 - DNA, 103 bp, Artificial Sequence
  Synthetic Polynucleotide
taatacgactcactataggggatttggagccatccaaactcttgagagagaacagaggagactctctatggagtttggaaacctggcggcagcgcaaaagatg

SEQ ID NO: 88619 - DNA, 103 bp, Artificial Sequence
  Synthetic Polynucleotide
taatacgactcactatagggcctggggggtgatttggagccatccaaactaacagaggagaagtttgatgggctccaaaaacctggcggcagcgcaaaagatg

SEQ ID NO: 88620 - DNA, 103 bp, Artificial Sequence
  Synthetic Polynucleotide
taatacgactcactatagggtgctgcctggggctagtctcttgctgctgcaacagaggagagcagcaatgagagactagaacctggcggcagcgcaaaagatg

SEQ ID NO: 88621 - DNA, 103 bp, Artificial Sequence
  Synthetic Polynucleotide
taatacgactcactatagggcacaggaattcctggggggtgatttggagcaacagaggagagctccaatgcaccccccaaacctggcggcagcgcaaaagatg

SEQ ID NO: 88622 - DNA, 103 bp, Artificial Sequence
  Synthetic Polynucleotide
taatacgactcactatagggtgctttcatgcacaggaattcctggggggtaacagaggagaacccccatggaattcctgaacctggcggcagcgcaaaagatg

SEQ ID NO: 88623 - DNA, 103 bp, Artificial Sequence
  Synthetic Polynucleotide
taatacgactcactatagggagagtagcagtgctttcatgcacaggaattaacagaggagaaattccatggcatgaaagaacctggcggcagcgcaaaagatg

SEQ ID NO: 88624 - DNA, 103 bp, Artificial Sequence
  Synthetic Polynucleotide
taatacgactcactatagggataatgctgaagagtagcagtgctttcatgaacagaggagacatgaaatgactgctactaacctggcggcagcgcaaaagatg

SEQ ID NO: 88625 - DNA, 103 bp, Artificial Sequence
  Synthetic Polynucleotide
taatacgactcactatagggatccactggaataatgctgaagagtagcagaacagaggagactgctaatgttcagcattaacctggcggcagcgcaaaagatg

SEQ ID NO: 88626 - DNA, 103 bp, Artificial Sequence
  Synthetic Polynucleotide
taatacgactcactatagggttttcagcccatccactggaataatgctgaaacagaggagatcagcaatgttccagtggaacctggcggcagcgcaaaagatg

SEQ ID NO: 88627 - DNA, 103 bp, Artificial Sequence
  Synthetic Polynucleotide
taatacgactcactatagggaatttttgatttttcagcccatccactggaaacagaggagatccagtatgtgggctgaaaacctggcggcagcgcaaaagatg

SEQ ID NO: 88628 - DNA, 103 bp, Artificial Sequence
  Synthetic Polynucleotide
taatacgactcactatagggttcatcaaagaatttttgatttttcagcccaacagaggagagggctgatgaatcaaaaaaacctggcggcagcgcaaaagatg

SEQ ID NO: 88629 - DNA, 103 bp, Artificial Sequence
  Synthetic Polynucleotide
taatacgactcactatagggtcattcgaagttcatcaaagaatttttgataacagaggagaatcaaaatgtctttgatgaacctggcggcagcgcaaaagatg

SEQ ID NO: 88630 - DNA, 103 bp, Artificial Sequence
  Synthetic Polynucleotide
taatacgactcactatagggttgatgtagttcattcgaagttcatcaaagaacagaggagactttgaatgacttcgaataacctggcggcagcgcaaaagatg

SEQ ID NO: 88631 - DNA, 103 bp, Artificial Sequence
  Synthetic Polynucleotide
taatacgactcactatagggctgctgctgctgctgcctggggctagtctcaacagaggagagagactatgcccaggcagaacctggcggcagcgcaaaagatg

SEQ ID NO: 88632 - DNA, 103 bp, Artificial Sequence
  Synthetic Polynucleotide
taatacgactcactatagggatcgagttccttgatgtagttcattcgaagaacagaggagacttcgaatgaactacatcaacctggcggcagcgcaaaagatg

SEQ ID NO: 88633 - DNA, 103 bp, Artificial Sequence
  Synthetic Polynucleotide
taatacgactcactatagggcaatgatacgatcgagttccttgatgtagtaacagaggagaactacaatgaggaactcgaacctggcggcagcgcaaaagatg

SEQ ID NO: 88634 - DNA, 103 bp, Artificial Sequence
  Synthetic Polynucleotide
taatacgactcactatagggcttttgcatgcaatgatacgatcgagttccaacagaggagaggaactatgtcgtatcataacctggcggcagcgcaaaagatg

SEQ ID NO: 88635 - DNA, 103 bp, Artificial Sequence
  Synthetic Polynucleotide
taatacgactcactataggggggattttttcttttgcatgcaatgatacgaacagaggagacgtatcatggcatgcaaaaacctggcggcagcgcaaaagatg

SEQ ID NO: 88636 - DNA, 103 bp, Artificial Sequence
  Synthetic Polynucleotide
taatacgactcactatagggagcaggatgtgggattttttcttttgcatgaacagaggagacatgcaatggaaaaaatcaacctggcggcagcgcaaaagatg

SEQ ID NO: 88637 - DNA, 103 bp, Artificial Sequence
  Synthetic Polynucleotide
taatacgactcactatagggaagcgtcttgagcaggatgtgggattttttaacagaggagaaaaaaaatgcacatcctgaacctggcggcagcgcaaaagatg

SEQ ID NO: 88638 - DNA, 103 bp, Artificial Sequence
  Synthetic Polynucleotide
taatacgactcactataggggagctggtagaagcgtcttgagcaggatgtaacagaggagaacatccatgtcaagacgcaacctggcggcagcgcaaaagatg

SEQ ID NO: 88639 - DNA, 103 bp, Artificial Sequence
  Synthetic Polynucleotide
taatacgactcactatagggggagcttggtgagctggtagaagcgtcttgaacagaggagacaagacatgtctaccagcaacctggcggcagcgcaaaagatg

SEQ ID NO: 88640 - DNA, 103 bp, Artificial Sequence
  Synthetic Polynucleotide
taatacgactcactatagggacggagtccaggagcttggtgagctggtagaacagaggagactaccaatgcaccaagctaacctggcggcagcgcaaaagatg

SEQ ID NO: 88641 - DNA, 103 bp, Artificial Sequence
  Synthetic Polynucleotide
taatacgactcactatagggaataggctgcacggagtccaggagcttggtaacagaggagaaccaagatgctggactccaacctggcggcagcgcaaaagatg

SEQ ID NO: 88642 - DNA, 103 bp, Artificial Sequence
  Synthetic Polynucleotide
taatacgactcactatagggcctcaccctgctgctgctgctgctgcctggaacagaggagaccaggcatgagcagcagcaacctggcggcagcgcaaaagatg

SEQ ID NO: 88643 - DNA, 103 bp, Artificial Sequence
  Synthetic Polynucleotide
taatacgactcactataggggctctctcgcaataggctgcacggagtccaaacagaggagatggactatgtgcagcctaaacctggcggcagcgcaaaagatg

SEQ ID NO: 88644 - DNA, 103 bp, Artificial Sequence
  Synthetic Polynucleotide
taatacgactcactatagggaactgatgcagctctctcgcaataggctgcaacagaggagagcagccatgtgcgagagaaacctggcggcagcgcaaaagatg

SEQ ID NO: 88645 - DNA, 103 bp, Artificial Sequence
  Synthetic Polynucleotide
taatacgactcactataggggtcaaaagtgaactgatgcagctctctcgcaacagaggagagcgagaatgctgcatcagaacctggcggcagcgcaaaagatg

SEQ ID NO: 88646 - DNA, 103 bp, Artificial Sequence
  Synthetic Polynucleotide
taatacgactcactatagggtgattagcaggtcaaaagtgaactgatgcaaacagaggagatgcatcatgtcacttttgaacctggcggcagcgcaaaagatg

SEQ ID NO: 88647 - DNA, 103 bp, Artificial Sequence
  Synthetic Polynucleotide
taatacgactcactatagggatgtgtgacttgattagcaggtcaaaagtgaacagaggagacactttatgcctgctaataacctggcggcagcgcaaaagatg

SEQ ID NO: 88648 - DNA, 103 bp, Artificial Sequence
  Synthetic Polynucleotide
taatacgactcactatagggcacgctcaccatgtgtgacttgattagcagaacagaggagactgctaatgaagtcacacaacctggcggcagcgcaaaagatg

SEQ ID NO: 88649 - DNA, 103 bp, Artificial Sequence
  Synthetic Polynucleotide
taatacgactcactatagggccggaaagtccacgctcaccatgtgtgactaacagaggagaagtcacatgtggtgagcgaacctggcggcagcgcaaaagatg

SEQ ID NO: 88650 - DNA, 103 bp, Artificial Sequence
  Synthetic Polynucleotide
taatacgactcactataggggccatcatttccggaaagtccacgctcaccaacagaggagaggtgagatgggactttccaacctggcggcagcgcaaaagatg

SEQ ID NO: 88651 - DNA, 103 bp, Artificial Sequence
  Synthetic Polynucleotide
taatacgactcactataggggatgatctctgccatcatttccggaaagtcaacagaggagagactttatggaaatgatgaacctggcggcagcgcaaaagatg

SEQ ID NO: 88652 - DNA, 103 bp, Artificial Sequence
  Synthetic Polynucleotide
taatacgactcactatagggcttgcacagagatgatctctgccatcatttaacagaggagaaaatgaatgcagagatcaaacctggcggcagcgcaaaagatg

SEQ ID NO: 88653 - DNA, 103 bp, Artificial Sequence
  Synthetic Polynucleotide
taatacgactcactatagggggagaaccatcctcaccctgctgctgctgcaacagaggagagcagcaatggcagggtgaaacctggcggcagcgcaaaagatg

SEQ ID NO: 88654 - DNA, 103 bp, Artificial Sequence
  Synthetic Polynucleotide
taatacgactcactatagggatcttgggcacttgcacagagatgatctctaacagaggagaagagatatgctctgtgcaaacctggcggcagcgcaaaagatg

SEQ ID NO: 88655 - DNA, 103 bp, Artificial Sequence
  Synthetic Polynucleotide
taatacgactcactatagggcccagaaaggatcttgggcacttgcacagaaacagaggagatctgtgatggtgcccaagaacctggcggcagcgcaaaagatg

SEQ ID NO: 88656 - DNA, 103 bp, Artificial Sequence
  Synthetic Polynucleotide
taatacgactcactataggggcttgactttcccagaaaggatcttgggcaaacagaggagatgcccaatgtcctttctgaacctggcggcagcgcaaaagatg

SEQ ID NO: 88657 - DNA, 103 bp, Artificial Sequence
  Synthetic Polynucleotide
taatacgactcactatagggaaatagatgggcttgactttcccagaaaggaacagaggagacctttcatggaaagtcaaaacctggcggcagcgcaaaagatg

SEQ ID NO: 88658 - DNA, 103 bp, Artificial Sequence
  Synthetic Polynucleotide
taatacgactcactatagggctgggtgtggaaatagatgggcttgactttaacagaggagaaaagtcatgcccatctataacctggcggcagcgcaaaagatg

SEQ ID NO: 88659 - DNA, 103 bp, Artificial Sequence
  Synthetic Polynucleotide
taatacgactcactatagggatgggcttggggagaaccatcctcaccctgaacagaggagacagggtatggatggttctaacctggcggcagcgcaaaagatg

SEQ ID NO: 88660 - DNA, 103 bp, Artificial Sequence
  Synthetic Polynucleotide
taatacgactcactatagggggcctctacgatgggcttggggagaaccataacagaggagaatggttatgcccaagcccaacctggcggcagcgcaaaagatg

SEQ ID NO: 88661 - DNA, 103 bp, Artificial Sequence
  Synthetic Polynucleotide
taatacgactcactatagggttggacggcggccgagggtagacccttcccaacagaggagagggaagatgctaccctcgaacctggcggcagcgcaaaagatg

SEQ ID NO: 88662 - DNA, 103 bp, Artificial Sequence
  Synthetic Polynucleotide
taatacgactcactatagggtagcctgtggggcctctacgatgggcttggaacagaggagaccaagcatgtcgtagaggaacctggcggcagcgcaaaagatg

SEQ ID NO: 88663 - DNA, 103 bp, Artificial Sequence
  Synthetic Polynucleotide
taatacgactcactatagggcaggaccaggtagcctgtggggcctctacgaacagaggagacgtagaatgcccacaggcaacctggcggcagcgcaaaagatg

SEQ ID NO: 88664 - DNA, 103 bp, Artificial Sequence
  Synthetic Polynucleotide
taatacgactcactataggggttcctcatccaggaccaggtagcctgtggaacagaggagaccacagatgacctggtccaacctggcggcagcgcaaaagatg

SEQ ID NO: 88665 - DNA, 103 bp, Artificial Sequence
  Synthetic Polynucleotide
taatacgactcactataggggaaggttgctgttcctcatccaggaccaggaacagaggagacctggtatgggatgaggaaacctggcggcagcgcaaaagatg

SEQ ID NO: 88666 - DNA, 103 bp, Artificial Sequence
  Synthetic Polynucleotide
taatacgactcactatagggctgcggctgtgaaggttgctgttcctcatcaacagaggagagatgagatgcagcaacctaacctggcggcagcgcaaaagatg

SEQ ID NO: 88667 - DNA, 103 bp, Artificial Sequence
  Synthetic Polynucleotide
taatacgactcactatagggccagggccgactgcggctgtgaaggttgctaacagaggagaagcaacatgcacagccgcaacctggcggcagcgcaaaagatg

SEQ ID NO: 88668 - DNA, 103 bp, Artificial Sequence
  Synthetic Polynucleotide
taatacgactcactataggggggtggcactccagggccgactgcggctgtaacagaggagaacagccatggtcggccctaacctggcggcagcgcaaaagatg

SEQ ID NO: 88669 - DNA, 103 bp, Artificial Sequence
  Synthetic Polynucleotide
taatacgactcactatagggacctctctcggggtggcactccagggccgaaacagaggagatcggccatggagtgccacaacctggcggcagcgcaaaagatg

SEQ ID NO: 88670 - DNA, 103 bp, Artificial Sequence
  Synthetic Polynucleotide
taatacgactcactatagggctgggacgcaacctctctcggggtggcactaacagaggagaagtgccatgccgagagagaacctggcggcagcgcaaaagatg

SEQ ID NO: 88671 - DNA, 103 bp, Artificial Sequence
  Synthetic Polynucleotide
taatacgactcactataggggctccaggctctgggacgcaacctctctcgaacagaggagacgagagatgttgcgtcccaacctggcggcagcgcaaaagatg

SEQ ID NO: 88672 - DNA, 103 bp, Artificial Sequence
  Synthetic Polynucleotide
taatacgactcactatagggtcggtaggtcttggacggcggccgagggtaaacagaggagataccctatgccgccgtccaacctggcggcagcgcaaaagatg

SEQ ID NO: 88673 - DNA, 103 bp, Artificial Sequence
  Synthetic Polynucleotide
taatacgactcactatagggggccacggcggctccaggctctgggacgcaaacagaggagatgcgtcatggagcctggaaacctggcggcagcgcaaaagatg

SEQ ID NO: 88674 - DNA, 103 bp, Artificial Sequence
  Synthetic Polynucleotide
taatacgactcactatagggccttgctggcggccacggcggctccaggctaacagaggagaagcctgatgccgccgtggaacctggcggcagcgcaaaagatg

SEQ ID NO: 88675 - DNA, 103 bp, Artificial Sequence
  Synthetic Polynucleotide
taatacgactcactatagggtgcggcagccccttgctggcggccacggcgaacagaggagacgccgtatgcgccagcaaaacctggcggcagcgcaaaagatg

SEQ ID NO: 88676 - DNA, 103 bp, Artificial Sequence
  Synthetic Polynucleotide
taatacgactcactatagggtggcagctgctgcggcagccccttgctggcaacagaggagagccagcatggggctgccgaacctggcggcagcgcaaaagatg

SEQ ID NO: 88677 - DNA, 103 bp, Artificial Sequence
  Synthetic Polynucleotide
taatacgactcactatagggccggaggtgctggcagctgctgcggcagccaacagaggagaggctgcatgagcagctgcaacctggcggcagcgcaaaagatg

SEQ ID NO: 88678 - DNA, 103 bp, Artificial Sequence
  Synthetic Polynucleotide
taatacgactcactatagggtcatcctcgtccggaggtgctggcagctgcaacagaggagagcagctatgagcacctccaacctggcggcagcgcaaaagatg

SEQ ID NO: 88679 - DNA, 103 bp, Artificial Sequence
  Synthetic Polynucleotide
taatacgactcactatagggggcagctgagtcatcctcgtccggaggtgcaacagaggagagcacctatggacgaggataacctggcggcagcgcaaaagatg

SEQ ID NO: 88680 - DNA, 103 bp, Artificial Sequence
  Synthetic Polynucleotide
taatacgactcactatagggacgtggatggggcagctgagtcatcctcgtaacagaggagaacgaggatgactcagctgaacctggcggcagcgcaaaagatg

SEQ ID NO: 88681 - DNA, 103 bp, Artificial Sequence
  Synthetic Polynucleotide
taatacgactcactatagggagcagggacaacgtggatggggcagctgagaacagaggagactcagcatgcccatccacaacctggcggcagcgcaaaagatg

SEQ ID NO: 88682 - DNA, 103 bp, Artificial Sequence
  Synthetic Polynucleotide
taatacgactcactatagggagtggggcccagcagggacaacgtggatggaacagaggagaccatccatgttgtccctgaacctggcggcagcgcaaaagatg

SEQ ID NO: 88683 - DNA, 103 bp, Artificial Sequence
  Synthetic Polynucleotide
taatacgactcactatagggggaaagctcctcggtaggtcttggacggcgaacagaggagacgccgtatgagacctaccaacctggcggcagcgcaaaagatg

SEQ ID NO: 88684 - DNA, 103 bp, Artificial Sequence
  Synthetic Polynucleotide
taatacgactcactatagggagccggggaaagtggggcccagcagggacaaacagaggagatgtcccatgtgggccccaaacctggcggcagcgcaaaagatg

SEQ ID NO: 88685 - DNA, 103 bp, Artificial Sequence
  Synthetic Polynucleotide
taatacgactcactatagggcagctgcttaagccggggaaagtggggcccaacagaggagagggcccatgtttccccggaacctggcggcagcgcaaaagatg

SEQ ID NO: 88686 - DNA, 103 bp, Artificial Sequence
  Synthetic Polynucleotide
taatacgactcactataggggtcagcggagcagctgcttaagccggggaaaacagaggagattccccatgttaagcagcaacctggcggcagcgcaaaagatg

SEQ ID NO: 88687 - DNA, 103 bp, Artificial Sequence
  Synthetic Polynucleotide
taatacgactcactatagggtgtctttaaggtcagcggagcagctgcttaaacagaggagataagcaatggctccgctgaacctggcggcagcgcaaaagatg

SEQ ID NO: 88688 - DNA, 103 bp, Artificial Sequence
  Synthetic Polynucleotide
taatacgactcactatagggtcgctcaggatgtctttaaggtcagcggagaacagaggagactccgcatgccttaaagaaacctggcggcagcgcaaaagatg

SEQ ID NO: 88689 - DNA, 103 bp, Artificial Sequence
  Synthetic Polynucleotide
taatacgactcactatagggggtgctggcctcgctcaggatgtctttaagaacagaggagacttaaaatgatcctgagcaacctggcggcagcgcaaaagatg

SEQ ID NO: 88690 - DNA, 103 bp, Artificial Sequence
  Synthetic Polynucleotide
taatacgactcactatagggggagttgcatggtgctggcctcgctcaggaaacagaggagatcctgaatgaggccagcaaacctggcggcagcgcaaaagatg

SEQ ID NO: 88691 - DNA, 103 bp, Artificial Sequence
  Synthetic Polynucleotide
taatacgactcactatagggtgttgctgaaggagttgcatggtgctggccaacagaggagaggccagatgcatgcaactaacctggcggcagcgcaaaagatg

SEQ ID NO: 88692 - DNA, 103 bp, Artificial Sequence
  Synthetic Polynucleotide
taatacgactcactatagggttcctgctgctgttgctgaaggagttgcataacagaggagaatgcaaatgcttcagcaaaacctggcggcagcgcaaaagatg

SEQ ID NO: 88693 - DNA, 103 bp, Artificial Sequence
  Synthetic Polynucleotide
taatacgactcactatagggcggatactgcttcctgctgctgttgctgaaaacagaggagattcagcatgagcagcaggaacctggcggcagcgcaaaagatg

SEQ ID NO: 88694 - DNA, 103 bp, Artificial Sequence
  Synthetic Polynucleotide
taatacgactcactatagggaacagattctggaaagctcctcggtaggtcaacagaggagagacctaatgaggagctttaacctggcggcagcgcaaaagatg

SEQ ID NO: 88695 - DNA, 103 bp, Artificial Sequence
  Synthetic Polynucleotide
taatacgactcactatagggctgctgccttcggatactgcttcctgctgcaacagaggagagcagcaatgagcagtatcaacctggcggcagcgcaaaagatg

SEQ ID NO: 88696 - DNA, 103 bp, Artificial Sequence
  Synthetic Polynucleotide
taatacgactcactatagggtctcccgctgctgctgccttcggatactgcaacagaggagagcagtaatggaaggcagcaacctggcggcagcgcaaaagatg

SEQ ID NO: 88697 - DNA, 103 bp, Artificial Sequence
  Synthetic Polynucleotide
taatacgactcactatagggcctccctcgctctcccgctgctgctgccttaacagaggagaaaggcaatggcagcgggaaacctggcggcagcgcaaaagatg

SEQ ID NO: 88698 - DNA, 103 bp, Artificial Sequence
  Synthetic Polynucleotide
taatacgactcactataggggcccccgaggcctccctcgctctcccgctgaacagaggagacagcggatgagcgagggaaacctggcggcagcgcaaaagatg

SEQ ID NO: 88699 - DNA, 103 bp, Artificial Sequence
  Synthetic Polynucleotide
taatacgactcactatagggggaagtgggagcccccgaggcctccctcgcaacagaggagagcgaggatggcctcggggaacctggcggcagcgcaaaagatg

SEQ ID NO: 88700 - DNA, 103 bp, Artificial Sequence
  Synthetic Polynucleotide
taatacgactcactatagggtgtccttggaggaagtgggagcccccgaggaacagaggagacctcggatgctcccacttaacctggcggcagcgcaaaagatg

SEQ ID NO: 88701 - DNA, 103 bp, Artificial Sequence
  Synthetic Polynucleotide
taatacgactcactatagggcctaagtaattgtccttggaggaagtgggaaacagaggagatcccacatgctccaaggaaacctggcggcagcgcaaaagatg

SEQ ID NO: 88702 - DNA, 103 bp, Artificial Sequence
  Synthetic Polynucleotide
taatacgactcactatagggcgaagtgccccctaagtaattgtccttggaaacagaggagatccaagatgaattacttaaacctggcggcagcgcaaaagatg

SEQ ID NO: 88703 - DNA, 103 bp, Artificial Sequence
  Synthetic Polynucleotide
taatacgactcactatagggcagaaatggtcgaagtgccccctaagtaataacagaggagaattactatgggggcacttaacctggcggcagcgcaaaagatg

SEQ ID NO: 88704 - DNA, 103 bp, Artificial Sequence
  Synthetic Polynucleotide
taatacgactcactatagggttggcgttgtcagaaatggtcgaagtgcccaacagaggagagggcacatggaccatttcaacctggcggcagcgcaaaagatg

SEQ ID NO: 88705 - DNA, 103 bp, Artificial Sequence
  Synthetic Polynucleotide
taatacgactcactatagggcacgctctggaacagattctggaaagctccaacagaggagaggagctatgcagaatctgaacctggcggcagcgcaaaagatg

SEQ ID NO: 88706 - DNA, 103 bp, Artificial Sequence
  Synthetic Polynucleotide
taatacgactcactatagggacacaactccttggcgttgtcagaaatggtaacagaggagaaccattatggacaacgccaacctggcggcagcgcaaaagatg

SEQ ID NO: 88707 - DNA, 103 bp, Artificial Sequence
  Synthetic Polynucleotide
taatacgactcactatagggacactgccttacacaactccttggcgttgtaacagaggagaacaacgatgaggagttgtaacctggcggcagcgcaaaagatg

SEQ ID NO: 88708 - DNA, 103 bp, Artificial Sequence
  Synthetic Polynucleotide
taatacgactcactatagggatggacaccgacactgccttacacaactccaacagaggagaggagttatgtaaggcagtaacctggcggcagcgcaaaagatg

SEQ ID NO: 88709 - DNA, 103 bp, Artificial Sequence
  Synthetic Polynucleotide
taatacgactcactatagggacccaggcccatggacaccgacactgccttaacagaggagaaaggcaatgtcggtgtccaacctggcggcagcgcaaaagatg

SEQ ID NO: 88710 - DNA, 103 bp, Artificial Sequence
  Synthetic Polynucleotide
taatacgactcactatagggacgcctccacacccaggcccatggacaccgaacagaggagacggtgtatgtgggcctggaacctggcggcagcgcaaaagatg

SEQ ID NO: 88711 - DNA, 103 bp, Artificial Sequence
  Synthetic Polynucleotide
taatacgactcactatagggagatgctccaacgcctccacacccaggcccaacagaggagagggcctatgtgtggaggcaacctggcggcagcgcaaaagatg

SEQ ID NO: 88712 - DNA, 103 bp, Artificial Sequence
  Synthetic Polynucleotide
taatacgactcactatagggccctggactcagatgctccaacgcctccacaacagaggagagtggagatgttggagcataacctggcggcagcgcaaaagatg

SEQ ID NO: 88713 - DNA, 103 bp, Artificial Sequence
  Synthetic Polynucleotide
taatacgactcactataggggaagctgttcccctggactcagatgctccaaacagaggagatggagcatgtgagtccagaacctggcggcagcgcaaaagatg

SEQ ID NO: 88714 - DNA, 103 bp, Artificial Sequence
  Synthetic Polynucleotide
taatacgactcactatagggcaatccccccgaagctgttcccctggactcaacagaggagagagtccatgggaacagctaacctggcggcagcgcaaaagatg

SEQ ID NO: 88715 - DNA, 103 bp, Artificial Sequence
  Synthetic Polynucleotide
taatacgactcactatagggggcgtacatgcaatccccccgaagctgttcaacagaggagagaacagatgcggggggataacctggcggcagcgcaaaagatg

SEQ ID NO: 88716 - DNA, 103 bp, Artificial Sequence
  Synthetic Polynucleotide
taatacgactcactatagggtcacttcgcgcacgctctggaacagattctaacagaggagaagaatcatgtccagagcgaacctggcggcagcgcaaaagatg

SEQ ID NO: 88717 - DNA, 103 bp, Artificial Sequence
  Synthetic Polynucleotide
taatacgactcactatagggccaaaagtggggcgtacatgcaatccccccaacagaggagaggggggatggcatgtacgaacctggcggcagcgcaaaagatg

SEQ ID NO: 88718 - DNA, 103 bp, Artificial Sequence
  Synthetic Polynucleotide
taatacgactcactatagggggtggaactcccaaaagtggggcgtacatgaacagaggagacatgtaatgcccacttttaacctggcggcagcgcaaaagatg

SEQ ID NO: 88719 - DNA, 103 bp, Artificial Sequence
  Synthetic Polynucleotide
taatacgactcactatagggacgcacagcgggtggaactcccaaaagtggaacagaggagaccacttatgggagttccaaacctggcggcagcgcaaaagatg

SEQ ID NO: 88720 - DNA, 103 bp, Artificial Sequence
  Synthetic Polynucleotide
taatacgactcactatagggaaggagtgggacgcacagcgggtggaactcaacagaggagagagttcatgccgctgtgcaacctggcggcagcgcaaaagatg

SEQ ID NO: 88721 - DNA, 103 bp, Artificial Sequence
  Synthetic Polynucleotide
taatacgactcactatagggaatggggcacaaggagtgggacgcacagcgaacagaggagacgctgtatgtcccactccaacctggcggcagcgcaaaagatg

SEQ ID NO: 88722 - DNA, 103 bp, Artificial Sequence
  Synthetic Polynucleotide
taatacgactcactataggggcattcggccaatggggcacaaggagtgggaacagaggagacccactatgtgtgccccaaacctggcggcagcgcaaaagatg

SEQ ID NO: 88723 - DNA, 103 bp, Artificial Sequence
  Synthetic Polynucleotide
taatacgactcactataggggagaacctttgcattcggccaatggggcacaacagaggagagtgcccatgtggccgaataacctggcggcagcgcaaaagatg

SEQ ID NO: 88724 - DNA, 103 bp, Artificial Sequence
  Synthetic Polynucleotide
taatacgactcactatagggtcgtctagcagagaacctttgcattcggccaacagaggagaggccgaatgcaaaggttcaacctggcggcagcgcaaaagatg

SEQ ID NO: 88725 - DNA, 103 bp, Artificial Sequence
  Synthetic Polynucleotide
taatacgactcactataggggcctgcgctgtcgtctagcagagaacctttaacagaggagaaaaggtatgctgctagacaacctggcggcagcgcaaaagatg

SEQ ID NO: 88726 - DNA, 103 bp, Artificial Sequence
  Synthetic Polynucleotide
taatacgactcactatagggcagtgctcttgcctgcgctgtcgtctagcaaacagaggagatgctagatgacagcgcagaacctggcggcagcgcaaaagatg

SEQ ID NO: 88727 - DNA, 103 bp, Artificial Sequence
  Synthetic Polynucleotide
taatacgactcactataggggggttctggatcacttcgcgcacgctctggaacagaggagaccagagatggcgcgaagtaacctggcggcagcgcaaaagatg

SEQ ID NO: 88728 - DNA, 103 bp, Artificial Sequence
  Synthetic Polynucleotide
taatacgactcactataggggcagtatcttcagtgctcttgcctgcgctgaacagaggagacagcgcatgcaagagcacaacctggcggcagcgcaaaagatg

SEQ ID NO: 88729 - DNA, 103 bp, Artificial Sequence
  Synthetic Polynucleotide
taatacgactcactatagggggaatactcagcagtatcttcagtgctcttaacagaggagaaagagcatggaagatactaacctggcggcagcgcaaaagatg

SEQ ID NO: 88730 - DNA, 103 bp, Artificial Sequence
  Synthetic Polynucleotide
taatacgactcactatagggccttgaaaggggaatactcagcagtatcttaacagaggagaaagataatgctgagtattaacctggcggcagcgcaaaagatg

SEQ ID NO: 88731 - DNA, 103 bp, Artificial Sequence
  Synthetic Polynucleotide
taatacgactcactataggggtgtaacctcccttgaaaggggaatactcaaacagaggagatgagtaatgccctttcaaaacctggcggcagcgcaaaagatg

SEQ ID NO: 88732 - DNA, 103 bp, Artificial Sequence
  Synthetic Polynucleotide
taatacgactcactatagggtagccctttggtgtaacctcccttgaaaggaacagaggagacctttcatgggaggttacaacctggcggcagcgcaaaagatg

SEQ ID NO: 88733 - DNA, 103 bp, Artificial Sequence
  Synthetic Polynucleotide
taatacgactcactatagggtctcgccttctagccctttggtgtaacctcaacagaggagagaggttatgccaaagggcaacctggcggcagcgcaaaagatg

SEQ ID NO: 88734 - DNA, 103 bp, Artificial Sequence
  Synthetic Polynucleotide
taatacgactcactatagggcagcctaggctctcgccttctagccctttgaacagaggagacaaaggatgagaaggcgaaacctggcggcagcgcaaaagatg

SEQ ID NO: 88735 - DNA, 103 bp, Artificial Sequence
  Synthetic Polynucleotide
taatacgactcactataggggctgccagagcagcctaggctctcgccttcaacagaggagagaaggcatgagcctaggcaacctggcggcagcgcaaaagatg

SEQ ID NO: 88736 - DNA, 103 bp, Artificial Sequence
  Synthetic Polynucleotide
taatacgactcactatagggctgctgcagcgctgccagagcagcctaggcaacagaggagagcctagatggctctggcaaacctggcggcagcgcaaaagatg

SEQ ID NO: 88737 - DNA, 103 bp, Artificial Sequence
  Synthetic Polynucleotide
taatacgactcactatagggccggagctccctgctgcagcgctgccagagaacagaggagactctggatgcgctgcagcaacctggcggcagcgcaaaagatg

SEQ ID NO: 88738 - DNA, 103 bp, Artificial Sequence
  Synthetic Polynucleotide
taatacgactcactatagggtcggacatcttgctttcttgccatcatcataacagaggagaatgatgatggcaagaaagaacctggcggcagcgcaaaagatg

SEQ ID NO: 88739 - DNA, 103 bp, Artificial Sequence
  Synthetic Polynucleotide
taatacgactcactataggggttgcacaaacaagactttccaatcccacaaacagaggagatgtgggatgggaaagtctaacctggcggcagcgcaaaagatg

SEQ ID NO: 88740 - DNA, 103 bp, Artificial Sequence
  Synthetic Polynucleotide
taatacgactcactataggggtacagctttctcctacgctcgatatgctcaacagaggagagagcatatggagcgtaggaacctggcggcagcgcaaaagatg

SEQ ID NO: 88741 - DNA, 103 bp, Artificial Sequence
  Synthetic Polynucleotide
taatacgactcactataggggggctgccaggtacagctttctcctacgctaacagaggagaagcgtaatggaaagctgtaacctggcggcagcgcaaaagatg

SEQ ID NO: 88742 - DNA, 103 bp, Artificial Sequence
  Synthetic Polynucleotide
taatacgactcactataggggctaatggcagggctgccaggtacagctttaacagaggagaaaagctatgcctggcagcaacctggcggcagcgcaaaagatg

SEQ ID NO: 88743 - DNA, 103 bp, Artificial Sequence
  Synthetic Polynucleotide
taatacgactcactatagggagcttcaaaagctaatggcagggctgccagaacagaggagactggcaatgctgccattaaacctggcggcagcgcaaaagatg

SEQ ID NO: 88744 - DNA, 103 bp, Artificial Sequence
  Synthetic Polynucleotide
taatacgactcactatagggtaggtataagagcttcaaaagctaatggcaaacagaggagatgccatatgcttttgaagaacctggcggcagcgcaaaagatg

SEQ ID NO: 88745 - DNA, 103 bp, Artificial Sequence
  Synthetic Polynucleotide
taatacgactcactatagggtcatctagattaggtataagagcttcaaaaaacagaggagattttgaatgtcttataccaacctggcggcagcgcaaaagatg

SEQ ID NO: 88746 - DNA, 103 bp, Artificial Sequence
  Synthetic Polynucleotide
taatacgactcactataggggtggtctatttcatctagattaggtataagaacagaggagacttataatgaatctagataacctggcggcagcgcaaaagatg

SEQ ID NO: 88747 - DNA, 103 bp, Artificial Sequence
  Synthetic Polynucleotide
taatacgactcactatagggtgcagcttaggtggtctatttcatctagataacagaggagaatctagatgaaatagaccaacctggcggcagcgcaaaagatg

SEQ ID NO: 88748 - DNA, 103 bp, Artificial Sequence
  Synthetic Polynucleotide
taatacgactcactatagggttggcttttatgcagcttaggtggtctattaacagaggagaaatagaatgcctaagctgaacctggcggcagcgcaaaagatg

SEQ ID NO: 88749 - DNA, 103 bp, Artificial Sequence
  Synthetic Polynucleotide
taatacgactcactatagggtaagagctttttggcttttatgcagcttagaacagaggagactaagcatgataaaagccaacctggcggcagcgcaaaagatg

SEQ ID NO: 88750 - DNA, 103 bp, Artificial Sequence
  Synthetic Polynucleotide
taatacgactcactataggggcacgaagcggttgcacaaacaagactttcaacagaggagagaaagtatggtttgtgcaaacctggcggcagcgcaaaagatg

SEQ ID NO: 88751 - DNA, 103 bp, Artificial Sequence
  Synthetic Polynucleotide
taatacgactcactataggggcttggtttctaagagctttttggcttttaaacagaggagataaaagatgaaaagctctaacctggcggcagcgcaaaagatg

SEQ ID NO: 88752 - DNA, 103 bp, Artificial Sequence
  Synthetic Polynucleotide
taatacgactcactatagggaagaattctggcttggtttctaagagctttaacagaggagaaaagctatgagaaaccaaaacctggcggcagcgcaaaagatg

SEQ ID NO: 88753 - DNA, 103 bp, Artificial Sequence
  Synthetic Polynucleotide
taatacgactcactatagggaaaccacttcaagaattctggcttggtttcaacagaggagagaaaccatgccagaattcaacctggcggcagcgcaaaagatg

SEQ ID NO: 88754 - DNA, 103 bp, Artificial Sequence
  Synthetic Polynucleotide
taatacgactcactatagggcaagcacaacaaaccacttcaagaattctgaacagaggagacagaatatgtgaagtggtaacctggcggcagcgcaaaagatg

SEQ ID NO: 88755 - DNA, 103 bp, Artificial Sequence
  Synthetic Polynucleotide
taatacgactcactatagggggggtctcttcaagcacaacaaaccacttcaacagaggagagaagtgatgtgttgtgctaacctggcggcagcgcaaaagatg

SEQ ID NO: 88756 - DNA, 103 bp, Artificial Sequence
  Synthetic Polynucleotide
taatacgactcactatagggggcatcccatggggtctcttcaagcacaacaacagaggagagttgtgatggaagagaccaacctggcggcagcgcaaaagatg

SEQ ID NO: 88757 - DNA, 103 bp, Artificial Sequence
  Synthetic Polynucleotide
taatacgactcactatagggtgtgactggtggcatcccatggggtctcttaacagaggagaaagagaatgcatgggatgaacctggcggcagcgcaaaagatg

SEQ ID NO: 88758 - DNA, 103 bp, Artificial Sequence
  Synthetic Polynucleotide
taatacgactcactatagggatgttgtcaatgtgactggtggcatcccataacagaggagaatgggaatgcaccagtcaaacctggcggcagcgcaaaagatg

SEQ ID NO: 88759 - DNA, 103 bp, Artificial Sequence
  Synthetic Polynucleotide
taatacgactcactatagggttcgttttccatgttgtcaatgtgactggtaacagaggagaaccagtatgattgacaacaacctggcggcagcgcaaaagatg

SEQ ID NO: 88760 - DNA, 103 bp, Artificial Sequence
  Synthetic Polynucleotide
taatacgactcactatagggagggaatccgttcgttttccatgttgtcaaaacagaggagattgacaatgtggaaaacgaacctggcggcagcgcaaaagatg

SEQ ID NO: 88761 - DNA, 103 bp, Artificial Sequence
  Synthetic Polynucleotide
taatacgactcactataggggcactcgggcgcacgaagcggttgcacaaaaacagaggagatttgtgatgccgcttcgtaacctggcggcagcgcaaaagatg

SEQ ID NO: 88762 - DNA, 103 bp, Artificial Sequence
  Synthetic Polynucleotide
taatacgactcactatagggattaaatcaaagggaatccgttcgttttccaacagaggagaggaaaaatgacggattccaacctggcggcagcgcaaaagatg

SEQ ID NO: 88763 - DNA, 103 bp, Artificial Sequence
  Synthetic Polynucleotide
taatacgactcactataggggacggtatccattaaatcaaagggaatccgaacagaggagacggattatgtttgatttaaacctggcggcagcgcaaaagatg

SEQ ID NO: 88764 - DNA, 103 bp, Artificial Sequence
  Synthetic Polynucleotide
taatacgactcactataggggctctgcagggacggtatccattaaatcaaaacagaggagattgattatgtggataccgaacctggcggcagcgcaaaagatg

SEQ ID NO: 88765 - DNA, 103 bp, Artificial Sequence
  Synthetic Polynucleotide
taatacgactcactatagggtcgtatagctgctctgcagggacggtatccaacagaggagaggatacatgccctgcagaaacctggcggcagcgcaaaagatg

SEQ ID NO: 88766 - DNA, 103 bp, Artificial Sequence
  Synthetic Polynucleotide
taatacgactcactatagggtaagtgggcctcgtatagctgctctgcaggaacagaggagacctgcaatgcagctatacaacctggcggcagcgcaaaagatg

SEQ ID NO: 88767 - DNA, 103 bp, Artificial Sequence
  Synthetic Polynucleotide
taatacgactcactatagggtcagcttctctaagtgggcctcgtatagctaacagaggagaagctatatgaggcccactaacctggcggcagcgcaaaagatg

SEQ ID NO: 88768 - DNA, 103 bp, Artificial Sequence
  Synthetic Polynucleotide
taatacgactcactatagggctttcgttcctcagcttctctaagtgggccaacagaggagaggcccaatgagagaagctaacctggcggcagcgcaaaagatg

SEQ ID NO: 88769 - DNA, 103 bp, Artificial Sequence
  Synthetic Polynucleotide
taatacgactcactatagggaactcttttcctttcgttcctcagcttctcaacagaggagagagaagatgaggaacgaaaacctggcggcagcgcaaaagatg

SEQ ID NO: 88770 - DNA, 103 bp, Artificial Sequence
  Synthetic Polynucleotide
taatacgactcactatagggttcgcatctcaactcttttcctttcgttccaacagaggagaggaacgatgggaaaagagaacctggcggcagcgcaaaagatg

SEQ ID NO: 88771 - DNA, 103 bp, Artificial Sequence
  Synthetic Polynucleotide
taatacgactcactatagggttaaacgcccttcgcatctcaactcttttcaacagaggagagaaaagatgtgagatgcgaacctggcggcagcgcaaaagatg

SEQ ID NO: 88772 - DNA, 103 bp, Artificial Sequence
  Synthetic Polynucleotide
taatacgactcactatagggaaactcgtcagcactcgggcgcacgaagcgaacagaggagacgcttcatgcgcccgagtaacctggcggcagcgcaaaagatg

SEQ ID NO: 88773 - DNA, 103 bp, Artificial Sequence
  Synthetic Polynucleotide
taatacgactcactatagggcaggttttctttaaacgcccttcgcatctcaacagaggagagagatgatgagggcgtttaacctggcggcagcgcaaaagatg

SEQ ID NO: 88774 - DNA, 103 bp, Artificial Sequence
  Synthetic Polynucleotide
taatacgactcactataggggagaagtctccaggttttctttaaacgcccaacagaggagagggcgtatgaagaaaaccaacctggcggcagcgcaaaagatg

SEQ ID NO: 88775 - DNA, 103 bp, Artificial Sequence
  Synthetic Polynucleotide
taatacgactcactataggggttatgaaaggagaagtctccaggttttctaacagaggagaagaaaaatgggagacttcaacctggcggcagcgcaaaagatg

SEQ ID NO: 88776 - DNA, 103 bp, Artificial Sequence
  Synthetic Polynucleotide
taatacgactcactatagggctttccgggagttatgaaaggagaagtctcaacagaggagagagactatgcctttcataaacctggcggcagcgcaaaagatg

SEQ ID NO: 88777 - DNA, 103 bp, Artificial Sequence
  Synthetic Polynucleotide
taatacgactcactatagggcttcccaaggctttccgggagttatgaaagaacagaggagactttcaatgctcccggaaaacctggcggcagcgcaaaagatg

SEQ ID NO: 88778 - DNA, 103 bp, Artificial Sequence
  Synthetic Polynucleotide
taatacgactcactatagggctacgggcctcttcccaaggctttccgggaaacagaggagatcccggatggccttgggaaacctggcggcagcgcaaaagatg

SEQ ID NO: 88779 - DNA, 103 bp, Artificial Sequence
  Synthetic Polynucleotide
taatacgactcactatagggcataataaaactacgggcctcttcccaaggaacagaggagaccttggatggaggcccgtaacctggcggcagcgcaaaagatg

SEQ ID NO: 88780 - DNA, 103 bp, Artificial Sequence
  Synthetic Polynucleotide
taatacgactcactatagggaatcctcattcataataaaactacgggcctaacagaggagaaggcccatggttttattaaacctggcggcagcgcaaaagatg

SEQ ID NO: 88781 - DNA, 103 bp, Artificial Sequence
  Synthetic Polynucleotide
taatacgactcactatagggcactggtagaaatcctcattcataataaaaaacagaggagattttatatggaatgaggaaacctggcggcagcgcaaaagatg

SEQ ID NO: 88782 - DNA, 103 bp, Artificial Sequence
  Synthetic Polynucleotide
taatacgactcactatagggttcctccagccactggtagaaatcctcattaacagaggagaaatgagatgttctaccagaacctggcggcagcgcaaaagatg

SEQ ID NO: 88783 - DNA, 103 bp, Artificial Sequence
  Synthetic Polynucleotide
taatacgactcactatagggggtccaagtgaaactcgtcagcactcgggcaacagaggagagcccgaatgctgacgagtaacctggcggcagcgcaaaagatg

SEQ ID NO: 88784 - DNA, 103 bp, Artificial Sequence
  Synthetic Polynucleotide
taatacgactcactatagggtgtatacagattcctccagccactggtagaaacagaggagatctaccatgggctggaggaacctggcggcagcgcaaaagatg

SEQ ID NO: 88785 - DNA, 103 bp, Artificial Sequence
  Synthetic Polynucleotide
taatacgactcactatagggtaaatatccatgtatacagattcctccagcaacagaggagagctggaatgatctgtataaacctggcggcagcgcaaaagatg

SEQ ID NO: 88786 - DNA, 103 bp, Artificial Sequence
  Synthetic Polynucleotide
taatacgactcactataggggtgtttgccataaatatccatgtatacagaaacagaggagatctgtaatgatggatattaacctggcggcagcgcaaaagatg

SEQ ID NO: 88787 - DNA, 103 bp, Artificial Sequence
  Synthetic Polynucleotide
taatacgactcactatagggtttgcttttggtgtttgccataaatatccaaacagaggagatggataatgatggcaaacaacctggcggcagcgcaaaagatg

SEQ ID NO: 88788 - DNA, 103 bp, Artificial Sequence
  Synthetic Polynucleotide
taatacgactcactatagggttatctataatttgcttttggtgtttgccaaacagaggagatggcaaatgccaaaagcaaacctggcggcagcgcaaaagatg

SEQ ID NO: 88789 - DNA, 103 bp, Artificial Sequence
  Synthetic Polynucleotide
taatacgactcactatagggttcctttgctttatctataatttgcttttgaacagaggagacaaaagatgattatagataacctggcggcagcgcaaaagatg

SEQ ID NO: 88790 - DNA, 103 bp, Artificial Sequence
  Synthetic Polynucleotide
taatacgactcactatagggcctgaaattcttcctttgctttatctataaaacagaggagattatagatgaagcaaaggaacctggcggcagcgcaaaagatg

SEQ ID NO: 88791 - DNA, 103 bp, Artificial Sequence
  Synthetic Polynucleotide
taatacgactcactatagggaaaagcaactcctgaaattcttcctttgctaacagaggagaagcaaaatgagaatttcaaacctggcggcagcgcaaaagatg

SEQ ID NO: 88792 - DNA, 103 bp, Artificial Sequence
  Synthetic Polynucleotide
taatacgactcactatagggtgaatattccaaaagcaactcctgaaattcaacagaggagagaatttatggagttgcttaacctggcggcagcgcaaaagatg

SEQ ID NO: 88793 - DNA, 103 bp, Artificial Sequence
  Synthetic Polynucleotide
taatacgactcactatagggaaaacaattctgaatattccaaaagcaactaacagaggagaagttgcatgtggaatattaacctggcggcagcgcaaaagatg

SEQ ID NO: 88794 - DNA, 103 bp, Artificial Sequence
  Synthetic Polynucleotide
taatacgactcactatagggacggaggtatggtccaagtgaaactcgtcaaacagaggagatgacgaatgtcacttggaaacctggcggcagcgcaaaagatg

SEQ ID NO: 88795 - DNA, 103 bp, Artificial Sequence
  Synthetic Polynucleotide
taatacgactcactatagggtccagttcataaaacaattctgaatattccaacagaggagaggaataatgagaattgttaacctggcggcagcgcaaaagatg

SEQ ID NO: 88796 - DNA, 103 bp, Artificial Sequence
  Synthetic Polynucleotide
taatacgactcactatagggagcatccagctccagttcataaaacaattcaacagaggagagaattgatgtatgaactgaacctggcggcagcgcaaaagatg

SEQ ID NO: 88797 - DNA, 103 bp, Artificial Sequence
  Synthetic Polynucleotide
taatacgactcactatagggtgctgggcttagcatccagctccagttcataacagaggagaatgaacatgagctggatgaacctggcggcagcgcaaaagatg

SEQ ID NO: 88798 - DNA, 103 bp, Artificial Sequence
  Synthetic Polynucleotide
taatacgactcactatagggatcttctccttgctgggcttagcatccagcaacagaggagagctggaatgtaagcccagaacctggcggcagcgcaaaagatg

SEQ ID NO: 88799 - DNA, 103 bp, Artificial Sequence
  Synthetic Polynucleotide
taatacgactcactatagggaataacacccatcttctccttgctgggcttaacagaggagaaagcccatgaaggagaagaacctggcggcagcgcaaaagatg

SEQ ID NO: 88800 - DNA, 103 bp, Artificial Sequence
  Synthetic Polynucleotide
taatacgactcactataggggaacatcctgaataacacccatcttctcctaacagaggagaaggagaatgtgggtgttaaacctggcggcagcgcaaaagatg

SEQ ID NO: 88801 - DNA, 103 bp, Artificial Sequence
  Synthetic Polynucleotide
taatacgactcactatagggtcctctcccagaacatcctgaataacacccaacagaggagagggtgtatgtcaggatgtaacctggcggcagcgcaaaagatg

SEQ ID NO: 88802 - DNA, 103 bp, Artificial Sequence
  Synthetic Polynucleotide
taatacgactcactatagggaaatcgctgttcctctcccagaacatcctgaacagaggagacaggatatgctgggagagaacctggcggcagcgcaaaagatg

SEQ ID NO: 88803 - DNA, 103 bp, Artificial Sequence
  Synthetic Polynucleotide
taatacgactcactataggggtaatgctttaaatcgctgttcctctcccaaacagaggagatgggagatgaacagcgataacctggcggcagcgcaaaagatg

SEQ ID NO: 88804 - DNA, 103 bp, Artificial Sequence
  Synthetic Polynucleotide
taatacgactcactatagggtggagcttttgtaatgctttaaatcgctgtaacagaggagaacagcgatgtaaagcattaacctggcggcagcgcaaaagatg

SEQ ID NO: 88805 - DNA, 103 bp, Artificial Sequence
  Synthetic Polynucleotide
taatacgactcactatagggggtgctgaggacggaggtatggtccaagtgaacagaggagacacttgatgcatacctccaacctggcggcagcgcaaaagatg

SEQ ID NO: 88806 - DNA, 103 bp, Artificial Sequence
  Synthetic Polynucleotide
taatacgactcactatagggacgctctgcttggagcttttgtaatgctttaacagaggagaaaagcaatgcaaaagctcaacctggcggcagcgcaaaagatg

SEQ ID NO: 88807 - DNA, 103 bp, Artificial Sequence
  Synthetic Polynucleotide
taatacgactcactatagggtaagggcatcacgctctgcttggagcttttaacagaggagaaaaagcatgaagcagagcaacctggcggcagcgcaaaagatg

SEQ ID NO: 88808 - DNA, 103 bp, Artificial Sequence
  Synthetic Polynucleotide
taatacgactcactatagggtgtttcagaataagggcatcacgctctgctaacagaggagaagcagaatgtgatgccctaacctggcggcagcgcaaaagatg

SEQ ID NO: 88809 - DNA, 103 bp, Artificial Sequence
  Synthetic Polynucleotide
taatacgactcactatagggaaaatgaatgtgtttcagaataagggcatcaacagaggagagatgccatgattctgaaaaacctggcggcagcgcaaaagatg

SEQ ID NO: 88810 - DNA, 103 bp, Artificial Sequence
  Synthetic Polynucleotide
taatacgactcactatagggggtggtacacaaaatgaatgtgtttcagaaaacagaggagattctgaatgacattcattaacctggcggcagcgcaaaagatg

SEQ ID NO: 88811 - DNA, 103 bp, Artificial Sequence
  Synthetic Polynucleotide
taatacgactcactatagggtcctttgttgggtggtacacaaaatgaatgaacagaggagacattcaatgtgtgtaccaaacctggcggcagcgcaaaagatg

SEQ ID NO: 88812 - DNA, 103 bp, Artificial Sequence
  Synthetic Polynucleotide
taatacgactcactatagggggggcatgtctcctttgttgggtggtacacaacagaggagagtgtacatgccaacaaagaacctggcggcagcgcaaaagatg

SEQ ID NO: 88813 - DNA, 103 bp, Artificial Sequence
  Synthetic Polynucleotide
taatacgactcactatagggctgggcagctggggcatgtctcctttgttgaacagaggagacaacaaatgagacatgccaacctggcggcagcgcaaaagatg

SEQ ID NO: 88814 - DNA, 103 bp, Artificial Sequence
  Synthetic Polynucleotide
taatacgactcactatagggtccacacaagctgggcagctggggcatgtcaacagaggagagacatgatgcagctgcccaacctggcggcagcgcaaaagatg

SEQ ID NO: 88815 - DNA, 103 bp, Artificial Sequence
  Synthetic Polynucleotide
taatacgactcactatagggaatcttagcgtccacacaagctgggcagctaacagaggagaagctgcatggcttgtgtgaacctggcggcagcgcaaaagatg

SEQ ID NO: 88816 - DNA, 103 bp, Artificial Sequence
  Synthetic Polynucleotide
taatacgactcactatagggcaaagtcactggtgctgaggacggaggtataacagaggagaatacctatgtcctcagcaaacctggcggcagcgcaaaagatg

SEQ ID NO: 88817 - DNA, 103 bp, Artificial Sequence
  Synthetic Polynucleotide
taatacgactcactatagggtcaagtgctcaatcttagcgtccacacaagaacagaggagacttgtgatgacgctaagaaacctggcggcagcgcaaaagatg

SEQ ID NO: 88818 - DNA, 103 bp, Artificial Sequence
  Synthetic Polynucleotide
taatacgactcactatagggcgagaactaatcaagtgctcaatcttagcgaacagaggagacgctaaatgtgagcacttaacctggcggcagcgcaaaagatg

SEQ ID NO: 88819 - DNA, 103 bp, Artificial Sequence
  Synthetic Polynucleotide
taatacgactcactatagggccggataaaccgagaactaatcaagtgctcaacagaggagagagcacatgattagttctaacctggcggcagcgcaaaagatg

SEQ ID NO: 88820 - DNA, 103 bp, Artificial Sequence
  Synthetic Polynucleotide
taatacgactcactatagggggtcagacggccggataaaccgagaactaaaacagaggagattagttatgggtttatccaacctggcggcagcgcaaaagatg

SEQ ID NO: 88821 - DNA, 103 bp, Artificial Sequence
  Synthetic Polynucleotide
taatacgactcactatagggttctgattccggtcagacggccggataaacaacagaggagagtttatatggccgtctgaaacctggcggcagcgcaaaagatg

SEQ ID NO: 88822 - DNA, 103 bp, Artificial Sequence
  Synthetic Polynucleotide
taatacgactcactataggggagtgaatttttctgattccggtcagacggaacagaggagaccgtctatgcggaatcagaacctggcggcagcgcaaaagatg

SEQ ID NO: 88823 - DNA, 103 bp, Artificial Sequence
  Synthetic Polynucleotide
taatacgactcactatagggtagggtcagagagtgaatttttctgattccaacagaggagaggaatcatgaaaattcacaacctggcggcagcgcaaaagatg

SEQ ID NO: 88824 - DNA, 103 bp, Artificial Sequence
  Synthetic Polynucleotide
taatacgactcactatagggctatcaatgttagggtcagagagtgaatttaacagaggagaaaattcatgctctgacccaacctggcggcagcgcaaaagatg

SEQ ID NO: 88825 - DNA, 103 bp, Artificial Sequence
  Synthetic Polynucleotide
taatacgactcactatagggcaagttgattctatcaatgttagggtcagaaacagaggagatctgacatgaacattgataacctggcggcagcgcaaaagatg

SEQ ID NO: 88826 - DNA, 103 bp, Artificial Sequence
  Synthetic Polynucleotide
taatacgactcactatagggccaatataaccaagttgattctatcaatgtaacagaggagaacattgatggaatcaactaacctggcggcagcgcaaaagatg

SEQ ID NO: 88827 - DNA, 103 bp, Artificial Sequence
  Synthetic Polynucleotide
taatacgactcactatagggactcgccctccaaagtcactggtgctgaggaacagaggagacctcagatgcagtgacttaacctggcggcagcgcaaaagatg

SEQ ID NO: 88828 - DNA, 103 bp, Artificial Sequence
  Synthetic Polynucleotide
taatacgactcactatagggccgtctttgcccaatataaccaagttgattaacagaggagaaatcaaatgggttatattaacctggcggcagcgcaaaagatg

SEQ ID NO: 88829 - DNA, 103 bp, Artificial Sequence
  Synthetic Polynucleotide
taatacgactcactatagggtcgggcaaggccgtctttgcccaatataacaacagaggagagttataatgggcaaagacaacctggcggcagcgcaaaagatg

SEQ ID NO: 88830 - DNA, 103 bp, Artificial Sequence
  Synthetic Polynucleotide
taatacgactcactatagggtggccaactctcgggcaaggccgtctttgcaacagaggagagcaaagatggccttgcccaacctggcggcagcgcaaaagatg

SEQ ID NO: 88831 - DNA, 103 bp, Artificial Sequence
  Synthetic Polynucleotide
taatacgactcactatagggcgaatctcattggccaactctcgggcaaggaacagaggagaccttgcatgagagttggcaacctggcggcagcgcaaaagatg

SEQ ID NO: 88832 - DNA, 103 bp, Artificial Sequence
  Synthetic Polynucleotide
taatacgactcactatagggacaaagagctcgaatctcattggccaactcaacagaggagagagttgatgaatgagattaacctggcggcagcgcaaaagatg

SEQ ID NO: 88833 - DNA, 103 bp, Artificial Sequence
  Synthetic Polynucleotide
taatacgactcactatagggcatcatttgtacaaagagctcgaatctcataacagaggagaatgagaatggagctctttaacctggcggcagcgcaaaagatg

SEQ ID NO: 88834 - DNA, 103 bp, Artificial Sequence
  Synthetic Polynucleotide
taatacgactcactatagggacatacttgtcatcatttgtacaaagagctaacagaggagaagctctatgtacaaatgaaacctggcggcagcgcaaaagatg

SEQ ID NO: 88835 - DNA, 103 bp, Artificial Sequence
  Synthetic Polynucleotide
taatacgactcactatagggaccatctatcacatacttgtcatcatttgtaacagaggagaacaaatatggacaagtataacctggcggcagcgcaaaagatg

SEQ ID NO: 88836 - DNA, 103 bp, Artificial Sequence
  Synthetic Polynucleotide
taatacgactcactatagggcatacattttaccatctatcacatacttgtaacagaggagaacaagtatgtgatagatgaacctggcggcagcgcaaaagatg

SEQ ID NO: 88837 - DNA, 103 bp, Artificial Sequence
  Synthetic Polynucleotide
taatacgactcactatagggagggaaagctcatacattttaccatctatcaacagaggagagatagaatgtaaaatgtaaacctggcggcagcgcaaaagatg

SEQ ID NO: 88838 - DNA, 103 bp, Artificial Sequence
  Synthetic Polynucleotide
taatacgactcactatagggattattgaccactcgccctccaaagtcactaacagaggagaagtgacatgggagggcgaaacctggcggcagcgcaaaagatg

SEQ ID NO: 88839 - DNA, 103 bp, Artificial Sequence
  Synthetic Polynucleotide
taatacgactcactatagggtattggcctcagggaaagctcatacattttaacagaggagaaaaatgatggagctttccaacctggcggcagcgcaaaagatg

SEQ ID NO: 88840 - DNA, 103 bp, Artificial Sequence
  Synthetic Polynucleotide
taatacgactcactatagggcattcccctctattggcctcagggaaagctaacagaggagaagctttatgtgaggccaaaacctggcggcagcgcaaaagatg

SEQ ID NO: 88841 - DNA, 103 bp, Artificial Sequence
  Synthetic Polynucleotide
taatacgactcactatagggggaagcctgacattcccctctattggcctcaacagaggagagaggccatgagaggggaaaacctggcggcagcgcaaaagatg

SEQ ID NO: 88842 - DNA, 103 bp, Artificial Sequence
  Synthetic Polynucleotide
taatacgactcactatagggagagttcacaggaagcctgacattcccctcaacagaggagagaggggatggtcaggcttaacctggcggcagcgcaaaagatg

SEQ ID NO: 88843 - DNA, 103 bp, Artificial Sequence
  Synthetic Polynucleotide
taatacgactcactataggggcgtctggaaagagttcacaggaagcctgaaacagaggagatcaggcatgctgtgaactaacctggcggcagcgcaaaagatg

SEQ ID NO: 88844 - DNA, 103 bp, Artificial Sequence
  Synthetic Polynucleotide
taatacgactcactatagggtgaaatgttggcgtctggaaagagttcacaaacagaggagatgtgaaatgtttccagacaacctggcggcagcgcaaaagatg

SEQ ID NO: 88845 - DNA, 103 bp, Artificial Sequence
  Synthetic Polynucleotide
taatacgactcactataggggccgtggggctgaaatgttggcgtctggaaaacagaggagattccagatgccaacatttaacctggcggcagcgcaaaagatg

SEQ ID NO: 88846 - DNA, 103 bp, Artificial Sequence
  Synthetic Polynucleotide
taatacgactcactatagggggcagagacagccgtggggctgaaatgttgaacagaggagacaacatatgagccccacgaacctggcggcagcgcaaaagatg

SEQ ID NO: 88847 - DNA, 103 bp, Artificial Sequence
  Synthetic Polynucleotide
taatacgactcactataggggaattgtaaaggcagagacagccgtggggcaacagaggagagccccaatgctgtctctgaacctggcggcagcgcaaaagatg

SEQ ID NO: 88848 - DNA, 103 bp, Artificial Sequence
  Synthetic Polynucleotide
taatacgactcactatagggcgattcctttgaattgtaaaggcagagacaaacagaggagatgtctcatgctttacaataacctggcggcagcgcaaaagatg

SEQ ID NO: 88849 - DNA, 103 bp, Artificial Sequence
  Synthetic Polynucleotide
taatacgactcactatagggaggtgggaattcggacatcttgctttcttgaacagaggagacaagaaatgaagatgtccaacctggcggcagcgcaaaagatg

SEQ ID NO: 88850 - DNA, 103 bp, Artificial Sequence
  Synthetic Polynucleotide
taatacgactcactataggggaaagtggtcattattgaccactcgccctcaacagaggagagagggcatgtggtcaataaacctggcggcagcgcaaaagatg

SEQ ID NO: 88851 - DNA, 103 bp, Artificial Sequence
  Synthetic Polynucleotide
taatacgactcactatagggcataggatagcgattcctttgaattgtaaaaacagaggagatttacaatgcaaaggaataacctggcggcagcgcaaaagatg

SEQ ID NO: 88852 - DNA, 103 bp, Artificial Sequence
  Synthetic Polynucleotide
taatacgactcactatagggctttccactacataggatagcgattcctttaacagaggagaaaaggaatggctatcctaaacctggcggcagcgcaaaagatg

SEQ ID NO: 88853 - DNA, 103 bp, Artificial Sequence
  Synthetic Polynucleotide
taatacgactcactatagggcttctctatactttccactacataggatagaacagaggagactatccatggtagtggaaaacctggcggcagcgcaaaagatg

SEQ ID NO: 88854 - DNA, 103 bp, Artificial Sequence
  Synthetic Polynucleotide
taatacgactcactatagggactctctactcttctctatactttccactaaacagaggagatagtggatggtatagagaaacctggcggcagcgcaaaagatg

SEQ ID NO: 88855 - DNA, 103 bp, Artificial Sequence
  Synthetic Polynucleotide
taatacgactcactatagggcccagcgtggactctctactcttctctataaacagaggagatatagaatggagtagagaaacctggcggcagcgcaaaagatg

SEQ ID NO: 88856 - DNA, 103 bp, Artificial Sequence
  Synthetic Polynucleotide
taatacgactcactatagggatcccgccggcccagcgtggactctctactaacagaggagaagtagaatgtccacgctgaacctggcggcagcgcaaaagatg

SEQ ID NO: 88857 - DNA, 103 bp, Artificial Sequence
  Synthetic Polynucleotide
taatacgactcactatagggctaaatgattatcccgccggcccagcgtggaacagaggagaccacgcatggccggcgggaacctggcggcagcgcaaaagatg

SEQ ID NO: 88858 - DNA, 103 bp, Artificial Sequence
  Synthetic Polynucleotide
taatacgactcactataggggggagatggactaaatgattatcccgccggaacagaggagaccggcgatgtaatcatttaacctggcggcagcgcaaaagatg

SEQ ID NO: 88859 - DNA, 103 bp, Artificial Sequence
  Synthetic Polynucleotide
taatacgactcactatagggtaatgtaagggggagatggactaaatgattaacagaggagaaatcatatggtccatctcaacctggcggcagcgcaaaagatg

SEQ ID NO: 88860 - DNA, 103 bp, Artificial Sequence
  Synthetic Polynucleotide
taatacgactcactatagggtaaccaaaattaatgtaagggggagatggaaacagaggagatccatcatgcccttacataacctggcggcagcgcaaaagatg

SEQ ID NO: 88861 - DNA, 103 bp, Artificial Sequence
  Synthetic Polynucleotide
taatacgactcactatagggccccagtagagaaagtggtcattattgaccaacagaggagaggtcaaatgtgaccacttaacctggcggcagcgcaaaagatg

SEQ ID NO: 88862 - DNA, 103 bp, Artificial Sequence
  Synthetic Polynucleotide
taatacgactcactatagggcctctcttgttaaccaaaattaatgtaaggaacagaggagaccttacatgaattttggtaacctggcggcagcgcaaaagatg

SEQ ID NO: 88863 - DNA, 103 bp, Artificial Sequence
  Synthetic Polynucleotide
taatacgactcactatagggactggtgtctcctctcttgttaaccaaaataacagaggagaattttgatgaacaagagaaacctggcggcagcgcaaaagatg

SEQ ID NO: 88864 - DNA, 103 bp, Artificial Sequence
  Synthetic Polynucleotide
taatacgactcactataggggagtctctccactggtgtctcctctcttgtaacagaggagaacaagaatggagacaccaaacctggcggcagcgcaaaagatg

SEQ ID NO: 88865 - DNA, 103 bp, Artificial Sequence
  Synthetic Polynucleotide
taatacgactcactatagggaagctatgcagagtctctccactggtgtctaacagaggagaagacacatgtggagagacaacctggcggcagcgcaaaagatg

SEQ ID NO: 88866 - DNA, 103 bp, Artificial Sequence
  Synthetic Polynucleotide
taatacgactcactatagggttgctgtattaagctatgcagagtctctccaacagaggagaggagagatgctgcatagcaacctggcggcagcgcaaaagatg

SEQ ID NO: 88867 - DNA, 103 bp, Artificial Sequence
  Synthetic Polynucleotide
taatacgactcactatagggtttgttgaccttgctgtattaagctatgcaaacagaggagatgcataatgtaatacagcaacctggcggcagcgcaaaagatg

SEQ ID NO: 88868 - DNA, 103 bp, Artificial Sequence
  Synthetic Polynucleotide
taatacgactcactatagggttgctagcaatttgttgaccttgctgtattaacagaggagaaatacaatgaggtcaacaaacctggcggcagcgcaaaagatg

SEQ ID NO: 88869 - DNA, 103 bp, Artificial Sequence
  Synthetic Polynucleotide
taatacgactcactatagggacactgaagtttgctagcaatttgttgaccaacagaggagaggtcaaatgattgctagcaacctggcggcagcgcaaaagatg

SEQ ID NO: 88870 - DNA, 103 bp, Artificial Sequence
  Synthetic Polynucleotide
taatacgactcactatagggcgagaaagacacactgaagtttgctagcaaaacagaggagattgctaatgaacttcagtaacctggcggcagcgcaaaagatg

SEQ ID NO: 88871 - DNA, 103 bp, Artificial Sequence
  Synthetic Polynucleotide
taatacgactcactataggggaagcagggtcgagaaagacacactgaagtaacagaggagaacttcaatgtgtctttctaacctggcggcagcgcaaaagatg

SEQ ID NO: 88872 - DNA, 103 bp, Artificial Sequence
  Synthetic Polynucleotide
taatacgactcactataggggctaacttctccccagtagagaaagtggtcaacagaggagagaccacatgctctactggaacctggcggcagcgcaaaagatg

SEQ ID NO: 88873 - DNA, 103 bp, Artificial Sequence
  Synthetic Polynucleotide
taatacgactcactatagggaatgccagcagaagcagggtcgagaaagacaacagaggagagtctttatggaccctgctaacctggcggcagcgcaaaagatg

SEQ ID NO: 88874 - DNA, 103 bp, Artificial Sequence
  Synthetic Polynucleotide
taatacgactcactataggggtccgtaaccaatgccagcagaagcagggtaacagaggagaaccctgatgctgctggcaaacctggcggcagcgcaaaagatg

SEQ ID NO: 88875 - DNA, 103 bp, Artificial Sequence
  Synthetic Polynucleotide
taatacgactcactatagggttaatgttgcgtccgtaaccaatgccagcaaacagaggagatgctggatgtggttacggaacctggcggcagcgcaaaagatg

SEQ ID NO: 88876 - DNA, 103 bp, Artificial Sequence
  Synthetic Polynucleotide
taatacgactcactatagggttgcttttcattaatgttgcgtccgtaaccaacagaggagaggttacatgcgcaacattaacctggcggcagcgcaaaagatg

SEQ ID NO: 88877 - DNA, 103 bp, Artificial Sequence
  Synthetic Polynucleotide
taatacgactcactatagggcttgactgatttgcttttcattaatgttgcaacagaggagagcaacaatgatgaaaagcaacctggcggcagcgcaaaagatg

SEQ ID NO: 88878 - DNA, 103 bp, Artificial Sequence
  Synthetic Polynucleotide
taatacgactcactatagggcccttcaaaacttgactgatttgcttttcaaacagaggagatgaaaaatgaatcagtcaaacctggcggcagcgcaaaagatg

SEQ ID NO: 88879 - DNA, 103 bp, Artificial Sequence
  Synthetic Polynucleotide
taatacgactcactataggggtccaggagtcccttcaaaacttgactgataacagaggagaatcagtatggttttgaagaacctggcggcagcgcaaaagatg

SEQ ID NO: 88880 - DNA, 103 bp, Artificial Sequence
  Synthetic Polynucleotide
taatacgactcactatagggtacgcttagagtccaggagtcccttcaaaaaacagaggagattttgaatggactcctggaacctggcggcagcgcaaaagatg

SEQ ID NO: 88881 - DNA, 103 bp, Artificial Sequence
  Synthetic Polynucleotide
taatacgactcactatagggaggtttaagttacgcttagagtccaggagtaacagaggagaactcctatgctctaagcgaacctggcggcagcgcaaaagatg

SEQ ID NO: 88882 - DNA, 103 bp, Artificial Sequence
  Synthetic Polynucleotide
taatacgactcactatagggagaactgaccaggtttaagttacgcttagaaacagaggagatctaagatgaacttaaacaacctggcggcagcgcaaaagatg

SEQ ID NO: 88883 - DNA, 103 bp, Artificial Sequence
  Synthetic Polynucleotide
taatacgactcactatagggccagggagcggctaacttctccccagtagaaacagaggagatctactatggagaagttaaacctggcggcagcgcaaaagatg

SEQ ID NO: 88884 - DNA, 103 bp, Artificial Sequence
  Synthetic Polynucleotide
taatacgactcactatagggtgctagcagtagaactgaccaggtttaagtaacagaggagaacttaaatgtggtcagttaacctggcggcagcgcaaaagatg

SEQ ID NO: 88885 - DNA, 103 bp, Artificial Sequence
  Synthetic Polynucleotide
taatacgactcactatagggaaatctttgatgctagcagtagaactgaccaacagaggagaggtcagatgtactgctagaacctggcggcagcgcaaaagatg

SEQ ID NO: 88886 - DNA, 103 bp, Artificial Sequence
  Synthetic Polynucleotide
taatacgactcactatagggaacatcagccaaatctttgatgctagcagtaacagaggagaactgctatgatcaaagataacctggcggcagcgcaaaagatg

SEQ ID NO: 88887 - DNA, 103 bp, Artificial Sequence
  Synthetic Polynucleotide
taatacgactcactatagggttcgcagatcaacatcagccaaatctttgaaacagaggagatcaaagatgtggctgatgaacctggcggcagcgcaaaagatg

SEQ ID NO: 88888 - DNA, 103 bp, Artificial Sequence
  Synthetic Polynucleotide
taatacgactcactatagggcacataacaattcgcagatcaacatcagccaacagaggagaggctgaatgtgatctgcgaacctggcggcagcgcaaaagatg

SEQ ID NO: 88889 - DNA, 103 bp, Artificial Sequence
  Synthetic Polynucleotide
taatacgactcactatagggacacatcagacacataacaattcgcagatcaacagaggagagatctgatgattgttatgaacctggcggcagcgcaaaagatg

SEQ ID NO: 88890 - DNA, 103 bp, Artificial Sequence
  Synthetic Polynucleotide
taatacgactcactatagggaaggatctccacacatcagacacataacaaaacagaggagattgttaatggtctgatgtaacctggcggcagcgcaaaagatg

SEQ ID NO: 88891 - DNA, 103 bp, Artificial Sequence
  Synthetic Polynucleotide
taatacgactcactatagggtctgcactaaaaggatctccacacatcagaaacagaggagatctgatatgtggagatccaacctggcggcagcgcaaaagatg

SEQ ID NO: 88892 - DNA, 103 bp, Artificial Sequence
  Synthetic Polynucleotide
taatacgactcactatagggaagtatgtcatctgcactaaaaggatctccaacagaggagaggagatatgtttagtgcaaacctggcggcagcgcaaaagatg

SEQ ID NO: 88893 - DNA, 103 bp, Artificial Sequence
  Synthetic Polynucleotide
taatacgactcactatagggggacaggaaaaagtatgtcatctgcactaaaacagaggagattagtgatgatgacatacaacctggcggcagcgcaaaagatg

SEQ ID NO: 88894 - DNA, 103 bp, Artificial Sequence
  Synthetic Polynucleotide
taatacgactcactatagggacacaatcctccagggagcggctaacttctaacagaggagaagaagtatgccgctccctaacctggcggcagcgcaaaagatg

SEQ ID NO: 88895 - DNA, 103 bp, Artificial Sequence
  Synthetic Polynucleotide
taatacgactcactatagggtgggactgaaggacaggaaaaagtatgtcaaacagaggagatgacatatgttttcctgtaacctggcggcagcgcaaaagatg

SEQ ID NO: 88896 - DNA, 103 bp, Artificial Sequence
  Synthetic Polynucleotide
taatacgactcactatagggtttacaggtttgggactgaaggacaggaaaaacagaggagatttcctatgcttcagtccaacctggcggcagcgcaaaagatg

SEQ ID NO: 88897 - DNA, 103 bp, Artificial Sequence
  Synthetic Polynucleotide
taatacgactcactatagggaatgggaagatttacaggtttgggactgaaaacagaggagattcagtatgaaacctgtaaacctggcggcagcgcaaaagatg

SEQ ID NO: 88898 - DNA, 103 bp, Artificial Sequence
  Synthetic Polynucleotide
taatacgactcactatagggttgcttccacaatgggaagatttacaggttaacagaggagaaacctgatgatcttcccaaacctggcggcagcgcaaaagatg

SEQ ID NO: 88899 - DNA, 103 bp, Artificial Sequence
  Synthetic Polynucleotide
taatacgactcactatagggaacagagttgttgcttccacaatgggaagaaacagaggagatcttccatgtgtggaagcaacctggcggcagcgcaaaagatg

SEQ ID NO: 88900 - DNA, 103 bp, Artificial Sequence
  Synthetic Polynucleotide
taatacgactcactataggggttcaagtaaaacagagttgttgcttccacaacagaggagagtggaaatgacaactctgaacctggcggcagcgcaaaagatg

SEQ ID NO: 88901 - DNA, 103 bp, Artificial Sequence
  Synthetic Polynucleotide
taatacgactcactatagggccgattggtagttcaagtaaaacagagttgaacagaggagacaactcatgtttacttgaaacctggcggcagcgcaaaagatg

SEQ ID NO: 88902 - DNA, 103 bp, Artificial Sequence
  Synthetic Polynucleotide
taatacgactcactatagggcttgtgcagtccgattggtagttcaagtaaaacagaggagattacttatgctaccaatcaacctggcggcagcgcaaaagatg

SEQ ID NO: 88903 - DNA, 103 bp, Artificial Sequence
  Synthetic Polynucleotide
taatacgactcactatagggcaatccgcttcttgtgcagtccgattggtaaacagaggagataccaaatggactgcacaaacctggcggcagcgcaaaagatg

SEQ ID NO: 88904 - DNA, 103 bp, Artificial Sequence
  Synthetic Polynucleotide
taatacgactcactatagggacagacagttcaatccgcttcttgtgcagtaacagaggagaactgcaatggaagcggataacctggcggcagcgcaaaagatg

SEQ ID NO: 88905 - DNA, 103 bp, Artificial Sequence
  Synthetic Polynucleotide
taatacgactcactatagggcttacattccacacaatcctccagggagcgaacagaggagacgctccatggaggattgtaacctggcggcagcgcaaaagatg

SEQ ID NO: 88906 - DNA, 103 bp, Artificial Sequence
  Synthetic Polynucleotide
taatacgactcactataggggtatgaaagaacagacagttcaatccgcttaacagaggagaaagcggatggaactgtctaacctggcggcagcgcaaaagatg

SEQ ID NO: 88907 - DNA, 103 bp, Artificial Sequence
  Synthetic Polynucleotide
taatacgactcactatagggaggaggaatggtatgaaagaacagacagttaacagaggagaaactgtatgttctttcataacctggcggcagcgcaaaagatg

SEQ ID NO: 88908 - DNA, 103 bp, Artificial Sequence
  Synthetic Polynucleotide
taatacgactcactatagggctgatgctaaaggaggaatggtatgaaagaaacagaggagatctttcatgccattcctcaacctggcggcagcgcaaaagatg

SEQ ID NO: 88909 - DNA, 103 bp, Artificial Sequence
  Synthetic Polynucleotide
taatacgactcactatagggccggctctttctgatgctaaaggaggaatgaacagaggagacattccatgtttagcatcaacctggcggcagcgcaaaagatg

SEQ ID NO: 88910 - DNA, 103 bp, Artificial Sequence
  Synthetic Polynucleotide
taatacgactcactatagggcatgaaccaaccggctctttctgatgctaaaacagaggagattagcaatggaaagagccaacctggcggcagcgcaaaagatg

SEQ ID NO: 88911 - DNA, 103 bp, Artificial Sequence
  Synthetic Polynucleotide
taatacgactcactatagggacaatgtacccatgaaccaaccggctctttaacagaggagaaaagagatggttggttcaaacctggcggcagcgcaaaagatg

SEQ ID NO: 88912 - DNA, 103 bp, Artificial Sequence
  Synthetic Polynucleotide
taatacgactcactatagggtgaataaaaaacaatgtacccatgaaccaaaacagaggagattggttatggggtacattaacctggcggcagcgcaaaagatg

SEQ ID NO: 88913 - DNA, 103 bp, Artificial Sequence
  Synthetic Polynucleotide
taatacgactcactatagggtacgtttggctgaataaaaaacaatgtaccaacagaggagaggtacaatgttttttattaacctggcggcagcgcaaaagatg

SEQ ID NO: 88914 - DNA, 103 bp, Artificial Sequence
  Synthetic Polynucleotide
taatacgactcactatagggaaagaggccttacgtttggctgaataaaaaaacagaggagatttttaatgagccaaacgaacctggcggcagcgcaaaagatg

SEQ ID NO: 88915 - DNA, 103 bp, Artificial Sequence
  Synthetic Polynucleotide
taatacgactcactatagggtaacatagccaaagaggccttacgtttggcaacagaggagagccaaaatgaaggcctctaacctggcggcagcgcaaaagatg

SEQ ID NO: 88916 - DNA, 103 bp, Artificial Sequence
  Synthetic Polynucleotide
taatacgactcactatagggcaatgtgcatcttacattccacacaatcctaacagaggagaaggattatgtggaatgtaaacctggcggcagcgcaaaagatg

SEQ ID NO: 88917 - DNA, 103 bp, Artificial Sequence
  Synthetic Polynucleotide
taatacgactcactataggggaaaggcacgtaacatagccaaagaggcctaacagaggagaaggcctatgtggctatgtaacctggcggcagcgcaaaagatg

SEQ ID NO: 88918 - DNA, 103 bp, Artificial Sequence
  Synthetic Polynucleotide
taatacgactcactatagggacttcacaaagaaaggcacgtaacatagccaacagaggagaggctatatgacgtgccttaacctggcggcagcgcaaaagatg

SEQ ID NO: 88919 - DNA, 103 bp, Artificial Sequence
  Synthetic Polynucleotide
taatacgactcactatagggaatatcctgcacttcacaaagaaaggcacgaacagaggagacgtgccatgctttgtgaaaacctggcggcagcgcaaaagatg

SEQ ID NO: 88920 - DNA, 103 bp, Artificial Sequence
  Synthetic Polynucleotide
taatacgactcactataggggaatagggataatatcctgcacttcacaaaaacagaggagatttgtgatgtgcaggataaacctggcggcagcgcaaaagatg

SEQ ID NO: 88921 - DNA, 103 bp, Artificial Sequence
  Synthetic Polynucleotide
taatacgactcactataggggctacaagctgaatagggataatatcctgcaacagaggagagcaggaatgtatccctataacctggcggcagcgcaaaagatg

SEQ ID NO: 88922 - DNA, 103 bp, Artificial Sequence
  Synthetic Polynucleotide
taatacgactcactatagggatcagtgagtgctacaagctgaatagggataacagaggagaatccctatgcagcttgtaaacctggcggcagcgcaaaagatg

SEQ ID NO: 88923 - DNA, 103 bp, Artificial Sequence
  Synthetic Polynucleotide
taatacgactcactatagggctacagcgccatcagtgagtgctacaagctaacagaggagaagcttgatgcactcactgaacctggcggcagcgcaaaagatg

SEQ ID NO: 88924 - DNA, 103 bp, Artificial Sequence
  Synthetic Polynucleotide
taatacgactcactatagggtccaggacatctacagcgccatcagtgagtaacagaggagaactcacatgtggcgctgtaacctggcggcagcgcaaaagatg

SEQ ID NO: 88925 - DNA, 103 bp, Artificial Sequence
  Synthetic Polynucleotide
taatacgactcactatagggtaagtcattgtccaggacatctacagcgccaacagaggagaggcgctatggatgtcctgaacctggcggcagcgcaaaagatg

SEQ ID NO: 88926 - DNA, 103 bp, Artificial Sequence
  Synthetic Polynucleotide
taatacgactcactataggggttccctacttaagtcattgtccaggacataacagaggagaatgtccatgacaatgactaacctggcggcagcgcaaaagatg

SEQ ID NO: 88927 - DNA, 103 bp, Artificial Sequence
  Synthetic Polynucleotide
taatacgactcactataggggtctgctccacaatgtgcatcttacattccaacagaggagaggaatgatggatgcacataacctggcggcagcgcaaaagatg

SEQ ID NO: 88928 - DNA, 103 bp, Artificial Sequence
  Synthetic Polynucleotide
taatacgactcactatagggtcagttagctgttccctacttaagtcattgaacagaggagacaatgaatgaagtagggaaacctggcggcagcgcaaaagatg

SEQ ID NO: 88929 - DNA, 103 bp, Artificial Sequence
  Synthetic Polynucleotide
taatacgactcactatagggctcctccccctcagttagctgttccctactaacagaggagaagtaggatgcagctaactaacctggcggcagcgcaaaagatg

SEQ ID NO: 88930 - DNA, 103 bp, Artificial Sequence
  Synthetic Polynucleotide
taatacgactcactatagggcttgagcaatctcctccccctcagttagctaacagaggagaagctaaatgagggggaggaacctggcggcagcgcaaaagatg

SEQ ID NO: 88931 - DNA, 103 bp, Artificial Sequence
  Synthetic Polynucleotide
taatacgactcactatagggccgtcaatttcttgagcaatctcctcccccaacagaggagagggggaatggattgctcaaacctggcggcagcgcaaaagatg

SEQ ID NO: 88932 - DNA, 103 bp, Artificial Sequence
  Synthetic Polynucleotide
taatacgactcactatagggtgtgaaccttccgtcaatttcttgagcaataacagaggagaattgctatggaaattgacaacctggcggcagcgcaaaagatg

SEQ ID NO: 88933 - DNA, 103 bp, Artificial Sequence
  Synthetic Polynucleotide
taatacgactcactatagggaggggatgcttgtgaaccttccgtcaatttaacagaggagaaaattgatggaaggttcaaacctggcggcagcgcaaaagatg

SEQ ID NO: 88934 - DNA, 103 bp, Artificial Sequence
  Synthetic Polynucleotide
taatacgactcactatagggggttggctacaggggatgcttgtgaaccttaacagaggagaaaggttatgaagcatcccaacctggcggcagcgcaaaagatg

SEQ ID NO: 88935 - DNA, 103 bp, Artificial Sequence
  Synthetic Polynucleotide
taatacgactcactatagggtttatgctggggttggctacaggggatgctaacagaggagaagcatcatgtgtagccaaaacctggcggcagcgcaaaagatg

SEQ ID NO: 88936 - DNA, 103 bp, Artificial Sequence
  Synthetic Polynucleotide
taatacgactcactatagggagatctcaagtttatgctggggttggctacaacagaggagagtagccatgcccagcataaacctggcggcagcgcaaaagatg

SEQ ID NO: 88937 - DNA, 103 bp, Artificial Sequence
  Synthetic Polynucleotide
taatacgactcactatagggaatgggtgaaagatctcaagtttatgctggaacagaggagaccagcaatgacttgagataacctggcggcagcgcaaaagatg

SEQ ID NO: 88938 - DNA, 103 bp, Artificial Sequence
  Synthetic Polynucleotide
taatacgactcactatagggaataaattcagtctgctccacaatgtgcataacagaggagaatgcacatggtggagcagaacctggcggcagcgcaaaagatg

SEQ ID NO: 88939 - DNA, 103 bp, Artificial Sequence
  Synthetic Polynucleotide
taatacgactcactatagggatctttaaaaaatgggtgaaagatctcaagaacagaggagacttgagatgtttcacccaaacctggcggcagcgcaaaagatg

SEQ ID NO: 88940 - DNA, 103 bp, Artificial Sequence
  Synthetic Polynucleotide
taatacgactcactatagggtttccaccacatctttaaaaaatgggtgaaaacagaggagattcaccatgtttttaaagaacctggcggcagcgcaaaagatg

SEQ ID NO: 88941 - DNA, 103 bp, Artificial Sequence
  Synthetic Polynucleotide
taatacgactcactatagggatgttctttttttccaccacatctttaaaaaacagaggagattttaaatgtgtggtggaaacctggcggcagcgcaaaagatg

SEQ ID NO: 88942 - DNA, 103 bp, Artificial Sequence
  Synthetic Polynucleotide
taatacgactcactatagggagcctcgattatgttctttttttccaccacaacagaggagagtggtgatgaaaaagaacaacctggcggcagcgcaaaagatg

SEQ ID NO: 88943 - DNA, 103 bp, Artificial Sequence
  Synthetic Polynucleotide
taatacgactcactatagggacatatgagtagcctcgattatgttcttttaacagaggagaaaaagaatgtaatcgaggaacctggcggcagcgcaaaagatg

SEQ ID NO: 88944 - DNA, 103 bp, Artificial Sequence
  Synthetic Polynucleotide
taatacgactcactataggggcattatcgtacatatgagtagcctcgattaacagaggagaaatcgaatgtactcatataacctggcggcagcgcaaaagatg

SEQ ID NO: 88945 - DNA, 103 bp, Artificial Sequence
  Synthetic Polynucleotide
taatacgactcactatagggggcctcggcagcattatcgtacatatgagtaacagaggagaactcatatgtacgataataacctggcggcagcgcaaaagatg

SEQ ID NO: 88946 - DNA, 103 bp, Artificial Sequence
  Synthetic Polynucleotide
taatacgactcactatagggtggtgctacaggcctcggcagcattatcgtaacagaggagaacgataatgctgccgaggaacctggcggcagcgcaaaagatg

SEQ ID NO: 88947 - DNA, 103 bp, Artificial Sequence
  Synthetic Polynucleotide
taatacgactcactatagggacctcttcggtggtgctacaggcctcggcaaacagaggagatgccgaatgctgtagcacaacctggcggcagcgcaaaagatg

SEQ ID NO: 88948 - DNA, 103 bp, Artificial Sequence
  Synthetic Polynucleotide
taatacgactcactatagggggagttaaacacctcttcggtggtgctacaaacagaggagatgtagcatgaccgaagagaacctggcggcagcgcaaaagatg

SEQ ID NO: 88949 - DNA, 103 bp, Artificial Sequence
  Synthetic Polynucleotide
taatacgactcactatagggtctgatcatcaataaattcagtctgctccaaacagaggagatggagcatgctgaatttaaacctggcggcagcgcaaaagatg

SEQ ID NO: 88950 - DNA, 103 bp, Artificial Sequence
  Synthetic Polynucleotide
taatacgactcactatagggctgcccggggggagttaaacacctcttcggaacagaggagaccgaagatgtgtttaactaacctggcggcagcgcaaaagatg

SEQ ID NO: 88951 - DNA, 103 bp, Artificial Sequence
  Synthetic Polynucleotide
taatacgactcactatagggagcggtgatcctgcccggggggagttaaacaacagaggagagtttaaatgcccccgggcaacctggcggcagcgcaaaagatg

SEQ ID NO: 88952 - DNA, 103 bp, Artificial Sequence
  Synthetic Polynucleotide
taatacgactcactatagggtgagttgcagagcggtgatcctgcccggggaacagaggagaccccggatgggatcaccgaacctggcggcagcgcaaaagatg

SEQ ID NO: 88953 - DNA, 103 bp, Artificial Sequence
  Synthetic Polynucleotide
taatacgactcactatagggcctgcaggtttgagttgcagagcggtgatcaacagaggagagatcacatgtctgcaactaacctggcggcagcgcaaaagatg

SEQ ID NO: 88954 - DNA, 103 bp, Artificial Sequence
  Synthetic Polynucleotide
taatacgactcactatagggtcttctgaatcctgcaggtttgagttgcagaacagaggagactgcaaatgaaacctgcaaacctggcggcagcgcaaaagatg

SEQ ID NO: 88955 - DNA, 103 bp, Artificial Sequence
  Synthetic Polynucleotide
taatacgactcactatagggctcgatatcttcttctgaatcctgcaggttaacagaggagaaacctgatggattcagaaaacctggcggcagcgcaaaagatg

SEQ ID NO: 88956 - DNA, 103 bp, Artificial Sequence
  Synthetic Polynucleotide
taatacgactcactatagggtgtaagatggctcgatatcttcttctgaataacagaggagaattcagatgaagatatcgaacctggcggcagcgcaaaagatg

SEQ ID NO: 88957 - DNA, 103 bp, Artificial Sequence
  Synthetic Polynucleotide
taatacgactcactatagggcgaaacaggctgtaagatggctcgatatctaacagaggagaagatatatggccatcttaaacctggcggcagcgcaaaagatg

SEQ ID NO: 88958 - DNA, 103 bp, Artificial Sequence
  Synthetic Polynucleotide
taatacgactcactatagggtgtgtcttctcgaaacaggctgtaagatggaacagaggagaccatctatgagcctgtttaacctggcggcagcgcaaaagatg

SEQ ID NO: 88959 - DNA, 103 bp, Artificial Sequence
  Synthetic Polynucleotide
taatacgactcactatagggaaggcagtgatgtgtcttctcgaaacaggcaacagaggagagcctgtatggagaagacaaacctggcggcagcgcaaaagatg

SEQ ID NO: 88960 - DNA, 103 bp, Artificial Sequence
  Synthetic Polynucleotide
taatacgactcactatagggctgatgttgtaggtgggaattcggacatctaacagaggagaagatgtatgaattcccacaacctggcggcagcgcaaaagatg

SEQ ID NO: 88961 - DNA, 103 bp, Artificial Sequence
  Synthetic Polynucleotide
taatacgactcactatagggggttgaaaagtctgatcatcaataaattcaaacagaggagatgaattatgtgatgatcaaacctggcggcagcgcaaaagatg

SEQ ID NO: 88962 - DNA, 103 bp, Artificial Sequence
  Synthetic Polynucleotide
taatacgactcactatagggttggacagagaaggcagtgatgtgtcttctaacagaggagaagaagaatgatcactgccaacctggcggcagcgcaaaagatg

SEQ ID NO: 88963 - DNA, 103 bp, Artificial Sequence
  Synthetic Polynucleotide
taatacgactcactatagggagaatggtctttggacagagaaggcagtgaaacagaggagatcactgatgtctctgtccaacctggcggcagcgcaaaagatg

SEQ ID NO: 88964 - DNA, 103 bp, Artificial Sequence
  Synthetic Polynucleotide
taatacgactcactatagggtagagagcttagaatggtctttggacagagaacagaggagactctgtatgaagaccattaacctggcggcagcgcaaaagatg

SEQ ID NO: 88965 - DNA, 103 bp, Artificial Sequence
  Synthetic Polynucleotide
taatacgactcactatagggtccagttccatagagagcttagaatggtctaacagaggagaagaccaatgtaagctctcaacctggcggcagcgcaaaagatg

SEQ ID NO: 88966 - DNA, 103 bp, Artificial Sequence
  Synthetic Polynucleotide
taatacgactcactatagggatcatttccctccagttccatagagagcttaacagaggagaaagctcatgatggaactgaacctggcggcagcgcaaaagatg

SEQ ID NO: 88967 - DNA, 103 bp, Artificial Sequence
  Synthetic Polynucleotide
taatacgactcactatagggaagacagcccatcatttccctccagttccaaacagaggagatggaacatgagggaaatgaacctggcggcagcgcaaaagatg

SEQ ID NO: 88968 - DNA, 103 bp, Artificial Sequence
  Synthetic Polynucleotide
taatacgactcactatagggctcataatgaaagacagcccatcatttcccaacagaggagagggaaaatgtgggctgtcaacctggcggcagcgcaaaagatg

SEQ ID NO: 88969 - DNA, 103 bp, Artificial Sequence
  Synthetic Polynucleotide
taatacgactcactatagggctcaaaattgctcataatgaaagacagcccaacagaggagagggctgatgttcattatgaacctggcggcagcgcaaaagatg

SEQ ID NO: 88970 - DNA, 103 bp, Artificial Sequence
  Synthetic Polynucleotide
taatacgactcactatagggtcagtttactctcaaaattgctcataatgaaacagaggagatcattaatggcaattttgaacctggcggcagcgcaaaagatg

SEQ ID NO: 88971 - DNA, 103 bp, Artificial Sequence
  Synthetic Polynucleotide
taatacgactcactatagggactttgttgttcagtttactctcaaaattgaacagaggagacaatttatggagtaaactaacctggcggcagcgcaaaagatg

SEQ ID NO: 88972 - DNA, 103 bp, Artificial Sequence
  Synthetic Polynucleotide
taatacgactcactataggggcttcgatgaggttgaaaagtctgatcatcaacagaggagagatgatatgacttttcaaaacctggcggcagcgcaaaagatg

SEQ ID NO: 88973 - DNA, 103 bp, Artificial Sequence
  Synthetic Polynucleotide
taatacgactcactatagggtggcggaggtactttgttgttcagtttactaacagaggagaagtaaaatgaacaacaaaaacctggcggcagcgcaaaagatg

SEQ ID NO: 88974 - DNA, 103 bp, Artificial Sequence
  Synthetic Polynucleotide
taatacgactcactatagggttggtttgactggcggaggtactttgttgtaacagaggagaacaacaatgtacctccgcaacctggcggcagcgcaaaagatg

SEQ ID NO: 88975 - DNA, 103 bp, Artificial Sequence
  Synthetic Polynucleotide
taatacgactcactatagggacaggaggctttggtttgactggcggaggtaacagaggagaacctccatgagtcaaaccaacctggcggcagcgcaaaagatg

SEQ ID NO: 88976 - DNA, 103 bp, Artificial Sequence
  Synthetic Polynucleotide
taatacgactcactatagggttcaaaatggacaggaggctttggtttgacaacagaggagagtcaaaatgaagcctcctaacctggcggcagcgcaaaagatg

SEQ ID NO: 88977 - DNA, 103 bp, Artificial Sequence
  Synthetic Polynucleotide
taatacgactcactatagggcctttgtaatttcaaaatggacaggaggctaacagaggagaagcctcatgtccattttgaacctggcggcagcgcaaaagatg

SEQ ID NO: 88978 - DNA, 103 bp, Artificial Sequence
  Synthetic Polynucleotide
taatacgactcactataggggatagatccccctttgtaatttcaaaatggaacagaggagaccatttatgaattacaaaaacctggcggcagcgcaaaagatg

SEQ ID NO: 88979 - DNA, 103 bp, Artificial Sequence
  Synthetic Polynucleotide
taatacgactcactataggggtctaaataagatagatccccctttgtaataacagaggagaattacaatgggggatctaaacctggcggcagcgcaaaagatg

SEQ ID NO: 88980 - DNA, 103 bp, Artificial Sequence
  Synthetic Polynucleotide
taatacgactcactatagggtatggccttggtctaaataagatagatcccaacagaggagagggatcatgcttatttagaacctggcggcagcgcaaaagatg

SEQ ID NO: 88981 - DNA, 103 bp, Artificial Sequence
  Synthetic Polynucleotide
taatacgactcactatagggtgtccatccctatggccttggtctaaataaaacagaggagattatttatgccaaggccaaacctggcggcagcgcaaaagatg

SEQ ID NO: 88982 - DNA, 103 bp, Artificial Sequence
  Synthetic Polynucleotide
taatacgactcactatagggagacttcctctgtccatccctatggccttgaacagaggagacaaggcatgagggatggaaacctggcggcagcgcaaaagatg

SEQ ID NO: 88983 - DNA, 103 bp, Artificial Sequence
  Synthetic Polynucleotide
taatacgactcactataggggcagggccgtgcttcgatgaggttgaaaagaacagaggagacttttcatgctcatcgaaaacctggcggcagcgcaaaagatg

SEQ ID NO: 88984 - DNA, 103 bp, Artificial Sequence
  Synthetic Polynucleotide
taatacgactcactatagggtagaagacacagacttcctctgtccatcccaacagaggagagggatgatgagaggaagtaacctggcggcagcgcaaaagatg

SEQ ID NO: 88985 - DNA, 103 bp, Artificial Sequence
  Synthetic Polynucleotide
taatacgactcactatagggagccaggggctagaagacacagacttcctcaacagaggagagaggaaatgtgtgtcttcaacctggcggcagcgcaaaagatg

SEQ ID NO: 88986 - DNA, 103 bp, Artificial Sequence
  Synthetic Polynucleotide
taatacgactcactatagggatcctgaggcagccaggggctagaagacacaacagaggagagtgtctatgagcccctggaacctggcggcagcgcaaaagatg

SEQ ID NO: 88987 - DNA, 103 bp, Artificial Sequence
  Synthetic Polynucleotide
taatacgactcactataggggatcaaacccatcctgaggcagccaggggcaacagaggagagcccctatgtgcctcaggaacctggcggcagcgcaaaagatg

SEQ ID NO: 88988 - DNA, 103 bp, Artificial Sequence
  Synthetic Polynucleotide
taatacgactcactatagggtagtcagaaggatcaaacccatcctgaggcaacagaggagagcctcaatgtgggtttgaaacctggcggcagcgcaaaagatg

SEQ ID NO: 88989 - DNA, 103 bp, Artificial Sequence
  Synthetic Polynucleotide
taatacgactcactataggggggttcagcatagtcagaaggatcaaacccaacagaggagagggtttatgccttctgacaacctggcggcagcgcaaaagatg

SEQ ID NO: 88990 - DNA, 103 bp, Artificial Sequence
  Synthetic Polynucleotide
taatacgactcactatagggcagcatccatgggttcagcatagtcagaagaacagaggagacttctgatgatgctgaacaacctggcggcagcgcaaaagatg

SEQ ID NO: 88991 - DNA, 103 bp, Artificial Sequence
  Synthetic Polynucleotide
taatacgactcactatagggggcttcaccacagcatccatgggttcagcaaacagaggagatgctgaatgcatggatgcaacctggcggcagcgcaaaagatg

SEQ ID NO: 88992 - DNA, 103 bp, Artificial Sequence
  Synthetic Polynucleotide
taatacgactcactatagggttcattccttggcttcaccacagcatccataacagaggagaatggatatggtggtgaagaacctggcggcagcgcaaaagatg

SEQ ID NO: 88993 - DNA, 103 bp, Artificial Sequence
  Synthetic Polynucleotide
taatacgactcactatagggtgttttcttcttcattccttggcttcaccaaacagaggagatggtgaatgcaaggaatgaacctggcggcagcgcaaaagatg

SEQ ID NO: 88994 - DNA, 103 bp, Artificial Sequence
  Synthetic Polynucleotide
taatacgactcactatagggatatagggctgcagggccgtgcttcgatgaaacagaggagatcatcgatgcacggccctaacctggcggcagcgcaaaagatg

SEQ ID NO: 88995 - DNA, 103 bp, Artificial Sequence
  Synthetic Polynucleotide
taatacgactcactatagggacggagtatatgttttcttcttcattccttaacagaggagaaaggaaatgagaagaaaaaacctggcggcagcgcaaaagatg

SEQ ID NO: 88996 - DNA, 103 bp, Artificial Sequence
  Synthetic Polynucleotide
taatacgactcactataggggtcatggggcacggagtatatgttttcttcaacagaggagagaagaaatgatatactccaacctggcggcagcgcaaaagatg

SEQ ID NO: 88997 - DNA, 103 bp, Artificial Sequence
  Synthetic Polynucleotide
taatacgactcactatagggcttgggtgctgtcatggggcacggagtataaacagaggagatatactatgtgccccatgaacctggcggcagcgcaaaagatg

SEQ ID NO: 88998 - DNA, 103 bp, Artificial Sequence
  Synthetic Polynucleotide
taatacgactcactatagggatgattttgccttgggtgctgtcatggggcaacagaggagagccccaatgcagcacccaaacctggcggcagcgcaaaagatg

SEQ ID NO: 88999 - DNA, 103 bp, Artificial Sequence
  Synthetic Polynucleotide
taatacgactcactatagggccgaatggtgatgattttgccttgggtgctaacagaggagaagcaccatgggcaaaatcaacctggcggcagcgcaaaagatg

SEQ ID NO: 89000 - DNA, 103 bp, Artificial Sequence
  Synthetic Polynucleotide
taatacgactcactatagggtgttgatattccgaatggtgatgattttgcaacagaggagagcaaaaatgtcaccattcaacctggcggcagcgcaaaagatg

SEQ ID NO: 89001 - DNA, 103 bp, Artificial Sequence
  Synthetic Polynucleotide
taatacgactcactataggggactgggctttgttgatattccgaatggtgaacagaggagacaccatatggaatatcaaaacctggcggcagcgcaaaagatg

SEQ ID NO: 89002 - DNA, 103 bp, Artificial Sequence
  Synthetic Polynucleotide
taatacgactcactataggggctgccgttggactgggctttgttgatattaacagaggagaaatatcatgaaagcccagaacctggcggcagcgcaaaagatg

SEQ ID NO: 89003 - DNA, 103 bp, Artificial Sequence
  Synthetic Polynucleotide
taatacgactcactatagggaaccattcccgctgccgttggactgggcttaacagaggagaaagcccatgccaacggcaaacctggcggcagcgcaaaagatg

SEQ ID NO: 89004 - DNA, 103 bp, Artificial Sequence
  Synthetic Polynucleotide
taatacgactcactatagggtcactgtcagaaccattcccgctgccgttgaacagaggagacaacggatgcgggaatggaacctggcggcagcgcaaaagatg

SEQ ID NO: 89005 - DNA, 103 bp, Artificial Sequence
  Synthetic Polynucleotide
taatacgactcactatagggagctctcttgatatagggctgcagggccgtaacagaggagaacggccatgcagccctataacctggcggcagcgcaaaagatg

SEQ ID NO: 89006 - DNA, 103 bp, Artificial Sequence
  Synthetic Polynucleotide
taatacgactcactatagggggtgtccatttcactgtcagaaccattcccaacagaggagagggaatatgtctgacagtaacctggcggcagcgcaaaagatg

SEQ ID NO: 89007 - DNA, 103 bp, Artificial Sequence
  Synthetic Polynucleotide
taatacgactcactatagggctagagagctggtgtccatttcactgtcagaacagaggagactgacaatgaaatggacaaacctggcggcagcgcaaaagatg

SEQ ID NO: 89008 - DNA, 103 bp, Artificial Sequence
  Synthetic Polynucleotide
taatacgactcactatagggcgccctcgctctagagagctggtgtccattaacagaggagaaatggaatgcagctctctaacctggcggcagcgcaaaagatg

SEQ ID NO: 89009 - DNA, 103 bp, Artificial Sequence
  Synthetic Polynucleotide
taatacgactcactatagggggaaaccttgcgccctcgctctagagagctaacagaggagaagctctatggagcgagggaacctggcggcagcgcaaaagatg

SEQ ID NO: 89010 - DNA, 103 bp, Artificial Sequence
  Synthetic Polynucleotide
taatacgactcactatagggtgctcacgatggaaaccttgcgccctcgctaacagaggagaagcgagatggcaaggtttaacctggcggcagcgcaaaagatg

SEQ ID NO: 89011 - DNA, 103 bp, Artificial Sequence
  Synthetic Polynucleotide
taatacgactcactatagggagcactggcttgctcacgatggaaaccttgaacagaggagacaaggtatgcatcgtgagaacctggcggcagcgcaaaagatg

SEQ ID NO: 89012 - DNA, 103 bp, Artificial Sequence
  Synthetic Polynucleotide
taatacgactcactatagggcgtcctgtacagcactggcttgctcacgataacagaggagaatcgtgatgaagccagtgaacctggcggcagcgcaaaagatg

SEQ ID NO: 89013 - DNA, 103 bp, Artificial Sequence
  Synthetic Polynucleotide
taatacgactcactataggggggtgcatctcgtcctgtacagcactggctaacagaggagaagccagatgtgtacaggaaacctggcggcagcgcaaaagatg

SEQ ID NO: 89014 - DNA, 103 bp, Artificial Sequence
  Synthetic Polynucleotide
taatacgactcactatagggcgccccagccgggtgcatctcgtcctgtacaacagaggagagtacagatggagatgcacaacctggcggcagcgcaaaagatg

SEQ ID NO: 89015 - DNA, 103 bp, Artificial Sequence
  Synthetic Polynucleotide
taatacgactcactatagggactagcaaaccgccccagccgggtgcatctaacagaggagaagatgcatgcggctggggaacctggcggcagcgcaaaagatg

SEQ ID NO: 89016 - DNA, 103 bp, Artificial Sequence
  Synthetic Polynucleotide
taatacgactcactatagggtggtcgcagcagctctcttgatatagggctaacagaggagaagccctatgtcaagagagaacctggcggcagcgcaaaagatg

SEQ ID NO: 89017 - DNA, 103 bp, Artificial Sequence
  Synthetic Polynucleotide
taatacgactcactatagggtggtccggtaactagcaaaccgccccagccaacagaggagaggctggatgggtttgctaaacctggcggcagcgcaaaagatg

SEQ ID NO: 89018 - DNA, 103 bp, Artificial Sequence
  Synthetic Polynucleotide
taatacgactcactatagggacgctgaagctggtccggtaactagcaaacaacagaggagagtttgcatgttaccggacaacctggcggcagcgcaaaagatg

SEQ ID NO: 89019 - DNA, 103 bp, Artificial Sequence
  Synthetic Polynucleotide
taatacgactcactatagggatcactccccacgctgaagctggtccggtaaacagaggagataccggatgagcttcagcaacctggcggcagcgcaaaagatg

SEQ ID NO: 89020 - DNA, 103 bp, Artificial Sequence
  Synthetic Polynucleotide
taatacgactcactatagggccagctcatcatcactccccacgctgaagcaacagaggagagcttcaatgtggggagtgaacctggcggcagcgcaaaagatg

SEQ ID NO: 89021 - DNA, 103 bp, Artificial Sequence
  Synthetic Polynucleotide
taatacgactcactatagggcggatgggccccagctcatcatcactccccaacagaggagaggggagatgtgatgagctaacctggcggcagcgcaaaagatg

SEQ ID NO: 89022 - DNA, 103 bp, Artificial Sequence
  Synthetic Polynucleotide
taatacgactcactatagggctctttcttccggatgggccccagctcatcaacagaggagagatgagatggggcccatcaacctggcggcagcgcaaaagatg

SEQ ID NO: 89023 - DNA, 103 bp, Artificial Sequence
  Synthetic Polynucleotide
taatacgactcactatagggcctgatcctcctctttcttccggatgggccaacagaggagaggcccaatgggaagaaagaacctggcggcagcgcaaaagatg

SEQ ID NO: 89024 - DNA, 103 bp, Artificial Sequence
  Synthetic Polynucleotide
taatacgactcactatagggccctgggatgcctgatcctcctctttcttcaacagaggagagaagaaatgggaggatcaaacctggcggcagcgcaaaagatg

SEQ ID NO: 89025 - DNA, 103 bp, Artificial Sequence
  Synthetic Polynucleotide
taatacgactcactatagggccctttataaccctgggatgcctgatcctcaacagaggagagaggatatggcatcccagaacctggcggcagcgcaaaagatg

SEQ ID NO: 89026 - DNA, 103 bp, Artificial Sequence
  Synthetic Polynucleotide
taatacgactcactatagggcagcattgtcccctttataaccctgggatgaacagaggagacatcccatggttataaagaacctggcggcagcgcaaaagatg

SEQ ID NO: 89027 - DNA, 103 bp, Artificial Sequence
  Synthetic Polynucleotide
taatacgactcactataggggatgcaagcttggtcgcagcagctctcttgaacagaggagacaagagatgtgctgcgacaacctggcggcagcgcaaaagatg

SEQ ID NO: 89028 - DNA, 103 bp, Artificial Sequence
  Synthetic Polynucleotide
taatacgactcactatagggtatggaatgacagcattgtcccctttataaaacagaggagattataaatgggacaatgcaacctggcggcagcgcaaaagatg

SEQ ID NO: 89029 - DNA, 103 bp, Artificial Sequence
  Synthetic Polynucleotide
taatacgactcactataggggtctgtttcgtatggaatgacagcattgtcaacagaggagagacaatatggtcattccaaacctggcggcagcgcaaaagatg

SEQ ID NO: 89030 - DNA, 103 bp, Artificial Sequence
  Synthetic Polynucleotide
taatacgactcactataggggcgggtcttcgtctgtttcgtatggaatgaaacagaggagatcattcatgacgaaacagaacctggcggcagcgcaaaagatg

SEQ ID NO: 89031 - DNA, 103 bp, Artificial Sequence
  Synthetic Polynucleotide
taatacgactcactatagggttcctcctccgcgggtcttcgtctgtttcgaacagaggagacgaaacatgcgaagacccaacctggcggcagcgcaaaagatg

SEQ ID NO: 89032 - DNA, 103 bp, Artificial Sequence
  Synthetic Polynucleotide
taatacgactcactataggggcgaagaatattcctcctccgcgggtcttcaacagaggagagaagacatgcggaggaggaacctggcggcagcgcaaaagatg

SEQ ID NO: 89033 - DNA, 103 bp, Artificial Sequence
  Synthetic Polynucleotide
taatacgactcactatagggtccttaggctgcgaagaatattcctcctccaacagaggagaggaggaatgatattcttcaacctggcggcagcgcaaaagatg

SEQ ID NO: 89034 - DNA, 103 bp, Artificial Sequence
  Synthetic Polynucleotide
taatacgactcactatagggttagtgttcctccttaggctgcgaagaataaacagaggagatattctatgcagcctaagaacctggcggcagcgcaaaagatg

SEQ ID NO: 89035 - DNA, 103 bp, Artificial Sequence
  Synthetic Polynucleotide
taatacgactcactatagggctttggtttcttagtgttcctccttaggctaacagaggagaagcctaatgaggaacactaacctggcggcagcgcaaaagatg

SEQ ID NO: 89036 - DNA, 103 bp, Artificial Sequence
  Synthetic Polynucleotide
taatacgactcactatagggggggtttgggctttggtttcttagtgttccaacagaggagaggaacaatgagaaaccaaaacctggcggcagcgcaaaagatg

SEQ ID NO: 89037 - DNA, 103 bp, Artificial Sequence
  Synthetic Polynucleotide
taatacgactcactatagggatggatggccggggtttgggctttggtttcaacagaggagagaaaccatggcccaaaccaacctggcggcagcgcaaaagatg

SEQ ID NO: 89038 - DNA, 103 bp, Artificial Sequence
  Synthetic Polynucleotide
taatacgactcactatagggtttttcagctgatgcaagcttggtcgcagcaacagaggagagctgcgatgaagcttgcaaacctggcggcagcgcaaaagatg

SEQ ID NO: 89039 - DNA, 103 bp, Artificial Sequence
  Synthetic Polynucleotide
taatacgactcactatagggtgcctttgtgatggatggccggggtttgggaacagaggagacccaaaatgcggccatccaacctggcggcagcgcaaaagatg

SEQ ID NO: 89040 - DNA, 103 bp, Artificial Sequence
  Synthetic Polynucleotide
taatacgactcactatagggtctcccaggttgcctttgtgatggatggccaacagaggagaggccatatgtcacaaaggaacctggcggcagcgcaaaagatg

SEQ ID NO: 89041 - DNA, 103 bp, Artificial Sequence
  Synthetic Polynucleotide
taatacgactcactatagggaaatagttactctcccaggttgcctttgtgaacagaggagacacaaaatgaacctgggaaacctggcggcagcgcaaaagatg

SEQ ID NO: 89042 - DNA, 103 bp, Artificial Sequence
  Synthetic Polynucleotide
taatacgactcactataggggggcaccccaaaatagttactctcccaggtaacagaggagaacctggatgagtaactataacctggcggcagcgcaaaagatg

SEQ ID NO: 89043 - DNA, 103 bp, Artificial Sequence
  Synthetic Polynucleotide
taatacgactcactatagggcagttgttaagggcaccccaaaatagttacaacagaggagagtaactatgttggggtgcaacctggcggcagcgcaaaagatg

SEQ ID NO: 89044 - DNA, 103 bp, Artificial Sequence
  Synthetic Polynucleotide
taatacgactcactatagggggagtcacgacagttgttaagggcaccccaaacagaggagatggggtatgcttaacaacaacctggcggcagcgcaaaagatg

SEQ ID NO: 89045 - DNA, 103 bp, Artificial Sequence
  Synthetic Polynucleotide
taatacgactcactatagggcggcttctctggagtcacgacagttgttaaaacagaggagattaacaatggtcgtgactaacctggcggcagcgcaaaagatg

SEQ ID NO: 89046 - DNA, 103 bp, Artificial Sequence
  Synthetic Polynucleotide
taatacgactcactatagggaaatggggatcggcttctctggagtcacgaaacagaggagatcgtgaatgcagagaagcaacctggcggcagcgcaaaagatg

SEQ ID NO: 89047 - DNA, 103 bp, Artificial Sequence
  Synthetic Polynucleotide
taatacgactcactatagggctttcaataaaaatggggatcggcttctctaacagaggagaagagaaatggatccccataacctggcggcagcgcaaaagatg

SEQ ID NO: 89048 - DNA, 103 bp, Artificial Sequence
  Synthetic Polynucleotide
taatacgactcactatagggctcaatacatctttcaataaaaatggggataacagaggagaatccccatgtttattgaaaacctggcggcagcgcaaaagatg

SEQ ID NO: 89049 - DNA, 103 bp, Artificial Sequence
  Synthetic Polynucleotide
taatacgactcactatagggagtacatgagtttttcagctgatgcaagctaacagaggagaagcttgatgcagctgaaaaacctggcggcagcgcaaaagatg

SEQ ID NO: 89050 - DNA, 103 bp, Artificial Sequence
  Synthetic Polynucleotide
taatacgactcactatagggcttcaatgtactcaatacatctttcaataaaacagaggagattattgatggatgtattgaacctggcggcagcgcaaaagatg

SEQ ID NO: 89051 - DNA, 103 bp, Artificial Sequence
  Synthetic Polynucleotide
taatacgactcactatagggagtcctgtggcttcaatgtactcaatacataacagaggagaatgtatatggtacattgaaacctggcggcagcgcaaaagatg

SEQ ID NO: 89052 - DNA, 103 bp, Artificial Sequence
  Synthetic Polynucleotide
taatacgactcactatagggttccgtgctcagtcctgtggcttcaatgtaaacagaggagatacattatggccacaggaaacctggcggcagcgcaaaagatg

SEQ ID NO: 89053 - DNA, 103 bp, Artificial Sequence
  Synthetic Polynucleotide
taatacgactcactatagggggtagatgccttccgtgctcagtcctgtggaacagaggagaccacagatgtgagcacggaacctggcggcagcgcaaaagatg

SEQ ID NO: 89054 - DNA, 103 bp, Artificial Sequence
  Synthetic Polynucleotide
taatacgactcactatagggccgctgacccggtagatgccttccgtgctcaacagaggagagagcacatgaggcatctaaacctggcggcagcgcaaaagatg

SEQ ID NO: 89055 - DNA, 103 bp, Artificial Sequence
  Synthetic Polynucleotide
taatacgactcactatagggagacttgttcccgctgacccggtagatgccaacagaggagaggcatcatgcgggtcagcaacctggcggcagcgcaaaagatg

SEQ ID NO: 89056 - DNA, 103 bp, Artificial Sequence
  Synthetic Polynucleotide
taatacgactcactatagggtctccatctcagacttgttcccgctgacccaacagaggagagggtcaatgggaacaagtaacctggcggcagcgcaaaagatg

SEQ ID NO: 89057 - DNA, 103 bp, Artificial Sequence
  Synthetic Polynucleotide
taatacgactcactatagggctctgcagactctccatctcagacttgttcaacagaggagagaacaaatgtgagatggaaacctggcggcagcgcaaaagatg

SEQ ID NO: 89058 - DNA, 103 bp, Artificial Sequence
  Synthetic Polynucleotide
taatacgactcactatagggatcaaactgtctctgcagactctccatctcaacagaggagagagatgatgagtctgcagaacctggcggcagcgcaaaagatg

SEQ ID NO: 89059 - DNA, 103 bp, Artificial Sequence
  Synthetic Polynucleotide
taatacgactcactatagggtgtggtcttgatcaaactgtctctgcagacaacagaggagagtctgcatggacagtttgaacctggcggcagcgcaaaagatg

SEQ ID NO: 89060 - DNA, 103 bp, Artificial Sequence
  Synthetic Polynucleotide
taatacgactcactatagggtcagtgcaaaagtacatgagtttttcagctaacagaggagaagctgaatgactcatgtaaacctggcggcagcgcaaaagatg

SEQ ID NO: 89061 - DNA, 103 bp, Artificial Sequence
  Synthetic Polynucleotide
taatacgactcactatagggaggtccaggttgtggtcttgatcaaactgtaacagaggagaacagttatgtcaagaccaaacctggcggcagcgcaaaagatg

SEQ ID NO: 89062 - DNA, 103 bp, Artificial Sequence
  Synthetic Polynucleotide
taatacgactcactatagggtttctctgccaggtccaggttgtggtcttgaacagaggagacaagacatgaacctggacaacctggcggcagcgcaaaagatg

SEQ ID NO: 89063 - DNA, 103 bp, Artificial Sequence
  Synthetic Polynucleotide
taatacgactcactatagggccgtaaagtctttctctgccaggtccaggtaacagaggagaacctggatgtggcagagaaacctggcggcagcgcaaaagatg

SEQ ID NO: 89064 - DNA, 103 bp, Artificial Sequence
  Synthetic Polynucleotide
taatacgactcactatagggacggtattcaccgtaaagtctttctctgccaacagaggagaggcagaatgagactttacaacctggcggcagcgcaaaagatg

SEQ ID NO: 89065 - DNA, 103 bp, Artificial Sequence
  Synthetic Polynucleotide
taatacgactcactatagggggcaccagccacggtattcaccgtaaagtcaacagaggagagactttatggtgaataccaacctggcggcagcgcaaaagatg

SEQ ID NO: 89066 - DNA, 103 bp, Artificial Sequence
  Synthetic Polynucleotide
taatacgactcactatagggagctcttcatggcaccagccacggtattcaaacagaggagatgaataatgtggctggtgaacctggcggcagcgcaaaagatg

SEQ ID NO: 89067 - DNA, 103 bp, Artificial Sequence
  Synthetic Polynucleotide
taatacgactcactatagggtctgagaaaaagctcttcatggcaccagccaacagaggagaggctggatgcatgaagagaacctggcggcagcgcaaaagatg

SEQ ID NO: 89068 - DNA, 103 bp, Artificial Sequence
  Synthetic Polynucleotide
taatacgactcactataggggtcaggcagttctgagaaaaagctcttcataacagaggagaatgaagatgtttttctcaaacctggcggcagcgcaaaagatg

SEQ ID NO: 89069 - DNA, 103 bp, Artificial Sequence
  Synthetic Polynucleotide
taatacgactcactatagggggaccagggggtcaggcagttctgagaaaaaacagaggagattttctatgaactgcctgaacctggcggcagcgcaaaagatg

SEQ ID NO: 89070 - DNA, 103 bp, Artificial Sequence
  Synthetic Polynucleotide
taatacgactcactatagggatgttatacgggaccagggggtcaggcagtaacagaggagaactgccatgccccctggtaacctggcggcagcgcaaaagatg

SEQ ID NO: 89071 - DNA, 103 bp, Artificial Sequence
  Synthetic Polynucleotide
taatacgactcactatagggtcccaccacactgatgttgtaggtgggaataacagaggagaattcccatgtacaacatcaacctggcggcagcgcaaaagatg

SEQ ID NO: 89072 - DNA, 103 bp, Artificial Sequence
  Synthetic Polynucleotide
taatacgactcactatagggccccagctggtcagtgcaaaagtacatgagaacagaggagactcatgatgttttgcactaacctggcggcagcgcaaaagatg

SEQ ID NO: 89073 - DNA, 103 bp, Artificial Sequence
  Synthetic Polynucleotide
taatacgactcactataggggtcgatctgcatgttatacgggaccaggggaacagaggagacccctgatgccgtataacaacctggcggcagcgcaaaagatg

SEQ ID NO: 89074 - DNA, 103 bp, Artificial Sequence
  Synthetic Polynucleotide
taatacgactcactatagggcttccaccaagtcgatctgcatgttatacgaacagaggagacgtataatgtgcagatcgaacctggcggcagcgcaaaagatg

SEQ ID NO: 89075 - DNA, 103 bp, Artificial Sequence
  Synthetic Polynucleotide
taatacgactcactatagggattttgtgtgcttccaccaagtcgatctgcaacagaggagagcagatatgcttggtggaaacctggcggcagcgcaaaagatg

SEQ ID NO: 89076 - DNA, 103 bp, Artificial Sequence
  Synthetic Polynucleotide
taatacgactcactatagggccggtcgttgattttgtgtgcttccaccaaaacagaggagattggtgatggcacacaaaaacctggcggcagcgcaaaagatg

SEQ ID NO: 89077 - DNA, 103 bp, Artificial Sequence
  Synthetic Polynucleotide
taatacgactcactatagggacttctgctcccggtcgttgattttgtgtgaacagaggagacacacaatgtcaacgaccaacctggcggcagcgcaaaagatg

SEQ ID NO: 89078 - DNA, 103 bp, Artificial Sequence
  Synthetic Polynucleotide
taatacgactcactatagggagggcatgcaacttctgctcccggtcgttgaacagaggagacaacgaatgggagcagaaaacctggcggcagcgcaaaagatg

SEQ ID NO: 89079 - DNA, 103 bp, Artificial Sequence
  Synthetic Polynucleotide
taatacgactcactatagggtacctccttaagggcatgcaacttctgctcaacagaggagagagcagatgttgcatgccaacctggcggcagcgcaaaagatg

SEQ ID NO: 89080 - DNA, 103 bp, Artificial Sequence
  Synthetic Polynucleotide
taatacgactcactatagggatttctttaatacctccttaagggcatgcaaacagaggagatgcatgatgttaaggaggaacctggcggcagcgcaaaagatg

SEQ ID NO: 89081 - DNA, 103 bp, Artificial Sequence
  Synthetic Polynucleotide
taatacgactcactatagggtcctttggaaatttctttaatacctccttaaacagaggagataaggaatgattaaagaaaacctggcggcagcgcaaaagatg

SEQ ID NO: 89082 - DNA, 103 bp, Artificial Sequence
  Synthetic Polynucleotide
taatacgactcactatagggttcgtggttttcctttggaaatttctttaaaacagaggagattaaagatgtttccaaagaacctggcggcagcgcaaaagatg

SEQ ID NO: 89083 - DNA, 103 bp, Artificial Sequence
  Synthetic Polynucleotide
taatacgactcactatagggcctgctccagccccagctggtcagtgcaaaaacagaggagatttgcaatgaccagctggaacctggcggcagcgcaaaagatg

SEQ ID NO: 89084 - DNA, 103 bp, Artificial Sequence
  Synthetic Polynucleotide
taatacgactcactatagggacttgaagacttcgtggttttcctttggaaaacagaggagattccaaatgaaaaccacgaacctggcggcagcgcaaaagatg

SEQ ID NO: 89085 - DNA, 103 bp, Artificial Sequence
  Synthetic Polynucleotide
taatacgactcactataggggagatgacatacttgaagacttcgtggtttaacagaggagaaaaccaatgagtcttcaaaacctggcggcagcgcaaaagatg

SEQ ID NO: 89086 - DNA, 103 bp, Artificial Sequence
  Synthetic Polynucleotide
taatacgactcactataggggtttaggtgagagatgacatacttgaagacaacagaggagagtcttcatgtatgtcatcaacctggcggcagcgcaaaagatg

SEQ ID NO: 89087 - DNA, 103 bp, Artificial Sequence
  Synthetic Polynucleotide
taatacgactcactatagggggctgaccttgtttaggtgagagatgacataacagaggagaatgtcaatgctcacctaaaacctggcggcagcgcaaaagatg

SEQ ID NO: 89088 - DNA, 103 bp, Artificial Sequence
  Synthetic Polynucleotide
taatacgactcactatagggttgttgttgtggctgaccttgtttaggtgaaacagaggagatcacctatgcaaggtcagaacctggcggcagcgcaaaagatg

SEQ ID NO: 89089 - DNA, 103 bp, Artificial Sequence
  Synthetic Polynucleotide
taatacgactcactataggggagattcaccttgttgttgtggctgaccttaacagaggagaaaggtcatgcacaacaacaacctggcggcagcgcaaaagatg

SEQ ID NO: 89090 - DNA, 103 bp, Artificial Sequence
  Synthetic Polynucleotide
taatacgactcactatagggcgctggtcatgagattcaccttgttgttgtaacagaggagaacaacaatgaggtgaatcaacctggcggcagcgcaaaagatg

SEQ ID NO: 89091 - DNA, 103 bp, Artificial Sequence
  Synthetic Polynucleotide
taatacgactcactataggggagaggttctcgctggtcatgagattcaccaacagaggagaggtgaaatgcatgaccagaacctggcggcagcgcaaaagatg

SEQ ID NO: 89092 - DNA, 103 bp, Artificial Sequence
  Synthetic Polynucleotide
taatacgactcactataggggaagcagatggagaggttctcgctggtcataacagaggagaatgaccatggagaacctcaacctggcggcagcgcaaaagatg

SEQ ID NO: 89093 - DNA, 103 bp, Artificial Sequence
  Synthetic Polynucleotide
taatacgactcactatagggaggtgggccagaagcagatggagaggttctaacagaggagaagaaccatgccatctgctaacctggcggcagcgcaaaagatg

SEQ ID NO: 89094 - DNA, 103 bp, Artificial Sequence
  Synthetic Polynucleotide
taatacgactcactatagggtgctcaaagtcctgctccagccccagctggaacagaggagaccagctatggctggagcaaacctggcggcagcgcaaaagatg

SEQ ID NO: 89095 - DNA, 103 bp, Artificial Sequence
  Synthetic Polynucleotide
taatacgactcactatagggggtctcatcaaggtgggccagaagcagatgaacagaggagacatctgatgctggcccacaacctggcggcagcgcaaaagatg

SEQ ID NO: 89096 - DNA, 103 bp, Artificial Sequence
  Synthetic Polynucleotide
taatacgactcactataggggctgaaatcaggtctcatcaaggtgggccaaacagaggagatggcccatgttgatgagaaacctggcggcagcgcaaaagatg

SEQ ID NO: 89097 - DNA, 103 bp, Artificial Sequence
  Synthetic Polynucleotide
taatacgactcactatagggcgtccatagtgctgaaatcaggtctcatcaaacagaggagatgatgaatgctgatttcaaacctggcggcagcgcaaaagatg

SEQ ID NO: 89098 - DNA, 103 bp, Artificial Sequence
  Synthetic Polynucleotide
taatacgactcactataggggctgtgagggcgtccatagtgctgaaatcaaacagaggagatgatttatgcactatggaaacctggcggcagcgcaaaagatg

SEQ ID NO: 89099 - DNA, 103 bp, Artificial Sequence
  Synthetic Polynucleotide
taatacgactcactatagggggtgcgcgtggctgtgagggcgtccatagtaacagaggagaactatgatggccctcacaaacctggcggcagcgcaaaagatg

SEQ ID NO: 89100 - DNA, 103 bp, Artificial Sequence
  Synthetic Polynucleotide
taatacgactcactatagggttgtctggtaggtgcgcgtggctgtgagggaacagaggagaccctcaatgccacgcgcaaacctggcggcagcgcaaaagatg

SEQ ID NO: 89101 - DNA, 103 bp, Artificial Sequence
  Synthetic Polynucleotide
taatacgactcactatagggagttcaatgattgtctggtaggtgcgcgtgaacagaggagacacgcgatgctaccagacaacctggcggcagcgcaaaagatg

SEQ ID NO: 89102 - DNA, 103 bp, Artificial Sequence
  Synthetic Polynucleotide
taatacgactcactatagggctggataaagagttcaatgattgtctggtaaacagaggagataccagatgatcattgaaaacctggcggcagcgcaaaagatg

SEQ ID NO: 89103 - DNA, 103 bp, Artificial Sequence
  Synthetic Polynucleotide
taatacgactcactatagggaggggcactgctggataaagagttcaatgaaacagaggagatcattgatgtctttatccaacctggcggcagcgcaaaagatg

SEQ ID NO: 89104 - DNA, 103 bp, Artificial Sequence
  Synthetic Polynucleotide
taatacgactcactatagggtagaagaagaaggggcactgctggataaagaacagaggagactttatatggcagtgcccaacctggcggcagcgcaaaagatg

SEQ ID NO: 89105 - DNA, 103 bp, Artificial Sequence
  Synthetic Polynucleotide
taatacgactcactatagggcatttgtttctgctcaaagtcctgctccagaacagaggagactggagatggactttgagaacctggcggcagcgcaaaagatg

SEQ ID NO: 89106 - DNA, 103 bp, Artificial Sequence
  Synthetic Polynucleotide
taatacgactcactataggggggccgattgtagaagaagaaggggcactgaacagaggagacagtgcatgttcttcttcaacctggcggcagcgcaaaagatg

SEQ ID NO: 89107 - DNA, 103 bp, Artificial Sequence
  Synthetic Polynucleotide
taatacgactcactataggggctcggtgatgggccgattgtagaagaagaaacagaggagatcttctatgacaatcggcaacctggcggcagcgcaaaagatg

SEQ ID NO: 89108 - DNA, 103 bp, Artificial Sequence
  Synthetic Polynucleotide
taatacgactcactataggggcgccggggggctcggtgatgggccgattgaacagaggagacaatcgatgcatcaccgaaacctggcggcagcgcaaaagatg

SEQ ID NO: 89109 - DNA, 103 bp, Artificial Sequence
  Synthetic Polynucleotide
taatacgactcactataggggctgggcctggcgccggggggctcggtgataacagaggagaatcaccatgccccccggcaacctggcggcagcgcaaaagatg

SEQ ID NO: 89110 - DNA, 103 bp, Artificial Sequence
  Synthetic Polynucleotide
taatacgactcactatagggcagagggggagctgggcctggcgccgggggaacagaggagacccccgatgccaggcccaaacctggcggcagcgcaaaagatg

SEQ ID NO: 89111 - DNA, 103 bp, Artificial Sequence
  Synthetic Polynucleotide
taatacgactcactataggggaagccacggcagagggggagctgggcctgaacagaggagacaggccatgctccccctcaacctggcggcagcgcaaaagatg

SEQ ID NO: 89112 - DNA, 103 bp, Artificial Sequence
  Synthetic Polynucleotide
taatacgactcactatagggggggacggtggaagccacggcagagggggaaacagaggagatcccccatggccgtggctaacctggcggcagcgcaaaagatg

SEQ ID NO: 89113 - DNA, 103 bp, Artificial Sequence
  Synthetic Polynucleotide
taatacgactcactatagggaagtgaggaaggggacggtggaagccacggaacagaggagaccgtggatgccaccgtccaacctggcggcagcgcaaaagatg

SEQ ID NO: 89114 - DNA, 103 bp, Artificial Sequence
  Synthetic Polynucleotide
taatacgactcactatagggacaggcgtggaagtgaggaaggggacggtgaacagaggagacaccgtatgcttcctcacaacctggcggcagcgcaaaagatg

SEQ ID NO: 89115 - DNA, 103 bp, Artificial Sequence
  Synthetic Polynucleotide
taatacgactcactatagggctgacttgtgacaggcgtggaagtgaggaaaacagaggagattcctcatgtccacgcctaacctggcggcagcgcaaaagatg

SEQ ID NO: 89116 - DNA, 103 bp, Artificial Sequence
  Synthetic Polynucleotide
taatacgactcactatagggttccgtctggcatttgtttctgctcaaagtaacagaggagaactttgatgagaaacaaaaacctggcggcagcgcaaaagatg

SEQ ID NO: 89117 - DNA, 103 bp, Artificial Sequence
  Synthetic Polynucleotide
taatacgactcactatagggggggcgacggctgacttgtgacaggcgtggaacagaggagaccacgcatgtcacaagtcaacctggcggcagcgcaaaagatg

SEQ ID NO: 89118 - DNA, 103 bp, Artificial Sequence
  Synthetic Polynucleotide
taatacgactcactatagggggcgactgtgggggcgacggctgacttgtgaacagaggagacacaagatggccgtcgccaacctggcggcagcgcaaaagatg

SEQ ID NO: 89119 - DNA, 103 bp, Artificial Sequence
  Synthetic Polynucleotide
taatacgactcactatagggggtgggtggaggcgactgtgggggcgacggaacagaggagaccgtcgatgccacagtcgaacctggcggcagcgcaaaagatg

SEQ ID NO: 89120 - DNA, 103 bp, Artificial Sequence
  Synthetic Polynucleotide
taatacgactcactataggggggactggggggtgggtggaggcgactgtgaacagaggagacacagtatgctccacccaaacctggcggcagcgcaaaagatg

SEQ ID NO: 89121 - DNA, 103 bp, Artificial Sequence
  Synthetic Polynucleotide
taatacgactcactatagggggctgcattggggactggggggtgggtggaaacagaggagatccaccatgcccccagtcaacctggcggcagcgcaaaagatg

SEQ ID NO: 89122 - DNA, 103 bp, Artificial Sequence
  Synthetic Polynucleotide
taatacgactcactataggggggaagcagtggctgcattggggactggggaacagaggagaccccagatgccaatgcagaacctggcggcagcgcaaaagatg

SEQ ID NO: 89123 - DNA, 103 bp, Artificial Sequence
  Synthetic Polynucleotide
taatacgactcactataggggaagctgggagggaagcagtggctgcattgaacagaggagacaatgcatgcactgcttcaacctggcggcagcgcaaaagatg

SEQ ID NO: 89124 - DNA, 103 bp, Artificial Sequence
  Synthetic Polynucleotide
taatacgactcactatagggtgttcggcttgaagctgggagggaagcagtaacagaggagaactgctatgctcccagctaacctggcggcagcgcaaaagatg

SEQ ID NO: 89125 - DNA, 103 bp, Artificial Sequence
  Synthetic Polynucleotide
taatacgactcactatagggtcacagcgtgtgttcggcttgaagctgggaaacagaggagatcccagatgcaagccgaaaacctggcggcagcgcaaaagatg

SEQ ID NO: 89126 - DNA, 103 bp, Artificial Sequence
  Synthetic Polynucleotide
taatacgactcactatagggaccagcagctttccgtctggcatttgtttcaacagaggagagaaacaatggccagacggaacctggcggcagcgcaaaagatg

SEQ ID NO: 89127 - DNA, 103 bp, Artificial Sequence
  Synthetic Polynucleotide
taatacgactcactatagggaaaaccatcaaccagcagctttccgtctggaacagaggagaccagacatgaagctgctgaacctggcggcagcgcaaaagatg

SEQ ID NO: 89128 - DNA, 103 bp, Artificial Sequence
  Synthetic Polynucleotide
taatacgactcactatagggtaccaagaagaaaaccatcaaccagcagctaacagaggagaagctgcatgttgatggttaacctggcggcagcgcaaaagatg

SEQ ID NO: 89129 - DNA, 103 bp, Artificial Sequence
  Synthetic Polynucleotide
taatacgactcactatagggctaacatcaataccaagaagaaaaccatcaaacagaggagatgatggatgtcttcttggaacctggcggcagcgcaaaagatg

SEQ ID NO: 89130 - DNA, 103 bp, Artificial Sequence
  Synthetic Polynucleotide
taatacgactcactatagggcatgcccctgctaacatcaataccaagaagaacagaggagacttcttatgattgatgttaacctggcggcagcgcaaaagatg

SEQ ID NO: 89131 - DNA, 103 bp, Artificial Sequence
  Synthetic Polynucleotide
taatacgactcactatagggtcccagataatcccaccacactgatgttgtaacagaggagaacaacaatggtgtggtggaacctggcggcagcgcaaaagatg

SEQ ID NO: 89132 - DNA, 103 bp, Artificial Sequence
  Synthetic Polynucleotide
taatacgactcactatagggagttcctattcatgcccctgctaacatcaaaacagaggagattgatgatggcaggggcaaacctggcggcagcgcaaaagatg

SEQ ID NO: 89133 - DNA, 103 bp, Artificial Sequence
  Synthetic Polynucleotide
taatacgactcactatagggtggtcatcaaagttcctattcatgcccctgaacagaggagacaggggatggaataggaaaacctggcggcagcgcaaaagatg

SEQ ID NO: 89134 - DNA, 103 bp, Artificial Sequence
  Synthetic Polynucleotide
taatacgactcactatagggaaacttgagctggtcatcaaagttcctattaacagaggagaaataggatgtttgatgacaacctggcggcagcgcaaaagatg

SEQ ID NO: 89135 - DNA, 103 bp, Artificial Sequence
  Synthetic Polynucleotide
taatacgactcactataggggattggagacaaacttgagctggtcatcaaaacagaggagattgatgatgagctcaagtaacctggcggcagcgcaaaagatg

SEQ ID NO: 89136 - DNA, 103 bp, Artificial Sequence
  Synthetic Polynucleotide
taatacgactcactatagggtgattgtagagattggagacaaacttgagcaacagaggagagctcaaatgtgtctccaaaacctggcggcagcgcaaaagatg

SEQ ID NO: 89137 - DNA, 103 bp, Artificial Sequence
  Synthetic Polynucleotide
taatacgactcactatagggttttgcaagctgattgtagagattggagacaacagaggagagtctccatgctctacaataacctggcggcagcgcaaaagatg

SEQ ID NO: 89138 - DNA, 103 bp, Artificial Sequence
  Synthetic Polynucleotide
taatacgactcactataggggcttttttgtttttgcaagctgattgtagaaacagaggagatctacaatgagcttgcaaaacctggcggcagcgcaaaagatg

SEQ ID NO: 89139 - DNA, 103 bp, Artificial Sequence
  Synthetic Polynucleotide
taatacgactcactatagggaccactatgggcttttttgtttttgcaagcaacagaggagagcttgcatgaacaaaaaaaacctggcggcagcgcaaaagatg

SEQ ID NO: 89140 - DNA, 103 bp, Artificial Sequence
  Synthetic Polynucleotide
taatacgactcactatagggagtcaggaccaccactatgggcttttttgtaacagaggagaacaaaaatgcccatagtgaacctggcggcagcgcaaaagatg

SEQ ID NO: 89141 - DNA, 103 bp, Artificial Sequence
  Synthetic Polynucleotide
taatacgactcactatagggcgtcacacttagtcaggaccaccactatggaacagaggagaccatagatgtggtcctgaaacctggcggcagcgcaaaagatg

SEQ ID NO: 89142 - DNA, 103 bp, Artificial Sequence
  Synthetic Polynucleotide
taatacgactcactatagggtccttctcggtcccagataatcccaccacaaacagaggagatgtggtatgattatctggaacctggcggcagcgcaaaagatg

SEQ ID NO: 89143 - DNA, 103 bp, Artificial Sequence
  Synthetic Polynucleotide
taatacgactcactatagggtcaacaccttcgtcacacttagtcaggaccaacagaggagaggtcctatgtaagtgtgaaacctggcggcagcgcaaaagatg

SEQ ID NO: 89144 - DNA, 103 bp, Artificial Sequence
  Synthetic Polynucleotide
taatacgactcactatagggaatgtaccgctcaacaccttcgtcacacttaacagaggagaaagtgtatggaaggtgttaacctggcggcagcgcaaaagatg

SEQ ID NO: 89145 - DNA, 103 bp, Artificial Sequence
  Synthetic Polynucleotide
taatacgactcactataggggtgcatctctaatgtaccgctcaacaccttaacagaggagaaaggtgatgagcggtacaaacctggcggcagcgcaaaagatg

SEQ ID NO: 89146 - DNA, 103 bp, Artificial Sequence
  Synthetic Polynucleotide
taatacgactcactataggggcaaaagtatgtgcatctctaatgtaccgcaacagaggagagcggtaatgtagagatgcaacctggcggcagcgcaaaagatg

SEQ ID NO: 89147 - DNA, 103 bp, Artificial Sequence
  Synthetic Polynucleotide
taatacgactcactatagggtttgcttaaggcaaaagtatgtgcatctctaacagaggagaagagatatgcatacttttaacctggcggcagcgcaaaagatg

SEQ ID NO: 89148 - DNA, 103 bp, Artificial Sequence
  Synthetic Polynucleotide
taatacgactcactatagggggaggttctttttgcttaaggcaaaagtataacagaggagaatacttatgccttaagcaaacctggcggcagcgcaaaagatg

SEQ ID NO: 89149 - DNA, 103 bp, Artificial Sequence
  Synthetic Polynucleotide
taatacgactcactatagggtccacaacctggaggttctttttgcttaagaacagaggagacttaagatgaaagaacctaacctggcggcagcgcaaaagatg

SEQ ID NO: 89150 - DNA, 103 bp, Artificial Sequence
  Synthetic Polynucleotide
taatacgactcactatagggcgctgaggtctccacaacctggaggttcttaacagaggagaaagaacatgcaggttgtgaacctggcggcagcgcaaaagatg

SEQ ID NO: 89151 - DNA, 103 bp, Artificial Sequence
  Synthetic Polynucleotide
taatacgactcactatagggcattggatctcgctgaggtctccacaacctaacagaggagaaggttgatgagacctcagaacctggcggcagcgcaaaagatg

SEQ ID NO: 89152 - DNA, 103 bp, Artificial Sequence
  Synthetic Polynucleotide
taatacgactcactatagggtccacgtttacattggatctcgctgaggtcaacagaggagagacctcatggagatccaaaacctggcggcagcgcaaaagatg

SEQ ID NO: 89153 - DNA, 103 bp, Artificial Sequence
  Synthetic Polynucleotide
taatacgactcactatagggctggcccttttccttctcggtcccagataaaacagaggagattatctatgaccgagaagaacctggcggcagcgcaaaagatg

SEQ ID NO: 89154 - DNA, 103 bp, Artificial Sequence
  Synthetic Polynucleotide
taatacgactcactataggggaaagccaagtccacgtttacattggatctaacagaggagaagatccatggtaaacgtgaacctggcggcagcgcaaaagatg

SEQ ID NO: 89155 - DNA, 103 bp, Artificial Sequence
  Synthetic Polynucleotide
taatacgactcactatagggctaaggtgctgaaagccaagtccacgtttaaacagaggagataaacgatgacttggcttaacctggcggcagcgcaaaagatg

SEQ ID NO: 89156 - DNA, 103 bp, Artificial Sequence
  Synthetic Polynucleotide
taatacgactcactatagggatgagttgcactaaggtgctgaaagccaagaacagaggagacttggcatgcagcaccttaacctggcggcagcgcaaaagatg

SEQ ID NO: 89157 - DNA, 103 bp, Artificial Sequence
  Synthetic Polynucleotide
taatacgactcactatagggacttttatcaatgagttgcactaaggtgctaacagaggagaagcaccatggtgcaactcaacctggcggcagcgcaaaagatg

SEQ ID NO: 89158 - DNA, 103 bp, Artificial Sequence
  Synthetic Polynucleotide
taatacgactcactatagggtctttccccgacttttatcaatgagttgcaaacagaggagatgcaacatgttgataaaaaacctggcggcagcgcaaaagatg

SEQ ID NO: 89159 - DNA, 103 bp, Artificial Sequence
  Synthetic Polynucleotide
taatacgactcactatagggatgatttttgtctttccccgacttttatcaaacagaggagatgataaatgtcggggaaaaacctggcggcagcgcaaaagatg

SEQ ID NO: 89160 - DNA, 103 bp, Artificial Sequence
  Synthetic Polynucleotide
taatacgactcactatagggaaaataaggaatgatttttgtctttccccgaacagaggagacggggaatgacaaaaatcaacctggcggcagcgcaaaagatg

SEQ ID NO: 89161 - DNA, 103 bp, Artificial Sequence
  Synthetic Polynucleotide
taatacgactcactatagggtgagagcttcaaaataaggaatgatttttgaacagaggagacaaaaaatgttccttattaacctggcggcagcgcaaaagatg

SEQ ID NO: 89162 - DNA, 103 bp, Artificial Sequence
  Synthetic Polynucleotide
taatacgactcactatagggctctgctgcttgagagcttcaaaataaggaaacagaggagatccttaatgtgaagctctaacctggcggcagcgcaaaagatg

SEQ ID NO: 89163 - DNA, 103 bp, Artificial Sequence
  Synthetic Polynucleotide
taatacgactcactatagggtatctgctgactctgctgcttgagagcttcaacagaggagagaagctatgaagcagcagaacctggcggcagcgcaaaagatg

SEQ ID NO: 89164 - DNA, 103 bp, Artificial Sequence
  Synthetic Polynucleotide
taatacgactcactatagggcaatcccacactggcccttttccttctcggaacagaggagaccgagaatgaaaagggccaacctggcggcagcgcaaaagatg

SEQ ID NO: 89165 - DNA, 103 bp, Artificial Sequence
  Synthetic Polynucleotide
taatacgactcactatagggttgctgtagctatctgctgactctgctgctaacagaggagaagcagcatggtcagcagaaacctggcggcagcgcaaaagatg

SEQ ID NO: 89166 - DNA, 103 bp, Artificial Sequence
  Synthetic Polynucleotide
taatacgactcactatagggtacttgtcttttgctgtagctatctgctgaaacagaggagatcagcaatgagctacagcaacctggcggcagcgcaaaagatg

SEQ ID NO: 89167 - DNA, 103 bp, Artificial Sequence
  Synthetic Polynucleotide
taatacgactcactatagggcagccactcatacttgtcttttgctgtagcaacagaggagagctacaatgaaagacaagaacctggcggcagcgcaaaagatg

SEQ ID NO: 89168 - DNA, 103 bp, Artificial Sequence
  Synthetic Polynucleotide
taatacgactcactatagggtgcgactcaccagccactcatacttgtcttaacagaggagaaagacaatgatgagtggcaacctggcggcagcgcaaaagatg

SEQ ID NO: 89169 - DNA, 103 bp, Artificial Sequence
  Synthetic Polynucleotide
taatacgactcactatagggtttttcacaatgcgactcaccagccactcaaacagaggagatgagtgatgggtgagtcgaacctggcggcagcgcaaaagatg

SEQ ID NO: 89170 - DNA, 103 bp, Artificial Sequence
  Synthetic Polynucleotide
taatacgactcactatagggctcattgtggtttttcacaatgcgactcacaacagaggagagtgagtatgattgtgaaaaacctggcggcagcgcaaaagatg

SEQ ID NO: 89171 - DNA, 103 bp, Artificial Sequence
  Synthetic Polynucleotide
taatacgactcactatagggtcagccagttctcattgtggtttttcacaaaacagaggagattgtgaatgaccacaatgaacctggcggcagcgcaaaagatg

SEQ ID NO: 89172 - DNA, 103 bp, Artificial Sequence
  Synthetic Polynucleotide
taatacgactcactatagggcggctgacactcagccagttctcattgtggaacagaggagaccacaaatggaactggctaacctggcggcagcgcaaaagatg

SEQ ID NO: 89173 - DNA, 103 bp, Artificial Sequence
  Synthetic Polynucleotide
taatacgactcactatagggctgcatctttcggctgacactcagccagttaacagaggagaaactggatgagtgtcagcaacctggcggcagcgcaaaagatg

SEQ ID NO: 89174 - DNA, 103 bp, Artificial Sequence
  Synthetic Polynucleotide
taatacgactcactatagggctggagaggcctgcatctttcggctgacacaacagaggagagtgtcaatggaaagatgcaacctggcggcagcgcaaaagatg

SEQ ID NO: 89175 - DNA, 103 bp, Artificial Sequence
  Synthetic Polynucleotide
taatacgactcactatagggcaagactttccaatcccacactggccctttaacagaggagaaaagggatggtgtgggataacctggcggcagcgcaaaagatg

SEQ ID NO: 89176 - DNA, 103 bp, Artificial Sequence
  Synthetic Polynucleotide
taatacgactcactatagggtcctggtattctggagaggcctgcatctttaacagaggagaaaagatatgggcctctccaacctggcggcagcgcaaaagatg

SEQ ID NO: 89177 - DNA, 103 bp, Artificial Sequence
  Synthetic Polynucleotide
taatacgactcactataggggtagacatagtcctggtattctggagaggcaacagaggagagcctctatggaataccagaacctggcggcagcgcaaaagatg

SEQ ID NO: 89178 - DNA, 103 bp, Artificial Sequence
  Synthetic Polynucleotide
taatacgactcactatagggtcccttccaggtagacatagtcctggtattaacagaggagaaataccatgactatgtctaacctggcggcagcgcaaaagatg

SEQ ID NO: 89179 - DNA, 103 bp, Artificial Sequence
  Synthetic Polynucleotide
taatacgactcactataggggctttctgagtcccttccaggtagacatagaacagaggagactatgtatgcctggaaggaacctggcggcagcgcaaaagatg

SEQ ID NO: 89180 - DNA, 103 bp, Artificial Sequence
  Synthetic Polynucleotide
taatacgactcactatagggcagcttcttggctttctgagtcccttccagaacagaggagactggaaatgactcagaaaaacctggcggcagcgcaaaagatg

SEQ ID NO: 89181 - DNA, 103 bp, Artificial Sequence
  Synthetic Polynucleotide
taatacgactcactataggggctgtagaaacagcttcttggctttctgagaacagaggagactcagaatgccaagaagcaacctggcggcagcgcaaaagatg

SEQ ID NO: 89182 - DNA, 103 bp, Artificial Sequence
  Synthetic Polynucleotide
taatacgactcactatagggcggtggatgtgctgtagaaacagcttcttgaacagaggagacaagaaatggtttctacaaacctggcggcagcgcaaaagatg

SEQ ID NO: 89183 - DNA, 103 bp, Artificial Sequence
  Synthetic Polynucleotide
taatacgactcactatagggatgcttgaggcggtggatgtgctgtagaaaaacagaggagatttctaatgcacatccacaacctggcggcagcgcaaaagatg

SEQ ID NO: 89184 - DNA, 103 bp, Artificial Sequence
  Synthetic Polynucleotide
taatacgactcactatagggcgatatgctcatgcttgaggcggtggatgtaacagaggagaacatccatggcctcaagcaacctggcggcagcgcaaaagatg

SEQ ID NO: 89185 - DNA, 103 bp, Artificial Sequence
  Synthetic Polynucleotide
taatacgactcactatagggctcctacgctcgatatgctcatgcttgaggaacagaggagacctcaaatgtgagcatataacctggcggcagcgcaaaagatg

SEQ ID NO: 89186 - DNA, 103 bp, Artificial Sequence
  Synthetic Polynucleotide
taatacgactcactatagggcagcgtctccatcacggcctgtagtttcataacagaggagaatgaaaatgcaggccgtgaacctggcggcagcgcaaaagatg

SEQ ID NO: 89187 - DNA, 103 bp, Artificial Sequence
  Synthetic Polynucleotide
taatacgactcactatagggccgggcccggccggggggtgcagcagggggaacagaggagaccccctatggcaccccccaacctggcggcagcgcaaaagatg

SEQ ID NO: 89188 - DNA, 103 bp, Artificial Sequence
  Synthetic Polynucleotide
taatacgactcactatagggtgcctggagctcattggggttactgaggccaacagaggagaggcctcatgaaccccaataacctggcggcagcgcaaaagatg

SEQ ID NO: 89189 - DNA, 103 bp, Artificial Sequence
  Synthetic Polynucleotide
taatacgactcactatagggtgtctatggctgcctggagctcattggggtaacagaggagaaccccaatgagctccaggaacctggcggcagcgcaaaagatg

SEQ ID NO: 89190 - DNA, 103 bp, Artificial Sequence
  Synthetic Polynucleotide
taatacgactcactatagggcgtcggttgctgtctatggctgcctggagcaacagaggagagctccaatgagccatagaaacctggcggcagcgcaaaagatg

SEQ ID NO: 89191 - DNA, 103 bp, Artificial Sequence
  Synthetic Polynucleotide
taatacgactcactatagggccggccctcccgtcggttgctgtctatggcaacagaggagagccataatgagcaaccgaaacctggcggcagcgcaaaagatg

SEQ ID NO: 89192 - DNA, 103 bp, Artificial Sequence
  Synthetic Polynucleotide
taatacgactcactatagggagctctggcgccggccctcccgtcggttgcaacagaggagagcaaccatggggagggccaacctggcggcagcgcaaaagatg

SEQ ID NO: 89193 - DNA, 103 bp, Artificial Sequence
  Synthetic Polynucleotide
taatacgactcactataggggagccaccaaagctctggcgccggccctccaacagaggagaggagggatggcgccagagaacctggcggcagcgcaaaagatg

SEQ ID NO: 89194 - DNA, 103 bp, Artificial Sequence
  Synthetic Polynucleotide
taatacgactcactatagggggcaaagagggagccaccaaagctctggcgaacagaggagacgccagatgtttggtggcaacctggcggcagcgcaaaagatg

SEQ ID NO: 89195 - DNA, 103 bp, Artificial Sequence
  Synthetic Polynucleotide
taatacgactcactatagggctggcgagtaggcaaagagggagccaccaaaacagaggagattggtgatgccctctttgaacctggcggcagcgcaaaagatg

SEQ ID NO: 89196 - DNA, 103 bp, Artificial Sequence
  Synthetic Polynucleotide
taatacgactcactatagggtgtgccccgcctggcgagtaggcaaagaggaacagaggagacctcttatgctactcgccaacctggcggcagcgcaaaagatg

SEQ ID NO: 89197 - DNA, 103 bp, Artificial Sequence
  Synthetic Polynucleotide
taatacgactcactataggggagcatgccgtgtgccccgcctggcgagtaaacagaggagatactcgatgggcggggcaaacctggcggcagcgcaaaagatg

SEQ ID NO: 89198 - DNA, 103 bp, Artificial Sequence
  Synthetic Polynucleotide
taatacgactcactatagggcgggggcagcccgggcccggccggggggtgaacagaggagacaccccatggccgggcccaacctggcggcagcgcaaaagatg

SEQ ID NO: 89199 - DNA, 103 bp, Artificial Sequence
  Synthetic Polynucleotide
taatacgactcactatagggtgggtgaggagagcatgccgtgtgccccgcaacagaggagagcggggatgacggcatgcaacctggcggcagcgcaaaagatg

SEQ ID NO: 89200 - DNA, 103 bp, Artificial Sequence
  Synthetic Polynucleotide
taatacgactcactatagggacgggtagcttgggtgaggagagcatgccgaacagaggagacggcatatgctcctcaccaacctggcggcagcgcaaaagatg

SEQ ID NO: 89201 - DNA, 103 bp, Artificial Sequence
  Synthetic Polynucleotide
taatacgactcactatagggcagggaggacacgggtagcttgggtgaggaaacagaggagatcctcaatgaagctacccaacctggcggcagcgcaaaagatg

SEQ ID NO: 89202 - DNA, 103 bp, Artificial Sequence
  Synthetic Polynucleotide
taatacgactcactatagggcggccaggcccagggaggacacgggtagctaacagaggagaagctacatgtgtcctcccaacctggcggcagcgcaaaagatg

SEQ ID NO: 89203 - DNA, 103 bp, Artificial Sequence
  Synthetic Polynucleotide
taatacgactcactatagggttggtgcttgcggccaggcccagggaggacaacagaggagagtcctcatggggcctggcaacctggcggcagcgcaaaagatg

SEQ ID NO: 89204 - DNA, 103 bp, Artificial Sequence
  Synthetic Polynucleotide
taatacgactcactatagggggagctgccattggtgcttgcggccaggccaacagaggagaggcctgatggcaagcaccaacctggcggcagcgcaaaagatg

SEQ ID NO: 89205 - DNA, 103 bp, Artificial Sequence
  Synthetic Polynucleotide
taatacgactcactatagggcgggggtgatggagctgccattggtgcttgaacagaggagacaagcaatgatggcagctaacctggcggcagcgcaaaagatg

SEQ ID NO: 89206 - DNA, 103 bp, Artificial Sequence
  Synthetic Polynucleotide
taatacgactcactatagggatcttaggggcgggggtgatggagctgccaaacagaggagatggcagatgcatcaccccaacctggcggcagcgcaaaagatg

SEQ ID NO: 89207 - DNA, 103 bp, Artificial Sequence
  Synthetic Polynucleotide
taatacgactcactatagggctctttcttgatcttaggggcgggggtgataacagaggagaatcaccatggcccctaagaacctggcggcagcgcaaaagatg

SEQ ID NO: 89208 - DNA, 103 bp, Artificial Sequence
  Synthetic Polynucleotide
taatacgactcactatagggctgagtcctcctctttcttgatcttaggggaacagaggagacccctaatgtcaagaaagaacctggcggcagcgcaaaagatg

SEQ ID NO: 89209 - DNA, 103 bp, Artificial Sequence
  Synthetic Polynucleotide
taatacgactcactatagggctgtcctcgtcgggggcagcccgggcccggaacagaggagaccgggcatgggctgccccaacctggcggcagcgcaaaagatg

SEQ ID NO: 89210 - DNA, 103 bp, Artificial Sequence
  Synthetic Polynucleotide
taatacgactcactatagggatggggatggctgagtcctcctctttcttgaacagaggagacaagaaatgggaggactcaacctggcggcagcgcaaaagatg

SEQ ID NO: 89211 - DNA, 103 bp, Artificial Sequence
  Synthetic Polynucleotide
taatacgactcactatagggagggactgtgatggggatggctgagtcctcaacagaggagagaggacatggccatccccaacctggcggcagcgcaaaagatg

SEQ ID NO: 89212 - DNA, 103 bp, Artificial Sequence
  Synthetic Polynucleotide
taatacgactcactataggggcaggcggccagggactgtgatggggatggaacagaggagaccatccatgtcacagtccaacctggcggcagcgcaaaagatg

SEQ ID NO: 89213 - DNA, 103 bp, Artificial Sequence
  Synthetic Polynucleotide
taatacgactcactatagggagggacacaggcaggcggccagggactgtgaacagaggagacacagtatgtggccgcctaacctggcggcagcgcaaaagatg

SEQ ID NO: 89214 - DNA, 103 bp, Artificial Sequence
  Synthetic Polynucleotide
taatacgactcactataggggtggcccgccagggacacaggcaggcggccaacagaggagaggccgcatgcctgtgtccaacctggcggcagcgcaaaagatg

SEQ ID NO: 89215 - DNA, 103 bp, Artificial Sequence
  Synthetic Polynucleotide
taatacgactcactatagggccaccacagggtggcccgccagggacacagaacagaggagactgtgtatgtggcgggccaacctggcggcagcgcaaaagatg

SEQ ID NO: 89216 - DNA, 103 bp, Artificial Sequence
  Synthetic Polynucleotide
taatacgactcactataggggcctgggctgccaccacagggtggcccgccaacagaggagaggcgggatgccctgtggtaacctggcggcagcgcaaaagatg

SEQ ID NO: 89217 - DNA, 103 bp, Artificial Sequence
  Synthetic Polynucleotide
taatacgactcactatagggcacagctgctgcctgggctgccaccacaggaacagaggagacctgtgatggcagcccagaacctggcggcagcgcaaaagatg

SEQ ID NO: 89218 - DNA, 103 bp, Artificial Sequence
  Synthetic Polynucleotide
taatacgactcactatagggctgctgcttgcacagctgctgcctgggctgaacagaggagacagcccatgcagcagctgaacctggcggcagcgcaaaagatg

SEQ ID NO: 89219 - DNA, 103 bp, Artificial Sequence
  Synthetic Polynucleotide
taatacgactcactataggggcttgggcggctgctgcttgcacagctgctaacagaggagaagcagcatggcaagcagcaacctggcggcagcgcaaaagatg

SEQ ID NO: 89220 - DNA, 103 bp, Artificial Sequence
  Synthetic Polynucleotide
taatacgactcactatagggctcgggctctctgtcctcgtcgggggcagcaacagaggagagctgccatggacgaggacaacctggcggcagcgcaaaagatg

SEQ ID NO: 89221 - DNA, 103 bp, Artificial Sequence
  Synthetic Polynucleotide
taatacgactcactatagggggccacagctgcttgggcggctgctgcttgaacagaggagacaagcaatggccgcccaaaacctggcggcagcgcaaaagatg

SEQ ID NO: 89222 - DNA, 103 bp, Artificial Sequence
  Synthetic Polynucleotide
taatacgactcactatagggctgcctgtgcggccacagctgcttgggcggaacagaggagaccgcccatgcagctgtggaacctggcggcagcgcaaaagatg

SEQ ID NO: 89223 - DNA, 103 bp, Artificial Sequence
  Synthetic Polynucleotide
taatacgactcactatagggtccagggcagctgcctgtgcggccacagctaacagaggagaagctgtatgcgcacaggcaacctggcggcagcgcaaaagatg

SEQ ID NO: 89224 - DNA, 103 bp, Artificial Sequence
  Synthetic Polynucleotide
taatacgactcactatagggccgcagctgttccagggcagctgcctgtgcaacagaggagagcacagatggctgccctgaacctggcggcagcgcaaaagatg

SEQ ID NO: 89225 - DNA, 103 bp, Artificial Sequence
  Synthetic Polynucleotide
taatacgactcactatagggccagcttctcccgcagctgttccagggcagaacagaggagactgcccatgaacagctgcaacctggcggcagcgcaaaagatg

SEQ ID NO: 89226 - DNA, 103 bp, Artificial Sequence
  Synthetic Polynucleotide
taatacgactcactatagggtctgcagactccagcttctcccgcagctgtaacagaggagaacagctatgggagaagctaacctggcggcagcgcaaaagatg

SEQ ID NO: 89227 - DNA, 103 bp, Artificial Sequence
  Synthetic Polynucleotide
taatacgactcactatagggctccggaggctctgcagactccagcttctcaacagaggagagagaagatggagtctgcaaacctggcggcagcgcaaaagatg

SEQ ID NO: 89228 - DNA, 103 bp, Artificial Sequence
  Synthetic Polynucleotide
taatacgactcactatagggccatcttcttctccggaggctctgcagactaacagaggagaagtctgatgagcctccggaacctggcggcagcgcaaaagatg

SEQ ID NO: 89229 - DNA, 103 bp, Artificial Sequence
  Synthetic Polynucleotide
taatacgactcactataggggccaccagggccatcttcttctccggaggcaacagaggagagcctccatggaagaagataacctggcggcagcgcaaaagatg

SEQ ID NO: 89230 - DNA, 103 bp, Artificial Sequence
  Synthetic Polynucleotide
taatacgactcactatagggctgctcatcggccaccagggccatcttcttaacagaggagaaagaagatggccctggtgaacctggcggcagcgcaaaagatg

SEQ ID NO: 89231 - DNA, 103 bp, Artificial Sequence
  Synthetic Polynucleotide
taatacgactcactatagggtccgggcactctcgggctctctgtcctcgtaacagaggagaacgaggatggagagcccgaacctggcggcagcgcaaaagatg

SEQ ID NO: 89232 - DNA, 103 bp, Artificial Sequence
  Synthetic Polynucleotide
taatacgactcactatagggtcagccgttgctgctcatcggccaccagggaacagaggagaccctggatgccgatgagcaacctggcggcagcgcaaaagatg

SEQ ID NO: 89233 - DNA, 103 bp, Artificial Sequence
  Synthetic Polynucleotide
taatacgactcactataggggcacgttgcatcagccgttgctgctcatcgaacagaggagacgatgaatggcaacggctaacctggcggcagcgcaaaagatg

SEQ ID NO: 89234 - DNA, 103 bp, Artificial Sequence
  Synthetic Polynucleotide
taatacgactcactatagggctgctggagtgcacgttgcatcagccgttgaacagaggagacaacggatgatgcaacgtaacctggcggcagcgcaaaagatg

SEQ ID NO: 89235 - DNA, 103 bp, Artificial Sequence
  Synthetic Polynucleotide
taatacgactcactatagggccaggaagttctgctggagtgcacgttgcaaacagaggagatgcaacatgcactccagcaacctggcggcagcgcaaaagatg

SEQ ID NO: 89236 - DNA, 103 bp, Artificial Sequence
  Synthetic Polynucleotide
taatacgactcactataggggccgccatggccaggaagttctgctggagtaacagaggagaactccaatggaacttcctaacctggcggcagcgcaaaagatg

SEQ ID NO: 89237 - DNA, 103 bp, Artificial Sequence
  Synthetic Polynucleotide
taatacgactcactataggggggcagctgggccgccatggccaggaagttaacagaggagaaacttcatggccatggcgaacctggcggcagcgcaaaagatg

SEQ ID NO: 89238 - DNA, 103 bp, Artificial Sequence
  Synthetic Polynucleotide
taatacgactcactataggggaatgctcatgggcagctgggccgccatggaacagaggagaccatggatgcccagctgcaacctggcggcagcgcaaaagatg

SEQ ID NO: 89239 - DNA, 103 bp, Artificial Sequence
  Synthetic Polynucleotide
taatacgactcactatagggctgttgatccgaatgctcatgggcagctggaacagaggagaccagctatgcatgagcataacctggcggcagcgcaaaagatg

SEQ ID NO: 89240 - DNA, 103 bp, Artificial Sequence
  Synthetic Polynucleotide
taatacgactcactatagggggaggcttggctgttgatccgaatgctcataacagaggagaatgagcatgcggatcaacaacctggcggcagcgcaaaagatg

SEQ ID NO: 89241 - DNA, 103 bp, Artificial Sequence
  Synthetic Polynucleotide
taatacgactcactatagggggcggctttcggaggcttggctgttgatccaacagaggagaggatcaatggccaagcctaacctggcggcagcgcaaaagatg

SEQ ID NO: 89242 - DNA, 103 bp, Artificial Sequence
  Synthetic Polynucleotide
taatacgactcactataggggcccgctgcatccgggcactctcgggctctaacagaggagaagagccatggagtgcccgaacctggcggcagcgcaaaagatg

SEQ ID NO: 89243 - DNA, 103 bp, Artificial Sequence
  Synthetic Polynucleotide
taatacgactcactataggggcagagtcctggcggctttcggaggcttggaacagaggagaccaagcatgcgaaagccgaacctggcggcagcgcaaaagatg

SEQ ID NO: 89244 - DNA, 103 bp, Artificial Sequence
  Synthetic Polynucleotide
taatacgactcactatagggcaggttcacagcagagtcctggcggctttcaacagaggagagaaagcatgcaggactctaacctggcggcagcgcaaaagatg

SEQ ID NO: 89245 - DNA, 103 bp, Artificial Sequence
  Synthetic Polynucleotide
taatacgactcactatagggtggtgcccgtcaggttcacagcagagtcctaacagaggagaaggactatgctgtgaaccaacctggcggcagcgcaaaagatg

SEQ ID NO: 89246 - DNA, 103 bp, Artificial Sequence
  Synthetic Polynucleotide
taatacgactcactatagggttgctgccgttggtgcccgtcaggttcacaaacagaggagatgtgaaatggacgggcacaacctggcggcagcgcaaaagatg

SEQ ID NO: 89247 - DNA, 103 bp, Artificial Sequence
  Synthetic Polynucleotide
taatacgactcactataggggctgatgctgttgctgccgttggtgcccgtaacagaggagaacgggcatgaacggcagcaacctggcggcagcgcaaaagatg

SEQ ID NO: 89248 - DNA, 103 bp, Artificial Sequence
  Synthetic Polynucleotide
taatacgactcactatagggccaccgacatgctgatgctgttgctgccgtaacagaggagaacggcaatgacagcatcaaacctggcggcagcgcaaaagatg

SEQ ID NO: 89249 - DNA, 103 bp, Artificial Sequence
  Synthetic Polynucleotide
taatacgactcactatagggccgttgatctccaccgacatgctgatgctgaacagaggagacagcatatgcatgtcggtaacctggcggcagcgcaaaagatg

SEQ ID NO: 89250 - DNA, 103 bp, Artificial Sequence
  Synthetic Polynucleotide
taatacgactcactataggggtacatgatgccgttgatctccaccgacataacagaggagaatgtcgatggagatcaacaacctggcggcagcgcaaaagatg

SEQ ID NO: 89251 - DNA, 103 bp, Artificial Sequence
  Synthetic Polynucleotide
taatacgactcactataggggaactcctgtgtacatgatgccgttgatctaacagaggagaagatcaatggcatcatgtaacctggcggcagcgcaaaagatg

SEQ ID NO: 89252 - DNA, 103 bp, Artificial Sequence
  Synthetic Polynucleotide
taatacgactcactatagggtgagcaaacagaactcctgtgtacatgatgaacagaggagacatcatatgcacaggagtaacctggcggcagcgcaaaagatg

SEQ ID NO: 89253 - DNA, 103 bp, Artificial Sequence
  Synthetic Polynucleotide
taatacgactcactatagggggccatctgagcccgctgcatccgggcactaacagaggagaagtgccatgatgcagcggaacctggcggcagcgcaaaagatg

SEQ ID NO: 89254 - DNA, 103 bp, Artificial Sequence
  Synthetic Polynucleotide
taatacgactcactatagggggccggcggctgagcaaacagaactcctgtaacagaggagaacaggaatgctgtttgctaacctggcggcagcgcaaaagatg

SEQ ID NO: 89255 - DNA, 103 bp, Artificial Sequence
  Synthetic Polynucleotide
taatacgactcactatagggttggcgtgggggccggcggctgagcaaacaaacagaggagatgtttgatgagccgccggaacctggcggcagcgcaaaagatg

SEQ ID NO: 89256 - DNA, 103 bp, Artificial Sequence
  Synthetic Polynucleotide
taatacgactcactatagggggagcagaggttggcgtgggggccggcggcaacagaggagagccgccatgccccacgccaacctggcggcagcgcaaaagatg

SEQ ID NO: 89257 - DNA, 103 bp, Artificial Sequence
  Synthetic Polynucleotide
taatacgactcactatagggtcctttgttgggagcagaggttggcgtgggaacagaggagacccacgatgacctctgctaacctggcggcagcgcaaaagatg

SEQ ID NO: 89258 - DNA, 103 bp, Artificial Sequence
  Synthetic Polynucleotide
taatacgactcactatagggcgccgccgcctcctttgttgggagcagaggaacagaggagacctctgatgccaacaaagaacctggcggcagcgcaaaagatg

SEQ ID NO: 89259 - DNA, 103 bp, Artificial Sequence
  Synthetic Polynucleotide
taatacgactcactatagggctgccgccgccgccgccgcctcctttgttgaacagaggagacaacaaatgaggcggcggaacctggcggcagcgcaaaagatg

SEQ ID NO: 89260 - DNA, 103 bp, Artificial Sequence
  Synthetic Polynucleotide
taatacgactcactataggggttgctgctgctgccgccgccgccgccgccaacagaggagaggcggcatgggcggcggcaacctggcggcagcgcaaaagatg

SEQ ID NO: 89261 - DNA, 103 bp, Artificial Sequence
  Synthetic Polynucleotide
taatacgactcactatagggggccgcctgcgttgctgctgctgccgccgcaacagaggagagcggcgatggcagcagcaaacctggcggcagcgcaaaagatg

SEQ ID NO: 89262 - DNA, 103 bp, Artificial Sequence
  Synthetic Polynucleotide
taatacgactcactatagggtttcctccccggccgcctgcgttgctgctgaacagaggagacagcagatgcgcaggcggaacctggcggcagcgcaaaagatg

SEQ ID NO: 89263 - DNA, 103 bp, Artificial Sequence
  Synthetic Polynucleotide
taatacgactcactatagggggttccggtgtttcctccccggccgcctgcaacagaggagagcaggcatgcggggaggaaacctggcggcagcgcaaaagatg

SEQ ID NO: 89264 - DNA, 103 bp, Artificial Sequence
  Synthetic Polynucleotide
taatacgactcactatagggctgccagtgcggccatctgagcccgctgcaaacagaggagatgcagcatgctcagatggaacctggcggcagcgcaaaagatg

SEQ ID NO: 89265 - DNA, 103 bp, Artificial Sequence
  Synthetic Polynucleotide
taatacgactcactatagggggccgccgctggttccggtgtttcctccccaacagaggagaggggagatgacaccggaaaacctggcggcagcgcaaaagatg

SEQ ID NO: 89266 - DNA, 103 bp, Artificial Sequence
  Synthetic Polynucleotide
taatacgactcactatagggggcccagcctggccgccgctggttccggtgaacagaggagacaccggatgcagcggcggaacctggcggcagcgcaaaagatg

SEQ ID NO: 89267 - DNA, 103 bp, Artificial Sequence
  Synthetic Polynucleotide
taatacgactcactatagggcagccccgctggcccagcctggccgccgctaacagaggagaagcggcatgcaggctgggaacctggcggcagcgcaaaagatg

SEQ ID NO: 89268 - DNA, 103 bp, Artificial Sequence
  Synthetic Polynucleotide
taatacgactcactatagggagggtgtggacagccccgctggcccagcctaacagaggagaaggctgatgcagcggggcaacctggcggcagcgcaaaagatg

SEQ ID NO: 89269 - DNA, 103 bp, Artificial Sequence
  Synthetic Polynucleotide
taatacgactcactataggggtagatgtggagggtgtggacagccccgctaacagaggagaagcgggatggtccacaccaacctggcggcagcgcaaaagatg

SEQ ID NO: 89270 - DNA, 103 bp, Artificial Sequence
  Synthetic Polynucleotide
taatacgactcactataggggttatttgaggtagatgtggagggtgtggaaacagaggagatccacaatgtccacatctaacctggcggcagcgcaaaagatg

SEQ ID NO: 89271 - DNA, 103 bp, Artificial Sequence
  Synthetic Polynucleotide
taatacgactcactatagggaaggcaacgagttatttgaggtagatgtggaacagaggagaccacatatgcctcaaataaacctggcggcagcgcaaaagatg

SEQ ID NO: 89272 - DNA, 103 bp, Artificial Sequence
  Synthetic Polynucleotide
taatacgactcactataggggcccgcatggctgccagtgcggccatctgaaacagaggagatcagatatgcgcactggcaacctggcggcagcgcaaaagatg

SEQ ID NO: 89273 - DNA, 103 bp, Artificial Sequence
  Synthetic Polynucleotide
taatacgactcactatagggcgcagctgcagcccgcatggctgccagtgcaacagaggagagcactgatggccatgcggaacctggcggcagcgcaaaagatg

SEQ ID NO: 89274 - DNA, 103 bp, Artificial Sequence
  Synthetic Polynucleotide
taatacgactcactataggggccgctgcaacagcgtctccatcacggcctaacagaggagaaggccgatgtggagacgcaacctggcggcagcgcaaaagatg

SEQ ID NO: 89275 - DNA, 103 bp, Artificial Sequence
  Synthetic Polynucleotide
taatacgactcactataggggtcccaggcccgcagctgcagcccgcatggaacagaggagaccatgcatgctgcagctgaacctggcggcagcgcaaaagatg

SEQ ID NO: 89276 - DNA, 103 bp, Artificial Sequence
  Synthetic Polynucleotide
taatacgactcactatagggctggctgggtgtcccaggcccgcagctgcaaacagaggagatgcagcatggggcctgggaacctggcggcagcgcaaaagatg

SEQ ID NO: 89277 - DNA, 103 bp, Artificial Sequence
  Synthetic Polynucleotide
taatacgactcactataggggccgccggggctggctgggtgtcccaggccaacagaggagaggcctgatgcacccagccaacctggcggcagcgcaaaagatg

SEQ ID NO: 89278 - DNA, 103 bp, Artificial Sequence
  Synthetic Polynucleotide
taatacgactcactatagggcatcctcagagccgccggggctggctgggtaacagaggagaacccagatggccccggcgaacctggcggcagcgcaaaagatg

SEQ ID NO: 89279 - DNA, 103 bp, Artificial Sequence
  Synthetic Polynucleotide
taatacgactcactatagggcctgggggcccatcctcagagccgccggggaacagaggagaccccggatgctctgaggaaacctggcggcagcgcaaaagatg

SEQ ID NO: 89280 - DNA, 103 bp, Artificial Sequence
  Synthetic Polynucleotide
taatacgactcactatagggctcctccgagcctgggggcccatcctcagaaacagaggagatctgagatggggcccccaaacctggcggcagcgcaaaagatg

SEQ ID NO: 89281 - DNA, 103 bp, Artificial Sequence
  Synthetic Polynucleotide
taatacgactcactatagggccgcgtcctcctcctccgagcctgggggccaacagaggagaggccccatggctcggaggaacctggcggcagcgcaaaagatg

SEQ ID NO: 89282 - DNA, 103 bp, Artificial Sequence
  Synthetic Polynucleotide
taatacgactcactatagggccctcccgggccgcgtcctcctcctccgagaacagaggagactcggaatgggaggacgcaacctggcggcagcgcaaaagatg

SEQ ID NO: 89283 - DNA, 103 bp, Artificial Sequence
  Synthetic Polynucleotide
taatacgactcactataggggcccggtgtcccctcccgggccgcgtcctcaacagaggagagaggacatggcccgggagaacctggcggcagcgcaaaagatg

SEQ ID NO: 89284 - DNA, 103 bp, Artificial Sequence
  Synthetic Polynucleotide
taatacgactcactataggggcccgggtgagcccggtgtcccctcccgggaacagaggagacccgggatgggacaccggaacctggcggcagcgcaaaagatg

SEQ ID NO: 89285 - DNA, 103 bp, Artificial Sequence
  Synthetic Polynucleotide
taatacgactcactataggggcccgctgctgccgctgcaacagcgtctccaacagaggagaggagacatggttgcagcgaacctggcggcagcgcaaaagatg

SEQ ID NO: 89286 - DNA, 103 bp, Artificial Sequence
  Synthetic Polynucleotide
taatacgactcactatagggtctctgcctcgcccgggtgagcccggtgtcaacagaggagagacaccatgctcacccggaacctggcggcagcgcaaaagatg

SEQ ID NO: 89287 - DNA, 103 bp, Artificial Sequence
  Synthetic Polynucleotide
taatacgactcactatagggtcctggcccttctctgcctcgcccgggtgaaacagaggagatcacccatgcgaggcagaaacctggcggcagcgcaaaagatg

SEQ ID NO: 89288 - DNA, 103 bp, Artificial Sequence
  Synthetic Polynucleotide
taatacgactcactatagggagtgctcctctcctggcccttctctgcctcaacagaggagagaggcaatgaagggccagaacctggcggcagcgcaaaagatg

SEQ ID NO: 89289 - DNA, 103 bp, Artificial Sequence
  Synthetic Polynucleotide
taatacgactcactatagggatgtcctcaaagtgctcctctcctggccctaacagaggagaagggccatgagaggagcaaacctggcggcagcgcaaaagatg

SEQ ID NO: 89290 - DNA, 103 bp, Artificial Sequence
  Synthetic Polynucleotide
taatacgactcactataggggtcggaggccatgtcctcaaagtgctcctcaacagaggagagaggagatgtttgaggacaacctggcggcagcgcaaaagatg

SEQ ID NO: 89291 - DNA, 103 bp, Artificial Sequence
  Synthetic Polynucleotide
taatacgactcactatagggtcatgtcctcgtcggaggccatgtcctcaaaacagaggagattgaggatgtggcctccgaacctggcggcagcgcaaaagatg

SEQ ID NO: 89292 - DNA, 103 bp, Artificial Sequence
  Synthetic Polynucleotide
taatacgactcactatagggcatttgggcttcatgtcctcgtcggaggccaacagaggagaggcctcatgcgaggacataacctggcggcagcgcaaaagatg

SEQ ID NO: 89293 - DNA, 103 bp, Artificial Sequence
  Synthetic Polynucleotide
taatacgactcactatagggctcctcctcccatttgggcttcatgtcctcaacagaggagagaggacatgaagcccaaaaacctggcggcagcgcaaaagatg

SEQ ID NO: 89294 - DNA, 103 bp, Artificial Sequence
  Synthetic Polynucleotide
taatacgactcactatagggcctccatctcctcctcctcccatttgggctaacagaggagaagcccaatggggaggaggaacctggcggcagcgcaaaagatg

SEQ ID NO: 89295 - DNA, 103 bp, Artificial Sequence
  Synthetic Polynucleotide
taatacgactcactatagggccgaggtcttcctccatctcctcctcctccaacagaggagaggaggaatgggagatggaaacctggcggcagcgcaaaagatg

SEQ ID NO: 89296 - DNA, 103 bp, Artificial Sequence
  Synthetic Polynucleotide
taatacgactcactatagggctcctggcgcgcccgctgctgccgctgcaaaacagaggagattgcagatgcagcagcggaacctggcggcagcgcaaaagatg

SEQ ID NO: 89297 - DNA, 103 bp, Artificial Sequence
  Synthetic Polynucleotide
taatacgactcactatagggctcatcctccccgaggtcttcctccatctcaacagaggagagagatgatggaagacctcaacctggcggcagcgcaaaagatg

SEQ ID NO: 89298 - DNA, 103 bp, Artificial Sequence
  Synthetic Polynucleotide
taatacgactcactatagggcctcctcctcctcatcctccccgaggtcttaacagaggagaaagaccatggggaggatgaacctggcggcagcgcaaaagatg

SEQ ID NO: 89299 - DNA, 103 bp, Artificial Sequence
  Synthetic Polynucleotide
taatacgactcactatagggtaatcctcctcctcctcctcctcatcctccaacagaggagaggaggaatgggaggaggaaacctggcggcagcgcaaaagatg

SEQ ID NO: 89300 - DNA, 103 bp, Artificial Sequence
  Synthetic Polynucleotide
taatacgactcactatagggctcatcctcgtaatcctcctcctcctcctcaacagaggagagaggagatggaggaggataacctggcggcagcgcaaaagatg

SEQ ID NO: 89301 - DNA, 103 bp, Artificial Sequence
  Synthetic Polynucleotide
taatacgactcactatagggcctcctcctcctcatcctcgtaatcctcctaacagaggagaaggaggatgacgaggatgaacctggcggcagcgcaaaagatg

SEQ ID NO: 89302 - DNA, 103 bp, Artificial Sequence
  Synthetic Polynucleotide
taatacgactcactatagggtcctcgtcctcctcctcctcctcatcctcgaacagaggagacgaggaatgggaggaggaaacctggcggcagcgcaaaagatg

SEQ ID NO: 89303 - DNA, 103 bp, Artificial Sequence
  Synthetic Polynucleotide
taatacgactcactataggggcccagcccctcctcgtcctcctcctcctcaacagaggagagaggagatggaggacgagaacctggcggcagcgcaaaagatg

SEQ ID NO: 89304 - DNA, 103 bp, Artificial Sequence
  Synthetic Polynucleotide
taatacgactcactatagggggcctggggggcccagcccctcctcgtcctaacagaggagaaggacgatgaggggctggaacctggcggcagcgcaaaagatg

SEQ ID NO: 89305 - DNA, 103 bp, Artificial Sequence
  Synthetic Polynucleotide
taatacgactcactatagggaagctggcagggcctggggggcccagccccaacagaggagaggggctatgccccccaggaacctggcggcagcgcaaaagatg

SEQ ID NO: 89306 - DNA, 103 bp, Artificial Sequence
  Synthetic Polynucleotide
taatacgactcactatagggcgtggtgcccaagctggcagggcctgggggaacagaggagacccccaatgcctgccagcaacctggcggcagcgcaaaagatg

SEQ ID NO: 89307 - DNA, 103 bp, Artificial Sequence
  Synthetic Polynucleotide
taatacgactcactataggggggcctccagctcctggcgcgcccgctgctaacagaggagaagcagcatgcgcgccaggaacctggcggcagcgcaaaagatg

SEQ ID NO: 89308 - DNA, 103 bp, Artificial Sequence
  Synthetic Polynucleotide
taatacgactcactatagggggaacagtgccgtggtgcccaagctggcagaacagaggagactgccaatgtgggcaccaaacctggcggcagcgcaaaagatg

SEQ ID NO: 89309 - DNA, 103 bp, Artificial Sequence
  Synthetic Polynucleotide
taatacgactcactataggggcctttcgggggaacagtgccgtggtgcccaacagaggagagggcacatgggcactgttaacctggcggcagcgcaaaagatg

SEQ ID NO: 89310 - DNA, 103 bp, Artificial Sequence
  Synthetic Polynucleotide
taatacgactcactataggggggtggctgggcctttcgggggaacagtgcaacagaggagagcactgatgccccgaaagaacctggcggcagcgcaaaagatg

SEQ ID NO: 89311 - DNA, 103 bp, Artificial Sequence
  Synthetic Polynucleotide
taatacgactcactatagggggaaggcctggggtggctgggcctttcgggaacagaggagacccgaaatgcccagccacaacctggcggcagcgcaaaagatg

SEQ ID NO: 89312 - DNA, 103 bp, Artificial Sequence
  Synthetic Polynucleotide
taatacgactcactatagggccatcgccgcggaaggcctggggtggctggaacagaggagaccagccatgccaggccttaacctggcggcagcgcaaaagatg

SEQ ID NO: 89313 - DNA, 103 bp, Artificial Sequence
  Synthetic Polynucleotide
taatacgactcactatagggcctgggaacgccatcgccgcggaaggcctgaacagaggagacaggccatgcgcggcgataacctggcggcagcgcaaaagatg

SEQ ID NO: 89314 - DNA, 103 bp, Artificial Sequence
  Synthetic Polynucleotide
taatacgactcactatagggcccccagcaccctgggaacgccatcgccgcaacagaggagagcggcgatggcgttcccaaacctggcggcagcgcaaaagatg

SEQ ID NO: 89315 - DNA, 103 bp, Artificial Sequence
  Synthetic Polynucleotide
taatacgactcactatagggcgctcctggccccccagcaccctgggaacgaacagaggagacgttccatgggtgctgggaacctggcggcagcgcaaaagatg

SEQ ID NO: 89316 - DNA, 103 bp, Artificial Sequence
  Synthetic Polynucleotide
taatacgactcactatagggaggccccggccgctcctggccccccagcacaacagaggagagtgctgatgggccaggagaacctggcggcagcgcaaaagatg

SEQ ID NO: 89317 - DNA, 103 bp, Artificial Sequence
  Synthetic Polynucleotide
taatacgactcactataggggggcagggccaggccccggccgctcctggcaacagaggagagccaggatgggccggggcaacctggcggcagcgcaaaagatg

SEQ ID NO: 89318 - DNA, 103 bp, Artificial Sequence
  Synthetic Polynucleotide
taatacgactcactatagggagctgctgccgggcctccagctcctggcgcaacagaggagagcgccaatggctggaggcaacctggcggcagcgcaaaagatg

SEQ ID NO: 89319 - DNA, 103 bp, Artificial Sequence
  Synthetic Polynucleotide
taatacgactcactatagggcctccggggtgggcagggccaggccccggcaacagaggagagccgggatgtggccctgcaacctggcggcagcgcaaaagatg

SEQ ID NO: 89320 - DNA, 103 bp, Artificial Sequence
  Synthetic Polynucleotide
taatacgactcactataggggtgggcggcccctccggggtgggcagggccaacagaggagaggccctatgcaccccggaaacctggcggcagcgcaaaagatg

SEQ ID NO: 89321 - DNA, 103 bp, Artificial Sequence
  Synthetic Polynucleotide
taatacgactcactataggggcggggctacgtgggcggcccctccggggtaacagaggagaaccccgatggggccgcccaacctggcggcagcgcaaaagatg

SEQ ID NO: 89322 - DNA, 103 bp, Artificial Sequence
  Synthetic Polynucleotide
taatacgactcactatagggggctgcagctgcggggctacgtgggcggccaacagaggagaggccgcatgcgtagccccaacctggcggcagcgcaaaagatg

SEQ ID NO: 89323 - DNA, 103 bp, Artificial Sequence
  Synthetic Polynucleotide
taatacgactcactataggggtggtcaggcggctgcagctgcggggctacaacagaggagagtagccatgcagctgcagaacctggcggcagcgcaaaagatg

SEQ ID NO: 89324 - DNA, 103 bp, Artificial Sequence
  Synthetic Polynucleotide
taatacgactcactatagggtccagtcgccgtggtcaggcggctgcagctaacagaggagaagctgcatgcgcctgaccaacctggcggcagcgcaaaagatg

SEQ ID NO: 89325 - DNA, 103 bp, Artificial Sequence
  Synthetic Polynucleotide
taatacgactcactatagggtcctcgtaagtccagtcgccgtggtcaggcaacagaggagagcctgaatgcggcgactgaacctggcggcagcgcaaaagatg

SEQ ID NO: 89326 - DNA, 103 bp, Artificial Sequence
  Synthetic Polynucleotide
taatacgactcactatagggcttaaactgctcctcgtaagtccagtcgccaacagaggagaggcgacatgacttacgagaacctggcggcagcgcaaaagatg

SEQ ID NO: 89327 - DNA, 103 bp, Artificial Sequence
  Synthetic Polynucleotide
taatacgactcactatagggcgtagagctgcttaaactgctcctcgtaagaacagaggagacttacgatgagcagtttaaacctggcggcagcgcaaaagatg

SEQ ID NO: 89328 - DNA, 103 bp, Artificial Sequence
  Synthetic Polynucleotide
taatacgactcactatagggccgtcgagttcgtagagctgcttaaactgcaacagaggagagcagttatggcagctctaaacctggcggcagcgcaaaagatg

SEQ ID NO: 89329 - DNA, 103 bp, Artificial Sequence
  Synthetic Polynucleotide
taatacgactcactatagggatcggggggcagctgctgccgggcctccagaacagaggagactggagatgcggcagcagaacctggcggcagcgcaaaagatg

SEQ ID NO: 89330 - DNA, 103 bp, Artificial Sequence
  Synthetic Polynucleotide
taatacgactcactatagggcttggggtccccgtcgagttcgtagagctgaacagaggagacagctcatggaactcgacaacctggcggcagcgcaaaagatg

SEQ ID NO: 89331 - DNA, 103 bp, Artificial Sequence
  Synthetic Polynucleotide
taatacgactcactatagggattccttcctcttggggtccccgtcgagttaacagaggagaaactcgatggggaccccaaacctggcggcagcgcaaaagatg

SEQ ID NO: 89332 - DNA, 103 bp, Artificial Sequence
  Synthetic Polynucleotide
taatacgactcactatagggtcatccaggaattccttcctcttggggtccaacagaggagaggacccatggaggaaggaaacctggcggcagcgcaaaagatg

SEQ ID NO: 89333 - DNA, 103 bp, Artificial Sequence
  Synthetic Polynucleotide
taatacgactcactataggggctgaacaagtcatccaggaattccttcctaacagaggagaaggaagatgttcctggataacctggcggcagcgcaaaagatg

SEQ ID NO: 89334 - DNA, 103 bp, Artificial Sequence
  Synthetic Polynucleotide
taatacgactcactatagggtctgcatgaagctgaacaagtcatccaggaaacagaggagatcctggatgacttgttcaaacctggcggcagcgcaaaagatg

SEQ ID NO: 89335 - DNA, 103 bp, Artificial Sequence
  Synthetic Polynucleotide
taatacgactcactataggggtccctcgcttctgcatgaagctgaacaagaacagaggagacttgttatgcttcatgcaaacctggcggcagcgcaaaagatg

SEQ ID NO: 89336 - DNA, 103 bp, Artificial Sequence
  Synthetic Polynucleotide
taatacgactcactataggggttcacaggtgtccctcgcttctgcatgaaaacagaggagattcatgatgaagcgagggaacctggcggcagcgcaaaagatg

SEQ ID NO: 89337 - DNA, 103 bp, Artificial Sequence
  Synthetic Polynucleotide
taatacgactcactatagggtggggatgcggttcacaggtgtccctcgctaacagaggagaagcgagatgcacctgtgaaacctggcggcagcgcaaaagatg

SEQ ID NO: 89338 - DNA, 103 bp, Artificial Sequence
  Synthetic Polynucleotide
taatacgactcactatagggttggccatgatggggatgcggttcacaggtaacagaggagaacctgtatgccgcatcccaacctggcggcagcgcaaaagatg

SEQ ID NO: 89339 - DNA, 103 bp, Artificial Sequence
  Synthetic Polynucleotide
taatacgactcactatagggaaggacctgtttggccatgatggggatgcgaacagaggagacgcatcatgatcatggccaacctggcggcagcgcaaaagatg

SEQ ID NO: 89340 - DNA, 103 bp, Artificial Sequence
  Synthetic Polynucleotide
taatacgactcactatagggcagcagggggatcggggggcagctgctgccaacagaggagaggcagcatgtgccccccgaacctggcggcagcgcaaaagatg

SEQ ID NO: 89341 - DNA, 103 bp, Artificial Sequence
  Synthetic Polynucleotide
taatacgactcactatagggtgaacaggtcaaggacctgtttggccatgaaacagaggagatcatggatgaacaggtccaacctggcggcagcgcaaaagatg

SEQ ID NO: 89342 - DNA, 103 bp, Artificial Sequence
  Synthetic Polynucleotide
taatacgactcactatagggacgtacagcatgaacaggtcaaggacctgtaacagaggagaacaggtatgtgacctgttaacctggcggcagcgcaaaagatg

SEQ ID NO: 89343 - DNA, 103 bp, Artificial Sequence
  Synthetic Polynucleotide
taatacgactcactatagggcgtcaccagcacgtacagcatgaacaggtcaacagaggagagacctgatgatgctgtacaacctggcggcagcgcaaaagatg

SEQ ID NO: 89344 - DNA, 103 bp, Artificial Sequence
  Synthetic Polynucleotide
taatacgactcactatagggcgcccttctccgtcaccagcacgtacagcaaacagaggagatgctgtatgtgctggtgaaacctggcggcagcgcaaaagatg

SEQ ID NO: 89345 - DNA, 103 bp, Artificial Sequence
  Synthetic Polynucleotide
taatacgactcactatagggtccacgaggccgcccttctccgtcaccagcaacagaggagagctggtatgggagaagggaacctggcggcagcgcaaaagatg

SEQ ID NO: 89346 - DNA, 103 bp, Artificial Sequence
  Synthetic Polynucleotide
taatacgactcactataggggttgatgacctccacgaggccgcccttctcaacagaggagagagaagatgggcctcgtgaacctggcggcagcgcaaaagatg

SEQ ID NO: 89347 - DNA, 103 bp, Artificial Sequence
  Synthetic Polynucleotide
taatacgactcactatagggacagcttcttgttgatgacctccacgaggcaacagaggagagcctcgatgaggtcatcaaacctggcggcagcgcaaaagatg

SEQ ID NO: 89348 - DNA, 103 bp, Artificial Sequence
  Synthetic Polynucleotide
taatacgactcactatagggatctcacgccacagcttcttgttgatgaccaacagaggagaggtcatatgcaagaagctaacctggcggcagcgcaaaagatg

SEQ ID NO: 89349 - DNA, 103 bp, Artificial Sequence
  Synthetic Polynucleotide
taatacgactcactataggggcccttggtgatctcacgccacagcttcttaacagaggagaaagaagatgtggcgtgagaacctggcggcagcgcaaaagatg

SEQ ID NO: 89350 - DNA, 103 bp, Artificial Sequence
  Synthetic Polynucleotide
taatacgactcactataggggcaggttgaggcccttggtgatctcacgccaacagaggagaggcgtgatgtcaccaaggaacctggcggcagcgcaaaagatg

SEQ ID NO: 89351 - DNA, 103 bp, Artificial Sequence
  Synthetic Polynucleotide
taatacgactcactatagggccggggggtgcagcagggggatcggggggcaacagaggagagcccccatgtccccctgcaacctggcggcagcgcaaaagatg

SEQ ID NO: 89352 - DNA, 103 bp, Artificial Sequence
  Synthetic Polynucleotide
taatacgactcactatagggatggacgtgggcaggttgaggcccttggtgaacagaggagacaccaaatgcctcaacctaacctggcggcagcgcaaaagatg

SEQ ID NO: 89353 - DNA, 103 bp, Artificial Sequence
  Synthetic Polynucleotide
taatacgactcactatagggtgcactggtgatggacgtgggcaggttgagaacagaggagactcaacatgcccacgtccaacctggcggcagcgcaaaagatg

SEQ ID NO: 89354 - DNA, 103 bp, Artificial Sequence
  Synthetic Polynucleotide
taatacgactcactataggggggtgaaggctgcactggtgatggacgtggaacagaggagaccacgtatgtcaccagtgaacctggcggcagcgcaaaagatg

SEQ ID NO: 89355 - DNA, 103 bp, Artificial Sequence
  Synthetic Polynucleotide
taatacgactcactatagggtgggtccgcagggtgaaggctgcactggtgaacagaggagacaccagatgagccttcacaacctggcggcagcgcaaaagatg

SEQ ID NO: 89356 - DNA, 103 bp, Artificial Sequence
  Synthetic Polynucleotide
taatacgactcactatagggcttcatgtattgggtccgcagggtgaaggcaacagaggagagccttcatgctgcggaccaacctggcggcagcgcaaaagatg

SEQ ID NO: 89357 - DNA, 103 bp, Artificial Sequence
  Synthetic Polynucleotide
taatacgactcactatagggggtacaggtacttcatgtattgggtccgcaaacagaggagatgcggaatgaatacatgaaacctggcggcagcgcaaaagatg

SEQ ID NO: 89358 - DNA, 103 bp, Artificial Sequence
  Synthetic Polynucleotide
taatacgactcactatagggcactcgtaggggtacaggtacttcatgtataacagaggagaatacatatggtacctgtaaacctggcggcagcgcaaaagatg

SEQ ID NO: 89359 - DNA, 103 bp, Artificial Sequence
  Synthetic Polynucleotide
taatacgactcactatagggccgcttctcacactcgtaggggtacaggtaaacagaggagatacctgatgccctacgagaacctggcggcagcgcaaaagatg

SEQ ID NO: 89360 - DNA, 103 bp, Artificial Sequence
  Synthetic Polynucleotide
taatacgactcactatagggtactgaggccccgcttctcacactcgtaggaacagaggagacctacgatggtgagaagcaacctggcggcagcgcaaaagatg

SEQ ID NO: 89361 - DNA, 103 bp, Artificial Sequence
  Synthetic Polynucleotide
taatacgactcactatagggtcattggggttactgaggccccgcttctcaaacagaggagatgagaaatggggcctcagaacctggcggcagcgcaaaagatg

SEQ ID NO: 89362 - DNA, 103 bp, Artificial Sequence
  Synthetic Polynucleotide
taatacgactcactatagggctgctgctgctgctgctgaagtggctccataacagaggagaatggagatgcttcagcagaacctggcggcagcgcaaaagatg

SEQ ID NO: 89363 - DNA, 103 bp, Artificial Sequence
  Synthetic Polynucleotide
taatacgactcactataggggaactgggcttctctcatctgctggccctgaacagaggagacagggcatgcagatgagaaacctggcggcagcgcaaaagatg

SEQ ID NO: 89364 - DNA, 103 bp, Artificial Sequence
  Synthetic Polynucleotide
taatacgactcactatagggaggtgagtagccaaagagggaggagctgtaaacagaggagatacagcatgtccctctttaacctggcggcagcgcaaaagatg

SEQ ID NO: 89365 - DNA, 103 bp, Artificial Sequence
  Synthetic Polynucleotide
taatacgactcactatagggtagccgcagcaggtgagtagccaaagagggaacagaggagaccctctatggctactcacaacctggcggcagcgcaaaagatg

SEQ ID NO: 89366 - DNA, 103 bp, Artificial Sequence
  Synthetic Polynucleotide
taatacgactcactataggggcagcagcagtagccgcagcaggtgagtagaacagaggagactactcatgtgctgcggcaacctggcggcagcgcaaaagatg

SEQ ID NO: 89367 - DNA, 103 bp, Artificial Sequence
  Synthetic Polynucleotide
taatacgactcactatagggcccggcagcggcagcagcagtagccgcagcaacagaggagagctgcgatgactgctgctaacctggcggcagcgcaaaagatg

SEQ ID NO: 89368 - DNA, 103 bp, Artificial Sequence
  Synthetic Polynucleotide
taatacgactcactataggggggcaggggccccggcagcggcagcagcagaacagaggagactgctgatgccgctgccgaacctggcggcagcgcaaaagatg

SEQ ID NO: 89369 - DNA, 103 bp, Artificial Sequence
  Synthetic Polynucleotide
taatacgactcactatagggggggagagaagggcaggggccccggcagcgaacagaggagacgctgcatgggcccctgcaacctggcggcagcgcaaaagatg

SEQ ID NO: 89370 - DNA, 103 bp, Artificial Sequence
  Synthetic Polynucleotide
taatacgactcactataggggatcttgggtggggagagaagggcaggggcaacagaggagagcccctatgcttctctccaacctggcggcagcgcaaaagatg

SEQ ID NO: 89371 - DNA, 103 bp, Artificial Sequence
  Synthetic Polynucleotide
taatacgactcactatagggtgggaaagcggatcttgggtggggagagaaaacagaggagattctctatgcacccaagaaacctggcggcagcgcaaaagatg

SEQ ID NO: 89372 - DNA, 103 bp, Artificial Sequence
  Synthetic Polynucleotide
taatacgactcactatagggagcccaaggatgggaaagcggatcttgggtaacagaggagaacccaaatgccgctttccaacctggcggcagcgcaaaagatg

SEQ ID NO: 89373 - DNA, 103 bp, Artificial Sequence
  Synthetic Polynucleotide
taatacgactcactataggggctggagccaagcccaaggatgggaaagcgaacagaggagacgctttatgatccttgggaacctggcggcagcgcaaaagatg

SEQ ID NO: 89374 - DNA, 103 bp, Artificial Sequence
  Synthetic Polynucleotide
taatacgactcactataggggggcatacaagaactgggcttctctcatctaacagaggagaagatgaatgaagcccagtaacctggcggcagcgcaaaagatg

SEQ ID NO: 89375 - DNA, 103 bp, Artificial Sequence
  Synthetic Polynucleotide
taatacgactcactatagggtggtaccactgctggagccaagcccaaggaaacagaggagatccttgatgttggctccaaacctggcggcagcgcaaaagatg

SEQ ID NO: 89376 - DNA, 103 bp, Artificial Sequence
  Synthetic Polynucleotide
taatacgactcactatagggctactggtattggtaccactgctggagccaaacagaggagatggctcatgcagtggtacaacctggcggcagcgcaaaagatg

SEQ ID NO: 89377 - DNA, 103 bp, Artificial Sequence
  Synthetic Polynucleotide
taatacgactcactatagggtatccgagggctactggtattggtaccactaacagaggagaagtggtatgaataccagtaacctggcggcagcgcaaaagatg

SEQ ID NO: 89378 - DNA, 103 bp, Artificial Sequence
  Synthetic Polynucleotide
taatacgactcactatagggttgctggggatatccgagggctactggtataacagaggagaataccaatggccctcggaaacctggcggcagcgcaaaagatg

SEQ ID NO: 89379 - DNA, 103 bp, Artificial Sequence
  Synthetic Polynucleotide
taatacgactcactatagggctgagagtggttgctggggatatccgagggaacagaggagaccctcgatgatccccagcaacctggcggcagcgcaaaagatg

SEQ ID NO: 89380 - DNA, 103 bp, Artificial Sequence
  Synthetic Polynucleotide
taatacgactcactatagggatcacctttcctgagagtggttgctggggaaacagaggagatccccaatgaccactctcaacctggcggcagcgcaaaagatg

SEQ ID NO: 89381 - DNA, 103 bp, Artificial Sequence
  Synthetic Polynucleotide
taatacgactcactatagggctggggctccatcacctttcctgagagtggaacagaggagaccactcatgggaaaggtgaacctggcggcagcgcaaaagatg

SEQ ID NO: 89382 - DNA, 103 bp, Artificial Sequence
  Synthetic Polynucleotide
taatacgactcactatagggactgttgtcactggggctccatcacctttcaacagaggagagaaaggatgtggagccccaacctggcggcagcgcaaaagatg

SEQ ID NO: 89383 - DNA, 103 bp, Artificial Sequence
  Synthetic Polynucleotide
taatacgactcactatagggtggcacaggcactgttgtcactggggctccaacagaggagaggagccatggtgacaacaaacctggcggcagcgcaaaagatg

SEQ ID NO: 89384 - DNA, 103 bp, Artificial Sequence
  Synthetic Polynucleotide
taatacgactcactatagggccagacgatttggcacaggcactgttgtcaaacagaggagatgacaaatgtgcctgtgcaacctggcggcagcgcaaaagatg

SEQ ID NO: 89385 - DNA, 103 bp, Artificial Sequence
  Synthetic Polynucleotide
taatacgactcactatagggaccagcttttgggcatacaagaactgggctaacagaggagaagcccaatgcttgtatgcaacctggcggcagcgcaaaagatg

SEQ ID NO: 89386 - DNA, 103 bp, Artificial Sequence
  Synthetic Polynucleotide
taatacgactcactatagggacgggcacagccagacgatttggcacaggcaacagaggagagcctgtatgaaatcgtctaacctggcggcagcgcaaaagatg

SEQ ID NO: 89387 - DNA, 103 bp, Artificial Sequence
  Synthetic Polynucleotide
taatacgactcactatagggtgccaaggtcacgggcacagccagacgattaacagaggagaaatcgtatggctgtgcccaacctggcggcagcgcaaaagatg

SEQ ID NO: 89388 - DNA, 103 bp, Artificial Sequence
  Synthetic Polynucleotide
taatacgactcactatagggcctgctggcttgccaaggtcacgggcacagaacagaggagactgtgcatgtgaccttggaacctggcggcagcgcaaaagatg

SEQ ID NO: 89389 - DNA, 103 bp, Artificial Sequence
  Synthetic Polynucleotide
taatacgactcactatagggcgagtaccagcctgctggcttgccaaggtcaacagaggagagaccttatgaagccagcaaacctggcggcagcgcaaaagatg

SEQ ID NO: 89390 - DNA, 103 bp, Artificial Sequence
  Synthetic Polynucleotide
taatacgactcactatagggtgcggcggtccgagtaccagcctgctggctaacagaggagaagccagatggctggtactaacctggcggcagcgcaaaagatg

SEQ ID NO: 89391 - DNA, 103 bp, Artificial Sequence
  Synthetic Polynucleotide
taatacgactcactataggggctgctccagtgcggcggtccgagtaccagaacagaggagactggtaatgggaccgccgaacctggcggcagcgcaaaagatg

SEQ ID NO: 89392 - DNA, 103 bp, Artificial Sequence
  Synthetic Polynucleotide
taatacgactcactatagggcgctcccgcagctgctccagtgcggcggtcaacagaggagagaccgcatgactggagcaaacctggcggcagcgcaaaagatg

SEQ ID NO: 89393 - DNA, 103 bp, Artificial Sequence
  Synthetic Polynucleotide
taatacgactcactatagggtgactccagccgctcccgcagctgctccagaacagaggagactggagatgctgcgggagaacctggcggcagcgcaaaagatg

SEQ ID NO: 89394 - DNA, 103 bp, Artificial Sequence
  Synthetic Polynucleotide
taatacgactcactatagggcaggctcccctgactccagccgctcccgcaaacagaggagatgcgggatgggctggagtaacctggcggcagcgcaaaagatg

SEQ ID NO: 89395 - DNA, 103 bp, Artificial Sequence
  Synthetic Polynucleotide
taatacgactcactatagggttcttctcagcaggctcccctgactccagcaacagaggagagctggaatgaggggagccaacctggcggcagcgcaaaagatg

SEQ ID NO: 89396 - DNA, 103 bp, Artificial Sequence
  Synthetic Polynucleotide
taatacgactcactatagggcggctgtgtgaccagcttttgggcatacaaaacagaggagattgtatatgcaaaagctgaacctggcggcagcgcaaaagatg

SEQ ID NO: 89397 - DNA, 103 bp, Artificial Sequence
  Synthetic Polynucleotide
taatacgactcactatagggcctcgatgccttcttctcagcaggctccccaacagaggagaggggagatggctgagaagaacctggcggcagcgcaaaagatg

SEQ ID NO: 89398 - DNA, 103 bp, Artificial Sequence
  Synthetic Polynucleotide
taatacgactcactatagggcctcagacagcctcgatgccttcttctcagaacagaggagactgagaatgaggcatcgaaacctggcggcagcgcaaaagatg

SEQ ID NO: 89399 - DNA, 103 bp, Artificial Sequence
  Synthetic Polynucleotide
taatacgactcactatagggcgctgctcctcctcagacagcctcgatgccaacagaggagaggcatcatggctgtctgaaacctggcggcagcgcaaaagatg

SEQ ID NO: 89400 - DNA, 103 bp, Artificial Sequence
  Synthetic Polynucleotide
taatacgactcactatagggctgcaccaggcgctgctcctcctcagacagaacagaggagactgtctatggaggagcagaacctggcggcagcgcaaaagatg

SEQ ID NO: 89401 - DNA, 103 bp, Artificial Sequence
  Synthetic Polynucleotide
taatacgactcactatagggggaaggcctgctgcaccaggcgctgctcctaacagaggagaaggagcatggcctggtgcaacctggcggcagcgcaaaagatg

SEQ ID NO: 89402 - DNA, 103 bp, Artificial Sequence
  Synthetic Polynucleotide
taatacgactcactatagggaagttgcgctggaaggcctgctgcaccaggaacagaggagacctggtatggcaggccttaacctggcggcagcgcaaaagatg

SEQ ID NO: 89403 - DNA, 103 bp, Artificial Sequence
  Synthetic Polynucleotide
taatacgactcactatagggcatgctgaaaaagttgcgctggaaggcctgaacagaggagacaggccatgcagcgcaacaacctggcggcagcgcaaaagatg

SEQ ID NO: 89404 - DNA, 103 bp, Artificial Sequence
  Synthetic Polynucleotide
taatacgactcactataggggctgccgtgccatgctgaaaaagttgcgctaacagaggagaagcgcaatgttttcagcaaacctggcggcagcgcaaaagatg

SEQ ID NO: 89405 - DNA, 103 bp, Artificial Sequence
  Synthetic Polynucleotide
taatacgactcactatagggttcatggggagctgccgtgccatgctgaaaaacagaggagatttcagatgggcacggcaaacctggcggcagcgcaaaagatg

SEQ ID NO: 89406 - DNA, 103 bp, Artificial Sequence
  Synthetic Polynucleotide
taatacgactcactataggggatcctgatcttcatggggagctgccgtgcaacagaggagagcacggatgctccccatgaacctggcggcagcgcaaaagatg

SEQ ID NO: 89407 - DNA, 103 bp, Artificial Sequence
  Synthetic Polynucleotide
taatacgactcactatagggaaaggagagtcggctgtgtgaccagcttttaacagaggagaaaaagcatgtcacacagcaacctggcggcagcgcaaaagatg

SEQ ID NO: 89408 - DNA, 103 bp, Artificial Sequence
  Synthetic Polynucleotide
taatacgactcactatagggccctgccgttgatcctgatcttcatggggaaacagaggagatccccaatgagatcaggaaacctggcggcagcgcaaaagatg

SEQ ID NO: 89409 - DNA, 103 bp, Artificial Sequence
  Synthetic Polynucleotide
taatacgactcactataggggctctgtcttccctgccgttgatcctgatcaacagaggagagatcagatgcaacggcagaacctggcggcagcgcaaaagatg

SEQ ID NO: 89410 - DNA, 103 bp, Artificial Sequence
  Synthetic Polynucleotide
taatacgactcactatagggcgaggcctctgctctgtcttccctgccgttaacagaggagaaacggcatggaagacagaaacctggcggcagcgcaaaagatg

SEQ ID NO: 89411 - DNA, 103 bp, Artificial Sequence
  Synthetic Polynucleotide
taatacgactcactataggggtgctgcagccgaggcctctgctctgtcttaacagaggagaaagacaatgcagaggcctaacctggcggcagcgcaaaagatg

SEQ ID NO: 89412 - DNA, 103 bp, Artificial Sequence
  Synthetic Polynucleotide
taatacgactcactataggggtcaggttcagtgctgcagccgaggcctctaacagaggagaagaggcatgggctgcagcaacctggcggcagcgcaaaagatg

SEQ ID NO: 89413 - DNA, 103 bp, Artificial Sequence
  Synthetic Polynucleotide
taatacgactcactataggggctactcgtggtcaggttcagtgctgcagcaacagaggagagctgcaatgctgaacctgaacctggcggcagcgcaaaagatg

SEQ ID NO: 89414 - DNA, 103 bp, Artificial Sequence
  Synthetic Polynucleotide
taatacgactcactatagggtgctcccaatgctactcgtggtcaggttcaaacagaggagatgaaccatgccacgagtaaacctggcggcagcgcaaaagatg

SEQ ID NO: 89415 - DNA, 103 bp, Artificial Sequence
  Synthetic Polynucleotide
taatacgactcactataggggacatgttaatgctcccaatgctactcgtgaacagaggagacacgagatgcattgggagaacctggcggcagcgcaaaagatg

SEQ ID NO: 89416 - DNA, 103 bp, Artificial Sequence
  Synthetic Polynucleotide
taatacgactcactataggggatgtccacagacatgttaatgctcccaataacagaggagaattgggatgattaacatgaacctggcggcagcgcaaaagatg

SEQ ID NO: 89417 - DNA, 103 bp, Artificial Sequence
  Synthetic Polynucleotide
taatacgactcactatagggtggtgccatcgatgtccacagacatgttaaaacagaggagattaacaatgctgtggacaaacctggcggcagcgcaaaagatg

SEQ ID NO: 89418 - DNA, 103 bp, Artificial Sequence
  Synthetic Polynucleotide
taatacgactcactataggggctgtggcggaaaggagagtcggctgtgtgaacagaggagacacacaatggactctcctaacctggcggcagcgcaaaagatg

SEQ ID NO: 89419 - DNA, 103 bp, Artificial Sequence
  Synthetic Polynucleotide
taatacgactcactatagggcctgcataggtggtgccatcgatgtccacaaacagaggagatgtggaatgcgatggcacaacctggcggcagcgcaaaagatg

SEQ ID NO: 89420 - DNA, 103 bp, Artificial Sequence
  Synthetic Polynucleotide
taatacgactcactatagggaaacagcacacctgcataggtggtgccatcaacagaggagagatggcatgacctatgcaaacctggcggcagcgcaaaagatg

SEQ ID NO: 89421 - DNA, 103 bp, Artificial Sequence
  Synthetic Polynucleotide
taatacgactcactataggggcttctgggcaaacagcacacctgcataggaacagaggagacctatgatggtgtgctgtaacctggcggcagcgcaaaagatg

SEQ ID NO: 89422 - DNA, 103 bp, Artificial Sequence
  Synthetic Polynucleotide
taatacgactcactatagggtggaccacaggcttctgggcaaacagcacaaacagaggagatgtgctatgtgcccagaaaacctggcggcagcgcaaaagatg

SEQ ID NO: 89423 - DNA, 103 bp, Artificial Sequence
  Synthetic Polynucleotide
taatacgactcactatagggcgtgatgaggtggaccacaggcttctgggcaacagaggagagcccagatgcctgtggtcaacctggcggcagcgcaaaagatg

SEQ ID NO: 89424 - DNA, 103 bp, Artificial Sequence
  Synthetic Polynucleotide
taatacgactcactataggggagcagaccccgtgatgaggtggaccacagaacagaggagactgtggatgacctcatcaaacctggcggcagcgcaaaagatg

SEQ ID NO: 89425 - DNA, 103 bp, Artificial Sequence
  Synthetic Polynucleotide
taatacgactcactatagggaggctctggggagcagaccccgtgatgaggaacagaggagacctcatatgggggtctgcaacctggcggcagcgcaaaagatg

SEQ ID NO: 89426 - DNA, 103 bp, Artificial Sequence
  Synthetic Polynucleotide
taatacgactcactataggggctgctgccgaggctctggggagcagacccaacagaggagagggtctatgccccagagcaacctggcggcagcgcaaaagatg

SEQ ID NO: 89427 - DNA, 103 bp, Artificial Sequence
  Synthetic Polynucleotide
taatacgactcactatagggtgctgctggcgctgctgccgaggctctgggaacagaggagacccagaatgtcggcagcaaacctggcggcagcgcaaaagatg

SEQ ID NO: 89428 - DNA, 103 bp, Artificial Sequence
  Synthetic Polynucleotide
taatacgactcactataggggagctgctgctgctgctggcgctgctgccgaacagaggagacggcagatgcgccagcagaacctggcggcagcgcaaaagatg

SEQ ID NO: 89429 - DNA, 103 bp, Artificial Sequence
  Synthetic Polynucleotide
taatacgactcactatagggaggtctcccagctgtggcggaaaggagagtaacagaggagaactctcatgtccgccacaaacctggcggcagcgcaaaagatg

SEQ ID NO: 89430 - DNA, 103 bp, Artificial Sequence
  Synthetic Polynucleotide
taatacgactcactatagggtgaacagtgagagctgctgctgctgctggcaacagaggagagccagcatgagcagcagcaacctggcggcagcgcaaaagatg

SEQ ID NO: 89431 - DNA, 103 bp, Artificial Sequence
  Synthetic Polynucleotide
taatacgactcactatagggtaggacttggtgaacagtgagagctgctgcaacagaggagagcagcaatgctcactgttaacctggcggcagcgcaaaagatg

SEQ ID NO: 89432 - DNA, 103 bp, Artificial Sequence
  Synthetic Polynucleotide
taatacgactcactatagggcgggatgaggtaggacttggtgaacagtgaaacagaggagatcactgatgaccaagtccaacctggcggcagcgcaaaagatg

SEQ ID NO: 89433 - DNA, 103 bp, Artificial Sequence
  Synthetic Polynucleotide
taatacgactcactataggggggggtgccccgggatgaggtaggacttggaacagaggagaccaagtatgacctcatccaacctggcggcagcgcaaaagatg

SEQ ID NO: 89434 - DNA, 103 bp, Artificial Sequence
  Synthetic Polynucleotide
taatacgactcactataggggctctgcgctgggggtgccccgggatgaggaacagaggagacctcatatgggggcacccaacctggcggcagcgcaaaagatg

SEQ ID NO: 89435 - DNA, 103 bp, Artificial Sequence
  Synthetic Polynucleotide
taatacgactcactatagggctggtggagggctctgcgctgggggtgcccaacagaggagagggcacatgcagcgcagaaacctggcggcagcgcaaaagatg

SEQ ID NO: 89436 - DNA, 103 bp, Artificial Sequence
  Synthetic Polynucleotide
taatacgactcactataggggagggaccagctggtggagggctctgcgctaacagaggagaagcgcaatgccctccaccaacctggcggcagcgcaaaagatg

SEQ ID NO: 89437 - DNA, 103 bp, Artificial Sequence
  Synthetic Polynucleotide
taatacgactcactatagggtgctgccagaaggtctcccagctgtggcggaacagaggagaccgccaatgctgggagacaacctggcggcagcgcaaaagatg

SEQ ID NO: 89438 - DNA, 103 bp, Artificial Sequence
  Synthetic Polynucleotide
taatacgactcactatagggcctaagggagtgctgccagaaggtctcccaaacagaggagatgggagatgttctggcagaacctggcggcagcgcaaaagatg

SEQ ID NO: 89439 - DNA, 103 bp, Artificial Sequence
  Synthetic Polynucleotide
taatacgactcactatagggggctaagggacctaagggagtgctgccagaaacagaggagatctggcatgactcccttaaacctggcggcagcgcaaaagatg

SEQ ID NO: 89440 - DNA, 103 bp, Artificial Sequence
  Synthetic Polynucleotide
taatacgactcactataggggttgctgctgctgctgctgctgctgctgaaaacagaggagattcagcatgagcagcagcaacctggcggcagcgcaaaagatg

SEQ ID NO: 89441 - DNA, 103 bp, Artificial Sequence
  Synthetic Polynucleotide
taatacgactcactataggggtggaactctggctaagggacctaagggagaacagaggagactccctatggtcccttagaacctggcggcagcgcaaaagatg

SEQ ID NO: 89442 - DNA, 103 bp, Artificial Sequence
  Synthetic Polynucleotide
taatacgactcactataggggctgcggtgggtggaactctggctaagggaaacagaggagatcccttatgcagagttccaacctggcggcagcgcaaaagatg

SEQ ID NO: 89443 - DNA, 103 bp, Artificial Sequence
  Synthetic Polynucleotide
taatacgactcactatagggttgggccactgctgcggtgggtggaactctaacagaggagaagagttatgcccaccgcaaacctggcggcagcgcaaaagatg

SEQ ID NO: 89444 - DNA, 103 bp, Artificial Sequence
  Synthetic Polynucleotide
taatacgactcactataggggttcaaacacttgggccactgctgcggtggaacagaggagaccaccgatgcagtggcccaacctggcggcagcgcaaaagatg

SEQ ID NO: 89445 - DNA, 103 bp, Artificial Sequence
  Synthetic Polynucleotide
taatacgactcactatagggatgttgccccgttcaaacacttgggccactaacagaggagaagtggcatgagtgtttgaaacctggcggcagcgcaaaagatg

SEQ ID NO: 89446 - DNA, 103 bp, Artificial Sequence
  Synthetic Polynucleotide
taatacgactcactatagggctctgagttcatgttgccccgttcaaacacaacagaggagagtgtttatgcggggcaacaacctggcggcagcgcaaaagatg

SEQ ID NO: 89447 - DNA, 103 bp, Artificial Sequence
  Synthetic Polynucleotide
taatacgactcactatagggcttcctcaggctctgagttcatgttgccccaacagaggagaggggcaatgtgaactcagaacctggcggcagcgcaaaagatg

SEQ ID NO: 89448 - DNA, 103 bp, Artificial Sequence
  Synthetic Polynucleotide
taatacgactcactatagggcctccgtcctcttcctcaggctctgagttcaacagaggagagaactcatggcctgaggaaacctggcggcagcgcaaaagatg

SEQ ID NO: 89449 - DNA, 103 bp, Artificial Sequence
  Synthetic Polynucleotide
taatacgactcactatagggatcttccaaacctccgtcctcttcctcaggaacagaggagacctgagatggaggacggaaacctggcggcagcgcaaaagatg

SEQ ID NO: 89450 - DNA, 103 bp, Artificial Sequence
  Synthetic Polynucleotide
taatacgactcactatagggccccatcctcatcttccaaacctccgtcctaacagaggagaaggacgatggtttggaagaacctggcggcagcgcaaaagatg

SEQ ID NO: 89451 - DNA, 103 bp, Artificial Sequence
  Synthetic Polynucleotide
taatacgactcactatagggtgcttctgttgttgctgctgctgctgctgcaacagaggagagcagcaatggcagcagcaaacctggcggcagcgcaaaagatg

SEQ ID NO: 89452 - DNA, 103 bp, Artificial Sequence
  Synthetic Polynucleotide
taatacgactcactatagggacttcatcatccccatcctcatcttccaaaaacagaggagatttggaatgtgaggatggaacctggcggcagcgcaaaagatg

SEQ ID NO: 89453 - DNA, 103 bp, Artificial Sequence
  Synthetic Polynucleotide
taatacgactcactatagggcacctctgcaacttcatcatccccatcctcaacagaggagagaggatatggatgatgaaaacctggcggcagcgcaaaagatg

SEQ ID NO: 89454 - DNA, 103 bp, Artificial Sequence
  Synthetic Polynucleotide
taatacgactcactatagggctttctcagccacctctgcaacttcatcataacagaggagaatgatgatgttgcagaggaacctggcggcagcgcaaaagatg

SEQ ID NO: 89455 - DNA, 103 bp, Artificial Sequence
  Synthetic Polynucleotide
taatacgactcactataggggcctgggtttctttctcagccacctctgcaaacagaggagatgcagaatgggctgagaaaacctggcggcagcgcaaaagatg

SEQ ID NO: 89456 - DNA, 103 bp, Artificial Sequence
  Synthetic Polynucleotide
taatacgactcactatagggttttgaagcagcctgggtttctttctcagcaacagaggagagctgagatggaaacccagaacctggcggcagcgcaaaagatg

SEQ ID NO: 89457 - DNA, 103 bp, Artificial Sequence
  Synthetic Polynucleotide
taatacgactcactatagggcatgaaaatattttgaagcagcctgggtttaacagaggagaaaacccatgctgcttcaaaacctggcggcagcgcaaaagatg

SEQ ID NO: 89458 - DNA, 103 bp, Artificial Sequence
  Synthetic Polynucleotide
taatacgactcactatagggactttctgcacatgaaaatattttgaagcaaacagaggagatgcttcatgatattttcaaacctggcggcagcgcaaaagatg

SEQ ID NO: 89459 - DNA, 103 bp, Artificial Sequence
  Synthetic Polynucleotide
taatacgactcactatagggttggcgagctactttctgcacatgaaaataaacagaggagatattttatggtgcagaaaaacctggcggcagcgcaaaagatg

SEQ ID NO: 89460 - DNA, 103 bp, Artificial Sequence
  Synthetic Polynucleotide
taatacgactcactatagggctctgggatcttggcgagctactttctgcaaacagaggagatgcagaatgtagctcgccaacctggcggcagcgcaaaagatg

SEQ ID NO: 89461 - DNA, 103 bp, Artificial Sequence
  Synthetic Polynucleotide
taatacgactcactatagggatgggtgccactctgggatcttggcgagctaacagaggagaagctcgatgagatcccagaacctggcggcagcgcaaaagatg

SEQ ID NO: 89462 - DNA, 103 bp, Artificial Sequence
  Synthetic Polynucleotide
taatacgactcactatagggcaggtgtggctgcttctgttgttgctgctgaacagaggagacagcagatgcaacagaagaacctggcggcagcgcaaaagatg

SEQ ID NO: 89463 - DNA, 103 bp, Artificial Sequence
  Synthetic Polynucleotide
taatacgactcactatagggtagattggacatgggtgccactctgggatcaacagaggagagatcccatggtggcacccaacctggcggcagcgcaaaagatg

SEQ ID NO: 89464 - DNA, 103 bp, Artificial Sequence
  Synthetic Polynucleotide
taatacgactcactataggggtgctggaagtagattggacatgggtgccaaacagaggagatggcacatgtgtccaatcaacctggcggcagcgcaaaagatg

SEQ ID NO: 89465 - DNA, 103 bp, Artificial Sequence
  Synthetic Polynucleotide
taatacgactcactataggggggagccctggtgctggaagtagattggacaacagaggagagtccaaatgacttccagcaacctggcggcagcgcaaaagatg

SEQ ID NO: 89466 - DNA, 103 bp, Artificial Sequence
  Synthetic Polynucleotide
taatacgactcactatagggtccatgtggtgggagccctggtgctggaagaacagaggagacttccaatgccagggctcaacctggcggcagcgcaaaagatg

SEQ ID NO: 89467 - DNA, 103 bp, Artificial Sequence
  Synthetic Polynucleotide
taatacgactcactatagggtagcttgttgtccatgtggtgggagccctgaacagaggagacagggcatgcaccacatgaacctggcggcagcgcaaaagatg

SEQ ID NO: 89468 - DNA, 103 bp, Artificial Sequence
  Synthetic Polynucleotide
taatacgactcactatagggtggtcttctttagcttgttgtccatgtggtaacagaggagaaccacaatgacaacaagcaacctggcggcagcgcaaaagatg

SEQ ID NO: 89469 - DNA, 103 bp, Artificial Sequence
  Synthetic Polynucleotide
taatacgactcactatagggatctttggtatggtcttctttagcttgttgaacagaggagacaacaaatgaaagaagacaacctggcggcagcgcaaaagatg

SEQ ID NO: 89470 - DNA, 103 bp, Artificial Sequence
  Synthetic Polynucleotide
taatacgactcactatagggccttggaagcatctttggtatggtcttcttaacagaggagaaagaagatgataccaaagaacctggcggcagcgcaaaagatg

SEQ ID NO: 89471 - DNA, 103 bp, Artificial Sequence
  Synthetic Polynucleotide
taatacgactcactataggggaaggtgaggccttggaagcatctttggtaaacagaggagataccaaatgtgcttccaaaacctggcggcagcgcaaaagatg

SEQ ID NO: 89472 - DNA, 103 bp, Artificial Sequence
  Synthetic Polynucleotide
taatacgactcactatagggtgtggagacagaaggtgaggccttggaagcaacagaggagagcttccatggcctcacctaacctggcggcagcgcaaaagatg

SEQ ID NO: 89473 - DNA, 103 bp, Artificial Sequence
  Synthetic Polynucleotide
taatacgactcactataggggcagaggagccaggtgtggctgcttctgttaacagaggagaaacagaatgagccacaccaacctggcggcagcgcaaaagatg

SEQ ID NO: 89474 - DNA, 103 bp, Artificial Sequence
  Synthetic Polynucleotide
taatacgactcactataggggctgtcctgctgtggagacagaaggtgaggaacagaggagacctcacatgctgtctccaaacctggcggcagcgcaaaagatg

SEQ ID NO: 89475 - DNA, 103 bp, Artificial Sequence
  Synthetic Polynucleotide
taatacgactcactatagggttccagttcggctgtcctgctgtggagacaaacagaggagatgtctcatgagcaggacaaacctggcggcagcgcaaaagatg

SEQ ID NO: 89476 - DNA, 103 bp, Artificial Sequence
  Synthetic Polynucleotide
taatacgactcactatagggctcatccagattccagttcggctgtcctgcaacagaggagagcaggaatgccgaactggaacctggcggcagcgcaaaagatg

SEQ ID NO: 89477 - DNA, 103 bp, Artificial Sequence
  Synthetic Polynucleotide
taatacgactcactataggggcttgagctgctcatccagattccagttcgaacagaggagacgaactatgatctggatgaacctggcggcagcgcaaaagatg

SEQ ID NO: 89478 - DNA, 103 bp, Artificial Sequence
  Synthetic Polynucleotide
taatacgactcactatagggccaccattctgcttgagctgctcatccagaaacagaggagatctggaatggcagctcaaaacctggcggcagcgcaaaagatg

SEQ ID NO: 89479 - DNA, 103 bp, Artificial Sequence
  Synthetic Polynucleotide
taatacgactcactatagggccaggccaaaccaccattctgcttgagctgaacagaggagacagctcatgcagaatggtaacctggcggcagcgcaaaagatg

SEQ ID NO: 89480 - DNA, 103 bp, Artificial Sequence
  Synthetic Polynucleotide
taatacgactcactatagggcatcatcactccaggccaaaccaccattctaacagaggagaagaatgatggtttggcctaacctggcggcagcgcaaaagatg

SEQ ID NO: 89481 - DNA, 103 bp, Artificial Sequence
  Synthetic Polynucleotide
taatacgactcactatagggcctccatctgcatcatcactccaggccaaaaacagaggagatttggcatggagtgatgaaacctggcggcagcgcaaaagatg

SEQ ID NO: 89482 - DNA, 103 bp, Artificial Sequence
  Synthetic Polynucleotide
taatacgactcactatagggtcttccccggcctccatctgcatcatcactaacagaggagaagtgatatggcagatggaaacctggcggcagcgcaaaagatg

SEQ ID NO: 89483 - DNA, 103 bp, Artificial Sequence
  Synthetic Polynucleotide
taatacgactcactataggggagagatctctcttccccggcctccatctgaacagaggagacagatgatggccggggaaaacctggcggcagcgcaaaagatg

SEQ ID NO: 89484 - DNA, 103 bp, Artificial Sequence
  Synthetic Polynucleotide
taatacgactcactataggggcatccatctgcagaggagccaggtgtggcaacagaggagagccacaatgggctcctctaacctggcggcagcgcaaaagatg

SEQ ID NO: 89485 - DNA, 103 bp, Artificial Sequence
  Synthetic Polynucleotide
taatacgactcactataggggcaaaatctcgagagatctctcttccccggaacagaggagaccggggatgagagatctcaacctggcggcagcgcaaaagatg

SEQ ID NO: 89486 - DNA, 103 bp, Artificial Sequence
  Synthetic Polynucleotide
taatacgactcactatagggatacagcttggcaaaatctcgagagatctcaacagaggagagagatcatgcgagattttaacctggcggcagcgcaaaagatg

SEQ ID NO: 89487 - DNA, 103 bp, Artificial Sequence
  Synthetic Polynucleotide
taatacgactcactatagggcgtccagttcatacagcttggcaaaatctcaacagaggagagagattatgccaagctgtaacctggcggcagcgcaaaagatg

SEQ ID NO: 89488 - DNA, 103 bp, Artificial Sequence
  Synthetic Polynucleotide
taatacgactcactatagggtcaggatcaccgtccagttcatacagcttgaacagaggagacaagctatgtgaactggaaacctggcggcagcgcaaaagatg

SEQ ID NO: 89489 - DNA, 103 bp, Artificial Sequence
  Synthetic Polynucleotide
taatacgactcactatagggctctttcctttcaggatcaccgtccagttcaacagaggagagaactgatgggtgatcctaacctggcggcagcgcaaaagatg

SEQ ID NO: 89490 - DNA, 103 bp, Artificial Sequence
  Synthetic Polynucleotide
taatacgactcactatagggcatccaggaactctttcctttcaggatcacaacagaggagagtgatcatgaaaggaaagaacctggcggcagcgcaaaagatg

SEQ ID NO: 89491 - DNA, 103 bp, Artificial Sequence
  Synthetic Polynucleotide
taatacgactcactatagggacgaagaggtcatccaggaactctttccttaacagaggagaaaggaaatggttcctggaaacctggcggcagcgcaaaagatg

SEQ ID NO: 89492 - DNA, 103 bp, Artificial Sequence
  Synthetic Polynucleotide
taatacgactcactatagggctgcataaagacgaagaggtcatccaggaaaacagaggagattcctgatggacctcttcaacctggcggcagcgcaaaagatg

SEQ ID NO: 89493 - DNA, 103 bp, Artificial Sequence
  Synthetic Polynucleotide
taatacgactcactatagggtccccctcttctgcataaagacgaagaggtaacagaggagaacctctatgtctttatgcaacctggcggcagcgcaaaagatg

SEQ ID NO: 89494 - DNA, 103 bp, Artificial Sequence
  Synthetic Polynucleotide
taatacgactcactatagggttgatgggggtccccctcttctgcataaagaacagaggagactttatatggaagaggggaacctggcggcagcgcaaaagatg

SEQ ID NO: 89495 - DNA, 103 bp, Artificial Sequence
  Synthetic Polynucleotide
taatacgactcactatagggcttctctctggcatccatctgcagaggagcaacagaggagagctcctatgcagatggataacctggcggcagcgcaaaagatg

SEQ ID NO: 89496 - DNA, 103 bp, Artificial Sequence
  Synthetic Polynucleotide
taatacgactcactatagggggggattcggttgatgggggtccccctcttaacagaggagaaagaggatgacccccatcaacctggcggcagcgcaaaagatg

SEQ ID NO: 89497 - DNA, 103 bp, Artificial Sequence
  Synthetic Polynucleotide
taatacgactcactatagggtggccatgatggggattcggttgatgggggaacagaggagacccccaatgaccgaatccaacctggcggcagcgcaaaagatg

SEQ ID NO: 89498 - DNA, 103 bp, Artificial Sequence
  Synthetic Polynucleotide
taatacgactcactatagggaggatctgtttggccatgatggggattcggaacagaggagaccgaatatgcatcatggcaacctggcggcagcgcaaaagatg

SEQ ID NO: 89499 - DNA, 103 bp, Artificial Sequence
  Synthetic Polynucleotide
taatacgactcactataggggtacaggtccaggatctgtttggccatgataacagaggagaatcatgatgaaacagatcaacctggcggcagcgcaaaagatg

SEQ ID NO: 89500 - DNA, 103 bp, Artificial Sequence
  Synthetic Polynucleotide
taatacgactcactatagggtatacagcatgtacaggtccaggatctgttaacagaggagaaacagaatgtggacctgtaacctggcggcagcgcaaaagatg

SEQ ID NO: 89501 - DNA, 103 bp, Artificial Sequence
  Synthetic Polynucleotide
taatacgactcactataggggtcaccagcttatacagcatgtacaggtccaacagaggagaggacctatgcatgctgtaaacctggcggcagcgcaaaagatg

SEQ ID NO: 89502 - DNA, 103 bp, Artificial Sequence
  Synthetic Polynucleotide
taatacgactcactatagggtcccttctcggtcaccagcttatacagcataacagaggagaatgctgatgaagctggtgaacctggcggcagcgcaaaagatg

SEQ ID NO: 89503 - DNA, 103 bp, Artificial Sequence
  Synthetic Polynucleotide
taatacgactcactatagggccaccaggcctcccttctcggtcaccagctaacagaggagaagctggatgccgagaaggaacctggcggcagcgcaaaagatg

SEQ ID NO: 89504 - DNA, 103 bp, Artificial Sequence
  Synthetic Polynucleotide
taatacgactcactatagggttgatgatctccaccaggcctcccttctcgaacagaggagacgagaaatgaggcctggtaacctggcggcagcgcaaaagatg

SEQ ID NO: 89505 - DNA, 103 bp, Artificial Sequence
  Synthetic Polynucleotide
taatacgactcactataggggatcttcttgttgatgatctccaccaggccaacagaggagaggcctgatggagatcatcaacctggcggcagcgcaaaagatg

SEQ ID NO: 89506 - DNA, 103 bp, Artificial Sequence
  Synthetic Polynucleotide
taatacgactcactataggggctggccctgcttctctctggcatccatctaacagaggagaagatggatgccagagagaaacctggcggcagcgcaaaagatg

SEQ ID NO: 89507 - DNA, 103 bp, Artificial Sequence
  Synthetic Polynucleotide
taatacgactcactatagggtctccctccagatcttcttgttgatgatctaacagaggagaagatcaatgacaagaagaaacctggcggcagcgcaaaagatg

SEQ ID NO: 89508 - DNA, 103 bp, Artificial Sequence
  Synthetic Polynucleotide
taatacgactcactatagggcctttggtgatctccctccagatcttcttgaacagaggagacaagaaatgctggagggaaacctggcggcagcgcaaaagatg

SEQ ID NO: 89509 - DNA, 103 bp, Artificial Sequence
  Synthetic Polynucleotide
taatacgactcactatagggcaggtttaggcctttggtgatctccctccaaacagaggagatggaggatgatcaccaaaaacctggcggcagcgcaaaagatg

SEQ ID NO: 89510 - DNA, 103 bp, Artificial Sequence
  Synthetic Polynucleotide
taatacgactcactatagggtggatgtgggcaggtttaggcctttggtgaaacagaggagatcaccaatggcctaaaccaacctggcggcagcgcaaaagatg

SEQ ID NO: 89511 - DNA, 103 bp, Artificial Sequence
  Synthetic Polynucleotide
taatacgactcactataggggcgctggtgatggatgtgggcaggtttaggaacagaggagacctaaaatggcccacatcaacctggcggcagcgcaaaagatg

SEQ ID NO: 89512 - DNA, 103 bp, Artificial Sequence
  Synthetic Polynucleotide
taatacgactcactatagggggtgaaggcggcgctggtgatggatgtgggaacagaggagacccacaatgatcaccagcaacctggcggcagcgcaaaagatg

SEQ ID NO: 89513 - DNA, 103 bp, Artificial Sequence
  Synthetic Polynucleotide
taatacgactcactataggggcgtcctgagggtgaaggcggcgctggtgaaacagaggagatcaccaatgccgccttcaaacctggcggcagcgcaaaagatg

SEQ ID NO: 89514 - DNA, 103 bp, Artificial Sequence
  Synthetic Polynucleotide
taatacgactcactatagggttcatgtactgcgtcctgagggtgaaggcgaacagaggagacgccttatgcctcaggacaacctggcggcagcgcaaaagatg

SEQ ID NO: 89515 - DNA, 103 bp, Artificial Sequence
  Synthetic Polynucleotide
taatacgactcactatagggatacagatacttcatgtactgcgtcctgagaacagaggagactcaggatgcagtacatgaacctggcggcagcgcaaaagatg

SEQ ID NO: 89516 - DNA, 103 bp, Artificial Sequence
  Synthetic Polynucleotide
taatacgactcactatagggactcataggcatacagatacttcatgtactaacagaggagaagtacaatgagtatctgtaacctggcggcagcgcaaaagatg

SEQ ID NO: 89517 - DNA, 103 bp, Artificial Sequence
  Synthetic Polynucleotide
taatacgactcactatagggtctctcatctgctggccctgcttctctctgaacagaggagacagagaatggcagggccaaacctggcggcagcgcaaaagatg

SEQ ID NO: 89518 - DNA, 103 bp, Artificial Sequence
  Synthetic Polynucleotide
taatacgactcactatagggttcttctcacactcataggcatacagatacaacagaggagagtatctatgtgcctatgaaacctggcggcagcgcaaaagatg

SEQ ID NO: 89519 - DNA, 103 bp, Artificial Sequence
  Synthetic Polynucleotide
taatacgactcactatagggactcaaggctttcttctcacactcataggcaacagaggagagcctatatgtgtgagaagaacctggcggcagcgcaaaagatg

SEQ ID NO: 89520 - DNA, 103 bp, Artificial Sequence
  Synthetic Polynucleotide
taatacgactcactatagggcggctggggaactcaaggctttcttctcacaacagaggagagtgagaatgaagccttgaaacctggcggcagcgcaaaagatg

SEQ ID NO: 89521 - DNA, 103 bp, Artificial Sequence
  Synthetic Polynucleotide
taatacgactcactataggggcctggagctcggctggggaactcaaggctaacagaggagaagccttatgttccccagcaacctggcggcagcgcaaaagatg

SEQ ID NO: 89522 - DNA, 103 bp, Artificial Sequence
  Synthetic Polynucleotide
taatacgactcactatagggatcaattgctgcctggagctcggctggggaaacagaggagatccccaatggagctccagaacctggcggcagcgcaaaagatg

SEQ ID NO: 89523 - DNA, 103 bp, Artificial Sequence
  Synthetic Polynucleotide
taatacgactcactatagggtgcggttgccatcaattgctgcctggagctaacagaggagaagctccatgcagcaattgaacctggcggcagcgcaaaagatg

SEQ ID NO: 89524 - DNA, 103 bp, Artificial Sequence
  Synthetic Polynucleotide
taatacgactcactatagggcggccctccctgcggttgccatcaattgctaacagaggagaagcaatatgtggcaaccgaacctggcggcagcgcaaaagatg

SEQ ID NO: 89525 - DNA, 103 bp, Artificial Sequence
  Synthetic Polynucleotide
taatacgactcactataggggctgggccgccggccctccctgcggttgccaacagaggagaggcaacatgagggagggcaacctggcggcagcgcaaaagatg

SEQ ID NO: 89526 - DNA, 103 bp, Artificial Sequence
  Synthetic Polynucleotide
taatacgactcactatagggaggagctgtagctgggccgccggccctcccaacagaggagagggaggatgggcggcccaaacctggcggcagcgcaaaagatg

SEQ ID NO: 89527 - DNA, 103 bp, Artificial Sequence
  Synthetic Polynucleotide
taatacgactcactatagggccaaagagggaggagctgtagctgggccgcaacagaggagagcggccatgctacagctcaacctggcggcagcgcaaaagatg

SEQ ID NO: 89528 - DNA, 103 bp, Artificial Sequence
  Synthetic Polynucleotide
taatacgactcactatagggagctgcctgctgcttctgcagggcctccataacagaggagaatggagatgctgcagaagaacctggcggcagcgcaaaagatg

SEQ ID NO: 89529 - DNA, 103 bp, Artificial Sequence
  Synthetic Polynucleotide
taatacgactcactatagggggcctgtagggtccggtggtcaggcaggggaacagaggagacccctgatggaccaccggaacctggcggcagcgcaaaagatg

SEQ ID NO: 89530 - DNA, 103 bp, Artificial Sequence
  Synthetic Polynucleotide
taatacgactcactataggggaaactggggggcatgcaaggtcgaggtggaacagaggagaccacctatgccttgcatgaacctggcggcagcgcaaaagatg

SEQ ID NO: 89531 - DNA, 103 bp, Artificial Sequence
  Synthetic Polynucleotide
taatacgactcactatagggcacggggcaggaaactggggggcatgcaagaacagaggagacttgcaatgcccccagttaacctggcggcagcgcaaaagatg

SEQ ID NO: 89532 - DNA, 103 bp, Artificial Sequence
  Synthetic Polynucleotide
taatacgactcactatagggggaaccttgccacggggcaggaaactggggaacagaggagaccccagatgcctgccccgaacctggcggcagcgcaaaagatg

SEQ ID NO: 89533 - DNA, 103 bp, Artificial Sequence
  Synthetic Polynucleotide
taatacgactcactatagggttccctcaggggaaccttgccacggggcagaacagaggagactgcccatgggcaaggttaacctggcggcagcgcaaaagatg

SEQ ID NO: 89534 - DNA, 103 bp, Artificial Sequence
  Synthetic Polynucleotide
taatacgactcactatagggccagccgctcttccctcaggggaaccttgcaacagaggagagcaaggatgccctgagggaacctggcggcagcgcaaaagatg

SEQ ID NO: 89535 - DNA, 103 bp, Artificial Sequence
  Synthetic Polynucleotide
taatacgactcactatagggagaggcccatccagccgctcttccctcaggaacagaggagacctgagatgagagcggctaacctggcggcagcgcaaaagatg

SEQ ID NO: 89536 - DNA, 103 bp, Artificial Sequence
  Synthetic Polynucleotide
taatacgactcactatagggtgccagattaagaggcccatccagccgctcaacagaggagagagcggatggatgggcctaacctggcggcagcgcaaaagatg

SEQ ID NO: 89537 - DNA, 103 bp, Artificial Sequence
  Synthetic Polynucleotide
taatacgactcactatagggtgccactgcctgccagattaagaggcccataacagaggagaatgggcatgttaatctggaacctggcggcagcgcaaaagatg

SEQ ID NO: 89538 - DNA, 103 bp, Artificial Sequence
  Synthetic Polynucleotide
taatacgactcactatagggatactgctgatgccactgcctgccagattaaacagaggagataatctatgaggcagtggaacctggcggcagcgcaaaagatg

SEQ ID NO: 89539 - DNA, 103 bp, Artificial Sequence
  Synthetic Polynucleotide
taatacgactcactatagggggccatgttgatactgctgatgccactgccaacagaggagaggcagtatgatcagcagtaacctggcggcagcgcaaaagatg

SEQ ID NO: 89540 - DNA, 103 bp, Artificial Sequence
  Synthetic Polynucleotide
taatacgactcactatagggccccctcaggggcctgtagggtccggtggtaacagaggagaaccaccatgccctacaggaacctggcggcagcgcaaaagatg

SEQ ID NO: 89541 - DNA, 103 bp, Artificial Sequence
  Synthetic Polynucleotide
taatacgactcactatagggtgatctctagggccatgttgatactgctgaaacagaggagatcagcaatgtcaacatggaacctggcggcagcgcaaaagatg

SEQ ID NO: 89542 - DNA, 103 bp, Artificial Sequence
  Synthetic Polynucleotide
taatacgactcactatagggaccaccccgttgatctctagggccatgttgaacagaggagacaacatatgcctagagataacctggcggcagcgcaaaagatg

SEQ ID NO: 89543 - DNA, 103 bp, Artificial Sequence
  Synthetic Polynucleotide
taatacgactcactatagggaccagtgtagaccaccccgttgatctctagaacagaggagactagagatgaacggggtgaacctggcggcagcgcaaaagatg

SEQ ID NO: 89544 - DNA, 103 bp, Artificial Sequence
  Synthetic Polynucleotide
taatacgactcactatagggcaaagaggacaccagtgtagaccaccccgtaacagaggagaacggggatgtctacactgaacctggcggcagcgcaaaagatg

SEQ ID NO: 89545 - DNA, 103 bp, Artificial Sequence
  Synthetic Polynucleotide
taatacgactcactatagggtggcggcgggcaaagaggacaccagtgtagaacagaggagactacacatgtgtcctcttaacctggcggcagcgcaaaagatg

SEQ ID NO: 89546 - DNA, 103 bp, Artificial Sequence
  Synthetic Polynucleotide
taatacgactcactatagggtggcacaggctggcggcgggcaaagaggacaacagaggagagtcctcatggcccgccgcaacctggcggcagcgcaaaagatg

SEQ ID NO: 89547 - DNA, 103 bp, Artificial Sequence
  Synthetic Polynucleotide
taatacgactcactatagggcctgggaagctggcacaggctggcggcgggaacagaggagacccgccatgagcctgtgcaacctggcggcagcgcaaaagatg

SEQ ID NO: 89548 - DNA, 103 bp, Artificial Sequence
  Synthetic Polynucleotide
taatacgactcactatagggttggttggaccctgggaagctggcacaggcaacagaggagagcctgtatgagcttcccaaacctggcggcagcgcaaaagatg

SEQ ID NO: 89549 - DNA, 103 bp, Artificial Sequence
  Synthetic Polynucleotide
taatacgactcactataggggggtgcagggttggttggaccctgggaagcaacagaggagagcttccatgggtccaaccaacctggcggcagcgcaaaagatg

SEQ ID NO: 89550 - DNA, 103 bp, Artificial Sequence
  Synthetic Polynucleotide
taatacgactcactatagggtggagggtgggggtgcagggttggttggacaacagaggagagtccaaatgaccctgcacaacctggcggcagcgcaaaagatg

SEQ ID NO: 89551 - DNA, 103 bp, Artificial Sequence
  Synthetic Polynucleotide
taatacgactcactatagggttccccaaggccccctcaggggcctgtaggaacagaggagacctacaatgccctgagggaacctggcggcagcgcaaaagatg

SEQ ID NO: 89552 - DNA, 103 bp, Artificial Sequence
  Synthetic Polynucleotide
taatacgactcactataggggggggccctgtggagggtgggggtgcagggaacagaggagaccctgcatgcccaccctcaacctggcggcagcgcaaaagatg

SEQ ID NO: 89553 - DNA, 103 bp, Artificial Sequence
  Synthetic Polynucleotide
taatacgactcactataggggatgctggaagggggccctgtggagggtggaacagaggagaccacccatgacagggcccaacctggcggcagcgcaaaagatg

SEQ ID NO: 89554 - DNA, 103 bp, Artificial Sequence
  Synthetic Polynucleotide
taatacgactcactatagggagccccaacattccccaaggccccctcaggaacagaggagacctgagatggccttggggaacctggcggcagcgcaaaagatg

SEQ ID NO: 89555 - DNA, 103 bp, Artificial Sequence
  Synthetic Polynucleotide
taatacgactcactatagggcctcttcctcagccccaacattccccaaggaacagaggagaccttggatgatgttggggaacctggcggcagcgcaaaagatg

SEQ ID NO: 89556 - DNA, 103 bp, Artificial Sequence
  Synthetic Polynucleotide
taatacgactcactatagggtcagcatcttcctcttcctcagccccaacaaacagaggagatgttggatgtgaggaagaaacctggcggcagcgcaaaagatg

SEQ ID NO: 89557 - DNA, 103 bp, Artificial Sequence
  Synthetic Polynucleotide
taatacgactcactatagggctcatcttcttcagcatcttcctcttcctcaacagaggagagaggaaatggaagatgctaacctggcggcagcgcaaaagatg

SEQ ID NO: 89558 - DNA, 103 bp, Artificial Sequence
  Synthetic Polynucleotide
taatacgactcactatagggcccgcttctcctcatcttcttcagcatcttaacagaggagaaagatgatgaagaagatgaacctggcggcagcgcaaaagatg

SEQ ID NO: 89559 - DNA, 103 bp, Artificial Sequence
  Synthetic Polynucleotide
taatacgactcactatagggccggcttcctcccgcttctcctcatcttctaacagaggagaagaagaatgggagaagcgaacctggcggcagcgcaaaagatg

SEQ ID NO: 89560 - DNA, 103 bp, Artificial Sequence
  Synthetic Polynucleotide
taatacgactcactatagggctcctctgccccggcttcctcccgcttctcaacagaggagagagaagatggaggaagccaacctggcggcagcgcaaaagatg

SEQ ID NO: 89561 - DNA, 103 bp, Artificial Sequence
  Synthetic Polynucleotide
taatacgactcactataggggggccagccgagctgcctgctgcttctgcaaacagaggagatgcagaatgagcaggcagaacctggcggcagcgcaaaagatg

SEQ ID NO: 89562 - DNA, 103 bp, Artificial Sequence
  Synthetic Polynucleotide
taatacgactcactatagggcagctgcctcctcctctgccccggcttcctaacagaggagaaggaagatggggcagaggaacctggcggcagcgcaaaagatg

SEQ ID NO: 89563 - DNA, 103 bp, Artificial Sequence
  Synthetic Polynucleotide
taatacgactcactatagggcggctctcctcagctgcctcctcctctgccaacagaggagaggcagaatgggaggcagcaacctggcggcagcgcaaaagatg

SEQ ID NO: 89564 - DNA, 103 bp, Artificial Sequence
  Synthetic Polynucleotide
taatacgactcactatagggggcccctggacggctctcctcagctgcctcaacagaggagagaggcaatggaggagagcaacctggcggcagcgcaaaagatg

SEQ ID NO: 89565 - DNA, 103 bp, Artificial Sequence
  Synthetic Polynucleotide
taatacgactcactatagggtggggccctgggcccctggacggctctcctaacagaggagaaggagaatggtccaggggaacctggcggcagcgcaaaagatg

SEQ ID NO: 89566 - DNA, 103 bp, Artificial Sequence
  Synthetic Polynucleotide
taatacgactcactataggggaaggcgagctggggccctgggcccctggaaacagaggagatccaggatgccagggcccaacctggcggcagcgcaaaagatg

SEQ ID NO: 89567 - DNA, 103 bp, Artificial Sequence
  Synthetic Polynucleotide
taatacgactcactataggggggctggctagaaggcgagctggggccctgaacagaggagacagggcatgagctcgcctaacctggcggcagcgcaaaagatg

SEQ ID NO: 89568 - DNA, 103 bp, Artificial Sequence
  Synthetic Polynucleotide
taatacgactcactatagggggagtccagggggctggctagaaggcgagcaacagaggagagctcgcatgctagccagcaacctggcggcagcgcaaaagatg

SEQ ID NO: 89569 - DNA, 103 bp, Artificial Sequence
  Synthetic Polynucleotide
taatacgactcactatagggtcgtggggatggagtccagggggctggctaaacagaggagatagccaatgccctggactaacctggcggcagcgcaaaagatg

SEQ ID NO: 89570 - DNA, 103 bp, Artificial Sequence
  Synthetic Polynucleotide
taatacgactcactataggggtaggtccactcgtggggatggagtccaggaacagaggagacctggaatgcatccccacaacctggcggcagcgcaaaagatg

SEQ ID NO: 89571 - DNA, 103 bp, Artificial Sequence
  Synthetic Polynucleotide
taatacgactcactatagggattgttcctcgtaggtccactcgtggggataacagaggagaatccccatgagtggacctaacctggcggcagcgcaaaagatg

SEQ ID NO: 89572 - DNA, 103 bp, Artificial Sequence
  Synthetic Polynucleotide
taatacgactcactatagggcccaccccctgggccagccgagctgcctgcaacagaggagagcaggcatgtcggctggcaacctggcggcagcgcaaaagatg

SEQ ID NO: 89573 - DNA, 103 bp, Artificial Sequence
  Synthetic Polynucleotide
taatacgactcactatagggagctgcttgaattgttcctcgtaggtccacaacagaggagagtggacatgcgaggaacaaacctggcggcagcgcaaaagatg

SEQ ID NO: 89574 - DNA, 103 bp, Artificial Sequence
  Synthetic Polynucleotide
taatacgactcactataggggagctcatacagctgcttgaattgttcctcaacagaggagagaggaaatgttcaagcagaacctggcggcagcgcaaaagatg

SEQ ID NO: 89575 - DNA, 103 bp, Artificial Sequence
  Synthetic Polynucleotide
taatacgactcactatagggggtctgcatcgagctcatacagctgcttgaaacagaggagatcaagcatgtgtatgagcaacctggcggcagcgcaaaagatg

SEQ ID NO: 89576 - DNA, 103 bp, Artificial Sequence
  Synthetic Polynucleotide
taatacgactcactatagggttcctcttggggtctgcatcgagctcatacaacagaggagagtatgaatgcgatgcagaaacctggcggcagcgcaaaagatg

SEQ ID NO: 89577 - DNA, 103 bp, Artificial Sequence
  Synthetic Polynucleotide
taatacgactcactatagggcagaaattccttcctcttggggtctgcatcaacagaggagagatgcaatgcccaagaggaacctggcggcagcgcaaaagatg

SEQ ID NO: 89578 - DNA, 103 bp, Artificial Sequence
  Synthetic Polynucleotide
taatacgactcactatagggacaggtcatccagaaattccttcctcttggaacagaggagaccaagaatgaggaatttcaacctggcggcagcgcaaaagatg

SEQ ID NO: 89579 - DNA, 103 bp, Artificial Sequence
  Synthetic Polynucleotide
taatacgactcactatagggatgaagctaaacaggtcatccagaaattccaacagaggagaggaattatgggatgacctaacctggcggcagcgcaaaagatg

SEQ ID NO: 89580 - DNA, 103 bp, Artificial Sequence
  Synthetic Polynucleotide
taatacgactcactatagggcctcttttgcatgaagctaaacaggtcatcaacagaggagagatgacatgtttagcttcaacctggcggcagcgcaaaagatg

SEQ ID NO: 89581 - DNA, 103 bp, Artificial Sequence
  Synthetic Polynucleotide
taatacgactcactatagggctggcgtccccctcttttgcatgaagctaaaacagaggagattagctatgtgcaaaagaaacctggcggcagcgcaaaagatg

SEQ ID NO: 89582 - DNA, 103 bp, Artificial Sequence
  Synthetic Polynucleotide
taatacgactcactatagggacgcggttcactggcgtccccctcttttgcaacagaggagagcaaaaatgggggacgccaacctggcggcagcgcaaaagatg

SEQ ID NO: 89583 - DNA, 103 bp, Artificial Sequence
  Synthetic Polynucleotide
taatacgactcactatagggggccaatggccccaccccctgggccagccgaacagaggagacggctgatgcagggggtgaacctggcggcagcgcaaaagatg

SEQ ID NO: 89584 - DNA, 103 bp, Artificial Sequence
  Synthetic Polynucleotide
taatacgactcactatagggcatgatgggcacgcggttcactggcgtcccaacagaggagagggacgatggtgaaccgcaacctggcggcagcgcaaaagatg

SEQ ID NO: 89585 - DNA, 103 bp, Artificial Sequence
  Synthetic Polynucleotide
taatacgactcactatagggcctgcttcgccatgatgggcacgcggttcaaacagaggagatgaaccatgtgcccatcaaacctggcggcagcgcaaaagatg

SEQ ID NO: 89586 - DNA, 103 bp, Artificial Sequence
  Synthetic Polynucleotide
taatacgactcactatagggaggtcgagcacctgcttcgccatgatgggcaacagaggagagcccatatgggcgaagcaaacctggcggcagcgcaaaagatg

SEQ ID NO: 89587 - DNA, 103 bp, Artificial Sequence
  Synthetic Polynucleotide
taatacgactcactatagggcagagcgtacaggtcgagcacctgcttcgcaacagaggagagcgaagatggtgctcgacaacctggcggcagcgcaaaagatg

SEQ ID NO: 89588 - DNA, 103 bp, Artificial Sequence
  Synthetic Polynucleotide
taatacgactcactatagggccaggcgaaacagagcgtacaggtcgagcaaacagaggagatgctcgatgtgtacgctcaacctggcggcagcgcaaaagatg

SEQ ID NO: 89589 - DNA, 103 bp, Artificial Sequence
  Synthetic Polynucleotide
taatacgactcactatagggttggcggtcaccaggcgaaacagagcgtacaacagaggagagtacgcatggtttcgcctaacctggcggcagcgcaaaagatg

SEQ ID NO: 89590 - DNA, 103 bp, Artificial Sequence
  Synthetic Polynucleotide
taatacgactcactatagggcaggccgcccttggcggtcaccaggcgaaaaacagaggagatttcgcatggtgaccgccaacctggcggcagcgcaaaagatg

SEQ ID NO: 89591 - DNA, 103 bp, Artificial Sequence
  Synthetic Polynucleotide
taatacgactcactatagggtgacttccaccaggccgcccttggcggtcaaacagaggagatgaccgatgagggcggccaacctggcggcagcgcaaaagatg

SEQ ID NO: 89592 - DNA, 103 bp, Artificial Sequence
  Synthetic Polynucleotide
taatacgactcactatagggttgcggttgatgacttccaccaggccgcccaacagaggagagggcggatgggtggaagtaacctggcggcagcgcaaaagatg

SEQ ID NO: 89593 - DNA, 103 bp, Artificial Sequence
  Synthetic Polynucleotide
taatacgactcactatagggccgccacactttgcggttgatgacttccacaacagaggagagtggaaatgatcaaccgcaacctggcggcagcgcaaaagatg

SEQ ID NO: 89594 - DNA, 103 bp, Artificial Sequence
  Synthetic Polynucleotide
taatacgactcactatagggggcatgcaggggccaatggccccaccccctaacagaggagaagggggatgggccattggaacctggcggcagcgcaaaagatg

SEQ ID NO: 89595 - DNA, 103 bp, Artificial Sequence
  Synthetic Polynucleotide
taatacgactcactataggggcgtgacttcccgccacactttgcggttgaaacagaggagatcaaccatgaagtgtggcaacctggcggcagcgcaaaagatg

SEQ ID NO: 89596 - DNA, 103 bp, Artificial Sequence
  Synthetic Polynucleotide
taatacgactcactatagggctgaggccgcgcgtgacttcccgccacactaacagaggagaagtgtgatgggaagtcacaacctggcggcagcgcaaaagatg

SEQ ID NO: 89597 - DNA, 103 bp, Artificial Sequence
  Synthetic Polynucleotide
taatacgactcactatagggggtgggtaggctgaggccgcgcgtgacttcaacagaggagagaagtcatgcgcggcctcaacctggcggcagcgcaaaagatg

SEQ ID NO: 89598 - DNA, 103 bp, Artificial Sequence
  Synthetic Polynucleotide
taatacgactcactatagggaggtgatggtggtgggtaggctgaggccgcaacagaggagagcggccatggcctacccaaacctggcggcagcgcaaaagatg

SEQ ID NO: 89599 - DNA, 103 bp, Artificial Sequence
  Synthetic Polynucleotide
taatacgactcactatagggaaggcggccgaggtgatggtggtgggtaggaacagaggagacctaccatgcaccatcacaacctggcggcagcgcaaaagatg

SEQ ID NO: 89600 - DNA, 103 bp, Artificial Sequence
  Synthetic Polynucleotide
taatacgactcactataggggcgtagagtgaaggcggccgaggtgatggtaacagaggagaaccatcatgtcggccgccaacctggcggcagcgcaaaagatg

SEQ ID NO: 89601 - DNA, 103 bp, Artificial Sequence
  Synthetic Polynucleotide
taatacgactcactatagggtgtactgggtgcgtagagtgaaggcggccgaacagaggagacggccgatgtcactctacaacctggcggcagcgcaaaagatg

SEQ ID NO: 89602 - DNA, 103 bp, Artificial Sequence
  Synthetic Polynucleotide
taatacgactcactatagggaggtacttcatgtactgggtgcgtagagtgaacagaggagacactctatgcacccagtaaacctggcggcagcgcaaaagatg

SEQ ID NO: 89603 - DNA, 103 bp, Artificial Sequence
  Synthetic Polynucleotide
taatacgactcactataggggtacgggtacaggtacttcatgtactgggtaacagaggagaacccagatgatgaagtacaacctggcggcagcgcaaaagatg

SEQ ID NO: 89604 - DNA, 103 bp, Artificial Sequence
  Synthetic Polynucleotide
taatacgactcactatagggtctcgcactcgtacgggtacaggtacttcaaacagaggagatgaagtatgtgtacccgtaacctggcggcagcgcaaaagatg

SEQ ID NO: 89605 - DNA, 103 bp, Artificial Sequence
  Synthetic Polynucleotide
taatacgactcactatagggggcagcagcgggcatgcaggggccaatggcaacagaggagagccattatgccctgcatgaacctggcggcagcgcaaaagatg

SEQ ID NO: 89606 - DNA, 103 bp, Artificial Sequence
  Synthetic Polynucleotide
taatacgactcactatagggagcgctcgagtctcgcactcgtacgggtacaacagaggagagtacccatgcgagtgcgaaacctggcggcagcgcaaaagatg

SEQ ID NO: 89607 - DNA, 103 bp, Artificial Sequence
  Synthetic Polynucleotide
taatacgactcactatagggtggggagctgagcgctcgagtctcgcactcaacagaggagagagtgcatgactcgagcgaacctggcggcagcgcaaaagatg

SEQ ID NO: 89608 - DNA, 103 bp, Artificial Sequence
  Synthetic Polynucleotide
taatacgactcactatagggggagctcccctggggagctgagcgctcgagaacagaggagactcgagatgtcagctcccaacctggcggcagcgcaaaagatg

SEQ ID NO: 89609 - DNA, 103 bp, Artificial Sequence
  Synthetic Polynucleotide
taatacgactcactatagggatggcggcctggagctcccctggggagctgaacagaggagacagctcatgaggggagctaacctggcggcagcgcaaaagatg

SEQ ID NO: 89610 - DNA, 103 bp, Artificial Sequence
  Synthetic Polynucleotide
taatacgactcactatagggattgctgtctatggcggcctggagctccccaacagaggagaggggagatgcaggccgccaacctggcggcagcgcaaaagatg

SEQ ID NO: 89611 - DNA, 103 bp, Artificial Sequence
  Synthetic Polynucleotide
taatacgactcactatagggcctcgcgccgattgctgtctatggcggcctaacagaggagaaggccgatgtagacagcaaacctggcggcagcgcaaaagatg

SEQ ID NO: 89612 - DNA, 103 bp, Artificial Sequence
  Synthetic Polynucleotide
taatacgactcactatagggtggcgacggccctcgcgccgattgctgtctaacagaggagaagacagatgtcggcgcgaaacctggcggcagcgcaaaagatg

SEQ ID NO: 89613 - DNA, 103 bp, Artificial Sequence
  Synthetic Polynucleotide
taatacgactcactatagggggtgtaagcctggcgacggccctcgcgccgaacagaggagacggcgcatgggccgtcgcaacctggcggcagcgcaaaagatg

SEQ ID NO: 89614 - DNA, 103 bp, Artificial Sequence
  Synthetic Polynucleotide
taatacgactcactataggggcggagtagcggtgtaagcctggcgacggcaacagaggagagccgtcatgaggcttacaaacctggcggcagcgcaaaagatg

SEQ ID NO: 89615 - DNA, 103 bp, Artificial Sequence
  Synthetic Polynucleotide
taatacgactcactatagggaagccgaagagcggagtagcggtgtaagccaacagaggagaggcttaatgcgctactccaacctggcggcagcgcaaaagatg

SEQ ID NO: 89616 - DNA, 103 bp, Artificial Sequence
  Synthetic Polynucleotide
taatacgactcactatagggaggctgcggtggcagcagcgggcatgcaggaacagaggagacctgcaatgccgctgctgaacctggcggcagcgcaaaagatg

SEQ ID NO: 89617 - DNA, 103 bp, Artificial Sequence
  Synthetic Polynucleotide
taatacgactcactatagggcggccctgccaagccgaagagcggagtagcaacagaggagagctactatgctcttcggcaacctggcggcagcgcaaaagatg

SEQ ID NO: 89618 - DNA, 103 bp, Artificial Sequence
  Synthetic Polynucleotide
taatacgactcactatagggcccgagggggcggccctgccaagccgaagaaacagaggagatcttcgatgtggcagggcaacctggcggcagcgcaaaagatg

SEQ ID NO: 89619 - DNA, 103 bp, Artificial Sequence
  Synthetic Polynucleotide
taatacgactcactatagggtcctgagcgccccgagggggcggccctgccaacagaggagaggcaggatggccccctcgaacctggcggcagcgcaaaagatg

SEQ ID NO: 89620 - DNA, 103 bp, Artificial Sequence
  Synthetic Polynucleotide
taatacgactcactatagggcaaggctgggtcctgagcgccccgagggggaacagaggagaccccctatgggcgctcagaacctggcggcagcgcaaaagatg

SEQ ID NO: 89621 - DNA, 103 bp, Artificial Sequence
  Synthetic Polynucleotide
taatacgactcactatagggggccgggacccaaggctgggtcctgagcgcaacagaggagagcgctcatgacccagcctaacctggcggcagcgcaaaagatg

SEQ ID NO: 89622 - DNA, 103 bp, Artificial Sequence
  Synthetic Polynucleotide
taatacgactcactatagggggaggggcggggccgggacccaaggctgggaacagaggagacccagcatggggtcccggaacctggcggcagcgcaaaagatg

SEQ ID NO: 89623 - DNA, 103 bp, Artificial Sequence
  Synthetic Polynucleotide
taatacgactcactatagggctgggtcgccggaggggcggggccgggaccaacagaggagaggtcccatgcccgcccctaacctggcggcagcgcaaaagatg

SEQ ID NO: 89624 - DNA, 103 bp, Artificial Sequence
  Synthetic Polynucleotide
taatacgactcactatagggcagggctggactgggtcgccggaggggcggaacagaggagaccgcccatgcggcgacccaacctggcggcagcgcaaaagatg

SEQ ID NO: 89625 - DNA, 103 bp, Artificial Sequence
  Synthetic Polynucleotide
taatacgactcactatagggtgggctgggccagggctggactgggtcgccaacagaggagaggcgacatggtccagcccaacctggcggcagcgcaaaagatg

SEQ ID NO: 89626 - DNA, 103 bp, Artificial Sequence
  Synthetic Polynucleotide
taatacgactcactatagggggtggaaccctgggctgggccagggctggaaacagaggagatccagcatgggcccagccaacctggcggcagcgcaaaagatg

SEQ ID NO: 89627 - DNA, 103 bp, Artificial Sequence
  Synthetic Polynucleotide
taatacgactcactatagggcaggcaggggaggctgcggtggcagcagcgaacagaggagacgctgcatgcaccgcagcaacctggcggcagcgcaaaagatg

SEQ ID NO: 89628 - DNA, 103 bp, Artificial Sequence
  Synthetic Polynucleotide
taatacgactcactataggggcaggccggaggtggaaccctgggctgggcaacagaggagagcccagatgagggttccaaacctggcggcagcgcaaaagatg

SEQ ID NO: 89629 - DNA, 103 bp, Artificial Sequence
  Synthetic Polynucleotide
taatacgactcactataggggcatgcgctggcaggccggaggtggaacccaacagaggagagggttcatgctccggcctaacctggcggcagcgcaaaagatg

SEQ ID NO: 89630 - DNA, 103 bp, Artificial Sequence
  Synthetic Polynucleotide
taatacgactcactatagggctgagcgcatgcatgcgctggcaggccggaaacagaggagatccggcatgccagcgcataacctggcggcagcgcaaaagatg

SEQ ID NO: 89631 - DNA, 103 bp, Artificial Sequence
  Synthetic Polynucleotide
taatacgactcactatagggttggactcagctgagcgcatgcatgcgctgaacagaggagacagcgcatgcatgcgctcaacctggcggcagcgcaaaagatg

SEQ ID NO: 89632 - DNA, 103 bp, Artificial Sequence
  Synthetic Polynucleotide
taatacgactcactatagggttaatagggcttggactcagctgagcgcataacagaggagaatgcgcatggctgagtccaacctggcggcagcgcaaaagatg

SEQ ID NO: 89633 - DNA, 103 bp, Artificial Sequence
  Synthetic Polynucleotide
taatacgactcactatagggctcctctttcttaatagggcttggactcagaacagaggagactgagtatgagccctattaacctggcggcagcgcaaaagatg

SEQ ID NO: 89634 - DNA, 103 bp, Artificial Sequence
  Synthetic Polynucleotide
taatacgactcactataggggaattccactctcctctttcttaatagggcaacagaggagagccctaatgagaaagaggaacctggcggcagcgcaaaagatg

SEQ ID NO: 89635 - DNA, 103 bp, Artificial Sequence
  Synthetic Polynucleotide
taatacgactcactatagggcaagggtttggaattccactctcctctttcaacagaggagagaaagaatggagtggaataacctggcggcagcgcaaaagatg

SEQ ID NO: 89636 - DNA, 103 bp, Artificial Sequence
  Synthetic Polynucleotide
taatacgactcactatagggcagtgccagacaagggtttggaattccactaacagaggagaagtggaatgccaaaccctaacctggcggcagcgcaaaagatg

SEQ ID NO: 89637 - DNA, 103 bp, Artificial Sequence
  Synthetic Polynucleotide
taatacgactcactatagggggcccacaggcagtgccagacaagggtttgaacagaggagacaaaccatggtctggcacaacctggcggcagcgcaaaagatg

SEQ ID NO: 89638 - DNA, 103 bp, Artificial Sequence
  Synthetic Polynucleotide
taatacgactcactataggggtccggtggtcaggcaggggaggctgcggtaacagaggagaaccgcaatgtcccctgccaacctggcggcagcgcaaaagatg

SEQ ID NO: 89639 - DNA, 103 bp, Artificial Sequence
  Synthetic Polynucleotide
taatacgactcactatagggcccagtgccaggcccacaggcagtgccagaaacagaggagatctggcatggcctgtgggaacctggcggcagcgcaaaagatg

SEQ ID NO: 89640 - DNA, 103 bp, Artificial Sequence
  Synthetic Polynucleotide
taatacgactcactatagggccgtgtaggtcccagtgccaggcccacaggaacagaggagacctgtgatgctggcactgaacctggcggcagcgcaaaagatg

SEQ ID NO: 89641 - DNA, 103 bp, Artificial Sequence
  Synthetic Polynucleotide
taatacgactcactatagggccaatttctcccgtgtaggtcccagtgccaaacagaggagatggcacatggacctacacaacctggcggcagcgcaaaagatg

SEQ ID NO: 89642 - DNA, 103 bp, Artificial Sequence
  Synthetic Polynucleotide
taatacgactcactatagggtcctctggtgccaatttctcccgtgtaggtaacagaggagaacctacatgggagaaattaacctggcggcagcgcaaaagatg

SEQ ID NO: 89643 - DNA, 103 bp, Artificial Sequence
  Synthetic Polynucleotide
taatacgactcactatagggctctgggggctcctctggtgccaatttctcaacagaggagagagaaaatggcaccagagaacctggcggcagcgcaaaagatg

SEQ ID NO: 89644 - DNA, 103 bp, Artificial Sequence
  Synthetic Polynucleotide
taatacgactcactatagggcagctctcttctctgggggctcctctggtgaacagaggagacaccagatgagcccccagaacctggcggcagcgcaaaagatg

SEQ ID NO: 89645 - DNA, 103 bp, Artificial Sequence
  Synthetic Polynucleotide
taatacgactcactatagggcccatcagcacagctctcttctctgggggcaacagaggagagcccccatggaagagagcaacctggcggcagcgcaaaagatg

SEQ ID NO: 89646 - DNA, 103 bp, Artificial Sequence
  Synthetic Polynucleotide
taatacgactcactataggggtccataggccccatcagcacagctctcttaacagaggagaaagagaatggtgctgatgaacctggcggcagcgcaaaagatg

SEQ ID NO: 89647 - DNA, 103 bp, Artificial Sequence
  Synthetic Polynucleotide
taatacgactcactataggggtcgaggtgggtccataggccccatcagcaaacagaggagatgctgaatgggcctatggaacctggcggcagcgcaaaagatg

SEQ ID NO: 89648 - DNA, 103 bp, Artificial Sequence
  Synthetic Polynucleotide
taatacgactcactatagggggcatgcaaggtcgaggtgggtccataggcaacagaggagagcctatatgcccacctcgaacctggcggcagcgcaaaagatg

SEQ ID NO: 89649 - DNA, 103 bp, Artificial Sequence
  Synthetic Polynucleotide
taatacgactcactatagggcaggtaggcaggctcatctgccgccttcataacagaggagaatgaagatggcagatgagaacctggcggcagcgcaaaagatg

SEQ ID NO: 89650 - DNA, 103 bp, Artificial Sequence
  Synthetic Polynucleotide
taatacgactcactatagggtaccttaactttcaccagccttttcacagtaacagaggagaactgtgatgaggctggtgaacctggcggcagcgcaaaagatg

SEQ ID NO: 89651 - DNA, 103 bp, Artificial Sequence
  Synthetic Polynucleotide
taatacgactcactatagggatctttatagcccaaaacaggtggtttgttaacagaggagaaacaaaatgcctgttttgaacctggcggcagcgcaaaagatg

SEQ ID NO: 89652 - DNA, 103 bp, Artificial Sequence
  Synthetic Polynucleotide
taatacgactcactatagggagagattgagatctttatagcccaaaacagaacagaggagactgtttatggctataaagaacctggcggcagcgcaaaagatg

SEQ ID NO: 89653 - DNA, 103 bp, Artificial Sequence
  Synthetic Polynucleotide
taatacgactcactatagggaagagtttgaagagattgagatctttatagaacagaggagactataaatgtctcaatctaacctggcggcagcgcaaaagatg

SEQ ID NO: 89654 - DNA, 103 bp, Artificial Sequence
  Synthetic Polynucleotide
taatacgactcactatagggaaccagtctgaagagtttgaagagattgagaacagaggagactcaatatgttcaaactcaacctggcggcagcgcaaaagatg

SEQ ID NO: 89655 - DNA, 103 bp, Artificial Sequence
  Synthetic Polynucleotide
taatacgactcactatagggcctgatgataaaccagtctgaagagtttgaaacagaggagatcaaacatgtcagactggaacctggcggcagcgcaaaagatg

SEQ ID NO: 89656 - DNA, 103 bp, Artificial Sequence
  Synthetic Polynucleotide
taatacgactcactatagggtcacatccaccctgatgataaaccagtctgaacagaggagacagactatgttatcatcaaacctggcggcagcgcaaaagatg

SEQ ID NO: 89657 - DNA, 103 bp, Artificial Sequence
  Synthetic Polynucleotide
taatacgactcactatagggatcaatattgtcacatccaccctgatgataaacagaggagatatcatatgggtggatgtaacctggcggcagcgcaaaagatg

SEQ ID NO: 89658 - DNA, 103 bp, Artificial Sequence
  Synthetic Polynucleotide
taatacgactcactatagggcagcaccactatcaatattgtcacatccacaacagaggagagtggatatgacaatattgaacctggcggcagcgcaaaagatg

SEQ ID NO: 89659 - DNA, 103 bp, Artificial Sequence
  Synthetic Polynucleotide
taatacgactcactatagggtgcttccatacagcaccactatcaatattgaacagaggagacaatatatgtagtggtgcaacctggcggcagcgcaaaagatg

SEQ ID NO: 89660 - DNA, 103 bp, Artificial Sequence
  Synthetic Polynucleotide
taatacgactcactatagggcatataaatttgcttccatacagcaccactaacagaggagaagtggtatggtatggaagaacctggcggcagcgcaaaagatg

SEQ ID NO: 89661 - DNA, 103 bp, Artificial Sequence
  Synthetic Polynucleotide
taatacgactcactataggggtttcaggagtaccttaactttcaccagccaacagaggagaggctggatgaagttaaggaacctggcggcagcgcaaaagatg

SEQ ID NO: 89662 - DNA, 103 bp, Artificial Sequence
  Synthetic Polynucleotide
taatacgactcactatagggtgccaaggtccatataaatttgcttccataaacagaggagatatggaatgaaatttataaacctggcggcagcgcaaaagatg

SEQ ID NO: 89663 - DNA, 103 bp, Artificial Sequence
  Synthetic Polynucleotide
taatacgactcactatagggaaaataggaatgccaaggtccatataaattaacagaggagaaatttaatgggaccttggaacctggcggcagcgcaaaagatg

SEQ ID NO: 89664 - DNA, 103 bp, Artificial Sequence
  Synthetic Polynucleotide
taatacgactcactatagggagctgaattcaaaataggaatgccaaggtcaacagaggagagaccttatgattcctattaacctggcggcagcgcaaaagatg

SEQ ID NO: 89665 - DNA, 103 bp, Artificial Sequence
  Synthetic Polynucleotide
taatacgactcactatagggtgtaggaagcagctgaattcaaaataggaaaacagaggagattcctaatgtgaattcagaacctggcggcagcgcaaaagatg

SEQ ID NO: 89666 - DNA, 103 bp, Artificial Sequence
  Synthetic Polynucleotide
taatacgactcactataggggtttttacattgtaggaagcagctgaattcaacagaggagagaattcatgtgcttcctaaacctggcggcagcgcaaaagatg

SEQ ID NO: 89667 - DNA, 103 bp, Artificial Sequence
  Synthetic Polynucleotide
taatacgactcactatagggtctataagcagtttttacattgtaggaagcaacagaggagagcttccatgaatgtaaaaaacctggcggcagcgcaaaagatg

SEQ ID NO: 89668 - DNA, 103 bp, Artificial Sequence
  Synthetic Polynucleotide
taatacgactcactatagggagagatactttctataagcagtttttacataacagaggagaatgtaaatgctgcttataaacctggcggcagcgcaaaagatg

SEQ ID NO: 89669 - DNA, 103 bp, Artificial Sequence
  Synthetic Polynucleotide
taatacgactcactatagggtcaaaaccatagagatactttctataagcaaacagaggagatgcttaatgaaagtatctaacctggcggcagcgcaaaagatg

SEQ ID NO: 89670 - DNA, 103 bp, Artificial Sequence
  Synthetic Polynucleotide
taatacgactcactataggggcagtactcctcaaaaccatagagatacttaacagaggagaaagtatatgtatggttttaacctggcggcagcgcaaaagatg

SEQ ID NO: 89671 - DNA, 103 bp, Artificial Sequence
  Synthetic Polynucleotide
taatacgactcactatagggttgccgaacggcagtactcctcaaaaccataacagaggagaatggttatgaggagtactaacctggcggcagcgcaaaagatg

SEQ ID NO: 89672 - DNA, 103 bp, Artificial Sequence
  Synthetic Polynucleotide
taatacgactcactataggggtattatcctgtttcaggagtaccttaactaacagaggagaagttaaatgactcctgaaaacctggcggcagcgcaaaagatg

SEQ ID NO: 89673 - DNA, 103 bp, Artificial Sequence
  Synthetic Polynucleotide
taatacgactcactatagggaactgaatatttgccgaacggcagtactccaacagaggagaggagtaatgccgttcggcaacctggcggcagcgcaaaagatg

SEQ ID NO: 89674 - DNA, 103 bp, Artificial Sequence
  Synthetic Polynucleotide
taatacgactcactatagggaacagttctgaactgaatatttgccgaacgaacagaggagacgttcgatgaatattcagaacctggcggcagcgcaaaagatg

SEQ ID NO: 89675 - DNA, 103 bp, Artificial Sequence
  Synthetic Polynucleotide
taatacgactcactatagggcatggtgatgaacagttctgaactgaatataacagaggagaatattcatgtcagaactgaacctggcggcagcgcaaaagatg

SEQ ID NO: 89676 - DNA, 103 bp, Artificial Sequence
  Synthetic Polynucleotide
taatacgactcactatagggacttttggttcatggtgatgaacagttctgaacagaggagacagaacatgtcatcaccaaacctggcggcagcgcaaaagatg

SEQ ID NO: 89677 - DNA, 103 bp, Artificial Sequence
  Synthetic Polynucleotide
taatacgactcactatagggttcctcttttacttttggttcatggtgatgaacagaggagacatcacatggaaccaaaaaacctggcggcagcgcaaaagatg

SEQ ID NO: 89678 - DNA, 103 bp, Artificial Sequence
  Synthetic Polynucleotide
taatacgactcactatagggagtcttttttttcctcttttacttttggttaacagaggagaaaccaaatgtaaaagaggaacctggcggcagcgcaaaagatg

SEQ ID NO: 89679 - DNA, 103 bp, Artificial Sequence
  Synthetic Polynucleotide
taatacgactcactataggggattcttctaagtcttttttttcctcttttaacagaggagaaaaagaatgaaaaaaagaaacctggcggcagcgcaaaagatg

SEQ ID NO: 89680 - DNA, 103 bp, Artificial Sequence
  Synthetic Polynucleotide
taatacgactcactatagggctcttccattgattcttctaagtcttttttaacagaggagaaaaaaaatgttagaagaaaacctggcggcagcgcaaaagatg

SEQ ID NO: 89681 - DNA, 103 bp, Artificial Sequence
  Synthetic Polynucleotide
taatacgactcactatagggatttgagagcctcttccattgattcttctaaacagaggagatagaagatgcaatggaagaacctggcggcagcgcaaaagatg

SEQ ID NO: 89682 - DNA, 103 bp, Artificial Sequence
  Synthetic Polynucleotide
taatacgactcactatagggtcttgatctaatttgagagcctcttccattaacagaggagaaatggaatgggctctcaaaacctggcggcagcgcaaaagatg

SEQ ID NO: 89683 - DNA, 103 bp, Artificial Sequence
  Synthetic Polynucleotide
taatacgactcactatagggcaattgtgtggtattatcctgtttcaggagaacagaggagactcctgatgcaggataataacctggcggcagcgcaaaagatg

SEQ ID NO: 89684 - DNA, 103 bp, Artificial Sequence
  Synthetic Polynucleotide
taatacgactcactatagggtaaaggcatttcttgatctaatttgagagcaacagaggagagctctcatgttagatcaaaacctggcggcagcgcaaaagatg

SEQ ID NO: 89685 - DNA, 103 bp, Artificial Sequence
  Synthetic Polynucleotide
taatacgactcactatagggtcacttctgttaaaggcatttcttgatctaaacagaggagatagatcatgaaatgccttaacctggcggcagcgcaaaagatg

SEQ ID NO: 89686 - DNA, 103 bp, Artificial Sequence
  Synthetic Polynucleotide
taatacgactcactatagggggttcactcttcacttctgttaaaggcattaacagaggagaaatgccatgaacagaagtaacctggcggcagcgcaaaagatg

SEQ ID NO: 89687 - DNA, 103 bp, Artificial Sequence
  Synthetic Polynucleotide
taatacgactcactatagggattttcctcaggttcactcttcacttctgtaacagaggagaacagaaatgaagagtgaaaacctggcggcagcgcaaaagatg

SEQ ID NO: 89688 - DNA, 103 bp, Artificial Sequence
  Synthetic Polynucleotide
taatacgactcactatagggttgaatcgatattttcctcaggttcactctaacagaggagaagagtgatgctgaggaaaaacctggcggcagcgcaaaagatg

SEQ ID NO: 89689 - DNA, 103 bp, Artificial Sequence
  Synthetic Polynucleotide
taatacgactcactatagggctttcactgtttgaatcgatattttcctcaaacagaggagatgaggaatgtatcgattcaacctggcggcagcgcaaaagatg

SEQ ID NO: 89690 - DNA, 103 bp, Artificial Sequence
  Synthetic Polynucleotide
taatacgactcactatagggttctctttcactttcactgtttgaatcgataacagaggagaatcgatatgaacagtgaaaacctggcggcagcgcaaaagatg

SEQ ID NO: 89691 - DNA, 103 bp, Artificial Sequence
  Synthetic Polynucleotide
taatacgactcactatagggattctatctcttctctttcactttcactgtaacagaggagaacagtgatggtgaaagagaacctggcggcagcgcaaaagatg

SEQ ID NO: 89692 - DNA, 103 bp, Artificial Sequence
  Synthetic Polynucleotide
taatacgactcactatagggggagattttaattctatctcttctctttcaaacagaggagatgaaagatgagagatagaaacctggcggcagcgcaaaagatg

SEQ ID NO: 89693 - DNA, 103 bp, Artificial Sequence
  Synthetic Polynucleotide
taatacgactcactatagggtcgtcccctcggagattttaattctatctcaacagaggagagagataatgttaaaatctaacctggcggcagcgcaaaagatg

SEQ ID NO: 89694 - DNA, 103 bp, Artificial Sequence
  Synthetic Polynucleotide
taatacgactcactatagggcatcttgtaccaattgtgtggtattatcctaacagaggagaaggataatgccacacaataacctggcggcagcgcaaaagatg

SEQ ID NO: 89695 - DNA, 103 bp, Artificial Sequence
  Synthetic Polynucleotide
taatacgactcactatagggcaattctccttcgtcccctcggagattttaaacagaggagataaaatatgcgaggggacaacctggcggcagcgcaaaagatg

SEQ ID NO: 89696 - DNA, 103 bp, Artificial Sequence
  Synthetic Polynucleotide
taatacgactcactatagggacatctcgagcaattctccttcgtcccctcaacagaggagagaggggatgaaggagaataacctggcggcagcgcaaaagatg

SEQ ID NO: 89697 - DNA, 103 bp, Artificial Sequence
  Synthetic Polynucleotide
taatacgactcactatagggaatagaatttacatctcgagcaattctcctaacagaggagaaggagaatggctcgagataacctggcggcagcgcaaaagatg

SEQ ID NO: 89698 - DNA, 103 bp, Artificial Sequence
  Synthetic Polynucleotide
taatacgactcactatagggtttcctttttaatagaatttacatctcgagaacagaggagactcgagatgtaaattctaaacctggcggcagcgcaaaagatg

SEQ ID NO: 89699 - DNA, 103 bp, Artificial Sequence
  Synthetic Polynucleotide
taatacgactcactatagggtcttcttcaatttcctttttaatagaatttaacagaggagaaaattcatgtaaaaaggaaacctggcggcagcgcaaaagatg

SEQ ID NO: 89700 - DNA, 103 bp, Artificial Sequence
  Synthetic Polynucleotide
taatacgactcactatagggttctgttttctcttcttcaatttcctttttaacagaggagaaaaaagatgattgaagaaaacctggcggcagcgcaaaagatg

SEQ ID NO: 89701 - DNA, 103 bp, Artificial Sequence
  Synthetic Polynucleotide
taatacgactcactatagggttaatttgtcttctgttttctcttcttcaaaacagaggagattgaagatgagaaaacagaacctggcggcagcgcaaaagatg

SEQ ID NO: 89702 - DNA, 103 bp, Artificial Sequence
  Synthetic Polynucleotide
taatacgactcactatagggtcattatcttttaatttgtcttctgttttcaacagaggagagaaaacatgagacaaattaacctggcggcagcgcaaaagatg

SEQ ID NO: 89703 - DNA, 103 bp, Artificial Sequence
  Synthetic Polynucleotide
taatacgactcactatagggattttctgtatcattatcttttaatttgtcaacagaggagagacaaaatgaaagataataacctggcggcagcgcaaaagatg

SEQ ID NO: 89704 - DNA, 103 bp, Artificial Sequence
  Synthetic Polynucleotide
taatacgactcactatagggctacatccttattttctgtatcattatcttaacagaggagaaagataatgatacagaaaaacctggcggcagcgcaaaagatg

SEQ ID NO: 89705 - DNA, 103 bp, Artificial Sequence
  Synthetic Polynucleotide
taatacgactcactatagggtttacttggtcatcttgtaccaattgtgtgaacagaggagacacacaatgggtacaagaaacctggcggcagcgcaaaagatg

SEQ ID NO: 89706 - DNA, 103 bp, Artificial Sequence
  Synthetic Polynucleotide
taatacgactcactatagggtagtcatcatctacatccttattttctgtaaacagaggagatacagaatgtaaggatgtaacctggcggcagcgcaaaagatg

SEQ ID NO: 89707 - DNA, 103 bp, Artificial Sequence
  Synthetic Polynucleotide
taatacgactcactatagggtgcagtttcatagtcatcatctacatccttaacagaggagaaaggatatggatgatgacaacctggcggcagcgcaaaagatg

SEQ ID NO: 89708 - DNA, 103 bp, Artificial Sequence
  Synthetic Polynucleotide
taatacgactcactatagggcttttttctctgcagtttcatagtcatcataacagaggagaatgatgatgatgaaactgaacctggcggcagcgcaaaagatg

SEQ ID NO: 89709 - DNA, 103 bp, Artificial Sequence
  Synthetic Polynucleotide
taatacgactcactatagggagctcattttcttttttctctgcagtttcaaacagaggagatgaaacatgagagaaaaaaacctggcggcagcgcaaaagatg

SEQ ID NO: 89710 - DNA, 103 bp, Artificial Sequence
  Synthetic Polynucleotide
taatacgactcactatagggccccagtagtagctcattttcttttttctcaacagaggagagagaaaatggaaaatgagaacctggcggcagcgcaaaagatg

SEQ ID NO: 89711 - DNA, 103 bp, Artificial Sequence
  Synthetic Polynucleotide
taatacgactcactatagggtattttttctccccagtagtagctcattttaacagaggagaaaaatgatgtactactggaacctggcggcagcgcaaaagatg

SEQ ID NO: 89712 - DNA, 103 bp, Artificial Sequence
  Synthetic Polynucleotide
taatacgactcactatagggtgctttggtgtattttttctccccagtagtaacagaggagaactactatggagaaaaaaaacctggcggcagcgcaaaagatg

SEQ ID NO: 89713 - DNA, 103 bp, Artificial Sequence
  Synthetic Polynucleotide
taatacgactcactatagggcttctctttttgctttggtgtattttttctaacagaggagaagaaaaatgacaccaaagaacctggcggcagcgcaaaagatg

SEQ ID NO: 89714 - DNA, 103 bp, Artificial Sequence
  Synthetic Polynucleotide
taatacgactcactatagggttttaattttcttctctttttgctttggtgaacagaggagacaccaaatgaaaaagagaaacctggcggcagcgcaaaagatg

SEQ ID NO: 89715 - DNA, 103 bp, Artificial Sequence
  Synthetic Polynucleotide
taatacgactcactatagggtcctcctgttttttaattttcttctcttttaacagaggagaaaaagaatggaaaattaaaacctggcggcagcgcaaaagatg

SEQ ID NO: 89716 - DNA, 103 bp, Artificial Sequence
  Synthetic Polynucleotide
taatacgactcactatagggtaaaggaccctttacttggtcatcttgtacaacagaggagagtacaaatggaccaagtaaacctggcggcagcgcaaaagatg

SEQ ID NO: 89717 - DNA, 103 bp, Artificial Sequence
  Synthetic Polynucleotide
taatacgactcactatagggtttgtcagaatcctcctgttttttaattttaacagaggagaaaaattatgaaacaggagaacctggcggcagcgcaaaagatg

SEQ ID NO: 89718 - DNA, 103 bp, Artificial Sequence
  Synthetic Polynucleotide
taatacgactcactatagggcatctgagtctttgtcagaatcctcctgttaacagaggagaaacaggatgattctgacaaacctggcggcagcgcaaaagatg

SEQ ID NO: 89719 - DNA, 103 bp, Artificial Sequence
  Synthetic Polynucleotide
taatacgactcactatagggtcttcctcttcatctgagtctttgtcagaaaacagaggagattctgaatgagactcagaaacctggcggcagcgcaaaagatg

SEQ ID NO: 89720 - DNA, 103 bp, Artificial Sequence
  Synthetic Polynucleotide
taatacgactcactatagggttggcttttctcttcctcttcatctgagtcaacagaggagagactcaatggaagaggaaaacctggcggcagcgcaaaagatg

SEQ ID NO: 89721 - DNA, 103 bp, Artificial Sequence
  Synthetic Polynucleotide
taatacgactcactatagggcttccctctcttggcttttctcttcctcttaacagaggagaaagaggatgagaaaagccaacctggcggcagcgcaaaagatg

SEQ ID NO: 89722 - DNA, 103 bp, Artificial Sequence
  Synthetic Polynucleotide
taatacgactcactatagggctttcagtttcttccctctcttggcttttcaacagaggagagaaaagatgagagagggaaacctggcggcagcgcaaaagatg

SEQ ID NO: 89723 - DNA, 103 bp, Artificial Sequence
  Synthetic Polynucleotide
taatacgactcactataggggtcacatttgctttcagtttcttccctctcaacagaggagagagaggatggaaactgaaaacctggcggcagcgcaaaagatg

SEQ ID NO: 89724 - DNA, 103 bp, Artificial Sequence
  Synthetic Polynucleotide
taatacgactcactatagggctccttcagagtcacatttgctttcagtttaacagaggagaaaactgatggcaaatgtgaacctggcggcagcgcaaaagatg

SEQ ID NO: 89725 - DNA, 103 bp, Artificial Sequence
  Synthetic Polynucleotide
taatacgactcactatagggtcatcttcctctccttcagagtcacatttgaacagaggagacaaatgatgctctgaaggaacctggcggcagcgcaaaagatg

SEQ ID NO: 89726 - DNA, 103 bp, Artificial Sequence
  Synthetic Polynucleotide
taatacgactcactatagggcatgtcttcctcatcttcctctccttcagaaacagaggagatctgaaatggaggaagataacctggcggcagcgcaaaagatg

SEQ ID NO: 89727 - DNA, 103 bp, Artificial Sequence
  Synthetic Polynucleotide
taatacgactcactatagggctccaactcttaaaggaccctttacttggtaacagaggagaaccaagatgagggtccttaacctggcggcagcgcaaaagatg

SEQ ID NO: 89728 - DNA, 103 bp, Artificial Sequence
  Synthetic Polynucleotide
taatacgactcactatagggggcagggttccatgtcttcctcatcttcctaacagaggagaaggaagatgaggaagacaaacctggcggcagcgcaaaagatg

SEQ ID NO: 89729 - DNA, 103 bp, Artificial Sequence
  Synthetic Polynucleotide
taatacgactcactataggggttcctgttaggcagggttccatgtcttccaacagaggagaggaagaatgggaaccctgaacctggcggcagcgcaaaagatg

SEQ ID NO: 89730 - DNA, 103 bp, Artificial Sequence
  Synthetic Polynucleotide
taatacgactcactatagggtttcactttggttcctgttaggcagggttcaacagaggagagaacccatgctaacaggaaacctggcggcagcgcaaaagatg

SEQ ID NO: 89731 - DNA, 103 bp, Artificial Sequence
  Synthetic Polynucleotide
taatacgactcactatagggcatattttactttcactttggttcctgttaaacagaggagataacagatgccaaagtgaaacctggcggcagcgcaaaagatg

SEQ ID NO: 89732 - DNA, 103 bp, Artificial Sequence
  Synthetic Polynucleotide
taatacgactcactatagggttccctcgtccatattttactttcactttgaacagaggagacaaagtatgagtaaaataaacctggcggcagcgcaaaagatg

SEQ ID NO: 89733 - DNA, 103 bp, Artificial Sequence
  Synthetic Polynucleotide
taatacgactcactatagggtttctgagtcttccctcgtccatattttacaacagaggagagtaaaaatgggacgagggaacctggcggcagcgcaaaagatg

SEQ ID NO: 89734 - DNA, 103 bp, Artificial Sequence
  Synthetic Polynucleotide
taatacgactcactatagggcttcataaattttctgagtcttccctcgtcaacagaggagagacgagatgagactcagaaacctggcggcagcgcaaaagatg

SEQ ID NO: 89735 - DNA, 103 bp, Artificial Sequence
  Synthetic Polynucleotide
taatacgactcactatagggttaatactggcttcataaattttctgagtcaacagaggagagactcaatgaatttatgaaacctggcggcagcgcaaaagatg

SEQ ID NO: 89736 - DNA, 103 bp, Artificial Sequence
  Synthetic Polynucleotide
taatacgactcactatagggttcagtgcttttaatactggcttcataaataacagaggagaatttatatggccagtattaacctggcggcagcgcaaaagatg

SEQ ID NO: 89737 - DNA, 103 bp, Artificial Sequence
  Synthetic Polynucleotide
taatacgactcactatagggcgtcatcaatttcagtgcttttaatactggaacagaggagaccagtaatgaaagcactgaacctggcggcagcgcaaaagatg

SEQ ID NO: 89738 - DNA, 103 bp, Artificial Sequence
  Synthetic Polynucleotide
taatacgactcactatagggtcaacaatagctccaactcttaaaggacccaacagaggagagggtccatgaagagttggaacctggcggcagcgcaaaagatg

SEQ ID NO: 89739 - DNA, 103 bp, Artificial Sequence
  Synthetic Polynucleotide
taatacgactcactatagggaaaacttctccgtcatcaatttcagtgcttaacagaggagaaagcacatgaattgatgaaacctggcggcagcgcaaaagatg

SEQ ID NO: 89740 - DNA, 103 bp, Artificial Sequence
  Synthetic Polynucleotide
taatacgactcactatagggtaccaaatataaaacttctccgtcatcaataacagaggagaattgatatgggagaagttaacctggcggcagcgcaaaagatg

SEQ ID NO: 89741 - DNA, 103 bp, Artificial Sequence
  Synthetic Polynucleotide
taatacgactcactatagggcatagtaatgtaccaaatataaaacttctcaacagaggagagagaagatgtatatttggaacctggcggcagcgcaaaagatg

SEQ ID NO: 89742 - DNA, 103 bp, Artificial Sequence
  Synthetic Polynucleotide
taatacgactcactatagggacattccatccatagtaatgtaccaaatataacagaggagaatatttatgacattactaaacctggcggcagcgcaaaagatg

SEQ ID NO: 89743 - DNA, 103 bp, Artificial Sequence
  Synthetic Polynucleotide
taatacgactcactatagggatcatacctgacattccatccatagtaatgaacagaggagacattacatgggatggaataacctggcggcagcgcaaaagatg

SEQ ID NO: 89744 - DNA, 103 bp, Artificial Sequence
  Synthetic Polynucleotide
taatacgactcactatagggtcacccactcatcatacctgacattccatcaacagaggagagatggaatgtcaggtatgaacctggcggcagcgcaaaagatg

SEQ ID NO: 89745 - DNA, 103 bp, Artificial Sequence
  Synthetic Polynucleotide
taatacgactcactatagggctgtcagccttcacccactcatcatacctgaacagaggagacaggtaatgtgagtgggtaacctggcggcagcgcaaaagatg

SEQ ID NO: 89746 - DNA, 103 bp, Artificial Sequence
  Synthetic Polynucleotide
taatacgactcactatagggccagattatcctgtcagccttcacccactcaacagaggagagagtggatgaaggctgacaacctggcggcagcgcaaaagatg

SEQ ID NO: 89747 - DNA, 103 bp, Artificial Sequence
  Synthetic Polynucleotide
taatacgactcactatagggtgtccaaaggccagattatcctgtcagcctaacagaggagaaggctgatgggataatctaacctggcggcagcgcaaaagatg

SEQ ID NO: 89748 - DNA, 103 bp, Artificial Sequence
  Synthetic Polynucleotide
taatacgactcactatagggggtccacctttgtccaaaggccagattatcaacagaggagagataatatggcctttggaaacctggcggcagcgcaaaagatg

SEQ ID NO: 89749 - DNA, 103 bp, Artificial Sequence
  Synthetic Polynucleotide
taatacgactcactatagggtgtccttgtttcaacaatagctccaactctaacagaggagaagagttatggctattgttaacctggcggcagcgcaaaagatg

SEQ ID NO: 89750 - DNA, 103 bp, Artificial Sequence
  Synthetic Polynucleotide
taatacgactcactatagggttttttctttggtccacctttgtccaaaggaacagaggagacctttgatgaaaggtggaaacctggcggcagcgcaaaagatg

SEQ ID NO: 89751 - DNA, 103 bp, Artificial Sequence
  Synthetic Polynucleotide
taatacgactcactatagggttttcttctgttttttctttggtccaccttaacagaggagaaaggtgatgcaaagaaaaaacctggcggcagcgcaaaagatg

SEQ ID NO: 89752 - DNA, 103 bp, Artificial Sequence
  Synthetic Polynucleotide
taatacgactcactatagggtttttagcttttttcttctgttttttctttaacagaggagaaaagaaatgacagaagaaaacctggcggcagcgcaaaagatg

SEQ ID NO: 89753 - DNA, 103 bp, Artificial Sequence
  Synthetic Polynucleotide
taatacgactcactatagggatcttctttatttttagcttttttcttctgaacagaggagacagaagatgaaagctaaaaacctggcggcagcgcaaaagatg

SEQ ID NO: 89754 - DNA, 103 bp, Artificial Sequence
  Synthetic Polynucleotide
taatacgactcactatagggccttttcactatcttctttatttttagcttaacagaggagaaagctaatgataaagaagaacctggcggcagcgcaaaagatg

SEQ ID NO: 89755 - DNA, 103 bp, Artificial Sequence
  Synthetic Polynucleotide
taatacgactcactatagggctcttttcgtccttttcactatcttctttaaacagaggagataaagaatgtagtgaaaaaacctggcggcagcgcaaaagatg

SEQ ID NO: 89756 - DNA, 103 bp, Artificial Sequence
  Synthetic Polynucleotide
taatacgactcactatagggctcctcatctctcttttcgtccttttcactaacagaggagaagtgaaatggacgaaaagaacctggcggcagcgcaaaagatg

SEQ ID NO: 89757 - DNA, 103 bp, Artificial Sequence
  Synthetic Polynucleotide
taatacgactcactatagggacttctgcctctcctcatctctcttttcgtaacagaggagaacgaaaatggagatgaggaacctggcggcagcgcaaaagatg

SEQ ID NO: 89758 - DNA, 103 bp, Artificial Sequence
  Synthetic Polynucleotide
taatacgactcactatagggccccgttttgacttctgcctctcctcatctaacagaggagaagatgaatggaggcagaaaacctggcggcagcgcaaaagatg

SEQ ID NO: 89759 - DNA, 103 bp, Artificial Sequence
  Synthetic Polynucleotide
taatacgactcactatagggaggaggtcgtccccgttttgacttctgcctaacagaggagaaggcagatgtcaaaacggaacctggcggcagcgcaaaagatg

SEQ ID NO: 89760 - DNA, 103 bp, Artificial Sequence
  Synthetic Polynucleotide
taatacgactcactatagggttcccactgtcaggtaggcaggctcatctgaacagaggagacagatgatgctgcctaccaacctggcggcagcgcaaaagatg

SEQ ID NO: 89761 - DNA, 103 bp, Artificial Sequence
  Synthetic Polynucleotide
taatacgactcactatagggatccatcagatgtccttgtttcaacaatagaacagaggagactattgatgaaacaaggaaacctggcggcagcgcaaaagatg

SEQ ID NO: 89762 - DNA, 103 bp, Artificial Sequence
  Synthetic Polynucleotide
taatacgactcactatagggttgattttaaaggaggtcgtccccgttttgaacagaggagacaaaacatggacgacctcaacctggcggcagcgcaaaagatg

SEQ ID NO: 89763 - DNA, 103 bp, Artificial Sequence
  Synthetic Polynucleotide
taatacgactcactataggggatgagagggttgattttaaaggaggtcgtaacagaggagaacgaccatgtttaaaatcaacctggcggcagcgcaaaagatg

SEQ ID NO: 89764 - DNA, 103 bp, Artificial Sequence
  Synthetic Polynucleotide
taatacgactcactatagggcggcatgtttgatgagagggttgattttaaaacagaggagattaaaaatgaccctctcaaacctggcggcagcgcaaaagatg

SEQ ID NO: 89765 - DNA, 103 bp, Artificial Sequence
  Synthetic Polynucleotide
taatacgactcactatagggataagccatacggcatgtttgatgagagggaacagaggagaccctctatgcaaacatgcaacctggcggcagcgcaaaagatg

SEQ ID NO: 89766 - DNA, 103 bp, Artificial Sequence
  Synthetic Polynucleotide
taatacgactcactataggggctgtcttagataagccatacggcatgtttaacagaggagaaaacatatggtatggcttaacctggcggcagcgcaaaagatg

SEQ ID NO: 89767 - DNA, 103 bp, Artificial Sequence
  Synthetic Polynucleotide
taatacgactcactatagggttcactgtttgctgtcttagataagccataaacagaggagatatggcatgtctaagacaaacctggcggcagcgcaaaagatg

SEQ ID NO: 89768 - DNA, 103 bp, Artificial Sequence
  Synthetic Polynucleotide
taatacgactcactatagggctgattttccttcactgtttgctgtcttagaacagaggagactaagaatgcaaacagtgaacctggcggcagcgcaaaagatg

SEQ ID NO: 89769 - DNA, 103 bp, Artificial Sequence
  Synthetic Polynucleotide
taatacgactcactataggggaacaagagtctgattttccttcactgtttaacagaggagaaaacagatgaggaaaatcaacctggcggcagcgcaaaagatg

SEQ ID NO: 89770 - DNA, 103 bp, Artificial Sequence
  Synthetic Polynucleotide
taatacgactcactatagggactatcagatgaacaagagtctgattttccaacagaggagaggaaaaatggactcttgtaacctggcggcagcgcaaaagatg

SEQ ID NO: 89771 - DNA, 103 bp, Artificial Sequence
  Synthetic Polynucleotide
taatacgactcactatagggcttctgtttcactatcagatgaacaagagtaacagaggagaactcttatgcatctgataaacctggcggcagcgcaaaagatg

SEQ ID NO: 89772 - DNA, 103 bp, Artificial Sequence
  Synthetic Polynucleotide
taatacgactcactatagggtcctgaaaagatccatcagatgtccttgttaacagaggagaaacaagatgatctgatggaacctggcggcagcgcaaaagatg

SEQ ID NO: 89773 - DNA, 103 bp, Artificial Sequence
  Synthetic Polynucleotide
taatacgactcactatagggtctaaagcatcttctgtttcactatcagataacagaggagaatctgaatgtgaaacagaaacctggcggcagcgcaaaagatg

SEQ ID NO: 89774 - DNA, 103 bp, Artificial Sequence
  Synthetic Polynucleotide
taatacgactcactatagggtaaattcttttctaaagcatcttctgtttcaacagaggagagaaacaatggatgctttaaacctggcggcagcgcaaaagatg

SEQ ID NO: 89775 - DNA, 103 bp, Artificial Sequence
  Synthetic Polynucleotide
taatacgactcactatagggcttcatttattaaattcttttctaaagcataacagaggagaatgcttatgaaaagaattaacctggcggcagcgcaaaagatg

SEQ ID NO: 89776 - DNA, 103 bp, Artificial Sequence
  Synthetic Polynucleotide
taatacgactcactatagggagagaaagttcttcatttattaaattctttaacagaggagaaaagaaatgaataaatgaaacctggcggcagcgcaaaagatg

SEQ ID NO: 89777 - DNA, 103 bp, Artificial Sequence
  Synthetic Polynucleotide
taatacgactcactatagggttcatctttaagagaaagttcttcatttataacagaggagaataaatatggaactttctaacctggcggcagcgcaaaagatg

SEQ ID NO: 89778 - DNA, 103 bp, Artificial Sequence
  Synthetic Polynucleotide
taatacgactcactatagggttttttctagttcatctttaagagaaagttaacagaggagaaactttatgttaaagatgaacctggcggcagcgcaaaagatg

SEQ ID NO: 89779 - DNA, 103 bp, Artificial Sequence
  Synthetic Polynucleotide
taatacgactcactatagggaaattttcatttttttctagttcatctttaaacagaggagataaagaatgactagaaaaaacctggcggcagcgcaaaagatg

SEQ ID NO: 89780 - DNA, 103 bp, Artificial Sequence
  Synthetic Polynucleotide
taatacgactcactatagggatcatcattcaaattttcatttttttctagaacagaggagactagaaatgaatgaaaataacctggcggcagcgcaaaagatg

SEQ ID NO: 89781 - DNA, 103 bp, Artificial Sequence
  Synthetic Polynucleotide
taatacgactcactatagggcatctagcttatcatcattcaaattttcataacagaggagaatgaaaatgtgaatgatgaacctggcggcagcgcaaaagatg

SEQ ID NO: 89782 - DNA, 103 bp, Artificial Sequence
  Synthetic Polynucleotide
taatacgactcactatagggggattttcttcatctagcttatcatcattcaacagaggagagaatgaatgtaagctagaaacctggcggcagcgcaaaagatg

SEQ ID NO: 89783 - DNA, 103 bp, Artificial Sequence
  Synthetic Polynucleotide
taatacgactcactataggggataatagcttcctgaaaagatccatcagaaacagaggagatctgatatgtcttttcagaacctggcggcagcgcaaaagatg

SEQ ID NO: 89784 - DNA, 103 bp, Artificial Sequence
  Synthetic Polynucleotide
taatacgactcactatagggagaaatctttggattttcttcatctagcttaacagaggagaaagctaatggaagaaaataacctggcggcagcgcaaaagatg

SEQ ID NO: 89785 - DNA, 103 bp, Artificial Sequence
  Synthetic Polynucleotide
taatacgactcactatagggatatatgtgcagaaatctttggattttcttaacagaggagaaagaaaatgcaaagatttaacctggcggcagcgcaaaagatg

SEQ ID NO: 89786 - DNA, 103 bp, Artificial Sequence
  Synthetic Polynucleotide
taatacgactcactatagggttttcttttaatatatgtgcagaaatctttaacagaggagaaaagatatgtgcacatataacctggcggcagcgcaaaagatg

SEQ ID NO: 89787 - DNA, 103 bp, Artificial Sequence
  Synthetic Polynucleotide
taatacgactcactatagggagtcctatcattttcttttaatatatgtgcaacagaggagagcacatatgttaaaagaaaacctggcggcagcgcaaaagatg

SEQ ID NO: 89788 - DNA, 103 bp, Artificial Sequence
  Synthetic Polynucleotide
taatacgactcactataggggctgcatttgagtcctatcattttcttttaaacagaggagataaaagatgatgataggaaacctggcggcagcgcaaaagatg

SEQ ID NO: 89789 - DNA, 103 bp, Artificial Sequence
  Synthetic Polynucleotide
taatacgactcactataggggtttctaaaggctgcatttgagtcctatcaaacagaggagatgatagatgtcaaatgcaaacctggcggcagcgcaaaagatg

SEQ ID NO: 89790 - DNA, 103 bp, Artificial Sequence
  Synthetic Polynucleotide
taatacgactcactatagggtaacttcagggtttctaaaggctgcatttgaacagaggagacaaatgatgcctttagaaaacctggcggcagcgcaaaagatg

SEQ ID NO: 89791 - DNA, 103 bp, Artificial Sequence
  Synthetic Polynucleotide
taatacgactcactatagggctccaacttctaacttcagggtttctaaagaacagaggagactttagatgccctgaagtaacctggcggcagcgcaaaagatg

SEQ ID NO: 89792 - DNA, 103 bp, Artificial Sequence
  Synthetic Polynucleotide
taatacgactcactatagggtgttcattctctccaacttctaacttcaggaacagaggagacctgaaatgagaagttggaacctggcggcagcgcaaaagatg

SEQ ID NO: 89793 - DNA, 103 bp, Artificial Sequence
  Synthetic Polynucleotide
taatacgactcactatagggctgtactatttgttcattctctccaacttcaacagaggagagaagttatggagaatgaaaacctggcggcagcgcaaaagatg

SEQ ID NO: 89794 - DNA, 103 bp, Artificial Sequence
  Synthetic Polynucleotide
taatacgactcactatagggtcaacttgctgataatagcttcctgaaaagaacagaggagacttttcatgaagctattaaacctggcggcagcgcaaaagatg

SEQ ID NO: 89795 - DNA, 103 bp, Artificial Sequence
  Synthetic Polynucleotide
taatacgactcactatagggtcccaaaaatctgtactatttgttcattctaacagaggagaagaatgatgaaatagtacaacctggcggcagcgcaaaagatg

SEQ ID NO: 89796 - DNA, 103 bp, Artificial Sequence
  Synthetic Polynucleotide
taatacgactcactatagggtccattttgttcccaaaaatctgtactattaacagaggagaaatagtatggatttttggaacctggcggcagcgcaaaagatg

SEQ ID NO: 89797 - DNA, 103 bp, Artificial Sequence
  Synthetic Polynucleotide
taatacgactcactatagggttctgttttttccattttgttcccaaaaataacagaggagaatttttatgaacaaaatgaacctggcggcagcgcaaaagatg

SEQ ID NO: 89798 - DNA, 103 bp, Artificial Sequence
  Synthetic Polynucleotide
taatacgactcactatagggtcttaacttcttctgttttttccattttgtaacagaggagaacaaaaatgaaaaaacagaacctggcggcagcgcaaaagatg

SEQ ID NO: 89799 - DNA, 103 bp, Artificial Sequence
  Synthetic Polynucleotide
taatacgactcactatagggtcggcttctttcttaacttcttctgtttttaacagaggagaaaaaacatgagaagttaaaacctggcggcagcgcaaaagatg

SEQ ID NO: 89800 - DNA, 103 bp, Artificial Sequence
  Synthetic Polynucleotide
taatacgactcactatagggtggagatttttcggcttctttcttaacttcaacagaggagagaagttatgaaagaagccaacctggcggcagcgcaaaagatg

SEQ ID NO: 89801 - DNA, 103 bp, Artificial Sequence
  Synthetic Polynucleotide
taatacgactcactatagggcctttccttttggagatttttcggcttcttaacagaggagaaagaagatgaaaaatctcaacctggcggcagcgcaaaagatg

SEQ ID NO: 89802 - DNA, 103 bp, Artificial Sequence
  Synthetic Polynucleotide
taatacgactcactatagggcttcgtcttccctttccttttggagattttaacagaggagaaaaatcatgaaaaggaaaaacctggcggcagcgcaaaagatg

SEQ ID NO: 89803 - DNA, 103 bp, Artificial Sequence
  Synthetic Polynucleotide
taatacgactcactatagggttttgtcttgcttcgtcttccctttcctttaacagaggagaaaaggaatgggaagacgaaacctggcggcagcgcaaaagatg

SEQ ID NO: 89804 - DNA, 103 bp, Artificial Sequence
  Synthetic Polynucleotide
taatacgactcactatagggaagaaagatcttttgtcttgcttcgtcttcaacagaggagagaagacatggcaagacaaaacctggcggcagcgcaaaagatg

SEQ ID NO: 89805 - DNA, 103 bp, Artificial Sequence
  Synthetic Polynucleotide
taatacgactcactatagggctagcatctgtcaacttgctgataatagctaacagaggagaagctatatgcagcaagttaacctggcggcagcgcaaaagatg

SEQ ID NO: 89806 - DNA, 103 bp, Artificial Sequence
  Synthetic Polynucleotide
taatacgactcactatagggataatttctaaagaaagatcttttgtcttgaacagaggagacaagacatgagatctttcaacctggcggcagcgcaaaagatg

SEQ ID NO: 89807 - DNA, 103 bp, Artificial Sequence
  Synthetic Polynucleotide
taatacgactcactatagggtgaaatctttataatttctaaagaaagatcaacagaggagagatcttatgttagaaattaacctggcggcagcgcaaaagatg

SEQ ID NO: 89808 - DNA, 103 bp, Artificial Sequence
  Synthetic Polynucleotide
taatacgactcactatagggggccaaatgatgaaatctttataatttctaaacagaggagatagaaaatgtaaagatttaacctggcggcagcgcaaaagatg

SEQ ID NO: 89809 - DNA, 103 bp, Artificial Sequence
  Synthetic Polynucleotide
taatacgactcactataggggcttcattctggccaaatgatgaaatctttaacagaggagaaaagatatgatcatttggaacctggcggcagcgcaaaagatg

SEQ ID NO: 89810 - DNA, 103 bp, Artificial Sequence
  Synthetic Polynucleotide
taatacgactcactatagggttcacttcctgcttcattctggccaaatgaaacagaggagatcatttatgcagaatgaaaacctggcggcagcgcaaaagatg

SEQ ID NO: 89811 - DNA, 103 bp, Artificial Sequence
  Synthetic Polynucleotide
taatacgactcactatagggctatatgaggttcacttcctgcttcattctaacagaggagaagaatgatgcaggaagtgaacctggcggcagcgcaaaagatg

SEQ ID NO: 89812 - DNA, 103 bp, Artificial Sequence
  Synthetic Polynucleotide
taatacgactcactatagggctatgagcttctatatgaggttcacttcctaacagaggagaaggaagatgacctcatataacctggcggcagcgcaaaagatg

SEQ ID NO: 89813 - DNA, 103 bp, Artificial Sequence
  Synthetic Polynucleotide
taatacgactcactatagggcaattcaagactatgagcttctatatgaggaacagaggagacctcatatggaagctcataacctggcggcagcgcaaaagatg

SEQ ID NO: 89814 - DNA, 103 bp, Artificial Sequence
  Synthetic Polynucleotide
taatacgactcactatagggctaatgaagacaattcaagactatgagcttaacagaggagaaagctcatggtcttgaataacctggcggcagcgcaaaagatg

SEQ ID NO: 89815 - DNA, 103 bp, Artificial Sequence
  Synthetic Polynucleotide
taatacgactcactatagggtttttattgtctaatgaagacaattcaagaaacagaggagatcttgaatggtcttcattaacctggcggcagcgcaaaagatg

SEQ ID NO: 89816 - DNA, 103 bp, Artificial Sequence
  Synthetic Polynucleotide
taatacgactcactatagggggtataccaactagcatctgtcaacttgctaacagaggagaagcaagatgacagatgctaacctggcggcagcgcaaaagatg

SEQ ID NO: 89817 - DNA, 103 bp, Artificial Sequence
  Synthetic Polynucleotide
taatacgactcactatagggagaagaaaagtttttattgtctaatgaagaaacagaggagatcttcaatggacaataaaaacctggcggcagcgcaaaagatg

SEQ ID NO: 89818 - DNA, 103 bp, Artificial Sequence
  Synthetic Polynucleotide
taatacgactcactatagggcttctgtagcagaagaaaagtttttattgtaacagaggagaacaataatgacttttcttaacctggcggcagcgcaaaagatg

SEQ ID NO: 89819 - DNA, 103 bp, Artificial Sequence
  Synthetic Polynucleotide
taatacgactcactatagggtcaatttcatcttctgtagcagaagaaaagaacagaggagacttttcatgtgctacagaaacctggcggcagcgcaaaagatg

SEQ ID NO: 89820 - DNA, 103 bp, Artificial Sequence
  Synthetic Polynucleotide
taatacgactcactatagggcacacattggtcaatttcatcttctgtagcaacagaggagagctacaatggatgaaattaacctggcggcagcgcaaaagatg

SEQ ID NO: 89821 - DNA, 103 bp, Artificial Sequence
  Synthetic Polynucleotide
taatacgactcactatagggtcttttctttcacacattggtcaatttcataacagaggagaatgaaaatgaccaatgtgaacctggcggcagcgcaaaagatg

SEQ ID NO: 89822 - DNA, 103 bp, Artificial Sequence
  Synthetic Polynucleotide
taatacgactcactatagggcgtttcaacttcttttctttcacacattggaacagaggagaccaatgatggaaagaaaaaacctggcggcagcgcaaaagatg

SEQ ID NO: 89823 - DNA, 103 bp, Artificial Sequence
  Synthetic Polynucleotide
taatacgactcactatagggtagtattttccgtttcaacttcttttctttaacagaggagaaaagaaatgaagttgaaaaacctggcggcagcgcaaaagatg

SEQ ID NO: 89824 - DNA, 103 bp, Artificial Sequence
  Synthetic Polynucleotide
taatacgactcactatagggatgattgtcctagtattttccgtttcaactaacagaggagaagttgaatgggaaaatacaacctggcggcagcgcaaaagatg

SEQ ID NO: 89825 - DNA, 103 bp, Artificial Sequence
  Synthetic Polynucleotide
taatacgactcactatagggttctctggcgatgattgtcctagtattttcaacagaggagagaaaatatgaggacaatcaacctggcggcagcgcaaaagatg

SEQ ID NO: 89826 - DNA, 103 bp, Artificial Sequence
  Synthetic Polynucleotide
taatacgactcactatagggtcttatttttttctctggcgatgattgtccaacagaggagaggacaaatgtcgccagagaacctggcggcagcgcaaaagatg

SEQ ID NO: 89827 - DNA, 103 bp, Artificial Sequence
  Synthetic Polynucleotide
taatacgactcactatagggcaaacaccacggtataccaactagcatctgaacagaggagacagatgatggttggtataaacctggcggcagcgcaaaagatg

SEQ ID NO: 89828 - DNA, 103 bp, Artificial Sequence
  Synthetic Polynucleotide
taatacgactcactatagggcattctcaattcttatttttttctctggcgaacagaggagacgccagatgaaaaaataaaacctggcggcagcgcaaaagatg

SEQ ID NO: 89829 - DNA, 103 bp, Artificial Sequence
  Synthetic Polynucleotide
taatacgactcactatagggatttccattccattctcaattcttatttttaacagaggagaaaaaatatgaattgagaaaacctggcggcagcgcaaaagatg

SEQ ID NO: 89830 - DNA, 103 bp, Artificial Sequence
  Synthetic Polynucleotide
taatacgactcactatagggagtatttgtcatttccattccattctcaataacagaggagaattgagatgggaatggaaaacctggcggcagcgcaaaagatg

SEQ ID NO: 89831 - DNA, 103 bp, Artificial Sequence
  Synthetic Polynucleotide
taatacgactcactatagggcttgagatacagtatttgtcatttccattcaacagaggagagaatggatgtgacaaataaacctggcggcagcgcaaaagatg

SEQ ID NO: 89832 - DNA, 103 bp, Artificial Sequence
  Synthetic Polynucleotide
taatacgactcactatagggctggtcctttcttgagatacagtatttgtcaacagaggagagacaaaatgtgtatctcaaacctggcggcagcgcaaaagatg

SEQ ID NO: 89833 - DNA, 103 bp, Artificial Sequence
  Synthetic Polynucleotide
taatacgactcactatagggaatacaatcactggtcctttcttgagatacaacagaggagagtatctatggaaaggaccaacctggcggcagcgcaaaagatg

SEQ ID NO: 89834 - DNA, 103 bp, Artificial Sequence
  Synthetic Polynucleotide
taatacgactcactatagggcctcagatccaatacaatcactggtcctttaacagaggagaaaaggaatggtgattgtaaacctggcggcagcgcaaaagatg

SEQ ID NO: 89835 - DNA, 103 bp, Artificial Sequence
  Synthetic Polynucleotide
taatacgactcactatagggtttttcattccctcagatccaatacaatcaaacagaggagatgattgatgtggatctgaaacctggcggcagcgcaaaagatg

SEQ ID NO: 89836 - DNA, 103 bp, Artificial Sequence
  Synthetic Polynucleotide
taatacgactcactatagggaaaatttaagtttttcattccctcagatccaacagaggagaggatctatgggaatgaaaaacctggcggcagcgcaaaagatg

SEQ ID NO: 89837 - DNA, 103 bp, Artificial Sequence
  Synthetic Polynucleotide
taatacgactcactatagggagtgctgttcaaaatttaagtttttcattcaacagaggagagaatgaatgacttaaattaacctggcggcagcgcaaaagatg

SEQ ID NO: 89838 - DNA, 103 bp, Artificial Sequence
  Synthetic Polynucleotide
taatacgactcactatagggtcaccatcatcaaacaccacggtataccaaaacagaggagattggtaatgcgtggtgttaacctggcggcagcgcaaaagatg

SEQ ID NO: 89839 - DNA, 103 bp, Artificial Sequence
  Synthetic Polynucleotide
taatacgactcactatagggtctctttcaaagtgctgttcaaaatttaagaacagaggagacttaaaatgtgaacagcaaacctggcggcagcgcaaaagatg

SEQ ID NO: 89840 - DNA, 103 bp, Artificial Sequence
  Synthetic Polynucleotide
taatacgactcactatagggtccttcattttctctttcaaagtgctgttcaacagaggagagaacagatgtttgaaagaaacctggcggcagcgcaaaagatg

SEQ ID NO: 89841 - DNA, 103 bp, Artificial Sequence
  Synthetic Polynucleotide
taatacgactcactatagggatgatggcattccttcattttctctttcaaaacagaggagattgaaaatgaaaatgaagaacctggcggcagcgcaaaagatg

SEQ ID NO: 89842 - DNA, 103 bp, Artificial Sequence
  Synthetic Polynucleotide
taatacgactcactatagggtctgctatcaatgatggcattccttcatttaacagaggagaaaatgaatgaatgccatcaacctggcggcagcgcaaaagatg

SEQ ID NO: 89843 - DNA, 103 bp, Artificial Sequence
  Synthetic Polynucleotide
taatacgactcactatagggttggtttgactctgctatcaatgatggcataacagaggagaatgccaatgttgatagcaaacctggcggcagcgcaaaagatg

SEQ ID NO: 89844 - DNA, 103 bp, Artificial Sequence
  Synthetic Polynucleotide
taatacgactcactataggggttggatgcattggtttgactctgctatcaaacagaggagatgatagatgagtcaaaccaacctggcggcagcgcaaaagatg

SEQ ID NO: 89845 - DNA, 103 bp, Artificial Sequence
  Synthetic Polynucleotide
taatacgactcactatagggctagtcagttgttggatgcattggtttgacaacagaggagagtcaaaatgatgcatccaaacctggcggcagcgcaaaagatg

SEQ ID NO: 89846 - DNA, 103 bp, Artificial Sequence
  Synthetic Polynucleotide
taatacgactcactatagggaaatctttcactagtcagttgttggatgcaaacagaggagatgcatcatgcaactgactaacctggcggcagcgcaaaagatg

SEQ ID NO: 89847 - DNA, 103 bp, Artificial Sequence
  Synthetic Polynucleotide
taatacgactcactatagggctggactatcaaatctttcactagtcagttaacagaggagaaactgaatggtgaaagataacctggcggcagcgcaaaagatg

SEQ ID NO: 89848 - DNA, 103 bp, Artificial Sequence
  Synthetic Polynucleotide
taatacgactcactataggggtttcttcagctggactatcaaatctttcaaacagaggagatgaaagatgtgatagtccaacctggcggcagcgcaaaagatg

SEQ ID NO: 89849 - DNA, 103 bp, Artificial Sequence
  Synthetic Polynucleotide
taatacgactcactatagggtgttcgctcatcaccatcatcaaacaccacaacagaggagagtggtgatggatgatggtaacctggcggcagcgcaaaagatg

SEQ ID NO: 89850 - DNA, 103 bp, Artificial Sequence
  Synthetic Polynucleotide
taatacgactcactatagggaatatttacagtttcttcagctggactatcaacagaggagagatagtatggctgaagaaaacctggcggcagcgcaaaagatg

SEQ ID NO: 89851 - DNA, 103 bp, Artificial Sequence
  Synthetic Polynucleotide
taatacgactcactatagggcttttagtggaatatttacagtttcttcagaacagaggagactgaagatgctgtaaataaacctggcggcagcgcaaaagatg

SEQ ID NO: 89852 - DNA, 103 bp, Artificial Sequence
  Synthetic Polynucleotide
taatacgactcactatagggtcctcatcttcttttagtggaatatttacaaacagaggagatgtaaaatgtccactaaaaacctggcggcagcgcaaaagatg

SEQ ID NO: 89853 - DNA, 103 bp, Artificial Sequence
  Synthetic Polynucleotide
taatacgactcactatagggaggcattgcatcctcatcttcttttagtggaacagaggagaccactaatggaagatgagaacctggcggcagcgcaaaagatg

SEQ ID NO: 89854 - DNA, 103 bp, Artificial Sequence
  Synthetic Polynucleotide
taatacgactcactataggggcccgatcagaggcattgcatcctcatcttaacagaggagaaagatgatgatgcaatgcaacctggcggcagcgcaaaagatg

SEQ ID NO: 89855 - DNA, 103 bp, Artificial Sequence
  Synthetic Polynucleotide
taatacgactcactatagggaaggtttcaggcccgatcagaggcattgcaaacagaggagatgcaatatgtctgatcggaacctggcggcagcgcaaaagatg

SEQ ID NO: 89856 - DNA, 103 bp, Artificial Sequence
  Synthetic Polynucleotide
taatacgactcactatagggatggcaaaccaaggtttcaggcccgatcagaacagaggagactgatcatgcctgaaaccaacctggcggcagcgcaaaagatg

SEQ ID NO: 89857 - DNA, 103 bp, Artificial Sequence
  Synthetic Polynucleotide
taatacgactcactatagggaatctacttcatggcaaaccaaggtttcagaacagaggagactgaaaatgtggtttgccaacctggcggcagcgcaaaagatg

SEQ ID NO: 89858 - DNA, 103 bp, Artificial Sequence
  Synthetic Polynucleotide
taatacgactcactatagggaaatcatccaaatctacttcatggcaaaccaacagaggagaggtttgatgtgaagtagaaacctggcggcagcgcaaaagatg

SEQ ID NO: 89859 - DNA, 103 bp, Artificial Sequence
  Synthetic Polynucleotide
taatacgactcactatagggcttttcatccaaatcatccaaatctacttcaacagaggagagaagtaatgttggatgataacctggcggcagcgcaaaagatg

SEQ ID NO: 89860 - DNA, 103 bp, Artificial Sequence
  Synthetic Polynucleotide
taatacgactcactatagggtacgtctcaatgttcgctcatcaccatcataacagaggagaatgatgatgatgagcgaaaacctggcggcagcgcaaaagatg

SEQ ID NO: 89861 - DNA, 103 bp, Artificial Sequence
  Synthetic Polynucleotide
taatacgactcactatagggtggtcttatccttttcatccaaatcatccaaacagaggagatggatgatgtggatgaaaaacctggcggcagcgcaaaagatg

SEQ ID NO: 89862 - DNA, 103 bp, Artificial Sequence
  Synthetic Polynucleotide
taatacgactcactatagggtcctcaatgctggtcttatccttttcatccaacagaggagaggatgaatgggataagacaacctggcggcagcgcaaaagatg

SEQ ID NO: 89863 - DNA, 103 bp, Artificial Sequence
  Synthetic Polynucleotide
taatacgactcactatagggaactgctacatcctcaatgctggtcttatcaacagaggagagataagatgagcattgagaacctggcggcagcgcaaaagatg

SEQ ID NO: 89864 - DNA, 103 bp, Artificial Sequence
  Synthetic Polynucleotide
taatacgactcactatagggcagagctttcaactgctacatcctcaatgcaacagaggagagcattgatgatgtagcagaacctggcggcagcgcaaaagatg

SEQ ID NO: 89865 - DNA, 103 bp, Artificial Sequence
  Synthetic Polynucleotide
taatacgactcactataggggagttagactcagagctttcaactgctacaaacagaggagatgtagcatgtgaaagctcaacctggcggcagcgcaaaagatg

SEQ ID NO: 89866 - DNA, 103 bp, Artificial Sequence
  Synthetic Polynucleotide
taatacgactcactatagggagaaacaagagagttagactcagagctttcaacagaggagagaaagcatggagtctaacaacctggcggcagcgcaaaagatg

SEQ ID NO: 89867 - DNA, 103 bp, Artificial Sequence
  Synthetic Polynucleotide
taatacgactcactatagggcaggtggaatagaaacaagagagttagactaacagaggagaagtctaatgctcttgtttaacctggcggcagcgcaaaagatg

SEQ ID NO: 89868 - DNA, 103 bp, Artificial Sequence
  Synthetic Polynucleotide
taatacgactcactatagggggaggtagggcaggtggaatagaaacaagaaacagaggagatcttgtatgtattccaccaacctggcggcagcgcaaaagatg

SEQ ID NO: 89869 - DNA, 103 bp, Artificial Sequence
  Synthetic Polynucleotide
taatacgactcactatagggttggactacaggaggtagggcaggtggaataacagaggagaattccaatggccctacctaacctggcggcagcgcaaaagatg

SEQ ID NO: 89870 - DNA, 103 bp, Artificial Sequence
  Synthetic Polynucleotide
taatacgactcactatagggaaaagttatgttggactacaggaggtagggaacagaggagaccctacatgctgtagtccaacctggcggcagcgcaaaagatg

SEQ ID NO: 89871 - DNA, 103 bp, Artificial Sequence
  Synthetic Polynucleotide
taatacgactcactatagggctgacatcggttcccactgtcaggtaggcaaacagaggagatgcctaatggacagtgggaacctggcggcagcgcaaaagatg

SEQ ID NO: 89872 - DNA, 103 bp, Artificial Sequence
  Synthetic Polynucleotide
taatacgactcactatagggcaaagtgaggtacgtctcaatgttcgctcaaacagaggagatgagcgatgattgagacgaacctggcggcagcgcaaaagatg

SEQ ID NO: 89873 - DNA, 103 bp, Artificial Sequence
  Synthetic Polynucleotide
taatacgactcactataggggaagctactgaaaagttatgttggactacaaacagaggagatgtagtatgacataacttaacctggcggcagcgcaaaagatg

SEQ ID NO: 89874 - DNA, 103 bp, Artificial Sequence
  Synthetic Polynucleotide
taatacgactcactatagggagtaagtggtgaagctactgaaaagttatgaacagaggagacataacatgtcagtagctaacctggcggcagcgcaaaagatg

SEQ ID NO: 89875 - DNA, 103 bp, Artificial Sequence
  Synthetic Polynucleotide
taatacgactcactatagggcttgactaagagtaagtggtgaagctactgaacagaggagacagtagatgcaccacttaaacctggcggcagcgcaaaagatg

SEQ ID NO: 89876 - DNA, 103 bp, Artificial Sequence
  Synthetic Polynucleotide
taatacgactcactatagggcgagactcatcttgactaagagtaagtggtaacagaggagaaccactatgtcttagtcaaacctggcggcagcgcaaaagatg

SEQ ID NO: 89877 - DNA, 103 bp, Artificial Sequence
  Synthetic Polynucleotide
taatacgactcactatagggttttacgcttcgagactcatcttgactaagaacagaggagacttagtatggatgagtctaacctggcggcagcgcaaaagatg

SEQ ID NO: 89878 - DNA, 103 bp, Artificial Sequence
  Synthetic Polynucleotide
taatacgactcactatagggcactctcactttttacgcttcgagactcataacagaggagaatgagtatggaagcgtaaaacctggcggcagcgcaaaagatg

SEQ ID NO: 89879 - DNA, 103 bp, Artificial Sequence
  Synthetic Polynucleotide
taatacgactcactatagggatcgttatatcactctcactttttacgcttaacagaggagaaagcgtatgaagtgagagaacctggcggcagcgcaaaagatg

SEQ ID NO: 89880 - DNA, 103 bp, Artificial Sequence
  Synthetic Polynucleotide
taatacgactcactatagggatcaacttcaatcgttatatcactctcactaacagaggagaagtgagatggatataacgaacctggcggcagcgcaaaagatg

SEQ ID NO: 89881 - DNA, 103 bp, Artificial Sequence
  Synthetic Polynucleotide
taatacgactcactatagggcagcaatactatcaacttcaatcgttatataacagaggagaatataaatgttgaagttgaacctggcggcagcgcaaaagatg

SEQ ID NO: 89882 - DNA, 103 bp, Artificial Sequence
  Synthetic Polynucleotide
taatacgactcactatagggtgagattcttcagcaatactatcaacttcaaacagaggagatgaagtatgtagtattgcaacctggcggcagcgcaaaagatg

SEQ ID NO: 89883 - DNA, 103 bp, Artificial Sequence
  Synthetic Polynucleotide
taatacgactcactatagggtcctttcagacaaagtgaggtacgtctcaaaacagaggagattgagaatgacctcacttaacctggcggcagcgcaaaagatg

SEQ ID NO: 89884 - DNA, 103 bp, Artificial Sequence
  Synthetic Polynucleotide
taatacgactcactataggggagaccttcttgagattcttcagcaatactaacagaggagaagtattatggaagaatctaacctggcggcagcgcaaaagatg

SEQ ID NO: 89885 - DNA, 103 bp, Artificial Sequence
  Synthetic Polynucleotide
taatacgactcactatagggccctctcacagagaccttcttgagattcttaacagaggagaaagaatatgaagaaggtcaacctggcggcagcgcaaaagatg

SEQ ID NO: 89886 - DNA, 103 bp, Artificial Sequence
  Synthetic Polynucleotide
taatacgactcactatagggtttgccgattccctctcacagagaccttctaacagaggagaagaaggatgctgtgagagaacctggcggcagcgcaaaagatg

SEQ ID NO: 89887 - DNA, 103 bp, Artificial Sequence
  Synthetic Polynucleotide
taatacgactcactatagggttcaaatccatttgccgattccctctcacaaacagaggagatgtgagatggaatcggcaaacctggcggcagcgcaaaagatg

SEQ ID NO: 89888 - DNA, 103 bp, Artificial Sequence
  Synthetic Polynucleotide
taatacgactcactatagggcaacattagtttcaaatccatttgccgattaacagaggagaaatcggatgatggatttgaacctggcggcagcgcaaaagatg

SEQ ID NO: 89889 - DNA, 103 bp, Artificial Sequence
  Synthetic Polynucleotide
taatacgactcactataggggtaccagaggcaacattagtttcaaatccaaacagaggagatggattatgaactaatgtaacctggcggcagcgcaaaagatg

SEQ ID NO: 89890 - DNA, 103 bp, Artificial Sequence
  Synthetic Polynucleotide
taatacgactcactatagggtatactacaggtaccagaggcaacattagtaacagaggagaactaatatggcctctggtaacctggcggcagcgcaaaagatg

SEQ ID NO: 89891 - DNA, 103 bp, Artificial Sequence
  Synthetic Polynucleotide
taatacgactcactatagggcttgtacaattatactacaggtaccagaggaacagaggagacctctgatgcctgtagtaaacctggcggcagcgcaaaagatg

SEQ ID NO: 89892 - DNA, 103 bp, Artificial Sequence
  Synthetic Polynucleotide
taatacgactcactatagggctctctctctcttgtacaattatactacagaacagaggagactgtagatgaattgtacaaacctggcggcagcgcaaaagatg

SEQ ID NO: 89893 - DNA, 103 bp, Artificial Sequence
  Synthetic Polynucleotide
taatacgactcactatagggcttctctctgctctctctctcttgtacaataacagaggagaattgtaatggagagagagaacctggcggcagcgcaaaagatg

SEQ ID NO: 89894 - DNA, 103 bp, Artificial Sequence
  Synthetic Polynucleotide
taatacgactcactatagggaatgtctctctcctttcagacaaagtgaggaacagaggagacctcacatggtctgaaagaacctggcggcagcgcaaaagatg

SEQ ID NO: 89895 - DNA, 103 bp, Artificial Sequence
  Synthetic Polynucleotide
taatacgactcactatagggtcttctgacccttctctctgctctctctctaacagaggagaagagagatggcagagagaaacctggcggcagcgcaaaagatg

SEQ ID NO: 89896 - DNA, 103 bp, Artificial Sequence
  Synthetic Polynucleotide
taatacgactcactatagggtcacttggcctcttctgacccttctctctgaacagaggagacagagaatggggtcagaaaacctggcggcagcgcaaaagatg

SEQ ID NO: 89897 - DNA, 103 bp, Artificial Sequence
  Synthetic Polynucleotide
taatacgactcactatagggactatttccatcacttggcctcttctgaccaacagaggagaggtcagatgaggccaagtaacctggcggcagcgcaaaagatg

SEQ ID NO: 89898 - DNA, 103 bp, Artificial Sequence
  Synthetic Polynucleotide
taatacgactcactatagggccattaatccactatttccatcacttggccaacagaggagaggccaaatgatggaaataaacctggcggcagcgcaaaagatg

SEQ ID NO: 89899 - DNA, 103 bp, Artificial Sequence
  Synthetic Polynucleotide
taatacgactcactatagggtgcttttttgccattaatccactatttccaaacagaggagatggaaaatgtggattaataacctggcggcagcgcaaaagatg

SEQ ID NO: 89900 - DNA, 103 bp, Artificial Sequence
  Synthetic Polynucleotide
taatacgactcactatagggggtacgcttttgcttttttgccattaatccaacagaggagaggattaatggcaaaaaagaacctggcggcagcgcaaaagatg

SEQ ID NO: 89901 - DNA, 103 bp, Artificial Sequence
  Synthetic Polynucleotide
taatacgactcactatagggttcgctttggggtacgcttttgcttttttgaacagaggagacaaaaaatgaaaagcgtaaacctggcggcagcgcaaaagatg

SEQ ID NO: 89902 - DNA, 103 bp, Artificial Sequence
  Synthetic Polynucleotide
taatacgactcactataggggcagcacttgttcgctttggggtacgctttaacagaggagaaaagcgatgcccaaagcgaacctggcggcagcgcaaaagatg

SEQ ID NO: 89903 - DNA, 103 bp, Artificial Sequence
  Synthetic Polynucleotide
taatacgactcactatagggatttttggctgcagcacttgttcgctttggaacagaggagaccaaagatgacaagtgctaacctggcggcagcgcaaaagatg

SEQ ID NO: 89904 - DNA, 103 bp, Artificial Sequence
  Synthetic Polynucleotide
taatacgactcactatagggcattcttttcatttttggctgcagcacttgaacagaggagacaagtgatgcagccaaaaaacctggcggcagcgcaaaagatg

SEQ ID NO: 89905 - DNA, 103 bp, Artificial Sequence
  Synthetic Polynucleotide
taatacgactcactatagggctctctgcaaaatgtctctctcctttcagaaacagaggagatctgaaatgagagagacaaacctggcggcagcgcaaaagatg

SEQ ID NO: 89906 - DNA, 103 bp, Artificial Sequence
  Synthetic Polynucleotide
taatacgactcactatagggtcatctgttccattcttttcatttttggctaacagaggagaagccaaatgtgaaaagaaaacctggcggcagcgcaaaagatg

SEQ ID NO: 89907 - DNA, 103 bp, Artificial Sequence
  Synthetic Polynucleotide
taatacgactcactatagggattatctaattcatctgttccattcttttcaacagaggagagaaaagatgggaacagataacctggcggcagcgcaaaagatg

SEQ ID NO: 89908 - DNA, 103 bp, Artificial Sequence
  Synthetic Polynucleotide
taatacgactcactatagggtactgttcatattatctaattcatctgttcaacagaggagagaacagatgaattagataaacctggcggcagcgcaaaagatg

SEQ ID NO: 89909 - DNA, 103 bp, Artificial Sequence
  Synthetic Polynucleotide
taatacgactcactatagggattctctctgtactgttcatattatctaataacagaggagaattagaatgtatgaacagaacctggcggcagcgcaaaagatg

SEQ ID NO: 89910 - DNA, 103 bp, Artificial Sequence
  Synthetic Polynucleotide
taatacgactcactataggggagaaatgagattctctctgtactgttcataacagaggagaatgaacatgacagagagaaacctggcggcagcgcaaaagatg

SEQ ID NO: 89911 - DNA, 103 bp, Artificial Sequence
  Synthetic Polynucleotide
taatacgactcactataggggtttttcttggagaaatgagattctctctgaacagaggagacagagaatgtctcatttcaacctggcggcagcgcaaaagatg

SEQ ID NO: 89912 - DNA, 103 bp, Artificial Sequence
  Synthetic Polynucleotide
taatacgactcactatagggatttcctgtagtttttcttggagaaatgagaacagaggagactcattatgccaagaaaaaacctggcggcagcgcaaaagatg

SEQ ID NO: 89913 - DNA, 103 bp, Artificial Sequence
  Synthetic Polynucleotide
taatacgactcactatagggatattttctgatttcctgtagtttttcttgaacagaggagacaagaaatgctacaggaaaacctggcggcagcgcaaaagatg

SEQ ID NO: 89914 - DNA, 103 bp, Artificial Sequence
  Synthetic Polynucleotide
taatacgactcactatagggaagacatataatattttctgatttcctgtaaacagaggagatacaggatgtcagaaaataacctggcggcagcgcaaaagatg

SEQ ID NO: 89915 - DNA, 103 bp, Artificial Sequence
  Synthetic Polynucleotide
taatacgactcactatagggtcagacttcaaagacatataatattttctgaacagaggagacagaaaatgttatatgtcaacctggcggcagcgcaaaagatg

SEQ ID NO: 89916 - DNA, 103 bp, Artificial Sequence
  Synthetic Polynucleotide
taatacgactcactatagggaagtgtctcactctctgcaaaatgtctctcaacagaggagagagagaatgtttgcagagaacctggcggcagcgcaaaagatg

SEQ ID NO: 89917 - DNA, 103 bp, Artificial Sequence
  Synthetic Polynucleotide
taatacgactcactatagggggttgcaacttcagacttcaaagacatataaacagaggagatatatgatgttgaagtctaacctggcggcagcgcaaaagatg

SEQ ID NO: 89918 - DNA, 103 bp, Artificial Sequence
  Synthetic Polynucleotide
taatacgactcactatagggtcctgtctatggttgcaacttcagacttcaaacagaggagatgaagtatgaagttgcaaaacctggcggcagcgcaaaagatg

SEQ ID NO: 89919 - DNA, 103 bp, Artificial Sequence
  Synthetic Polynucleotide
taatacgactcactatagggctttttctcctcctgtctatggttgcaactaacagaggagaagttgcatgcatagacagaacctggcggcagcgcaaaagatg

SEQ ID NO: 89920 - DNA, 103 bp, Artificial Sequence
  Synthetic Polynucleotide
taatacgactcactatagggcttttttaatctttttctcctcctgtctataacagaggagaatagacatgaggagaaaaaacctggcggcagcgcaaaagatg

SEQ ID NO: 89921 - DNA, 103 bp, Artificial Sequence
  Synthetic Polynucleotide
taatacgactcactatagggccctgtctttcttttttaatctttttctccaacagaggagaggagaaatggattaaaaaaacctggcggcagcgcaaaagatg

SEQ ID NO: 89922 - DNA, 103 bp, Artificial Sequence
  Synthetic Polynucleotide
taatacgactcactatagggtgagacacttccctgtctttcttttttaataacagaggagaattaaaatggaaagacagaacctggcggcagcgcaaaagatg

SEQ ID NO: 89923 - DNA, 103 bp, Artificial Sequence
  Synthetic Polynucleotide
taatacgactcactatagggggctcccgcatgagacacttccctgtctttaacagaggagaaaagacatggaagtgtctaacctggcggcagcgcaaaagatg

SEQ ID NO: 89924 - DNA, 103 bp, Artificial Sequence
  Synthetic Polynucleotide
taatacgactcactatagggatgacatggaggctcccgcatgagacacttaacagaggagaaagtgtatgatgcgggagaacctggcggcagcgcaaaagatg

SEQ ID NO: 89925 - DNA, 103 bp, Artificial Sequence
  Synthetic Polynucleotide
taatacgactcactataggggatgaagcagatgacatggaggctcccgcaaacagaggagatgcgggatgctccatgtcaacctggcggcagcgcaaaagatg

SEQ ID NO: 89926 - DNA, 103 bp, Artificial Sequence
  Synthetic Polynucleotide
taatacgactcactatagggtccagtgtctgatgaagcagatgacatggaaacagaggagatccatgatgtctgcttcaaacctggcggcagcgcaaaagatg

SEQ ID NO: 89927 - DNA, 103 bp, Artificial Sequence
  Synthetic Polynucleotide
taatacgactcactataggggaagctggtcaagtgtctcactctctgcaaaacagaggagattgcagatggtgagacacaacctggcggcagcgcaaaagatg

SEQ ID NO: 89928 - DNA, 103 bp, Artificial Sequence
  Synthetic Polynucleotide
taatacgactcactatagggagggactcattccagtgtctgatgaagcagaacagaggagactgcttatgcagacactgaacctggcggcagcgcaaaagatg

SEQ ID NO: 89929 - DNA, 103 bp, Artificial Sequence
  Synthetic Polynucleotide
taatacgactcactataggggatgatgatgagggactcattccagtgtctaacagaggagaagacacatgaatgagtccaacctggcggcagcgcaaaagatg

SEQ ID NO: 89930 - DNA, 103 bp, Artificial Sequence
  Synthetic Polynucleotide
taatacgactcactatagggttgtgggggagatgatgatgagggactcataacagaggagaatgagtatgtcatcatcaaacctggcggcagcgcaaaagatg

SEQ ID NO: 89931 - DNA, 103 bp, Artificial Sequence
  Synthetic Polynucleotide
taatacgactcactatagggcaagtacattttgtgggggagatgatgatgaacagaggagacatcatatgctcccccacaacctggcggcagcgcaaaagatg

SEQ ID NO: 89932 - DNA, 103 bp, Artificial Sequence
  Synthetic Polynucleotide
taatacgactcactatagggcattctacagcaagtacattttgtgggggaaacagaggagatcccccatgaaatgtactaacctggcggcagcgcaaaagatg

SEQ ID NO: 89933 - DNA, 103 bp, Artificial Sequence
  Synthetic Polynucleotide
taatacgactcactatagggtttgttaatggaagctggtcaagtgtctcaaacagaggagatgagacatgtgaccagctaacctggcggcagcgcaaaagatg

SEQ ID NO: 89934 - DNA, 103 bp, Artificial Sequence
  Synthetic Polynucleotide
taatacgactcactatagggatgctctggatttgttaatggaagctggtcaacagaggagagaccagatgccattaacaaacctggcggcagcgcaaaagatg

SEQ ID NO: 89935 - DNA, 103 bp, Artificial Sequence
  Synthetic Polynucleotide
taatacgactcactataggggagttccaaaatgctctggatttgttaatgaacagaggagacattaaatgatccagagcaacctggcggcagcgcaaaagatg

SEQ ID NO: 89936 - DNA, 103 bp, Artificial Sequence
  Synthetic Polynucleotide
taatacgactcactataggggcaattactggagttccaaaatgctctggaaacagaggagatccagaatgttttggaacaacctggcggcagcgcaaaagatg

SEQ ID NO: 89937 - DNA, 103 bp, Artificial Sequence
  Synthetic Polynucleotide
taatacgactcactataggggtacttggcactgacatcggttcccactgtaacagaggagaacagtgatgaccgatgtcaacctggcggcagcgcaaaagatg

SEQ ID NO: 89938 - DNA, 103 bp, Artificial Sequence
  Synthetic Polynucleotide
taatacgactcactatagggcgtcttctttgcaattactggagttccaaaaacagaggagatttggaatgccagtaattaacctggcggcagcgcaaaagatg

SEQ ID NO: 89939 - DNA, 103 bp, Artificial Sequence
  Synthetic Polynucleotide
taatacgactcactatagggttcctctgttcgtcttctttgcaattactgaacagaggagacagtaaatgcaaagaagaaacctggcggcagcgcaaaagatg

SEQ ID NO: 89940 - DNA, 103 bp, Artificial Sequence
  Synthetic Polynucleotide
taatacgactcactataggggaagatctccttcctctgttcgtcttctttaacagaggagaaaagaaatggaacagaggaacctggcggcagcgcaaaagatg

SEQ ID NO: 89941 - DNA, 103 bp, Artificial Sequence
  Synthetic Polynucleotide
taatacgactcactatagggaacaggaagagaagatctccttcctctgttaacagaggagaaacagaatgaggagatctaacctggcggcagcgcaaaagatg

SEQ ID NO: 89942 - DNA, 103 bp, Artificial Sequence
  Synthetic Polynucleotide
taatacgactcactatagggcatcttcagtaacaggaagagaagatctccaacagaggagaggagatatgctcttcctgaacctggcggcagcgcaaaagatg

SEQ ID NO: 89943 - DNA, 103 bp, Artificial Sequence
  Synthetic Polynucleotide
taatacgactcactatagggtcttccttttcatcttcagtaacaggaagaaacagaggagatcttccatgtactgaagaaacctggcggcagcgcaaaagatg

SEQ ID NO: 89944 - DNA, 103 bp, Artificial Sequence
  Synthetic Polynucleotide
taatacgactcactatagggactgctttcttcttccttttcatcttcagtaacagaggagaactgaaatggaaaaggaaaacctggcggcagcgcaaaagatg

SEQ ID NO: 89945 - DNA, 103 bp, Artificial Sequence
  Synthetic Polynucleotide
taatacgactcactatagggcttcctcttcactgctttcttcttccttttaacagaggagaaaaaggatgaagaaagcaaacctggcggcagcgcaaaagatg

SEQ ID NO: 89946 - DNA, 103 bp, Artificial Sequence
  Synthetic Polynucleotide
taatacgactcactatagggttgtcttcatcttcctcttcactgctttctaacagaggagaagaaagatgtgaagaggaaacctggcggcagcgcaaaagatg

SEQ ID NO: 89947 - DNA, 103 bp, Artificial Sequence
  Synthetic Polynucleotide
taatacgactcactataggggagacggcgcttgtcttcatcttcctcttcaacagaggagagaagagatggatgaagacaacctggcggcagcgcaaaagatg

SEQ ID NO: 89948 - DNA, 103 bp, Artificial Sequence
  Synthetic Polynucleotide
taatacgactcactatagggaggcacctcggtacttggcactgacatcggaacagaggagaccgatgatggtgccaagtaacctggcggcagcgcaaaagatg

SEQ ID NO: 89949 - DNA, 103 bp, Artificial Sequence
  Synthetic Polynucleotide
taatacgactcactatagggattcatcattgagacggcgcttgtcttcataacagaggagaatgaagatgagcgccgtcaacctggcggcagcgcaaaagatg

SEQ ID NO: 89950 - DNA, 103 bp, Artificial Sequence
  Synthetic Polynucleotide
taatacgactcactatagggtttcctagtaattcatcattgagacggcgcaacagaggagagcgccgatgcaatgatgaaacctggcggcagcgcaaaagatg

SEQ ID NO: 89951 - DNA, 103 bp, Artificial Sequence
  Synthetic Polynucleotide
taatacgactcactatagggacttacaacttttcctagtaattcatcattaacagaggagaaatgatatgttactaggaaacctggcggcagcgcaaaagatg

SEQ ID NO: 89952 - DNA, 103 bp, Artificial Sequence
  Synthetic Polynucleotide
taatacgactcactatagggcagacaccacacttacaacttttcctagtaaacagaggagatactagatgaagttgtaaaacctggcggcagcgcaaaagatg

SEQ ID NO: 89953 - DNA, 103 bp, Artificial Sequence
  Synthetic Polynucleotide
taatacgactcactatagggctctccgttgcagacaccacacttacaactaacagaggagaagttgtatgtgtggtgtcaacctggcggcagcgcaaaagatg

SEQ ID NO: 89954 - DNA, 103 bp, Artificial Sequence
  Synthetic Polynucleotide
taatacgactcactatagggccattcagtcctctccgttgcagacaccacaacagaggagagtggtgatggcaacggagaacctggcggcagcgcaaaagatg

SEQ ID NO: 89955 - DNA, 103 bp, Artificial Sequence
  Synthetic Polynucleotide
taatacgactcactatagggaagcaggataccattcagtcctctccgttgaacagaggagacaacggatgggactgaataacctggcggcagcgcaaaagatg

SEQ ID NO: 89956 - DNA, 103 bp, Artificial Sequence
  Synthetic Polynucleotide
taatacgactcactataggggatattaccaaagcaggataccattcagtcaacagaggagagactgaatggtatcctgcaacctggcggcagcgcaaaagatg

SEQ ID NO: 89957 - DNA, 103 bp, Artificial Sequence
  Synthetic Polynucleotide
taatacgactcactatagggacagctgggagatattaccaaagcaggataaacagaggagatatcctatgttggtaataaacctggcggcagcgcaaaagatg

SEQ ID NO: 89958 - DNA, 103 bp, Artificial Sequence
  Synthetic Polynucleotide
taatacgactcactatagggtgtcatcattacagctgggagatattaccaaacagaggagatggtaaatgctcccagctaacctggcggcagcgcaaaagatg

SEQ ID NO: 89959 - DNA, 103 bp, Artificial Sequence
  Synthetic Polynucleotide
taatacgactcactataggggcctcacagaaggcacctcggtacttggcaaacagaggagatgccaaatgccgaggtgcaacctggcggcagcgcaaaagatg

SEQ ID NO: 89960 - DNA, 103 bp, Artificial Sequence
  Synthetic Polynucleotide
taatacgactcactatagggttcactgtgatgtcatcattacagctgggaaacagaggagatcccagatgtaatgatgaaacctggcggcagcgcaaaagatg

SEQ ID NO: 89961 - DNA, 103 bp, Artificial Sequence
  Synthetic Polynucleotide
taatacgactcactatagggctgatcctttttcactgtgatgtcatcattaacagaggagaaatgatatgatcacagtgaacctggcggcagcgcaaaagatg

SEQ ID NO: 89962 - DNA, 103 bp, Artificial Sequence
  Synthetic Polynucleotide
taatacgactcactataggggaactaaacactgatcctttttcactgtgaaacagaggagatcacagatgaaaaggatcaacctggcggcagcgcaaaagatg

SEQ ID NO: 89963 - DNA, 103 bp, Artificial Sequence
  Synthetic Polynucleotide
taatacgactcactatagggataaatgatcgaactaaacactgatcctttaacagaggagaaaaggaatggtgtttagtaacctggcggcagcgcaaaagatg

SEQ ID NO: 89964 - DNA, 103 bp, Artificial Sequence
  Synthetic Polynucleotide
taatacgactcactatagggtttagaatcaataaatgatcgaactaaacaaacagaggagatgtttaatgcgatcatttaacctggcggcagcgcaaaagatg

SEQ ID NO: 89965 - DNA, 103 bp, Artificial Sequence
  Synthetic Polynucleotide
taatacgactcactatagggtagagtaaaatttagaatcaataaatgatcaacagaggagagatcatatgttgattctaaacctggcggcagcgcaaaagatg

SEQ ID NO: 89966 - DNA, 103 bp, Artificial Sequence
  Synthetic Polynucleotide
taatacgactcactatagggtttcttgctatagagtaaaatttagaatcaaacagaggagatgattcatgattttactcaacctggcggcagcgcaaaagatg

SEQ ID NO: 89967 - DNA, 103 bp, Artificial Sequence
  Synthetic Polynucleotide
taatacgactcactatagggcttaatgtcctttcttgctatagagtaaaaaacagaggagattttacatgatagcaagaaacctggcggcagcgcaaaagatg

SEQ ID NO: 89968 - DNA, 103 bp, Artificial Sequence
  Synthetic Polynucleotide
taatacgactcactatagggtgtctacttccttaatgtcctttcttgctaaacagaggagatagcaaatgaggacattaaacctggcggcagcgcaaaagatg

SEQ ID NO: 89969 - DNA, 103 bp, Artificial Sequence
  Synthetic Polynucleotide
taatacgactcactatagggagattgagaatgtctacttccttaatgtccaacagaggagaggacatatgggaagtagaaacctggcggcagcgcaaaagatg

SEQ ID NO: 89970 - DNA, 103 bp, Artificial Sequence
  Synthetic Polynucleotide
taatacgactcactatagggcttaatctttgcctcacagaaggcacctcgaacagaggagacgaggtatgttctgtgagaacctggcggcagcgcaaaagatg

SEQ ID NO: 89971 - DNA, 103 bp, Artificial Sequence
  Synthetic Polynucleotide
taatacgactcactatagggagattccggtagattgagaatgtctacttcaacagaggagagaagtaatgattctcaataacctggcggcagcgcaaaagatg

SEQ ID NO: 89972 - DNA, 103 bp, Artificial Sequence
  Synthetic Polynucleotide
taatacgactcactatagggtggagagctcagattccggtagattgagaaaacagaggagattctcaatgtaccggaataacctggcggcagcgcaaaagatg

SEQ ID NO: 89973 - DNA, 103 bp, Artificial Sequence
  Synthetic Polynucleotide
taatacgactcactatagggcctggtttagtggagagctcagattccggtaacagaggagaaccggaatgtgagctctcaacctggcggcagcgcaaaagatg

SEQ ID NO: 89974 - DNA, 103 bp, Artificial Sequence
  Synthetic Polynucleotide
taatacgactcactatagggtttctgaagccctggtttagtggagagctcaacagaggagagagctcatgactaaaccaaacctggcggcagcgcaaaagatg

SEQ ID NO: 89975 - DNA, 103 bp, Artificial Sequence
  Synthetic Polynucleotide
taatacgactcactatagggagatgcttgctttctgaagccctggtttagaacagaggagactaaacatgggcttcagaaacctggcggcagcgcaaaagatg

SEQ ID NO: 89976 - DNA, 103 bp, Artificial Sequence
  Synthetic Polynucleotide
taatacgactcactataggggtttttaagaagatgcttgctttctgaagcaacagaggagagcttcaatgagcaagcataacctggcggcagcgcaaaagatg

SEQ ID NO: 89977 - DNA, 103 bp, Artificial Sequence
  Synthetic Polynucleotide
taatacgactcactatagggaacaactctagtttttaagaagatgcttgcaacagaggagagcaagcatgttcttaaaaaacctggcggcagcgcaaaagatg

SEQ ID NO: 89978 - DNA, 103 bp, Artificial Sequence
  Synthetic Polynucleotide
taatacgactcactatagggaattatcaggaacaactctagtttttaagaaacagaggagatcttaaatgctagagttgaacctggcggcagcgcaaaagatg

SEQ ID NO: 89979 - DNA, 103 bp, Artificial Sequence
  Synthetic Polynucleotide
taatacgactcactatagggtccattttccaattatcaggaacaactctaaacagaggagatagagtatgtcctgataaaacctggcggcagcgcaaaagatg

SEQ ID NO: 89980 - DNA, 103 bp, Artificial Sequence
  Synthetic Polynucleotide
taatacgactcactatagggttcacttatatccattttccaattatcaggaacagaggagacctgatatgtggaaaatgaacctggcggcagcgcaaaagatg

SEQ ID NO: 89981 - DNA, 103 bp, Artificial Sequence
  Synthetic Polynucleotide
taatacgactcactatagggttttcacagtcttaatctttgcctcacagaaacagaggagatctgtgatgcaaagattaaacctggcggcagcgcaaaagatg

SEQ ID NO: 89982 - DNA, 103 bp, Artificial Sequence
  Synthetic Polynucleotide
taatacgactcactatagggactcaaggatttcacttatatccattttccaacagaggagaggaaaaatgatataagtgaacctggcggcagcgcaaaagatg

SEQ ID NO: 89983 - DNA, 103 bp, Artificial Sequence
  Synthetic Polynucleotide
taatacgactcactatagggctactggatgactcaaggatttcacttataaacagaggagatataagatgaatccttgaaacctggcggcagcgcaaaagatg

SEQ ID NO: 89984 - DNA, 103 bp, Artificial Sequence
  Synthetic Polynucleotide
taatacgactcactatagggttcatcatcactactggatgactcaaggataacagaggagaatccttatgtcatccagtaacctggcggcagcgcaaaagatg

SEQ ID NO: 89985 - DNA, 103 bp, Artificial Sequence
  Synthetic Polynucleotide
taatacgactcactatagggctgggccatcttcatcatcactactggatgaacagaggagacatccaatggtgatgatgaacctggcggcagcgcaaaagatg

SEQ ID NO: 89986 - DNA, 103 bp, Artificial Sequence
  Synthetic Polynucleotide
taatacgactcactatagggttttcttcagctgggccatcttcatcatcaaacagaggagatgatgaatgagatggcccaacctggcggcagcgcaaaagatg

SEQ ID NO: 89987 - DNA, 103 bp, Artificial Sequence
  Synthetic Polynucleotide
taatacgactcactatagggctcttcatcattttcttcagctgggccatcaacagaggagagatggcatggctgaagaaaacctggcggcagcgcaaaagatg

SEQ ID NO: 89988 - DNA, 103 bp, Artificial Sequence
  Synthetic Polynucleotide
taatacgactcactatagggccttttccttctcttcatcattttcttcagaacagaggagactgaagatgatgatgaagaacctggcggcagcgcaaaagatg

SEQ ID NO: 89989 - DNA, 103 bp, Artificial Sequence
  Synthetic Polynucleotide
taatacgactcactatagggtttttggcctccttttccttctcttcatcaaacagaggagatgatgaatggaaggaaaaaacctggcggcagcgcaaaagatg

SEQ ID NO: 89990 - DNA, 103 bp, Artificial Sequence
  Synthetic Polynucleotide
taatacgactcactatagggttcttctgtctttttggcctccttttccttaacagaggagaaaggaaatggaggccaaaaacctggcggcagcgcaaaagatg

SEQ ID NO: 89991 - DNA, 103 bp, Artificial Sequence
  Synthetic Polynucleotide
taatacgactcactatagggcaggcacctcttcttctgtctttttggcctaacagaggagaaggccaatgagacagaagaacctggcggcagcgcaaaagatg

SEQ ID NO: 89992 - DNA, 103 bp, Artificial Sequence
  Synthetic Polynucleotide
taatacgactcactatagggttcaccagccttttcacagtcttaatctttaacagaggagaaaagatatggactgtgaaaacctggcggcagcgcaaaagatg

SEQ ID NO: 89993 - DNA, 103 bp, Artificial Sequence
  Synthetic Polynucleotide
taatacgactcactatagggagttcttcctcaggcacctcttcttctgtcaacagaggagagacagaatgagaggtgccaacctggcggcagcgcaaaagatg

SEQ ID NO: 89994 - DNA, 103 bp, Artificial Sequence
  Synthetic Polynucleotide
taatacgactcactatagggttcaggatcaagttcttcctcaggcacctcaacagaggagagaggtgatggaggaagaaaacctggcggcagcgcaaaagatg

SEQ ID NO: 89995 - DNA, 103 bp, Artificial Sequence
  Synthetic Polynucleotide
taatacgactcactatagggtgtccctctcttcaggatcaagttcttcctaacagaggagaaggaagatgttgatcctgaacctggcggcagcgcaaaagatg

SEQ ID NO: 89996 - DNA, 103 bp, Artificial Sequence
  Synthetic Polynucleotide
taatacgactcactatagggtggaggaagttgtccctctcttcaggatcaaacagaggagatgatccatgagagagggaaacctggcggcagcgcaaaagatg

SEQ ID NO: 89997 - DNA, 103 bp, Artificial Sequence
  Synthetic Polynucleotide
taatacgactcactatagggataaagctgctggaggaagttgtccctctcaacagaggagagagaggatgaacttcctcaacctggcggcagcgcaaaagatg

SEQ ID NO: 89998 - DNA, 103 bp, Artificial Sequence
  Synthetic Polynucleotide
taatacgactcactatagggccataaacttataaagctgctggaggaagtaacagaggagaacttccatgagcagctttaacctggcggcagcgcaaaagatg

SEQ ID NO: 89999 - DNA, 103 bp, Artificial Sequence
  Synthetic Polynucleotide
taatacgactcactatagggcctctgtcttccataaacttataaagctgcaacagaggagagcagctatgtaagtttataacctggcggcagcgcaaaagatg

SEQ ID NO: 90000 - DNA, 103 bp, Artificial Sequence
  Synthetic Polynucleotide
taatacgactcactataggggattggagtacctctgtcttccataaacttaacagaggagaaagtttatggaagacagaaacctggcggcagcgcaaaagatg

SEQ ID NO: 90001 - DNA, 103 bp, Artificial Sequence
  Synthetic Polynucleotide
taatacgactcactataggggtggtttgttgattggagtacctctgtcttaacagaggagaaagacaatggtactccaaaacctggcggcagcgcaaaagatg

SEQ ID NO: 90002 - DNA, 103 bp, Artificial Sequence
  Synthetic Polynucleotide
taatacgactcactatagggcccaaaacaggtggtttgttgattggagtaaacagaggagatactccatgcaacaaaccaacctggcggcagcgcaaaagatg

SEQ ID NO: 90003 - DNA, 103 bp, Artificial Sequence
  Synthetic Polynucleotide
taatacgactcactatagggcaaatagggaggctcatcaagggccttcataacagaggagaatgaagatgcttgatgagaacctggcggcagcgcaaaagatg

SEQ ID NO: 90004 - DNA, 103 bp, Artificial Sequence
  Synthetic Polynucleotide
taatacgactcactatagggcaccttgactttgacaagtctttttgctgtaacagaggagaacagcaatgagacttgtcaacctggcggcagcgcaaaagatg

SEQ ID NO: 90005 - DNA, 103 bp, Artificial Sequence
  Synthetic Polynucleotide
taatacgactcactataggggagattcaaatttcgatatccaagtacaggaacagaggagacctgtaatgggatatcgaaacctggcggcagcgcaaaagatg

SEQ ID NO: 90006 - DNA, 103 bp, Artificial Sequence
  Synthetic Polynucleotide
taatacgactcactatagggataacttaaagagattcaaatttcgatatcaacagaggagagatatcatgatttgaatcaacctggcggcagcgcaaaagatg

SEQ ID NO: 90007 - DNA, 103 bp, Artificial Sequence
  Synthetic Polynucleotide
taatacgactcactatagggacaagtctgaataacttaaagagattcaaaaacagaggagatttgaaatgctttaagttaacctggcggcagcgcaaaagatg

SEQ ID NO: 90008 - DNA, 103 bp, Artificial Sequence
  Synthetic Polynucleotide
taatacgactcactatagggaagtttgtgtacaagtctgaataacttaaaaacagaggagatttaagatgttcagacttaacctggcggcagcgcaaaagatg

SEQ ID NO: 90009 - DNA, 103 bp, Artificial Sequence
  Synthetic Polynucleotide
taatacgactcactatagggcaaatcctccaagtttgtgtacaagtctgaaacagaggagatcagacatgtacacaaacaacctggcggcagcgcaaaagatg

SEQ ID NO: 90010 - DNA, 103 bp, Artificial Sequence
  Synthetic Polynucleotide
taatacgactcactatagggtcaatattatcaaatcctccaagtttgtgtaacagaggagaacacaaatgtggaggattaacctggcggcagcgcaaaagatg

SEQ ID NO: 90011 - DNA, 103 bp, Artificial Sequence
  Synthetic Polynucleotide
taatacgactcactatagggagctccactttcaatattatcaaatcctccaacagaggagaggaggaatggataatattaacctggcggcagcgcaaaagatg

SEQ ID NO: 90012 - DNA, 103 bp, Artificial Sequence
  Synthetic Polynucleotide
taatacgactcactataggggtttccaaacagctccactttcaatattataacagaggagaataataatgaaagtggagaacctggcggcagcgcaaaagatg

SEQ ID NO: 90013 - DNA, 103 bp, Artificial Sequence
  Synthetic Polynucleotide
taatacgactcactatagggtggtagacttgtttccaaacagctccacttaacagaggagaaagtggatgtgtttggaaaacctggcggcagcgcaaaagatg

SEQ ID NO: 90014 - DNA, 103 bp, Artificial Sequence
  Synthetic Polynucleotide
taatacgactcactatagggtccaagatcttggtagacttgtttccaaacaacagaggagagtttggatgcaagtctacaacctggcggcagcgcaaaagatg

SEQ ID NO: 90015 - DNA, 103 bp, Artificial Sequence
  Synthetic Polynucleotide
taatacgactcactataggggtctaaatgtcaccttgactttgacaagtcaacagaggagagacttgatgaagtcaaggaacctggcggcagcgcaaaagatg

SEQ ID NO: 90016 - DNA, 103 bp, Artificial Sequence
  Synthetic Polynucleotide
taatacgactcactatagggagacagggattccaagatcttggtagacttaacagaggagaaagtctatgaagatcttgaacctggcggcagcgcaaaagatg

SEQ ID NO: 90017 - DNA, 103 bp, Artificial Sequence
  Synthetic Polynucleotide
taatacgactcactataggggctgaatttaagacagggattccaagatctaacagaggagaagatctatgaatccctgtaacctggcggcagcgcaaaagatg

SEQ ID NO: 90018 - DNA, 103 bp, Artificial Sequence
  Synthetic Polynucleotide
taatacgactcactataggggtatcctgcagctgaatttaagacagggataacagaggagaatccctatgttaaattcaaacctggcggcagcgcaaaagatg

SEQ ID NO: 90019 - DNA, 103 bp, Artificial Sequence
  Synthetic Polynucleotide
taatacgactcactatagggatttaacattgtatcctgcagctgaatttaaacagaggagataaattatgctgcaggataacctggcggcagcgcaaaagatg

SEQ ID NO: 90020 - DNA, 103 bp, Artificial Sequence
  Synthetic Polynucleotide
taatacgactcactatagggttataagcacatttaacattgtatcctgcaaacagaggagatgcaggatgcaatgttaaaacctggcggcagcgcaaaagatg

SEQ ID NO: 90021 - DNA, 103 bp, Artificial Sequence
  Synthetic Polynucleotide
taatacgactcactatagggtaagtattttttataagcacatttaacattaacagaggagaaatgttatgtgtgcttataacctggcggcagcgcaaaagatg

SEQ ID NO: 90022 - DNA, 103 bp, Artificial Sequence
  Synthetic Polynucleotide
taatacgactcactatagggcaaaaccatataagtattttttataagcacaacagaggagagtgcttatgaaaaatactaacctggcggcagcgcaaaagatg

SEQ ID NO: 90023 - DNA, 103 bp, Artificial Sequence
  Synthetic Polynucleotide
taatacgactcactatagggcagtactcctcaaaaccatataagtattttaacagaggagaaaaataatgatatggtttaacctggcggcagcgcaaaagatg

SEQ ID NO: 90024 - DNA, 103 bp, Artificial Sequence
  Synthetic Polynucleotide
taatacgactcactatagggggctgatctacagtactcctcaaaaccataaacagaggagatatggtatggaggagtacaacctggcggcagcgcaaaagatg

SEQ ID NO: 90025 - DNA, 103 bp, Artificial Sequence
  Synthetic Polynucleotide
taatacgactcactatagggattcaatgttggctgatctacagtactcctaacagaggagaaggagtatggtagatcagaacctggcggcagcgcaaaagatg

SEQ ID NO: 90026 - DNA, 103 bp, Artificial Sequence
  Synthetic Polynucleotide
taatacgactcactataggggaagaatcatgtctaaatgtcaccttgactaacagaggagaagtcaaatggacatttagaacctggcggcagcgcaaaagatg

SEQ ID NO: 90027 - DNA, 103 bp, Artificial Sequence
  Synthetic Polynucleotide
taatacgactcactataggggccatctgaaattcaatgttggctgatctaaacagaggagatagatcatgcaacattgaaacctggcggcagcgcaaaagatg

SEQ ID NO: 90028 - DNA, 103 bp, Artificial Sequence
  Synthetic Polynucleotide
taatacgactcactatagggctctggcaatgccatctgaaattcaatgttaacagaggagaaacattatgtttcagatgaacctggcggcagcgcaaaagatg

SEQ ID NO: 90029 - DNA, 103 bp, Artificial Sequence
  Synthetic Polynucleotide
taatacgactcactatagggtaacaactttctctggcaatgccatctgaaaacagaggagattcagaatgcattgccagaacctggcggcagcgcaaaagatg

SEQ ID NO: 90030 - DNA, 103 bp, Artificial Sequence
  Synthetic Polynucleotide
taatacgactcactatagggcattgcttgttaacaactttctctggcaataacagaggagaattgccatggaaagttgtaacctggcggcagcgcaaaagatg

SEQ ID NO: 90031 - DNA, 103 bp, Artificial Sequence
  Synthetic Polynucleotide
taatacgactcactatagggacactccttacattgcttgttaacaactttaacagaggagaaaagttatgaacaagcaaaacctggcggcagcgcaaaagatg

SEQ ID NO: 90032 - DNA, 103 bp, Artificial Sequence
  Synthetic Polynucleotide
taatacgactcactatagggttacattttcacactccttacattgcttgtaacagaggagaacaagcatggtaaggagtaacctggcggcagcgcaaaagatg

SEQ ID NO: 90033 - DNA, 103 bp, Artificial Sequence
  Synthetic Polynucleotide
taatacgactcactatagggtttatttcttttacattttcacactccttaaacagaggagataaggaatgtgaaaatgtaacctggcggcagcgcaaaagatg

SEQ ID NO: 90034 - DNA, 103 bp, Artificial Sequence
  Synthetic Polynucleotide
taatacgactcactatagggctccttaacttttatttcttttacattttcaacagaggagagaaaatatgaaagaaataaacctggcggcagcgcaaaagatg

SEQ ID NO: 90035 - DNA, 103 bp, Artificial Sequence
  Synthetic Polynucleotide
taatacgactcactatagggtttcattttcctccttaacttttatttcttaacagaggagaaagaaaatgaagttaaggaacctggcggcagcgcaaaagatg

SEQ ID NO: 90036 - DNA, 103 bp, Artificial Sequence
  Synthetic Polynucleotide
taatacgactcactatagggttgatctctgtttcattttcctccttaactaacagaggagaagttaaatgggaaaatgaaacctggcggcagcgcaaaagatg

SEQ ID NO: 90037 - DNA, 103 bp, Artificial Sequence
  Synthetic Polynucleotide
taatacgactcactatagggttccactgttgaagaatcatgtctaaatgtaacagaggagaacatttatgcatgattctaacctggcggcagcgcaaaagatg

SEQ ID NO: 90038 - DNA, 103 bp, Artificial Sequence
  Synthetic Polynucleotide
taatacgactcactatagggctttatttctttgatctctgtttcattttcaacagaggagagaaaatatgacagagatcaacctggcggcagcgcaaaagatg

SEQ ID NO: 90039 - DNA, 103 bp, Artificial Sequence
  Synthetic Polynucleotide
taatacgactcactatagggcctcctccatctttatttctttgatctctgaacagaggagacagagaatgaagaaataaaacctggcggcagcgcaaaagatg

SEQ ID NO: 90040 - DNA, 103 bp, Artificial Sequence
  Synthetic Polynucleotide
taatacgactcactatagggatattcctctcctcctccatctttatttctaacagaggagaagaaatatggatggaggaaacctggcggcagcgcaaaagatg

SEQ ID NO: 90041 - DNA, 103 bp, Artificial Sequence
  Synthetic Polynucleotide
taatacgactcactatagggtcttggtattatattcctctcctcctccataacagaggagaatggagatggagaggaataacctggcggcagcgcaaaagatg

SEQ ID NO: 90042 - DNA, 103 bp, Artificial Sequence
  Synthetic Polynucleotide
taatacgactcactataggggcttttcttctcttggtattatattcctctaacagaggagaagaggaatgtaataccaaaacctggcggcagcgcaaaagatg

SEQ ID NO: 90043 - DNA, 103 bp, Artificial Sequence
  Synthetic Polynucleotide
taatacgactcactatagggtcctcaataggcttttcttctcttggtattaacagaggagaaataccatgagaagaaaaaacctggcggcagcgcaaaagatg

SEQ ID NO: 90044 - DNA, 103 bp, Artificial Sequence
  Synthetic Polynucleotide
taatacgactcactatagggttcaatttcatcctcaataggcttttcttcaacagaggagagaagaaatgcctattgagaacctggcggcagcgcaaaagatg

SEQ ID NO: 90045 - DNA, 103 bp, Artificial Sequence
  Synthetic Polynucleotide
taatacgactcactatagggtttcttttctttcaatttcatcctcaatagaacagaggagactattgatgatgaaattgaacctggcggcagcgcaaaagatg

SEQ ID NO: 90046 - DNA, 103 bp, Artificial Sequence
  Synthetic Polynucleotide
taatacgactcactatagggggcttaatattttcttttctttcaatttcaaacagaggagatgaaatatgaagaaaagaaacctggcggcagcgcaaaagatg

SEQ ID NO: 90047 - DNA, 103 bp, Artificial Sequence
  Synthetic Polynucleotide
taatacgactcactatagggtcccagagagggcttaatattttcttttctaacagaggagaagaaaaatgaatattaagaacctggcggcagcgcaaaagatg

SEQ ID NO: 90048 - DNA, 103 bp, Artificial Sequence
  Synthetic Polynucleotide
taatacgactcactatagggcatcctgaacttccactgttgaagaatcataacagaggagaatgattatgcaacagtggaacctggcggcagcgcaaaagatg

SEQ ID NO: 90049 - DNA, 103 bp, Artificial Sequence
  Synthetic Polynucleotide
taatacgactcactatagggtctttttacttcccagagagggcttaatataacagaggagaatattaatgcctctctggaacctggcggcagcgcaaaagatg

SEQ ID NO: 90050 - DNA, 103 bp, Artificial Sequence
  Synthetic Polynucleotide
taatacgactcactatagggtctaataaattctttttacttcccagagagaacagaggagactctctatgaagtaaaaaaacctggcggcagcgcaaaagatg

SEQ ID NO: 90051 - DNA, 103 bp, Artificial Sequence
  Synthetic Polynucleotide
taatacgactcactatagggaggtatagattctaataaattctttttactaacagaggagaagtaaaatgaatttattaaacctggcggcagcgcaaaagatg

SEQ ID NO: 90052 - DNA, 103 bp, Artificial Sequence
  Synthetic Polynucleotide
taatacgactcactatagggcagaatgtgtaggtatagattctaataaataacagaggagaatttatatgaatctatacaacctggcggcagcgcaaaagatg

SEQ ID NO: 90053 - DNA, 103 bp, Artificial Sequence
  Synthetic Polynucleotide
taatacgactcactatagggttttcctgatcagaatgtgtaggtatagataacagaggagaatctatatgtacacattcaacctggcggcagcgcaaaagatg

SEQ ID NO: 90054 - DNA, 103 bp, Artificial Sequence
  Synthetic Polynucleotide
taatacgactcactataggggttaacttctttttcctgatcagaatgtgtaacagaggagaacacatatggatcaggaaaacctggcggcagcgcaaaagatg

SEQ ID NO: 90055 - DNA, 103 bp, Artificial Sequence
  Synthetic Polynucleotide
taatacgactcactataggggttttttaatgttaacttctttttcctgataacagaggagaatcaggatgaagaagttaaacctggcggcagcgcaaaagatg

SEQ ID NO: 90056 - DNA, 103 bp, Artificial Sequence
  Synthetic Polynucleotide
taatacgactcactatagggttgtcttctggttttttaatgttaacttctaacagaggagaagaagtatgcattaaaaaaacctggcggcagcgcaaaagatg

SEQ ID NO: 90057 - DNA, 103 bp, Artificial Sequence
  Synthetic Polynucleotide
taatacgactcactatagggcagattttcattgtcttctggttttttaataacagaggagaattaaaatgccagaagacaacctggcggcagcgcaaaagatg

SEQ ID NO: 90058 - DNA, 103 bp, Artificial Sequence
  Synthetic Polynucleotide
taatacgactcactatagggctttgtcatccagattttcattgtcttctgaacagaggagacagaagatgatgaaaatcaacctggcggcagcgcaaaagatg

SEQ ID NO: 90059 - DNA, 103 bp, Artificial Sequence
  Synthetic Polynucleotide
taatacgactcactatagggtttatgtggtcatcctgaacttccactgttaacagaggagaaacagtatgagttcaggaaacctggcggcagcgcaaaagatg

SEQ ID NO: 90060 - DNA, 103 bp, Artificial Sequence
  Synthetic Polynucleotide
taatacgactcactataggggtgtcatcatctttgtcatccagattttcaaacagaggagatgaaaaatgggatgacaaaacctggcggcagcgcaaaagatg

SEQ ID NO: 90061 - DNA, 103 bp, Artificial Sequence
  Synthetic Polynucleotide
taatacgactcactatagggtaccctagttgtgtcatcatctttgtcatcaacagaggagagatgacatggatgatgacaacctggcggcagcgcaaaagatg

SEQ ID NO: 90062 - DNA, 103 bp, Artificial Sequence
  Synthetic Polynucleotide
taatacgactcactataggggggattcatctaccctagttgtgtcatcataacagaggagaatgatgatgcaactagggaacctggcggcagcgcaaaagatg

SEQ ID NO: 90063 - DNA, 103 bp, Artificial Sequence
  Synthetic Polynucleotide
taatacgactcactatagggtttatgttgagggattcatctaccctagttaacagaggagaaactagatgagatgaatcaacctggcggcagcgcaaaagatg

SEQ ID NO: 90064 - DNA, 103 bp, Artificial Sequence
  Synthetic Polynucleotide
taatacgactcactatagggagcttctacctttatgttgagggattcatcaacagaggagagatgaaatgctcaacataaacctggcggcagcgcaaaagatg

SEQ ID NO: 90065 - DNA, 103 bp, Artificial Sequence
  Synthetic Polynucleotide
taatacgactcactatagggtttcttcctcagcttctacctttatgttgaaacagaggagatcaacaatgaggtagaagaacctggcggcagcgcaaaagatg

SEQ ID NO: 90066 - DNA, 103 bp, Artificial Sequence
  Synthetic Polynucleotide
taatacgactcactataggggattttgctttttcttcctcagcttctaccaacagaggagaggtagaatgtgaggaagaaacctggcggcagcgcaaaagatg

SEQ ID NO: 90067 - DNA, 103 bp, Artificial Sequence
  Synthetic Polynucleotide
taatacgactcactatagggttcatctccagattttgctttttcttcctcaacagaggagagaggaaatgaaagcaaaaaacctggcggcagcgcaaaagatg

SEQ ID NO: 90068 - DNA, 103 bp, Artificial Sequence
  Synthetic Polynucleotide
taatacgactcactatagggctttattcgtttcatctccagattttgcttaacagaggagaaagcaaatgctggagatgaacctggcggcagcgcaaaagatg

SEQ ID NO: 90069 - DNA, 103 bp, Artificial Sequence
  Synthetic Polynucleotide
taatacgactcactatagggtcatcttcttctttattcgtttcatctccaaacagaggagatggagaatgaacgaataaaacctggcggcagcgcaaaagatg

SEQ ID NO: 90070 - DNA, 103 bp, Artificial Sequence
  Synthetic Polynucleotide
taatacgactcactatagggtagtgggccctttatgtggtcatcctgaacaacagaggagagttcagatggaccacataaacctggcggcagcgcaaaagatg

SEQ ID NO: 90071 - DNA, 103 bp, Artificial Sequence
  Synthetic Polynucleotide
taatacgactcactatagggttcatcatcttcatcttcttctttattcgtaacagaggagaacgaatatggaagaagataacctggcggcagcgcaaaagatg

SEQ ID NO: 90072 - DNA, 103 bp, Artificial Sequence
  Synthetic Polynucleotide
taatacgactcactatagggcttctgcttcttcatcatcttcatcttcttaacagaggagaaagaagatgaagatgatgaacctggcggcagcgcaaaagatg

SEQ ID NO: 90073 - DNA, 103 bp, Artificial Sequence
  Synthetic Polynucleotide
taatacgactcactatagggtcctcctcctcttctgcttcttcatcatctaacagaggagaagatgaatgagaagcagaaacctggcggcagcgcaaaagatg

SEQ ID NO: 90074 - DNA, 103 bp, Artificial Sequence
  Synthetic Polynucleotide
taatacgactcactatagggttcttcctcctcctcctcctcttctgcttcaacagaggagagaagcaatggaggaggagaacctggcggcagcgcaaaagatg

SEQ ID NO: 90075 - DNA, 103 bp, Artificial Sequence
  Synthetic Polynucleotide
taatacgactcactatagggcctcttcttcttcttcctcctcctcctcctaacagaggagaaggaggatgaggaggaagaacctggcggcagcgcaaaagatg

SEQ ID NO: 90076 - DNA, 103 bp, Artificial Sequence
  Synthetic Polynucleotide
taatacgactcactatagggtcatcttcatcctcttcttcttcttcctccaacagaggagaggaggaatgagaagaagaaacctggcggcagcgcaaaagatg

SEQ ID NO: 90077 - DNA, 103 bp, Artificial Sequence
  Synthetic Polynucleotide
taatacgactcactataggggttgtcatcatcatcttcatcctcttcttcaacagaggagagaagaaatggatgaagataacctggcggcagcgcaaaagatg

SEQ ID NO: 90078 - DNA, 103 bp, Artificial Sequence
  Synthetic Polynucleotide
taatacgactcactatagggcttcctcattgttgtcatcatcatcttcataacagaggagaatgaagatgatgatgacaaacctggcggcagcgcaaaagatg

SEQ ID NO: 90079 - DNA, 103 bp, Artificial Sequence
  Synthetic Polynucleotide
taatacgactcactatagggtcaaactcctcttcctcattgttgtcatcaaacagaggagatgatgaatgcaatgaggaaacctggcggcagcgcaaaagatg

SEQ ID NO: 90080 - DNA, 103 bp, Artificial Sequence
  Synthetic Polynucleotide
taatacgactcactatagggtggatagcactcaaactcctcttcctcattaacagaggagaaatgagatggaggagtttaacctggcggcagcgcaaaagatg

SEQ ID NO: 90081 - DNA, 103 bp, Artificial Sequence
  Synthetic Polynucleotide
taatacgactcactatagggctcctacctttagtgggccctttatgtggtaacagaggagaaccacaatgagggcccacaacctggcggcagcgcaaaagatg

SEQ ID NO: 90082 - DNA, 103 bp, Artificial Sequence
  Synthetic Polynucleotide
taatacgactcactatagggtcatgcctggtggatagcactcaaactcctaacagaggagaaggagtatgagtgctatcaacctggcggcagcgcaaaagatg

SEQ ID NO: 90083 - DNA, 103 bp, Artificial Sequence
  Synthetic Polynucleotide
taatacgactcactatagggacttggactttcatgcctggtggatagcacaacagaggagagtgctaatgaccaggcataacctggcggcagcgcaaaagatg

SEQ ID NO: 90084 - DNA, 103 bp, Artificial Sequence
  Synthetic Polynucleotide
taatacgactcactatagggtccataccgcacttggactttcatgcctggaacagaggagaccaggcatgaaagtccaaaacctggcggcagcgcaaaagatg

SEQ ID NO: 90085 - DNA, 103 bp, Artificial Sequence
  Synthetic Polynucleotide
taatacgactcactatagggttttccctcgtccataccgcacttggacttaacagaggagaaagtccatgtgcggtatgaacctggcggcagcgcaaaagatg

SEQ ID NO: 90086 - DNA, 103 bp, Artificial Sequence
  Synthetic Polynucleotide
taatacgactcactatagggattttttgatttttccctcgtccataccgcaacagaggagagcggtaatgacgagggaaaacctggcggcagcgcaaaagatg

SEQ ID NO: 90087 - DNA, 103 bp, Artificial Sequence
  Synthetic Polynucleotide
taatacgactcactatagggagcttcatacattttttgatttttccctcgaacagaggagacgagggatgaatcaaaaaaacctggcggcagcgcaaaagatg

SEQ ID NO: 90088 - DNA, 103 bp, Artificial Sequence
  Synthetic Polynucleotide
taatacgactcactatagggctttaatactagcttcatacattttttgataacagaggagaatcaaaatgtgtatgaagaacctggcggcagcgcaaaagatg

SEQ ID NO: 90089 - DNA, 103 bp, Artificial Sequence
  Synthetic Polynucleotide
taatacgactcactatagggacatcagaatctttaatactagcttcatacaacagaggagagtatgaatgtagtattaaaacctggcggcagcgcaaaagatg

SEQ ID NO: 90090 - DNA, 103 bp, Artificial Sequence
  Synthetic Polynucleotide
taatacgactcactatagggtccaccttcgacatcagaatctttaatactaacagaggagaagtattatggattctgataacctggcggcagcgcaaaagatg

SEQ ID NO: 90091 - DNA, 103 bp, Artificial Sequence
  Synthetic Polynucleotide
taatacgactcactatagggaaaggacctctccaccttcgacatcagaataacagaggagaattctgatgtcgaaggtgaacctggcggcagcgcaaaagatg

SEQ ID NO: 90092 - DNA, 103 bp, Artificial Sequence
  Synthetic Polynucleotide
taatacgactcactatagggtccacaatagctcctacctttagtgggcccaacagaggagagggcccatgaaaggtaggaacctggcggcagcgcaaaagatg

SEQ ID NO: 90093 - DNA, 103 bp, Artificial Sequence
  Synthetic Polynucleotide
taatacgactcactatagggtgcaccaagtaaaggacctctccaccttcgaacagaggagacgaaggatgagaggtcctaacctggcggcagcgcaaaagatg

SEQ ID NO: 90094 - DNA, 103 bp, Artificial Sequence
  Synthetic Polynucleotide
taatacgactcactatagggtccgcagtaatgcaccaagtaaaggacctcaacagaggagagaggtcatgtacttggtgaacctggcggcagcgcaaaagatg

SEQ ID NO: 90095 - DNA, 103 bp, Artificial Sequence
  Synthetic Polynucleotide
taatacgactcactatagggtcacattccatccgcagtaatgcaccaagtaacagaggagaacttggatgattactgcgaacctggcggcagcgcaaaagatg

SEQ ID NO: 90096 - DNA, 103 bp, Artificial Sequence
  Synthetic Polynucleotide
taatacgactcactatagggtcatcgtatctcacattccatccgcagtaaaacagaggagattactgatgatggaatgtaacctggcggcagcgcaaaagatg

SEQ ID NO: 90097 - DNA, 103 bp, Artificial Sequence
  Synthetic Polynucleotide
taatacgactcactatagggtttaatccattcatcgtatctcacattccaaacagaggagatggaatatgagatacgataacctggcggcagcgcaaaagatg

SEQ ID NO: 90098 - DNA, 103 bp, Artificial Sequence
  Synthetic Polynucleotide
taatacgactcactatagggttttatctgctttaatccattcatcgtatcaacagaggagagatacgatgaatggattaaacctggcggcagcgcaaaagatg

SEQ ID NO: 90099 - DNA, 103 bp, Artificial Sequence
  Synthetic Polynucleotide
taatacgactcactatagggggtcttactattttatctgctttaatccataacagaggagaatggatatgagcagataaaacctggcggcagcgcaaaagatg

SEQ ID NO: 90100 - DNA, 103 bp, Artificial Sequence
  Synthetic Polynucleotide
taatacgactcactatagggtttatcagcaggtcttactattttatctgcaacagaggagagcagatatgatagtaagaaacctggcggcagcgcaaaagatg

SEQ ID NO: 90101 - DNA, 103 bp, Artificial Sequence
  Synthetic Polynucleotide
taatacgactcactatagggttggcacatttttatcagcaggtcttactaaacagaggagatagtaaatgctgctgataaacctggcggcagcgcaaaagatg

SEQ ID NO: 90102 - DNA, 103 bp, Artificial Sequence
  Synthetic Polynucleotide
taatacgactcactatagggtgttttatctttggcacatttttatcagcaaacagaggagatgctgaatgaaatgtgccaacctggcggcagcgcaaaagatg

SEQ ID NO: 90103 - DNA, 103 bp, Artificial Sequence
  Synthetic Polynucleotide
taatacgactcactatagggattcttcacttccacaatagctcctaccttaacagaggagaaaggtaatggctattgtgaacctggcggcagcgcaaaagatg

SEQ ID NO: 90104 - DNA, 103 bp, Artificial Sequence
  Synthetic Polynucleotide
taatacgactcactatagggtttcttccgatgttttatctttggcacattaacagaggagaaatgtgatgaagataaaaaacctggcggcagcgcaaaagatg

SEQ ID NO: 90105 - DNA, 103 bp, Artificial Sequence
  Synthetic Polynucleotide
taatacgactcactatagggtattctttattttcttccgatgttttatctaacagaggagaagataaatgatcggaagaaacctggcggcagcgcaaaagatg

SEQ ID NO: 90106 - DNA, 103 bp, Artificial Sequence
  Synthetic Polynucleotide
taatacgactcactatagggttgtctaatttattctttattttcttccgaaacagaggagatcggaaatgaataaagaaaacctggcggcagcgcaaaagatg

SEQ ID NO: 90107 - DNA, 103 bp, Artificial Sequence
  Synthetic Polynucleotide
taatacgactcactataggggtctttttctttgtctaatttattctttataacagaggagaataaagatgaaattagacaacctggcggcagcgcaaaagatg

SEQ ID NO: 90108 - DNA, 103 bp, Artificial Sequence
  Synthetic Polynucleotide
taatacgactcactatagggtttcatctttgtctttttctttgtctaattaacagaggagaaattagatgaagaaaaagaacctggcggcagcgcaaaagatg

SEQ ID NO: 90109 - DNA, 103 bp, Artificial Sequence
  Synthetic Polynucleotide
taatacgactcactatagggggagagtatttttcatctttgtctttttctaacagaggagaagaaaaatgcaaagatgaaacctggcggcagcgcaaaagatg

SEQ ID NO: 90110 - DNA, 103 bp, Artificial Sequence
  Synthetic Polynucleotide
taatacgactcactatagggacagttttttggagagtatttttcatctttaacagaggagaaaagatatgaaatactctaacctggcggcagcgcaaaagatg

SEQ ID NO: 90111 - DNA, 103 bp, Artificial Sequence
  Synthetic Polynucleotide
taatacgactcactataggggccgaagtttacagttttttggagagtattaacagaggagaaatactatgcaaaaaactaacctggcggcagcgcaaaagatg

SEQ ID NO: 90112 - DNA, 103 bp, Artificial Sequence
  Synthetic Polynucleotide
taatacgactcactatagggttggacaagcgccgaagtttacagttttttaacagaggagaaaaaaaatgtaaacttcgaacctggcggcagcgcaaaagatg

SEQ ID NO: 90113 - DNA, 103 bp, Artificial Sequence
  Synthetic Polynucleotide
taatacgactcactatagggaaatggtggtttggacaagcgccgaagtttaacagaggagaaaacttatgcgcttgtccaacctggcggcagcgcaaaagatg

SEQ ID NO: 90114 - DNA, 103 bp, Artificial Sequence
  Synthetic Polynucleotide
taatacgactcactatagggtgcccactgtcaaatagggaggctcatcaaaacagaggagattgatgatgctccctattaacctggcggcagcgcaaaagatg

SEQ ID NO: 90115 - DNA, 103 bp, Artificial Sequence
  Synthetic Polynucleotide
taatacgactcactatagggcaccatcaagattcttcacttccacaatagaacagaggagactattgatgaagtgaagaaacctggcggcagcgcaaaagatg

SEQ ID NO: 90116 - DNA, 103 bp, Artificial Sequence
  Synthetic Polynucleotide
taatacgactcactataggggatttgtctgaaatggtggtttggacaagcaacagaggagagcttgtatgaaccaccataacctggcggcagcgcaaaagatg

SEQ ID NO: 90117 - DNA, 103 bp, Artificial Sequence
  Synthetic Polynucleotide
taatacgactcactatagggtcaggagatggatttgtctgaaatggtggtaacagaggagaaccaccatgtcagacaaaaacctggcggcagcgcaaaagatg

SEQ ID NO: 90118 - DNA, 103 bp, Artificial Sequence
  Synthetic Polynucleotide
taatacgactcactatagggggataccatttcaggagatggatttgtctgaacagaggagacagacaatgccatctcctaacctggcggcagcgcaaaagatg

SEQ ID NO: 90119 - DNA, 103 bp, Artificial Sequence
  Synthetic Polynucleotide
taatacgactcactataggggatccagtttggataccatttcaggagatgaacagaggagacatctcatgaaatggtataacctggcggcagcgcaaaagatg

SEQ ID NO: 90120 - DNA, 103 bp, Artificial Sequence
  Synthetic Polynucleotide
taatacgactcactataggggcatcagtgagatccagtttggataccattaacagaggagaaatggtatgcaaactggaaacctggcggcagcgcaaaagatg

SEQ ID NO: 90121 - DNA, 103 bp, Artificial Sequence
  Synthetic Polynucleotide
taatacgactcactatagggagagtttttggcatcagtgagatccagtttaacagaggagaaaactgatgctcactgataacctggcggcagcgcaaaagatg

SEQ ID NO: 90122 - DNA, 103 bp, Artificial Sequence
  Synthetic Polynucleotide
taatacgactcactataggggagcagtatcagagtttttggcatcagtgaaacagaggagatcactgatgccaaaaactaacctggcggcagcgcaaaagatg

SEQ ID NO: 90123 - DNA, 103 bp, Artificial Sequence
  Synthetic Polynucleotide
taatacgactcactataggggacttaatatgagcagtatcagagtttttgaacagaggagacaaaaaatgtgatactgcaacctggcggcagcgcaaaagatg

SEQ ID NO: 90124 - DNA, 103 bp, Artificial Sequence
  Synthetic Polynucleotide
taatacgactcactatagggaatttctatggacttaatatgagcagtatcaacagaggagagatactatgcatattaagaacctggcggcagcgcaaaagatg

SEQ ID NO: 90125 - DNA, 103 bp, Artificial Sequence
  Synthetic Polynucleotide
taatacgactcactatagggggatcgaagtaatttctatggacttaatataacagaggagaatattaatgccatagaaaaacctggcggcagcgcaaaagatg

SEQ ID NO: 90126 - DNA, 103 bp, Artificial Sequence
  Synthetic Polynucleotide
taatacgactcactatagggtcctgatatgcaccatcaagattcttcactaacagaggagaagtgaaatgtcttgatggaacctggcggcagcgcaaaagatg

SEQ ID NO: 90127 - DNA, 103 bp, Artificial Sequence
  Synthetic Polynucleotide
taatacgactcactatagggagtccattaaggatcgaagtaatttctatgaacagaggagacatagaatgtacttcgataacctggcggcagcgcaaaagatg

SEQ ID NO: 90128 - DNA, 103 bp, Artificial Sequence
  Synthetic Polynucleotide
taatacgactcactatagggagaagcttgaagtccattaaggatcgaagtaacagaggagaacttcgatgcttaatggaaacctggcggcagcgcaaaagatg

SEQ ID NO: 90129 - DNA, 103 bp, Artificial Sequence
  Synthetic Polynucleotide
taatacgactcactatagggcagaactttcagaagcttgaagtccattaaaacagaggagattaatgatgttcaagcttaacctggcggcagcgcaaaagatg

SEQ ID NO: 90130 - DNA, 103 bp, Artificial Sequence
  Synthetic Polynucleotide
taatacgactcactatagggctgtcttcagcagaactttcagaagcttgaaacagaggagatcaagcatgtgaaagttcaacctggcggcagcgcaaaagatg

SEQ ID NO: 90131 - DNA, 103 bp, Artificial Sequence
  Synthetic Polynucleotide
taatacgactcactatagggttcctgctcactgtcttcagcagaactttcaacagaggagagaaagtatggctgaagacaacctggcggcagcgcaaaagatg

SEQ ID NO: 90132 - DNA, 103 bp, Artificial Sequence
  Synthetic Polynucleotide
taatacgactcactatagggctctctcatcttcctgctcactgtcttcagaacagaggagactgaagatggtgagcaggaacctggcggcagcgcaaaagatg

SEQ ID NO: 90133 - DNA, 103 bp, Artificial Sequence
  Synthetic Polynucleotide
taatacgactcactatagggtcttgagcacctctctcatcttcctgctcaaacagaggagatgagcaatgagatgagagaacctggcggcagcgcaaaagatg

SEQ ID NO: 90134 - DNA, 103 bp, Artificial Sequence
  Synthetic Polynucleotide
taatacgactcactatagggattatccatgtcttgagcacctctctcatcaacagaggagagatgagatgggtgctcaaaacctggcggcagcgcaaaagatg

SEQ ID NO: 90135 - DNA, 103 bp, Artificial Sequence
  Synthetic Polynucleotide
taatacgactcactatagggctttgccattattatccatgtcttgagcacaacagaggagagtgctcatgacatggataaacctggcggcagcgcaaaagatg

SEQ ID NO: 90136 - DNA, 103 bp, Artificial Sequence
  Synthetic Polynucleotide
taatacgactcactatagggttagattcctctttgccattattatccatgaacagaggagacatggaatgtaatggcaaaacctggcggcagcgcaaaagatg

SEQ ID NO: 90137 - DNA, 103 bp, Artificial Sequence
  Synthetic Polynucleotide
taatacgactcactataggggataacagcttcctgatatgcaccatcaagaacagaggagacttgatatggcatatcagaacctggcggcagcgcaaaagatg

SEQ ID NO: 90138 - DNA, 103 bp, Artificial Sequence
  Synthetic Polynucleotide
taatacgactcactatagggatgatcaatcttagattcctctttgccattaacagaggagaaatggcatggaggaatctaacctggcggcagcgcaaaagatg

SEQ ID NO: 90139 - DNA, 103 bp, Artificial Sequence
  Synthetic Polynucleotide
taatacgactcactatagggtgttggtcaaatgatcaatcttagattcctaacagaggagaaggaatatgagattgatcaacctggcggcagcgcaaaagatg

SEQ ID NO: 90140 - DNA, 103 bp, Artificial Sequence
  Synthetic Polynucleotide
taatacgactcactatagggtcatttctgttgttggtcaaatgatcaatcaacagaggagagattgaatgtttgaccaaaacctggcggcagcgcaaaagatg

SEQ ID NO: 90141 - DNA, 103 bp, Artificial Sequence
  Synthetic Polynucleotide
taatacgactcactatagggtgaaataagatcatttctgttgttggtcaaaacagaggagattgaccatgaacagaaataacctggcggcagcgcaaaagatg

SEQ ID NO: 90142 - DNA, 103 bp, Artificial Sequence
  Synthetic Polynucleotide
taatacgactcactataggggttcctcctttgaaataagatcatttctgtaacagaggagaacagaaatgatcttatttaacctggcggcagcgcaaaagatg

SEQ ID NO: 90143 - DNA, 103 bp, Artificial Sequence
  Synthetic Polynucleotide
taatacgactcactataggggaactgttctgttcctcctttgaaataagaaacagaggagatcttatatgaaaggaggaaacctggcggcagcgcaaaagatg

SEQ ID NO: 90144 - DNA, 103 bp, Artificial Sequence
  Synthetic Polynucleotide
taatacgactcactatagggtagcaaagatgaactgttctgttcctccttaacagaggagaaaggagatgcagaacagtaacctggcggcagcgcaaaagatg

SEQ ID NO: 90145 - DNA, 103 bp, Artificial Sequence
  Synthetic Polynucleotide
taatacgactcactatagggtgttttcttctagcaaagatgaactgttctaacagaggagaagaacaatgcatctttgcaacctggcggcagcgcaaaagatg

SEQ ID NO: 90146 - DNA, 103 bp, Artificial Sequence
  Synthetic Polynucleotide
taatacgactcactataggggcatgaactttgttttcttctagcaaagataacagaggagaatctttatgagaagaaaaaacctggcggcagcgcaaaagatg

SEQ ID NO: 90147 - DNA, 103 bp, Artificial Sequence
  Synthetic Polynucleotide
taatacgactcactatagggtaccaaatctgcatgaactttgttttcttcaacagaggagagaagaaatgaaagttcataacctggcggcagcgcaaaagatg

SEQ ID NO: 90148 - DNA, 103 bp, Artificial Sequence
  Synthetic Polynucleotide
taatacgactcactatagggttagtttattgataacagcttcctgatatgaacagaggagacatatcatgaagctgttaaacctggcggcagcgcaaaagatg

SEQ ID NO: 90149 - DNA, 103 bp, Artificial Sequence
  Synthetic Polynucleotide
taatacgactcactataggggtttggatattaccaaatctgcatgaacttaacagaggagaaagttcatgcagatttggaacctggcggcagcgcaaaagatg

SEQ ID NO: 90150 - DNA, 103 bp, Artificial Sequence
  Synthetic Polynucleotide
taatacgactcactatagggtttgacactggtttggatattaccaaatctaacagaggagaagatttatgaatatccaaaacctggcggcagcgcaaaagatg

SEQ ID NO: 90151 - DNA, 103 bp, Artificial Sequence
  Synthetic Polynucleotide
taatacgactcactatagggttctggagattttgacactggtttggatataacagaggagaatatccatgccagtgtcaaacctggcggcagcgcaaaagatg

SEQ ID NO: 90152 - DNA, 103 bp, Artificial Sequence
  Synthetic Polynucleotide
taatacgactcactatagggtccttaatctttctggagattttgacactgaacagaggagacagtgtatgaatctccagaacctggcggcagcgcaaaagatg

SEQ ID NO: 90153 - DNA, 103 bp, Artificial Sequence
  Synthetic Polynucleotide
taatacgactcactatagggtctatatctttccttaatctttctggagataacagaggagaatctccatgaagattaagaacctggcggcagcgcaaaagatg

SEQ ID NO: 90154 - DNA, 103 bp, Artificial Sequence
  Synthetic Polynucleotide
taatacgactcactatagggggataatacttctatatctttccttaatctaacagaggagaagattaatgaaagatataaacctggcggcagcgcaaaagatg

SEQ ID NO: 90155 - DNA, 103 bp, Artificial Sequence
  Synthetic Polynucleotide
taatacgactcactatagggcagtatcttcggataatacttctatatcttaacagaggagaaagataatgaagtattataacctggcggcagcgcaaaagatg

SEQ ID NO: 90156 - DNA, 103 bp, Artificial Sequence
  Synthetic Polynucleotide
taatacgactcactatagggtcttcataatcagtatcttcggataatactaacagaggagaagtattatgcgaagatacaacctggcggcagcgcaaaagatg

SEQ ID NO: 90157 - DNA, 103 bp, Artificial Sequence
  Synthetic Polynucleotide
taatacgactcactataggggacttcatcttcttcataatcagtatcttcaacagaggagagaagatatggattatgaaaacctggcggcagcgcaaaagatg

SEQ ID NO: 90158 - DNA, 103 bp, Artificial Sequence
  Synthetic Polynucleotide
taatacgactcactatagggtcttttttgtgacttcatcttcttcataataacagaggagaattatgatgaagatgaagaacctggcggcagcgcaaaagatg

SEQ ID NO: 90159 - DNA, 103 bp, Artificial Sequence
  Synthetic Polynucleotide
taatacgactcactatagggctcgcatctgttagtttattgataacagctaacagaggagaagctgtatgcaataaactaacctggcggcagcgcaaaagatg

SEQ ID NO: 90160 - DNA, 103 bp, Artificial Sequence
  Synthetic Polynucleotide
taatacgactcactatagggacatcctttctcttttttgtgacttcatctaacagaggagaagatgaatgcacaaaaaaaacctggcggcagcgcaaaagatg

SEQ ID NO: 90161 - DNA, 103 bp, Artificial Sequence
  Synthetic Polynucleotide
taatacgactcactataggggtccttcttgacatcctttctcttttttgtaacagaggagaacaaaaatgagaaaggataacctggcggcagcgcaaaagatg

SEQ ID NO: 90162 - DNA, 103 bp, Artificial Sequence
  Synthetic Polynucleotide
taatacgactcactatagggtatctgttgtgtccttcttgacatcctttcaacagaggagagaaaggatgtcaagaaggaacctggcggcagcgcaaaagatg

SEQ ID NO: 90163 - DNA, 103 bp, Artificial Sequence
  Synthetic Polynucleotide
taatacgactcactatagggtttgaagatttatctgttgtgtccttcttgaacagaggagacaagaaatgcacaacagaaacctggcggcagcgcaaaagatg

SEQ ID NO: 90164 - DNA, 103 bp, Artificial Sequence
  Synthetic Polynucleotide
taatacgactcactatagggtatttgtggttttgaagatttatctgttgtaacagaggagaacaacaatgaaatcttcaaacctggcggcagcgcaaaagatg

SEQ ID NO: 90165 - DNA, 103 bp, Artificial Sequence
  Synthetic Polynucleotide
taatacgactcactatagggtaccacgttttatttgtggttttgaagattaacagaggagaaatcttatgaaccacaaaaacctggcggcagcgcaaaagatg

SEQ ID NO: 90166 - DNA, 103 bp, Artificial Sequence
  Synthetic Polynucleotide
taatacgactcactatagggtaccttcttttaccacgttttatttgtggtaacagaggagaaccacaatgaaaacgtggaacctggcggcagcgcaaaagatg

SEQ ID NO: 90167 - DNA, 103 bp, Artificial Sequence
  Synthetic Polynucleotide
taatacgactcactatagggtgtattgcaataccttcttttaccacgtttaacagaggagaaaacgtatgaaaagaaggaacctggcggcagcgcaaaagatg

SEQ ID NO: 90168 - DNA, 103 bp, Artificial Sequence
  Synthetic Polynucleotide
taatacgactcactataggggacactcttctgtattgcaataccttctttaacagaggagaaaagaaatgattgcaataaacctggcggcagcgcaaaagatg

SEQ ID NO: 90169 - DNA, 103 bp, Artificial Sequence
  Synthetic Polynucleotide
taatacgactcactatagggccagtttttagacactcttctgtattgcaaaacagaggagattgcaaatgagaagagtgaacctggcggcagcgcaaaagatg

SEQ ID NO: 90170 - DNA, 103 bp, Artificial Sequence
  Synthetic Polynucleotide
taatacgactcactatagggagtgtaccaactcgcatctgttagtttattaacagaggagaaataaaatgacagatgcgaacctggcggcagcgcaaaagatg

SEQ ID NO: 90171 - DNA, 103 bp, Artificial Sequence
  Synthetic Polynucleotide
taatacgactcactataggggccaggtgatccagtttttagacactcttcaacagaggagagaagagatgctaaaaactaacctggcggcagcgcaaaagatg

SEQ ID NO: 90172 - DNA, 103 bp, Artificial Sequence
  Synthetic Polynucleotide
taatacgactcactatagggcttcctttttgccaggtgatccagtttttaaacagaggagataaaaaatggatcacctgaacctggcggcagcgcaaaagatg

SEQ ID NO: 90173 - DNA, 103 bp, Artificial Sequence
  Synthetic Polynucleotide
taatacgactcactatagggttggccttctcttcctttttgccaggtgataacagaggagaatcaccatgcaaaaaggaaacctggcggcagcgcaaaagatg

SEQ ID NO: 90174 - DNA, 103 bp, Artificial Sequence
  Synthetic Polynucleotide
taatacgactcactatagggttctttgttcttggccttctcttcctttttaacagaggagaaaaaagatggagaaggccaacctggcggcagcgcaaaagatg

SEQ ID NO: 90175 - DNA, 103 bp, Artificial Sequence
  Synthetic Polynucleotide
taatacgactcactatagggtgcaaagtgattctttgttcttggccttctaacagaggagaagaaggatgagaacaaagaacctggcggcagcgcaaaagatg

SEQ ID NO: 90176 - DNA, 103 bp, Artificial Sequence
  Synthetic Polynucleotide
taatacgactcactatagggctgttttccatgcaaagtgattctttgttcaacagaggagagaacaaatgatcactttgaacctggcggcagcgcaaaagatg

SEQ ID NO: 90177 - DNA, 103 bp, Artificial Sequence
  Synthetic Polynucleotide
taatacgactcactataggggctgttgctactgttttccatgcaaagtgaaacagaggagatcacttatgatggaaaacaacctggcggcagcgcaaaagatg

SEQ ID NO: 90178 - DNA, 103 bp, Artificial Sequence
  Synthetic Polynucleotide
taatacgactcactatagggcatctgaagagctgttgctactgttttccaaacagaggagatggaaaatggtagcaacaaacctggcggcagcgcaaaagatg

SEQ ID NO: 90179 - DNA, 103 bp, Artificial Sequence
  Synthetic Polynucleotide
taatacgactcactatagggtcttcatcttcatctgaagagctgttgctaaacagaggagatagcaaatgctcttcagaaacctggcggcagcgcaaaagatg

SEQ ID NO: 90180 - DNA, 103 bp, Artificial Sequence
  Synthetic Polynucleotide
taatacgactcactatagggttttgtttcttcttcatcttcatctgaagaaacagaggagatcttcaatggaagatgaaaacctggcggcagcgcaaaagatg

SEQ ID NO: 90181 - DNA, 103 bp, Artificial Sequence
  Synthetic Polynucleotide
taatacgactcactatagggcaaaaactacagtgtaccaactcgcatctgaacagaggagacagatgatggttggtacaaacctggcggcagcgcaaaagatg

SEQ ID NO: 90182 - DNA, 103 bp, Artificial Sequence
  Synthetic Polynucleotide
taatacgactcactatagggtcatctttgcttttgtttcttcttcatcttaacagaggagaaagatgatgaagaaacaaaacctggcggcagcgcaaaagatg

SEQ ID NO: 90183 - DNA, 103 bp, Artificial Sequence
  Synthetic Polynucleotide
taatacgactcactatagggttagttggtgtcatctttgcttttgtttctaacagaggagaagaaacatgagcaaagataacctggcggcagcgcaaaagatg

SEQ ID NO: 90184 - DNA, 103 bp, Artificial Sequence
  Synthetic Polynucleotide
taatacgactcactatagggattgtatttcttagttggtgtcatctttgcaacagaggagagcaaagatgacaccaactaacctggcggcagcgcaaaagatg

SEQ ID NO: 90185 - DNA, 103 bp, Artificial Sequence
  Synthetic Polynucleotide
taatacgactcactatagggcctccaaaccattgtatttcttagttggtgaacagaggagacaccaaatgagaaatacaaacctggcggcagcgcaaaagatg

SEQ ID NO: 90186 - DNA, 103 bp, Artificial Sequence
  Synthetic Polynucleotide
taatacgactcactatagggtttcttttttcctccaaaccattgtatttcaacagaggagagaaataatgtggtttggaaacctggcggcagcgcaaaagatg

SEQ ID NO: 90187 - DNA, 103 bp, Artificial Sequence
  Synthetic Polynucleotide
taatacgactcactatagggccgtagagattttcttttttcctccaaaccaacagaggagaggtttgatggaaaaaagaaacctggcggcagcgcaaaagatg

SEQ ID NO: 90188 - DNA, 103 bp, Artificial Sequence
  Synthetic Polynucleotide
taatacgactcactatagggaaccagttgtccgtagagattttcttttttaacagaggagaaaaaaaatgaatctctacaacctggcggcagcgcaaaagatg

SEQ ID NO: 90189 - DNA, 103 bp, Artificial Sequence
  Synthetic Polynucleotide
taatacgactcactatagggcctgaatagaaaccagttgtccgtagagataacagaggagaatctctatggacaactggaacctggcggcagcgcaaaagatg

SEQ ID NO: 90190 - DNA, 103 bp, Artificial Sequence
  Synthetic Polynucleotide
taatacgactcactatagggttctgaaaatcctgaatagaaaccagttgtaacagaggagaacaactatgttctattcaaacctggcggcagcgcaaaagatg

SEQ ID NO: 90191 - DNA, 103 bp, Artificial Sequence
  Synthetic Polynucleotide
taatacgactcactatagggtttctgccacttctgaaaatcctgaatagaaacagaggagatctattatggattttcagaacctggcggcagcgcaaaagatg

SEQ ID NO: 90192 - DNA, 103 bp, Artificial Sequence
  Synthetic Polynucleotide
taatacgactcactatagggtctccgtcatcaaaaactacagtgtaccaaaacagaggagattggtaatgtgtagttttaacctggcggcagcgcaaaagatg

SEQ ID NO: 90193 - DNA, 103 bp, Artificial Sequence
  Synthetic Polynucleotide
taatacgactcactatagggttaatccttttttctgccacttctgaaaataacagaggagaattttcatgagtggcagaaacctggcggcagcgcaaaagatg

SEQ ID NO: 90194 - DNA, 103 bp, Artificial Sequence
  Synthetic Polynucleotide
taatacgactcactatagggatttaaaagtttaatccttttttctgccacaacagaggagagtggcaatgaaaaggattaacctggcggcagcgcaaaagatg

SEQ ID NO: 90195 - DNA, 103 bp, Artificial Sequence
  Synthetic Polynucleotide
taatacgactcactatagggcatcagagttatttaaaagtttaatcctttaacagaggagaaaaggaatgaacttttaaaacctggcggcagcgcaaaagatg

SEQ ID NO: 90196 - DNA, 103 bp, Artificial Sequence
  Synthetic Polynucleotide
taatacgactcactatagggtgaagtctttcatcagagttatttaaaagtaacagaggagaacttttatgtaactctgaaacctggcggcagcgcaaaagatg

SEQ ID NO: 90197 - DNA, 103 bp, Artificial Sequence
  Synthetic Polynucleotide
taatacgactcactatagggcctgctgttttgaagtctttcatcagagttaacagaggagaaactctatggaaagacttaacctggcggcagcgcaaaagatg

SEQ ID NO: 90198 - DNA, 103 bp, Artificial Sequence
  Synthetic Polynucleotide
taatacgactcactataggggatctttggccctgctgttttgaagtctttaacagaggagaaaagacatgaaaacagcaaacctggcggcagcgcaaaagatg

SEQ ID NO: 90199 - DNA, 103 bp, Artificial Sequence
  Synthetic Polynucleotide
taatacgactcactatagggacatcttttcgatctttggccctgctgtttaacagaggagaaaacagatgggccaaagaaacctggcggcagcgcaaaagatg

SEQ ID NO: 90200 - DNA, 103 bp, Artificial Sequence
  Synthetic Polynucleotide
taatacgactcactatagggacttgaccagacatcttttcgatctttggcaacagaggagagccaaaatgcgaaaagataacctggcggcagcgcaaaagatg

SEQ ID NO: 90201 - DNA, 103 bp, Artificial Sequence
  Synthetic Polynucleotide
taatacgactcactataggggtccctgaatacttgaccagacatcttttcaacagaggagagaaaagatgtctggtcaaaacctggcggcagcgcaaaagatg

SEQ ID NO: 90202 - DNA, 103 bp, Artificial Sequence
  Synthetic Polynucleotide
taatacgactcactatagggttaggccactgtccctgaatacttgaccagaacagaggagactggtcatgtattcagggaacctggcggcagcgcaaaagatg

SEQ ID NO: 90203 - DNA, 103 bp, Artificial Sequence
  Synthetic Polynucleotide
taatacgactcactatagggtgtcttctcatctccgtcatcaaaaactacaacagaggagagtagttatggatgacggaaacctggcggcagcgcaaaagatg

SEQ ID NO: 90204 - DNA, 103 bp, Artificial Sequence
  Synthetic Polynucleotide
taatacgactcactatagggcagcgtttttttaggccactgtccctgaataacagaggagaattcagatgcagtggcctaacctggcggcagcgcaaaagatg

SEQ ID NO: 90205 - DNA, 103 bp, Artificial Sequence
  Synthetic Polynucleotide
taatacgactcactatagggaaagctctttcagcgtttttttaggccactaacagaggagaagtggcatgaaaaaacgcaacctggcggcagcgcaaaagatg

SEQ ID NO: 90206 - DNA, 103 bp, Artificial Sequence
  Synthetic Polynucleotide
taatacgactcactataggggagtctgaaaaaagctctttcagcgtttttaacagaggagaaaaaacatggaaagagctaacctggcggcagcgcaaaagatg

SEQ ID NO: 90207 - DNA, 103 bp, Artificial Sequence
  Synthetic Polynucleotide
taatacgactcactatagggctcagtatcagagtctgaaaaaagctctttaacagaggagaaaagagatgttttcagacaacctggcggcagcgcaaaagatg

SEQ ID NO: 90208 - DNA, 103 bp, Artificial Sequence
  Synthetic Polynucleotide
taatacgactcactatagggaagctgcagcctcagtatcagagtctgaaaaacagaggagatttcagatgctgatactgaacctggcggcagcgcaaaagatg

SEQ ID NO: 90209 - DNA, 103 bp, Artificial Sequence
  Synthetic Polynucleotide
taatacgactcactatagggtgcggtggggaagctgcagcctcagtatcaaacagaggagatgatacatgggctgcagcaacctggcggcagcgcaaaagatg

SEQ ID NO: 90210 - DNA, 103 bp, Artificial Sequence
  Synthetic Polynucleotide
taatacgactcactatagggtggggcaggatgcggtggggaagctgcagcaacagaggagagctgcaatgtccccaccgaacctggcggcagcgcaaaagatg

SEQ ID NO: 90211 - DNA, 103 bp, Artificial Sequence
  Synthetic Polynucleotide
taatacgactcactatagggccccctcctctggggcaggatgcggtggggaacagaggagaccccacatgatcctgcccaacctggcggcagcgcaaaagatg

SEQ ID NO: 90212 - DNA, 103 bp, Artificial Sequence
  Synthetic Polynucleotide
taatacgactcactatagggtcctctgccaccccctcctctggggcaggaaacagaggagatcctgcatgagaggagggaacctggcggcagcgcaaaagatg

SEQ ID NO: 90213 - DNA, 103 bp, Artificial Sequence
  Synthetic Polynucleotide
taatacgactcactatagggctgcagtgactcctctgccaccccctcctcaacagaggagagaggagatggtggcagagaacctggcggcagcgcaaaagatg

SEQ ID NO: 90214 - DNA, 103 bp, Artificial Sequence
  Synthetic Polynucleotide
taatacgactcactatagggatcgtctcagtgtcttctcatctccgtcataacagaggagaatgacgatgatgagaagaaacctggcggcagcgcaaaagatg

SEQ ID NO: 90215 - DNA, 103 bp, Artificial Sequence
  Synthetic Polynucleotide
taatacgactcactatagggcagccacagtctgcagtgactcctctgccaaacagaggagatggcagatgagtcactgcaacctggcggcagcgcaaaagatg

SEQ ID NO: 90216 - DNA, 103 bp, Artificial Sequence
  Synthetic Polynucleotide
taatacgactcactatagggctctcctcttcagccacagtctgcagtgacaacagaggagagtcactatggactgtggcaacctggcggcagcgcaaaagatg

SEQ ID NO: 90217 - DNA, 103 bp, Artificial Sequence
  Synthetic Polynucleotide
taatacgactcactataggggggtgaacaactctcctcttcagccacagtaacagaggagaactgtgatggaagaggagaacctggcggcagcgcaaaagatg

SEQ ID NO: 90218 - DNA, 103 bp, Artificial Sequence
  Synthetic Polynucleotide
taatacgactcactataggggttctacactgggtgaacaactctcctcttaacagaggagaaagaggatggttgttcacaacctggcggcagcgcaaaagatg

SEQ ID NO: 90219 - DNA, 103 bp, Artificial Sequence
  Synthetic Polynucleotide
taatacgactcactatagggggtttttctagttctacactgggtgaacaaaacagaggagattgttcatgcagtgtagaaacctggcggcagcgcaaaagatg

SEQ ID NO: 90220 - DNA, 103 bp, Artificial Sequence
  Synthetic Polynucleotide
taatacgactcactataggggactggaggtggtttttctagttctacactaacagaggagaagtgtaatgctagaaaaaaacctggcggcagcgcaaaagatg

SEQ ID NO: 90221 - DNA, 103 bp, Artificial Sequence
  Synthetic Polynucleotide
taatacgactcactatagggtatcgacattgactggaggtggtttttctaaacagaggagatagaaaatgcacctccagaacctggcggcagcgcaaaagatg

SEQ ID NO: 90222 - DNA, 103 bp, Artificial Sequence
  Synthetic Polynucleotide
taatacgactcactatagggatgggtttactatcgacattgactggaggtaacagaggagaacctccatgcaatgtcgaaacctggcggcagcgcaaaagatg

SEQ ID NO: 90223 - DNA, 103 bp, Artificial Sequence
  Synthetic Polynucleotide
taatacgactcactatagggtttttcttcaatgggtttactatcgacattaacagaggagaaatgtcatgagtaaacccaacctggcggcagcgcaaaagatg

SEQ ID NO: 90224 - DNA, 103 bp, Artificial Sequence
  Synthetic Polynucleotide
taatacgactcactatagggcctctactgttttttcttcaatgggtttacaacagaggagagtaaacatgttgaagaaaaacctggcggcagcgcaaaagatg

SEQ ID NO: 90225 - DNA, 103 bp, Artificial Sequence
  Synthetic Polynucleotide
taatacgactcactatagggctcacatcagtgcccactgtcaaatagggaaacagaggagatccctaatggacagtgggaacctggcggcagcgcaaaagatg

SEQ ID NO: 90226 - DNA, 103 bp, Artificial Sequence
  Synthetic Polynucleotide
taatacgactcactatagggcacagtgaagatcgtctcagtgtcttctcaaacagaggagatgagaaatgactgagacgaacctggcggcagcgcaaaagatg

SEQ ID NO: 90227 - DNA, 103 bp, Artificial Sequence
  Synthetic Polynucleotide
taatacgactcactatagggctgtcattgacctctactgttttttcttcaaacagaggagatgaagaatgaacagtagaaacctggcggcagcgcaaaagatg

SEQ ID NO: 90228 - DNA, 103 bp, Artificial Sequence
  Synthetic Polynucleotide
taatacgactcactatagggttctgcttttctgtcattgacctctactgtaacagaggagaacagtaatggtcaatgacaacctggcggcagcgcaaaagatg

SEQ ID NO: 90229 - DNA, 103 bp, Artificial Sequence
  Synthetic Polynucleotide
taatacgactcactatagggtacttggaaattctgcttttctgtcattgaaacagaggagatcaatgatggaaaagcagaacctggcggcagcgcaaaagatg

SEQ ID NO: 90230 - DNA, 103 bp, Artificial Sequence
  Synthetic Polynucleotide
taatacgactcactatagggttactgccactacttggaaattctgcttttaacagaggagaaaaagcatgatttccaagaacctggcggcagcgcaaaagatg

SEQ ID NO: 90231 - DNA, 103 bp, Artificial Sequence
  Synthetic Polynucleotide
taatacgactcactatagggtagcactgaattactgccactacttggaaaaacagaggagatttccaatgagtggcagtaacctggcggcagcgcaaaagatg

SEQ ID NO: 90232 - DNA, 103 bp, Artificial Sequence
  Synthetic Polynucleotide
taatacgactcactataggggaggggtatttagcactgaattactgccacaacagaggagagtggcaatgattcagtgcaacctggcggcagcgcaaaagatg

SEQ ID NO: 90233 - DNA, 103 bp, Artificial Sequence
  Synthetic Polynucleotide
taatacgactcactatagggggtgtagtaggaggggtatttagcactgaaaacagaggagattcagtatgaaataccccaacctggcggcagcgcaaaagatg

SEQ ID NO: 90234 - DNA, 103 bp, Artificial Sequence
  Synthetic Polynucleotide
taatacgactcactatagggaggcgattcaggtgtagtaggaggggtattaacagaggagaaataccatgcctactacaaacctggcggcagcgcaaaagatg

SEQ ID NO: 90235 - DNA, 103 bp, Artificial Sequence
  Synthetic Polynucleotide
taatacgactcactatagggtgactgatgaaggcgattcaggtgtagtagaacagaggagactactaatgctgaatcgcaacctggcggcagcgcaaaagatg

SEQ ID NO: 90236 - DNA, 103 bp, Artificial Sequence
  Synthetic Polynucleotide
taatacgactcactatagggtctgttacagtgactgatgaaggcgattcaaacagaggagatgaatcatgttcatcagtaacctggcggcagcgcaaaagatg

SEQ ID NO: 90237 - DNA, 103 bp, Artificial Sequence
  Synthetic Polynucleotide
taatacgactcactatagggtcctttcaggcacagtgaagatcgtctcagaacagaggagactgagaatgtcttcactgaacctggcggcagcgcaaaagatg

SEQ ID NO: 90238 - DNA, 103 bp, Artificial Sequence
  Synthetic Polynucleotide
taatacgactcactatagggccggctgccttctgttacagtgactgatgaaacagaggagatcatcaatgactgtaacaaacctggcggcagcgcaaaagatg

SEQ ID NO: 90239 - DNA, 103 bp, Artificial Sequence
  Synthetic Polynucleotide
taatacgactcactatagggaagactgctgccggctgccttctgttacagaacagaggagactgtaaatgaaggcagccaacctggcggcagcgcaaaagatg

SEQ ID NO: 90240 - DNA, 103 bp, Artificial Sequence
  Synthetic Polynucleotide
taatacgactcactatagggactgttacagaagactgctgccggctgcctaacagaggagaaggcagatggcagcagtcaacctggcggcagcgcaaaagatg

SEQ ID NO: 90241 - DNA, 103 bp, Artificial Sequence
  Synthetic Polynucleotide
taatacgactcactatagggtggttctgatactgttacagaagactgctgaacagaggagacagcagatgtctgtaacaaacctggcggcagcgcaaaagatg

SEQ ID NO: 90242 - DNA, 103 bp, Artificial Sequence
  Synthetic Polynucleotide
taatacgactcactatagggttggagccagtggttctgatactgttacagaacagaggagactgtaaatgtatcagaacaacctggcggcagcgcaaaagatg

SEQ ID NO: 90243 - DNA, 103 bp, Artificial Sequence
  Synthetic Polynucleotide
taatacgactcactatagggtcttcttggtttggagccagtggttctgataacagaggagaatcagaatgactggctccaacctggcggcagcgcaaaagatg

SEQ ID NO: 90244 - DNA, 103 bp, Artificial Sequence
  Synthetic Polynucleotide
taatacgactcactatagggacttcgaacctcttcttggtttggagccagaacagaggagactggctatgaaccaagaaaacctggcggcagcgcaaaagatg

SEQ ID NO: 90245 - DNA, 103 bp, Artificial Sequence
  Synthetic Polynucleotide
taatacgactcactatagggcactcttgatacttcgaacctcttcttggtaacagaggagaaccaagatgaggttcgaaaacctggcggcagcgcaaaagatg

SEQ ID NO: 90246 - DNA, 103 bp, Artificial Sequence
  Synthetic Polynucleotide
taatacgactcactatagggctatcagtttcactcttgatacttcgaaccaacagaggagaggttcgatgtatcaagagaacctggcggcagcgcaaaagatg

SEQ ID NO: 90247 - DNA, 103 bp, Artificial Sequence
  Synthetic Polynucleotide
taatacgactcactatagggctcaattgtgctatcagtttcactcttgataacagaggagaatcaagatggaaactgataacctggcggcagcgcaaaagatg

SEQ ID NO: 90248 - DNA, 103 bp, Artificial Sequence
  Synthetic Polynucleotide
taatacgactcactatagggaatgcctctctcctttcaggcacagtgaagaacagaggagacttcacatggcctgaaagaacctggcggcagcgcaaaagatg

SEQ ID NO: 90249 - DNA, 103 bp, Artificial Sequence
  Synthetic Polynucleotide
taatacgactcactatagggcactatccacctcaattgtgctatcagtttaacagaggagaaaactgatggcacaattgaacctggcggcagcgcaaaagatg

SEQ ID NO: 90250 - DNA, 103 bp, Artificial Sequence
  Synthetic Polynucleotide
taatacgactcactatagggtccccagcaacactatccacctcaattgtgaacagaggagacacaatatgggtggatagaacctggcggcagcgcaaaagatg

SEQ ID NO: 90251 - DNA, 103 bp, Artificial Sequence
  Synthetic Polynucleotide
taatacgactcactataggggtcttggagctccccagcaacactatccacaacagaggagagtggatatggttgctgggaacctggcggcagcgcaaaagatg

SEQ ID NO: 90252 - DNA, 103 bp, Artificial Sequence
  Synthetic Polynucleotide
taatacgactcactatagggcagactggaggtcttggagctccccagcaaaacagaggagattgctgatgagctccaagaacctggcggcagcgcaaaagatg

SEQ ID NO: 90253 - DNA, 103 bp, Artificial Sequence
  Synthetic Polynucleotide
taatacgactcactatagggctattcccttcagactggaggtcttggagcaacagaggagagctccaatgcctccagtcaacctggcggcagcgcaaaagatg

SEQ ID NO: 90254 - DNA, 103 bp, Artificial Sequence
  Synthetic Polynucleotide
taatacgactcactatagggtgctggcgagctattcccttcagactggagaacagaggagactccagatggaagggaataacctggcggcagcgcaaaagatg

SEQ ID NO: 90255 - DNA, 103 bp, Artificial Sequence
  Synthetic Polynucleotide
taatacgactcactatagggcatcaaaacctgctggcgagctattcccttaacagaggagaaagggaatggctcgccagaacctggcggcagcgcaaaagatg

SEQ ID NO: 90256 - DNA, 103 bp, Artificial Sequence
  Synthetic Polynucleotide
taatacgactcactatagggctcacactggcatcaaaacctgctggcgagaacagaggagactcgccatgaggttttgaaacctggcggcagcgcaaaagatg

SEQ ID NO: 90257 - DNA, 103 bp, Artificial Sequence
  Synthetic Polynucleotide
taatacgactcactatagggactgcttgagctcacactggcatcaaaaccaacagaggagaggttttatggccagtgtgaacctggcggcagcgcaaaagatg

SEQ ID NO: 90258 - DNA, 103 bp, Artificial Sequence
  Synthetic Polynucleotide
taatacgactcactataggggctgattactactgcttgagctcacactggaacagaggagaccagtgatggctcaagcaaacctggcggcagcgcaaaagatg

SEQ ID NO: 90259 - DNA, 103 bp, Artificial Sequence
  Synthetic Polynucleotide
taatacgactcactatagggctttcagcaaaatgcctctctcctttcaggaacagaggagacctgaaatgagagaggcaaacctggcggcagcgcaaaagatg

SEQ ID NO: 90260 - DNA, 103 bp, Artificial Sequence
  Synthetic Polynucleotide
taatacgactcactatagggtctggttctggctgattactactgcttgagaacagaggagactcaagatgtagtaatcaaacctggcggcagcgcaaaagatg

SEQ ID NO: 90261 - DNA, 103 bp, Artificial Sequence
  Synthetic Polynucleotide
taatacgactcactatagggttcaggatgttctggttctggctgattactaacagaggagaagtaatatgccagaaccaaacctggcggcagcgcaaaagatg

SEQ ID NO: 90262 - DNA, 103 bp, Artificial Sequence
  Synthetic Polynucleotide
taatacgactcactatagggtacaggctttttcaggatgttctggttctgaacagaggagacagaacatgaacatcctgaacctggcggcagcgcaaaagatg

SEQ ID NO: 90263 - DNA, 103 bp, Artificial Sequence
  Synthetic Polynucleotide
taatacgactcactatagggttctgacctgtacaggctttttcaggatgtaacagaggagaacatccatgaaaagcctgaacctggcggcagcgcaaaagatg

SEQ ID NO: 90264 - DNA, 103 bp, Artificial Sequence
  Synthetic Polynucleotide
taatacgactcactatagggtttcactcttttctgacctgtacaggctttaacagaggagaaaagccatgacaggtcagaacctggcggcagcgcaaaagatg

SEQ ID NO: 90265 - DNA, 103 bp, Artificial Sequence
  Synthetic Polynucleotide
taatacgactcactatagggcctgagcatctttcactcttttctgacctgaacagaggagacaggtcatgaaagagtgaaacctggcggcagcgcaaaagatg

SEQ ID NO: 90266 - DNA, 103 bp, Artificial Sequence
  Synthetic Polynucleotide
taatacgactcactatagggcttcctcctccctgagcatctttcactcttaacagaggagaaagagtatgagatgctcaaacctggcggcagcgcaaaagatg

SEQ ID NO: 90267 - DNA, 103 bp, Artificial Sequence
  Synthetic Polynucleotide
taatacgactcactatagggttttgatgaacttcctcctccctgagcatcaacagaggagagatgctatgggaggaggaaacctggcggcagcgcaaaagatg

SEQ ID NO: 90268 - DNA, 103 bp, Artificial Sequence
  Synthetic Polynucleotide
taatacgactcactatagggttttctgcttttttgatgaacttcctcctcaacagaggagagaggagatggttcatcaaaacctggcggcagcgcaaaagatg

SEQ ID NO: 90269 - DNA, 103 bp, Artificial Sequence
  Synthetic Polynucleotide
taatacgactcactatagggttatggcttcttttctgcttttttgatgaaaacagaggagattcatcatgaaagcagaaaacctggcggcagcgcaaaagatg

SEQ ID NO: 90270 - DNA, 103 bp, Artificial Sequence
  Synthetic Polynucleotide
taatacgactcactatagggtaatgtttcactttcagcaaaatgcctctcaacagaggagagagaggatgtttgctgaaaacctggcggcagcgcaaaagatg

SEQ ID NO: 90271 - DNA, 103 bp, Artificial Sequence
  Synthetic Polynucleotide
taatacgactcactatagggcactgttgctttatggcttcttttctgcttaacagaggagaaagcagatgagaagccataacctggcggcagcgcaaaagatg

SEQ ID NO: 90272 - DNA, 103 bp, Artificial Sequence
  Synthetic Polynucleotide
taatacgactcactatagggtgttgtttaccactgttgctttatggcttcaacagaggagagaagccatgaagcaacagaacctggcggcagcgcaaaagatg

SEQ ID NO: 90273 - DNA, 103 bp, Artificial Sequence
  Synthetic Polynucleotide
taatacgactcactatagggcccttctttttgttgtttaccactgttgctaacagaggagaagcaacatgggtaaacaaaacctggcggcagcgcaaaagatg

SEQ ID NO: 90274 - DNA, 103 bp, Artificial Sequence
  Synthetic Polynucleotide
taatacgactcactatagggtgtgccttttcccttctttttgttgtttacaacagaggagagtaaacatgaaaaagaagaacctggcggcagcgcaaaagatg

SEQ ID NO: 90275 - DNA, 103 bp, Artificial Sequence
  Synthetic Polynucleotide
taatacgactcactatagggcactactatttgtgccttttcccttcttttaacagaggagaaaaagaatggaaaaggcaaacctggcggcagcgcaaaagatg

SEQ ID NO: 90276 - DNA, 103 bp, Artificial Sequence
  Synthetic Polynucleotide
taatacgactcactatagggtcttcactatcactactatttgtgccttttaacagaggagaaaaaggatgaaatagtagaacctggcggcagcgcaaaagatg

SEQ ID NO: 90277 - DNA, 103 bp, Artificial Sequence
  Synthetic Polynucleotide
taatacgactcactatagggagctgaaagttcttcactatcactactattaacagaggagaaatagtatggatagtgaaaacctggcggcagcgcaaaagatg

SEQ ID NO: 90278 - DNA, 103 bp, Artificial Sequence
  Synthetic Polynucleotide
taatacgactcactatagggtactttcaccagctgaaagttcttcactataacagaggagaatagtgatgaactttcagaacctggcggcagcgcaaaagatg

SEQ ID NO: 90279 - DNA, 103 bp, Artificial Sequence
  Synthetic Polynucleotide
taatacgactcactatagggctcttagttatactttcaccagctgaaagtaacagaggagaactttcatgtggtgaaagaacctggcggcagcgcaaaagatg

SEQ ID NO: 90280 - DNA, 103 bp, Artificial Sequence
  Synthetic Polynucleotide
taatacgactcactataggggactggctgactcttagttatactttcaccaacagaggagaggtgaaatgataactaagaacctggcggcagcgcaaaagatg

SEQ ID NO: 90281 - DNA, 103 bp, Artificial Sequence
  Synthetic Polynucleotide
taatacgactcactatagggggagctggtctaatgtttcactttcagcaaaacagaggagattgctgatggtgaaacataacctggcggcagcgcaaaagatg

SEQ ID NO: 90282 - DNA, 103 bp, Artificial Sequence
  Synthetic Polynucleotide
taatacgactcactatagggaaactgatttgactggctgactcttagttaaacagaggagataactaatggtcagccagaacctggcggcagcgcaaaagatg

SEQ ID NO: 90283 - DNA, 103 bp, Artificial Sequence
  Synthetic Polynucleotide
taatacgactcactatagggattccagtggaaactgatttgactggctgaaacagaggagatcagccatgcaaatcagtaacctggcggcagcgcaaaagatg

SEQ ID NO: 90284 - DNA, 103 bp, Artificial Sequence
  Synthetic Polynucleotide
taatacgactcactatagggatgagacttcattccagtggaaactgatttaacagaggagaaaatcaatgtccactggaaacctggcggcagcgcaaaagatg

SEQ ID NO: 90285 - DNA, 103 bp, Artificial Sequence
  Synthetic Polynucleotide
taatacgactcactatagggatttggtactatgagacttcattccagtggaacagaggagaccactgatgtgaagtctcaacctggcggcagcgcaaaagatg

SEQ ID NO: 90286 - DNA, 103 bp, Artificial Sequence
  Synthetic Polynucleotide
taatacgactcactatagggcttgcgggagatttggtactatgagacttcaacagaggagagaagtcatgtagtaccaaaacctggcggcagcgcaaaagatg

SEQ ID NO: 90287 - DNA, 103 bp, Artificial Sequence
  Synthetic Polynucleotide
taatacgactcactatagggagactgcgtccttgcgggagatttggtactaacagaggagaagtaccatgtctcccgcaaacctggcggcagcgcaaaagatg

SEQ ID NO: 90288 - DNA, 103 bp, Artificial Sequence
  Synthetic Polynucleotide
taatacgactcactatagggattttcctggagactgcgtccttgcgggagaacagaggagactcccgatgggacgcagtaacctggcggcagcgcaaaagatg

SEQ ID NO: 90289 - DNA, 103 bp, Artificial Sequence
  Synthetic Polynucleotide
taatacgactcactatagggttctttccacattttcctggagactgcgtcaacagaggagagacgcaatgtccaggaaaaacctggcggcagcgcaaaagatg

SEQ ID NO: 90290 - DNA, 103 bp, Artificial Sequence
  Synthetic Polynucleotide
taatacgactcactatagggcttatcaccattctttccacattttcctggaacagaggagaccaggaatgtgtggaaagaacctggcggcagcgcaaaagatg

SEQ ID NO: 90291 - DNA, 103 bp, Artificial Sequence
  Synthetic Polynucleotide
taatacgactcactataggggatcaggatccttatcaccattctttccacaacagaggagagtggaaatgatggtgataaacctggcggcagcgcaaaagatg

SEQ ID NO: 90292 - DNA, 103 bp, Artificial Sequence
  Synthetic Polynucleotide
taatacgactcactatagggttggtgagtgggagctggtctaatgtttcaaacagaggagatgaaacatgagaccagctaacctggcggcagcgcaaaagatg

SEQ ID NO: 90293 - DNA, 103 bp, Artificial Sequence
  Synthetic Polynucleotide
taatacgactcactatagggggttccttgagatcaggatccttatcaccaaacagaggagatggtgaatgggatcctgaaacctggcggcagcgcaaaagatg

SEQ ID NO: 90294 - DNA, 103 bp, Artificial Sequence
  Synthetic Polynucleotide
taatacgactcactatagggtcgattactgggttccttgagatcaggatcaacagaggagagatcctatgctcaaggaaaacctggcggcagcgcaaaagatg

SEQ ID NO: 90295 - DNA, 103 bp, Artificial Sequence
  Synthetic Polynucleotide
taatacgactcactatagggctttgggtaatcgattactgggttccttgaaacagaggagatcaaggatgccagtaatcaacctggcggcagcgcaaaagatg

SEQ ID NO: 90296 - DNA, 103 bp, Artificial Sequence
  Synthetic Polynucleotide
taatacgactcactatagggcatttgtaaactttgggtaatcgattactgaacagaggagacagtaaatgattacccaaaacctggcggcagcgcaaaagatg

SEQ ID NO: 90297 - DNA, 103 bp, Artificial Sequence
  Synthetic Polynucleotide
taatacgactcactatagggctgaaaactccatttgtaaactttgggtaaaacagaggagattacccatggtttacaaaaacctggcggcagcgcaaaagatg

SEQ ID NO: 90298 - DNA, 103 bp, Artificial Sequence
  Synthetic Polynucleotide
taatacgactcactatagggggtccgacatctgaaaactccatttgtaaaaacagaggagatttacaatgggagttttcaacctggcggcagcgcaaaagatg

SEQ ID NO: 90299 - DNA, 103 bp, Artificial Sequence
  Synthetic Polynucleotide
taatacgactcactatagggatattttccaggtccgacatctgaaaactcaacagaggagagagtttatggatgtcggaaacctggcggcagcgcaaaagatg

SEQ ID NO: 90300 - DNA, 103 bp, Artificial Sequence
  Synthetic Polynucleotide
taatacgactcactatagggggcacttgtcatattttccaggtccgacataacagaggagaatgtcgatgctggaaaataacctggcggcagcgcaaaagatg

SEQ ID NO: 90301 - DNA, 103 bp, Artificial Sequence
  Synthetic Polynucleotide
taatacgactcactatagggtgatgcgttcggcacttgtcatattttccaaacagaggagatggaaaatgtgacaagtgaacctggcggcagcgcaaaagatg

SEQ ID NO: 90302 - DNA, 103 bp, Artificial Sequence
  Synthetic Polynucleotide
taatacgactcactatagggtgaagaattgtgatgcgttcggcacttgtcaacagaggagagacaagatgcgaacgcataacctggcggcagcgcaaaagatg

SEQ ID NO: 90303 - DNA, 103 bp, Artificial Sequence
  Synthetic Polynucleotide
taatacgactcactatagggatgctcagggttggtgagtgggagctggtcaacagaggagagaccagatgccactcaccaacctggcggcagcgcaaaagatg

SEQ ID NO: 90304 - DNA, 103 bp, Artificial Sequence
  Synthetic Polynucleotide
taatacgactcactatagggaagtttttcttgaagaattgtgatgcgttcaacagaggagagaacgcatgacaattcttaacctggcggcagcgcaaaagatg

SEQ ID NO: 90305 - DNA, 103 bp, Artificial Sequence
  Synthetic Polynucleotide
taatacgactcactatagggtgatttcttgaagtttttcttgaagaattgaacagaggagacaattcatgaagaaaaacaacctggcggcagcgcaaaagatg

SEQ ID NO: 90306 - DNA, 103 bp, Artificial Sequence
  Synthetic Polynucleotide
taatacgactcactatagggtaatgttttctgatttcttgaagtttttctaacagaggagaagaaaaatgtcaagaaataacctggcggcagcgcaaaagatg

SEQ ID NO: 90307 - DNA, 103 bp, Artificial Sequence
  Synthetic Polynucleotide
taatacgactcactatagggtaatgacagataatgttttctgatttcttgaacagaggagacaagaaatgagaaaacataacctggcggcagcgcaaaagatg

SEQ ID NO: 90308 - DNA, 103 bp, Artificial Sequence
  Synthetic Polynucleotide
taatacgactcactatagggcttcagattttaatgacagataatgttttcaacagaggagagaaaacatgatctgtcataacctggcggcagcgcaaaagatg

SEQ ID NO: 90309 - DNA, 103 bp, Artificial Sequence
  Synthetic Polynucleotide
taatacgactcactatagggatggaagctacttcagattttaatgacagaaacagaggagatctgtcatgaaaatctgaaacctggcggcagcgcaaaagatg

SEQ ID NO: 90310 - DNA, 103 bp, Artificial Sequence
  Synthetic Polynucleotide
taatacgactcactatagggcctccgatcaatggaagctacttcagatttaacagaggagaaaatctatggtagcttccaacctggcggcagcgcaaaagatg

SEQ ID NO: 90311 - DNA, 103 bp, Artificial Sequence
  Synthetic Polynucleotide
taatacgactcactatagggaacgctttctcctccgatcaatggaagctaaacagaggagatagcttatgttgatcggaaacctggcggcagcgcaaaagatg

SEQ ID NO: 90312 - DNA, 103 bp, Artificial Sequence
  Synthetic Polynucleotide
taatacgactcactatagggttcttctttaaacgctttctcctccgatcaaacagaggagatgatcgatggagaaagcgaacctggcggcagcgcaaaagatg

SEQ ID NO: 90313 - DNA, 103 bp, Artificial Sequence
  Synthetic Polynucleotide
taatacgactcactatagggttctctctctttcttctttaaacgctttctaacagaggagaagaaagatgttaaagaagaacctggcggcagcgcaaaagatg

SEQ ID NO: 90314 - DNA, 103 bp, Artificial Sequence
  Synthetic Polynucleotide
taatacgactcactataggggagtgccaaaatgctcagggttggtgagtgaacagaggagacactcaatgaccctgagcaacctggcggcagcgcaaaagatg

SEQ ID NO: 90315 - DNA, 103 bp, Artificial Sequence
  Synthetic Polynucleotide
taatacgactcactatagggtagcagcactttctctctctttcttctttaaacagaggagataaagaatgaagagagagaacctggcggcagcgcaaaagatg

SEQ ID NO: 90316 - DNA, 103 bp, Artificial Sequence
  Synthetic Polynucleotide
taatacgactcactataggggatgaggatgtagcagcactttctctctctaacagaggagaagagagatgaagtgctgcaacctggcggcagcgcaaaagatg

SEQ ID NO: 90317 - DNA, 103 bp, Artificial Sequence
  Synthetic Polynucleotide
taatacgactcactatagggtgaagaggaggatgaggatgtagcagcactaacagaggagaagtgctatgacatcctcaaacctggcggcagcgcaaaagatg

SEQ ID NO: 90318 - DNA, 103 bp, Artificial Sequence
  Synthetic Polynucleotide
taatacgactcactatagggtggatgaaggtgaagaggaggatgaggatgaacagaggagacatcctatgcctcctcttaacctggcggcagcgcaaaagatg

SEQ ID NO: 90319 - DNA, 103 bp, Artificial Sequence
  Synthetic Polynucleotide
taatacgactcactataggggttatggaactggatgaaggtgaagaggagaacagaggagactcctcatgaccttcatcaacctggcggcagcgcaaaagatg

SEQ ID NO: 90320 - DNA, 103 bp, Artificial Sequence
  Synthetic Polynucleotide
taatacgactcactatagggaacagcagctgttatggaactggatgaaggaacagaggagaccttcaatgagttccataaacctggcggcagcgcaaaagatg

SEQ ID NO: 90321 - DNA, 103 bp, Artificial Sequence
  Synthetic Polynucleotide
taatacgactcactatagggaagttaacataacagcagctgttatggaacaacagaggagagttccaatgcagctgctgaacctggcggcagcgcaaaagatg

SEQ ID NO: 90322 - DNA, 103 bp, Artificial Sequence
  Synthetic Polynucleotide
taatacgactcactatagggggttcagctaaagttaacataacagcagctaacagaggagaagctgcatgtatgttaacaacctggcggcagcgcaaaagatg

SEQ ID NO: 90323 - DNA, 103 bp, Artificial Sequence
  Synthetic Polynucleotide
taatacgactcactatagggggacattgacggttcagctaaagttaacataacagaggagaatgttaatgttagctgaaaacctggcggcagcgcaaaagatg

SEQ ID NO: 90324 - DNA, 103 bp, Artificial Sequence
  Synthetic Polynucleotide
taatacgactcactataggggtgatgcgctggacattgacggttcagctaaacagaggagatagctgatgcgtcaatgtaacctggcggcagcgcaaaagatg

SEQ ID NO: 90325 - DNA, 103 bp, Artificial Sequence
  Synthetic Polynucleotide
taatacgactcactatagggcctatgactggagtgccaaaatgctcagggaacagaggagaccctgaatgttttggcacaacctggcggcagcgcaaaagatg

SEQ ID NO: 90326 - DNA, 103 bp, Artificial Sequence
  Synthetic Polynucleotide
taatacgactcactatagggattccattttgtgatgcgctggacattgacaacagaggagagtcaatatgcagcgcatcaacctggcggcagcgcaaaagatg

SEQ ID NO: 90327 - DNA, 103 bp, Artificial Sequence
  Synthetic Polynucleotide
taatacgactcactatagggctcaactgacattccattttgtgatgcgctaacagaggagaagcgcaatgcaaaatggaaacctggcggcagcgcaaaagatg

SEQ ID NO: 90328 - DNA, 103 bp, Artificial Sequence
  Synthetic Polynucleotide
taatacgactcactataggggtatttagcactcacatcagtgcccactgtaacagaggagaacagtgatgactgatgtgaacctggcggcagcgcaaaagatg

SEQ ID NO: 90329 - DNA, 103 bp, Artificial Sequence
  Synthetic Polynucleotide
taatacgactcactatagggtgttttctttcctatgactggagtgccaaaaacagaggagatttggcatgccagtcataaacctggcggcagcgcaaaagatg

SEQ ID NO: 90330 - DNA, 103 bp, Artificial Sequence
  Synthetic Polynucleotide
taatacgactcactatagggttcctctatttgttttctttcctatgactgaacagaggagacagtcaatggaaagaaaaaacctggcggcagcgcaaaagatg

SEQ ID NO: 90331 - DNA, 103 bp, Artificial Sequence
  Synthetic Polynucleotide
taatacgactcactatagggttagatcttcttcctctatttgttttctttaacagaggagaaaagaaatgaaatagaggaacctggcggcagcgcaaaagatg

SEQ ID NO: 90332 - DNA, 103 bp, Artificial Sequence
  Synthetic Polynucleotide
taatacgactcactatagggtggtatatgattagatcttcttcctctattaacagaggagaaatagaatgagaagatctaacctggcggcagcgcaaaagatg

SEQ ID NO: 90333 - DNA, 103 bp, Artificial Sequence
  Synthetic Polynucleotide
taatacgactcactatagggactcttcctctggtatatgattagatcttcaacagaggagagaagatatgatcatatacaacctggcggcagcgcaaaagatg

SEQ ID NO: 90334 - DNA, 103 bp, Artificial Sequence
  Synthetic Polynucleotide
taatacgactcactataggggatgatgaagactcttcctctggtatatgaaacagaggagatcatatatgagaggaagaaacctggcggcagcgcaaaagatg

SEQ ID NO: 90335 - DNA, 103 bp, Artificial Sequence
  Synthetic Polynucleotide
taatacgactcactatagggatcactggaggatgatgaagactcttcctcaacagaggagagaggaaatgtcttcatcaaacctggcggcagcgcaaaagatg

SEQ ID NO: 90336 - DNA, 103 bp, Artificial Sequence
  Synthetic Polynucleotide
taatacgactcactatagggcctcatcttcatcactggaggatgatgaagaacagaggagacttcatatgcctccagtgaacctggcggcagcgcaaaagatg

SEQ ID NO: 90337 - DNA, 103 bp, Artificial Sequence
  Synthetic Polynucleotide
taatacgactcactatagggttcctatcatcctcatcttcatcactggagaacagaggagactccagatgtgaagatgaaacctggcggcagcgcaaaagatg

SEQ ID NO: 90338 - DNA, 103 bp, Artificial Sequence
  Synthetic Polynucleotide
taatacgactcactatagggatcaatctgtttcctatcatcctcatcttcaacagaggagagaagatatggatgataggaacctggcggcagcgcaaaagatg

SEQ ID NO: 90339 - DNA, 103 bp, Artificial Sequence
  Synthetic Polynucleotide
taatacgactcactatagggaggctcctctgtatttagcactcacatcagaacagaggagactgatgatggtgctaaataacctggcggcagcgcaaaagatg

SEQ ID NO: 90340 - DNA, 103 bp, Artificial Sequence
  Synthetic Polynucleotide
taatacgactcactatagggctagtagctcatcaatctgtttcctatcataacagaggagaatgataatgaacagattgaacctggcggcagcgcaaaagatg

SEQ ID NO: 90341 - DNA, 103 bp, Artificial Sequence
  Synthetic Polynucleotide
taatacgactcactatagggacaactttgcctagtagctcatcaatctgtaacagaggagaacagatatgtgagctactaacctggcggcagcgcaaaagatg

SEQ ID NO: 90342 - DNA, 103 bp, Artificial Sequence
  Synthetic Polynucleotide
taatacgactcactatagggatctacacatacaactttgcctagtagctcaacagaggagagagctaatgggcaaagttaacctggcggcagcgcaaaagatg

SEQ ID NO: 90343 - DNA, 103 bp, Artificial Sequence
  Synthetic Polynucleotide
taatacgactcactatagggaactaatgtaatctacacatacaactttgcaacagaggagagcaaagatgtatgtgtagaacctggcggcagcgcaaaagatg

SEQ ID NO: 90344 - DNA, 103 bp, Artificial Sequence
  Synthetic Polynucleotide
taatacgactcactatagggtttttatccaaactaatgtaatctacacataacagaggagaatgtgtatgttacattagaacctggcggcagcgcaaaagatg

SEQ ID NO: 90345 - DNA, 103 bp, Artificial Sequence
  Synthetic Polynucleotide
taatacgactcactatagggcagtgctttctttttatccaaactaatgtaaacagaggagatacattatgttggataaaaacctggcggcagcgcaaaagatg

SEQ ID NO: 90346 - DNA, 103 bp, Artificial Sequence
  Synthetic Polynucleotide
taatacgactcactatagggcaggaaaccacagtgctttctttttatccaaacagaggagatggataatgagaaagcacaacctggcggcagcgcaaaagatg

SEQ ID NO: 90347 - DNA, 103 bp, Artificial Sequence
  Synthetic Polynucleotide
taatacgactcactatagggaccaccaatgcaggaaaccacagtgctttcaacagaggagagaaagcatggtggtttccaacctggcggcagcgcaaaagatg

SEQ ID NO: 90348 - DNA, 103 bp, Artificial Sequence
  Synthetic Polynucleotide
taatacgactcactatagggatcaggacaaaccaccaatgcaggaaaccaaacagaggagatggtttatggcattggtgaacctggcggcagcgcaaaagatg

SEQ ID NO: 90349 - DNA, 103 bp, Artificial Sequence
  Synthetic Polynucleotide
taatacgactcactatagggcatcactacaatcaggacaaaccaccaatgaacagaggagacattggatgtttgtcctgaacctggcggcagcgcaaaagatg

SEQ ID NO: 90350 - DNA, 103 bp, Artificial Sequence
  Synthetic Polynucleotide
taatacgactcactataggggcttcacaaaaggctcctctgtatttagcaaacagaggagatgctaaatgcagaggagcaacctggcggcagcgcaaaagatg

SEQ ID NO: 90351 - DNA, 103 bp, Artificial Sequence
  Synthetic Polynucleotide
taatacgactcactatagggacagcaatctcatcactacaatcaggacaaaacagaggagattgtccatgttgtagtgaaacctggcggcagcgcaaaagatg

SEQ ID NO: 90352 - DNA, 103 bp, Artificial Sequence
  Synthetic Polynucleotide
taatacgactcactataggggtccttttttacagcaatctcatcactacaaacagaggagatgtagtatggagattgctaacctggcggcagcgcaaaagatg

SEQ ID NO: 90353 - DNA, 103 bp, Artificial Sequence
  Synthetic Polynucleotide
taatacgactcactatagggcaagaatattgtccttttttacagcaatctaacagaggagaagattgatgtaaaaaaggaacctggcggcagcgcaaaagatg

SEQ ID NO: 90354 - DNA, 103 bp, Artificial Sequence
  Synthetic Polynucleotide
taatacgactcactatagggaaagatcgaacaagaatattgtccttttttaacagaggagaaaaaaaatgcaatattctaacctggcggcagcgcaaaagatg

SEQ ID NO: 90355 - DNA, 103 bp, Artificial Sequence
  Synthetic Polynucleotide
taatacgactcactatagggtccatctttgaaagatcgaacaagaatattaacagaggagaaatattatggttcgatctaacctggcggcagcgcaaaagatg

SEQ ID NO: 90356 - DNA, 103 bp, Artificial Sequence
  Synthetic Polynucleotide
taatacgactcactatagggaagtaaattttccatctttgaaagatcgaaaacagaggagattcgatatgtcaaagatgaacctggcggcagcgcaaaagatg

SEQ ID NO: 90357 - DNA, 103 bp, Artificial Sequence
  Synthetic Polynucleotide
taatacgactcactatagggcttggaactgaagtaaattttccatctttgaacagaggagacaaagaatgaaaatttacaacctggcggcagcgcaaaagatg

SEQ ID NO: 90358 - DNA, 103 bp, Artificial Sequence
  Synthetic Polynucleotide
taatacgactcactataggggacatcttttcttggaactgaagtaaatttaacagaggagaaaatttatgtcagttccaaacctggcggcagcgcaaaagatg

SEQ ID NO: 90359 - DNA, 103 bp, Artificial Sequence
  Synthetic Polynucleotide
taatacgactcactatagggtaatttcatggacatcttttcttggaactgaacagaggagacagttcatggaaaagatgaacctggcggcagcgcaaaagatg

SEQ ID NO: 90360 - DNA, 103 bp, Artificial Sequence
  Synthetic Polynucleotide
taatacgactcactataggggtgtcactagtaatttcatggacatcttttaacagaggagaaaaagaatgccatgaaataacctggcggcagcgcaaaagatg

SEQ ID NO: 90361 - DNA, 103 bp, Artificial Sequence
  Synthetic Polynucleotide
taatacgactcactatagggcttgatcttggcttcacaaaaggctcctctaacagaggagaagaggaatgttttgtgaaaacctggcggcagcgcaaaagatg

SEQ ID NO: 90362 - DNA, 103 bp, Artificial Sequence
  Synthetic Polynucleotide
taatacgactcactatagggctttggtgcagtgtcactagtaatttcatgaacagaggagacatgaaatgactagtgacaacctggcggcagcgcaaaagatg

SEQ ID NO: 90363 - DNA, 103 bp, Artificial Sequence
  Synthetic Polynucleotide
taatacgactcactatagggcagcatcaggctttggtgcagtgtcactagaacagaggagactagtgatgctgcaccaaaacctggcggcagcgcaaaagatg

SEQ ID NO: 90364 - DNA, 103 bp, Artificial Sequence
  Synthetic Polynucleotide
taatacgactcactatagggtgctttaaaacagcatcaggctttggtgcaaacagaggagatgcaccatggcctgatgcaacctggcggcagcgcaaaagatg

SEQ ID NO: 90365 - DNA, 103 bp, Artificial Sequence
  Synthetic Polynucleotide
taatacgactcactatagggttcaaaggcttgctttaaaacagcatcaggaacagaggagacctgatatggttttaaagaacctggcggcagcgcaaaagatg

SEQ ID NO: 90366 - DNA, 103 bp, Artificial Sequence
  Synthetic Polynucleotide
taatacgactcactatagggcaagtgcctgttcaaaggcttgctttaaaaaacagaggagattttaaatgaagcctttgaacctggcggcagcgcaaaagatg

SEQ ID NO: 90367 - DNA, 103 bp, Artificial Sequence
  Synthetic Polynucleotide
taatacgactcactatagggttgtgaaattcaagtgcctgttcaaaggctaacagaggagaagccttatgacaggcactaacctggcggcagcgcaaaagatg

SEQ ID NO: 90368 - DNA, 103 bp, Artificial Sequence
  Synthetic Polynucleotide
taatacgactcactatagggagttctacttttgtgaaattcaagtgcctgaacagaggagacaggcaatggaatttcacaacctggcggcagcgcaaaagatg

SEQ ID NO: 90369 - DNA, 103 bp, Artificial Sequence
  Synthetic Polynucleotide
taatacgactcactatagggtagcaggaatagttctacttttgtgaaattaacagaggagaaatttcatgaaagtagaaaacctggcggcagcgcaaaagatg

SEQ ID NO: 90370 - DNA, 103 bp, Artificial Sequence
  Synthetic Polynucleotide
taatacgactcactataggggtcttccagttagcaggaatagttctacttaacagaggagaaagtagatgtattcctgcaacctggcggcagcgcaaaagatg

SEQ ID NO: 90371 - DNA, 103 bp, Artificial Sequence
  Synthetic Polynucleotide
taatacgactcactatagggtttcaattcagtcttccagttagcaggaataacagaggagaattcctatgaactggaagaacctggcggcagcgcaaaagatg

SEQ ID NO: 90372 - DNA, 103 bp, Artificial Sequence
  Synthetic Polynucleotide
taatacgactcactatagggtttttgctgtcttgatcttggcttcacaaaaacagaggagatttgtgatgccaagatcaaacctggcggcagcgcaaaagatg

SEQ ID NO: 90373 - DNA, 103 bp, Artificial Sequence
  Synthetic Polynucleotide
taatacgactcactatagggagctatcttctttcaattcagtcttccagtaacagaggagaactggaatgctgaattgaaacctggcggcagcgcaaaagatg

SEQ ID NO: 90374 - DNA, 103 bp, Artificial Sequence
  Synthetic Polynucleotide
taatacgactcactatagggtcactgctagagctatcttctttcaattcaaacagaggagatgaattatgagaagatagaacctggcggcagcgcaaaagatg

SEQ ID NO: 90375 - DNA, 103 bp, Artificial Sequence
  Synthetic Polynucleotide
taatacgactcactatagggttcctctgcttcactgctagagctatcttcaacagaggagagaagatatgtctagcagtaacctggcggcagcgcaaaagatg

SEQ ID NO: 90376 - DNA, 103 bp, Artificial Sequence
  Synthetic Polynucleotide
taatacgactcactatagggcctcctcttcttcctctgcttcactgctagaacagaggagactagcaatgaagcagaggaacctggcggcagcgcaaaagatg

SEQ ID NO: 90377 - DNA, 103 bp, Artificial Sequence
  Synthetic Polynucleotide
taatacgactcactatagggtcatcttcctcctcctcttcttcctctgctaacagaggagaagcagaatgagaagaggaaacctggcggcagcgcaaaagatg

SEQ ID NO: 90378 - DNA, 103 bp, Artificial Sequence
  Synthetic Polynucleotide
taatacgactcactatagggttctttttcatcatcttcctcctcctcttcaacagaggagagaagagatggaggaagataacctggcggcagcgcaaaagatg

SEQ ID NO: 90379 - DNA, 103 bp, Artificial Sequence
  Synthetic Polynucleotide
taatacgactcactatagggtatcctccttttctttttcatcatcttcctaacagaggagaaggaagatgatgaaaaagaacctggcggcagcgcaaaagatg

SEQ ID NO: 90380 - DNA, 103 bp, Artificial Sequence
  Synthetic Polynucleotide
taatacgactcactatagggtcactgctattatcctccttttctttttcaaacagaggagatgaaaaatgaaaggaggaaacctggcggcagcgcaaaagatg

SEQ ID NO: 90381 - DNA, 103 bp, Artificial Sequence
  Synthetic Polynucleotide
taatacgactcactatagggttcttcttcttcactgctattatcctccttaacagaggagaaaggagatgaatagcagtaacctggcggcagcgcaaaagatg

SEQ ID NO: 90382 - DNA, 103 bp, Artificial Sequence
  Synthetic Polynucleotide
taatacgactcactataggggttctatttcttcttcttcttcactgctataacagaggagaatagcaatgaagaagaagaacctggcggcagcgcaaaagatg

SEQ ID NO: 90383 - DNA, 103 bp, Artificial Sequence
  Synthetic Polynucleotide
taatacgactcactatagggttgacaagtctttttgctgtcttgatcttgaacagaggagacaagatatggacagcaaaaacctggcggcagcgcaaaagatg

SEQ ID NO: 90384 - DNA, 103 bp, Artificial Sequence
  Synthetic Polynucleotide
taatacgactcactatagggtctggaaatggttctatttcttcttcttctaacagaggagaagaagaatgagaaatagaaacctggcggcagcgcaaaagatg

SEQ ID NO: 90385 - DNA, 103 bp, Artificial Sequence
  Synthetic Polynucleotide
taatacgactcactatagggctccctttcttctggaaatggttctatttcaacagaggagagaaataatgccatttccaaacctggcggcagcgcaaaagatg

SEQ ID NO: 90386 - DNA, 103 bp, Artificial Sequence
  Synthetic Polynucleotide
taatacgactcactataggggaagaaagttctccctttcttctggaaatgaacagaggagacatttcatgaagaaagggaacctggcggcagcgcaaaagatg

SEQ ID NO: 90387 - DNA, 103 bp, Artificial Sequence
  Synthetic Polynucleotide
taatacgactcactatagggtacaattgctgaagaaagttctccctttctaacagaggagaagaaagatggaactttctaacctggcggcagcgcaaaagatg

SEQ ID NO: 90388 - DNA, 103 bp, Artificial Sequence
  Synthetic Polynucleotide
taatacgactcactatagggcataaatttgtacaattgctgaagaaagttaacagaggagaaactttatgcagcaattgaacctggcggcagcgcaaaagatg

SEQ ID NO: 90389 - DNA, 103 bp, Artificial Sequence
  Synthetic Polynucleotide
taatacgactcactatagggctctatcttccataaatttgtacaattgctaacagaggagaagcaatatgacaaatttaaacctggcggcagcgcaaaagatg

SEQ ID NO: 90390 - DNA, 103 bp, Artificial Sequence
  Synthetic Polynucleotide
taatacgactcactatagggataggtgtacctctatcttccataaatttgaacagaggagacaaattatgggaagatagaacctggcggcagcgcaaaagatg

SEQ ID NO: 90391 - DNA, 103 bp, Artificial Sequence
  Synthetic Polynucleotide
taatacgactcactatagggtcgtttgttaataggtgtacctctatcttcaacagaggagagaagatatgggtacacctaacctggcggcagcgcaaaagatg

SEQ ID NO: 90392 - DNA, 103 bp, Artificial Sequence
  Synthetic Polynucleotide
taatacgactcactatagggcaagtacaggtcgtttgttaataggtgtacaacagaggagagtacacatgttaacaaacaacctggcggcagcgcaaaagatg

SEQ ID NO: 90393 - DNA, 103 bp, Artificial Sequence
  Synthetic Polynucleotide
taatacgactcactatagggtttcgatatccaagtacaggtcgtttgttaaacagaggagataacaaatgacctgtactaacctggcggcagcgcaaaagatg

SEQ ID NO: 90394 - DNA, 103 bp, Artificial Sequence
  Synthetic Polynucleotide
taatacgactcactatagggcttcctgttccctttgacaggggctgccataacagaggagaatggcaatgcctgtcaaaaacctggcggcagcgcaaaagatg

SEQ ID NO: 90395 - DNA, 103 bp, Artificial Sequence
  Synthetic Polynucleotide
taatacgactcactatagggctccagcgagatggggttctggattccgttaacagaggagaaacggaatgcagaaccccaacctggcggcagcgcaaaagatg

SEQ ID NO: 90396 - DNA, 103 bp, Artificial Sequence
  Synthetic Polynucleotide
taatacgactcactataggggaagatgggggctgccgggcaggggcctgcaacagaggagagcaggcatgtgcccggcaaacctggcggcagcgcaaaagatg

SEQ ID NO: 90397 - DNA, 103 bp, Artificial Sequence
  Synthetic Polynucleotide
taatacgactcactatagggagcagcccttgaagatgggggctgccgggcaacagaggagagcccggatgcccccatctaacctggcggcagcgcaaaagatg

SEQ ID NO: 90398 - DNA, 103 bp, Artificial Sequence
  Synthetic Polynucleotide
taatacgactcactatagggtgggtgtagaagcagcccttgaagatggggaacagaggagaccccatatgcaagggctgaacctggcggcagcgcaaaagatg

SEQ ID NO: 90399 - DNA, 103 bp, Artificial Sequence
  Synthetic Polynucleotide
taatacgactcactatagggctcggtggggtgggtgtagaagcagcccttaacagaggagaaagggcatgttctacaccaacctggcggcagcgcaaaagatg

SEQ ID NO: 90400 - DNA, 103 bp, Artificial Sequence
  Synthetic Polynucleotide
taatacgactcactataggggcttcagcacctcggtggggtgggtgtagaaacagaggagatctacaatgaccccaccgaacctggcggcagcgcaaaagatg

SEQ ID NO: 90401 - DNA, 103 bp, Artificial Sequence
  Synthetic Polynucleotide
taatacgactcactatagggtggctgacaggcttcagcacctcggtggggaacagaggagaccccacatgggtgctgaaaacctggcggcagcgcaaaagatg

SEQ ID NO: 90402 - DNA, 103 bp, Artificial Sequence
  Synthetic Polynucleotide
taatacgactcactatagggcctggggtgctggctgacaggcttcagcacaacagaggagagtgctgatgcctgtcagcaacctggcggcagcgcaaaagatg

SEQ ID NO: 90403 - DNA, 103 bp, Artificial Sequence
  Synthetic Polynucleotide
taatacgactcactatagggagaagaagtccctggggtgctggctgacagaacagaggagactgtcaatgagcaccccaaacctggcggcagcgcaaaagatg

SEQ ID NO: 90404 - DNA, 103 bp, Artificial Sequence
  Synthetic Polynucleotide
taatacgactcactatagggttaagtctagagaagaagtccctggggtgcaacagaggagagcacccatgggacttcttaacctggcggcagcgcaaaagatg

SEQ ID NO: 90405 - DNA, 103 bp, Artificial Sequence
  Synthetic Polynucleotide
taatacgactcactatagggcaccccatctttaagtctagagaagaagtcaacagaggagagacttcatgtctagacttaacctggcggcagcgcaaaagatg

SEQ ID NO: 90406 - DNA, 103 bp, Artificial Sequence
  Synthetic Polynucleotide
taatacgactcactatagggcgggggagtcctccagcgagatggggttctaacagaggagaagaaccatgtctcgctggaacctggcggcagcgcaaaagatg

SEQ ID NO: 90407 - DNA, 103 bp, Artificial Sequence
  Synthetic Polynucleotide
taatacgactcactataggggccccaatagcaccccatctttaagtctagaacagaggagactagacatgaagatggggaacctggcggcagcgcaaaagatg

SEQ ID NO: 90408 - DNA, 103 bp, Artificial Sequence
  Synthetic Polynucleotide
taatacgactcactatagggttgccaggaggccccaatagcaccccatctaacagaggagaagatggatggctattgggaacctggcggcagcgcaaaagatg

SEQ ID NO: 90409 - DNA, 103 bp, Artificial Sequence
  Synthetic Polynucleotide
taatacgactcactatagggcagcccctctttgccaggaggccccaatagaacagaggagactattgatgcctcctggcaacctggcggcagcgcaaaagatg

SEQ ID NO: 90410 - DNA, 103 bp, Artificial Sequence
  Synthetic Polynucleotide
taatacgactcactatagggctttcactgacagcccctctttgccaggagaacagaggagactcctgatgaagaggggcaacctggcggcagcgcaaaagatg

SEQ ID NO: 90411 - DNA, 103 bp, Artificial Sequence
  Synthetic Polynucleotide
taatacgactcactatagggagctggggctctttcactgacagcccctctaacagaggagaagagggatggtcagtgaaaacctggcggcagcgcaaaagatg

SEQ ID NO: 90412 - DNA, 103 bp, Artificial Sequence
  Synthetic Polynucleotide
taatacgactcactataggggccccacaccagctggggctctttcactgaaacagaggagatcagtgatggagccccagaacctggcggcagcgcaaaagatg

SEQ ID NO: 90413 - DNA, 103 bp, Artificial Sequence
  Synthetic Polynucleotide
taatacgactcactatagggtagcgtctccgccccacaccagctggggctaacagaggagaagccccatgtggtgtgggaacctggcggcagcgcaaaagatg

SEQ ID NO: 90414 - DNA, 103 bp, Artificial Sequence
  Synthetic Polynucleotide
taatacgactcactataggggaagggcggttagcgtctccgccccacaccaacagaggagaggtgtgatgcggagacgcaacctggcggcagcgcaaaagatg

SEQ ID NO: 90415 - DNA, 103 bp, Artificial Sequence
  Synthetic Polynucleotide
taatacgactcactatagggatggaacgcagaagggcggttagcgtctccaacagaggagaggagacatgaaccgccctaacctggcggcagcgcaaaagatg

SEQ ID NO: 90416 - DNA, 103 bp, Artificial Sequence
  Synthetic Polynucleotide
taatacgactcactatagggagccacctttatggaacgcagaagggcggtaacagaggagaaccgccatgctgcgttccaacctggcggcagcgcaaaagatg

SEQ ID NO: 90417 - DNA, 103 bp, Artificial Sequence
  Synthetic Polynucleotide
taatacgactcactatagggccgcctgcctcgggggagtcctccagcgagaacagaggagactcgctatgggactccccaacctggcggcagcgcaaaagatg

SEQ ID NO: 90418 - DNA, 103 bp, Artificial Sequence
  Synthetic Polynucleotide
taatacgactcactatagggccctttctggagccacctttatggaacgcaaacagaggagatgcgttatgtaaaggtggaacctggcggcagcgcaaaagatg

SEQ ID NO: 90419 - DNA, 103 bp, Artificial Sequence
  Synthetic Polynucleotide
taatacgactcactataggggtagaggatgccctttctggagccacctttaacagaggagaaaaggtatgtccagaaagaacctggcggcagcgcaaaagatg

SEQ ID NO: 90420 - DNA, 103 bp, Artificial Sequence
  Synthetic Polynucleotide
taatacgactcactatagggtgggcttggggtagaggatgccctttctggaacagaggagaccagaaatggcatcctctaacctggcggcagcgcaaaagatg

SEQ ID NO: 90421 - DNA, 103 bp, Artificial Sequence
  Synthetic Polynucleotide
taatacgactcactatagggcagcaggctttgggcttggggtagaggatgaacagaggagacatcctatgccccaagccaacctggcggcagcgcaaaagatg

SEQ ID NO: 90422 - DNA, 103 bp, Artificial Sequence
  Synthetic Polynucleotide
taatacgactcactataggggggggacacccagcaggctttgggcttgggaacagaggagacccaagatgaaagcctgcaacctggcggcagcgcaaaagatg

SEQ ID NO: 90423 - DNA, 103 bp, Artificial Sequence
  Synthetic Polynucleotide
taatacgactcactatagggccttggccatgggggacacccagcaggcttaacagaggagaaagcctatggggtgtcccaacctggcggcagcgcaaaagatg

SEQ ID NO: 90424 - DNA, 103 bp, Artificial Sequence
  Synthetic Polynucleotide
taatacgactcactatagggtcggctgggaccttggccatgggggacaccaacagaggagaggtgtcatgcatggccaaaacctggcggcagcgcaaaagatg

SEQ ID NO: 90425 - DNA, 103 bp, Artificial Sequence
  Synthetic Polynucleotide
taatacgactcactatagggcgtggggctctcggctgggaccttggccataacagaggagaatggccatggtcccagccaacctggcggcagcgcaaaagatg

SEQ ID NO: 90426 - DNA, 103 bp, Artificial Sequence
  Synthetic Polynucleotide
taatacgactcactatagggtgggcgggagcgtggggctctcggctgggaaacagaggagatcccagatgagagccccaaacctggcggcagcgcaaaagatg

SEQ ID NO: 90427 - DNA, 103 bp, Artificial Sequence
  Synthetic Polynucleotide
taatacgactcactatagggctggggaaggtgggcgggagcgtggggctcaacagaggagagagcccatggctcccgccaacctggcggcagcgcaaaagatg

SEQ ID NO: 90428 - DNA, 103 bp, Artificial Sequence
  Synthetic Polynucleotide
taatacgactcactatagggctcccgctccccgcctgcctcgggggagtcaacagaggagagactccatggaggcaggcaacctggcggcagcgcaaaagatg

SEQ ID NO: 90429 - DNA, 103 bp, Artificial Sequence
  Synthetic Polynucleotide
taatacgactcactataggggcctgggctactggggaaggtgggcgggagaacagaggagactcccgatgaccttccccaacctggcggcagcgcaaaagatg

SEQ ID NO: 90430 - DNA, 103 bp, Artificial Sequence
  Synthetic Polynucleotide
taatacgactcactatagggtgctgcccaggcctgggctactggggaaggaacagaggagaccttccatggtagcccagaacctggcggcagcgcaaaagatg

SEQ ID NO: 90431 - DNA, 103 bp, Artificial Sequence
  Synthetic Polynucleotide
taatacgactcactatagggaggctgcgcttgctgcccaggcctgggctaaacagaggagatagcccatgcctgggcagaacctggcggcagcgcaaaagatg

SEQ ID NO: 90432 - DNA, 103 bp, Artificial Sequence
  Synthetic Polynucleotide
taatacgactcactatagggctcttcctccaggctgcgcttgctgcccagaacagaggagactgggcatgaagcgcagcaacctggcggcagcgcaaaagatg

SEQ ID NO: 90433 - DNA, 103 bp, Artificial Sequence
  Synthetic Polynucleotide
taatacgactcactataggggggcagcaccctcttcctccaggctgcgctaacagaggagaagcgcaatgtggaggaagaacctggcggcagcgcaaaagatg

SEQ ID NO: 90434 - DNA, 103 bp, Artificial Sequence
  Synthetic Polynucleotide
taatacgactcactatagggttcccactgtgggcagcaccctcttcctccaacagaggagaggaggaatggggtgctgcaacctggcggcagcgcaaaagatg

SEQ ID NO: 90435 - DNA, 103 bp, Artificial Sequence
  Synthetic Polynucleotide
taatacgactcactatagggccgcagtctcttcccactgtgggcagcaccaacagaggagaggtgctatgcacagtgggaacctggcggcagcgcaaaagatg

SEQ ID NO: 90436 - DNA, 103 bp, Artificial Sequence
  Synthetic Polynucleotide
taatacgactcactataggggagacacggcccgcagtctcttcccactgtaacagaggagaacagtgatgagagactgcaacctggcggcagcgcaaaagatg

SEQ ID NO: 90437 - DNA, 103 bp, Artificial Sequence
  Synthetic Polynucleotide
taatacgactcactatagggttaagaaagggagacacggcccgcagtctcaacagaggagagagactatgggccgtgtcaacctggcggcagcgcaaaagatg

SEQ ID NO: 90438 - DNA, 103 bp, Artificial Sequence
  Synthetic Polynucleotide
taatacgactcactatagggatccgcctccttaagaaagggagacacggcaacagaggagagccgtgatgccctttcttaacctggcggcagcgcaaaagatg

SEQ ID NO: 90439 - DNA, 103 bp, Artificial Sequence
  Synthetic Polynucleotide
taatacgactcactatagggcctgctcctcctcccgctccccgcctgcctaacagaggagaaggcagatggggagcgggaacctggcggcagcgcaaaagatg

SEQ ID NO: 90440 - DNA, 103 bp, Artificial Sequence
  Synthetic Polynucleotide
taatacgactcactatagggacttcttggcatccgcctccttaagaaaggaacagaggagacctttcatgaggaggcggaacctggcggcagcgcaaaagatg

SEQ ID NO: 90441 - DNA, 103 bp, Artificial Sequence
  Synthetic Polynucleotide
taatacgactcactatagggttggccccacacttcttggcatccgcctccaacagaggagaggaggcatgtgccaagaaaacctggcggcagcgcaaaagatg

SEQ ID NO: 90442 - DNA, 103 bp, Artificial Sequence
  Synthetic Polynucleotide
taatacgactcactatagggccctgcaggtttggccccacacttcttggcaacagaggagagccaagatgtgtggggccaacctggcggcagcgcaaaagatg

SEQ ID NO: 90443 - DNA, 103 bp, Artificial Sequence
  Synthetic Polynucleotide
taatacgactcactatagggccaggccggaccctgcaggtttggccccacaacagaggagagtggggatgaacctgcagaacctggcggcagcgcaaaagatg

SEQ ID NO: 90444 - DNA, 103 bp, Artificial Sequence
  Synthetic Polynucleotide
taatacgactcactatagggaggcaggagaccaggccggaccctgcaggtaacagaggagaacctgcatggtccggcctaacctggcggcagcgcaaaagatg

SEQ ID NO: 90445 - DNA, 103 bp, Artificial Sequence
  Synthetic Polynucleotide
taatacgactcactatagggtgggcccagaaggcaggagaccaggccggaaacagaggagatccggcatggtctcctgcaacctggcggcagcgcaaaagatg

SEQ ID NO: 90446 - DNA, 103 bp, Artificial Sequence
  Synthetic Polynucleotide
taatacgactcactataggggccccagggctgggcccagaaggcaggagaaacagaggagatctcctatgttctgggccaacctggcggcagcgcaaaagatg

SEQ ID NO: 90447 - DNA, 103 bp, Artificial Sequence
  Synthetic Polynucleotide
taatacgactcactataggggggggcacaggccccagggctgggcccagaaacagaggagatctgggatgagccctgggaacctggcggcagcgcaaaagatg

SEQ ID NO: 90448 - DNA, 103 bp, Artificial Sequence
  Synthetic Polynucleotide
taatacgactcactataggggtaggcctctgggggcacaggccccagggcaacagaggagagccctgatgcctgtgcccaacctggcggcagcgcaaaagatg

SEQ ID NO: 90449 - DNA, 103 bp, Artificial Sequence
  Synthetic Polynucleotide
taatacgactcactatagggtggtgcccctgtaggcctctgggggcacagaacagaggagactgtgcatgcagaggcctaacctggcggcagcgcaaaagatg

SEQ ID NO: 90450 - DNA, 103 bp, Artificial Sequence
  Synthetic Polynucleotide
taatacgactcactatagggtcctcccgctcctgctcctcctcccgctccaacagaggagaggagcgatgggaggagcaaacctggcggcagcgcaaaagatg

SEQ ID NO: 90451 - DNA, 103 bp, Artificial Sequence
  Synthetic Polynucleotide
taatacgactcactatagggcagtgcagcatggtgcccctgtaggcctctaacagaggagaagaggcatgcaggggcacaacctggcggcagcgcaaaagatg

SEQ ID NO: 90452 - DNA, 103 bp, Artificial Sequence
  Synthetic Polynucleotide
taatacgactcactataggggttcagcgggcagtgcagcatggtgcccctaacagaggagaaggggcatgatgctgcacaacctggcggcagcgcaaaagatg

SEQ ID NO: 90453 - DNA, 103 bp, Artificial Sequence
  Synthetic Polynucleotide
taatacgactcactatagggtgccagtgaagttcagcgggcagtgcagcaaacagaggagatgctgcatggcccgctgaaacctggcggcagcgcaaaagatg

SEQ ID NO: 90454 - DNA, 103 bp, Artificial Sequence
  Synthetic Polynucleotide
taatacgactcactataggggggcccggggtgccagtgaagttcagcgggaacagaggagacccgctatgcttcactggaacctggcggcagcgcaaaagatg

SEQ ID NO: 90455 - DNA, 103 bp, Artificial Sequence
  Synthetic Polynucleotide
taatacgactcactataggggcccttcaaggggcccggggtgccagtgaaaacagaggagattcactatgaccccgggcaacctggcggcagcgcaaaagatg

SEQ ID NO: 90456 - DNA, 103 bp, Artificial Sequence
  Synthetic Polynucleotide
taatacgactcactataggggtgcagcctggcccttcaaggggcccggggaacagaggagaccccggatgccttgaaggaacctggcggcagcgcaaaagatg

SEQ ID NO: 90457 - DNA, 103 bp, Artificial Sequence
  Synthetic Polynucleotide
taatacgactcactatagggctgaaggggagtgcagcctggcccttcaagaacagaggagacttgaaatgccaggctgcaacctggcggcagcgcaaaagatg

SEQ ID NO: 90458 - DNA, 103 bp, Artificial Sequence
  Synthetic Polynucleotide
taatacgactcactataggggaccagggggctgaaggggagtgcagcctgaacagaggagacaggctatgctccccttcaacctggcggcagcgcaaaagatg

SEQ ID NO: 90459 - DNA, 103 bp, Artificial Sequence
  Synthetic Polynucleotide
taatacgactcactatagggaggccgggatgaccagggggctgaaggggaaacagaggagatcccctatggccccctggaacctggcggcagcgcaaaagatg

SEQ ID NO: 90460 - DNA, 103 bp, Artificial Sequence
  Synthetic Polynucleotide
taatacgactcactatagggtgggccgggaaggccgggatgaccagggggaacagaggagaccccctatgcatcccggcaacctggcggcagcgcaaaagatg

SEQ ID NO: 90461 - DNA, 103 bp, Artificial Sequence
  Synthetic Polynucleotide
taatacgactcactatagggggcctgctcctcctcccgctcctgctcctcaacagaggagagaggagatggagcgggagaacctggcggcagcgcaaaagatg

SEQ ID NO: 90462 - DNA, 103 bp, Artificial Sequence
  Synthetic Polynucleotide
taatacgactcactatagggggccaggaagtgggccgggaaggccgggataacagaggagaatcccgatgttcccggccaacctggcggcagcgcaaaagatg

SEQ ID NO: 90463 - DNA, 103 bp, Artificial Sequence
  Synthetic Polynucleotide
taatacgactcactatagggggcctgcggtggccaggaagtgggccgggaaacagaggagatcccggatgacttcctggaacctggcggcagcgcaaaagatg

SEQ ID NO: 90464 - DNA, 103 bp, Artificial Sequence
  Synthetic Polynucleotide
taatacgactcactatagggatgggcgaggggcctgcggtggccaggaagaacagaggagacttcctatgcaccgcaggaacctggcggcagcgcaaaagatg

SEQ ID NO: 90465 - DNA, 103 bp, Artificial Sequence
  Synthetic Polynucleotide
taatacgactcactataggggccagcggccatgggcgaggggcctgcggtaacagaggagaaccgcaatgccctcgcccaacctggcggcagcgcaaaagatg

SEQ ID NO: 90466 - DNA, 103 bp, Artificial Sequence
  Synthetic Polynucleotide
taatacgactcactatagggagtgcatcaggccagcggccatgggcgaggaacagaggagacctcgcatgtggccgctgaacctggcggcagcgcaaaagatg

SEQ ID NO: 90467 - DNA, 103 bp, Artificial Sequence
  Synthetic Polynucleotide
taatacgactcactataggggttggggggaagtgcatcaggccagcggccaacagaggagaggccgcatgcctgatgcaaacctggcggcagcgcaaaagatg

SEQ ID NO: 90468 - DNA, 103 bp, Artificial Sequence
  Synthetic Polynucleotide
taatacgactcactataggggtcgaaggacgttggggggaagtgcatcagaacagaggagactgatgatgttccccccaaacctggcggcagcgcaaaagatg

SEQ ID NO: 90469 - DNA, 103 bp, Artificial Sequence
  Synthetic Polynucleotide
taatacgactcactatagggggagggcactgtcgaaggacgttggggggaaacagaggagatcccccatgcgtccttcgaacctggcggcagcgcaaaagatg

SEQ ID NO: 90470 - DNA, 103 bp, Artificial Sequence
  Synthetic Polynucleotide
taatacgactcactatagggagtctgtggcggagggcactgtcgaaggacaacagaggagagtccttatgcagtgccctaacctggcggcagcgcaaaagatg

SEQ ID NO: 90471 - DNA, 103 bp, Artificial Sequence
  Synthetic Polynucleotide
taatacgactcactatagggggccgggcaaagtctgtggcggagggcactaacagaggagaagtgccatgcgccacagaaacctggcggcagcgcaaaagatg

SEQ ID NO: 90472 - DNA, 103 bp, Artificial Sequence
  Synthetic Polynucleotide
taatacgactcactatagggtgaccaggaaggcctgctcctcctcccgctaacagaggagaagcgggatgaggagcaggaacctggcggcagcgcaaaagatg

SEQ ID NO: 90473 - DNA, 103 bp, Artificial Sequence
  Synthetic Polynucleotide
taatacgactcactatagggaggcagatgaggccgggcaaagtctgtggcaacagaggagagccacaatgtttgcccggaacctggcggcagcgcaaaagatg

SEQ ID NO: 90474 - DNA, 103 bp, Artificial Sequence
  Synthetic Polynucleotide
taatacgactcactatagggggtgcgtgccaggcagatgaggccgggcaaaacagaggagattgcccatgctcatctgcaacctggcggcagcgcaaaagatg

SEQ ID NO: 90475 - DNA, 103 bp, Artificial Sequence
  Synthetic Polynucleotide
taatacgactcactatagggtgtgactggtggtgcgtgccaggcagatgaaacagaggagatcatctatgtggcacgcaaacctggcggcagcgcaaaagatg

SEQ ID NO: 90476 - DNA, 103 bp, Artificial Sequence
  Synthetic Polynucleotide
taatacgactcactatagggctgcataggttgtgactggtggtgcgtgccaacagaggagaggcacgatgcaccagtcaaacctggcggcagcgcaaaagatg

SEQ ID NO: 90477 - DNA, 103 bp, Artificial Sequence
  Synthetic Polynucleotide
taatacgactcactatagggaagtggggcgctgcataggttgtgactggtaacagaggagaaccagtatgaacctatgcaacctggcggcagcgcaaaagatg

SEQ ID NO: 90478 - DNA, 103 bp, Artificial Sequence
  Synthetic Polynucleotide
taatacgactcactataggggaggtggaagaagtggggcgctgcataggtaacagaggagaacctatatggcgccccacaacctggcggcagcgcaaaagatg

SEQ ID NO: 90479 - DNA, 103 bp, Artificial Sequence
  Synthetic Polynucleotide
taatacgactcactataggggcttggtgttgaggtggaagaagtggggcgaacagaggagacgccccatgtcttccaccaacctggcggcagcgcaaaagatg

SEQ ID NO: 90480 - DNA, 103 bp, Artificial Sequence
  Synthetic Polynucleotide
taatacgactcactatagggttgtagaggctgaccaggaaggcctgctccaacagaggagaggagcaatgcttcctggtaacctggcggcagcgcaaaagatg

SEQ ID NO: 90481 - DNA, 103 bp, Artificial Sequence
  Synthetic Polynucleotide
taatacgactcactatagggcttcatgaacttgtagaggctgaccaggaaaacagaggagattcctgatgagcctctacaacctggcggcagcgcaaaagatg

SEQ ID NO: 90482 - DNA, 103 bp, Artificial Sequence
  Synthetic Polynucleotide
taatacgactcactatagggccgtggactgcttcctgttccctttgacagaacagaggagactgtcaatgggaacaggaaacctggcggcagcgcaaaagatg

SEQ ID NO: 90483 - DNA, 103 bp, Artificial Sequence
  Synthetic Polynucleotide
taatacgactcactatagggtgtgtcgctccttcatgaacttgtagaggcaacagaggagagcctctatgagttcatgaaacctggcggcagcgcaaaagatg

SEQ ID NO: 90484 - DNA, 103 bp, Artificial Sequence
  Synthetic Polynucleotide
taatacgactcactatagggtcgatgggcgtgtgtcgctccttcatgaacaacagaggagagttcatatgggagcgacaaacctggcggcagcgcaaaagatg

SEQ ID NO: 90485 - DNA, 103 bp, Artificial Sequence
  Synthetic Polynucleotide
taatacgactcactataggggggcaccctctcgatgggcgtgtgtcgctcaacagaggagagagcgaatgacgcccatcaacctggcggcagcgcaaaagatg

SEQ ID NO: 90486 - DNA, 103 bp, Artificial Sequence
  Synthetic Polynucleotide
taatacgactcactatagggagccgagatggggcaccctctcgatgggcgaacagaggagacgcccaatgagagggtgcaacctggcggcagcgcaaaagatg

SEQ ID NO: 90487 - DNA, 103 bp, Artificial Sequence
  Synthetic Polynucleotide
taatacgactcactatagggatctgcttgaagccgagatggggcaccctcaacagaggagagagggtatgccatctcggaacctggcggcagcgcaaaagatg

SEQ ID NO: 90488 - DNA, 103 bp, Artificial Sequence
  Synthetic Polynucleotide
taatacgactcactatagggccacaggttaatctgcttgaagccgagatgaacagaggagacatctcatgttcaagcagaacctggcggcagcgcaaaagatg

SEQ ID NO: 90489 - DNA, 103 bp, Artificial Sequence
  Synthetic Polynucleotide
taatacgactcactatagggtgtagatcttccacaggttaatctgcttgaaacagaggagatcaagcatgttaacctgtaacctggcggcagcgcaaaagatg

SEQ ID NO: 90490 - DNA, 103 bp, Artificial Sequence
  Synthetic Polynucleotide
taatacgactcactatagggtccactgctttgtagatcttccacaggttaaacagaggagataacctatggaagatctaaacctggcggcagcgcaaaagatg

SEQ ID NO: 90491 - DNA, 103 bp, Artificial Sequence
  Synthetic Polynucleotide
taatacgactcactatagggccccagcttctccactgctttgtagatcttaacagaggagaaagatcatgaaagcagtgaacctggcggcagcgcaaaagatg

SEQ ID NO: 90492 - DNA, 103 bp, Artificial Sequence
  Synthetic Polynucleotide
taatacgactcactataggggctcataggcccccagcttctccactgcttaacagaggagaaagcagatgagaagctggaacctggcggcagcgcaaaagatg

SEQ ID NO: 90493 - DNA, 103 bp, Artificial Sequence
  Synthetic Polynucleotide
taatacgactcactataggggcgtcaccctccgtggactgcttcctgttcaacagaggagagaacagatggcagtccacaacctggcggcagcgcaaaagatg

SEQ ID NO: 90494 - DNA, 103 bp, Artificial Sequence
  Synthetic Polynucleotide
taatacgactcactatagggccggtcaccagctcataggcccccagcttcaacagaggagagaagctatgggcctatgaaacctggcggcagcgcaaaagatg

SEQ ID NO: 90495 - DNA, 103 bp, Artificial Sequence
  Synthetic Polynucleotide
taatacgactcactataggggaggcggcgcccggtcaccagctcataggcaacagaggagagcctatatgctggtgaccaacctggcggcagcgcaaaagatg

SEQ ID NO: 90496 - DNA, 103 bp, Artificial Sequence
  Synthetic Polynucleotide
taatacgactcactatagggcgttcttccagaggcggcgcccggtcaccaaacagaggagatggtgaatgggcgccgccaacctggcggcagcgcaaaagatg

SEQ ID NO: 90497 - DNA, 103 bp, Artificial Sequence
  Synthetic Polynucleotide
taatacgactcactatagggtcgtcgtacacgttcttccagaggcggcgcaacagaggagagcgccgatgctggaagaaaacctggcggcagcgcaaaagatg

SEQ ID NO: 90498 - DNA, 103 bp, Artificial Sequence
  Synthetic Polynucleotide
taatacgactcactataggggccccccagctcgtcgtacacgttcttccaaacagaggagatggaagatggtgtacgacaacctggcggcagcgcaaaagatg

SEQ ID NO: 90499 - DNA, 103 bp, Artificial Sequence
  Synthetic Polynucleotide
taatacgactcactatagggtgcctgggctgccccccagctcgtcgtacaaacagaggagatgtacgatgagctgggggaacctggcggcagcgcaaaagatg

SEQ ID NO: 90500 - DNA, 103 bp, Artificial Sequence
  Synthetic Polynucleotide
taatacgactcactataggggcgctggtgctgcctgggctgccccccagcaacagaggagagctgggatgcagcccaggaacctggcggcagcgcaaaagatg

SEQ ID NO: 90501 - DNA, 103 bp, Artificial Sequence
  Synthetic Polynucleotide
taatacgactcactataggggcacgtggccgcgctggtgctgcctgggctaacagaggagaagcccaatgagcaccagcaacctggcggcagcgcaaaagatg

SEQ ID NO: 90502 - DNA, 103 bp, Artificial Sequence
  Synthetic Polynucleotide
taatacgactcactatagggggcggcgcgtgcacgtggccgcgctggtgcaacagaggagagcaccaatgcggccacgtaacctggcggcagcgcaaaagatg

SEQ ID NO: 90503 - DNA, 103 bp, Artificial Sequence
  Synthetic Polynucleotide
taatacgactcactatagggctctcgtagtggcggcgcgtgcacgtggccaacagaggagaggccacatgcacgcgccgaacctggcggcagcgcaaaagatg

SEQ ID NO: 90504 - DNA, 103 bp, Artificial Sequence
  Synthetic Polynucleotide
taatacgactcactatagggtgggtctagggcgtcaccctccgtggactgaacagaggagacagtccatggagggtgacaacctggcggcagcgcaaaagatg

SEQ ID NO: 90505 - DNA, 103 bp, Artificial Sequence
  Synthetic Polynucleotide
taatacgactcactatagggcaggaccagcctctcgtagtggcggcgcgtaacagaggagaacgcgcatgcactacgagaacctggcggcagcgcaaaagatg

SEQ ID NO: 90506 - DNA, 103 bp, Artificial Sequence
  Synthetic Polynucleotide
taatacgactcactataggggcacgtatggcaggaccagcctctcgtagtaacagaggagaactacgatgggctggtccaacctggcggcagcgcaaaagatg

SEQ ID NO: 90507 - DNA, 103 bp, Artificial Sequence
  Synthetic Polynucleotide
taatacgactcactatagggttcaggtgccgcacgtatggcaggaccagcaacagaggagagctggtatggccatacgtaacctggcggcagcgcaaaagatg

SEQ ID NO: 90508 - DNA, 103 bp, Artificial Sequence
  Synthetic Polynucleotide
taatacgactcactatagggatcctcccccttcaggtgccgcacgtatggaacagaggagaccatacatgcggcacctgaacctggcggcagcgcaaaagatg

SEQ ID NO: 90509 - DNA, 103 bp, Artificial Sequence
  Synthetic Polynucleotide
taatacgactcactataggggcggcttgtcatcctcccccttcaggtgccaacagaggagaggcaccatgagggggaggaacctggcggcagcgcaaaagatg

SEQ ID NO: 90510 - DNA, 103 bp, Artificial Sequence
  Synthetic Polynucleotide
taatacgactcactataggggaggtgggcagcggcttgtcatcctcccccaacagaggagagggggaatgtgacaagccaacctggcggcagcgcaaaagatg

SEQ ID NO: 90511 - DNA, 103 bp, Artificial Sequence
  Synthetic Polynucleotide
taatacgactcactatagggcctgggcttggaggtgggcagcggcttgtcaacagaggagagacaagatgctgcccaccaacctggcggcagcgcaaaagatg

SEQ ID NO: 90512 - DNA, 103 bp, Artificial Sequence
  Synthetic Polynucleotide
taatacgactcactatagggtgtactgtttcctgggcttggaggtgggcaaacagaggagatgcccaatgccaagcccaaacctggcggcagcgcaaaagatg

SEQ ID NO: 90513 - DNA, 103 bp, Artificial Sequence
  Synthetic Polynucleotide
taatacgactcactatagggttagccatcttgtactgtttcctgggcttgaacagaggagacaagccatggaaacagtaaacctggcggcagcgcaaaagatg

SEQ ID NO: 90514 - DNA, 103 bp, Artificial Sequence
  Synthetic Polynucleotide
taatacgactcactatagggcctgttctccttagccatcttgtactgtttaacagaggagaaaacagatgaagatggctaacctggcggcagcgcaaaagatg

SEQ ID NO: 90515 - DNA, 103 bp, Artificial Sequence
  Synthetic Polynucleotide
taatacgactcactataggggggatgcaggtgggtctagggcgtcaccctaacagaggagaagggtgatgccctagaccaacctggcggcagcgcaaaagatg

SEQ ID NO: 90516 - DNA, 103 bp, Artificial Sequence
  Synthetic Polynucleotide
taatacgactcactatagggcatcatcccccctgttctccttagccatctaacagaggagaagatggatgaggagaacaaacctggcggcagcgcaaaagatg

SEQ ID NO: 90517 - DNA, 103 bp, Artificial Sequence
  Synthetic Polynucleotide
taatacgactcactatagggtcggtggccccatcatcccccctgttctccaacagaggagaggagaaatggggggatgaaacctggcggcagcgcaaaagatg

SEQ ID NO: 90518 - DNA, 103 bp, Artificial Sequence
  Synthetic Polynucleotide
taatacgactcactatagggcttcggcctctcggtggccccatcatccccaacagaggagaggggatatgggggccaccaacctggcggcagcgcaaaagatg

SEQ ID NO: 90519 - DNA, 103 bp, Artificial Sequence
  Synthetic Polynucleotide
taatacgactcactatagggccttggccttcttcggcctctcggtggcccaacagaggagagggccaatgagaggccgaaacctggcggcagcgcaaaagatg

SEQ ID NO: 90520 - DNA, 103 bp, Artificial Sequence
  Synthetic Polynucleotide
taatacgactcactatagggcgccgctcctccttggccttcttcggcctcaacagaggagagaggccatggaaggccaaaacctggcggcagcgcaaaagatg

SEQ ID NO: 90521 - DNA, 103 bp, Artificial Sequence
  Synthetic Polynucleotide
taatacgactcactatagggctggtccatgcgccgctcctccttggccttaacagaggagaaaggccatggaggagcggaacctggcggcagcgcaaaagatg

SEQ ID NO: 90522 - DNA, 103 bp, Artificial Sequence
  Synthetic Polynucleotide
taatacgactcactatagggctggcatcatctggtccatgcgccgctcctaacagaggagaaggagcatggcatggaccaacctggcggcagcgcaaaagatg

SEQ ID NO: 90523 - DNA, 103 bp, Artificial Sequence
  Synthetic Polynucleotide
taatacgactcactatagggttggtctttcctggcatcatctggtccatgaacagaggagacatggaatggatgatgccaacctggcggcagcgcaaaagatg

SEQ ID NO: 90524 - DNA, 103 bp, Artificial Sequence
  Synthetic Polynucleotide
taatacgactcactatagggagcatctgctttggtctttcctggcatcataacagaggagaatgatgatgggaaagaccaacctggcggcagcgcaaaagatg

SEQ ID NO: 90525 - DNA, 103 bp, Artificial Sequence
  Synthetic Polynucleotide
taatacgactcactatagggctgggtcagcagcatctgctttggtctttcaacagaggagagaaagaatgaagcagatgaacctggcggcagcgcaaaagatg

SEQ ID NO: 90526 - DNA, 103 bp, Artificial Sequence
  Synthetic Polynucleotide
taatacgactcactataggggcaggtttgggggatgcaggtgggtctaggaacagaggagacctagaatgacctgcatcaacctggcggcagcgcaaaagatg

SEQ ID NO: 90527 - DNA, 103 bp, Artificial Sequence
  Synthetic Polynucleotide
taatacgactcactatagggggaagtggtgctgggtcagcagcatctgctaacagaggagaagcagaatgtgctgacccaacctggcggcagcgcaaaagatg

SEQ ID NO: 90528 - DNA, 103 bp, Artificial Sequence
  Synthetic Polynucleotide
taatacgactcactatagggctcctggctgggaagtggtgctgggtcagcaacagaggagagctgacatggcaccacttaacctggcggcagcgcaaaagatg

SEQ ID NO: 90529 - DNA, 103 bp, Artificial Sequence
  Synthetic Polynucleotide
taatacgactcactatagggtcctggggggctcctggctgggaagtggtgaacagaggagacaccacatgccagccaggaacctggcggcagcgcaaaagatg

SEQ ID NO: 90530 - DNA, 103 bp, Artificial Sequence
  Synthetic Polynucleotide
taatacgactcactatagggtctgtgctgttcctggggggctcctggctgaacagaggagacagccaatggccccccagaacctggcggcagcgcaaaagatg

SEQ ID NO: 90531 - DNA, 103 bp, Artificial Sequence
  Synthetic Polynucleotide
taatacgactcactataggggccctgctgttctgtgctgttcctggggggaacagaggagaccccccatgaacagcacaaacctggcggcagcgcaaaagatg

SEQ ID NO: 90532 - DNA, 103 bp, Artificial Sequence
  Synthetic Polynucleotide
taatacgactcactatagggcagaggccaggccctgctgttctgtgctgtaacagaggagaacagcaatgaacagcaggaacctggcggcagcgcaaaagatg

SEQ ID NO: 90533 - DNA, 103 bp, Artificial Sequence
  Synthetic Polynucleotide
taatacgactcactatagggacagaagacccagaggccaggccctgctgtaacagaggagaacagcaatgcctggcctcaacctggcggcagcgcaaaagatg

SEQ ID NO: 90534 - DNA, 103 bp, Artificial Sequence
  Synthetic Polynucleotide
taatacgactcactatagggcacaaaggacacagaagacccagaggccagaacagaggagactggccatggggtcttctaacctggcggcagcgcaaaagatg

SEQ ID NO: 90535 - DNA, 103 bp, Artificial Sequence
  Synthetic Polynucleotide
taatacgactcactatagggcgctggcacccacaaaggacacagaagaccaacagaggagaggtcttatgtgtcctttgaacctggcggcagcgcaaaagatg

SEQ ID NO: 90536 - DNA, 103 bp, Artificial Sequence
  Synthetic Polynucleotide
taatacgactcactatagggtcaggacagccgctggcacccacaaaggacaacagaggagagtccttatggggtgccagaacctggcggcagcgcaaaagatg

SEQ ID NO: 90537 - DNA, 103 bp, Artificial Sequence
  Synthetic Polynucleotide
taatacgactcactatagggctgcttgccagcaggtttgggggatgcaggaacagaggagacctgcaatgcccaaacctaacctggcggcagcgcaaaagatg

SEQ ID NO: 90538 - DNA, 103 bp, Artificial Sequence
  Synthetic Polynucleotide
taatacgactcactatagggcttgtaggcctcaggacagccgctggcaccaacagaggagaggtgccatgggctgtcctaacctggcggcagcgcaaaagatg

SEQ ID NO: 90539 - DNA, 103 bp, Artificial Sequence
  Synthetic Polynucleotide
taatacgactcactatagggataggagccgcttgtaggcctcaggacagcaacagaggagagctgtcatgaggcctacaaacctggcggcagcgcaaaagatg

SEQ ID NO: 90540 - DNA, 103 bp, Artificial Sequence
  Synthetic Polynucleotide
taatacgactcactatagggtagaagctggataggagccgcttgtaggccaacagaggagaggcctaatggcggctcctaacctggcggcagcgcaaaagatg

SEQ ID NO: 90541 - DNA, 103 bp, Artificial Sequence
  Synthetic Polynucleotide
taatacgactcactatagggccccttgcagtagaagctggataggagccgaacagaggagacggctcatgtccagcttcaacctggcggcagcgcaaaagatg

SEQ ID NO: 90542 - DNA, 103 bp, Artificial Sequence
  Synthetic Polynucleotide
taatacgactcactatagggtgccgtgtgtccccttgcagtagaagctggaacagaggagaccagctatgactgcaaggaacctggcggcagcgcaaaagatg

SEQ ID NO: 90543 - DNA, 103 bp, Artificial Sequence
  Synthetic Polynucleotide
taatacgactcactatagggggtgacatgatgccgtgtgtccccttgcagaacagaggagactgcaaatggacacacggaacctggcggcagcgcaaaagatg

SEQ ID NO: 90544 - DNA, 103 bp, Artificial Sequence
  Synthetic Polynucleotide
taatacgactcactatagggtttggccagtggtgacatgatgccgtgtgtaacagaggagaacacacatgatcatgtcaaacctggcggcagcgcaaaagatg

SEQ ID NO: 90545 - DNA, 103 bp, Artificial Sequence
  Synthetic Polynucleotide
taatacgactcactatagggggagcttctttttggccagtggtgacatgaaacagaggagatcatgtatgcactggccaaacctggcggcagcgcaaaagatg

SEQ ID NO: 90546 - DNA, 103 bp, Artificial Sequence
  Synthetic Polynucleotide
taatacgactcactatagggacctgggccaggagcttctttttggccagtaacagaggagaactggcatgaaagaagctaacctggcggcagcgcaaaagatg

SEQ ID NO: 90547 - DNA, 103 bp, Artificial Sequence
  Synthetic Polynucleotide
taatacgactcactatagggcaccttgctcacctgggccaggagcttcttaacagaggagaaagaagatgctggcccagaacctggcggcagcgcaaaagatg

SEQ ID NO: 90548 - DNA, 103 bp, Artificial Sequence
  Synthetic Polynucleotide
taatacgactcactatagggggattccgttctgcttgccagcaggtttggaacagaggagaccaaacatgctggcaagcaacctggcggcagcgcaaaagatg

SEQ ID NO: 90549 - DNA, 103 bp, Artificial Sequence
  Synthetic Polynucleotide
taatacgactcactataggggcaaggcctccaccttgctcacctgggccaaacagaggagatggcccatgtgagcaaggaacctggcggcagcgcaaaagatg

SEQ ID NO: 90550 - DNA, 103 bp, Artificial Sequence
  Synthetic Polynucleotide
taatacgactcactatagggtcctggcactgcaaggcctccaccttgctcaacagaggagagagcaaatgggaggccttaacctggcggcagcgcaaaagatg

SEQ ID NO: 90551 - DNA, 103 bp, Artificial Sequence
  Synthetic Polynucleotide
taatacgactcactataggggcagccctcctcctggcactgcaaggcctcaacagaggagagaggccatgcagtgccagaacctggcggcagcgcaaaagatg

SEQ ID NO: 90552 - DNA, 103 bp, Artificial Sequence
  Synthetic Polynucleotide
taatacgactcactatagggccccatggcggcagccctcctcctggcactaacagaggagaagtgccatgaggagggctaacctggcggcagcgcaaaagatg

SEQ ID NO: 90553 - DNA, 103 bp, Artificial Sequence
  Synthetic Polynucleotide
taatacgactcactatagggtggggctctgccccatggcggcagccctccaacagaggagaggagggatgccgccatggaacctggcggcagcgcaaaagatg

SEQ ID NO: 90554 - DNA, 103 bp, Artificial Sequence
  Synthetic Polynucleotide
taatacgactcactatagggtggggacgcctggggctctgccccatggcgaacagaggagacgccatatggcagagcccaacctggcggcagcgcaaaagatg

SEQ ID NO: 90555 - DNA, 103 bp, Artificial Sequence
  Synthetic Polynucleotide
taatacgactcactatagggggtgaacagctggggacgcctggggctctgaacagaggagacagagcatgaggcgtcccaacctggcggcagcgcaaaagatg

SEQ ID NO: 90556 - DNA, 103 bp, Artificial Sequence
  Synthetic Polynucleotide
taatacgactcactatagggctctctgggaggtgaacagctggggacgccaacagaggagaggcgtcatgagctgttcaaacctggcggcagcgcaaaagatg

SEQ ID NO: 90557 - DNA, 103 bp, Artificial Sequence
  Synthetic Polynucleotide
taatacgactcactataggggctctggggactctctgggaggtgaacagcaacagaggagagctgttatgctcccagagaacctggcggcagcgcaaaagatg

SEQ ID NO: 90558 - DNA, 103 bp, Artificial Sequence
  Synthetic Polynucleotide
taatacgactcactataggggccctttggggctctggggactctctgggaaacagaggagatcccagatggtccccagaaacctggcggcagcgcaaaagatg

SEQ ID NO: 90559 - DNA, 103 bp, Artificial Sequence
  Synthetic Polynucleotide
taatacgactcactatagggatggggttctggattccgttctgcttgccaaacagaggagatggcaaatggaacggaataacctggcggcagcgcaaaagatg

SEQ ID NO: 90560 - DNA, 103 bp, Artificial Sequence
  Synthetic Polynucleotide
taatacgactcactatagggttctcagtcagccctttggggctctggggaaacagaggagatccccaatgccccaaaggaacctggcggcagcgcaaaagatg

SEQ ID NO: 90561 - DNA, 103 bp, Artificial Sequence
  Synthetic Polynucleotide
taatacgactcactataggggtgcctggagttctcagtcagccctttgggaacagaggagacccaaaatgctgactgagaacctggcggcagcgcaaaagatg

SEQ ID NO: 90562 - DNA, 103 bp, Artificial Sequence
  Synthetic Polynucleotide
taatacgactcactataggggggtcagccggtgcctggagttctcagtcaaacagaggagatgactgatgactccaggcaacctggcggcagcgcaaaagatg

SEQ ID NO: 90563 - DNA, 103 bp, Artificial Sequence
  Synthetic Polynucleotide
taatacgactcactatagggccctcctgaggggtcagccggtgcctggagaacagaggagactccagatgccggctgacaacctggcggcagcgcaaaagatg

SEQ ID NO: 90564 - DNA, 103 bp, Artificial Sequence
  Synthetic Polynucleotide
taatacgactcactatagggggcctgcaatccctcctgaggggtcagccgaacagaggagacggctgatgcctcaggagaacctggcggcagcgcaaaagatg

SEQ ID NO: 90565 - DNA, 103 bp, Artificial Sequence
  Synthetic Polynucleotide
taatacgactcactatagggtgccacctggggcctgcaatccctcctgagaacagaggagactcaggatggattgcaggaacctggcggcagcgcaaaagatg

SEQ ID NO: 90566 - DNA, 103 bp, Artificial Sequence
  Synthetic Polynucleotide
taatacgactcactatagggtctctgaggctgccacctggggcctgcaataacagaggagaattgcaatgcccaggtggaacctggcggcagcgcaaaagatg

SEQ ID NO: 90567 - DNA, 103 bp, Artificial Sequence
  Synthetic Polynucleotide
taatacgactcactatagggctgcgcctcctctctgaggctgccacctggaacagaggagaccaggtatgagcctcagaaacctggcggcagcgcaaaagatg

SEQ ID NO: 90568 - DNA, 103 bp, Artificial Sequence
  Synthetic Polynucleotide
taatacgactcactatagggaggggcctgcctgcgcctcctctctgaggcaacagaggagagcctcaatgaggaggcgcaacctggcggcagcgcaaaagatg

SEQ ID NO: 90569 - DNA, 103 bp, Artificial Sequence
  Synthetic Polynucleotide
taatacgactcactataggggctgccgggcaggggcctgcctgcgcctccaacagaggagaggaggcatgggcaggcccaacctggcggcagcgcaaaagatg

SEQ ID NO: 90570 - DNA, 103 bp, Artificial Sequence
  Synthetic Polynucleotide
taatacgactcactataggggccgacccactggagtgagttgggctccataacagaggagaatggagatgaactcactcaacctggcggcagcgcaaaagatg

SEQ ID NO: 90571 - DNA, 103 bp, Artificial Sequence
  Synthetic Polynucleotide
taatacgactcactataggggtcgccaagggacaaaattcttggtttgccaacagaggagaggcaaaatgagaattttgaacctggcggcagcgcaaaagatg

SEQ ID NO: 90572 - DNA, 103 bp, Artificial Sequence
  Synthetic Polynucleotide
taatacgactcactatagggttctatcggcgttttcctttctttcatgtaaacagaggagatacatgatggaaaggaaaaacctggcggcagcgcaaaagatg

SEQ ID NO: 90573 - DNA, 103 bp, Artificial Sequence
  Synthetic Polynucleotide
taatacgactcactatagggagggtattcgttctatcggcgttttcctttaacagaggagaaaaggaatgcgccgatagaacctggcggcagcgcaaaagatg

SEQ ID NO: 90574 - DNA, 103 bp, Artificial Sequence
  Synthetic Polynucleotide
taatacgactcactatagggaaacctaaatagggtattcgttctatcggcaacagaggagagccgatatgacgaataccaacctggcggcagcgcaaaagatg

SEQ ID NO: 90575 - DNA, 103 bp, Artificial Sequence
  Synthetic Polynucleotide
taatacgactcactatagggaatctgtttaaaacctaaatagggtattcgaacagaggagacgaataatgtatttaggtaacctggcggcagcgcaaaagatg

SEQ ID NO: 90576 - DNA, 103 bp, Artificial Sequence
  Synthetic Polynucleotide
taatacgactcactatagggtccaaaggttaatctgtttaaaacctaaataacagaggagaatttagatgttaaacagaaacctggcggcagcgcaaaagatg

SEQ ID NO: 90577 - DNA, 103 bp, Artificial Sequence
  Synthetic Polynucleotide
taatacgactcactatagggtgaaacatagtccaaaggttaatctgtttaaacagaggagataaacaatgtaacctttgaacctggcggcagcgcaaaagatg

SEQ ID NO: 90578 - DNA, 103 bp, Artificial Sequence
  Synthetic Polynucleotide
taatacgactcactatagggttgagcagcttgaaacatagtccaaaggttaacagaggagaaaccttatgactatgtttaacctggcggcagcgcaaaagatg

SEQ ID NO: 90579 - DNA, 103 bp, Artificial Sequence
  Synthetic Polynucleotide
taatacgactcactatagggctcccagtttttgagcagcttgaaacatagaacagaggagactatgtatgaagctgctcaacctggcggcagcgcaaaagatg

SEQ ID NO: 90580 - DNA, 103 bp, Artificial Sequence
  Synthetic Polynucleotide
taatacgactcactataggggtttcatatcctcccagtttttgagcagctaacagaggagaagctgcatgaaaactgggaacctggcggcagcgcaaaagatg

SEQ ID NO: 90581 - DNA, 103 bp, Artificial Sequence
  Synthetic Polynucleotide
taatacgactcactatagggggctgttattgtttcatatcctcccagtttaacagaggagaaaactgatgggatatgaaaacctggcggcagcgcaaaagatg

SEQ ID NO: 90582 - DNA, 103 bp, Artificial Sequence
  Synthetic Polynucleotide
taatacgactcactatagggcaaagaaaaagtcgccaagggacaaaattcaacagaggagagaatttatgcccttggcgaacctggcggcagcgcaaaagatg

SEQ ID NO: 90583 - DNA, 103 bp, Artificial Sequence
  Synthetic Polynucleotide
taatacgactcactatagggactgacggcgggctgttattgtttcatatcaacagaggagagatatgatgcaataacagaacctggcggcagcgcaaaagatg

SEQ ID NO: 90584 - DNA, 103 bp, Artificial Sequence
  Synthetic Polynucleotide
taatacgactcactatagggatatgtttccactgacggcgggctgttattaacagaggagaaataacatgccgccgtcaaacctggcggcagcgcaaaagatg

SEQ ID NO: 90585 - DNA, 103 bp, Artificial Sequence
  Synthetic Polynucleotide
taatacgactcactatagggttcatcataaatatgtttccactgacggcgaacagaggagacgccgtatgtggaaacataacctggcggcagcgcaaaagatg

SEQ ID NO: 90586 - DNA, 103 bp, Artificial Sequence
  Synthetic Polynucleotide
taatacgactcactatagggtaccgcctaattcatcataaatatgtttccaacagaggagaggaaacatgtttatgatgaacctggcggcagcgcaaaagatg

SEQ ID NO: 90587 - DNA, 103 bp, Artificial Sequence
  Synthetic Polynucleotide
taatacgactcactatagggctcccaggattaccgcctaattcatcataaaacagaggagattatgaatgattaggcggaacctggcggcagcgcaaaagatg

SEQ ID NO: 90588 - DNA, 103 bp, Artificial Sequence
  Synthetic Polynucleotide
taatacgactcactatagggagcgctggtgctcccaggattaccgcctaaaacagaggagattaggcatgaatcctgggaacctggcggcagcgcaaaagatg

SEQ ID NO: 90589 - DNA, 103 bp, Artificial Sequence
  Synthetic Polynucleotide
taatacgactcactatagggtacaagtggcagcgctggtgctcccaggataacagaggagaatcctgatggcaccagcgaacctggcggcagcgcaaaagatg

SEQ ID NO: 90590 - DNA, 103 bp, Artificial Sequence
  Synthetic Polynucleotide
taatacgactcactatagggtgtctgcgggtacaagtggcagcgctggtgaacagaggagacaccagatgtgccacttgaacctggcggcagcgcaaaagatg

SEQ ID NO: 90591 - DNA, 103 bp, Artificial Sequence
  Synthetic Polynucleotide
taatacgactcactatagggtctttcataatgtctgcgggtacaagtggcaacagaggagagccactatgacccgcagaaacctggcggcagcgcaaaagatg

SEQ ID NO: 90592 - DNA, 103 bp, Artificial Sequence
  Synthetic Polynucleotide
taatacgactcactataggggtaggattaatctttcataatgtctgcgggaacagaggagacccgcaatgattatgaaaaacctggcggcagcgcaaaagatg

SEQ ID NO: 90593 - DNA, 103 bp, Artificial Sequence
  Synthetic Polynucleotide
taatacgactcactataggggtacatcttacaaagaaaaagtcgccaaggaacagaggagaccttggatgctttttcttaacctggcggcagcgcaaaagatg

SEQ ID NO: 90594 - DNA, 103 bp, Artificial Sequence
  Synthetic Polynucleotide
taatacgactcactatagggctttcatatggtaggattaatctttcataaaacagaggagattatgaatgattaatcctaacctggcggcagcgcaaaagatg

SEQ ID NO: 90595 - DNA, 103 bp, Artificial Sequence
  Synthetic Polynucleotide
taatacgactcactatagggtttaataaatctttcatatggtaggattaaaacagaggagattaatcatgccatatgaaaacctggcggcagcgcaaaagatg

SEQ ID NO: 90596 - DNA, 103 bp, Artificial Sequence
  Synthetic Polynucleotide
taatacgactcactatagggcttcttctcctttaataaatctttcatatgaacagaggagacatatgatggatttattaaacctggcggcagcgcaaaagatg

SEQ ID NO: 90597 - DNA, 103 bp, Artificial Sequence
  Synthetic Polynucleotide
taatacgactcactatagggaggggcttatcttcttctcctttaataaataacagaggagaatttatatgaggagaagaaacctggcggcagcgcaaaagatg

SEQ ID NO: 90598 - DNA, 103 bp, Artificial Sequence
  Synthetic Polynucleotide
taatacgactcactataggggattggaggcaggggcttatcttcttctccaacagaggagaggagaaatggataagcccaacctggcggcagcgcaaaagatg

SEQ ID NO: 90599 - DNA, 103 bp, Artificial Sequence
  Synthetic Polynucleotide
taatacgactcactatagggtccgaggtttgattggaggcaggggcttataacagaggagaataagcatgtgcctccaaaacctggcggcagcgcaaaagatg

SEQ ID NO: 90600 - DNA, 103 bp, Artificial Sequence
  Synthetic Polynucleotide
taatacgactcactatagggttctcctgtttccgaggtttgattggaggcaacagaggagagcctccatgcaaacctcgaacctggcggcagcgcaaaagatg

SEQ ID NO: 90601 - DNA, 103 bp, Artificial Sequence
  Synthetic Polynucleotide
taatacgactcactatagggctgtgaactgttctcctgtttccgaggtttaacagaggagaaaacctatgaaacaggagaacctggcggcagcgcaaaagatg

SEQ ID NO: 90602 - DNA, 103 bp, Artificial Sequence
  Synthetic Polynucleotide
taatacgactcactatagggtctcattttcctgtgaactgttctcctgttaacagaggagaaacaggatgacagttcacaacctggcggcagcgcaaaagatg

SEQ ID NO: 90603 - DNA, 103 bp, Artificial Sequence
  Synthetic Polynucleotide
taatacgactcactatagggtttgttttgttctcattttcctgtgaactgaacagaggagacagttcatgggaaaatgaaacctggcggcagcgcaaaagatg

SEQ ID NO: 90604 - DNA, 103 bp, Artificial Sequence
  Synthetic Polynucleotide
taatacgactcactatagggatcctttggcgtacatcttacaaagaaaaaaacagaggagatttttcatggtaagatgtaacctggcggcagcgcaaaagatg

SEQ ID NO: 90605 - DNA, 103 bp, Artificial Sequence
  Synthetic Polynucleotide
taatacgactcactatagggtccagatacttttgttttgttctcattttcaacagaggagagaaaatatgaacaaaacaaacctggcggcagcgcaaaagatg

SEQ ID NO: 90606 - DNA, 103 bp, Artificial Sequence
  Synthetic Polynucleotide
taatacgactcactatagggtgcgtttggttccagatacttttgttttgtaacagaggagaacaaaaatgaagtatctgaacctggcggcagcgcaaaagatg

SEQ ID NO: 90607 - DNA, 103 bp, Artificial Sequence
  Synthetic Polynucleotide
taatacgactcactatagggtcatgtttgatgcgtttggttccagatactaacagaggagaagtatcatgaaccaaacgaacctggcggcagcgcaaaagatg

SEQ ID NO: 90608 - DNA, 103 bp, Artificial Sequence
  Synthetic Polynucleotide
taatacgactcactatagggtttaggtatttcatgtttgatgcgtttggtaacagaggagaaccaaaatgatcaaacataacctggcggcagcgcaaaagatg

SEQ ID NO: 90609 - DNA, 103 bp, Artificial Sequence
  Synthetic Polynucleotide
taatacgactcactatagggctttcttgcttttaggtatttcatgtttgaaacagaggagatcaaacatgaaatacctaaacctggcggcagcgcaaaagatg

SEQ ID NO: 90610 - DNA, 103 bp, Artificial Sequence
  Synthetic Polynucleotide
taatacgactcactatagggttttctttttctttcttgcttttaggtattaacagaggagaaataccatgaagcaagaaaacctggcggcagcgcaaaagatg

SEQ ID NO: 90611 - DNA, 103 bp, Artificial Sequence
  Synthetic Polynucleotide
taatacgactcactatagggctttggggcattttctttttctttcttgctaacagaggagaagcaagatggaaaaagaaaacctggcggcagcgcaaaagatg

SEQ ID NO: 90612 - DNA, 103 bp, Artificial Sequence
  Synthetic Polynucleotide
taatacgactcactatagggcatcctggggctttggggcattttctttttaacagaggagaaaaaagatgatgccccaaaacctggcggcagcgcaaaagatg

SEQ ID NO: 90613 - DNA, 103 bp, Artificial Sequence
  Synthetic Polynucleotide
taatacgactcactatagggacctctgctgcatcctggggctttggggcaaacagaggagatgccccatggccccaggaaacctggcggcagcgcaaaagatg

SEQ ID NO: 90614 - DNA, 103 bp, Artificial Sequence
  Synthetic Polynucleotide
taatacgactcactatagggctctgatgaaacctctgctgcatcctggggaacagaggagaccccagatggcagcagagaacctggcggcagcgcaaaagatg

SEQ ID NO: 90615 - DNA, 103 bp, Artificial Sequence
  Synthetic Polynucleotide
taatacgactcactatagggtgcaaatcggatcctttggcgtacatcttaaacagaggagataagatatgcgccaaaggaacctggcggcagcgcaaaagatg

SEQ ID NO: 90616 - DNA, 103 bp, Artificial Sequence
  Synthetic Polynucleotide
taatacgactcactatagggctttttcttgctctgatgaaacctctgctgaacagaggagacagcagatgtttcatcagaacctggcggcagcgcaaaagatg

SEQ ID NO: 90617 - DNA, 103 bp, Artificial Sequence
  Synthetic Polynucleotide
taatacgactcactataggggtctcttgttctttttcttgctctgatgaaaacagaggagattcatcatggcaagaaaaaacctggcggcagcgcaaaagatg

SEQ ID NO: 90618 - DNA, 103 bp, Artificial Sequence
  Synthetic Polynucleotide
taatacgactcactataggggcttattaaagtctcttgttctttttcttgaacagaggagacaagaaatggaacaagagaacctggcggcagcgcaaaagatg

SEQ ID NO: 90619 - DNA, 103 bp, Artificial Sequence
  Synthetic Polynucleotide
taatacgactcactatagggtgcttttctggcttattaaagtctcttgttaacagaggagaaacaagatgctttaataaaacctggcggcagcgcaaaagatg

SEQ ID NO: 90620 - DNA, 103 bp, Artificial Sequence
  Synthetic Polynucleotide
taatacgactcactatagggggctcagggatgcttttctggcttattaaaaacagaggagatttaatatgccagaaaagaacctggcggcagcgcaaaagatg

SEQ ID NO: 90621 - DNA, 103 bp, Artificial Sequence
  Synthetic Polynucleotide
taatacgactcactatagggtgctgggagaggctcagggatgcttttctgaacagaggagacagaaaatgatccctgagaacctggcggcagcgcaaaagatg

SEQ ID NO: 90622 - DNA, 103 bp, Artificial Sequence
  Synthetic Polynucleotide
taatacgactcactatagggtcatgtctgctgctgggagaggctcagggaaacagaggagatccctgatgctctcccagaacctggcggcagcgcaaaagatg

SEQ ID NO: 90623 - DNA, 103 bp, Artificial Sequence
  Synthetic Polynucleotide
taatacgactcactatagggatttttttcttcatgtctgctgctgggagaaacagaggagatctcccatgagcagacataacctggcggcagcgcaaaagatg

SEQ ID NO: 90624 - DNA, 103 bp, Artificial Sequence
  Synthetic Polynucleotide
taatacgactcactatagggatacccttctatttttttcttcatgtctgcaacagaggagagcagacatgaagaaaaaaaacctggcggcagcgcaaaagatg

SEQ ID NO: 90625 - DNA, 103 bp, Artificial Sequence
  Synthetic Polynucleotide
taatacgactcactatagggaaaattcctgatacccttctatttttttctaacagaggagaagaaaaatgtagaagggtaacctggcggcagcgcaaaagatg

SEQ ID NO: 90626 - DNA, 103 bp, Artificial Sequence
  Synthetic Polynucleotide
taatacgactcactatagggagctccgctatgcaaatcggatcctttggcaacagaggagagccaaaatgtccgatttgaacctggcggcagcgcaaaagatg

SEQ ID NO: 90627 - DNA, 103 bp, Artificial Sequence
  Synthetic Polynucleotide
taatacgactcactatagggggcttcgctgaaaattcctgatacccttctaacagaggagaagaaggatgtcaggaattaacctggcggcagcgcaaaagatg

SEQ ID NO: 90628 - DNA, 103 bp, Artificial Sequence
  Synthetic Polynucleotide
taatacgactcactatagggggatgccaggggcttcgctgaaaattcctgaacagaggagacaggaaatgtcagcgaagaacctggcggcagcgcaaaagatg

SEQ ID NO: 90629 - DNA, 103 bp, Artificial Sequence
  Synthetic Polynucleotide
taatacgactcactatagggggtctactctggatgccaggggcttcgctgaacagaggagacagcgaatgccctggcataacctggcggcagcgcaaaagatg

SEQ ID NO: 90630 - DNA, 103 bp, Artificial Sequence
  Synthetic Polynucleotide
taatacgactcactatagggtccttctctgggtctactctggatgccaggaacagaggagacctggcatgcagagtagaaacctggcggcagcgcaaaagatg

SEQ ID NO: 90631 - DNA, 103 bp, Artificial Sequence
  Synthetic Polynucleotide
taatacgactcactatagggtgtttcgttgtccttctctgggtctactctaacagaggagaagagtaatgccagagaagaacctggcggcagcgcaaaagatg

SEQ ID NO: 90632 - DNA, 103 bp, Artificial Sequence
  Synthetic Polynucleotide
taatacgactcactatagggaaccttggtctgtttcgttgtccttctctgaacagaggagacagagaatgacaacgaaaaacctggcggcagcgcaaaagatg

SEQ ID NO: 90633 - DNA, 103 bp, Artificial Sequence
  Synthetic Polynucleotide
taatacgactcactatagggtcactgttggaaccttggtctgtttcgttgaacagaggagacaacgaatgagaccaaggaacctggcggcagcgcaaaagatg

SEQ ID NO: 90634 - DNA, 103 bp, Artificial Sequence
  Synthetic Polynucleotide
taatacgactcactatagggtgccaccttctcactgttggaaccttggtcaacagaggagagaccaaatgtccaacagtaacctggcggcagcgcaaaagatg

SEQ ID NO: 90635 - DNA, 103 bp, Artificial Sequence
  Synthetic Polynucleotide
taatacgactcactatagggccgcctcctctgccaccttctcactgttggaacagaggagaccaacaatgagaaggtggaacctggcggcagcgcaaaagatg

SEQ ID NO: 90636 - DNA, 103 bp, Artificial Sequence
  Synthetic Polynucleotide
taatacgactcactatagggcccttctctcccgcctcctctgccaccttcaacagaggagagaaggtatgagaggaggcaacctggcggcagcgcaaaagatg

SEQ ID NO: 90637 - DNA, 103 bp, Artificial Sequence
  Synthetic Polynucleotide
taatacgactcactatagggcaacagctggagctccgctatgcaaatcggaacagaggagaccgattatgatagcggagaacctggcggcagcgcaaaagatg

SEQ ID NO: 90638 - DNA, 103 bp, Artificial Sequence
  Synthetic Polynucleotide
taatacgactcactatagggaggtgtgggccccttctctcccgcctcctcaacagaggagagaggagatgggagagaagaacctggcggcagcgcaaaagatg

SEQ ID NO: 90639 - DNA, 103 bp, Artificial Sequence
  Synthetic Polynucleotide
taatacgactcactatagggttgggagtggaggtgtgggccccttctctcaacagaggagagagagaatgggcccacacaacctggcggcagcgcaaaagatg

SEQ ID NO: 90640 - DNA, 103 bp, Artificial Sequence
  Synthetic Polynucleotide
taatacgactcactatagggagaggagcacttgggagtggaggtgtgggcaacagaggagagcccacatgtccactcccaacctggcggcagcgcaaaagatg

SEQ ID NO: 90641 - DNA, 103 bp, Artificial Sequence
  Synthetic Polynucleotide
taatacgactcactatagggttctggggccagaggagcacttgggagtggaacagaggagaccactcatgagtgctcctaacctggcggcagcgcaaaagatg

SEQ ID NO: 90642 - DNA, 103 bp, Artificial Sequence
  Synthetic Polynucleotide
taatacgactcactatagggctgaatctttttctggggccagaggagcacaacagaggagagtgctcatgtggccccagaacctggcggcagcgcaaaagatg

SEQ ID NO: 90643 - DNA, 103 bp, Artificial Sequence
  Synthetic Polynucleotide
taatacgactcactataggggggaccaaggctgaatctttttctggggccaacagaggagaggccccatgaaaagattcaacctggcggcagcgcaaaagatg

SEQ ID NO: 90644 - DNA, 103 bp, Artificial Sequence
  Synthetic Polynucleotide
taatacgactcactataggggctggccccagggaccaaggctgaatctttaacagaggagaaaagatatggccttggtcaacctggcggcagcgcaaaagatg

SEQ ID NO: 90645 - DNA, 103 bp, Artificial Sequence
  Synthetic Polynucleotide
taatacgactcactataggggtggctgtttgctggccccagggaccaaggaacagaggagaccttggatgctggggccaaacctggcggcagcgcaaaagatg

SEQ ID NO: 90646 - DNA, 103 bp, Artificial Sequence
  Synthetic Polynucleotide
taatacgactcactatagggggagaggtgagtggctgtttgctggccccaaacagaggagatggggcatgcaaacagccaacctggcggcagcgcaaaagatg

SEQ ID NO: 90647 - DNA, 103 bp, Artificial Sequence
  Synthetic Polynucleotide
taatacgactcactatagggcagggcactaggagaggtgagtggctgtttaacagaggagaaaacagatgctcacctctaacctggcggcagcgcaaaagatg

SEQ ID NO: 90648 - DNA, 103 bp, Artificial Sequence
  Synthetic Polynucleotide
taatacgactcactatagggtctcttcccacaacagctggagctccgctaaacagaggagatagcggatgtccagctgtaacctggcggcagcgcaaaagatg

SEQ ID NO: 90649 - DNA, 103 bp, Artificial Sequence
  Synthetic Polynucleotide
taatacgactcactatagggttgagtccaccagggcactaggagaggtgaaacagaggagatcacctatgctagtgcccaacctggcggcagcgcaaaagatg

SEQ ID NO: 90650 - DNA, 103 bp, Artificial Sequence
  Synthetic Polynucleotide
taatacgactcactataggggattcttgttttgagtccaccagggcactaaacagaggagatagtgcatgggtggactcaacctggcggcagcgcaaaagatg

SEQ ID NO: 90651 - DNA, 103 bp, Artificial Sequence
  Synthetic Polynucleotide
taatacgactcactataggggcacagtttggattcttgttttgagtccacaacagaggagagtggacatgaaacaagaaaacctggcggcagcgcaaaagatg

SEQ ID NO: 90652 - DNA, 103 bp, Artificial Sequence
  Synthetic Polynucleotide
taatacgactcactatagggctgtaaaacagcacagtttggattcttgttaacagaggagaaacaagatgccaaactgtaacctggcggcagcgcaaaagatg

SEQ ID NO: 90653 - DNA, 103 bp, Artificial Sequence
  Synthetic Polynucleotide
taatacgactcactatagggtcagggctctctgtaaaacagcacagtttgaacagaggagacaaactatgctgttttacaacctggcggcagcgcaaaagatg

SEQ ID NO: 90654 - DNA, 103 bp, Artificial Sequence
  Synthetic Polynucleotide
taatacgactcactataggggggttcactttcagggctctctgtaaaacaaacagaggagatgttttatggagagccctaacctggcggcagcgcaaaagatg

SEQ ID NO: 90655 - DNA, 103 bp, Artificial Sequence
  Synthetic Polynucleotide
taatacgactcactatagggatgcttcttggggttcactttcagggctctaacagaggagaagagccatgaaagtgaacaacctggcggcagcgcaaaagatg

SEQ ID NO: 90656 - DNA, 103 bp, Artificial Sequence
  Synthetic Polynucleotide
taatacgactcactatagggctggggaaggatgcttcttggggttcacttaacagaggagaaagtgaatgccaagaagcaacctggcggcagcgcaaaagatg

SEQ ID NO: 90657 - DNA, 103 bp, Artificial Sequence
  Synthetic Polynucleotide
taatacgactcactatagggggtggggaagctggggaaggatgcttcttgaacagaggagacaagaaatgtccttccccaacctggcggcagcgcaaaagatg

SEQ ID NO: 90658 - DNA, 103 bp, Artificial Sequence
  Synthetic Polynucleotide
taatacgactcactataggggtggctgtgtggtggggaagctggggaaggaacagaggagaccttccatggcttccccaaacctggcggcagcgcaaaagatg

SEQ ID NO: 90659 - DNA, 103 bp, Artificial Sequence
  Synthetic Polynucleotide
taatacgactcactatagggcggctggtcctctcttcccacaacagctggaacagaggagaccagctatggtgggaagaaacctggcggcagcgcaaaagatg

SEQ ID NO: 90660 - DNA, 103 bp, Artificial Sequence
  Synthetic Polynucleotide
taatacgactcactatagggtttgccagcggtggctgtgtggtggggaagaacagaggagacttcccatgcacacagccaacctggcggcagcgcaaaagatg

SEQ ID NO: 90661 - DNA, 103 bp, Artificial Sequence
  Synthetic Polynucleotide
taatacgactcactatagggctcattctggtttgccagcggtggctgtgtaacagaggagaacacagatgccgctggcaaacctggcggcagcgcaaaagatg

SEQ ID NO: 90662 - DNA, 103 bp, Artificial Sequence
  Synthetic Polynucleotide
taatacgactcactatagggcatcctccgtctcattctggtttgccagcgaacagaggagacgctggatgaccagaatgaacctggcggcagcgcaaaagatg

SEQ ID NO: 90663 - DNA, 103 bp, Artificial Sequence
  Synthetic Polynucleotide
taatacgactcactatagggggcagtttgtcatcctccgtctcattctggaacagaggagaccagaaatggacggaggaaacctggcggcagcgcaaaagatg

SEQ ID NO: 90664 - DNA, 103 bp, Artificial Sequence
  Synthetic Polynucleotide
taatacgactcactatagggtgccatggcgggcagtttgtcatcctccgtaacagaggagaacggagatggacaaactgaacctggcggcagcgcaaaagatg

SEQ ID NO: 90665 - DNA, 103 bp, Artificial Sequence
  Synthetic Polynucleotide
taatacgactcactatagggcaatgtaatctgccatggcgggcagtttgtaacagaggagaacaaacatgccgccatggaacctggcggcagcgcaaaagatg

SEQ ID NO: 90666 - DNA, 103 bp, Artificial Sequence
  Synthetic Polynucleotide
taatacgactcactataggggtgcagttggcaatgtaatctgccatggcgaacagaggagacgccatatgagattacataacctggcggcagcgcaaaagatg

SEQ ID NO: 90667 - DNA, 103 bp, Artificial Sequence
  Synthetic Polynucleotide
taatacgactcactatagggcaccttcacggtgcagttggcaatgtaatcaacagaggagagattacatggccaactgcaacctggcggcagcgcaaaagatg

SEQ ID NO: 90668 - DNA, 103 bp, Artificial Sequence
  Synthetic Polynucleotide
taatacgactcactatagggccagctggtccaccttcacggtgcagttggaacagaggagaccaactatgccgtgaaggaacctggcggcagcgcaaaagatg

SEQ ID NO: 90669 - DNA, 103 bp, Artificial Sequence
  Synthetic Polynucleotide
taatacgactcactatagggtcgtcactgcccagctggtccaccttcacgaacagaggagacgtgaaatgggaccagctaacctggcggcagcgcaaaagatg

SEQ ID NO: 90670 - DNA, 103 bp, Artificial Sequence
  Synthetic Polynucleotide
taatacgactcactatagggtaaaagttgccggctggtcctctcttcccaaacagaggagatgggaaatgaggaccagcaacctggcggcagcgcaaaagatg

SEQ ID NO: 90671 - DNA, 103 bp, Artificial Sequence
  Synthetic Polynucleotide
taatacgactcactatagggattgtggatgtcgtcactgcccagctggtcaacagaggagagaccagatgggcagtgacaacctggcggcagcgcaaaagatg

SEQ ID NO: 90672 - DNA, 103 bp, Artificial Sequence
  Synthetic Polynucleotide
taatacgactcactataggggcttgagcgcattgtggatgtcgtcactgcaacagaggagagcagtgatgacatccacaaacctggcggcagcgcaaaagatg

SEQ ID NO: 90673 - DNA, 103 bp, Artificial Sequence
  Synthetic Polynucleotide
taatacgactcactatagggtttggggtctgcttgagcgcattgtggatgaacagaggagacatccaatgtgcgctcaaaacctggcggcagcgcaaaagatg

SEQ ID NO: 90674 - DNA, 103 bp, Artificial Sequence
  Synthetic Polynucleotide
taatacgactcactatagggcacaaggacctttggggtctgcttgagcgcaacagaggagagcgctcatgcagaccccaaacctggcggcagcgcaaaagatg

SEQ ID NO: 90675 - DNA, 103 bp, Artificial Sequence
  Synthetic Polynucleotide
taatacgactcactatagggacgactggaccacaaggacctttggggtctaacagaggagaagacccatgaggtccttgaacctggcggcagcgcaaaagatg

SEQ ID NO: 90676 - DNA, 103 bp, Artificial Sequence
  Synthetic Polynucleotide
taatacgactcactatagggaacatgtcaaacgactggaccacaaggaccaacagaggagaggtcctatgggtccagtcaacctggcggcagcgcaaaagatg

SEQ ID NO: 90677 - DNA, 103 bp, Artificial Sequence
  Synthetic Polynucleotide
taatacgactcactatagggtttgtctttgaacatgtcaaacgactggacaacagaggagagtccagatgtttgacatgaacctggcggcagcgcaaaagatg

SEQ ID NO: 90678 - DNA, 103 bp, Artificial Sequence
  Synthetic Polynucleotide
taatacgactcactatagggcagtcaggtctttgtctttgaacatgtcaaaacagaggagattgacaatgtcaaagacaaacctggcggcagcgcaaaagatg

SEQ ID NO: 90679 - DNA, 103 bp, Artificial Sequence
  Synthetic Polynucleotide
taatacgactcactatagggttcatgggcccagtcaggtctttgtctttgaacagaggagacaaagaatgagacctgacaacctggcggcagcgcaaaagatg

SEQ ID NO: 90680 - DNA, 103 bp, Artificial Sequence
  Synthetic Polynucleotide
taatacgactcactatagggatggttctcgttcatgggcccagtcaggtcaacagaggagagacctgatggggcccatgaacctggcggcagcgcaaaagatg

SEQ ID NO: 90681 - DNA, 103 bp, Artificial Sequence
  Synthetic Polynucleotide
taatacgactcactatagggcacacggtgagccgacccactggagtgagtaacagaggagaactcacatgagtgggtcgaacctggcggcagcgcaaaagatg

SEQ ID NO: 90682 - DNA, 103 bp, Artificial Sequence
  Synthetic Polynucleotide
taatacgactcactatagggtagagctggataaaagttgccggctggtccaacagaggagaggaccaatgggcaactttaacctggcggcagcgcaaaagatg

SEQ ID NO: 90683 - DNA, 103 bp, Artificial Sequence
  Synthetic Polynucleotide
taatacgactcactatagggaattaagtccatggttctcgttcatgggccaacagaggagaggcccaatgacgagaaccaacctggcggcagcgcaaaagatg

SEQ ID NO: 90684 - DNA, 103 bp, Artificial Sequence
  Synthetic Polynucleotide
taatacgactcactatagggaggggcgtgtaattaagtccatggttctcgaacagaggagacgagaaatgtggacttaaaacctggcggcagcgcaaaagatg

SEQ ID NO: 90685 - DNA, 103 bp, Artificial Sequence
  Synthetic Polynucleotide
taatacgactcactatagggagagtagagcaggggcgtgtaattaagtccaacagaggagaggacttatgtacacgcccaacctggcggcagcgcaaaagatg

SEQ ID NO: 90686 - DNA, 103 bp, Artificial Sequence
  Synthetic Polynucleotide
taatacgactcactatagggggttgcccctagagtagagcaggggcgtgtaacagaggagaacacgcatgtgctctactaacctggcggcagcgcaaaagatg

SEQ ID NO: 90687 - DNA, 103 bp, Artificial Sequence
  Synthetic Polynucleotide
taatacgactcactatagggatgatgcctgggttgcccctagagtagagcaacagaggagagctctaatgtaggggcaaaacctggcggcagcgcaaaagatg

SEQ ID NO: 90688 - DNA, 103 bp, Artificial Sequence
  Synthetic Polynucleotide
taatacgactcactatagggcagtggggacatgatgcctgggttgcccctaacagaggagaaggggcatgccaggcatcaacctggcggcagcgcaaaagatg

SEQ ID NO: 90689 - DNA, 103 bp, Artificial Sequence
  Synthetic Polynucleotide
taatacgactcactatagggttttcttggccagtggggacatgatgcctgaacagaggagacaggcaatgtgtccccacaacctggcggcagcgcaaaagatg

SEQ ID NO: 90690 - DNA, 103 bp, Artificial Sequence
  Synthetic Polynucleotide
taatacgactcactataggggacaaaagctttttcttggccagtggggacaacagaggagagtccccatgggccaagaaaacctggcggcagcgcaaaagatg

SEQ ID NO: 90691 - DNA, 103 bp, Artificial Sequence
  Synthetic Polynucleotide
taatacgactcactatagggactcacttgggacaaaagctttttcttggcaacagaggagagccaagatgaagcttttgaacctggcggcagcgcaaaagatg

SEQ ID NO: 90692 - DNA, 103 bp, Artificial Sequence
  Synthetic Polynucleotide
taatacgactcactatagggggctggccccactcacttgggacaaaagctaacagaggagaagctttatgcccaagtgaaacctggcggcagcgcaaaagatg

SEQ ID NO: 90693 - DNA, 103 bp, Artificial Sequence
  Synthetic Polynucleotide
taatacgactcactatagggaaataaagtttagagctggataaaagttgcaacagaggagagcaactatgatccagctcaacctggcggcagcgcaaaagatg

SEQ ID NO: 90694 - DNA, 103 bp, Artificial Sequence
  Synthetic Polynucleotide
taatacgactcactatagggctgctggagaggctggccccactcacttggaacagaggagaccaagtatgtggggccagaacctggcggcagcgcaaaagatg

SEQ ID NO: 90695 - DNA, 103 bp, Artificial Sequence
  Synthetic Polynucleotide
taatacgactcactatagggataagggtagctgctggagaggctggccccaacagaggagaggggccatgctctccagcaacctggcggcagcgcaaaagatg

SEQ ID NO: 90696 - DNA, 103 bp, Artificial Sequence
  Synthetic Polynucleotide
taatacgactcactataggggtggggagccataagggtagctgctggagaaacagaggagatctccaatggctacccttaacctggcggcagcgcaaaagatg

SEQ ID NO: 90697 - DNA, 103 bp, Artificial Sequence
  Synthetic Polynucleotide
taatacgactcactatagggatcaaagggggtggggagccataagggtagaacagaggagactacccatgtggctccccaacctggcggcagcgcaaaagatg

SEQ ID NO: 90698 - DNA, 103 bp, Artificial Sequence
  Synthetic Polynucleotide
taatacgactcactatagggctttttgctgatcaaagggggtggggagccaacagaggagaggctccatgccccctttgaacctggcggcagcgcaaaagatg

SEQ ID NO: 90699 - DNA, 103 bp, Artificial Sequence
  Synthetic Polynucleotide
taatacgactcactatagggcaatcagtttctttttgctgatcaaaggggaacagaggagaccccttatgtcagcaaaaaacctggcggcagcgcaaaagatg

SEQ ID NO: 90700 - DNA, 103 bp, Artificial Sequence
  Synthetic Polynucleotide
taatacgactcactatagggtcatccctagcaatcagtttctttttgctgaacagaggagacagcaaatggaaactgataacctggcggcagcgcaaaagatg

SEQ ID NO: 90701 - DNA, 103 bp, Artificial Sequence
  Synthetic Polynucleotide
taatacgactcactatagggggaacacaagtcatccctagcaatcagtttaacagaggagaaaactgatggctagggataacctggcggcagcgcaaaagatg

SEQ ID NO: 90702 - DNA, 103 bp, Artificial Sequence
  Synthetic Polynucleotide
taatacgactcactataggggggacaaactggaacacaagtcatccctagaacagaggagactagggatgacttgtgttaacctggcggcagcgcaaaagatg

SEQ ID NO: 90703 - DNA, 103 bp, Artificial Sequence
  Synthetic Polynucleotide
taatacgactcactatagggtggtgggtctgggacaaactggaacacaagaacagaggagacttgtgatgcagtttgtcaacctggcggcagcgcaaaagatg

SEQ ID NO: 90704 - DNA, 103 bp, Artificial Sequence
  Synthetic Polynucleotide
taatacgactcactatagggttctgggaggaaataaagtttagagctggaaacagaggagatccagcatgaaactttataacctggcggcagcgcaaaagatg

SEQ ID NO: 90705 - DNA, 103 bp, Artificial Sequence
  Synthetic Polynucleotide
taatacgactcactataggggctttggccatggtgggtctgggacaaactaacagaggagaagtttgatgcagacccacaacctggcggcagcgcaaaagatg

SEQ ID NO: 90706 - DNA, 103 bp, Artificial Sequence
  Synthetic Polynucleotide
taatacgactcactatagggtatggtcagtgctttggccatggtgggtctaacagaggagaagacccatgatggccaaaaacctggcggcagcgcaaaagatg

SEQ ID NO: 90707 - DNA, 103 bp, Artificial Sequence
  Synthetic Polynucleotide
taatacgactcactatagggctgaccgccatatggtcagtgctttggccaaacagaggagatggccaatgcactgaccaaacctggcggcagcgcaaaagatg

SEQ ID NO: 90708 - DNA, 103 bp, Artificial Sequence
  Synthetic Polynucleotide
taatacgactcactatagggtgatggccggctgaccgccatatggtcagtaacagaggagaactgacatgatggcggtcaacctggcggcagcgcaaaagatg

SEQ ID NO: 90709 - DNA, 103 bp, Artificial Sequence
  Synthetic Polynucleotide
taatacgactcactataggggctgaatcactgatggccggctgaccgccaaacagaggagatggcggatggccggccataacctggcggcagcgcaaaagatg

SEQ ID NO: 90710 - DNA, 103 bp, Artificial Sequence
  Synthetic Polynucleotide
taatacgactcactatagggctctggacgtgctgaatcactgatggccggaacagaggagaccggccatgagtgattcaaacctggcggcagcgcaaaagatg

SEQ ID NO: 90711 - DNA, 103 bp, Artificial Sequence
  Synthetic Polynucleotide
taatacgactcactataggggcttctgaaactctggacgtgctgaatcacaacagaggagagtgattatgcacgtccagaacctggcggcagcgcaaaagatg

SEQ ID NO: 90712 - DNA, 103 bp, Artificial Sequence
  Synthetic Polynucleotide
taatacgactcactatagggccgagggcttgcttctgaaactctggacgtaacagaggagaacgtccatggtttcagaaaacctggcggcagcgcaaaagatg

SEQ ID NO: 90713 - DNA, 103 bp, Artificial Sequence
  Synthetic Polynucleotide
taatacgactcactatagggtttctctcttccgagggcttgcttctgaaaaacagaggagatttcagatgcaagccctcaacctggcggcagcgcaaaagatg

SEQ ID NO: 90714 - DNA, 103 bp, Artificial Sequence
  Synthetic Polynucleotide
taatacgactcactatagggattgatggtctttctctcttccgagggcttaacagaggagaaagcccatggaagagagaaacctggcggcagcgcaaaagatg

SEQ ID NO: 90715 - DNA, 103 bp, Artificial Sequence
  Synthetic Polynucleotide
taatacgactcactatagggggggagtgtcttctgggaggaaataaagttaacagaggagaaactttatgtcctcccagaacctggcggcagcgcaaaagatg

SEQ ID NO: 90716 - DNA, 103 bp, Artificial Sequence
  Synthetic Polynucleotide
taatacgactcactatagggtaaagatgtcattgatggtctttctctcttaacagaggagaaagagaatgagaccatcaaacctggcggcagcgcaaaagatg

SEQ ID NO: 90717 - DNA, 103 bp, Artificial Sequence
  Synthetic Polynucleotide
taatacgactcactatagggttctcatgcttaaagatgtcattgatggtcaacagaggagagaccatatgtgacatcttaacctggcggcagcgcaaaagatg

SEQ ID NO: 90718 - DNA, 103 bp, Artificial Sequence
  Synthetic Polynucleotide
taatacgactcactatagggtcgactcagtttctcatgcttaaagatgtcaacagaggagagacatcatgaagcatgagaacctggcggcagcgcaaaagatg

SEQ ID NO: 90719 - DNA, 103 bp, Artificial Sequence
  Synthetic Polynucleotide
taatacgactcactatagggggggatctgatcgactcagtttctcatgctaacagaggagaagcatgatgaactgagtcaacctggcggcagcgcaaaagatg

SEQ ID NO: 90720 - DNA, 103 bp, Artificial Sequence
  Synthetic Polynucleotide
taatacgactcactatagggctgcagcggtggggatctgatcgactcagtaacagaggagaactgagatgatcagatccaacctggcggcagcgcaaaagatg

SEQ ID NO: 90721 - DNA, 103 bp, Artificial Sequence
  Synthetic Polynucleotide
taatacgactcactatagggcttggagaagctgcagcggtggggatctgaaacagaggagatcagatatgcaccgctgcaacctggcggcagcgcaaaagatg

SEQ ID NO: 90722 - DNA, 103 bp, Artificial Sequence
  Synthetic Polynucleotide
taatacgactcactatagggtaaggtgatgcttggagaagctgcagcggtaacagaggagaaccgctatggcttctccaaacctggcggcagcgcaaaagatg

SEQ ID NO: 90723 - DNA, 103 bp, Artificial Sequence
  Synthetic Polynucleotide
taatacgactcactataggggcaagggggttaaggtgatgcttggagaagaacagaggagacttctcatggcatcacctaacctggcggcagcgcaaaagatg

SEQ ID NO: 90724 - DNA, 103 bp, Artificial Sequence
  Synthetic Polynucleotide
taatacgactcactataggggtaggagtcagcaagggggttaaggtgatgaacagaggagacatcacatgaacccccttaacctggcggcagcgcaaaagatg

SEQ ID NO: 90725 - DNA, 103 bp, Artificial Sequence
  Synthetic Polynucleotide
taatacgactcactataggggcttcaggacgtaggagtcagcaagggggtaacagaggagaacccccatgctgactcctaacctggcggcagcgcaaaagatg

SEQ ID NO: 90726 - DNA, 103 bp, Artificial Sequence
  Synthetic Polynucleotide
taatacgactcactatagggtttctgccctggggagtgtcttctgggaggaacagaggagacctcccatgagacactccaacctggcggcagcgcaaaagatg

SEQ ID NO: 90727 - DNA, 103 bp, Artificial Sequence
  Synthetic Polynucleotide
taatacgactcactatagggtgaatttcttgcttcaggacgtaggagtcaaacagaggagatgactcatgcgtcctgaaaacctggcggcagcgcaaaagatg

SEQ ID NO: 90728 - DNA, 103 bp, Artificial Sequence
  Synthetic Polynucleotide
taatacgactcactatagggcttgccctcctgaatttcttgcttcaggacaacagaggagagtcctgatgcaagaaattaacctggcggcagcgcaaaagatg

SEQ ID NO: 90729 - DNA, 103 bp, Artificial Sequence
  Synthetic Polynucleotide
taatacgactcactatagggagagtttatccttgccctcctgaatttcttaacagaggagaaagaaaatgaggagggcaaacctggcggcagcgcaaaagatg

SEQ ID NO: 90730 - DNA, 103 bp, Artificial Sequence
  Synthetic Polynucleotide
taatacgactcactatagggcttttctctaagagtttatccttgccctccaacagaggagaggagggatgggataaactaacctggcggcagcgcaaaagatg

SEQ ID NO: 90731 - DNA, 103 bp, Artificial Sequence
  Synthetic Polynucleotide
taatacgactcactatagggggggagggcccttttctctaagagtttatcaacagaggagagataaaatgttagagaaaaacctggcggcagcgcaaaagatg

SEQ ID NO: 90732 - DNA, 103 bp, Artificial Sequence
  Synthetic Polynucleotide
taatacgactcactatagggtgtgggaatgggggagggcccttttctctaaacagaggagatagagaatggggccctccaacctggcggcagcgcaaaagatg

SEQ ID NO: 90733 - DNA, 103 bp, Artificial Sequence
  Synthetic Polynucleotide
taatacgactcactatagggaagctaggcatgtgggaatgggggagggccaacagaggagaggccctatgccattcccaaacctggcggcagcgcaaaagatg

SEQ ID NO: 90734 - DNA, 103 bp, Artificial Sequence
  Synthetic Polynucleotide
taatacgactcactataggggtcagccaggaagctaggcatgtgggaatgaacagaggagacattccatgatgcctagcaacctggcggcagcgcaaaagatg

SEQ ID NO: 90735 - DNA, 103 bp, Artificial Sequence
  Synthetic Polynucleotide
taatacgactcactatagggacgagtagaagtcagccaggaagctaggcaaacagaggagatgcctaatgtcctggctgaacctggcggcagcgcaaaagatg

SEQ ID NO: 90736 - DNA, 103 bp, Artificial Sequence
  Synthetic Polynucleotide
taatacgactcactatagggagatgaggggacgagtagaagtcagccaggaacagaggagacctggcatgcttctactcaacctggcggcagcgcaaaagatg

SEQ ID NO: 90737 - DNA, 103 bp, Artificial Sequence
  Synthetic Polynucleotide
taatacgactcactatagggatggtcgctatttctgccctggggagtgtcaacagaggagagacactatgcagggcagaaacctggcggcagcgcaaaagatg

SEQ ID NO: 90738 - DNA, 103 bp, Artificial Sequence
  Synthetic Polynucleotide
taatacgactcactataggggaggctatggagatgaggggacgagtagaaaacagaggagattctacatgtcccctcataacctggcggcagcgcaaaagatg

SEQ ID NO: 90739 - DNA, 103 bp, Artificial Sequence
  Synthetic Polynucleotide
taatacgactcactatagggtgtgtctgtagaggctatggagatgaggggaacagaggagacccctcatgtccatagccaacctggcggcagcgcaaaagatg

SEQ ID NO: 90740 - DNA, 103 bp, Artificial Sequence
  Synthetic Polynucleotide
taatacgactcactatagggtggtgctcggtgtgtctgtagaggctatggaacagaggagaccatagatgctacagacaaacctggcggcagcgcaaaagatg

SEQ ID NO: 90741 - DNA, 103 bp, Artificial Sequence
  Synthetic Polynucleotide
taatacgactcactatagggattatgaagatggtgctcggtgtgtctgtaaacagaggagatacagaatgaccgagcacaacctggcggcagcgcaaaagatg

SEQ ID NO: 90742 - DNA, 103 bp, Artificial Sequence
  Synthetic Polynucleotide
taatacgactcactatagggatgtctgttcattatgaagatggtgctcggaacagaggagaccgagcatgatcttcataaacctggcggcagcgcaaaagatg

SEQ ID NO: 90743 - DNA, 103 bp, Artificial Sequence
  Synthetic Polynucleotide
taatacgactcactataggggggtatttggatgtctgttcattatgaagaaacagaggagatcttcaatgtgaacagacaacctggcggcagcgcaaaagatg

SEQ ID NO: 90744 - DNA, 103 bp, Artificial Sequence
  Synthetic Polynucleotide
taatacgactcactataggggtccctggaagggtatttggatgtctgttcaacagaggagagaacagatgtccaaatacaacctggcggcagcgcaaaagatg

SEQ ID NO: 90745 - DNA, 103 bp, Artificial Sequence
  Synthetic Polynucleotide
taatacgactcactatagggccctgtacatgtccctggaagggtatttggaacagaggagaccaaatatgcttccagggaacctggcggcagcgcaaaagatg

SEQ ID NO: 90746 - DNA, 103 bp, Artificial Sequence
  Synthetic Polynucleotide
taatacgactcactatagggttttccgattccctgtacatgtccctggaaaacagaggagattccagatgcatgtacagaacctggcggcagcgcaaaagatg

SEQ ID NO: 90747 - DNA, 103 bp, Artificial Sequence
  Synthetic Polynucleotide
taatacgactcactatagggaaaagaactgttttccgattccctgtacataacagaggagaatgtacatggaatcggaaaacctggcggcagcgcaaaagatg

SEQ ID NO: 90748 - DNA, 103 bp, Artificial Sequence
  Synthetic Polynucleotide
taatacgactcactatagggcatcctcgccatggtcgctatttctgccctaacagaggagaagggcaatgatagcgaccaacctggcggcagcgcaaaagatg

SEQ ID NO: 90749 - DNA, 103 bp, Artificial Sequence
  Synthetic Polynucleotide
taatacgactcactatagggtgtgggaaggaaaagaactgttttccgattaacagaggagaaatcggatgacagttcttaacctggcggcagcgcaaaagatg

SEQ ID NO: 90750 - DNA, 103 bp, Artificial Sequence
  Synthetic Polynucleotide
taatacgactcactatagggtcttggtgtctgtgggaaggaaaagaactgaacagaggagacagttcatgtccttcccaaacctggcggcagcgcaaaagatg

SEQ ID NO: 90751 - DNA, 103 bp, Artificial Sequence
  Synthetic Polynucleotide
taatacgactcactatagggatggagcttttcttggtgtctgtgggaaggaacagaggagaccttccatgagacaccaaaacctggcggcagcgcaaaagatg

SEQ ID NO: 90752 - DNA, 103 bp, Artificial Sequence
  Synthetic Polynucleotide
taatacgactcactataggggataatttacatggagcttttcttggtgtcaacagaggagagacaccatgaaaagctccaacctggcggcagcgcaaaagatg

SEQ ID NO: 90753 - DNA, 103 bp, Artificial Sequence
  Synthetic Polynucleotide
taatacgactcactatagggagggacgtgagataatttacatggagctttaacagaggagaaaagctatgtgtaaattaaacctggcggcagcgcaaaagatg

SEQ ID NO: 90754 - DNA, 103 bp, Artificial Sequence
  Synthetic Polynucleotide
taatacgactcactatagggttgcaggtgcagggacgtgagataatttacaacagaggagagtaaatatgctcacgtccaacctggcggcagcgcaaaagatg

SEQ ID NO: 90755 - DNA, 103 bp, Artificial Sequence
  Synthetic Polynucleotide
taatacgactcactatagggactttttgtcttgcaggtgcagggacgtgaaacagaggagatcacgtatgtgcacctgcaacctggcggcagcgcaaaagatg

SEQ ID NO: 90756 - DNA, 103 bp, Artificial Sequence
  Synthetic Polynucleotide
taatacgactcactataggggctgccgccgactttttgtcttgcaggtgcaacagaggagagcacctatgagacaaaaaaacctggcggcagcgcaaaagatg

SEQ ID NO: 90757 - DNA, 103 bp, Artificial Sequence
  Synthetic Polynucleotide
taatacgactcactatagggaggggcttctgctgccgccgactttttgtcaacagaggagagacaaaatgtcggcggcaaacctggcggcagcgcaaaagatg

SEQ ID NO: 90758 - DNA, 103 bp, Artificial Sequence
  Synthetic Polynucleotide
taatacgactcactataggggatcatccgtaggggcttctgctgccgccgaacagaggagacggcggatgcagaagcccaacctggcggcagcgcaaaagatg

SEQ ID NO: 90759 - DNA, 103 bp, Artificial Sequence
  Synthetic Polynucleotide
taatacgactcactataggggcaatgacttcatcctcgccatggtcgctaaacagaggagatagcgaatgtggcgaggaaacctggcggcagcgcaaaagatg

SEQ ID NO: 90760 - DNA, 103 bp, Artificial Sequence
  Synthetic Polynucleotide
taatacgactcactatagggtctgtaggctgatcatccgtaggggcttctaacagaggagaagaagcatgtacggatgaaacctggcggcagcgcaaaagatg

SEQ ID NO: 90761 - DNA, 103 bp, Artificial Sequence
  Synthetic Polynucleotide
taatacgactcactatagggaaggctcagatctgtaggctgatcatccgtaacagaggagaacggatatgcagcctacaaacctggcggcagcgcaaaagatg

SEQ ID NO: 90762 - DNA, 103 bp, Artificial Sequence
  Synthetic Polynucleotide
taatacgactcactatagggggttcttgggaaggctcagatctgtaggctaacagaggagaagcctaatgatctgagccaacctggcggcagcgcaaaagatg

SEQ ID NO: 90763 - DNA, 103 bp, Artificial Sequence
  Synthetic Polynucleotide
taatacgactcactatagggggtttgtgcgggttcttgggaaggctcagaaacagaggagatctgagatgtcccaagaaaacctggcggcagcgcaaaagatg

SEQ ID NO: 90764 - DNA, 103 bp, Artificial Sequence
  Synthetic Polynucleotide
taatacgactcactatagggcttgccggtaggtttgtgcgggttcttgggaacagaggagacccaagatgccgcacaaaaacctggcggcagcgcaaaagatg

SEQ ID NO: 90765 - DNA, 103 bp, Artificial Sequence
  Synthetic Polynucleotide
taatacgactcactatagggggcccaggaccttgccggtaggtttgtgcgaacagaggagacgcacaatgctaccggcaaacctggcggcagcgcaaaagatg

SEQ ID NO: 90766 - DNA, 103 bp, Artificial Sequence
  Synthetic Polynucleotide
taatacgactcactataggggaatgagccaggcccaggaccttgccggtaaacagaggagataccggatgggtcctgggaacctggcggcagcgcaaaagatg

SEQ ID NO: 90767 - DNA, 103 bp, Artificial Sequence
  Synthetic Polynucleotide
taatacgactcactatagggccctgtggtggaatgagccaggcccaggacaacagaggagagtcctgatgctggctcataacctggcggcagcgcaaaagatg

SEQ ID NO: 90768 - DNA, 103 bp, Artificial Sequence
  Synthetic Polynucleotide
taatacgactcactatagggtctcctggggccctgtggtggaatgagccaaacagaggagatggctcatgccaccacagaacctggcggcagcgcaaaagatg

SEQ ID NO: 90769 - DNA, 103 bp, Artificial Sequence
  Synthetic Polynucleotide
taatacgactcactatagggatgcctttgctctcctggggccctgtggtgaacagaggagacaccacatggccccaggaaacctggcggcagcgcaaaagatg

SEQ ID NO: 90770 - DNA, 103 bp, Artificial Sequence
  Synthetic Polynucleotide
taatacgactcactatagggttcggaaacagcaatgacttcatcctcgccaacagaggagaggcgagatggaagtcattaacctggcggcagcgcaaaagatg

SEQ ID NO: 90771 - DNA, 103 bp, Artificial Sequence
  Synthetic Polynucleotide
taatacgactcactataggggaactgggagatgcctttgctctcctggggaacagaggagaccccagatgagcaaaggcaacctggcggcagcgcaaaagatg

SEQ ID NO: 90772 - DNA, 103 bp, Artificial Sequence
  Synthetic Polynucleotide
taatacgactcactatagggctaagacctggaactgggagatgcctttgcaacagaggagagcaaagatgtctcccagtaacctggcggcagcgcaaaagatg

SEQ ID NO: 90773 - DNA, 103 bp, Artificial Sequence
  Synthetic Polynucleotide
taatacgactcactatagggctctggctgcctaagacctggaactgggagaacagaggagactcccaatgccaggtcttaacctggcggcagcgcaaaagatg

SEQ ID NO: 90774 - DNA, 103 bp, Artificial Sequence
  Synthetic Polynucleotide
taatacgactcactatagggacagtctcgactctggctgcctaagacctgaacagaggagacaggtcatgggcagccagaacctggcggcagcgcaaaagatg

SEQ ID NO: 90775 - DNA, 103 bp, Artificial Sequence
  Synthetic Polynucleotide
taatacgactcactatagggctttggggtgacagtctcgactctggctgcaacagaggagagcagccatggtcgagactaacctggcggcagcgcaaaagatg

SEQ ID NO: 90776 - DNA, 103 bp, Artificial Sequence
  Synthetic Polynucleotide
taatacgactcactatagggacccgacaggctttggggtgacagtctcgaaacagaggagatcgagaatgtcaccccaaaacctggcggcagcgcaaaagatg

SEQ ID NO: 90777 - DNA, 103 bp, Artificial Sequence
  Synthetic Polynucleotide
taatacgactcactatagggcatgggtgatacccgacaggctttggggtgaacagaggagacaccccatggcctgtcggaacctggcggcagcgcaaaagatg

SEQ ID NO: 90778 - DNA, 103 bp, Artificial Sequence
  Synthetic Polynucleotide
taatacgactcactatagggctgacatggtcatgggtgatacccgacaggaacagaggagacctgtcatgtatcacccaaacctggcggcagcgcaaaagatg

SEQ ID NO: 90779 - DNA, 103 bp, Artificial Sequence
  Synthetic Polynucleotide
taatacgactcactatagggtttttagggcctgacatggtcatgggtgataacagaggagaatcaccatggaccatgtcaacctggcggcagcgcaaaagatg

SEQ ID NO: 90780 - DNA, 103 bp, Artificial Sequence
  Synthetic Polynucleotide
taatacgactcactatagggttcagggtattttttagggcctgacatggtaacagaggagaaccatgatgggccctaaaaacctggcggcagcgcaaaagatg

SEQ ID NO: 90781 - DNA, 103 bp, Artificial Sequence
  Synthetic Polynucleotide
taatacgactcactatagggcaatcaccttttcggaaacagcaatgacttaacagaggagaaagtcaatgctgtttccgaacctggcggcagcgcaaaagatg

SEQ ID NO: 90782 - DNA, 103 bp, Artificial Sequence
  Synthetic Polynucleotide
taatacgactcactatagggttgaaagcgattcagggtattttttagggcaacagaggagagccctaatgaataccctgaacctggcggcagcgcaaaagatg

SEQ ID NO: 90783 - DNA, 103 bp, Artificial Sequence
  Synthetic Polynucleotide
taatacgactcactatagggtttcctgatcttgaaagcgattcagggtataacagaggagaatacccatgatcgctttcaacctggcggcagcgcaaaagatg

SEQ ID NO: 90784 - DNA, 103 bp, Artificial Sequence
  Synthetic Polynucleotide
taatacgactcactatagggatggtgaggttttcctgatcttgaaagcgaaacagaggagatcgcttatgagatcaggaaacctggcggcagcgcaaaagatg

SEQ ID NO: 90785 - DNA, 103 bp, Artificial Sequence
  Synthetic Polynucleotide
taatacgactcactatagggccagtctcacatggtgaggttttcctgatcaacagaggagagatcagatgaacctcaccaacctggcggcagcgcaaaagatg

SEQ ID NO: 90786 - DNA, 103 bp, Artificial Sequence
  Synthetic Polynucleotide
taatacgactcactatagggctgaaattctccagtctcacatggtgaggtaacagaggagaacctcaatgtgtgagactaacctggcggcagcgcaaaagatg

SEQ ID NO: 90787 - DNA, 103 bp, Artificial Sequence
  Synthetic Polynucleotide
taatacgactcactatagggttccatcttcctgaaattctccagtctcacaacagaggagagtgagaatggagaatttcaacctggcggcagcgcaaaagatg

SEQ ID NO: 90788 - DNA, 103 bp, Artificial Sequence
  Synthetic Polynucleotide
taatacgactcactatagggggaccatgccttccatcttcctgaaattctaacagaggagaagaattatgggaagatggaacctggcggcagcgcaaaagatg

SEQ ID NO: 90789 - DNA, 103 bp, Artificial Sequence
  Synthetic Polynucleotide
taatacgactcactatagggaggattgggtggaccatgccttccatcttcaacagaggagagaagatatgaggcatggtaacctggcggcagcgcaaaagatg

SEQ ID NO: 90790 - DNA, 103 bp, Artificial Sequence
  Synthetic Polynucleotide
taatacgactcactatagggtttccggtgcaggattgggtggaccatgccaacagaggagaggcatgatgcacccaatcaacctggcggcagcgcaaaagatg

SEQ ID NO: 90791 - DNA, 103 bp, Artificial Sequence
  Synthetic Polynucleotide
taatacgactcactataggggcgggctcattttccggtgcaggattgggtaacagaggagaacccaaatgtgcaccggaaacctggcggcagcgcaaaagatg

SEQ ID NO: 90792 - DNA, 103 bp, Artificial Sequence
  Synthetic Polynucleotide
taatacgactcactatagggccgtgcaagccacacggtgagccgacccacaacagaggagagtgggtatgctcaccgtgaacctggcggcagcgcaaaagatg

SEQ ID NO: 90793 - DNA, 103 bp, Artificial Sequence
  Synthetic Polynucleotide
taatacgactcactatagggtcaagcttcacaatcaccttttcggaaacaaacagaggagatgtttcatgaaaggtgataacctggcggcagcgcaaaagatg

SEQ ID NO: 90794 - DNA, 103 bp, Artificial Sequence
  Synthetic Polynucleotide
taatacgactcactatagggccaatgttctgcgggctcattttccggtgcaacagaggagagcaccgatgaatgagcccaacctggcggcagcgcaaaagatg

SEQ ID NO: 90795 - DNA, 103 bp, Artificial Sequence
  Synthetic Polynucleotide
taatacgactcactatagggccgcgccgccccaatgttctgcgggctcataacagaggagaatgagcatgcagaacattaacctggcggcagcgcaaaagatg

SEQ ID NO: 90796 - DNA, 103 bp, Artificial Sequence
  Synthetic Polynucleotide
taatacgactcactataggggcttgatcggccgcgccgccccaatgttctaacagaggagaagaacaatggggcggcgcaacctggcggcagcgcaaaagatg

SEQ ID NO: 90797 - DNA, 103 bp, Artificial Sequence
  Synthetic Polynucleotide
taatacgactcactatagggtccaggctgcgcttgatcggccgcgccgccaacagaggagaggcggcatggccgatcaaaacctggcggcagcgcaaaagatg

SEQ ID NO: 90798 - DNA, 103 bp, Artificial Sequence
  Synthetic Polynucleotide
taatacgactcactataggggtccaaatcctccaggctgcgcttgatcggaacagaggagaccgatcatgcgcagcctgaacctggcggcagcgcaaaagatg

SEQ ID NO: 90799 - DNA, 103 bp, Artificial Sequence
  Synthetic Polynucleotide
taatacgactcactatagggcaatcacaaggtccaaatcctccaggctgcaacagaggagagcagccatgaggatttggaacctggcggcagcgcaaaagatg

SEQ ID NO: 90800 - DNA, 103 bp, Artificial Sequence
  Synthetic Polynucleotide
taatacgactcactatagggtttttccctgcaatcacaaggtccaaatccaacagaggagaggatttatgccttgtgataacctggcggcagcgcaaaagatg

SEQ ID NO: 90801 - DNA, 103 bp, Artificial Sequence
  Synthetic Polynucleotide
taatacgactcactatagggtgcccgggcctttttccctgcaatcacaagaacagaggagacttgtgatggcagggaaaaacctggcggcagcgcaaaagatg

SEQ ID NO: 90802 - DNA, 103 bp, Artificial Sequence
  Synthetic Polynucleotide
taatacgactcactatagggagggagacactgcccgggcctttttccctgaacagaggagacagggaatgaggcccgggaacctggcggcagcgcaaaagatg

SEQ ID NO: 90803 - DNA, 103 bp, Artificial Sequence
  Synthetic Polynucleotide
taatacgactcactataggggatgggtctaagggagacactgcccgggccaacagaggagaggcccgatgagtgtctccaacctggcggcagcgcaaaagatg

SEQ ID NO: 90804 - DNA, 103 bp, Artificial Sequence
  Synthetic Polynucleotide
taatacgactcactataggggaccaggtcttcaagcttcacaatcaccttaacagaggagaaaggtgatggtgaagcttaacctggcggcagcgcaaaagatg

SEQ ID NO: 90805 - DNA, 103 bp, Artificial Sequence
  Synthetic Polynucleotide
taatacgactcactataggggacctccttggatgggtctaagggagacacaacagaggagagtgtctatgttagacccaaacctggcggcagcgcaaaagatg

SEQ ID NO: 90806 - DNA, 103 bp, Artificial Sequence
  Synthetic Polynucleotide
taatacgactcactatagggccttcccagagacctccttggatgggtctaaacagaggagatagaccatgccaaggaggaacctggcggcagcgcaaaagatg

SEQ ID NO: 90807 - DNA, 103 bp, Artificial Sequence
  Synthetic Polynucleotide
taatacgactcactataggggaggccttctccttcccagagacctccttgaacagaggagacaaggaatgctctgggaaaacctggcggcagcgcaaaagatg

SEQ ID NO: 90808 - DNA, 103 bp, Artificial Sequence
  Synthetic Polynucleotide
taatacgactcactatagggctcctgctcagaggccttctccttcccagaaacagaggagatctgggatggagaaggccaacctggcggcagcgcaaaagatg

SEQ ID NO: 90809 - DNA, 103 bp, Artificial Sequence
  Synthetic Polynucleotide
taatacgactcactatagggtgccttcactctcctgctcagaggccttctaacagaggagaagaaggatgctgagcaggaacctggcggcagcgcaaaagatg

SEQ ID NO: 90810 - DNA, 103 bp, Artificial Sequence
  Synthetic Polynucleotide
taatacgactcactataggggctgctttgctgccttcactctcctgctcaaacagaggagatgagcaatggagtgaaggaacctggcggcagcgcaaaagatg

SEQ ID NO: 90811 - DNA, 103 bp, Artificial Sequence
  Synthetic Polynucleotide
taatacgactcactatagggcccaccgtgcgctgctttgctgccttcactaacagaggagaagtgaaatgagcaaagcaaacctggcggcagcgcaaaagatg

SEQ ID NO: 90812 - DNA, 103 bp, Artificial Sequence
  Synthetic Polynucleotide
taatacgactcactatagggccccggaatgcccaccgtgcgctgctttgcaacagaggagagcaaagatgcgcacggtgaacctggcggcagcgcaaaagatg

SEQ ID NO: 90813 - DNA, 103 bp, Artificial Sequence
  Synthetic Polynucleotide
taatacgactcactatagggtctgatccgcccccggaatgcccaccgtgcaacagaggagagcacggatggcattccggaacctggcggcagcgcaaaagatg

SEQ ID NO: 90814 - DNA, 103 bp, Artificial Sequence
  Synthetic Polynucleotide
taatacgactcactatagggcttgtggccttctgatccgcccccggaatgaacagaggagacattccatgggcggatcaaacctggcggcagcgcaaaagatg

SEQ ID NO: 90815 - DNA, 103 bp, Artificial Sequence
  Synthetic Polynucleotide
taatacgactcactataggggtacccacttgaccaggtcttcaagcttcaaacagaggagatgaagcatgaagacctggaacctggcggcagcgcaaaagatg

SEQ ID NO: 90816 - DNA, 103 bp, Artificial Sequence
  Synthetic Polynucleotide
taatacgactcactatagggagaggggaagcttgtggccttctgatccgcaacagaggagagcggatatgaaggccacaaacctggcggcagcgcaaaagatg

SEQ ID NO: 90817 - DNA, 103 bp, Artificial Sequence
  Synthetic Polynucleotide
taatacgactcactatagggataggggaggagaggggaagcttgtggcctaacagaggagaaggccaatggcttcccctaacctggcggcagcgcaaaagatg

SEQ ID NO: 90818 - DNA, 103 bp, Artificial Sequence
  Synthetic Polynucleotide
taatacgactcactatagggacctgggaagataggggaggagaggggaagaacagaggagacttcccatgtcctcccctaacctggcggcagcgcaaaagatg

SEQ ID NO: 90819 - DNA, 103 bp, Artificial Sequence
  Synthetic Polynucleotide
taatacgactcactatagggcggaatacagacctgggaagataggggaggaacagaggagacctcccatgtcttcccagaacctggcggcagcgcaaaagatg

SEQ ID NO: 90820 - DNA, 103 bp, Artificial Sequence
  Synthetic Polynucleotide
taatacgactcactatagggcacaggctcccggaatacagacctgggaagaacagaggagacttcccatgtctgtattcaacctggcggcagcgcaaaagatg

SEQ ID NO: 90821 - DNA, 103 bp, Artificial Sequence
  Synthetic Polynucleotide
taatacgactcactataggggcccgagttacacaggctcccggaatacagaacagaggagactgtatatggggagcctgaacctggcggcagcgcaaaagatg

SEQ ID NO: 90822 - DNA, 103 bp, Artificial Sequence
  Synthetic Polynucleotide
taatacgactcactatagggtggagttgaggcccgagttacacaggctccaacagaggagaggagccatggtaactcggaacctggcggcagcgcaaaagatg

SEQ ID NO: 90823 - DNA, 103 bp, Artificial Sequence
  Synthetic Polynucleotide
taatacgactcactataggggccgggagcctggagttgaggcccgagttaaacagaggagataactcatgcctcaactcaacctggcggcagcgcaaaagatg

SEQ ID NO: 90824 - DNA, 103 bp, Artificial Sequence
  Synthetic Polynucleotide
taatacgactcactatagggagaatacccagccgggagcctggagttgagaacagaggagactcaacatgaggctcccgaacctggcggcagcgcaaaagatg

SEQ ID NO: 90825 - DNA, 103 bp, Artificial Sequence
  Synthetic Polynucleotide
taatacgactcactataggggcagagaatgagaatacccagccgggagccaacagaggagaggctccatgctgggtattaacctggcggcagcgcaaaagatg

SEQ ID NO: 90826 - DNA, 103 bp, Artificial Sequence
  Synthetic Polynucleotide
taatacgactcactatagggaaatcagaatgtacccacttgaccaggtctaacagaggagaagacctatgcaagtgggtaacctggcggcagcgcaaaagatg

SEQ ID NO: 90827 - DNA, 103 bp, Artificial Sequence
  Synthetic Polynucleotide
taatacgactcactatagggttcaagtactgcagagaatgagaatacccaaacagaggagatgggtaatgtcattctctaacctggcggcagcgcaaaagatg

SEQ ID NO: 90828 - DNA, 103 bp, Artificial Sequence
  Synthetic Polynucleotide
taatacgactcactatagggagtctggtttttcaagtactgcagagaatgaacagaggagacattctatgcagtacttgaacctggcggcagcgcaaaagatg

SEQ ID NO: 90829 - DNA, 103 bp, Artificial Sequence
  Synthetic Polynucleotide
taatacgactcactataggggagaaagcacagtctggtttttcaagtactaacagaggagaagtactatgaaaaccagaaacctggcggcagcgcaaaagatg

SEQ ID NO: 90830 - DNA, 103 bp, Artificial Sequence
  Synthetic Polynucleotide
taatacgactcactatagggtgcatgagtggagaaagcacagtctggtttaacagaggagaaaaccaatgtgtgctttcaacctggcggcagcgcaaaagatg

SEQ ID NO: 90831 - DNA, 103 bp, Artificial Sequence
  Synthetic Polynucleotide
taatacgactcactatagggagccaggggctgcatgagtggagaaagcacaacagaggagagtgcttatgccactcatgaacctggcggcagcgcaaaagatg

SEQ ID NO: 90832 - DNA, 103 bp, Artificial Sequence
  Synthetic Polynucleotide
taatacgactcactataggggcgagtggaaagccaggggctgcatgagtgaacagaggagacactcaatgagcccctggaacctggcggcagcgcaaaagatg

SEQ ID NO: 90833 - DNA, 103 bp, Artificial Sequence
  Synthetic Polynucleotide
taatacgactcactatagggtgcatcacaagcgagtggaaagccaggggcaacagaggagagcccctatgtttccactcaacctggcggcagcgcaaaagatg

SEQ ID NO: 90834 - DNA, 103 bp, Artificial Sequence
  Synthetic Polynucleotide
taatacgactcactatagggaattcctctttgcatcacaagcgagtggaaaacagaggagattccacatgcttgtgatgaacctggcggcagcgcaaaagatg

SEQ ID NO: 90835 - DNA, 103 bp, Artificial Sequence
  Synthetic Polynucleotide
taatacgactcactataggggtgatgtaaaaattcctctttgcatcacaaaacagaggagattgtgaatgaaagaggaaaacctggcggcagcgcaaaagatg

SEQ ID NO: 90836 - DNA, 103 bp, Artificial Sequence
  Synthetic Polynucleotide
taatacgactcactataggggaatttgtcggtgatgtaaaaattcctcttaacagaggagaaagaggatgttttacatcaacctggcggcagcgcaaaagatg

SEQ ID NO: 90837 - DNA, 103 bp, Artificial Sequence
  Synthetic Polynucleotide
taatacgactcactatagggccacttggagaaatcagaatgtacccacttaacagaggagaaagtggatgcattctgataacctggcggcagcgcaaaagatg

SEQ ID NO: 90838 - DNA, 103 bp, Artificial Sequence
  Synthetic Polynucleotide
taatacgactcactatagggcagctgctgagaatttgtcggtgatgtaaaaacagaggagatttacaatgccgacaaataacctggcggcagcgcaaaagatg

SEQ ID NO: 90839 - DNA, 103 bp, Artificial Sequence
  Synthetic Polynucleotide
taatacgactcactatagggagtgtctgtacagctgctgagaatttgtcgaacagaggagacgacaaatgctcagcagcaacctggcggcagcgcaaaagatg

SEQ ID NO: 90840 - DNA, 103 bp, Artificial Sequence
  Synthetic Polynucleotide
taatacgactcactataggggccgcagccaagtgtctgtacagctgctgaaacagaggagatcagcaatggtacagacaaacctggcggcagcgcaaaagatg

SEQ ID NO: 90841 - DNA, 103 bp, Artificial Sequence
  Synthetic Polynucleotide
taatacgactcactatagggtacaggtgtagccgcagccaagtgtctgtaaacagaggagatacagaatgttggctgcgaacctggcggcagcgcaaaagatg

SEQ ID NO: 90842 - DNA, 103 bp, Artificial Sequence
  Synthetic Polynucleotide
taatacgactcactatagggatgaacttcctacaggtgtagccgcagccaaacagaggagatggctgatgctacacctgaacctggcggcagcgcaaaagatg

SEQ ID NO: 90843 - DNA, 103 bp, Artificial Sequence
  Synthetic Polynucleotide
taatacgactcactatagggaggtccccatatgaacttcctacaggtgtaaacagaggagatacaccatgaggaagttcaacctggcggcagcgcaaaagatg

SEQ ID NO: 90844 - DNA, 103 bp, Artificial Sequence
  Synthetic Polynucleotide
taatacgactcactataggggttatgcaaaaggtccccatatgaacttccaacagaggagaggaagtatgtatggggacaacctggcggcagcgcaaaagatg

SEQ ID NO: 90845 - DNA, 103 bp, Artificial Sequence
  Synthetic Polynucleotide
taatacgactcactatagggggtaaatgctgttatgcaaaaggtccccataacagaggagaatggggatgttttgcataaacctggcggcagcgcaaaagatg

SEQ ID NO: 90846 - DNA, 103 bp, Artificial Sequence
  Synthetic Polynucleotide
taatacgactcactataggggcagctaaagggtaaatgctgttatgcaaaaacagaggagatttgcaatgcagcatttaaacctggcggcagcgcaaaagatg

SEQ ID NO: 90847 - DNA, 103 bp, Artificial Sequence
  Synthetic Polynucleotide
taatacgactcactatagggaggatttatagcagctaaagggtaaatgctaacagaggagaagcattatgcctttagctaacctggcggcagcgcaaaagatg

SEQ ID NO: 90848 - DNA, 103 bp, Artificial Sequence
  Synthetic Polynucleotide
taatacgactcactatagggagccacatctccacttggagaaatcagaataacagaggagaattctgatgtctccaagtaacctggcggcagcgcaaaagatg

SEQ ID NO: 90849 - DNA, 103 bp, Artificial Sequence
  Synthetic Polynucleotide
taatacgactcactatagggaggcagcttgaggatttatagcagctaaagaacagaggagactttagatgctataaatcaacctggcggcagcgcaaaagatg

SEQ ID NO: 90850 - DNA, 103 bp, Artificial Sequence
  Synthetic Polynucleotide
taatacgactcactataggggaagatggaaaggcagcttgaggatttataaacagaggagatataaaatgtcaagctgcaacctggcggcagcgcaaaagatg

SEQ ID NO: 90851 - DNA, 103 bp, Artificial Sequence
  Synthetic Polynucleotide
taatacgactcactatagggtgacagctgggaagatggaaaggcagcttgaacagaggagacaagctatgtttccatctaacctggcggcagcgcaaaagatg

SEQ ID NO: 90852 - DNA, 103 bp, Artificial Sequence
  Synthetic Polynucleotide
taatacgactcactatagggggtgcacggatgacagctgggaagatggaaaacagaggagattccatatgcccagctgtaacctggcggcagcgcaaaagatg

SEQ ID NO: 90853 - DNA, 103 bp, Artificial Sequence
  Synthetic Polynucleotide
taatacgactcactatagggtttgtactggggtgcacggatgacagctggaacagaggagaccagctatgatccgtgcaaacctggcggcagcgcaaaagatg

SEQ ID NO: 90854 - DNA, 103 bp, Artificial Sequence
  Synthetic Polynucleotide
taatacgactcactatagggccagcgtggaagccacatctccacttggagaacagaggagactccaaatggagatgtggaacctggcggcagcgcaaaagatg

SEQ ID NO: 90855 - DNA, 103 bp, Artificial Sequence
  Synthetic Polynucleotide
taatacgactcactatagggtttcactggtccagcgtggaagccacatctaacagaggagaagatgtatgttccacgctaacctggcggcagcgcaaaagatg

SEQ ID NO: 90856 - DNA, 103 bp, Artificial Sequence
  Synthetic Polynucleotide
taatacgactcactatagggaggcctcagttttcactggtccagcgtggaaacagaggagatccacgatggaccagtgaaacctggcggcagcgcaaaagatg

SEQ ID NO: 90857 - DNA, 103 bp, Artificial Sequence
  Synthetic Polynucleotide
taatacgactcactatagggttccttcccaaggcctcagttttcactggtaacagaggagaaccagtatgaactgaggcaacctggcggcagcgcaaaagatg

SEQ ID NO: 90858 - DNA, 103 bp, Artificial Sequence
  Synthetic Polynucleotide
taatacgactcactatagggaatgtaaggtccgtgcaagccacacggtgaaacagaggagatcaccgatgggcttgcacaacctggcggcagcgcaaaagatg

SEQ ID NO: 90859 - DNA, 103 bp, Artificial Sequence
  Synthetic Polynucleotide
taatacgactcactatagggcttctgtccattccttcccaaggcctcagtaacagaggagaactgagatgttgggaaggaacctggcggcagcgcaaaagatg

SEQ ID NO: 90860 - DNA, 103 bp, Artificial Sequence
  Synthetic Polynucleotide
taatacgactcactataggggcagagcttccttctgtccattccttcccaaacagaggagatgggaaatgatggacagaaacctggcggcagcgcaaaagatg

SEQ ID NO: 90861 - DNA, 103 bp, Artificial Sequence
  Synthetic Polynucleotide
taatacgactcactatagggctgtacttcagcagagcttccttctgtccaaacagaggagatggacaatgggaagctctaacctggcggcagcgcaaaagatg

SEQ ID NO: 90862 - DNA, 103 bp, Artificial Sequence
  Synthetic Polynucleotide
taatacgactcactatagggggttgactgcctgtacttcagcagagcttcaacagaggagagaagctatgctgaagtacaacctggcggcagcgcaaaagatg

SEQ ID NO: 90863 - DNA, 103 bp, Artificial Sequence
  Synthetic Polynucleotide
taatacgactcactatagggcactgtttagggttgactgcctgtacttcaaacagaggagatgaagtatgggcagtcaaaacctggcggcagcgcaaaagatg

SEQ ID NO: 90864 - DNA, 103 bp, Artificial Sequence
  Synthetic Polynucleotide
taatacgactcactatagggaagttgagtccactgtttagggttgactgcaacagaggagagcagtcatgcctaaacagaacctggcggcagcgcaaaagatg

SEQ ID NO: 90865 - DNA, 103 bp, Artificial Sequence
  Synthetic Polynucleotide
taatacgactcactatagggaacgtctttgaagttgagtccactgtttagaacagaggagactaaacatgggactcaacaacctggcggcagcgcaaaagatg

SEQ ID NO: 90866 - DNA, 103 bp, Artificial Sequence
  Synthetic Polynucleotide
taatacgactcactatagggtctccttgagaacgtctttgaagttgagtcaacagaggagagactcaatgtcaaagacgaacctggcggcagcgcaaaagatg

SEQ ID NO: 90867 - DNA, 103 bp, Artificial Sequence
  Synthetic Polynucleotide
taatacgactcactatagggaggtctgccttctccttgagaacgtctttgaacagaggagacaaagaatgtctcaaggaaacctggcggcagcgcaaaagatg

SEQ ID NO: 90868 - DNA, 103 bp, Artificial Sequence
  Synthetic Polynucleotide
taatacgactcactataggggtcctcccccaggtctgccttctccttgagaacagaggagactcaagatgaaggcagacaacctggcggcagcgcaaaagatg

SEQ ID NO: 90869 - DNA, 103 bp, Artificial Sequence
  Synthetic Polynucleotide
taatacgactcactatagggccttgtagaaaatgtaaggtccgtgcaagcaacagaggagagcttgcatggaccttacaaacctggcggcagcgcaaaagatg

SEQ ID NO: 90870 - DNA, 103 bp, Artificial Sequence
  Synthetic Polynucleotide
taatacgactcactatagggtttcttcctcgtcctcccccaggtctgcctaacagaggagaaggcagatgtgggggaggaacctggcggcagcgcaaaagatg

SEQ ID NO: 90871 - DNA, 103 bp, Artificial Sequence
  Synthetic Polynucleotide
taatacgactcactatagggatcacgttcgtttcttcctcgtcctcccccaacagaggagagggggaatgcgaggaagaaacctggcggcagcgcaaaagatg

SEQ ID NO: 90872 - DNA, 103 bp, Artificial Sequence
  Synthetic Polynucleotide
taatacgactcactataggggctgagaactatcacgttcgtttcttcctcaacagaggagagaggaaatgacgaacgtgaacctggcggcagcgcaaaagatg

SEQ ID NO: 90873 - DNA, 103 bp, Artificial Sequence
  Synthetic Polynucleotide
taatacgactcactatagggactgggggtagctgagaactatcacgttcgaacagaggagacgaacgatgtagttctcaaacctggcggcagcgcaaaagatg

SEQ ID NO: 90874 - DNA, 103 bp, Artificial Sequence
  Synthetic Polynucleotide
taatacgactcactatagggtaccggcagtactgggggtagctgagaactaacagaggagaagttctatgctacccccaaacctggcggcagcgcaaaagatg

SEQ ID NO: 90875 - DNA, 103 bp, Artificial Sequence
  Synthetic Polynucleotide
taatacgactcactatagggcatcgagcggtaccggcagtactgggggtaaacagaggagataccccatgtactgccggaacctggcggcagcgcaaaagatg

SEQ ID NO: 90876 - DNA, 103 bp, Artificial Sequence
  Synthetic Polynucleotide
taatacgactcactatagggtgcgtttcagcatcgagcggtaccggcagtaacagaggagaactgccatgaccgctcgaaacctggcggcagcgcaaaagatg

SEQ ID NO: 90877 - DNA, 103 bp, Artificial Sequence
  Synthetic Polynucleotide
taatacgactcactatagggttatcctggatgcgtttcagcatcgagcggaacagaggagaccgctcatggctgaaacgaacctggcggcagcgcaaaagatg

SEQ ID NO: 90878 - DNA, 103 bp, Artificial Sequence
  Synthetic Polynucleotide
taatacgactcactatagggggaagatggcttatcctggatgcgtttcagaacagaggagactgaaaatgatccaggataacctggcggcagcgcaaaagatg

SEQ ID NO: 90879 - DNA, 103 bp, Artificial Sequence
  Synthetic Polynucleotide
taatacgactcactatagggccgttagaatggaagatggcttatcctggaaacagaggagatccaggatgagccatcttaacctggcggcagcgcaaaagatg

SEQ ID NO: 90880 - DNA, 103 bp, Artificial Sequence
  Synthetic Polynucleotide
taatacgactcactatagggaattgaaaagccttgtagaaaatgtaaggtaacagaggagaaccttaatgtttctacaaaacctggcggcagcgcaaaagatg

SEQ ID NO: 90881 - DNA, 103 bp, Artificial Sequence
  Synthetic Polynucleotide
taatacgactcactataggggcaaactggtccgttagaatggaagatggcaacagaggagagccatcatgcattctaacaacctggcggcagcgcaaaagatg

SEQ ID NO: 90882 - DNA, 103 bp, Artificial Sequence
  Synthetic Polynucleotide
taatacgactcactatagggcagggccaatgcaaactggtccgttagaataacagaggagaattctaatggaccagtttaacctggcggcagcgcaaaagatg

SEQ ID NO: 90883 - DNA, 103 bp, Artificial Sequence
  Synthetic Polynucleotide
taatacgactcactatagggcaatgccccccagggccaatgcaaactggtaacagaggagaaccagtatgcattggcccaacctggcggcagcgcaaaagatg

SEQ ID NO: 90884 - DNA, 103 bp, Artificial Sequence
  Synthetic Polynucleotide
taatacgactcactatagggctgaccactgcaatgccccccagggccaataacagaggagaattggcatgggggggcataacctggcggcagcgcaaaagatg

SEQ ID NO: 90885 - DNA, 103 bp, Artificial Sequence
  Synthetic Polynucleotide
taatacgactcactatagggagggttcctgctgaccactgcaatgcccccaacagaggagagggggcatggcagtggtcaacctggcggcagcgcaaaagatg

SEQ ID NO: 90886 - DNA, 103 bp, Artificial Sequence
  Synthetic Polynucleotide
taatacgactcactatagggacaggatctgagggttcctgctgaccactgaacagaggagacagtggatggcaggaaccaacctggcggcagcgcaaaagatg

SEQ ID NO: 90887 - DNA, 103 bp, Artificial Sequence
  Synthetic Polynucleotide
taatacgactcactatagggtcccgacagtacaggatctgagggttcctgaacagaggagacaggaaatgtcagatcctaacctggcggcagcgcaaaagatg

SEQ ID NO: 90888 - DNA, 103 bp, Artificial Sequence
  Synthetic Polynucleotide
taatacgactcactataggggtcaaaggtgtcccgacagtacaggatctgaacagaggagacagatcatgtactgtcggaacctggcggcagcgcaaaagatg

SEQ ID NO: 90889 - DNA, 103 bp, Artificial Sequence
  Synthetic Polynucleotide
taatacgactcactataggggagtcgggtggtcaaaggtgtcccgacagtaacagaggagaactgtcatgacacctttgaacctggcggcagcgcaaaagatg

SEQ ID NO: 90890 - DNA, 103 bp, Artificial Sequence
  Synthetic Polynucleotide
taatacgactcactatagggttttctatgagagtcgggtggtcaaaggtgaacagaggagacaccttatgccacccgacaacctggcggcagcgcaaaagatg

SEQ ID NO: 90891 - DNA, 103 bp, Artificial Sequence
  Synthetic Polynucleotide
taatacgactcactatagggttcaaggtggaattgaaaagccttgtagaaaacagaggagattctacatggcttttcaaaacctggcggcagcgcaaaagatg

SEQ ID NO: 90892 - DNA, 103 bp, Artificial Sequence
  Synthetic Polynucleotide
taatacgactcactatagggtatactctcgttttctatgagagtcgggtgaacagaggagacacccgatgctcatagaaaacctggcggcagcgcaaaagatg

SEQ ID NO: 90893 - DNA, 103 bp, Artificial Sequence
  Synthetic Polynucleotide
taatacgactcactatagggactcatcgcatatactctcgttttctatgaaacagaggagatcatagatgacgagagtaaacctggcggcagcgcaaaagatg

SEQ ID NO: 90894 - DNA, 103 bp, Artificial Sequence
  Synthetic Polynucleotide
taatacgactcactatagggtttggcgcaaactcatcgcatatactctcgaacagaggagacgagagatgatgcgatgaaacctggcggcagcgcaaaagatg

SEQ ID NO: 90895 - DNA, 103 bp, Artificial Sequence
  Synthetic Polynucleotide
taatacgactcactataggggcctttaagatttggcgcaaactcatcgcaaacagaggagatgcgatatgtttgcgccaaacctggcggcagcgcaaaagatg

SEQ ID NO: 90896 - DNA, 103 bp, Artificial Sequence
  Synthetic Polynucleotide
taatacgactcactatagggtgcgtggtctgcctttaagatttggcgcaaaacagaggagattgcgcatgatcttaaagaacctggcggcagcgcaaaagatg

SEQ ID NO: 90897 - DNA, 103 bp, Artificial Sequence
  Synthetic Polynucleotide
taatacgactcactatagggggtttctttttgcgtggtctgcctttaagaaacagaggagatcttaaatgcagaccacgaacctggcggcagcgcaaaagatg

SEQ ID NO: 90898 - DNA, 103 bp, Artificial Sequence
  Synthetic Polynucleotide
taatacgactcactatagggttgtgggcatggtttctttttgcgtggtctaacagaggagaagaccaatgaaaaagaaaaacctggcggcagcgcaaaagatg

SEQ ID NO: 90899 - DNA, 103 bp, Artificial Sequence
  Synthetic Polynucleotide
taatacgactcactatagggaatctcttctttgtgggcatggtttcttttaacagaggagaaaaagaatgcatgcccacaacctggcggcagcgcaaaagatg

SEQ ID NO: 90900 - DNA, 103 bp, Artificial Sequence
  Synthetic Polynucleotide
taatacgactcactatagggccactgaatgaatctcttctttgtgggcataacagaggagaatgcccatgaagaagagaaacctggcggcagcgcaaaagatg

SEQ ID NO: 90901 - DNA, 103 bp, Artificial Sequence
  Synthetic Polynucleotide
taatacgactcactatagggatccttaacaccactgaatgaatctcttctaacagaggagaagaagaatgtcattcagtaacctggcggcagcgcaaaagatg

SEQ ID NO: 90902 - DNA, 103 bp, Artificial Sequence
  Synthetic Polynucleotide
taatacgactcactatagggttggtttgccttcaaggtggaattgaaaagaacagaggagacttttcatgtccaccttgaacctggcggcagcgcaaaagatg

SEQ ID NO: 90903 - DNA, 103 bp, Artificial Sequence
  Synthetic Polynucleotide
taatacgactcactatagggtgttgttggaatccttaacaccactgaatgaacagaggagacattcaatggtgttaaggaacctggcggcagcgcaaaagatg

SEQ ID NO: 90904 - DNA, 103 bp, Artificial Sequence
  Synthetic Polynucleotide
taatacgactcactatagggccatcggaattgttgttggaatccttaacaaacagaggagatgttaaatgttccaacaaaacctggcggcagcgcaaaagatg

SEQ ID NO: 90905 - DNA, 103 bp, Artificial Sequence
  Synthetic Polynucleotide
taatacgactcactatagggaacggctttgccatcggaattgttgttggaaacagaggagatccaacatgaattccgataacctggcggcagcgcaaaagatg

SEQ ID NO: 90906 - DNA, 103 bp, Artificial Sequence
  Synthetic Polynucleotide
taatacgactcactatagggtcaccttggcaacggctttgccatcggaataacagaggagaattccgatggcaaagccgaacctggcggcagcgcaaaagatg

SEQ ID NO: 90907 - DNA, 103 bp, Artificial Sequence
  Synthetic Polynucleotide
taatacgactcactataggggcctcacatttcaccttggcaacggctttgaacagaggagacaaagcatgtgccaaggtaacctggcggcagcgcaaaagatg

SEQ ID NO: 90908 - DNA, 103 bp, Artificial Sequence
  Synthetic Polynucleotide
taatacgactcactatagggggctgacctggcctcacatttcaccttggcaacagaggagagccaagatgaaatgtgagaacctggcggcagcgcaaaagatg

SEQ ID NO: 90909 - DNA, 103 bp, Artificial Sequence
  Synthetic Polynucleotide
taatacgactcactataggggcttggtcaaggctgacctggcctcacattaacagaggagaaatgtgatgccaggtcagaacctggcggcagcgcaaaagatg

SEQ ID NO: 90910 - DNA, 103 bp, Artificial Sequence
  Synthetic Polynucleotide
taatacgactcactatagggttattcttcggcttggtcaaggctgacctgaacagaggagacaggtcatgcttgaccaaaacctggcggcagcgcaaaagatg

SEQ ID NO: 90911 - DNA, 103 bp, Artificial Sequence
  Synthetic Polynucleotide
taatacgactcactatagggacagttatggttattcttcggcttggtcaaaacagaggagattgaccatgccgaagaataacctggcggcagcgcaaaagatg

SEQ ID NO: 90912 - DNA, 103 bp, Artificial Sequence
  Synthetic Polynucleotide
taatacgactcactatagggagacttttttacagttatggttattcttcgaacagaggagacgaagaatgaccataactaacctggcggcagcgcaaaagatg

SEQ ID NO: 90913 - DNA, 103 bp, Artificial Sequence
  Synthetic Polynucleotide
taatacgactcactataggggacaaaattcttggtttgccttcaaggtggaacagaggagaccacctatgaggcaaaccaacctggcggcagcgcaaaagatg

SEQ ID NO: 90914 - DNA, 103 bp, Artificial Sequence
  Synthetic Polynucleotide
taatacgactcactatagggtcttcatttgagacttttttacagttatggaacagaggagaccataaatgtaaaaaagtaacctggcggcagcgcaaaagatg

SEQ ID NO: 90915 - DNA, 103 bp, Artificial Sequence
  Synthetic Polynucleotide
taatacgactcactatagggctttggtttttcttcatttgagacttttttaacagaggagaaaaaaaatgtcaaatgaaaacctggcggcagcgcaaaagatg

SEQ ID NO: 90916 - DNA, 103 bp, Artificial Sequence
  Synthetic Polynucleotide
taatacgactcactatagggcaatggcaacctttggtttttcttcatttgaacagaggagacaaatgatgaaaaaccaaaacctggcggcagcgcaaaagatg

SEQ ID NO: 90917 - DNA, 103 bp, Artificial Sequence
  Synthetic Polynucleotide
taatacgactcactatagggcactcttcaccaatggcaacctttggttttaacagaggagaaaaaccatgggttgccataacctggcggcagcgcaaaagatg

SEQ ID NO: 90918 - DNA, 103 bp, Artificial Sequence
  Synthetic Polynucleotide
taatacgactcactatagggatctgccctgcactcttcaccaatggcaacaacagaggagagttgccatgggtgaagagaacctggcggcagcgcaaaagatg

SEQ ID NO: 90919 - DNA, 103 bp, Artificial Sequence
  Synthetic Polynucleotide
taatacgactcactatagggaggcttgttcatctgccctgcactcttcacaacagaggagagtgaagatggcagggcagaacctggcggcagcgcaaaagatg

SEQ ID NO: 90920 - DNA, 103 bp, Artificial Sequence
  Synthetic Polynucleotide
taatacgactcactataggggccaccaagaaggcttgttcatctgccctgaacagaggagacagggcatgtgaacaagcaacctggcggcagcgcaaaagatg

SEQ ID NO: 90921 - DNA, 103 bp, Artificial Sequence
  Synthetic Polynucleotide
taatacgactcactatagggtttataaagtgccaccaagaaggcttgttcaacagaggagagaacaaatgttcttggtgaacctggcggcagcgcaaaagatg

SEQ ID NO: 90922 - DNA, 103 bp, Artificial Sequence
  Synthetic Polynucleotide
taatacgactcactatagggctttcatgtatttataaagtgccaccaagaaacagaggagatcttggatgcactttataaacctggcggcagcgcaaaagatg

SEQ ID NO: 90923 - DNA, 103 bp, Artificial Sequence
  Synthetic Polynucleotide
taatacgactcactataggggttttcctttctttcatgtatttataaagtaacagaggagaactttaatgatacatgaaaacctggcggcagcgcaaaagatg

SEQ ID NO: 90924 - DNA, 103 bp, Artificial Sequence
  Synthetic Polynucleotide
taatacgactcactatagggcatttcggggttggcagtagtcgccgccataacagaggagaatggcgatgactactgccaacctggcggcagcgcaaaagatg

SEQ ID NO: 90925 - DNA, 103 bp, Artificial Sequence
  Synthetic Polynucleotide
taatacgactcactatagggagccctctggacaatggctcctccaccttgaacagaggagacaaggtatgggagccattaacctggcggcagcgcaaaagatg

SEQ ID NO: 90926 - DNA, 103 bp, Artificial Sequence
  Synthetic Polynucleotide
taatacgactcactatagggaatggccactaggcaaaacttgcttccctgaacagaggagacagggaatgaagttttgcaacctggcggcagcgcaaaagatg

SEQ ID NO: 90927 - DNA, 103 bp, Artificial Sequence
  Synthetic Polynucleotide
taatacgactcactataggggcaatctgccaatggccactaggcaaaactaacagaggagaagttttatgtagtggccaaacctggcggcagcgcaaaagatg

SEQ ID NO: 90928 - DNA, 103 bp, Artificial Sequence
  Synthetic Polynucleotide
taatacgactcactatagggctagttacctgcaatctgccaatggccactaacagaggagaagtggcatgtggcagattaacctggcggcagcgcaaaagatg

SEQ ID NO: 90929 - DNA, 103 bp, Artificial Sequence
  Synthetic Polynucleotide
taatacgactcactataggggttgggagaactagttacctgcaatctgccaacagaggagaggcagaatgcaggtaactaacctggcggcagcgcaaaagatg

SEQ ID NO: 90930 - DNA, 103 bp, Artificial Sequence
  Synthetic Polynucleotide
taatacgactcactatagggtgtctgtacagttgggagaactagttacctaacagaggagaaggtaaatggttctcccaaacctggcggcagcgcaaaagatg

SEQ ID NO: 90931 - DNA, 103 bp, Artificial Sequence
  Synthetic Polynucleotide
taatacgactcactatagggacattactcatgtctgtacagttgggagaaaacagaggagattctccatgctgtacagaaacctggcggcagcgcaaaagatg

SEQ ID NO: 90932 - DNA, 103 bp, Artificial Sequence
  Synthetic Polynucleotide
taatacgactcactatagggtggttgacaaacattactcatgtctgtacaaacagaggagatgtacaatgatgagtaataacctggcggcagcgcaaaagatg

SEQ ID NO: 90933 - DNA, 103 bp, Artificial Sequence
  Synthetic Polynucleotide
taatacgactcactatagggtgaactctgttggttgacaaacattactcaaacagaggagatgagtaatgtttgtcaacaacctggcggcagcgcaaaagatg

SEQ ID NO: 90934 - DNA, 103 bp, Artificial Sequence
  Synthetic Polynucleotide
taatacgactcactatagggtgtcgggagatgaactctgttggttgacaaaacagaggagattgtcaatgaacagagttaacctggcggcagcgcaaaagatg

SEQ ID NO: 90935 - DNA, 103 bp, Artificial Sequence
  Synthetic Polynucleotide
taatacgactcactatagggctcaatgttgtgtcgggagatgaactctgtaacagaggagaacagagatgatctcccgaaacctggcggcagcgcaaaagatg

SEQ ID NO: 90936 - DNA, 103 bp, Artificial Sequence
  Synthetic Polynucleotide
taatacgactcactataggggccgcttaatagccctctggacaatggctcaacagaggagagagccaatgtccagagggaacctggcggcagcgcaaaagatg

SEQ ID NO: 90937 - DNA, 103 bp, Artificial Sequence
  Synthetic Polynucleotide
taatacgactcactatagggtgaagataccctcaatgttgtgtcgggagaaacagaggagatctcccatgacaacattgaacctggcggcagcgcaaaagatg

SEQ ID NO: 90938 - DNA, 103 bp, Artificial Sequence
  Synthetic Polynucleotide
taatacgactcactatagggtccacaaaagtgaagataccctcaatgttgaacagaggagacaacatatggggtatcttaacctggcggcagcgcaaaagatg

SEQ ID NO: 90939 - DNA, 103 bp, Artificial Sequence
  Synthetic Polynucleotide
taatacgactcactatagggacagcggtgatccacaaaagtgaagataccaacagaggagaggtatcatgacttttgtgaacctggcggcagcgcaaaagatg

SEQ ID NO: 90940 - DNA, 103 bp, Artificial Sequence
  Synthetic Polynucleotide
taatacgactcactatagggcagtagccacacagcggtgatccacaaaagaacagaggagacttttgatgatcaccgctaacctggcggcagcgcaaaagatg

SEQ ID NO: 90941 - DNA, 103 bp, Artificial Sequence
  Synthetic Polynucleotide
taatacgactcactatagggtggtagccaacagtagccacacagcggtgaaacagaggagatcaccgatgtgtggctacaacctggcggcagcgcaaaagatg

SEQ ID NO: 90942 - DNA, 103 bp, Artificial Sequence
  Synthetic Polynucleotide
taatacgactcactatagggttcctgtggctggtagccaacagtagccacaacagaggagagtggctatggttggctacaacctggcggcagcgcaaaagatg

SEQ ID NO: 90943 - DNA, 103 bp, Artificial Sequence
  Synthetic Polynucleotide
taatacgactcactatagggttcctaagagttcctgtggctggtagccaaaacagaggagattggctatgagccacaggaacctggcggcagcgcaaaagatg

SEQ ID NO: 90944 - DNA, 103 bp, Artificial Sequence
  Synthetic Polynucleotide
taatacgactcactatagggacaatattctttcctaagagttcctgtggcaacagaggagagccacaatgactcttaggaacctggcggcagcgcaaaagatg

SEQ ID NO: 90945 - DNA, 103 bp, Artificial Sequence
  Synthetic Polynucleotide
taatacgactcactatagggacagaattctacaatattctttcctaagagaacagaggagactcttaatgaagaatattaacctggcggcagcgcaaaagatg

SEQ ID NO: 90946 - DNA, 103 bp, Artificial Sequence
  Synthetic Polynucleotide
taatacgactcactatagggcttcaggatgacagaattctacaatattctaacagaggagaagaataatgtagaattctaacctggcggcagcgcaaaagatg

SEQ ID NO: 90947 - DNA, 103 bp, Artificial Sequence
  Synthetic Polynucleotide
taatacgactcactatagggagccctggtcgccgcttaatagccctctggaacagaggagaccagagatgtattaagcgaacctggcggcagcgcaaaagatg

SEQ ID NO: 90948 - DNA, 103 bp, Artificial Sequence
  Synthetic Polynucleotide
taatacgactcactatagggagctgctggtcttcaggatgacagaattctaacagaggagaagaattatgtcatcctgaaacctggcggcagcgcaaaagatg

SEQ ID NO: 90949 - DNA, 103 bp, Artificial Sequence
  Synthetic Polynucleotide
taatacgactcactataggggtctcttagaagctgctggtcttcaggatgaacagaggagacatcctatggaccagcagaacctggcggcagcgcaaaagatg

SEQ ID NO: 90950 - DNA, 103 bp, Artificial Sequence
  Synthetic Polynucleotide
taatacgactcactataggggttggaagctgtctcttagaagctgctggtaacagaggagaaccagcatgttctaagagaacctggcggcagcgcaaaagatg

SEQ ID NO: 90951 - DNA, 103 bp, Artificial Sequence
  Synthetic Polynucleotide
taatacgactcactatagggttcactacctgttggaagctgtctcttagaaacagaggagatctaagatgcagcttccaaacctggcggcagcgcaaaagatg

SEQ ID NO: 90952 - DNA, 103 bp, Artificial Sequence
  Synthetic Polynucleotide
taatacgactcactataggggccttttaatttcactacctgttggaagctaacagaggagaagcttcatgcaggtagtgaacctggcggcagcgcaaaagatg

SEQ ID NO: 90953 - DNA, 103 bp, Artificial Sequence
  Synthetic Polynucleotide
taatacgactcactatagggacagcacttggccttttaatttcactacctaacagaggagaaggtagatgaattaaaagaacctggcggcagcgcaaaagatg

SEQ ID NO: 90954 - DNA, 103 bp, Artificial Sequence
  Synthetic Polynucleotide
taatacgactcactatagggaacatgacagacagcacttggccttttaataacagaggagaattaaaatgccaagtgctaacctggcggcagcgcaaaagatg

SEQ ID NO: 90955 - DNA, 103 bp, Artificial Sequence
  Synthetic Polynucleotide
taatacgactcactatagggccggaaccggaacatgacagacagcacttgaacagaggagacaagtgatgtctgtcatgaacctggcggcagcgcaaaagatg

SEQ ID NO: 90956 - DNA, 103 bp, Artificial Sequence
  Synthetic Polynucleotide
taatacgactcactatagggggttcttagaccggaaccggaacatgacagaacagaggagactgtcaatgtccggttccaacctggcggcagcgcaaaagatg

SEQ ID NO: 90957 - DNA, 103 bp, Artificial Sequence
  Synthetic Polynucleotide
taatacgactcactatagggagccattcttggttcttagaccggaaccggaacagaggagaccggttatggtctaagaaaacctggcggcagcgcaaaagatg

SEQ ID NO: 90958 - DNA, 103 bp, Artificial Sequence
  Synthetic Polynucleotide
taatacgactcactatagggatcaaaatccagccctggtcgccgcttaataacagaggagaattaagatgcgaccagggaacctggcggcagcgcaaaagatg

SEQ ID NO: 90959 - DNA, 103 bp, Artificial Sequence
  Synthetic Polynucleotide
taatacgactcactatagggtctcatccagagccattcttggttcttagaaacagaggagatctaagatgcaagaatggaacctggcggcagcgcaaaagatg

SEQ ID NO: 90960 - DNA, 103 bp, Artificial Sequence
  Synthetic Polynucleotide
taatacgactcactatagggaggagctggttctcatccagagccattcttaacagaggagaaagaatatgtctggatgaaacctggcggcagcgcaaaagatg

SEQ ID NO: 90961 - DNA, 103 bp, Artificial Sequence
  Synthetic Polynucleotide
taatacgactcactatagggtggaaagtaaaggagctggttctcatccagaacagaggagactggatatgaaccagctcaacctggcggcagcgcaaaagatg

SEQ ID NO: 90962 - DNA, 103 bp, Artificial Sequence
  Synthetic Polynucleotide
taatacgactcactataggggtaagggttctggaaagtaaaggagctggtaacagaggagaaccagcatgtttactttcaacctggcggcagcgcaaaagatg

SEQ ID NO: 90963 - DNA, 103 bp, Artificial Sequence
  Synthetic Polynucleotide
taatacgactcactatagggtttcatctgagtaagggttctggaaagtaaaacagaggagattacttatgagaacccttaacctggcggcagcgcaaaagatg

SEQ ID NO: 90964 - DNA, 103 bp, Artificial Sequence
  Synthetic Polynucleotide
taatacgactcactatagggatgtactcaatttcatctgagtaagggttcaacagaggagagaacccatgctcagatgaaacctggcggcagcgcaaaagatg

SEQ ID NO: 90965 - DNA, 103 bp, Artificial Sequence
  Synthetic Polynucleotide
taatacgactcactatagggggtacagatgatgtactcaatttcatctgaaacagaggagatcagatatgattgagtacaacctggcggcagcgcaaaagatg

SEQ ID NO: 90966 - DNA, 103 bp, Artificial Sequence
  Synthetic Polynucleotide
taatacgactcactatagggcattggtgttggtacagatgatgtactcaaaacagaggagattgagtatgtcatctgtaaacctggcggcagcgcaaaagatg

SEQ ID NO: 90967 - DNA, 103 bp, Artificial Sequence
  Synthetic Polynucleotide
taatacgactcactataggggagttcttcacattggtgttggtacagatgaacagaggagacatctgatgcaacaccaaaacctggcggcagcgcaaaagatg

SEQ ID NO: 90968 - DNA, 103 bp, Artificial Sequence
  Synthetic Polynucleotide
taatacgactcactatagggttcttggctagagttcttcacattggtgttaacagaggagaaacaccatggtgaagaacaacctggcggcagcgcaaaagatg

SEQ ID NO: 90969 - DNA, 103 bp, Artificial Sequence
  Synthetic Polynucleotide
taatacgactcactatagggctccatcatcatcaaaatccagccctggtcaacagaggagagaccagatgtggattttgaacctggcggcagcgcaaaagatg

SEQ ID NO: 90970 - DNA, 103 bp, Artificial Sequence
  Synthetic Polynucleotide
taatacgactcactatagggtaggccgtggttcttggctagagttcttcaaacagaggagatgaagaatgctagccaagaacctggcggcagcgcaaaagatg

SEQ ID NO: 90971 - DNA, 103 bp, Artificial Sequence
  Synthetic Polynucleotide
taatacgactcactatagggttggagagtgtaggccgtggttcttggctaaacagaggagatagccaatgaccacggccaacctggcggcagcgcaaaagatg

SEQ ID NO: 90972 - DNA, 103 bp, Artificial Sequence
  Synthetic Polynucleotide
taatacgactcactatagggctggattgtgttggagagtgtaggccgtggaacagaggagaccacggatgacactctccaacctggcggcagcgcaaaagatg

SEQ ID NO: 90973 - DNA, 103 bp, Artificial Sequence
  Synthetic Polynucleotide
taatacgactcactataggggttgtggcctctggattgtgttggagagtgaacagaggagacactctatgacacaatccaacctggcggcagcgcaaaagatg

SEQ ID NO: 90974 - DNA, 103 bp, Artificial Sequence
  Synthetic Polynucleotide
taatacgactcactataggggtgggacctagttgtggcctctggattgtgaacagaggagacacaatatggaggccacaaacctggcggcagcgcaaaagatg

SEQ ID NO: 90975 - DNA, 103 bp, Artificial Sequence
  Synthetic Polynucleotide
taatacgactcactatagggtaaattagctgtgggacctagttgtggcctaacagaggagaaggccaatgctaggtcccaacctggcggcagcgcaaaagatg

SEQ ID NO: 90976 - DNA, 103 bp, Artificial Sequence
  Synthetic Polynucleotide
taatacgactcactatagggtctccaggggtaaattagctgtgggacctaaacagaggagataggtcatgcagctaattaacctggcggcagcgcaaaagatg

SEQ ID NO: 90977 - DNA, 103 bp, Artificial Sequence
  Synthetic Polynucleotide
taatacgactcactatagggcctgagcccatctccaggggtaaattagctaacagaggagaagctaaatgacccctggaaacctggcggcagcgcaaaagatg

SEQ ID NO: 90978 - DNA, 103 bp, Artificial Sequence
  Synthetic Polynucleotide
taatacgactcactatagggtgccagctgtcctgagcccatctccaggggaacagaggagacccctgatgatgggctcaaacctggcggcagcgcaaaagatg

SEQ ID NO: 90979 - DNA, 103 bp, Artificial Sequence
  Synthetic Polynucleotide
taatacgactcactataggggctgcctgggtgccagctgtcctgagcccaaacagaggagatgggctatggacagctggaacctggcggcagcgcaaaagatg

SEQ ID NO: 90980 - DNA, 103 bp, Artificial Sequence
  Synthetic Polynucleotide
taatacgactcactatagggctgttcccttctccatcatcatcaaaatccaacagaggagaggatttatgtgatgatggaacctggcggcagcgcaaaagatg

SEQ ID NO: 90981 - DNA, 103 bp, Artificial Sequence
  Synthetic Polynucleotide
taatacgactcactatagggtgctgttgctgctgcctgggtgccagctgtaacagaggagaacagctatgacccaggcaaacctggcggcagcgcaaaagatg

SEQ ID NO: 90982 - DNA, 103 bp, Artificial Sequence
  Synthetic Polynucleotide
taatacgactcactatagggcaattctgtttgctgttgctgctgcctgggaacagaggagacccaggatgcagcaacagaacctggcggcagcgcaaaagatg

SEQ ID NO: 90983 - DNA, 103 bp, Artificial Sequence
  Synthetic Polynucleotide
taatacgactcactataggggtaccatgtccaattctgtttgctgttgctaacagaggagaagcaacatgaaacagaataacctggcggcagcgcaaaagatg

SEQ ID NO: 90984 - DNA, 103 bp, Artificial Sequence
  Synthetic Polynucleotide
taatacgactcactatagggtctcttcctggtaccatgtccaattctgttaacagaggagaaacagaatgggacatggtaacctggcggcagcgcaaaagatg

SEQ ID NO: 90985 - DNA, 103 bp, Artificial Sequence
  Synthetic Polynucleotide
taatacgactcactatagggggccagtccatctcttcctggtaccatgtcaacagaggagagacatgatgccaggaagaaacctggcggcagcgcaaaagatg

SEQ ID NO: 90986 - DNA, 103 bp, Artificial Sequence
  Synthetic Polynucleotide
taatacgactcactataggggattgtagctggccagtccatctcttcctgaacagaggagacaggaaatgatggactggaacctggcggcagcgcaaaagatg

SEQ ID NO: 90987 - DNA, 103 bp, Artificial Sequence
  Synthetic Polynucleotide
taatacgactcactatagggacctgggaatgattgtagctggccagtccaaacagaggagatggactatgcagctacaaaacctggcggcagcgcaaaagatg

SEQ ID NO: 90988 - DNA, 103 bp, Artificial Sequence
  Synthetic Polynucleotide
taatacgactcactatagggaggctgaaccacctgggaatgattgtagctaacagaggagaagctacatgcattcccagaacctggcggcagcgcaaaagatg

SEQ ID NO: 90989 - DNA, 103 bp, Artificial Sequence
  Synthetic Polynucleotide
taatacgactcactatagggtggttgtcacaggctgaaccacctgggaataacagaggagaattcccatgtggttcagcaacctggcggcagcgcaaaagatg

SEQ ID NO: 90990 - DNA, 103 bp, Artificial Sequence
  Synthetic Polynucleotide
taatacgactcactatagggtctggtcctgtggttgtcacaggctgaaccaacagaggagaggttcaatgtgtgacaacaacctggcggcagcgcaaaagatg

SEQ ID NO: 90991 - DNA, 103 bp, Artificial Sequence
  Synthetic Polynucleotide
taatacgactcactatagggcaaaaatttactgttcccttctccatcatcaacagaggagagatgatatggaagggaacaacctggcggcagcgcaaaagatg

SEQ ID NO: 90992 - DNA, 103 bp, Artificial Sequence
  Synthetic Polynucleotide
taatacgactcactatagggcttgctgtgttctggtcctgtggttgtcacaacagaggagagtgacaatgacaggaccaaacctggcggcagcgcaaaagatg

SEQ ID NO: 90993 - DNA, 103 bp, Artificial Sequence
  Synthetic Polynucleotide
taatacgactcactatagggtctcaaggggcttgctgtgttctggtcctgaacagaggagacaggacatgaacacagcaaacctggcggcagcgcaaaagatg

SEQ ID NO: 90994 - DNA, 103 bp, Artificial Sequence
  Synthetic Polynucleotide
taatacgactcactatagggccatctgacttctcaaggggcttgctgtgtaacagaggagaacacagatggccccttgaaacctggcggcagcgcaaaagatg

SEQ ID NO: 90995 - DNA, 103 bp, Artificial Sequence
  Synthetic Polynucleotide
taatacgactcactatagggggcaaataaaccatctgacttctcaaggggaacagaggagaccccttatgaagtcagataacctggcggcagcgcaaaagatg

SEQ ID NO: 90996 - DNA, 103 bp, Artificial Sequence
  Synthetic Polynucleotide
taatacgactcactatagggctctatcctgggcaaataaaccatctgactaacagaggagaagtcagatggtttatttgaacctggcggcagcgcaaaagatg

SEQ ID NO: 90997 - DNA, 103 bp, Artificial Sequence
  Synthetic Polynucleotide
taatacgactcactatagggaatcttggatctctatcctgggcaaataaaaacagaggagatttattatgccaggatagaacctggcggcagcgcaaaagatg

SEQ ID NO: 90998 - DNA, 103 bp, Artificial Sequence
  Synthetic Polynucleotide
taatacgactcactataggggatttctgaaaatcttggatctctatcctgaacagaggagacaggatatggatccaagaaacctggcggcagcgcaaaagatg

SEQ ID NO: 90999 - DNA, 103 bp, Artificial Sequence
  Synthetic Polynucleotide
taatacgactcactatagggtgttgtgatagatttctgaaaatcttggataacagaggagaatccaaatgtttcagaaaaacctggcggcagcgcaaaagatg

SEQ ID NO: 91000 - DNA, 103 bp, Artificial Sequence
  Synthetic Polynucleotide
taatacgactcactatagggtccgcattgatgttgtgatagatttctgaaaacagaggagattcagaatgctatcacaaaacctggcggcagcgcaaaagatg

SEQ ID NO: 91001 - DNA, 103 bp, Artificial Sequence
  Synthetic Polynucleotide
taatacgactcactatagggtttactctgatccgcattgatgttgtgataaacagaggagatatcacatgatcaatgcgaacctggcggcagcgcaaaagatg

SEQ ID NO: 91002 - DNA, 103 bp, Artificial Sequence
  Synthetic Polynucleotide
taatacgactcactatagggcatcacacctcaaaaatttactgttcccttaacagaggagaaagggaatggtaaattttaacctggcggcagcgcaaaagatg

SEQ ID NO: 91003 - DNA, 103 bp, Artificial Sequence
  Synthetic Polynucleotide
taatacgactcactatagggaggagatgcctttactctgatccgcattgaaacagaggagatcaatgatgatcagagtaaacctggcggcagcgcaaaagatg

SEQ ID NO: 91004 - DNA, 103 bp, Artificial Sequence
  Synthetic Polynucleotide
taatacgactcactatagggacagtgctggaggagatgcctttactctgaaacagaggagatcagagatgaggcatctcaacctggcggcagcgcaaaagatg

SEQ ID NO: 91005 - DNA, 103 bp, Artificial Sequence
  Synthetic Polynucleotide
taatacgactcactatagggggtggcagggacagtgctggaggagatgccaacagaggagaggcatcatgtccagcactaacctggcggcagcgcaaaagatg

SEQ ID NO: 91006 - DNA, 103 bp, Artificial Sequence
  Synthetic Polynucleotide
taatacgactcactatagggatagctgttgggtggcagggacagtgctggaacagaggagaccagcaatgtccctgccaaacctggcggcagcgcaaaagatg

SEQ ID NO: 91007 - DNA, 103 bp, Artificial Sequence
  Synthetic Polynucleotide
taatacgactcactatagggccctgggagaatagctgttgggtggcagggaacagaggagaccctgcatgccaacagctaacctggcggcagcgcaaaagatg

SEQ ID NO: 91008 - DNA, 103 bp, Artificial Sequence
  Synthetic Polynucleotide
taatacgactcactataggggaatgtgttgccctgggagaatagctgttgaacagaggagacaacagatgttctcccagaacctggcggcagcgcaaaagatg

SEQ ID NO: 91009 - DNA, 103 bp, Artificial Sequence
  Synthetic Polynucleotide
taatacgactcactataggggggtaggagggaatgtgttgccctgggagaaacagaggagatctcccatggcaacacataacctggcggcagcgcaaaagatg

SEQ ID NO: 91010 - DNA, 103 bp, Artificial Sequence
  Synthetic Polynucleotide
taatacgactcactataggggccggccggggggtaggagggaatgtgttgaacagaggagacaacacatgccctcctacaacctggcggcagcgcaaaagatg

SEQ ID NO: 91011 - DNA, 103 bp, Artificial Sequence
  Synthetic Polynucleotide
taatacgactcactataggggaaattctctgccggccggggggtaggaggaacagaggagacctcctatgccccggccgaacctggcggcagcgcaaaagatg

SEQ ID NO: 91012 - DNA, 103 bp, Artificial Sequence
  Synthetic Polynucleotide
taatacgactcactatagggctaggccactgaaattctctgccggccgggaacagaggagacccggcatgcagagaattaacctggcggcagcgcaaaagatg

SEQ ID NO: 91013 - DNA, 103 bp, Artificial Sequence
  Synthetic Polynucleotide
taatacgactcactatagggatctgatcatcatcacacctcaaaaatttaaacagaggagataaattatggaggtgtgaaacctggcggcagcgcaaaagatg

SEQ ID NO: 91014 - DNA, 103 bp, Artificial Sequence
  Synthetic Polynucleotide
taatacgactcactatagggacaggaggggctaggccactgaaattctctaacagaggagaagagaaatgcagtggcctaacctggcggcagcgcaaaagatg

SEQ ID NO: 91015 - DNA, 103 bp, Artificial Sequence
  Synthetic Polynucleotide
taatacgactcactataggggacaatggttacaggaggggctaggccactaacagaggagaagtggcatggcccctcctaacctggcggcagcgcaaaagatg

SEQ ID NO: 91016 - DNA, 103 bp, Artificial Sequence
  Synthetic Polynucleotide
taatacgactcactatagggctgatggctggacaatggttacaggaggggaacagaggagacccctcatgtaaccattgaacctggcggcagcgcaaaagatg

SEQ ID NO: 91017 - DNA, 103 bp, Artificial Sequence
  Synthetic Polynucleotide
taatacgactcactatagggcctgcagaagctgatggctggacaatggttaacagaggagaaaccatatgccagccatcaacctggcggcagcgcaaaagatg

SEQ ID NO: 91018 - DNA, 103 bp, Artificial Sequence
  Synthetic Polynucleotide
taatacgactcactatagggcaacatctgtcctgcagaagctgatggctgaacagaggagacagccaatggcttctgcaaacctggcggcagcgcaaaagatg

SEQ ID NO: 91019 - DNA, 103 bp, Artificial Sequence
  Synthetic Polynucleotide
taatacgactcactatagggaaatctgggccaacatctgtcctgcagaagaacagaggagacttctgatggacagatgtaacctggcggcagcgcaaaagatg

SEQ ID NO: 91020 - DNA, 103 bp, Artificial Sequence
  Synthetic Polynucleotide
taatacgactcactataggggagtggcgggaaatctgggccaacatctgtaacagaggagaacagatatgggcccagataacctggcggcagcgcaaaagatg

SEQ ID NO: 91021 - DNA, 103 bp, Artificial Sequence
  Synthetic Polynucleotide
taatacgactcactatagggggtggggttggagtggcgggaaatctgggcaacagaggagagcccagatgtcccgccacaacctggcggcagcgcaaaagatg

SEQ ID NO: 91022 - DNA, 103 bp, Artificial Sequence
  Synthetic Polynucleotide
taatacgactcactatagggttgctccttgggtggggttggagtggcgggaacagaggagacccgccatgccaaccccaaacctggcggcagcgcaaaagatg

SEQ ID NO: 91023 - DNA, 103 bp, Artificial Sequence
  Synthetic Polynucleotide
taatacgactcactatagggcaagttggggttgctccttgggtggggttgaacagaggagacaacccatgccaaggagcaacctggcggcagcgcaaaagatg

SEQ ID NO: 91024 - DNA, 103 bp, Artificial Sequence
  Synthetic Polynucleotide
taatacgactcactatagggatcgttagacatctgatcatcatcacacctaacagaggagaaggtgtatggatgatcagaacctggcggcagcgcaaaagatg

SEQ ID NO: 91025 - DNA, 103 bp, Artificial Sequence
  Synthetic Polynucleotide
taatacgactcactatagggagtaggggtccaagttggggttgctccttgaacagaggagacaaggaatgaccccaactaacctggcggcagcgcaaaagatg

SEQ ID NO: 91026 - DNA, 103 bp, Artificial Sequence
  Synthetic Polynucleotide
taatacgactcactatagggctgagcgggtagtaggggtccaagttggggaacagaggagaccccaaatgggacccctaaacctggcggcagcgcaaaagatg

SEQ ID NO: 91027 - DNA, 103 bp, Artificial Sequence
  Synthetic Polynucleotide
taatacgactcactataggggcagaaaagcctgagcgggtagtaggggtcaacagaggagagaccccatgtacccgctcaacctggcggcagcgcaaaagatg

SEQ ID NO: 91028 - DNA, 103 bp, Artificial Sequence
  Synthetic Polynucleotide
taatacgactcactatagggcacctgctgggcagaaaagcctgagcgggtaacagaggagaacccgcatgggcttttctaacctggcggcagcgcaaaagatg

SEQ ID NO: 91029 - DNA, 103 bp, Artificial Sequence
  Synthetic Polynucleotide
taatacgactcactatagggcctgggtagccacctgctgggcagaaaagcaacagaggagagcttttatgcccagcaggaacctggcggcagcgcaaaagatg

SEQ ID NO: 91030 - DNA, 103 bp, Artificial Sequence
  Synthetic Polynucleotide
taatacgactcactatagggttagcagtagcctgggtagccacctgctggaacagaggagaccagcaatgggctacccaaacctggcggcagcgcaaaagatg

SEQ ID NO: 91031 - DNA, 103 bp, Artificial Sequence
  Synthetic Polynucleotide
taatacgactcactatagggagtacgagtcttagcagtagcctgggtagcaacagaggagagctaccatggctactgctaacctggcggcagcgcaaaagatg

SEQ ID NO: 91032 - DNA, 103 bp, Artificial Sequence
  Synthetic Polynucleotide
taatacgactcactatagggcaaactgggaagtacgagtcttagcagtagaacagaggagactactgatgagactcgtaaacctggcggcagcgcaaaagatg

SEQ ID NO: 91033 - DNA, 103 bp, Artificial Sequence
  Synthetic Polynucleotide
taatacgactcactatagggctgcccacaccaaactgggaagtacgagtcaacagaggagagactcgatgttcccagttaacctggcggcagcgcaaaagatg

SEQ ID NO: 91034 - DNA, 103 bp, Artificial Sequence
  Synthetic Polynucleotide
taatacgactcactatagggagtctgaaagctgcccacaccaaactgggaaacagaggagatcccagatgggtgtgggcaacctggcggcagcgcaaaagatg

SEQ ID NO: 91035 - DNA, 103 bp, Artificial Sequence
  Synthetic Polynucleotide
taatacgactcactatagggcatctgatgtcatttcggggttggcagtagaacagaggagactactgatgaccccgaaaaacctggcggcagcgcaaaagatg

SEQ ID NO: 91036 - DNA, 103 bp, Artificial Sequence
  Synthetic Polynucleotide
taatacgactcactatagggaccgctccttatcgttagacatctgatcataacagaggagaatgatcatgtgtctaacgaacctggcggcagcgcaaaagatg

SEQ ID NO: 91037 - DNA, 103 bp, Artificial Sequence
  Synthetic Polynucleotide
taatacgactcactatagggaggaggatggagtctgaaagctgcccacacaacagaggagagtgtggatggctttcagaaacctggcggcagcgcaaaagatg

SEQ ID NO: 91038 - DNA, 103 bp, Artificial Sequence
  Synthetic Polynucleotide
taatacgactcactatagggatggagctgaaggaggatggagtctgaaagaacagaggagactttcaatgtccatcctcaacctggcggcagcgcaaaagatg

SEQ ID NO: 91039 - DNA, 103 bp, Artificial Sequence
  Synthetic Polynucleotide
taatacgactcactatagggagggagggacatggagctgaaggaggatggaacagaggagaccatccatgttcagctccaacctggcggcagcgcaaaagatg

SEQ ID NO: 91040 - DNA, 103 bp, Artificial Sequence
  Synthetic Polynucleotide
taatacgactcactatagggttggggcaccagggagggacatggagctgaaacagaggagatcagctatgtgtccctccaacctggcggcagcgcaaaagatg

SEQ ID NO: 91041 - DNA, 103 bp, Artificial Sequence
  Synthetic Polynucleotide
taatacgactcactatagggggcgatgcagttggggcaccagggagggacaacagaggagagtccctatgtggtgccccaacctggcggcagcgcaaaagatg

SEQ ID NO: 91042 - DNA, 103 bp, Artificial Sequence
  Synthetic Polynucleotide
taatacgactcactatagggagcagcaccaggcgatgcagttggggcaccaacagaggagaggtgccatgactgcatcgaacctggcggcagcgcaaaagatg

SEQ ID NO: 91043 - DNA, 103 bp, Artificial Sequence
  Synthetic Polynucleotide
taatacgactcactatagggtagggtaggcagcagcaccaggcgatgcagaacagaggagactgcatatgctggtgctgaacctggcggcagcgcaaaagatg

SEQ ID NO: 91044 - DNA, 103 bp, Artificial Sequence
  Synthetic Polynucleotide
taatacgactcactatagggttggtgagactagggtaggcagcagcaccaaacagaggagatggtgcatgtgcctacccaacctggcggcagcgcaaaagatg

SEQ ID NO: 91045 - DNA, 103 bp, Artificial Sequence
  Synthetic Polynucleotide
taatacgactcactatagggagatccacgattggtgagactagggtaggcaacagaggagagcctacatgagtctcaccaacctggcggcagcgcaaaagatg

SEQ ID NO: 91046 - DNA, 103 bp, Artificial Sequence
  Synthetic Polynucleotide
taatacgactcactataggggagcaaagttagatccacgattggtgagacaacagaggagagtctcaatgatcgtggataacctggcggcagcgcaaaagatg

SEQ ID NO: 91047 - DNA, 103 bp, Artificial Sequence
  Synthetic Polynucleotide
taatacgactcactataggggacctggcaaaccgctccttatcgttagacaacagaggagagtctaaatgtaaggagcgaacctggcggcagcgcaaaagatg

SEQ ID NO: 91048 - DNA, 103 bp, Artificial Sequence
  Synthetic Polynucleotide
taatacgactcactatagggccagtctcaggagcaaagttagatccacgaaacagaggagatcgtggatgtaactttgcaacctggcggcagcgcaaaagatg

SEQ ID NO: 91049 - DNA, 103 bp, Artificial Sequence
  Synthetic Polynucleotide
taatacgactcactatagggtgcagtctgtccagtctcaggagcaaagttaacagaggagaaactttatgcctgagactaacctggcggcagcgcaaaagatg

SEQ ID NO: 91050 - DNA, 103 bp, Artificial Sequence
  Synthetic Polynucleotide
taatacgactcactatagggggaattgtcctgcagtctgtccagtctcagaacagaggagactgagaatggacagactgaacctggcggcagcgcaaaagatg

SEQ ID NO: 91051 - DNA, 103 bp, Artificial Sequence
  Synthetic Polynucleotide
taatacgactcactataggggtccgtgtctggaattgtcctgcagtctgtaacagaggagaacagacatgaggacaattaacctggcggcagcgcaaaagatg

SEQ ID NO: 91052 - DNA, 103 bp, Artificial Sequence
  Synthetic Polynucleotide
taatacgactcactatagggaccctctgctgtccgtgtctggaattgtccaacagaggagaggacaaatgcagacacggaacctggcggcagcgcaaaagatg

SEQ ID NO: 91053 - DNA, 103 bp, Artificial Sequence
  Synthetic Polynucleotide
taatacgactcactatagggagacacccacaccctctgctgtccgtgtctaacagaggagaagacacatgcagcagaggaacctggcggcagcgcaaaagatg

SEQ ID NO: 91054 - DNA, 103 bp, Artificial Sequence
  Synthetic Polynucleotide
taatacgactcactatagggcactgtggccagacacccacaccctctgctaacagaggagaagcagaatgtgtgggtgtaacctggcggcagcgcaaaagatg

SEQ ID NO: 91055 - DNA, 103 bp, Artificial Sequence
  Synthetic Polynucleotide
taatacgactcactatagggctggccctgccactgtggccagacacccacaacagaggagagtgggtatgtggccacagaacctggcggcagcgcaaaagatg

SEQ ID NO: 91056 - DNA, 103 bp, Artificial Sequence
  Synthetic Polynucleotide
taatacgactcactataggggatgaggctgctggccctgccactgtggccaacagaggagaggccacatgggcagggccaacctggcggcagcgcaaaagatg

SEQ ID NO: 91057 - DNA, 103 bp, Artificial Sequence
  Synthetic Polynucleotide
taatacgactcactatagggcttgaacgatgatgaggctgctggccctgcaacagaggagagcagggatggcagcctcaaacctggcggcagcgcaaaagatg

SEQ ID NO: 91058 - DNA, 103 bp, Artificial Sequence
  Synthetic Polynucleotide
taatacgactcactatagggctcatcatccgacctggcaaaccgctccttaacagaggagaaaggagatgtttgccaggaacctggcggcagcgcaaaagatg

SEQ ID NO: 91059 - DNA, 103 bp, Artificial Sequence
  Synthetic Polynucleotide
taatacgactcactatagggctcactagaacttgaacgatgatgaggctgaacagaggagacagcctatgcatcgttcaaacctggcggcagcgcaaaagatg

SEQ ID NO: 91060 - DNA, 103 bp, Artificial Sequence
  Synthetic Polynucleotide
taatacgactcactataggggaacatgttgctcactagaacttgaacgataacagaggagaatcgttatggttctagtgaacctggcggcagcgcaaaagatg

SEQ ID NO: 91061 - DNA, 103 bp, Artificial Sequence
  Synthetic Polynucleotide
taatacgactcactatagggggcggttgttgaacatgttgctcactagaaaacagaggagattctagatggcaacatgtaacctggcggcagcgcaaaagatg

SEQ ID NO: 91062 - DNA, 103 bp, Artificial Sequence
  Synthetic Polynucleotide
taatacgactcactatagggttgctgtgctggcggttgttgaacatgttgaacagaggagacaacatatgcaacaaccgaacctggcggcagcgcaaaagatg

SEQ ID NO: 91063 - DNA, 103 bp, Artificial Sequence
  Synthetic Polynucleotide
taatacgactcactataggggctggccaggttgctgtgctggcggttgttaacagaggagaaacaacatgcagcacagcaacctggcggcagcgcaaaagatg

SEQ ID NO: 91064 - DNA, 103 bp, Artificial Sequence
  Synthetic Polynucleotide
taatacgactcactatagggaagacctcaggctggccaggttgctgtgctaacagaggagaagcacaatgacctggccaaacctggcggcagcgcaaaagatg

SEQ ID NO: 91065 - DNA, 103 bp, Artificial Sequence
  Synthetic Polynucleotide
taatacgactcactatagggcatctcctggaagacctcaggctggccaggaacagaggagacctggcatgcctgaggtcaacctggcggcagcgcaaaagatg

SEQ ID NO: 91066 - DNA, 103 bp, Artificial Sequence
  Synthetic Polynucleotide
taatacgactcactataggggcatggacagcatctcctggaagacctcagaacagaggagactgaggatgtccaggagaaacctggcggcagcgcaaaagatg

SEQ ID NO: 91067 - DNA, 103 bp, Artificial Sequence
  Synthetic Polynucleotide
taatacgactcactatagggtgatctcccagcatggacagcatctcctggaacagaggagaccaggaatggctgtccataacctggcggcagcgcaaaagatg

SEQ ID NO: 91068 - DNA, 103 bp, Artificial Sequence
  Synthetic Polynucleotide
taatacgactcactataggggctgttgctctgatctcccagcatggacagaacagaggagactgtccatgctgggagataacctggcggcagcgcaaaagatg

SEQ ID NO: 91069 - DNA, 103 bp, Artificial Sequence
  Synthetic Polynucleotide
taatacgactcactatagggcagagctctgctcatcatccgacctggcaaaacagaggagattgccaatgcggatgatgaacctggcggcagcgcaaaagatg

SEQ ID NO: 91070 - DNA, 103 bp, Artificial Sequence
  Synthetic Polynucleotide
taatacgactcactatagggcattgttgtagctgttgctctgatctcccaaacagaggagatgggagatgagagcaacaaacctggcggcagcgcaaaagatg

SEQ ID NO: 91071 - DNA, 103 bp, Artificial Sequence
  Synthetic Polynucleotide
taatacgactcactataggggggaattcttcattgttgtagctgttgctcaacagaggagagagcaaatgctacaacaaaacctggcggcagcgcaaaagatg

SEQ ID NO: 91072 - DNA, 103 bp, Artificial Sequence
  Synthetic Polynucleotide
taatacgactcactatagggagttagatcagggaattcttcattgttgtaaacagaggagatacaacatggaagaattcaacctggcggcagcgcaaaagatg

SEQ ID NO: 91073 - DNA, 103 bp, Artificial Sequence
  Synthetic Polynucleotide
taatacgactcactatagggggggaaacatagttagatcagggaattcttaacagaggagaaagaatatgctgatctaaaacctggcggcagcgcaaaagatg

SEQ ID NO: 91074 - DNA, 103 bp, Artificial Sequence
  Synthetic Polynucleotide
taatacgactcactatagggtctgaaaaggggggaaacatagttagatcaaacagaggagatgatctatgtatgtttccaacctggcggcagcgcaaaagatg

SEQ ID NO: 91075 - DNA, 103 bp, Artificial Sequence
  Synthetic Polynucleotide
taatacgactcactatagggtctttatccgcagagctctgctcatcatccaacagaggagaggatgaatggcagagctcaacctggcggcagcgcaaaagatg

SEQ ID NO: 91076 - DNA, 103 bp, Artificial Sequence
  Synthetic Polynucleotide
taatacgactcactatagggggcaagtctctctttatccgcagagctctgaacagaggagacagagcatggcggataaaaacctggcggcagcgcaaaagatg

SEQ ID NO: 91077 - DNA, 103 bp, Artificial Sequence
  Synthetic Polynucleotide
taatacgactcactataggggattttccctggcaagtctctctttatccgaacagaggagacggataatgagagacttgaacctggcggcagcgcaaaagatg

SEQ ID NO: 91078 - DNA, 103 bp, Artificial Sequence
  Synthetic Polynucleotide
taatacgactcactatagggatttcactgtgattttccctggcaagtctcaacagaggagagagactatgcagggaaaaaacctggcggcagcgcaaaagatg

SEQ ID NO: 91079 - DNA, 103 bp, Artificial Sequence
  Synthetic Polynucleotide
taatacgactcactatagggccgccgttcaatttcactgtgattttccctaacagaggagaagggaaatgcacagtgaaaacctggcggcagcgcaaaagatg

SEQ ID NO: 91080 - DNA, 103 bp, Artificial Sequence
  Synthetic Polynucleotide
taatacgactcactatagggtgttccgtcgccgccgttcaatttcactgtaacagaggagaacagtgatgttgaacggcaacctggcggcagcgcaaaagatg

SEQ ID NO: 91081 - DNA, 103 bp, Artificial Sequence
  Synthetic Polynucleotide
taatacgactcactatagggagtgatggtacatctgatgtcatttcggggaacagaggagaccccgaatggacatcagaaacctggcggcagcgcaaaagatg

SEQ ID NO: 91082 - DNA, 103 bp, Artificial Sequence
  Synthetic Polynucleotide
taatacgactcactataggggctgtcatcttgttccgtcgccgccgttcaaacagaggagatgaacgatggcgacggaaaacctggcggcagcgcaaaagatg

SEQ ID NO: 91083 - DNA, 103 bp, Artificial Sequence
  Synthetic Polynucleotide
taatacgactcactatagggtgtgatgtaggctgtcatcttgttccgtcgaacagaggagacgacggatgaagatgacaaacctggcggcagcgcaaaagatg

SEQ ID NO: 91084 - DNA, 103 bp, Artificial Sequence
  Synthetic Polynucleotide
taatacgactcactatagggctgacagttctgtgatgtaggctgtcatctaacagaggagaagatgaatgcctacatcaaacctggcggcagcgcaaaagatg

SEQ ID NO: 91085 - DNA, 103 bp, Artificial Sequence
  Synthetic Polynucleotide
taatacgactcactatagggggtaccatatctgacagttctgtgatgtagaacagaggagactacatatgagaactgtcaacctggcggcagcgcaaaagatg

SEQ ID NO: 91086 - DNA, 103 bp, Artificial Sequence
  Synthetic Polynucleotide
taatacgactcactatagggactacaggtgggtaccatatctgacagttcaacagaggagagaactgatggatatggtaaacctggcggcagcgcaaaagatg

SEQ ID NO: 91087 - DNA, 103 bp, Artificial Sequence
  Synthetic Polynucleotide
taatacgactcactataggggagccagggcactacaggtgggtaccatataacagaggagaatatggatgccacctgtaaacctggcggcagcgcaaaagatg

SEQ ID NO: 91088 - DNA, 103 bp, Artificial Sequence
  Synthetic Polynucleotide
taatacgactcactatagggtctggttttcgagccagggcactacaggtgaacagaggagacacctgatgtgccctggcaacctggcggcagcgcaaaagatg

SEQ ID NO: 91089 - DNA, 103 bp, Artificial Sequence
  Synthetic Polynucleotide
taatacgactcactatagggggttagcttgtctggttttcgagccagggcaacagaggagagccctgatgcgaaaaccaaacctggcggcagcgcaaaagatg

SEQ ID NO: 91090 - DNA, 103 bp, Artificial Sequence
  Synthetic Polynucleotide
taatacgactcactatagggtgcgtaagatggttagcttgtctggttttcaacagaggagagaaaacatgacaagctaaaacctggcggcagcgcaaaagatg

SEQ ID NO: 91091 - DNA, 103 bp, Artificial Sequence
  Synthetic Polynucleotide
taatacgactcactataggggaaactgccatgcgtaagatggttagcttgaacagaggagacaagctatgcatcttacgaacctggcggcagcgcaaaagatg

SEQ ID NO: 91092 - DNA, 103 bp, Artificial Sequence
  Synthetic Polynucleotide
taatacgactcactatagggggctggacccagtgatggtacatctgatgtaacagaggagaacatcaatggtaccatcaaacctggcggcagcgcaaaagatg

SEQ ID NO: 91093 - DNA, 103 bp, Artificial Sequence
  Synthetic Polynucleotide
taatacgactcactatagggcttcatgtgagaaactgccatgcgtaagataacagaggagaatcttaatgatggcagttaacctggcggcagcgcaaaagatg

SEQ ID NO: 91094 - DNA, 103 bp, Artificial Sequence
  Synthetic Polynucleotide
taatacgactcactatagggcccgcaaggacttcatgtgagaaactgccaaacagaggagatggcagatgctcacatgaaacctggcggcagcgcaaaagatg

SEQ ID NO: 91095 - DNA, 103 bp, Artificial Sequence
  Synthetic Polynucleotide
taatacgactcactatagggttgccagttccccgcaaggacttcatgtgaaacagaggagatcacatatggtccttgcgaacctggcggcagcgcaaaagatg

SEQ ID NO: 91096 - DNA, 103 bp, Artificial Sequence
  Synthetic Polynucleotide
taatacgactcactatagggagtggatgtgttgccagttccccgcaaggaaacagaggagatccttgatgggaactggcaacctggcggcagcgcaaaagatg

SEQ ID NO: 91097 - DNA, 103 bp, Artificial Sequence
  Synthetic Polynucleotide
taatacgactcactatagggaggagccatcagtggatgtgttgccagttcaacagaggagagaactgatgacacatccaaacctggcggcagcgcaaaagatg

SEQ ID NO: 91098 - DNA, 103 bp, Artificial Sequence
  Synthetic Polynucleotide
taatacgactcactataggggacggcttataggagccatcagtggatgtgaacagaggagacacatcatgtgatggctcaacctggcggcagcgcaaaagatg

SEQ ID NO: 91099 - DNA, 103 bp, Artificial Sequence
  Synthetic Polynucleotide
taatacgactcactatagggagtgaggaaagacggcttataggagccatcaacagaggagagatggcatgtataagccgaacctggcggcagcgcaaaagatg

SEQ ID NO: 91100 - DNA, 103 bp, Artificial Sequence
  Synthetic Polynucleotide
taatacgactcactataggggttcctgatcagtgaggaaagacggcttataacagaggagaataagcatgctttcctcaaacctggcggcagcgcaaaagatg

SEQ ID NO: 91101 - DNA, 103 bp, Artificial Sequence
  Synthetic Polynucleotide
taatacgactcactatagggaaatgtttcagttcctgatcagtgaggaaaaacagaggagatttcctatgtgatcaggaaacctggcggcagcgcaaaagatg

SEQ ID NO: 91102 - DNA, 103 bp, Artificial Sequence
  Synthetic Polynucleotide
taatacgactcactatagggctccaagatcaaatgtttcagttcctgatcaacagaggagagatcagatgctgaaacataacctggcggcagcgcaaaagatg

SEQ ID NO: 91103 - DNA, 103 bp, Artificial Sequence
  Synthetic Polynucleotide
taatacgactcactatagggcagaggcaatggctggacccagtgatggtaaacagaggagataccatatgtgggtccagaacctggcggcagcgcaaaagatg

SEQ ID NO: 91104 - DNA, 103 bp, Artificial Sequence
  Synthetic Polynucleotide
taatacgactcactatagggcatctgctgcctccaagatcaaatgtttcaaacagaggagatgaaacatgtgatcttggaacctggcggcagcgcaaaagatg

SEQ ID NO: 91105 - DNA, 103 bp, Artificial Sequence
  Synthetic Polynucleotide
taatacgactcactatagggaacagaaagccatctgctgcctccaagatcaacagaggagagatcttatgggcagcagaaacctggcggcagcgcaaaagatg

SEQ ID NO: 91106 - DNA, 103 bp, Artificial Sequence
  Synthetic Polynucleotide
taatacgactcactatagggtgagacaataaacagaaagccatctgctgcaacagaggagagcagcaatgggctttctgaacctggcggcagcgcaaaagatg

SEQ ID NO: 91107 - DNA, 103 bp, Artificial Sequence
  Synthetic Polynucleotide
taatacgactcactatagggctgtctcacatgagacaataaacagaaagcaacagaggagagctttcatgttattgtctaacctggcggcagcgcaaaagatg

SEQ ID NO: 91108 - DNA, 103 bp, Artificial Sequence
  Synthetic Polynucleotide
taatacgactcactatagggaccaccctgcctgtctcacatgagacaataaacagaggagatattgtatgatgtgagacaacctggcggcagcgcaaaagatg

SEQ ID NO: 91109 - DNA, 103 bp, Artificial Sequence
  Synthetic Polynucleotide
taatacgactcactatagggagacacatacaccaccctgcctgtctcacaaacagaggagatgtgagatgggcagggtgaacctggcggcagcgcaaaagatg

SEQ ID NO: 91110 - DNA, 103 bp, Artificial Sequence
  Synthetic Polynucleotide
taatacgactcactatagggtcacggagtcagacacatacaccaccctgcaacagaggagagcagggatgtgtatgtgtaacctggcggcagcgcaaaagatg

SEQ ID NO: 91111 - DNA, 103 bp, Artificial Sequence
  Synthetic Polynucleotide
taatacgactcactatagggaaaacaggagtcacggagtcagacacatacaacagaggagagtatgtatgtgactccgtaacctggcggcagcgcaaaagatg

SEQ ID NO: 91112 - DNA, 103 bp, Artificial Sequence
  Synthetic Polynucleotide
taatacgactcactatagggtggctggttcaaaacaggagtcacggagtcaacagaggagagactccatgactcctgttaacctggcggcagcgcaaaagatg

SEQ ID NO: 91113 - DNA, 103 bp, Artificial Sequence
  Synthetic Polynucleotide
taatacgactcactatagggattcagactgtggctggttcaaaacaggagaacagaggagactcctgatgtgaaccagcaacctggcggcagcgcaaaagatg

SEQ ID NO: 91114 - DNA, 103 bp, Artificial Sequence
  Synthetic Polynucleotide
taatacgactcactatagggccagagtttccagaggcaatggctggacccaacagaggagagggtccatgcattgcctcaacctggcggcagcgcaaaagatg

SEQ ID NO: 91115 - DNA, 103 bp, Artificial Sequence
  Synthetic Polynucleotide
taatacgactcactatagggctgccaaaccattcagactgtggctggttcaacagaggagagaaccaatgacagtctgaaacctggcggcagcgcaaaagatg

SEQ ID NO: 91116 - DNA, 103 bp, Artificial Sequence
  Synthetic Polynucleotide
taatacgactcactatagggatagagtgtgctgccaaaccattcagactgaacagaggagacagtctatgtggtttggcaacctggcggcagcgcaaaagatg

SEQ ID NO: 91117 - DNA, 103 bp, Artificial Sequence
  Synthetic Polynucleotide
taatacgactcactataggggcacctgatcatagagtgtgctgccaaaccaacagaggagaggtttgatggcacactctaacctggcggcagcgcaaaagatg

SEQ ID NO: 91118 - DNA, 103 bp, Artificial Sequence
  Synthetic Polynucleotide
taatacgactcactatagggtcatctgggtgcacctgatcatagagtgtgaacagaggagacacactatgtgatcaggtaacctggcggcagcgcaaaagatg

SEQ ID NO: 91119 - DNA, 103 bp, Artificial Sequence
  Synthetic Polynucleotide
taatacgactcactatagggtttatccacatcatctgggtgcacctgatcaacagaggagagatcagatgcacccagataacctggcggcagcgcaaaagatg

SEQ ID NO: 91120 - DNA, 103 bp, Artificial Sequence
  Synthetic Polynucleotide
taatacgactcactataggggctcacgaagtttatccacatcatctgggtaacagaggagaacccagatgatgtggataaacctggcggcagcgcaaaagatg

SEQ ID NO: 91121 - DNA, 103 bp, Artificial Sequence
  Synthetic Polynucleotide
taatacgactcactataggggtggaaagctgctcacgaagtttatccacaaacagaggagatgtggaatgacttcgtgaaacctggcggcagcgcaaaagatg

SEQ ID NO: 91122 - DNA, 103 bp, Artificial Sequence
  Synthetic Polynucleotide
taatacgactcactatagggattttctgaagtggaaagctgctcacgaagaacagaggagacttcgtatgcagctttccaacctggcggcagcgcaaaagatg

SEQ ID NO: 91123 - DNA, 103 bp, Artificial Sequence
  Synthetic Polynucleotide
taatacgactcactatagggctgtcagggcattttctgaagtggaaagctaacagaggagaagctttatgcttcagaaaaacctggcggcagcgcaaaagatg

SEQ ID NO: 91124 - DNA, 103 bp, Artificial Sequence
  Synthetic Polynucleotide
taatacgactcactatagggaggatacgccctgtcagggcattttctgaaaacagaggagattcagaatgtgccctgacaacctggcggcagcgcaaaagatg

SEQ ID NO: 91125 - DNA, 103 bp, Artificial Sequence
  Synthetic Polynucleotide
taatacgactcactatagggaattccaggtccagagtttccagaggcaataacagaggagaattgccatgggaaactctaacctggcggcagcgcaaaagatg

SEQ ID NO: 91126 - DNA, 103 bp, Artificial Sequence
  Synthetic Polynucleotide
taatacgactcactatagggctttagatccaggatacgccctgtcagggcaacagaggagagccctgatggggcgtatcaacctggcggcagcgcaaaagatg

SEQ ID NO: 91127 - DNA, 103 bp, Artificial Sequence
  Synthetic Polynucleotide
taatacgactcactatagggctgttccagtctttagatccaggatacgccaacagaggagaggcgtaatgtggatctaaaacctggcggcagcgcaaaagatg

SEQ ID NO: 91128 - DNA, 103 bp, Artificial Sequence
  Synthetic Polynucleotide
taatacgactcactatagggtcctttttcactgttccagtctttagatccaacagaggagaggatctatggactggaacaacctggcggcagcgcaaaagatg

SEQ ID NO: 91129 - DNA, 103 bp, Artificial Sequence
  Synthetic Polynucleotide
taatacgactcactatagggctgctgaccttcctttttcactgttccagtaacagaggagaactggaatggtgaaaaagaacctggcggcagcgcaaaagatg

SEQ ID NO: 91130 - DNA, 103 bp, Artificial Sequence
  Synthetic Polynucleotide
taatacgactcactatagggtcatggaagactgctgaccttcctttttcaaacagaggagatgaaaaatgaaggtcagcaacctggcggcagcgcaaaagatg

SEQ ID NO: 91131 - DNA, 103 bp, Artificial Sequence
  Synthetic Polynucleotide
taatacgactcactatagggatacacattctcatggaagactgctgacctaacagaggagaaggtcaatggtcttccataacctggcggcagcgcaaaagatg

SEQ ID NO: 91132 - DNA, 103 bp, Artificial Sequence
  Synthetic Polynucleotide
taatacgactcactatagggccttgagcccatacacattctcatggaagaaacagaggagatcttccatgagaatgtgtaacctggcggcagcgcaaaagatg

SEQ ID NO: 91133 - DNA, 103 bp, Artificial Sequence
  Synthetic Polynucleotide
taatacgactcactatagggtaaacgatctccttgagcccatacacattcaacagaggagagaatgtatgtgggctcaaaacctggcggcagcgcaaaagatg

SEQ ID NO: 91134 - DNA, 103 bp, Artificial Sequence
  Synthetic Polynucleotide
taatacgactcactatagggattcggcaaataaacgatctccttgagcccaacagaggagagggctcatggagatcgttaacctggcggcagcgcaaaagatg

SEQ ID NO: 91135 - DNA, 103 bp, Artificial Sequence
  Synthetic Polynucleotide
taatacgactcactataggggccacacctcattcggcaaataaacgatctaacagaggagaagatcgatgatttgccgaaacctggcggcagcgcaaaagatg

SEQ ID NO: 91136 - DNA, 103 bp, Artificial Sequence
  Synthetic Polynucleotide
taatacgactcactatagggctccaccttgaattccaggtccagagtttcaacagaggagagaaactatggacctggaaaacctggcggcagcgcaaaagatg

SEQ ID NO: 91137 - DNA, 103 bp, Artificial Sequence
  Synthetic Polynucleotide
taatacgactcactatagggcagagctactgccacacctcattcggcaaaaacagaggagatttgccatgtgaggtgtgaacctggcggcagcgcaaaagatg

SEQ ID NO: 91138 - DNA, 103 bp, Artificial Sequence
  Synthetic Polynucleotide
taatacgactcactatagggactgggtccacagagctactgccacacctcaacagaggagagaggtgatgcagtagctcaacctggcggcagcgcaaaagatg

SEQ ID NO: 91139 - DNA, 103 bp, Artificial Sequence
  Synthetic Polynucleotide
taatacgactcactatagggattcacagaaactgggtccacagagctactaacagaggagaagtagcatggtggacccaaacctggcggcagcgcaaaagatg

SEQ ID NO: 91140 - DNA, 103 bp, Artificial Sequence
  Synthetic Polynucleotide
taatacgactcactatagggagctcagcctattcacagaaactgggtccaaacagaggagatggaccatgtttctgtgaaacctggcggcagcgcaaaagatg

SEQ ID NO: 91141 - DNA, 103 bp, Artificial Sequence
  Synthetic Polynucleotide
taatacgactcactatagggttcctcacaaagctcagcctattcacagaaaacagaggagattctgtatgtaggctgagaacctggcggcagcgcaaaagatg

SEQ ID NO: 91142 - DNA, 103 bp, Artificial Sequence
  Synthetic Polynucleotide
taatacgactcactatagggcctgcatctgttcctcacaaagctcagcctaacagaggagaaggctgatgtttgtgaggaacctggcggcagcgcaaaagatg

SEQ ID NO: 91143 - DNA, 103 bp, Artificial Sequence
  Synthetic Polynucleotide
taatacgactcactatagggcaagtccattcctgcatctgttcctcacaaaacagaggagattgtgaatgacagatgcaaacctggcggcagcgcaaaagatg

SEQ ID NO: 91144 - DNA, 103 bp, Artificial Sequence
  Synthetic Polynucleotide
taatacgactcactatagggtttacagagccaagtccattcctgcatctgaacagaggagacagatgatggaatggactaacctggcggcagcgcaaaagatg

SEQ ID NO: 91145 - DNA, 103 bp, Artificial Sequence
  Synthetic Polynucleotide
taatacgactcactatagggttccccatcctttacagagccaagtccattaacagaggagaaatggaatgggctctgtaaacctggcggcagcgcaaaagatg

SEQ ID NO: 91146 - DNA, 103 bp, Artificial Sequence
  Synthetic Polynucleotide
taatacgactcactatagggcgaagtgaggttccccatcctttacagagcaacagaggagagctctgatgaggatggggaacctggcggcagcgcaaaagatg

SEQ ID NO: 91147 - DNA, 103 bp, Artificial Sequence
  Synthetic Polynucleotide
taatacgactcactatagggacaatggctcctccaccttgaattccaggtaacagaggagaacctggatgtcaaggtggaacctggcggcagcgcaaaagatg

SEQ ID NO: 91148 - DNA, 103 bp, Artificial Sequence
  Synthetic Polynucleotide
taatacgactcactatagggtggaccaccacgaagtgaggttccccatccaacagaggagaggatggatgacctcacttaacctggcggcagcgcaaaagatg

SEQ ID NO: 91149 - DNA, 103 bp, Artificial Sequence
  Synthetic Polynucleotide
taatacgactcactataggggcctgtgcagtggaccaccacgaagtgaggaacagaggagacctcacatggtggtggtcaacctggcggcagcgcaaaagatg

SEQ ID NO: 91150 - DNA, 103 bp, Artificial Sequence
  Synthetic Polynucleotide
taatacgactcactatagggccttgatgtagcctgtgcagtggaccaccaaacagaggagatggtggatgactgcacagaacctggcggcagcgcaaaagatg

SEQ ID NO: 91151 - DNA, 103 bp, Artificial Sequence
  Synthetic Polynucleotide
taatacgactcactataggggggggccaggccttgatgtagcctgtgcagaacagaggagactgcacatgctacatcaaaacctggcggcagcgcaaaagatg

SEQ ID NO: 91152 - DNA, 103 bp, Artificial Sequence
  Synthetic Polynucleotide
taatacgactcactatagggaacacctgctgggggccaggccttgatgtaaacagaggagatacatcatggcctggcccaacctggcggcagcgcaaaagatg

SEQ ID NO: 91153 - DNA, 103 bp, Artificial Sequence
  Synthetic Polynucleotide
taatacgactcactatagggctgggagggaaacacctgctgggggccaggaacagaggagacctggcatgcagcaggtgaacctggcggcagcgcaaaagatg

SEQ ID NO: 91154 - DNA, 103 bp, Artificial Sequence
  Synthetic Polynucleotide
taatacgactcactataggggggtcatcatctgggagggaaacacctgctaacagaggagaagcaggatgttccctcccaacctggcggcagcgcaaaagatg

SEQ ID NO: 91155 - DNA, 103 bp, Artificial Sequence
  Synthetic Polynucleotide
taatacgactcactataggggccagcctctgggtcatcatctgggagggaaacagaggagatccctcatggatgatgacaacctggcggcagcgcaaaagatg

SEQ ID NO: 91156 - DNA, 103 bp, Artificial Sequence
  Synthetic Polynucleotide
taatacgactcactatagggtgcttccctggccagcctctgggtcatcataacagaggagaatgatgatgcagaggctgaacctggcggcagcgcaaaagatg

SEQ ID NO: 91157 - DNA, 103 bp, Artificial Sequence
  Synthetic Polynucleotide
taatacgactcactatagggaggcaaaacttgcttccctggccagcctctaacagaggagaagaggcatgccagggaagaacctggcggcagcgcaaaagatg

SEQ ID NO: 91158 - DNA, 103 bp, Artificial Sequence
  Synthetic Polynucleotide
taatacgactcactatagggcggagggttgaccgccgccggggttgccataacagaggagaatggcaatgccggcggcgaacctggcggcagcgcaaaagatg

SEQ ID NO: 91159 - DNA, 103 bp, Artificial Sequence
  Synthetic Polynucleotide
taatacgactcactatagggaggcatggcccccgccatcctcacctgtccaacagaggagaggacagatgaggatggcgaacctggcggcagcgcaaaagatg

SEQ ID NO: 91160 - DNA, 103 bp, Artificial Sequence
  Synthetic Polynucleotide
taatacgactcactatagggccgggataagaactctgtgggcaccgacataacagaggagaatgtcgatgcccacagagaacctggcggcagcgcaaaagatg

SEQ ID NO: 91161 - DNA, 103 bp, Artificial Sequence
  Synthetic Polynucleotide
taatacgactcactatagggcggagttatgccgggataagaactctgtggaacagaggagaccacagatgtcttatcccaacctggcggcagcgcaaaagatg

SEQ ID NO: 91162 - DNA, 103 bp, Artificial Sequence
  Synthetic Polynucleotide
taatacgactcactatagggatgattccatcggagttatgccgggataagaacagaggagacttatcatggcataactcaacctggcggcagcgcaaaagatg

SEQ ID NO: 91163 - DNA, 103 bp, Artificial Sequence
  Synthetic Polynucleotide
taatacgactcactatagggcacaaatgtgatgattccatcggagttatgaacagaggagacataacatggatggaatcaacctggcggcagcgcaaaagatg

SEQ ID NO: 91164 - DNA, 103 bp, Artificial Sequence
  Synthetic Polynucleotide
taatacgactcactatagggatcttggatccacaaatgtgatgattccataacagaggagaatggaaatgtcacatttgaacctggcggcagcgcaaaagatg

SEQ ID NO: 91165 - DNA, 103 bp, Artificial Sequence
  Synthetic Polynucleotide
taatacgactcactatagggacactgatacatcttggatccacaaatgtgaacagaggagacacattatgggatccaagaacctggcggcagcgcaaaagatg

SEQ ID NO: 91166 - DNA, 103 bp, Artificial Sequence
  Synthetic Polynucleotide
taatacgactcactataggggtagccaatcacactgatacatcttggatcaacagaggagagatccaatgtgtatcagtaacctggcggcagcgcaaaagatg

SEQ ID NO: 91167 - DNA, 103 bp, Artificial Sequence
  Synthetic Polynucleotide
taatacgactcactatagggcctggggttggtagccaatcacactgatacaacagaggagagtatcaatgtgattggctaacctggcggcagcgcaaaagatg

SEQ ID NO: 91168 - DNA, 103 bp, Artificial Sequence
  Synthetic Polynucleotide
taatacgactcactatagggcccagaagatcctggggttggtagccaatcaacagaggagagattggatgccaaccccaaacctggcggcagcgcaaaagatg

SEQ ID NO: 91169 - DNA, 103 bp, Artificial Sequence
  Synthetic Polynucleotide
taatacgactcactatagggaatgtcctttcccagaagatcctggggttgaacagaggagacaacccatggatcttctgaacctggcggcagcgcaaaagatg

SEQ ID NO: 91170 - DNA, 103 bp, Artificial Sequence
  Synthetic Polynucleotide
taatacgactcactatagggctccacgggcaggcatggcccccgccatccaacagaggagaggatggatggggccatgcaacctggcggcagcgcaaaagatg

SEQ ID NO: 91171 - DNA, 103 bp, Artificial Sequence
  Synthetic Polynucleotide
taatacgactcactatagggagaattccaaaatgtcctttcccagaagataacagaggagaatcttcatggaaaggacaaacctggcggcagcgcaaaagatg

SEQ ID NO: 91172 - DNA, 103 bp, Artificial Sequence
  Synthetic Polynucleotide
taatacgactcactatagggtcagggtggcagaattccaaaatgtcctttaacagaggagaaaaggaatgtttggaattaacctggcggcagcgcaaaagatg

SEQ ID NO: 91173 - DNA, 103 bp, Artificial Sequence
  Synthetic Polynucleotide
taatacgactcactataggggctttgatcctcagggtggcagaattccaaaacagaggagattggaaatgtgccaccctaacctggcggcagcgcaaaagatg

SEQ ID NO: 91174 - DNA, 103 bp, Artificial Sequence
  Synthetic Polynucleotide
taatacgactcactatagggcacgcagatggctttgatcctcagggtggcaacagaggagagccaccatgaggatcaaaaacctggcggcagcgcaaaagatg

SEQ ID NO: 91175 - DNA, 103 bp, Artificial Sequence
  Synthetic Polynucleotide
taatacgactcactatagggtggaagctctcacgcagatggctttgatccaacagaggagaggatcaatgccatctgcgaacctggcggcagcgcaaaagatg

SEQ ID NO: 91176 - DNA, 103 bp, Artificial Sequence
  Synthetic Polynucleotide
taatacgactcactatagggaaccacctgctggaagctctcacgcagatgaacagaggagacatctgatggagagcttcaacctggcggcagcgcaaaagatg

SEQ ID NO: 91177 - DNA, 103 bp, Artificial Sequence
  Synthetic Polynucleotide
taatacgactcactatagggctttcagcttaaccacctgctggaagctctaacagaggagaagagctatgagcaggtggaacctggcggcagcgcaaaagatg

SEQ ID NO: 91178 - DNA, 103 bp, Artificial Sequence
  Synthetic Polynucleotide
taatacgactcactatagggaggacttggcctttcagcttaaccacctgcaacagaggagagcaggtatgtaagctgaaaacctggcggcagcgcaaaagatg

SEQ ID NO: 91179 - DNA, 103 bp, Artificial Sequence
  Synthetic Polynucleotide
taatacgactcactatagggcatgaccgacaggacttggcctttcagcttaacagaggagaaagctgatgggccaagtcaacctggcggcagcgcaaaagatg

SEQ ID NO: 91180 - DNA, 103 bp, Artificial Sequence
  Synthetic Polynucleotide
taatacgactcactataggggaaatcgatacatgaccgacaggacttggcaacagaggagagccaagatgtgtcggtcaaacctggcggcagcgcaaaagatg

SEQ ID NO: 91181 - DNA, 103 bp, Artificial Sequence
  Synthetic Polynucleotide
taatacgactcactatagggcgccgctttcctccacgggcaggcatggccaacagaggagaggccatatgtgcccgtggaacctggcggcagcgcaaaagatg

SEQ ID NO: 91182 - DNA, 103 bp, Artificial Sequence
  Synthetic Polynucleotide
taatacgactcactatagggttcttggtgcgaaatcgatacatgaccgacaacagaggagagtcggtatggtatcgattaacctggcggcagcgcaaaagatg

SEQ ID NO: 91183 - DNA, 103 bp, Artificial Sequence
  Synthetic Polynucleotide
taatacgactcactatagggccactcccggttcttggtgcgaaatcgataaacagaggagatatcgaatgcgcaccaagaacctggcggcagcgcaaaagatg

SEQ ID NO: 91184 - DNA, 103 bp, Artificial Sequence
  Synthetic Polynucleotide
taatacgactcactatagggggatcaacatccactcccggttcttggtgcaacagaggagagcaccaatgaccgggagtaacctggcggcagcgcaaaagatg

SEQ ID NO: 91185 - DNA, 103 bp, Artificial Sequence
  Synthetic Polynucleotide
taatacgactcactatagggctgctggtgcggatcaacatccactcccggaacagaggagaccgggaatggatgttgataacctggcggcagcgcaaaagatg

SEQ ID NO: 91186 - DNA, 103 bp, Artificial Sequence
  Synthetic Polynucleotide
taatacgactcactataggggaatgtgaagctgctggtgcggatcaacataacagaggagaatgttgatgcgcaccagcaacctggcggcagcgcaaaagatg

SEQ ID NO: 91187 - DNA, 103 bp, Artificial Sequence
  Synthetic Polynucleotide
taatacgactcactatagggagggattctggaatgtgaagctgctggtgcaacagaggagagcaccaatggcttcacataacctggcggcagcgcaaaagatg

SEQ ID NO: 91188 - DNA, 103 bp, Artificial Sequence
  Synthetic Polynucleotide
taatacgactcactatagggtcatcagaatagggattctggaatgtgaagaacagaggagacttcacatgccagaatccaacctggcggcagcgcaaaagatg

SEQ ID NO: 91189 - DNA, 103 bp, Artificial Sequence
  Synthetic Polynucleotide
taatacgactcactataggggtactcaatctcatcagaatagggattctgaacagaggagacagaatatgtattctgataacctggcggcagcgcaaaagatg

SEQ ID NO: 91190 - DNA, 103 bp, Artificial Sequence
  Synthetic Polynucleotide
taatacgactcactatagggtgcagatgatgtactcaatctcatcagaataacagaggagaattctgatgagattgagtaacctggcggcagcgcaaaagatg

SEQ ID NO: 91191 - DNA, 103 bp, Artificial Sequence
  Synthetic Polynucleotide
taatacgactcactatagggttggtgttggtgcagatgatgtactcaatcaacagaggagagattgaatgcatcatctgaacctggcggcagcgcaaaagatg

SEQ ID NO: 91192 - DNA, 103 bp, Artificial Sequence
  Synthetic Polynucleotide
taatacgactcactatagggcattccggaacgccgctttcctccacgggcaacagaggagagcccgtatgggaaagcggaacctggcggcagcgcaaaagatg

SEQ ID NO: 91193 - DNA, 103 bp, Artificial Sequence
  Synthetic Polynucleotide
taatacgactcactatagggttgcttgacgttggtgttggtgcagatgataacagaggagaatcatcatgaccaacaccaacctggcggcagcgcaaaagatg

SEQ ID NO: 91194 - DNA, 103 bp, Artificial Sequence
  Synthetic Polynucleotide
taatacgactcactataggggttgctgaagttgcttgacgttggtgttggaacagaggagaccaacaatgacgtcaagcaacctggcggcagcgcaaaagatg

SEQ ID NO: 91195 - DNA, 103 bp, Artificial Sequence
  Synthetic Polynucleotide
taatacgactcactatagggtctgcctgctgttgctgaagttgcttgacgaacagaggagacgtcaaatgacttcagcaaacctggcggcagcgcaaaagatg

SEQ ID NO: 91196 - DNA, 103 bp, Artificial Sequence
  Synthetic Polynucleotide
taatacgactcactatagggcacttccaattctgcctgctgttgctgaagaacagaggagacttcagatgcagcaggcaaacctggcggcagcgcaaaagatg

SEQ ID NO: 91197 - DNA, 103 bp, Artificial Sequence
  Synthetic Polynucleotide
taatacgactcactatagggctctctggtgcacttccaattctgcctgctaacagaggagaagcaggatgaattggaagaacctggcggcagcgcaaaagatg

SEQ ID NO: 91198 - DNA, 103 bp, Artificial Sequence
  Synthetic Polynucleotide
taatacgactcactataggggacaatccatctctctggtgcacttccaataacagaggagaattggaatggcaccagagaacctggcggcagcgcaaaagatg

SEQ ID NO: 91199 - DNA, 103 bp, Artificial Sequence
  Synthetic Polynucleotide
taatacgactcactataggggtcatacgatgacaatccatctctctggtgaacagaggagacaccagatggatggattgaacctggcggcagcgcaaaagatg

SEQ ID NO: 91200 - DNA, 103 bp, Artificial Sequence
  Synthetic Polynucleotide
taatacgactcactatagggcctgggataagtcatacgatgacaatccataacagaggagaatggatatgcatcgtatgaacctggcggcagcgcaaaagatg

SEQ ID NO: 91201 - DNA, 103 bp, Artificial Sequence
  Synthetic Polynucleotide
taatacgactcactataggggggacggggacctgggataagtcatacgataacagaggagaatcgtaatgcttatcccaaacctggcggcagcgcaaaagatg

SEQ ID NO: 91202 - DNA, 103 bp, Artificial Sequence
  Synthetic Polynucleotide
taatacgactcactatagggtggtaggttggggacggggacctgggataaaacagaggagattatccatggtccccgtcaacctggcggcagcgcaaaagatg

SEQ ID NO: 91203 - DNA, 103 bp, Artificial Sequence
  Synthetic Polynucleotide
taatacgactcactatagggcatcgaagtccattccggaacgccgctttcaacagaggagagaaagcatggttccggaaaacctggcggcagcgcaaaagatg

SEQ ID NO: 91204 - DNA, 103 bp, Artificial Sequence
  Synthetic Polynucleotide
taatacgactcactataggggaacaccggctggtaggttggggacggggaaacagaggagatccccgatgccaacctacaacctggcggcagcgcaaaagatg

SEQ ID NO: 91205 - DNA, 103 bp, Artificial Sequence
  Synthetic Polynucleotide
taatacgactcactatagggccggcctcatgaacaccggctggtaggttgaacagaggagacaacctatgagccggtgtaacctggcggcagcgcaaaagatg

SEQ ID NO: 91206 - DNA, 103 bp, Artificial Sequence
  Synthetic Polynucleotide
taatacgactcactatagggcacggacttcccggcctcatgaacaccggcaacagaggagagccggtatgcatgaggccaacctggcggcagcgcaaaagatg

SEQ ID NO: 91207 - DNA, 103 bp, Artificial Sequence
  Synthetic Polynucleotide
taatacgactcactatagggccgccttttccacggacttcccggcctcataacagaggagaatgaggatgggaagtccgaacctggcggcagcgcaaaagatg

SEQ ID NO: 91208 - DNA, 103 bp, Artificial Sequence
  Synthetic Polynucleotide
taatacgactcactatagggaagattgcatccgccttttccacggacttcaacagaggagagaagtcatgggaaaaggcaacctggcggcagcgcaaaagatg

SEQ ID NO: 91209 - DNA, 103 bp, Artificial Sequence
  Synthetic Polynucleotide
taatacgactcactatagggttcctgggagaagattgcatccgccttttcaacagaggagagaaaagatggatgcaatcaacctggcggcagcgcaaaagatg

SEQ ID NO: 91210 - DNA, 103 bp, Artificial Sequence
  Synthetic Polynucleotide
taatacgactcactataggggaggatctctttcctgggagaagattgcataacagaggagaatgcaaatgtctcccaggaacctggcggcagcgcaaaagatg

SEQ ID NO: 91211 - DNA, 103 bp, Artificial Sequence
  Synthetic Polynucleotide
taatacgactcactatagggtcagcaaaccgaggatctctttcctgggagaacagaggagactcccaatgaagagatccaacctggcggcagcgcaaaagatg

SEQ ID NO: 91212 - DNA, 103 bp, Artificial Sequence
  Synthetic Polynucleotide
taatacgactcactatagggtgcaaacatttcagcaaaccgaggatctctaacagaggagaagagatatgcggtttgctaacctggcggcagcgcaaaagatg

SEQ ID NO: 91213 - DNA, 103 bp, Artificial Sequence
  Synthetic Polynucleotide
taatacgactcactatagggcactaattcctgcaaacatttcagcaaaccaacagaggagaggtttgatgaaatgtttgaacctggcggcagcgcaaaagatg

SEQ ID NO: 91214 - DNA, 103 bp, Artificial Sequence
  Synthetic Polynucleotide
taatacgactcactatagggccatcttcatcatcgaagtccattccggaaaacagaggagattccggatgggacttcgaaacctggcggcagcgcaaaagatg

SEQ ID NO: 91215 - DNA, 103 bp, Artificial Sequence
  Synthetic Polynucleotide
taatacgactcactatagggttctccgatgcactaattcctgcaaacattaacagaggagaaatgttatgaggaattagaacctggcggcagcgcaaaagatg

SEQ ID NO: 91216 - DNA, 103 bp, Artificial Sequence
  Synthetic Polynucleotide
taatacgactcactatagggcatcatcttcttctccgatgcactaattccaacagaggagaggaattatggcatcggagaacctggcggcagcgcaaaagatg

SEQ ID NO: 91217 - DNA, 103 bp, Artificial Sequence
  Synthetic Polynucleotide
taatacgactcactatagggaggctgagctcatcatcttcttctccgatgaacagaggagacatcggatgagaagatgaaacctggcggcagcgcaaaagatg

SEQ ID NO: 91218 - DNA, 103 bp, Artificial Sequence
  Synthetic Polynucleotide
taatacgactcactatagggcctgctgcagaggctgagctcatcatcttcaacagaggagagaagatatggagctcagcaacctggcggcagcgcaaaagatg

SEQ ID NO: 91219 - DNA, 103 bp, Artificial Sequence
  Synthetic Polynucleotide
taatacgactcactatagggctgctgggttcctgctgcagaggctgagctaacagaggagaagctcaatgtctgcagcaaacctggcggcagcgcaaaagatg

SEQ ID NO: 91220 - DNA, 103 bp, Artificial Sequence
  Synthetic Polynucleotide
taatacgactcactataggggggagtagatctgctgggttcctgctgcagaacagaggagactgcagatggaacccagcaacctggcggcagcgcaaaagatg

SEQ ID NO: 91221 - DNA, 103 bp, Artificial Sequence
  Synthetic Polynucleotide
taatacgactcactataggggggcttccttgggagtagatctgctgggttaacagaggagaaacccaatggatctactcaacctggcggcagcgcaaaagatg

SEQ ID NO: 91222 - DNA, 103 bp, Artificial Sequence
  Synthetic Polynucleotide
taatacgactcactatagggagagggaaatgggcttccttgggagtagataacagaggagaatctacatgcaaggaagcaacctggcggcagcgcaaaagatg

SEQ ID NO: 91223 - DNA, 103 bp, Artificial Sequence
  Synthetic Polynucleotide
taatacgactcactatagggcggagtgtccagagggaaatgggcttccttaacagaggagaaaggaaatgcatttccctaacctggcggcagcgcaaaagatg

SEQ ID NO: 91224 - DNA, 103 bp, Artificial Sequence
  Synthetic Polynucleotide
taatacgactcactatagggaaggccttcccggagtgtccagagggaaataacagaggagaatttccatgtggacactcaacctggcggcagcgcaaaagatg

SEQ ID NO: 91225 - DNA, 103 bp, Artificial Sequence
  Synthetic Polynucleotide
taatacgactcactatagggggggccttcaccatcttcatcatcgaagtcaacagaggagagacttcatggatgaagataacctggcggcagcgcaaaagatg

SEQ ID NO: 91226 - DNA, 103 bp, Artificial Sequence
  Synthetic Polynucleotide
taatacgactcactatagggtgaagagctgaaggccttcccggagtgtccaacagaggagaggacacatggggaaggccaacctggcggcagcgcaaaagatg

SEQ ID NO: 91227 - DNA, 103 bp, Artificial Sequence
  Synthetic Polynucleotide
taatacgactcactatagggcatgaaccactgaagagctgaaggccttccaacagaggagaggaaggatgtcagctcttaacctggcggcagcgcaaaagatg

SEQ ID NO: 91228 - DNA, 103 bp, Artificial Sequence
  Synthetic Polynucleotide
taatacgactcactatagggactccaggcacatgaaccactgaagagctgaacagaggagacagctcatgagtggttcaaacctggcggcagcgcaaaagatg

SEQ ID NO: 91229 - DNA, 103 bp, Artificial Sequence
  Synthetic Polynucleotide
taatacgactcactatagggaatatcattcactccaggcacatgaaccacaacagaggagagtggttatggtgcctggaaacctggcggcagcgcaaaagatg

SEQ ID NO: 91230 - DNA, 103 bp, Artificial Sequence
  Synthetic Polynucleotide
taatacgactcactatagggaagaggactgaatatcattcactccaggcaaacagaggagatgcctgatgtgaatgataaacctggcggcagcgcaaaagatg

SEQ ID NO: 91231 - DNA, 103 bp, Artificial Sequence
  Synthetic Polynucleotide
taatacgactcactatagggcccgtggaagaagaggactgaatatcattcaacagaggagagaatgaatgtcagtcctcaacctggcggcagcgcaaaagatg

SEQ ID NO: 91232 - DNA, 103 bp, Artificial Sequence
  Synthetic Polynucleotide
taatacgactcactatagggcatgttctggcccgtggaagaagaggactgaacagaggagacagtccatgtcttccacgaacctggcggcagcgcaaaagatg

SEQ ID NO: 91233 - DNA, 103 bp, Artificial Sequence
  Synthetic Polynucleotide
taatacgactcactatagggagatttgggacatgttctggcccgtggaagaacagaggagacttccaatggccagaacaaacctggcggcagcgcaaaagatg

SEQ ID NO: 91234 - DNA, 103 bp, Artificial Sequence
  Synthetic Polynucleotide
taatacgactcactatagggagctgccgggagatttgggacatgttctggaacagaggagaccagaaatggtcccaaataacctggcggcagcgcaaaagatg

SEQ ID NO: 91235 - DNA, 103 bp, Artificial Sequence
  Synthetic Polynucleotide
taatacgactcactatagggactctggtttagctgccgggagatttgggaaacagaggagatcccaaatgtcccggcagaacctggcggcagcgcaaaagatg

SEQ ID NO: 91236 - DNA, 103 bp, Artificial Sequence
  Synthetic Polynucleotide
taatacgactcactatagggaaaatttactggggccttcaccatcttcataacagaggagaatgaagatggtgaaggccaacctggcggcagcgcaaaagatg

SEQ ID NO: 91237 - DNA, 103 bp, Artificial Sequence
  Synthetic Polynucleotide
taatacgactcactatagggatgccacctgactctggtttagctgccgggaacagaggagacccggcatgtaaaccagaaacctggcggcagcgcaaaagatg

SEQ ID NO: 91238 - DNA, 103 bp, Artificial Sequence
  Synthetic Polynucleotide
taatacgactcactatagggctccctgtccatgccacctgactctggtttaacagaggagaaaaccaatgtcaggtggcaacctggcggcagcgcaaaagatg

SEQ ID NO: 91239 - DNA, 103 bp, Artificial Sequence
  Synthetic Polynucleotide
taatacgactcactataggggggcggacgactccctgtccatgccacctgaacagaggagacaggtgatgtggacagggaacctggcggcagcgcaaaagatg

SEQ ID NO: 91240 - DNA, 103 bp, Artificial Sequence
  Synthetic Polynucleotide
taatacgactcactataggggtcccggaaagggcggacgactccctgtccaacagaggagaggacagatggtcgtccgcaacctggcggcagcgcaaaagatg

SEQ ID NO: 91241 - DNA, 103 bp, Artificial Sequence
  Synthetic Polynucleotide
taatacgactcactataggggggatttgctgtcccggaaagggcggacgaaacagaggagatcgtccatgctttccgggaacctggcggcagcgcaaaagatg

SEQ ID NO: 91242 - DNA, 103 bp, Artificial Sequence
  Synthetic Polynucleotide
taatacgactcactatagggggactgagatgggatttgctgtcccggaaaaacagaggagatttccgatgcagcaaatcaacctggcggcagcgcaaaagatg

SEQ ID NO: 91243 - DNA, 103 bp, Artificial Sequence
  Synthetic Polynucleotide
taatacgactcactataggggagtcttgctggactgagatgggatttgctaacagaggagaagcaaaatgcatctcagtaacctggcggcagcgcaaaagatg

SEQ ID NO: 91244 - DNA, 103 bp, Artificial Sequence
  Synthetic Polynucleotide
taatacgactcactatagggggagatgactgagtcttgctggactgagataacagaggagaatctcaatgcagcaagacaacctggcggcagcgcaaaagatg

SEQ ID NO: 91245 - DNA, 103 bp, Artificial Sequence
  Synthetic Polynucleotide
taatacgactcactatagggaatcccaaagggagatgactgagtcttgctaacagaggagaagcaagatgcagtcatctaacctggcggcagcgcaaaagatg

SEQ ID NO: 91246 - DNA, 103 bp, Artificial Sequence
  Synthetic Polynucleotide
taatacgactcactatagggggctcgttccaatcccaaagggagatgactaacagaggagaagtcatatgcctttgggaaacctggcggcagcgcaaaagatg

SEQ ID NO: 91247 - DNA, 103 bp, Artificial Sequence
  Synthetic Polynucleotide
taatacgactcactatagggttctctcttgaaaatttactggggccttcaaacagaggagatgaaggatgcagtaaattaacctggcggcagcgcaaaagatg

SEQ ID NO: 91248 - DNA, 103 bp, Artificial Sequence
  Synthetic Polynucleotide
taatacgactcactataggggggtaggtgtggctcgttccaatcccaaagaacagaggagactttggatgtggaacgagaacctggcggcagcgcaaaagatg

SEQ ID NO: 91249 - DNA, 103 bp, Artificial Sequence
  Synthetic Polynucleotide
taatacgactcactatagggggggtctgccgggtaggtgtggctcgttccaacagaggagaggaacgatgcacacctacaacctggcggcagcgcaaaagatg

SEQ ID NO: 91250 - DNA, 103 bp, Artificial Sequence
  Synthetic Polynucleotide
taatacgactcactatagggtgtaggaagaggggtctgccgggtaggtgtaacagaggagaacacctatgcggcagaccaacctggcggcagcgcaaaagatg

SEQ ID NO: 91251 - DNA, 103 bp, Artificial Sequence
  Synthetic Polynucleotide
taatacgactcactataggggagagggggctgtaggaagaggggtctgccaacagaggagaggcagaatgctcttcctaaacctggcggcagcgcaaaagatg

SEQ ID NO: 91252 - DNA, 103 bp, Artificial Sequence
  Synthetic Polynucleotide
taatacgactcactatagggagctgggctggagagggggctgtaggaagaaacagaggagatcttccatgagccccctcaacctggcggcagcgcaaaagatg

SEQ ID NO: 91253 - DNA, 103 bp, Artificial Sequence
  Synthetic Polynucleotide
taatacgactcactataggggcgaggaggtagctgggctggagagggggcaacagaggagagcccccatgccagcccagaacctggcggcagcgcaaaagatg

SEQ ID NO: 91254 - DNA, 103 bp, Artificial Sequence
  Synthetic Polynucleotide
taatacgactcactatagggttcccacttggcgaggaggtagctgggctgaacagaggagacagcccatgtacctcctcaacctggcggcagcgcaaaagatg

SEQ ID NO: 91255 - DNA, 103 bp, Artificial Sequence
  Synthetic Polynucleotide
taatacgactcactatagggggagtaggcattcccacttggcgaggaggtaacagaggagaacctccatgccaagtgggaacctggcggcagcgcaaaagatg

SEQ ID NO: 91256 - DNA, 103 bp, Artificial Sequence
  Synthetic Polynucleotide
taatacgactcactatagggtggcaagactggagtaggcattcccacttgaacagaggagacaagtgatgatgcctactaacctggcggcagcgcaaaagatg

SEQ ID NO: 91257 - DNA, 103 bp, Artificial Sequence
  Synthetic Polynucleotide
taatacgactcactatagggggagtcctgttggcaagactggagtaggcaaacagaggagatgcctaatgcagtcttgcaacctggcggcagcgcaaaagatg

SEQ ID NO: 91258 - DNA, 103 bp, Artificial Sequence
  Synthetic Polynucleotide
taatacgactcactatagggttcactatgattctctcttgaaaatttactaacagaggagaagtaaaatgtcaagagagaacctggcggcagcgcaaaagatg

SEQ ID NO: 91259 - DNA, 103 bp, Artificial Sequence
  Synthetic Polynucleotide
taatacgactcactatagggagcgaaccctggagtcctgttggcaagactaacagaggagaagtcttatgaacaggactaacctggcggcagcgcaaaagatg

SEQ ID NO: 91260 - DNA, 103 bp, Artificial Sequence
  Synthetic Polynucleotide
taatacgactcactataggggtccactttcagcgaaccctggagtcctgtaacagaggagaacaggaatgcagggttcgaacctggcggcagcgcaaaagatg

SEQ ID NO: 91261 - DNA, 103 bp, Artificial Sequence
  Synthetic Polynucleotide
taatacgactcactatagggccgctactttgtccactttcagcgaaccctaacagaggagaagggttatgtgaaagtggaacctggcggcagcgcaaaagatg

SEQ ID NO: 91262 - DNA, 103 bp, Artificial Sequence
  Synthetic Polynucleotide
taatacgactcactatagggttggaactgcccgctactttgtccactttcaacagaggagagaaagtatgcaaagtagcaacctggcggcagcgcaaaagatg

SEQ ID NO: 91263 - DNA, 103 bp, Artificial Sequence
  Synthetic Polynucleotide
taatacgactcactatagggagggccgcccttggaactgcccgctactttaacagaggagaaaagtaatgggcagttccaacctggcggcagcgcaaaagatg

SEQ ID NO: 91264 - DNA, 103 bp, Artificial Sequence
  Synthetic Polynucleotide
taatacgactcactatagggcagacttccgagggccgcccttggaactgcaacagaggagagcagttatgagggcggccaacctggcggcagcgcaaaagatg

SEQ ID NO: 91265 - DNA, 103 bp, Artificial Sequence
  Synthetic Polynucleotide
taatacgactcactatagggccactgcgaccagacttccgagggccgcccaacagaggagagggcggatgtcggaagtcaacctggcggcagcgcaaaagatg

SEQ ID NO: 91266 - DNA, 103 bp, Artificial Sequence
  Synthetic Polynucleotide
taatacgactcactataggggctggctttgccactgcgaccagacttccgaacagaggagacggaagatgggtcgcagtaacctggcggcagcgcaaaagatg

SEQ ID NO: 91267 - DNA, 103 bp, Artificial Sequence
  Synthetic Polynucleotide
taatacgactcactatagggtggccatggtgctggctttgccactgcgacaacagaggagagtcgcaatggcaaagccaaacctggcggcagcgcaaaagatg

SEQ ID NO: 91268 - DNA, 103 bp, Artificial Sequence
  Synthetic Polynucleotide
taatacgactcactatagggaccgctctgctggccatggtgctggctttgaacagaggagacaaagcatgcaccatggcaacctggcggcagcgcaaaagatg

SEQ ID NO: 91269 - DNA, 103 bp, Artificial Sequence
  Synthetic Polynucleotide
taatacgactcactatagggaagccatttccggagggttgaccgccgccgaacagaggagacggcggatgtcaaccctcaacctggcggcagcgcaaaagatg

SEQ ID NO: 91270 - DNA, 103 bp, Artificial Sequence
  Synthetic Polynucleotide
taatacgactcactataggggcctttcgatttcactatgattctctcttgaacagaggagacaagagatgatcatagtgaacctggcggcagcgcaaaagatg

SEQ ID NO: 91271 - DNA, 103 bp, Artificial Sequence
  Synthetic Polynucleotide
taatacgactcactatagggagtgctgctcaccgctctgctggccatggtaacagaggagaaccatgatgagcagagcgaacctggcggcagcgcaaaagatg

SEQ ID NO: 91272 - DNA, 103 bp, Artificial Sequence
  Synthetic Polynucleotide
taatacgactcactatagggtgctggtgggagtgctgctcaccgctctgcaacagaggagagcagagatgtgagcagcaaacctggcggcagcgcaaaagatg

SEQ ID NO: 91273 - DNA, 103 bp, Artificial Sequence
  Synthetic Polynucleotide
taatacgactcactatagggctgaccgggctgctggtgggagtgctgctcaacagaggagagagcagatgtcccaccagaacctggcggcagcgcaaaagatg

SEQ ID NO: 91274 - DNA, 103 bp, Artificial Sequence
  Synthetic Polynucleotide
taatacgactcactatagggacacttcagtctgaccgggctgctggtgggaacagaggagacccaccatgagcccggtcaacctggcggcagcgcaaaagatg

SEQ ID NO: 91275 - DNA, 103 bp, Artificial Sequence
  Synthetic Polynucleotide
taatacgactcactatagggatgtcctggaacacttcagtctgaccgggcaacagaggagagcccggatggactgaagtaacctggcggcagcgcaaaagatg

SEQ ID NO: 91276 - DNA, 103 bp, Artificial Sequence
  Synthetic Polynucleotide
taatacgactcactatagggcatgggcagcatgtcctggaacacttcagtaacagaggagaactgaaatgttccaggacaacctggcggcagcgcaaaagatg

SEQ ID NO: 91277 - DNA, 103 bp, Artificial Sequence
  Synthetic Polynucleotide
taatacgactcactataggggatctcctggcatgggcagcatgtcctggaaacagaggagatccaggatgtgctgcccaaacctggcggcagcgcaaaagatg

SEQ ID NO: 91278 - DNA, 103 bp, Artificial Sequence
  Synthetic Polynucleotide
taatacgactcactatagggccctgggttggatctcctggcatgggcagcaacagaggagagctgccatggccaggagaaacctggcggcagcgcaaaagatg

SEQ ID NO: 91279 - DNA, 103 bp, Artificial Sequence
  Synthetic Polynucleotide
taatacgactcactataggggttgccagtcccctgggttggatctcctggaacagaggagaccaggaatgccaacccagaacctggcggcagcgcaaaagatg

SEQ ID NO: 91280 - DNA, 103 bp, Artificial Sequence
  Synthetic Polynucleotide
taatacgactcactatagggcgatgttatagttgccagtcccctgggttgaacagaggagacaacccatgggactggcaaacctggcggcagcgcaaaagatg

SEQ ID NO: 91281 - DNA, 103 bp, Artificial Sequence
  Synthetic Polynucleotide
taatacgactcactatagggttccgtctgcgcctttcgatttcactatgaaacagaggagatcatagatgaatcgaaagaacctggcggcagcgcaaaagatg

SEQ ID NO: 91282 - DNA, 103 bp, Artificial Sequence
  Synthetic Polynucleotide
taatacgactcactataggggcaaagtcttcgatgttatagttgccagtcaacagaggagagactggatgctataacataacctggcggcagcgcaaaagatg

SEQ ID NO: 91283 - DNA, 103 bp, Artificial Sequence
  Synthetic Polynucleotide
taatacgactcactataggggcccaggtcggcaaagtcttcgatgttataaacagaggagatataacatggaagactttaacctggcggcagcgcaaaagatg

SEQ ID NO: 91284 - DNA, 103 bp, Artificial Sequence
  Synthetic Polynucleotide
taatacgactcactataggggtggaaacatgcccaggtcggcaaagtcttaacagaggagaaagactatgccgacctggaacctggcggcagcgcaaaagatg

SEQ ID NO: 91285 - DNA, 103 bp, Artificial Sequence
  Synthetic Polynucleotide
taatacgactcactatagggtcagaaaacggtggaaacatgcccaggtcgaacagaggagacgacctatgcatgtttccaacctggcggcagcgcaaaagatg

SEQ ID NO: 91286 - DNA, 103 bp, Artificial Sequence
  Synthetic Polynucleotide
taatacgactcactatagggagtcatcttgttccgtctgcgcctttcgataacagaggagaatcgaaatgcgcagacggaacctggcggcagcgcaaaagatg

SEQ ID NO: 91287 - DNA, 103 bp, Artificial Sequence
  Synthetic Polynucleotide
taatacgactcactatagggtgatgtactgagtcatcttgttccgtctgcaacagaggagagcagacatgacaagatgaaacctggcggcagcgcaaaagatg

SEQ ID NO: 91288 - DNA, 103 bp, Artificial Sequence
  Synthetic Polynucleotide
taatacgactcactataggggagagctccgtgatgtactgagtcatcttgaacagaggagacaagatatgtcagtacataacctggcggcagcgcaaaagatg

SEQ ID NO: 91289 - DNA, 103 bp, Artificial Sequence
  Synthetic Polynucleotide
taatacgactcactataggggaccatgtcggagagctccgtgatgtactgaacagaggagacagtacatgacggagctcaacctggcggcagcgcaaaagatg

SEQ ID NO: 91290 - DNA, 103 bp, Artificial Sequence
  Synthetic Polynucleotide
taatacgactcactatagggtgcatgtggggaccatgtcggagagctccgaacagaggagacggagcatgccgacatggaacctggcggcagcgcaaaagatg

SEQ ID NO: 91291 - DNA, 103 bp, Artificial Sequence
  Synthetic Polynucleotide
taatacgactcactataggggccagtgcgctgcatgtggggaccatgtcgaacagaggagacgacatatgccccacatgaacctggcggcagcgcaaaagatg

SEQ ID NO: 91292 - DNA, 103 bp, Artificial Sequence
  Synthetic Polynucleotide
taatacgactcactatagggtggcttccgagccagtgcgctgcatgtgggaacagaggagacccacaatgagcgcactgaacctggcggcagcgcaaaagatg

SEQ ID NO: 91293 - DNA, 103 bp, Artificial Sequence
  Synthetic Polynucleotide
taatacgactcactatagggtgagcttgtctggcttccgagccagtgcgcaacagaggagagcgcacatgctcggaagcaacctggcggcagcgcaaaagatg

SEQ ID NO: 91294 - DNA, 103 bp, Artificial Sequence
  Synthetic Polynucleotide
taatacgactcactatagggggtatgtctgaagccatttccggagggttgaacagaggagacaacccatgggaaatggcaacctggcggcagcgcaaaagatg

SEQ ID NO: 91295 - DNA, 103 bp, Artificial Sequence
  Synthetic Polynucleotide
taatacgactcactatagggcggaggatggtgagcttgtctggcttccgaaacagaggagatcggaaatgagacaagctaacctggcggcagcgcaaaagatg

SEQ ID NO: 91296 - DNA, 103 bp, Artificial Sequence
  Synthetic Polynucleotide
taatacgactcactataggggacggccatgcggaggatggtgagcttgtcaacagaggagagacaagatgaccatcctcaacctggcggcagcgcaaaagatg

SEQ ID NO: 91297 - DNA, 103 bp, Artificial Sequence
  Synthetic Polynucleotide
taatacgactcactatagggtcatgtgcgagacggccatgcggaggatggaacagaggagaccatccatggcatggccgaacctggcggcagcgcaaaagatg

SEQ ID NO: 91298 - DNA, 103 bp, Artificial Sequence
  Synthetic Polynucleotide
taatacgactcactatagggctcatggacttcatgtgcgagacggccatgaacagaggagacatggcatgctcgcacataacctggcggcagcgcaaaagatg

SEQ ID NO: 91299 - DNA, 103 bp, Artificial Sequence
  Synthetic Polynucleotide
taatacgactcactatagggccctgtacccctcatggacttcatgtgcgaaacagaggagatcgcacatgaagtccatgaacctggcggcagcgcaaaagatg

SEQ ID NO: 91300 - DNA, 103 bp, Artificial Sequence
  Synthetic Polynucleotide
taatacgactcactatagggtggacttgttccctgtacccctcatggactaacagaggagaagtccaatgggggtacagaacctggcggcagcgcaaaagatg

SEQ ID NO: 91301 - DNA, 103 bp, Artificial Sequence
  Synthetic Polynucleotide
taatacgactcactataggggcgccatcggtggacttgttccctgtacccaacagaggagagggtacatggaacaagtcaacctggcggcagcgcaaaagatg

SEQ ID NO: 91302 - DNA, 103 bp, Artificial Sequence
  Synthetic Polynucleotide
taatacgactcactatagggaggcttgtacgcgccatcggtggacttgttaacagaggagaaacaagatgaccgatggcaacctggcggcagcgcaaaagatg

SEQ ID NO: 91303 - DNA, 103 bp, Artificial Sequence
  Synthetic Polynucleotide
taatacgactcactatagggtgaggaaggaaggcttgtacgcgccatcggaacagaggagaccgatgatgcgtacaagcaacctggcggcagcgcaaaagatg

SEQ ID NO: 91304 - DNA, 103 bp, Artificial Sequence
  Synthetic Polynucleotide
taatacgactcactatagggtcctgctctgtgaggaaggaaggcttgtacaacagaggagagtacaaatgttccttcctaacctggcggcagcgcaaaagatg

SEQ ID NO: 91305 - DNA, 103 bp, Artificial Sequence
  Synthetic Polynucleotide
taatacgactcactatagggcacagatccaggtatgtctgaagccatttcaacagaggagagaaatgatgtcagacataaacctggcggcagcgcaaaagatg

SEQ ID NO: 91306 - DNA, 103 bp, Artificial Sequence
  Synthetic Polynucleotide
taatacgactcactatagggatgcttcagttcctgctctgtgaggaaggaaacagaggagatccttcatgacagagcagaacctggcggcagcgcaaaagatg

SEQ ID NO: 91307 - DNA, 103 bp, Artificial Sequence
  Synthetic Polynucleotide
taatacgactcactatagggcaaggatgagatgcttcagttcctgctctgaacagaggagacagagcatgaactgaagcaacctggcggcagcgcaaaagatg

SEQ ID NO: 91308 - DNA, 103 bp, Artificial Sequence
  Synthetic Polynucleotide
taatacgactcactatagggtcagctgcttcaaggatgagatgcttcagtaacagaggagaactgaaatgtctcatcctaacctggcggcagcgcaaaagatg

SEQ ID NO: 91309 - DNA, 103 bp, Artificial Sequence
  Synthetic Polynucleotide
taatacgactcactatagggcagaaatccatcagctgcttcaaggatgagaacagaggagactcatcatggaagcagctaacctggcggcagcgcaaaagatg

SEQ ID NO: 91310 - DNA, 103 bp, Artificial Sequence
  Synthetic Polynucleotide
taatacgactcactatagggccaccacaaacagaaatccatcagctgcttaacagaggagaaagcagatgatggatttcaacctggcggcagcgcaaaagatg

SEQ ID NO: 91311 - DNA, 103 bp, Artificial Sequence
  Synthetic Polynucleotide
taatacgactcactataggggtctcagcagccaccacaaacagaaatccaaacagaggagatggattatggtttgtggtaacctggcggcagcgcaaaagatg

SEQ ID NO: 91312 - DNA, 103 bp, Artificial Sequence
  Synthetic Polynucleotide
taatacgactcactatagggcactcgccctgtctcagcagccaccacaaaaacagaggagatttgtgatggctgctgagaacctggcggcagcgcaaaagatg

SEQ ID NO: 91313 - DNA, 103 bp, Artificial Sequence
  Synthetic Polynucleotide
taatacgactcactatagggacacataaatcactcgccctgtctcagcagaacagaggagactgctgatgcagggcgagaacctggcggcagcgcaaaagatg

SEQ ID NO: 91314 - DNA, 103 bp, Artificial Sequence
  Synthetic Polynucleotide
taatacgactcactatagggacggagtcagacacataaatcactcgccctaacagaggagaagggcgatggatttatgtaacctggcggcagcgcaaaagatg

SEQ ID NO: 91315 - DNA, 103 bp, Artificial Sequence
  Synthetic Polynucleotide
taatacgactcactatagggaacaggggtgacggagtcagacacataaataacagaggagaatttatatgtctgactccaacctggcggcagcgcaaaagatg

SEQ ID NO: 91316 - DNA, 103 bp, Artificial Sequence
  Synthetic Polynucleotide
taatacgactcactatagggcgggcaacgtcacagatccaggtatgtctgaacagaggagacagacaatgctggatctgaacctggcggcagcgcaaaagatg

SEQ ID NO: 91317 - DNA, 103 bp, Artificial Sequence
  Synthetic Polynucleotide
taatacgactcactataggggctggttcagaacaggggtgacggagtcagaacagaggagactgactatgtcacccctgaacctggcggcagcgcaaaagatg

SEQ ID NO: 91318 - DNA, 103 bp, Artificial Sequence
  Synthetic Polynucleotide
taatacgactcactatagggtctgactggggctggttcagaacaggggtgaacagaggagacaccccatgtctgaaccaaacctggcggcagcgcaaaagatg

SEQ ID NO: 91319 - DNA, 103 bp, Artificial Sequence
  Synthetic Polynucleotide
taatacgactcactatagggcccaaaccactctgactggggctggttcagaacagaggagactgaacatgccccagtcaaacctggcggcagcgcaaaagatg

SEQ ID NO: 91320 - DNA, 103 bp, Artificial Sequence
  Synthetic Polynucleotide
taatacgactcactatagggacagtgtgctcccaaaccactctgactgggaacagaggagacccagtatgagtggtttgaacctggcggcagcgcaaaagatg

SEQ ID NO: 91321 - DNA, 103 bp, Artificial Sequence
  Synthetic Polynucleotide
taatacgactcactatagggacctgttcatacagtgtgctcccaaaccacaacagaggagagtggttatggagcacactaacctggcggcagcgcaaaagatg

SEQ ID NO: 91322 - DNA, 103 bp, Artificial Sequence
  Synthetic Polynucleotide
taatacgactcactatagggatcaggatgcacctgttcatacagtgtgctaacagaggagaagcacaatgtatgaacagaacctggcggcagcgcaaaagatg

SEQ ID NO: 91323 - DNA, 103 bp, Artificial Sequence
  Synthetic Polynucleotide
taatacgactcactatagggtctccacgtcatcaggatgcacctgttcataacagaggagaatgaacatgtgcatcctgaacctggcggcagcgcaaaagatg

SEQ ID NO: 91324 - DNA, 103 bp, Artificial Sequence
  Synthetic Polynucleotide
taatacgactcactatagggtctctcagcttctccacgtcatcaggatgcaacagaggagagcatccatgtgacgtggaaacctggcggcagcgcaaaagatg

SEQ ID NO: 91325 - DNA, 103 bp, Artificial Sequence
  Synthetic Polynucleotide
taatacgactcactataggggcacagttgctctctcagcttctccacgtcaacagaggagagacgtgatgaagctgagaaacctggcggcagcgcaaaagatg

SEQ ID NO: 91326 - DNA, 103 bp, Artificial Sequence
  Synthetic Polynucleotide
taatacgactcactatagggtttctgaggtgcacagttgctctctcagctaacagaggagaagctgaatgagcaactgtaacctggcggcagcgcaaaagatg

SEQ ID NO: 91327 - DNA, 103 bp, Artificial Sequence
  Synthetic Polynucleotide
taatacgactcactatagggatgggggcaacgggcaacgtcacagatccaaacagaggagatggatcatggacgttgccaacctggcggcagcgcaaaagatg

SEQ ID NO: 91328 - DNA, 103 bp, Artificial Sequence
  Synthetic Polynucleotide
taatacgactcactataggggtcattgagttttctgaggtgcacagttgcaacagaggagagcaactatgcacctcagaaacctggcggcagcgcaaaagatg

SEQ ID NO: 91329 - DNA, 103 bp, Artificial Sequence
  Synthetic Polynucleotide
taatacgactcactataggggatccggcctgtcattgagttttctgaggtaacagaggagaacctcaatgaactcaatgaacctggcggcagcgcaaaagatg

SEQ ID NO: 91330 - DNA, 103 bp, Artificial Sequence
  Synthetic Polynucleotide
taatacgactcactatagggtcaggtccaagatccggcctgtcattgagtaacagaggagaactcaaatgcaggccggaaacctggcggcagcgcaaaagatg

SEQ ID NO: 91331 - DNA, 103 bp, Artificial Sequence
  Synthetic Polynucleotide
taatacgactcactataggggtcccagtcttcaggtccaagatccggcctaacagaggagaaggccgatgcttggacctaacctggcggcagcgcaaaagatg

SEQ ID NO: 91332 - DNA, 103 bp, Artificial Sequence
  Synthetic Polynucleotide
taatacgactcactatagggtttcttgaccgtcccagtcttcaggtccaaaacagaggagattggacatgaagactgggaacctggcggcagcgcaaaagatg

SEQ ID NO: 91333 - DNA, 103 bp, Artificial Sequence
  Synthetic Polynucleotide
taatacgactcactataggggctgcccttctttcttgaccgtcccagtctaacagaggagaagactgatgcggtcaagaaacctggcggcagcgcaaaagatg

SEQ ID NO: 91334 - DNA, 103 bp, Artificial Sequence
  Synthetic Polynucleotide
taatacgactcactatagggatggatgactgctgcccttctttcttgaccaacagaggagaggtcaaatgagaagggcaaacctggcggcagcgcaaaagatg

SEQ ID NO: 91335 - DNA, 103 bp, Artificial Sequence
  Synthetic Polynucleotide
taatacgactcactataggggcacatcctcatggatgactgctgcccttcaacagaggagagaagggatgcagtcatccaacctggcggcagcgcaaaagatg

SEQ ID NO: 91336 - DNA, 103 bp, Artificial Sequence
  Synthetic Polynucleotide
taatacgactcactataggggcgagcccatgcacatcctcatggatgactaacagaggagaagtcatatgtgaggatgtaacctggcggcagcgcaaaagatg

SEQ ID NO: 91337 - DNA, 103 bp, Artificial Sequence
  Synthetic Polynucleotide
taatacgactcactatagggaaagaccgccgcgagcccatgcacatcctcaacagaggagagaggatatgcatgggctcaacctggcggcagcgcaaaagatg

SEQ ID NO: 91338 - DNA, 103 bp, Artificial Sequence
  Synthetic Polynucleotide
taatacgactcactatagggggtggccgccatgggggcaacgggcaacgtaacagaggagaacgttgatggttgcccccaacctggcggcagcgcaaaagatg

SEQ ID NO: 91339 - DNA, 103 bp, Artificial Sequence
  Synthetic Polynucleotide
taatacgactcactatagggcctgcagatgaaagaccgccgcgagcccataacagaggagaatgggcatgcggcggtctaacctggcggcagcgcaaaagatg

SEQ ID NO: 91340 - DNA, 103 bp, Artificial Sequence
  Synthetic Polynucleotide
taatacgactcactatagggcacacctcatcctgcagatgaaagaccgccaacagaggagaggcggtatgtcatctgcaaacctggcggcagcgcaaaagatg

SEQ ID NO: 91341 - DNA, 103 bp, Artificial Sequence
  Synthetic Polynucleotide
taatacgactcactatagggggagcatttccacacctcatcctgcagatgaacagaggagacatctgatggatgaggtgaacctggcggcagcgcaaaagatg

SEQ ID NO: 91342 - DNA, 103 bp, Artificial Sequence
  Synthetic Polynucleotide
taatacgactcactataggggtggtccaaaggagcatttccacacctcataacagaggagaatgaggatgggaaatgctaacctggcggcagcgcaaaagatg

SEQ ID NO: 91343 - DNA, 103 bp, Artificial Sequence
  Synthetic Polynucleotide
taatacgactcactatagggttagaggaaggtggtccaaaggagcatttcaacagaggagagaaatgatgctttggaccaacctggcggcagcgcaaaagatg

SEQ ID NO: 91344 - DNA, 103 bp, Artificial Sequence
  Synthetic Polynucleotide
taatacgactcactataggggttattctgtttagaggaaggtggtccaaaaacagaggagatttggaatgccttcctctaacctggcggcagcgcaaaagatg

SEQ ID NO: 91345 - DNA, 103 bp, Artificial Sequence
  Synthetic Polynucleotide
taatacgactcactatagggcctcatggtggttattctgtttagaggaagaacagaggagacttcctatgaacagaataaacctggcggcagcgcaaaagatg

SEQ ID NO: 91346 - DNA, 103 bp, Artificial Sequence
  Synthetic Polynucleotide
taatacgactcactatagggtgaaccttttcctcatggtggttattctgtaacagaggagaacagaaatgccaccatgaaacctggcggcagcgcaaaagatg

SEQ ID NO: 91347 - DNA, 103 bp, Artificial Sequence
  Synthetic Polynucleotide
taatacgactcactatagggaggccattcctgaaccttttcctcatggtgaacagaggagacaccatatggaaaaggttaacctggcggcagcgcaaaagatg

SEQ ID NO: 91348 - DNA, 103 bp, Artificial Sequence
  Synthetic Polynucleotide
taatacgactcactatagggcacagggccaaggccattcctgaaccttttaacagaggagaaaaaggatgaggaatggcaacctggcggcagcgcaaaagatg

SEQ ID NO: 91349 - DNA, 103 bp, Artificial Sequence
  Synthetic Polynucleotide
taatacgactcactatagggtcacctgtccggtggccgccatgggggcaaaacagaggagattgcccatgtggcggccaaacctggcggcagcgcaaaagatg

SEQ ID NO: 91350 - DNA, 103 bp, Artificial Sequence
  Synthetic Polynucleotide
taatacgactcactatagggctccttctttcacagggccaaggccattccaacagaggagaggaatgatgttggccctgaacctggcggcagcgcaaaagatg

SEQ ID NO: 91351 - DNA, 103 bp, Artificial Sequence
  Synthetic Polynucleotide
taatacgactcactatagggtattgggcttctccttctttcacagggccaaacagaggagatggcccatggaaagaaggaacctggcggcagcgcaaaagatg

SEQ ID NO: 91352 - DNA, 103 bp, Artificial Sequence
  Synthetic Polynucleotide
taatacgactcactataggggaccacagcatattgggcttctccttctttaacagaggagaaaagaaatggaagcccaaaacctggcggcagcgcaaaagatg

SEQ ID NO: 91353 - DNA, 103 bp, Artificial Sequence
  Synthetic Polynucleotide
taatacgactcactatagggctgtacagtggaccacagcatattgggcttaacagaggagaaagcccatgatgctgtggaacctggcggcagcgcaaaagatg

SEQ ID NO: 91354 - DNA, 103 bp, Artificial Sequence
  Synthetic Polynucleotide
taatacgactcactatagggttgatgtatcctgtacagtggaccacagcaaacagaggagatgctgtatgccactgtacaacctggcggcagcgcaaaagatg

SEQ ID NO: 91355 - DNA, 103 bp, Artificial Sequence
  Synthetic Polynucleotide
taatacgactcactatagggtggccaggccttgatgtatcctgtacagtgaacagaggagacactgtatgggatacatcaacctggcggcagcgcaaaagatg

SEQ ID NO: 91356 - DNA, 103 bp, Artificial Sequence
  Synthetic Polynucleotide
taatacgactcactatagggttcctgctggtggccaggccttgatgtatcaacagaggagagatacaatgaggcctggcaacctggcggcagcgcaaaagatg

SEQ ID NO: 91357 - DNA, 103 bp, Artificial Sequence
  Synthetic Polynucleotide
taatacgactcactatagggggtatggtcattcctgctggtggccaggccaacagaggagaggcctgatgaccagcaggaacctggcggcagcgcaaaagatg

SEQ ID NO: 91358 - DNA, 103 bp, Artificial Sequence
  Synthetic Polynucleotide
taatacgactcactataggggtcttcttcaggtatggtcattcctgctggaacagaggagaccagcaatgatgaccataaacctggcggcagcgcaaaagatg

SEQ ID NO: 91359 - DNA, 103 bp, Artificial Sequence
  Synthetic Polynucleotide
taatacgactcactatagggccacatcagcgtcttcttcaggtatggtcaaacagaggagatgaccaatgctgaagaagaacctggcggcagcgcaaaagatg

SEQ ID NO: 91360 - DNA, 103 bp, Artificial Sequence
  Synthetic Polynucleotide
taatacgactcactatagggcccgccatcctcacctgtccggtggccgccaacagaggagaggcggcatgcggacaggtaacctggcggcagcgcaaaagatg

SEQ ID NO: 91361 - DNA, 103 bp, Artificial Sequence
  Synthetic Polynucleotide
taatacgactcactatagggctgccttgtcccacatcagcgtcttcttcaaacagaggagatgaagaatgcgctgatgtaacctggcggcagcgcaaaagatg

SEQ ID NO: 91362 - DNA, 103 bp, Artificial Sequence
  Synthetic Polynucleotide
taatacgactcactataggggcaatatttactgccttgtcccacatcagcaacagaggagagctgatatgggacaaggcaacctggcggcagcgcaaaagatg

SEQ ID NO: 91363 - DNA, 103 bp, Artificial Sequence
  Synthetic Polynucleotide
taatacgactcactatagggttgccacgaggcaatatttactgccttgtcaacagaggagagacaagatggtaaatattaacctggcggcagcgcaaaagatg

SEQ ID NO: 91364 - DNA, 103 bp, Artificial Sequence
  Synthetic Polynucleotide
taatacgactcactatagggagtctcccaattgccacgaggcaatatttaaacagaggagataaataatgcctcgtggcaacctggcggcagcgcaaaagatg

SEQ ID NO: 91365 - DNA, 103 bp, Artificial Sequence
  Synthetic Polynucleotide
taatacgactcactatagggggtcacctggagtctcccaattgccacgagaacagaggagactcgtgatgattgggagaaacctggcggcagcgcaaaagatg

SEQ ID NO: 91366 - DNA, 103 bp, Artificial Sequence
  Synthetic Polynucleotide
taatacgactcactatagggcaggagagctggtcacctggagtctcccaaaacagaggagattgggaatgtccaggtgaaacctggcggcagcgcaaaagatg

SEQ ID NO: 91367 - DNA, 103 bp, Artificial Sequence
  Synthetic Polynucleotide
taatacgactcactatagggtccatgcatacaggagagctggtcacctggaacagaggagaccaggtatgcagctctccaacctggcggcagcgcaaaagatg

SEQ ID NO: 91368 - DNA, 103 bp, Artificial Sequence
  Synthetic Polynucleotide
taatacgactcactatagggcccattcatgtccatgcatacaggagagctaacagaggagaagctctatggtatgcatgaacctggcggcagcgcaaaagatg

SEQ ID NO: 91369 - DNA, 103 bp, Artificial Sequence
  Synthetic Polynucleotide
taatacgactcactataggggcaccgacatcccattcatgtccatgcataaacagaggagatatgcaatgacatgaatgaacctggcggcagcgcaaaagatg

SEQ ID NO: 91370 - DNA, 103 bp, Artificial Sequence
  Synthetic Polynucleotide
taatacgactcactatagggaactctgtgggcaccgacatcccattcatgaacagaggagacatgaaatggatgtcggtaacctggcggcagcgcaaaagatg

SEQ ID NO: 91371 - DNA, 103 bp, Artificial Sequence
  Synthetic Polynucleotide
taatacgactcactatagggtgaagaaatgtccattctctggtctgccataacagaggagaatggcaatgcagagaatgaacctggcggcagcgcaaaagatg

SEQ ID NO: 91372 - DNA, 103 bp, Artificial Sequence
  Synthetic Polynucleotide
taatacgactcactatagggtttccgtttgcggttgcaatccacaccactaacagaggagaagtggtatggattgcaacaacctggcggcagcgcaaaagatg

SEQ ID NO: 91373 - DNA, 103 bp, Artificial Sequence
  Synthetic Polynucleotide
taatacgactcactatagggatattccatagatttcaccctgatttccccaacagaggagaggggaaatgagggtgaaaaacctggcggcagcgcaaaagatg

SEQ ID NO: 91374 - DNA, 103 bp, Artificial Sequence
  Synthetic Polynucleotide
taatacgactcactataggggccgagaaacatattccatagatttcacccaacagaggagagggtgaatgctatggaataacctggcggcagcgcaaaagatg

SEQ ID NO: 91375 - DNA, 103 bp, Artificial Sequence
  Synthetic Polynucleotide
taatacgactcactatagggtctatcgcgtgccgagaaacatattccataaacagaggagatatggaatgtgtttctcgaacctggcggcagcgcaaaagatg

SEQ ID NO: 91376 - DNA, 103 bp, Artificial Sequence
  Synthetic Polynucleotide
taatacgactcactatagggaaactttccatctatcgcgtgccgagaaacaacagaggagagtttctatgcacgcgataaacctggcggcagcgcaaaagatg

SEQ ID NO: 91377 - DNA, 103 bp, Artificial Sequence
  Synthetic Polynucleotide
taatacgactcactatagggctacaaaaacaaactttccatctatcgcgtaacagaggagaacgcgaatgatggaaagtaacctggcggcagcgcaaaagatg

SEQ ID NO: 91378 - DNA, 103 bp, Artificial Sequence
  Synthetic Polynucleotide
taatacgactcactataggggccctctggtctacaaaaacaaactttccaaacagaggagatggaaaatgtgtttttgtaacctggcggcagcgcaaaagatg

SEQ ID NO: 91379 - DNA, 103 bp, Artificial Sequence
  Synthetic Polynucleotide
taatacgactcactatagggaatagctgttgccctctggtctacaaaaacaacagaggagagtttttatggaccagaggaacctggcggcagcgcaaaagatg

SEQ ID NO: 91380 - DNA, 103 bp, Artificial Sequence
  Synthetic Polynucleotide
taatacgactcactatagggaatatgccaaaatagctgttgccctctggtaacagaggagaaccagaatgcaacagctaaacctggcggcagcgcaaaagatg

SEQ ID NO: 91381 - DNA, 103 bp, Artificial Sequence
  Synthetic Polynucleotide
taatacgactcactatagggtcttgtggtaaatatgccaaaatagctgttaacagaggagaaacagcatgtttggcataaacctggcggcagcgcaaaagatg

SEQ ID NO: 91382 - DNA, 103 bp, Artificial Sequence
  Synthetic Polynucleotide
taatacgactcactataggggcctagaagttcttgtggtaaatatgccaaaacagaggagattggcaatgttaccacaaaacctggcggcagcgcaaaagatg

SEQ ID NO: 91383 - DNA, 103 bp, Artificial Sequence
  Synthetic Polynucleotide
taatacgactcactatagggtggagctgcctttccgtttgcggttgcaataacagaggagaattgcaatggcaaacggaaacctggcggcagcgcaaaagatg

SEQ ID NO: 91384 - DNA, 103 bp, Artificial Sequence
  Synthetic Polynucleotide
taatacgactcactatagggaacacgatgtgcctagaagttcttgtggtaaacagaggagataccacatgaacttctagaacctggcggcagcgcaaaagatg

SEQ ID NO: 91385 - DNA, 103 bp, Artificial Sequence
  Synthetic Polynucleotide
taatacgactcactatagggaaatattcataacacgatgtgcctagaagtaacagaggagaacttctatgcacatcgtgaacctggcggcagcgcaaaagatg

SEQ ID NO: 91386 - DNA, 103 bp, Artificial Sequence
  Synthetic Polynucleotide
taatacgactcactatagggatcttggtgaaaatattcataacacgatgtaacagaggagaacatcgatgtatgaatataacctggcggcagcgcaaaagatg

SEQ ID NO: 91387 - DNA, 103 bp, Artificial Sequence
  Synthetic Polynucleotide
taatacgactcactataggggtcctatgtcatcttggtgaaaatattcataacagaggagaatgaatatgttcaccaagaacctggcggcagcgcaaaagatg

SEQ ID NO: 91388 - DNA, 103 bp, Artificial Sequence
  Synthetic Polynucleotide
taatacgactcactatagggtctgcaagatgtcctatgtcatcttggtgaaacagaggagatcaccaatgtgacataggaacctggcggcagcgcaaaagatg

SEQ ID NO: 91389 - DNA, 103 bp, Artificial Sequence
  Synthetic Polynucleotide
taatacgactcactatagggcctatgacattctgcaagatgtcctatgtcaacagaggagagacataatgcatcttgcaaacctggcggcagcgcaaaagatg

SEQ ID NO: 91390 - DNA, 103 bp, Artificial Sequence
  Synthetic Polynucleotide
taatacgactcactataggggtaaaacttgcctatgacattctgcaagataacagaggagaatcttgatgaatgtcataaacctggcggcagcgcaaaagatg

SEQ ID NO: 91391 - DNA, 103 bp, Artificial Sequence
  Synthetic Polynucleotide
taatacgactcactatagggtctctcgtctgtaaaacttgcctatgacataacagaggagaatgtcaatggcaagttttaacctggcggcagcgcaaaagatg

SEQ ID NO: 91392 - DNA, 103 bp, Artificial Sequence
  Synthetic Polynucleotide
taatacgactcactatagggtgtaattttttctctcgtctgtaaaacttgaacagaggagacaagttatgcagacgagaaacctggcggcagcgcaaaagatg

SEQ ID NO: 91393 - DNA, 103 bp, Artificial Sequence
  Synthetic Polynucleotide
taatacgactcactatagggagcaattagttgtaattttttctctcgtctaacagaggagaagacgaatgaaaaaattaaacctggcggcagcgcaaaagatg

SEQ ID NO: 91394 - DNA, 103 bp, Artificial Sequence
  Synthetic Polynucleotide
taatacgactcactatagggtggtagtcagtggagctgcctttccgtttgaacagaggagacaaacgatgaggcagctcaacctggcggcagcgcaaaagatg

SEQ ID NO: 91395 - DNA, 103 bp, Artificial Sequence
  Synthetic Polynucleotide
taatacgactcactatagggttaaatttatagcaattagttgtaatttttaacagaggagaaaaaatatgaactaattgaacctggcggcagcgcaaaagatg

SEQ ID NO: 91396 - DNA, 103 bp, Artificial Sequence
  Synthetic Polynucleotide
taatacgactcactatagggatctttgattttaaatttatagcaattagtaacagaggagaactaatatgtataaatttaacctggcggcagcgcaaaagatg

SEQ ID NO: 91397 - DNA, 103 bp, Artificial Sequence
  Synthetic Polynucleotide
taatacgactcactatagggtaaaagaaccatctttgattttaaatttataacagaggagaataaatatgaaatcaaagaacctggcggcagcgcaaaagatg

SEQ ID NO: 91398 - DNA, 103 bp, Artificial Sequence
  Synthetic Polynucleotide
taatacgactcactatagggcgtagtgtgataaaagaaccatctttgattaacagaggagaaatcaaatgtggttctttaacctggcggcagcgcaaaagatg

SEQ ID NO: 91399 - DNA, 103 bp, Artificial Sequence
  Synthetic Polynucleotide
taatacgactcactatagggccatcgactccgtagtgtgataaaagaaccaacagaggagaggttctatgatcacactaaacctggcggcagcgcaaaagatg

SEQ ID NO: 91400 - DNA, 103 bp, Artificial Sequence
  Synthetic Polynucleotide
taatacgactcactatagggtgaaactgaaccatcgactccgtagtgtgaaacagaggagatcacacatgggagtcgataacctggcggcagcgcaaaagatg

SEQ ID NO: 91401 - DNA, 103 bp, Artificial Sequence
  Synthetic Polynucleotide
taatacgactcactatagggcaagggttcatgaaactgaaccatcgactcaacagaggagagagtcgatggttcagtttaacctggcggcagcgcaaaagatg

SEQ ID NO: 91402 - DNA, 103 bp, Artificial Sequence
  Synthetic Polynucleotide
taatacgactcactatagggttccttggtccaagggttcatgaaactgaaaacagaggagattcagtatgatgaaccctaacctggcggcagcgcaaaagatg

SEQ ID NO: 91403 - DNA, 103 bp, Artificial Sequence
  Synthetic Polynucleotide
taatacgactcactatagggtatattctacttccttggtccaagggttcaaacagaggagatgaaccatgggaccaaggaacctggcggcagcgcaaaagatg

SEQ ID NO: 91404 - DNA, 103 bp, Artificial Sequence
  Synthetic Polynucleotide
taatacgactcactataggggttgagacaatatattctacttccttggtcaacagaggagagaccaaatgagtagaataaacctggcggcagcgcaaaagatg

SEQ ID NO: 91405 - DNA, 103 bp, Artificial Sequence
  Synthetic Polynucleotide
taatacgactcactatagggcatgctttcttggtagtcagtggagctgccaacagaggagaggcagcatgactgactacaacctggcggcagcgcaaaagatg

SEQ ID NO: 91406 - DNA, 103 bp, Artificial Sequence
  Synthetic Polynucleotide
taatacgactcactatagggaacagtgttagttgagacaatatattctacaacagaggagagtagaaatgattgtctcaaacctggcggcagcgcaaaagatg

SEQ ID NO: 91407 - DNA, 103 bp, Artificial Sequence
  Synthetic Polynucleotide
taatacgactcactatagggtggctaaaacaacagtgttagttgagacaaaacagaggagattgtctatgctaacactgaacctggcggcagcgcaaaagatg

SEQ ID NO: 91408 - DNA, 103 bp, Artificial Sequence
  Synthetic Polynucleotide
taatacgactcactatagggtccaggacgttggctaaaacaacagtgttaaacagaggagataacacatgtgttttagcaacctggcggcagcgcaaaagatg

SEQ ID NO: 91409 - DNA, 103 bp, Artificial Sequence
  Synthetic Polynucleotide
taatacgactcactataggggtccccgccttccaggacgttggctaaaacaacagaggagagttttaatgaacgtcctgaacctggcggcagcgcaaaagatg

SEQ ID NO: 91410 - DNA, 103 bp, Artificial Sequence
  Synthetic Polynucleotide
taatacgactcactatagggggaaggttgggtccccgccttccaggacgtaacagaggagaacgtccatgaaggcggggaacctggcggcagcgcaaaagatg

SEQ ID NO: 91411 - DNA, 103 bp, Artificial Sequence
  Synthetic Polynucleotide
taatacgactcactataggggtgagctgtgggaaggttgggtccccgcctaacagaggagaaggcggatgcccaaccttaacctggcggcagcgcaaaagatg

SEQ ID NO: 91412 - DNA, 103 bp, Artificial Sequence
  Synthetic Polynucleotide
taatacgactcactataggggggggatgctgtgagctgtgggaaggttggaacagaggagaccaaccatgccacagctcaacctggcggcagcgcaaaagatg

SEQ ID NO: 91413 - DNA, 103 bp, Artificial Sequence
  Synthetic Polynucleotide
taatacgactcactatagggccatgctgtggggggatgctgtgagctgtgaacagaggagacacagcatgcagcatcccaacctggcggcagcgcaaaagatg

SEQ ID NO: 91414 - DNA, 103 bp, Artificial Sequence
  Synthetic Polynucleotide
taatacgactcactatagggagcatgctgtccatgctgtggggggatgctaacagaggagaagcatcatgccacagcataacctggcggcagcgcaaaagatg

SEQ ID NO: 91415 - DNA, 103 bp, Artificial Sequence
  Synthetic Polynucleotide
taatacgactcactatagggtccagagggcagcatgctgtccatgctgtgaacagaggagacacagcatggacagcatgaacctggcggcagcgcaaaagatg

SEQ ID NO: 91416 - DNA, 103 bp, Artificial Sequence
  Synthetic Polynucleotide
taatacgactcactatagggtgtctgtgtccatgctttcttggtagtcagaacagaggagactgactatgaagaaagcaaacctggcggcagcgcaaaagatg

SEQ ID NO: 91417 - DNA, 103 bp, Artificial Sequence
  Synthetic Polynucleotide
taatacgactcactatagggggccaccttctccagagggcagcatgctgtaacagaggagaacagcaatgtgccctctgaacctggcggcagcgcaaaagatg

SEQ ID NO: 91418 - DNA, 103 bp, Artificial Sequence
  Synthetic Polynucleotide
taatacgactcactataggggtcctctttgggccaccttctccagagggcaacagaggagagccctcatgagaaggtggaacctggcggcagcgcaaaagatg

SEQ ID NO: 91419 - DNA, 103 bp, Artificial Sequence
  Synthetic Polynucleotide
taatacgactcactatagggagtggggtgggtcctctttgggccaccttcaacagaggagagaaggtatgccaaagaggaacctggcggcagcgcaaaagatg

SEQ ID NO: 91420 - DNA, 103 bp, Artificial Sequence
  Synthetic Polynucleotide
taatacgactcactatagggtccctggaacagtggggtgggtcctctttgaacagaggagacaaagaatgcccaccccaaacctggcggcagcgcaaaagatg

SEQ ID NO: 91421 - DNA, 103 bp, Artificial Sequence
  Synthetic Polynucleotide
taatacgactcactatagggccccctggaatccctggaacagtggggtggaacagaggagaccacccatgtgttccaggaacctggcggcagcgcaaaagatg

SEQ ID NO: 91422 - DNA, 103 bp, Artificial Sequence
  Synthetic Polynucleotide
taatacgactcactatagggagcccgggttccccctggaatccctggaacaacagaggagagttccaatgattccagggaacctggcggcagcgcaaaagatg

SEQ ID NO: 91423 - DNA, 103 bp, Artificial Sequence
  Synthetic Polynucleotide
taatacgactcactatagggttcctgccccagcccgggttccccctggaaaacagaggagattccagatggaacccgggaacctggcggcagcgcaaaagatg

SEQ ID NO: 91424 - DNA, 103 bp, Artificial Sequence
  Synthetic Polynucleotide
taatacgactcactatagggcggcctatttttcctgccccagcccgggttaacagaggagaaacccgatgtggggcaggaacctggcggcagcgcaaaagatg

SEQ ID NO: 91425 - DNA, 103 bp, Artificial Sequence
  Synthetic Polynucleotide
taatacgactcactatagggagcaatcattcggcctatttttcctgccccaacagaggagaggggcaatgaaaataggcaacctggcggcagcgcaaaagatg

SEQ ID NO: 91426 - DNA, 103 bp, Artificial Sequence
  Synthetic Polynucleotide
taatacgactcactatagggtgatttcctcagcaatcattcggcctatttaacagaggagaaaatagatggaatgattgaacctggcggcagcgcaaaagatg

SEQ ID NO: 91427 - DNA, 103 bp, Artificial Sequence
  Synthetic Polynucleotide
taatacgactcactataggggggtcatctttgtctgtgtccatgctttctaacagaggagaagaaagatgggacacagaaacctggcggcagcgcaaaagatg

SEQ ID NO: 91428 - DNA, 103 bp, Artificial Sequence
  Synthetic Polynucleotide
taatacgactcactatagggtggatttccatgatttcctcagcaatcattaacagaggagaaatgatatgtgaggaaataacctggcggcagcgcaaaagatg

SEQ ID NO: 91429 - DNA, 103 bp, Artificial Sequence
  Synthetic Polynucleotide
taatacgactcactatagggtcttatcctgtggatttccatgatttcctcaacagaggagagaggaaatgatggaaatcaacctggcggcagcgcaaaagatg

SEQ ID NO: 91430 - DNA, 103 bp, Artificial Sequence
  Synthetic Polynucleotide
taatacgactcactataggggcgatgaccctcttatcctgtggatttccaaacagaggagatggaaaatgacaggataaaacctggcggcagcgcaaaagatg

SEQ ID NO: 91431 - DNA, 103 bp, Artificial Sequence
  Synthetic Polynucleotide
taatacgactcactatagggcagctagaaggcgatgaccctcttatcctgaacagaggagacaggatatgagggtcatcaacctggcggcagcgcaaaagatg

SEQ ID NO: 91432 - DNA, 103 bp, Artificial Sequence
  Synthetic Polynucleotide
taatacgactcactataggggctggagccacagctagaaggcgatgacccaacagaggagagggtcaatgccttctagcaacctggcggcagcgcaaaagatg

SEQ ID NO: 91433 - DNA, 103 bp, Artificial Sequence
  Synthetic Polynucleotide
taatacgactcactatagggtgttcaatgggctggagccacagctagaagaacagaggagacttctaatggtggctccaaacctggcggcagcgcaaaagatg

SEQ ID NO: 91434 - DNA, 103 bp, Artificial Sequence
  Synthetic Polynucleotide
taatacgactcactataggggtactcgtgatgttcaatgggctggagccaaacagaggagatggctcatgcccattgaaaacctggcggcagcgcaaaagatg

SEQ ID NO: 91435 - DNA, 103 bp, Artificial Sequence
  Synthetic Polynucleotide
taatacgactcactatagggagggggaggcgtactcgtgatgttcaatggaacagaggagaccattgatgatcacgagtaacctggcggcagcgcaaaagatg

SEQ ID NO: 91436 - DNA, 103 bp, Artificial Sequence
  Synthetic Polynucleotide
taatacgactcactatagggaagaggcatcagggggaggcgtactcgtgaaacagaggagatcacgaatgcgcctccccaacctggcggcagcgcaaaagatg

SEQ ID NO: 91437 - DNA, 103 bp, Artificial Sequence
  Synthetic Polynucleotide
taatacgactcactatagggcctcctggagaagaggcatcagggggaggcaacagaggagagcctccatgtgatgcctcaacctggcggcagcgcaaaagatg

SEQ ID NO: 91438 - DNA, 103 bp, Artificial Sequence
  Synthetic Polynucleotide
taatacgactcactatagggccttccatgagggtcatctttgtctgtgtcaacagaggagagacacaatgaaagatgacaacctggcggcagcgcaaaagatg

SEQ ID NO: 91439 - DNA, 103 bp, Artificial Sequence
  Synthetic Polynucleotide
taatacgactcactatagggaatcttcttgcctcctggagaagaggcatcaacagaggagagatgccatgtctccaggaaacctggcggcagcgcaaaagatg

SEQ ID NO: 91440 - DNA, 103 bp, Artificial Sequence
  Synthetic Polynucleotide
taatacgactcactatagggctccatttaaaatcttcttgcctcctggagaacagaggagactccagatggcaagaagaaacctggcggcagcgcaaaagatg

SEQ ID NO: 91441 - DNA, 103 bp, Artificial Sequence
  Synthetic Polynucleotide
taatacgactcactatagggtctggagtccctccatttaaaatcttcttgaacagaggagacaagaaatgtttaaatggaacctggcggcagcgcaaaagatg

SEQ ID NO: 91442 - DNA, 103 bp, Artificial Sequence
  Synthetic Polynucleotide
taatacgactcactatagggggaaggaatgtctggagtccctccatttaaaacagaggagattaaatatggggactccaaacctggcggcagcgcaaaagatg

SEQ ID NO: 91443 - DNA, 103 bp, Artificial Sequence
  Synthetic Polynucleotide
taatacgactcactataggggtaggccactggaaggaatgtctggagtccaacagaggagaggactcatgacattccttaacctggcggcagcgcaaaagatg

SEQ ID NO: 91444 - DNA, 103 bp, Artificial Sequence
  Synthetic Polynucleotide
taatacgactcactatagggtggcctgatagtaggccactggaaggaatgaacagaggagacattccatgcagtggcctaacctggcggcagcgcaaaagatg

SEQ ID NO: 91445 - DNA, 103 bp, Artificial Sequence
  Synthetic Polynucleotide
taatacgactcactatagggctcctgagcctggcctgatagtaggccactaacagaggagaagtggcatgctatcaggcaacctggcggcagcgcaaaagatg

SEQ ID NO: 91446 - DNA, 103 bp, Artificial Sequence
  Synthetic Polynucleotide
taatacgactcactatagggaacctgggttctcctgagcctggcctgataaacagaggagatatcagatgaggctcaggaacctggcggcagcgcaaaagatg

SEQ ID NO: 91447 - DNA, 103 bp, Artificial Sequence
  Synthetic Polynucleotide
taatacgactcactataggggaatatggataacctgggttctcctgagccaacagaggagaggctcaatggaacccaggaacctggcggcagcgcaaaagatg

SEQ ID NO: 91448 - DNA, 103 bp, Artificial Sequence
  Synthetic Polynucleotide
taatacgactcactatagggagaactatcagaatatggataacctgggttaacagaggagaaacccaatgtatccatataacctggcggcagcgcaaaagatg

SEQ ID NO: 91449 - DNA, 103 bp, Artificial Sequence
  Synthetic Polynucleotide
taatacgactcactatagggtatattctaaccttccatgagggtcatcttaacagaggagaaagatgatgctcatggaaaacctggcggcagcgcaaaagatg

SEQ ID NO: 91450 - DNA, 103 bp, Artificial Sequence
  Synthetic Polynucleotide
taatacgactcactatagggcaagaatagaagaactatcagaatatggataacagaggagaatccatatgctgatagttaacctggcggcagcgcaaaagatg

SEQ ID NO: 91451 - DNA, 103 bp, Artificial Sequence
  Synthetic Polynucleotide
taatacgactcactataggggggttctcaccaagaatagaagaactatcaaacagaggagatgatagatgttctattctaacctggcggcagcgcaaaagatg

SEQ ID NO: 91452 - DNA, 103 bp, Artificial Sequence
  Synthetic Polynucleotide
taatacgactcactatagggacctatgtgggggttctcaccaagaatagaaacagaggagatctattatgggtgagaacaacctggcggcagcgcaaaagatg

SEQ ID NO: 91453 - DNA, 103 bp, Artificial Sequence
  Synthetic Polynucleotide
taatacgactcactatagggtcatgtctatacctatgtgggggttctcacaacagaggagagtgagaatgcccacatagaacctggcggcagcgcaaaagatg

SEQ ID NO: 91454 - DNA, 103 bp, Artificial Sequence
  Synthetic Polynucleotide
taatacgactcactatagggtcgttgtcaatcatgtctatacctatgtggaacagaggagaccacatatgtatagacataacctggcggcagcgcaaaagatg

SEQ ID NO: 91455 - DNA, 103 bp, Artificial Sequence
  Synthetic Polynucleotide
taatacgactcactatagggtgatccttggtcgttgtcaatcatgtctataacagaggagaatagacatgattgacaacaacctggcggcagcgcaaaagatg

SEQ ID NO: 91456 - DNA, 103 bp, Artificial Sequence
  Synthetic Polynucleotide
taatacgactcactatagggtgggactacttgatccttggtcgttgtcaaaacagaggagattgacaatgaccaaggataacctggcggcagcgcaaaagatg

SEQ ID NO: 91457 - DNA, 103 bp, Artificial Sequence
  Synthetic Polynucleotide
taatacgactcactatagggtcatcattactgggactacttgatccttggaacagaggagaccaaggatgaagtagtccaacctggcggcagcgcaaaagatg

SEQ ID NO: 91458 - DNA, 103 bp, Artificial Sequence
  Synthetic Polynucleotide
taatacgactcactatagggcattgctgcctcatcattactgggactactaacagaggagaagtagtatgagtaatgataacctggcggcagcgcaaaagatg

SEQ ID NO: 91459 - DNA, 103 bp, Artificial Sequence
  Synthetic Polynucleotide
taatacgactcactatagggtgatgacagccattgctgcctcatcattacaacagaggagagtaatgatgaggcagcaaaacctggcggcagcgcaaaagatg

SEQ ID NO: 91460 - DNA, 103 bp, Artificial Sequence
  Synthetic Polynucleotide
taatacgactcactatagggtggtgttctgtatattctaaccttccatgaaacagaggagatcatggatggttagaataaacctggcggcagcgcaaaagatg

SEQ ID NO: 91461 - DNA, 103 bp, Artificial Sequence
  Synthetic Polynucleotide
taatacgactcactatagggaagaggctcatgatgacagccattgctgccaacagaggagaggcagcatgggctgtcataacctggcggcagcgcaaaagatg

SEQ ID NO: 91462 - DNA, 103 bp, Artificial Sequence
  Synthetic Polynucleotide
taatacgactcactatagggatctgcttccaagaggctcatgatgacagcaacagaggagagctgtcatgatgagcctcaacctggcggcagcgcaaaagatg

SEQ ID NO: 91463 - DNA, 103 bp, Artificial Sequence
  Synthetic Polynucleotide
taatacgactcactatagggccagtccagcatctgcttccaagaggctcaaacagaggagatgagccatgtggaagcagaacctggcggcagcgcaaaagatg

SEQ ID NO: 91464 - DNA, 103 bp, Artificial Sequence
  Synthetic Polynucleotide
taatacgactcactatagggacagggccacccagtccagcatctgcttccaacagaggagaggaagcatgtgctggactaacctggcggcagcgcaaaagatg

SEQ ID NO: 91465 - DNA, 103 bp, Artificial Sequence
  Synthetic Polynucleotide
taatacgactcactatagggactaaagtcaacagggccacccagtccagcaacagaggagagctggaatgggtggccctaacctggcggcagcgcaaaagatg

SEQ ID NO: 91466 - DNA, 103 bp, Artificial Sequence
  Synthetic Polynucleotide
taatacgactcactatagggatggcaagtcactaaagtcaacagggccacaacagaggagagtggccatgttgactttaaacctggcggcagcgcaaaagatg

SEQ ID NO: 91467 - DNA, 103 bp, Artificial Sequence
  Synthetic Polynucleotide
taatacgactcactatagggtacagcggccatggcaagtcactaaagtcaaacagaggagatgacttatgtgacttgccaacctggcggcagcgcaaaagatg

SEQ ID NO: 91468 - DNA, 103 bp, Artificial Sequence
  Synthetic Polynucleotide
taatacgactcactatagggtatccttccttggtgttctgtatattctaaaacagaggagattagaaatgacagaacacaacctggcggcagcgcaaaagatg

SEQ ID NO: 91469 - DNA, 103 bp, Artificial Sequence
  Synthetic Polynucleotide
taatacgactcactatagggcactgatggttgaagaaatgtccattctctaacagaggagaagagaaatgacatttcttaacctggcggcagcgcaaaagatg

SEQ ID NO: 91470 - DNA, 103 bp, Artificial Sequence
  Synthetic Polynucleotide
taatacgactcactatagggttgcattttttatccttccttggtgttctgaacagaggagacagaacatgaaggaaggaaacctggcggcagcgcaaaagatg

SEQ ID NO: 91471 - DNA, 103 bp, Artificial Sequence
  Synthetic Polynucleotide
taatacgactcactatagggtgagcttcccttgcattttttatccttcctaacagaggagaaggaagatgaaaaaatgcaacctggcggcagcgcaaaagatg

SEQ ID NO: 91472 - DNA, 103 bp, Artificial Sequence
  Synthetic Polynucleotide
taatacgactcactatagggaatctgactgtgagcttcccttgcatttttaacagaggagaaaaaatatgagggaagctaacctggcggcagcgcaaaagatg

SEQ ID NO: 91473 - DNA, 103 bp, Artificial Sequence
  Synthetic Polynucleotide
taatacgactcactataggggccgcttttcaatctgactgtgagcttcccaacagaggagagggaagatgacagtcagaaacctggcggcagcgcaaaagatg

SEQ ID NO: 91474 - DNA, 103 bp, Artificial Sequence
  Synthetic Polynucleotide
taatacgactcactatagggttatcccgacgccgcttttcaatctgactgaacagaggagacagtcaatgtgaaaagcgaacctggcggcagcgcaaaagatg

SEQ ID NO: 91475 - DNA, 103 bp, Artificial Sequence
  Synthetic Polynucleotide
taatacgactcactatagggactgttcattttatcccgacgccgcttttcaacagaggagagaaaagatgcgtcgggataacctggcggcagcgcaaaagatg

SEQ ID NO: 91476 - DNA, 103 bp, Artificial Sequence
  Synthetic Polynucleotide
taatacgactcactatagggcatctataaaactgttcattttatcccgacaacagaggagagtcgggatgaaatgaacaaacctggcggcagcgcaaaagatg

SEQ ID NO: 91477 - DNA, 103 bp, Artificial Sequence
  Synthetic Polynucleotide
taatacgactcactataggggaagccaattcatctataaaactgttcattaacagaggagaaatgaaatgttttatagaaacctggcggcagcgcaaaagatg

SEQ ID NO: 91478 - DNA, 103 bp, Artificial Sequence
  Synthetic Polynucleotide
taatacgactcactatagggtggtaccaaagaagccaattcatctataaaaacagaggagatttataatggaattggctaacctggcggcagcgcaaaagatg

SEQ ID NO: 91479 - DNA, 103 bp, Artificial Sequence
  Synthetic Polynucleotide
taatacgactcactatagggcgttgcatgttggtaccaaagaagccaattaacagaggagaaattggatgctttggtacaacctggcggcagcgcaaaagatg

SEQ ID NO: 91480 - DNA, 103 bp, Artificial Sequence
  Synthetic Polynucleotide
taatacgactcactataggggacatgaaatcactgatggttgaagaaatgaacagaggagacatttcatgaaccatcagaacctggcggcagcgcaaaagatg

SEQ ID NO: 91481 - DNA, 103 bp, Artificial Sequence
  Synthetic Polynucleotide
taatacgactcactatagggctggacattgcgttgcatgttggtaccaaaaacagaggagatttggtatgaacatgcaaaacctggcggcagcgcaaaagatg

SEQ ID NO: 91482 - DNA, 103 bp, Artificial Sequence
  Synthetic Polynucleotide
taatacgactcactatagggatctaatttcctggacattgcgttgcatgtaacagaggagaacatgcatggcaatgtccaacctggcggcagcgcaaaagatg

SEQ ID NO: 91483 - DNA, 103 bp, Artificial Sequence
  Synthetic Polynucleotide
taatacgactcactatagggcagtaagtttatctaatttcctggacattgaacagaggagacaatgtatgggaaattagaacctggcggcagcgcaaaagatg

SEQ ID NO: 91484 - DNA, 103 bp, Artificial Sequence
  Synthetic Polynucleotide
taatacgactcactatagggatccttagcacagtaagtttatctaatttcaacagaggagagaaattatgtaaacttacaacctggcggcagcgcaaaagatg

SEQ ID NO: 91485 - DNA, 103 bp, Artificial Sequence
  Synthetic Polynucleotide
taatacgactcactatagggctgaacagccatccttagcacagtaagtttaacagaggagaaaacttatggtgctaaggaacctggcggcagcgcaaaagatg

SEQ ID NO: 91486 - DNA, 103 bp, Artificial Sequence
  Synthetic Polynucleotide
taatacgactcactatagggttttcatgtgctgaacagccatccttagcaaacagaggagatgctaaatgtggctgttcaacctggcggcagcgcaaaagatg

SEQ ID NO: 91487 - DNA, 103 bp, Artificial Sequence
  Synthetic Polynucleotide
taatacgactcactatagggcctcttaatgttttcatgtgctgaacagccaacagaggagaggctgtatggcacatgaaaacctggcggcagcgcaaaagatg

SEQ ID NO: 91488 - DNA, 103 bp, Artificial Sequence
  Synthetic Polynucleotide
taatacgactcactatagggattggtggcacctcttaatgttttcatgtgaacagaggagacacatgatgacattaagaaacctggcggcagcgcaaaagatg

SEQ ID NO: 91489 - DNA, 103 bp, Artificial Sequence
  Synthetic Polynucleotide
taatacgactcactatagggctgtgtatggattggtggcacctcttaatgaacagaggagacattaaatggtgccaccaaacctggcggcagcgcaaaagatg

SEQ ID NO: 91490 - DNA, 103 bp, Artificial Sequence
  Synthetic Polynucleotide
taatacgactcactatagggtagtttgcttctgtgtatggattggtggcaaacagaggagatgccacatgtccatacacaacctggcggcagcgcaaaagatg

SEQ ID NO: 91491 - DNA, 103 bp, Artificial Sequence
  Synthetic Polynucleotide
taatacgactcactatagggggggcccggggacatgaaatcactgatggtaacagaggagaaccatcatggatttcatgaacctggcggcagcgcaaaagatg

SEQ ID NO: 91492 - DNA, 103 bp, Artificial Sequence
  Synthetic Polynucleotide
taatacgactcactatagggagttggtttgtagtttgcttctgtgtatggaacagaggagaccatacatggaagcaaacaacctggcggcagcgcaaaagatg

SEQ ID NO: 91493 - DNA, 103 bp, Artificial Sequence
  Synthetic Polynucleotide
taatacgactcactatagggctgatagaaaagttggtttgtagtttgcttaacagaggagaaagcaaatgacaaaccaaaacctggcggcagcgcaaaagatg

SEQ ID NO: 91494 - DNA, 103 bp, Artificial Sequence
  Synthetic Polynucleotide
taatacgactcactatagggaattcatcgtctgatagaaaagttggtttgaacagaggagacaaaccatgttttctatcaacctggcggcagcgcaaaagatg

SEQ ID NO: 91495 - DNA, 103 bp, Artificial Sequence
  Synthetic Polynucleotide
taatacgactcactataggggaggtgtttcaattcatcgtctgatagaaaaacagaggagatttctaatggacgatgaaaacctggcggcagcgcaaaagatg

SEQ ID NO: 91496 - DNA, 103 bp, Artificial Sequence
  Synthetic Polynucleotide
taatacgactcactatagggccctgagaatgaggtgtttcaattcatcgtaacagaggagaacgatgatgtgaaacaccaacctggcggcagcgcaaaagatg

SEQ ID NO: 91497 - DNA, 103 bp, Artificial Sequence
  Synthetic Polynucleotide
taatacgactcactatagggccatctgctgccctgagaatgaggtgtttcaacagaggagagaaacaatgcattctcagaacctggcggcagcgcaaaagatg

SEQ ID NO: 91498 - DNA, 103 bp, Artificial Sequence
  Synthetic Polynucleotide
taatacgactcactatagggaaacaaaaatccatctgctgccctgagaataacagaggagaattctcatggcagcagataacctggcggcagcgcaaaagatg

SEQ ID NO: 91499 - DNA, 103 bp, Artificial Sequence
  Synthetic Polynucleotide
taatacgactcactatagggatcctacgacaaacaaaaatccatctgctgaacagaggagacagcagatggatttttgtaacctggcggcagcgcaaaagatg

SEQ ID NO: 91500 - DNA, 103 bp, Artificial Sequence
  Synthetic Polynucleotide
taatacgactcactatagggcctcggtcacatcctacgacaaacaaaaataacagaggagaatttttatgtgtcgtaggaacctggcggcagcgcaaaagatg

SEQ ID NO: 91501 - DNA, 103 bp, Artificial Sequence
  Synthetic Polynucleotide
taatacgactcactataggggagtatcttccctcggtcacatcctacgacaacagaggagagtcgtaatgtgtgaccgaaacctggcggcagcgcaaaagatg

SEQ ID NO: 91502 - DNA, 103 bp, Artificial Sequence
  Synthetic Polynucleotide
taatacgactcactataggggcaggtcggtggggcccggggacatgaaataacagaggagaatttcaatgccccgggccaacctggcggcagcgcaaaagatg

SEQ ID NO: 91503 - DNA, 103 bp, Artificial Sequence
  Synthetic Polynucleotide
taatacgactcactatagggctgagacaaagagtatcttccctcggtcacaacagaggagagtgaccatgggaagatacaacctggcggcagcgcaaaagatg

SEQ ID NO: 91504 - DNA, 103 bp, Artificial Sequence
  Synthetic Polynucleotide
taatacgactcactatagggaagacagactctgagacaaagagtatcttcaacagaggagagaagatatgctttgtctcaacctggcggcagcgcaaaagatg

SEQ ID NO: 91505 - DNA, 103 bp, Artificial Sequence
  Synthetic Polynucleotide
taatacgactcactataggggaggatcttgaagacagactctgagacaaaaacagaggagatttgtcatggagtctgtcaacctggcggcagcgcaaaagatg

SEQ ID NO: 91506 - DNA, 103 bp, Artificial Sequence
  Synthetic Polynucleotide
taatacgactcactatagggggctgtagttgaggatcttgaagacagactaacagaggagaagtctgatgtcaagatccaacctggcggcagcgcaaaagatg

SEQ ID NO: 91507 - DNA, 103 bp, Artificial Sequence
  Synthetic Polynucleotide
taatacgactcactatagggagatcattctggctgtagttgaggatcttgaacagaggagacaagatatgcaactacagaacctggcggcagcgcaaaagatg

SEQ ID NO: 91508 - DNA, 103 bp, Artificial Sequence
  Synthetic Polynucleotide
taatacgactcactatagggctgaccaatcagatcattctggctgtagttaacagaggagaaactacatgcagaatgataacctggcggcagcgcaaaagatg

SEQ ID NO: 91509 - DNA, 103 bp, Artificial Sequence
  Synthetic Polynucleotide
taatacgactcactatagggcaaacaaactctgaccaatcagatcattctaacagaggagaagaatgatgtgattggtcaacctggcggcagcgcaaaagatg

SEQ ID NO: 91510 - DNA, 103 bp, Artificial Sequence
  Synthetic Polynucleotide
taatacgactcactatagggtgcaggtagtcaaacaaactctgaccaatcaacagaggagagattggatggagtttgttaacctggcggcagcgcaaaagatg

SEQ ID NO: 91511 - DNA, 103 bp, Artificial Sequence
  Synthetic Polynucleotide
taatacgactcactatagggatctttaggatgcaggtagtcaaacaaactaacagaggagaagtttgatggactacctgaacctggcggcagcgcaaaagatg

SEQ ID NO: 91512 - DNA, 103 bp, Artificial Sequence
  Synthetic Polynucleotide
taatacgactcactatagggctttggcaatatctttaggatgcaggtagtaacagaggagaactaccatgatcctaaagaacctggcggcagcgcaaaagatg

SEQ ID NO: 91513 - DNA, 103 bp, Artificial Sequence
  Synthetic Polynucleotide
taatacgactcactataggggagctggaaagcaggtcggtggggcccgggaacagaggagacccgggatgcaccgacctaacctggcggcagcgcaaaagatg

SEQ ID NO: 91514 - DNA, 103 bp, Artificial Sequence
  Synthetic Polynucleotide
taatacgactcactatagggtgctccttgactttggcaatatctttaggaaacagaggagatcctaaatgtattgccaaaacctggcggcagcgcaaaagatg

SEQ ID NO: 91515 - DNA, 103 bp, Artificial Sequence
  Synthetic Polynucleotide
taatacgactcactatagggggaggagagctgctccttgactttggcaataacagaggagaattgccatggtcaaggagaacctggcggcagcgcaaaagatg

SEQ ID NO: 91516 - DNA, 103 bp, Artificial Sequence
  Synthetic Polynucleotide
taatacgactcactatagggcggtgtcagaggaggagagctgctccttgaaacagaggagatcaaggatgagctctcctaacctggcggcagcgcaaaagatg

SEQ ID NO: 91517 - DNA, 103 bp, Artificial Sequence
  Synthetic Polynucleotide
taatacgactcactatagggtcccggggtgcggtgtcagaggaggagagcaacagaggagagctctcatgctctgacacaacctggcggcagcgcaaaagatg

SEQ ID NO: 91518 - DNA, 103 bp, Artificial Sequence
  Synthetic Polynucleotide
taatacgactcactatagggtatgagccgctcccggggtgcggtgtcagaaacagaggagatctgacatggcaccccggaacctggcggcagcgcaaaagatg

SEQ ID NO: 91519 - DNA, 103 bp, Artificial Sequence
  Synthetic Polynucleotide
taatacgactcactatagggtttttgcatctatgagccgctcccggggtgaacagaggagacaccccatgagcggctcaaacctggcggcagcgcaaaagatg

SEQ ID NO: 91520 - DNA, 103 bp, Artificial Sequence
  Synthetic Polynucleotide
taatacgactcactatagggggaagtccagtttttgcatctatgagccgcaacagaggagagcggctatgagatgcaaaaacctggcggcagcgcaaaagatg

SEQ ID NO: 91521 - DNA, 103 bp, Artificial Sequence
  Synthetic Polynucleotide
taatacgactcactatagggtgttttaactggaagtccagtttttgcatcaacagaggagagatgcaatgactggacttaacctggcggcagcgcaaaagatg

SEQ ID NO: 91522 - DNA, 103 bp, Artificial Sequence
  Synthetic Polynucleotide
taatacgactcactataggggggttatatctgttttaactggaagtccagaacagaggagactggacatgcagttaaaaaacctggcggcagcgcaaaagatg

SEQ ID NO: 91523 - DNA, 103 bp, Artificial Sequence
  Synthetic Polynucleotide
taatacgactcactataggggatggcccaggggttatatctgttttaactaacagaggagaagttaaatgagatataacaacctggcggcagcgcaaaagatg

SEQ ID NO: 91524 - DNA, 103 bp, Artificial Sequence
  Synthetic Polynucleotide
taatacgactcactatagggggtaccaagagagctggaaagcaggtcggtaacagaggagaaccgacatgctttccagcaacctggcggcagcgcaaaagatg

SEQ ID NO: 91525 - DNA, 103 bp, Artificial Sequence
  Synthetic Polynucleotide
taatacgactcactatagggacataatcgagatggcccaggggttatatcaacagaggagagatataatgcctgggccaaacctggcggcagcgcaaaagatg

SEQ ID NO: 91526 - DNA, 103 bp, Artificial Sequence
  Synthetic Polynucleotide
taatacgactcactataggggtgctccagaacataatcgagatggcccagaacagaggagactgggcatgctcgattataacctggcggcagcgcaaaagatg

SEQ ID NO: 91527 - DNA, 103 bp, Artificial Sequence
  Synthetic Polynucleotide
taatacgactcactatagggaaagaacgtcgtgctccagaacataatcgaaacagaggagatcgattatgttctggagcaacctggcggcagcgcaaaagatg

SEQ ID NO: 91528 - DNA, 103 bp, Artificial Sequence
  Synthetic Polynucleotide
taatacgactcactatagggcctacagaagaaagaacgtcgtgctccagaaacagaggagatctggaatgcgacgttctaacctggcggcagcgcaaaagatg

SEQ ID NO: 91529 - DNA, 103 bp, Artificial Sequence
  Synthetic Polynucleotide
taatacgactcactatagggtacacttcatcctacagaagaaagaacgtcaacagaggagagacgttatgtcttctgtaaacctggcggcagcgcaaaagatg

SEQ ID NO: 91530 - DNA, 103 bp, Artificial Sequence
  Synthetic Polynucleotide
taatacgactcactataggggaaggcctgttacacttcatcctacagaagaacagaggagacttctgatggatgaagtgaacctggcggcagcgcaaaagatg

SEQ ID NO: 91531 - DNA, 103 bp, Artificial Sequence
  Synthetic Polynucleotide
taatacgactcactatagggaacctttactgaaggcctgttacacttcataacagaggagaatgaagatgaacaggcctaacctggcggcagcgcaaaagatg

SEQ ID NO: 91532 - DNA, 103 bp, Artificial Sequence
  Synthetic Polynucleotide
taatacgactcactatagggccttgtcttcaacctttactgaaggcctgtaacagaggagaacaggcatgcagtaaaggaacctggcggcagcgcaaaagatg

SEQ ID NO: 91533 - DNA, 103 bp, Artificial Sequence
  Synthetic Polynucleotide
taatacgactcactataggggaggggaagtccttgtcttcaacctttactaacagaggagaagtaaaatgtgaagacaaaacctggcggcagcgcaaaagatg

SEQ ID NO: 91534 - DNA, 103 bp, Artificial Sequence
  Synthetic Polynucleotide
taatacgactcactatagggtgagcaggtagaggggaagtccttgtcttcaacagaggagagaagacatggacttccccaacctggcggcagcgcaaaagatg

SEQ ID NO: 91535 - DNA, 103 bp, Artificial Sequence
  Synthetic Polynucleotide
taatacgactcactatagggccacaccactggtaccaagagagctggaaaaacagaggagatttccaatgctcttggtaaacctggcggcagcgcaaaagatg

SEQ ID NO: 91536 - DNA, 103 bp, Artificial Sequence
  Synthetic Polynucleotide
taatacgactcactatagggcttttttctttgagcaggtagaggggaagtaacagaggagaacttccatgctacctgctaacctggcggcagcgcaaaagatg

SEQ ID NO: 91537 - DNA, 103 bp, Artificial Sequence
  Synthetic Polynucleotide
taatacgactcactatagggtttcgatctgcttttttctttgagcaggtaaacagaggagatacctgatgaaagaaaaaaacctggcggcagcgcaaaagatg

SEQ ID NO: 91538 - DNA, 103 bp, Artificial Sequence
  Synthetic Polynucleotide
taatacgactcactataggggcagaagctttttcgatctgcttttttcttaacagaggagaaagaaaatggcagatcgaaacctggcggcagcgcaaaagatg

SEQ ID NO: 91539 - DNA, 103 bp, Artificial Sequence
  Synthetic Polynucleotide
taatacgactcactatagggtgtggattgtgcagaagctttttcgatctgaacagaggagacagatcatgaaagcttctaacctggcggcagcgcaaaagatg

SEQ ID NO: 91540 - DNA, 103 bp, Artificial Sequence
  Synthetic Polynucleotide
taatacgactcactatagggtagcctgtgctgtggattgtgcagaagcttaacagaggagaaagcttatgcacaatccaaacctggcggcagcgcaaaagatg

SEQ ID NO: 91541 - DNA, 103 bp, Artificial Sequence
  Synthetic Polynucleotide
taatacgactcactataggggcttttcaaatagcctgtgctgtggattgtaacagaggagaacaatcatgagcacaggcaacctggcggcagcgcaaaagatg

SEQ ID NO: 91542 - DNA, 103 bp, Artificial Sequence
  Synthetic Polynucleotide
taatacgactcactatagggtgggtggccagcttttcaaatagcctgtgcaacagaggagagcacagatgatttgaaaaaacctggcggcagcgcaaaagatg

SEQ ID NO: 91543 - DNA, 103 bp, Artificial Sequence
  Synthetic Polynucleotide
taatacgactcactatagggcccatctttgtgggtggccagcttttcaaaaacagaggagatttgaaatgctggccaccaacctggcggcagcgcaaaagatg

SEQ ID NO: 91544 - DNA, 103 bp, Artificial Sequence
  Synthetic Polynucleotide
taatacgactcactatagggttcatccagccccatctttgtgggtggccaaacagaggagatggccaatgacaaagatgaacctggcggcagcgcaaaagatg

SEQ ID NO: 91545 - DNA, 103 bp, Artificial Sequence
  Synthetic Polynucleotide
taatacgactcactataggggttcgttgtcttcatccagccccatctttgaacagaggagacaaagaatgggctggatgaacctggcggcagcgcaaaagatg

SEQ ID NO: 91546 - DNA, 103 bp, Artificial Sequence
  Synthetic Polynucleotide
taatacgactcactatagggcggttgcaatccacaccactggtaccaagaaacagaggagatcttggatgcagtggtgtaacctggcggcagcgcaaaagatg

SEQ ID NO: 91547 - DNA, 103 bp, Artificial Sequence
  Synthetic Polynucleotide
taatacgactcactatagggtcattgtctggttcgttgtcttcatccagcaacagaggagagctggaatgagacaacgaaacctggcggcagcgcaaaagatg

SEQ ID NO: 91548 - DNA, 103 bp, Artificial Sequence
  Synthetic Polynucleotide
taatacgactcactataggggttacacccctcattgtctggttcgttgtcaacagaggagagacaacatgccagacaataacctggcggcagcgcaaaagatg

SEQ ID NO: 91549 - DNA, 103 bp, Artificial Sequence
  Synthetic Polynucleotide
taatacgactcactatagggggcagctgaggttacacccctcattgtctgaacagaggagacagacaatgaggggtgtaaacctggcggcagcgcaaaagatg

SEQ ID NO: 91550 - DNA, 103 bp, Artificial Sequence
  Synthetic Polynucleotide
taatacgactcactatagggattgcgacgaggcagctgaggttacaccccaacagaggagaggggtgatgcctcagctgaacctggcggcagcgcaaaagatg

SEQ ID NO: 91551 - DNA, 103 bp, Artificial Sequence
  Synthetic Polynucleotide
taatacgactcactatagggcagtcgtccaattgcgacgaggcagctgagaacagaggagactcagcatgctcgtcgcaaacctggcggcagcgcaaaagatg

SEQ ID NO: 91552 - DNA, 103 bp, Artificial Sequence
  Synthetic Polynucleotide
taatacgactcactatagggcatgagaatgcagtcgtccaattgcgacgaaacagaggagatcgtcgatgttggacgacaacctggcggcagcgcaaaagatg

SEQ ID NO: 91553 - DNA, 103 bp, Artificial Sequence
  Synthetic Polynucleotide
taatacgactcactatagggtgtggaactacatgagaatgcagtcgtccaaacagaggagatggacgatggcattctcaaacctggcggcagcgcaaaagatg

SEQ ID NO: 91554 - DNA, 103 bp, Artificial Sequence
  Synthetic Polynucleotide
taatacgactcactataggggttcactggttgtggaactacatgagaatgaacagaggagacattctatggtagttccaaacctggcggcagcgcaaaagatg

SEQ ID NO: 91555 - DNA, 103 bp, Artificial Sequence
  Synthetic Polynucleotide
taatacgactcactatagggtgatttccccgttcactggttgtggaactaaacagaggagatagttcatgaaccagtgaaacctggcggcagcgcaaaagatg

SEQ ID NO: 91556 - DNA, 103 bp, Artificial Sequence
  Synthetic Polynucleotide
taatacgactcactataggggatttcaccctgatttccccgttcactggtaacagaggagaaccagtatgcggggaaataacctggcggcagcgcaaaagatg

SEQ ID NO: 91557 - DNA, 103 bp, Artificial Sequence
  Synthetic Polynucleotide
taatacgactcactatagggtcccgccgcagcctcctcttccgccgccataacagaggagaatggcgatggaagaggagaacctggcggcagcgcaaaagatg

SEQ ID NO: 91558 - DNA, 103 bp, Artificial Sequence
  Synthetic Polynucleotide
taatacgactcactatagggagaccccatagctgttggtcttgtccctggaacagaggagaccagggatgagaccaacaaacctggcggcagcgcaaaagatg

SEQ ID NO: 91559 - DNA, 103 bp, Artificial Sequence
  Synthetic Polynucleotide
taatacgactcactatagggtgccctttgatctacatagacaaattttccaacagaggagaggaaaaatggtctatgtaaacctggcggcagcgcaaaagatg

SEQ ID NO: 91560 - DNA, 103 bp, Artificial Sequence
  Synthetic Polynucleotide
taatacgactcactatagggaaatcgctgttgccctttgatctacatagaaacagaggagatctatgatgatcaaagggaacctggcggcagcgcaaaagatg

SEQ ID NO: 91561 - DNA, 103 bp, Artificial Sequence
  Synthetic Polynucleotide
taatacgactcactatagggagatatcctaaaatcgctgttgccctttgaaacagaggagatcaaagatgaacagcgataacctggcggcagcgcaaaagatg

SEQ ID NO: 91562 - DNA, 103 bp, Artificial Sequence
  Synthetic Polynucleotide
taatacgactcactatagggttcctgaggcagatatcctaaaatcgctgtaacagaggagaacagcgatgttaggatataacctggcggcagcgcaaaagatg

SEQ ID NO: 91563 - DNA, 103 bp, Artificial Sequence
  Synthetic Polynucleotide
taatacgactcactatagggttcccaaaagttcctgaggcagatatcctaaacagaggagataggatatgtgcctcaggaacctggcggcagcgcaaaagatg

SEQ ID NO: 91564 - DNA, 103 bp, Artificial Sequence
  Synthetic Polynucleotide
taatacgactcactatagggtaacaagaagttcccaaaagttcctgaggcaacagaggagagcctcaatgacttttgggaacctggcggcagcgcaaaagatg

SEQ ID NO: 91565 - DNA, 103 bp, Artificial Sequence
  Synthetic Polynucleotide
taatacgactcactatagggaaaatattcataacaagaagttcccaaaagaacagaggagacttttgatgacttcttgtaacctggcggcagcgcaaaagatg

SEQ ID NO: 91566 - DNA, 103 bp, Artificial Sequence
  Synthetic Polynucleotide
taatacgactcactatagggcatcttgatgaaaatattcataacaagaagaacagaggagacttcttatgatgaatattaacctggcggcagcgcaaaagatg

SEQ ID NO: 91567 - DNA, 103 bp, Artificial Sequence
  Synthetic Polynucleotide
taatacgactcactatagggttattgtggtcatcttgatgaaaatattcaaacagaggagatgaataatgtcatcaagaaacctggcggcagcgcaaaagatg

SEQ ID NO: 91568 - DNA, 103 bp, Artificial Sequence
  Synthetic Polynucleotide
taatacgactcactataggggtcagtcaaattattgtggtcatcttgatgaacagaggagacatcaaatggaccacaataacctggcggcagcgcaaaagatg

SEQ ID NO: 91569 - DNA, 103 bp, Artificial Sequence
  Synthetic Polynucleotide
taatacgactcactataggggtgagctgaaagaccccatagctgttggtcaacagaggagagaccaaatgctatggggtaacctggcggcagcgcaaaagatg

SEQ ID NO: 91570 - DNA, 103 bp, Artificial Sequence
  Synthetic Polynucleotide
taatacgactcactatagggctttgtgcttgtcagtcaaattattgtggtaacagaggagaaccacaatgatttgactgaacctggcggcagcgcaaaagatg

SEQ ID NO: 91571 - DNA, 103 bp, Artificial Sequence
  Synthetic Polynucleotide
taatacgactcactatagggtgtagaactgctttgtgcttgtcagtcaaaaacagaggagatttgacatgcaagcacaaaacctggcggcagcgcaaaagatg

SEQ ID NO: 91572 - DNA, 103 bp, Artificial Sequence
  Synthetic Polynucleotide
taatacgactcactatagggctccttactctgtagaactgctttgtgcttaacagaggagaaagcacatggcagttctaaacctggcggcagcgcaaaagatg

SEQ ID NO: 91573 - DNA, 103 bp, Artificial Sequence
  Synthetic Polynucleotide
taatacgactcactatagggtaagtattttctccttactctgtagaactgaacagaggagacagttcatgagagtaaggaacctggcggcagcgcaaaagatg

SEQ ID NO: 91574 - DNA, 103 bp, Artificial Sequence
  Synthetic Polynucleotide
taatacgactcactatagggtaggaatctgtaagtattttctccttactcaacagaggagagagtaaatggaaaatactaacctggcggcagcgcaaaagatg

SEQ ID NO: 91575 - DNA, 103 bp, Artificial Sequence
  Synthetic Polynucleotide
taatacgactcactatagggtctgaatttgtaggaatctgtaagtattttaacagaggagaaaaataatgacagattccaacctggcggcagcgcaaaagatg

SEQ ID NO: 91576 - DNA, 103 bp, Artificial Sequence
  Synthetic Polynucleotide
taatacgactcactatagggcatcttttgctctgaatttgtaggaatctgaacagaggagacagattatgacaaattcaaacctggcggcagcgcaaaagatg

SEQ ID NO: 91577 - DNA, 103 bp, Artificial Sequence
  Synthetic Polynucleotide
taatacgactcactatagggacaaaagagccatcttttgctctgaatttgaacagaggagacaaattatgagcaaaagaaacctggcggcagcgcaaaagatg

SEQ ID NO: 91578 - DNA, 103 bp, Artificial Sequence
  Synthetic Polynucleotide
taatacgactcactatagggttttaaagttacaaaagagccatcttttgcaacagaggagagcaaaaatgggctcttttaacctggcggcagcgcaaaagatg

SEQ ID NO: 91579 - DNA, 103 bp, Artificial Sequence
  Synthetic Polynucleotide
taatacgactcactatagggaccattggctttttaaagttacaaaagagcaacagaggagagctcttatgtaactttaaaacctggcggcagcgcaaaagatg

SEQ ID NO: 91580 - DNA, 103 bp, Artificial Sequence
  Synthetic Polynucleotide
taatacgactcactatagggtctgtcatgtgtgagctgaaagaccccataaacagaggagatatgggatgtttcagctcaacctggcggcagcgcaaaagatg

SEQ ID NO: 91581 - DNA, 103 bp, Artificial Sequence
  Synthetic Polynucleotide
taatacgactcactataggggtgaaactaaaccattggctttttaaagttaacagaggagaaactttatgaagccaatgaacctggcggcagcgcaaaagatg

SEQ ID NO: 91582 - DNA, 103 bp, Artificial Sequence
  Synthetic Polynucleotide
taatacgactcactatagggccaaggatttgtgaaactaaaccattggctaacagaggagaagccaaatgtttagtttcaacctggcggcagcgcaaaagatg

SEQ ID NO: 91583 - DNA, 103 bp, Artificial Sequence
  Synthetic Polynucleotide
taatacgactcactataggggttcttttgtccaaggatttgtgaaactaaaacagaggagattagttatgcaaatccttaacctggcggcagcgcaaaagatg

SEQ ID NO: 91584 - DNA, 103 bp, Artificial Sequence
  Synthetic Polynucleotide
taatacgactcactatagggatatattccagttcttttgtccaaggatttaacagaggagaaaatccatggacaaaagaaacctggcggcagcgcaaaagatg

SEQ ID NO: 91585 - DNA, 103 bp, Artificial Sequence
  Synthetic Polynucleotide
taatacgactcactataggggacagatacaatatattccagttcttttgtaacagaggagaacaaaaatgctggaatataacctggcggcagcgcaaaagatg

SEQ ID NO: 91586 - DNA, 103 bp, Artificial Sequence
  Synthetic Polynucleotide
taatacgactcactatagggctaaagtgttgacagatacaatatattccaaacagaggagatggaatatgttgtatctgaacctggcggcagcgcaaaagatg

SEQ ID NO: 91587 - DNA, 103 bp, Artificial Sequence
  Synthetic Polynucleotide
taatacgactcactatagggtgtcccaaaactaaagtgttgacagatacaaacagaggagatgtatcatgcaacactttaacctggcggcagcgcaaaagatg

SEQ ID NO: 91588 - DNA, 103 bp, Artificial Sequence
  Synthetic Polynucleotide
taatacgactcactatagggaggctcactatgtcccaaaactaaagtgttaacagaggagaaacactatggttttgggaaacctggcggcagcgcaaaagatg

SEQ ID NO: 91589 - DNA, 103 bp, Artificial Sequence
  Synthetic Polynucleotide
taatacgactcactatagggatgcttctccaggctcactatgtcccaaaaaacagaggagattttggatgatagtgagcaacctggcggcagcgcaaaagatg

SEQ ID NO: 91590 - DNA, 103 bp, Artificial Sequence
  Synthetic Polynucleotide
taatacgactcactatagggggtaaaaatgatgcttctccaggctcactaaacagaggagatagtgaatgtggagaagcaacctggcggcagcgcaaaagatg

SEQ ID NO: 91591 - DNA, 103 bp, Artificial Sequence
  Synthetic Polynucleotide
taatacgactcactatagggtcgtggaaactctgtcatgtgtgagctgaaaacagaggagattcagcatgcacatgacaaacctggcggcagcgcaaaagatg

SEQ ID NO: 91592 - DNA, 103 bp, Artificial Sequence
  Synthetic Polynucleotide
taatacgactcactatagggagagctacaaggtaaaaatgatgcttctccaacagaggagaggagaaatgtcatttttaaacctggcggcagcgcaaaagatg

SEQ ID NO: 91593 - DNA, 103 bp, Artificial Sequence
  Synthetic Polynucleotide
taatacgactcactatagggctgatgattgagagctacaaggtaaaaatgaacagaggagacattttatgcttgtagctaacctggcggcagcgcaaaagatg

SEQ ID NO: 91594 - DNA, 103 bp, Artificial Sequence
  Synthetic Polynucleotide
taatacgactcactataggggaggattcttctgatgattgagagctacaaaacagaggagattgtagatgtcaatcatcaacctggcggcagcgcaaaagatg

SEQ ID NO: 91595 - DNA, 103 bp, Artificial Sequence
  Synthetic Polynucleotide
taatacgactcactatagggggactgtctagaggattcttctgatgattgaacagaggagacaatcaatggaagaatccaacctggcggcagcgcaaaagatg

SEQ ID NO: 91596 - DNA, 103 bp, Artificial Sequence
  Synthetic Polynucleotide
taatacgactcactatagggcactcatacaggactgtctagaggattcttaacagaggagaaagaatatgctagacagtaacctggcggcagcgcaaaagatg

SEQ ID NO: 91597 - DNA, 103 bp, Artificial Sequence
  Synthetic Polynucleotide
taatacgactcactatagggattccaggtacactcatacaggactgtctaaacagaggagatagacaatgctgtatgagaacctggcggcagcgcaaaagatg

SEQ ID NO: 91598 - DNA, 103 bp, Artificial Sequence
  Synthetic Polynucleotide
taatacgactcactatagggtccagtagacattccaggtacactcatacaaacagaggagatgtatgatggtacctggaaacctggcggcagcgcaaaagatg

SEQ ID NO: 91599 - DNA, 103 bp, Artificial Sequence
  Synthetic Polynucleotide
taatacgactcactatagggcaagtactgttccagtagacattccaggtaaacagaggagatacctgatgtgtctactgaacctggcggcagcgcaaaagatg

SEQ ID NO: 91600 - DNA, 103 bp, Artificial Sequence
  Synthetic Polynucleotide
taatacgactcactatagggctaccagcaccaagtactgttccagtagacaacagaggagagtctacatgaacagtactaacctggcggcagcgcaaaagatg

SEQ ID NO: 91601 - DNA, 103 bp, Artificial Sequence
  Synthetic Polynucleotide
taatacgactcactatagggtgttccaatactaccagcaccaagtactgtaacagaggagaacagtaatgggtgctggtaacctggcggcagcgcaaaagatg

SEQ ID NO: 91602 - DNA, 103 bp, Artificial Sequence
  Synthetic Polynucleotide
taatacgactcactatagggctttgcgttttcgtggaaactctgtcatgtaacagaggagaacatgaatgagtttccacaacctggcggcagcgcaaaagatg

SEQ ID NO: 91603 - DNA, 103 bp, Artificial Sequence
  Synthetic Polynucleotide
taatacgactcactatagggttgcaatatctgttccaatactaccagcacaacagaggagagtgctgatggtattggaaaacctggcggcagcgcaaaagatg

SEQ ID NO: 91604 - DNA, 103 bp, Artificial Sequence
  Synthetic Polynucleotide
taatacgactcactatagggagaatttcatttgcaatatctgttccaataaacagaggagatattggatgagatattgcaacctggcggcagcgcaaaagatg

SEQ ID NO: 91605 - DNA, 103 bp, Artificial Sequence
  Synthetic Polynucleotide
taatacgactcactatagggctgtaaatccagaatttcatttgcaatatcaacagaggagagatattatgaatgaaattaacctggcggcagcgcaaaagatg

SEQ ID NO: 91606 - DNA, 103 bp, Artificial Sequence
  Synthetic Polynucleotide
taatacgactcactatagggactgtaacctctgtaaatccagaatttcataacagaggagaatgaaaatgtggatttacaacctggcggcagcgcaaaagatg

SEQ ID NO: 91607 - DNA, 103 bp, Artificial Sequence
  Synthetic Polynucleotide
taatacgactcactatagggtatgaagaagactgtaacctctgtaaatccaacagaggagaggatttatggaggttacaaacctggcggcagcgcaaaagatg

SEQ ID NO: 91608 - DNA, 103 bp, Artificial Sequence
  Synthetic Polynucleotide
taatacgactcactatagggatcatcaaggtatgaagaagactgtaacctaacagaggagaaggttaatgtcttcttcaaacctggcggcagcgcaaaagatg

SEQ ID NO: 91609 - DNA, 103 bp, Artificial Sequence
  Synthetic Polynucleotide
taatacgactcactatagggttggactcgaatcatcaaggtatgaagaagaacagaggagacttcttatgaccttgatgaacctggcggcagcgcaaaagatg

SEQ ID NO: 91610 - DNA, 103 bp, Artificial Sequence
  Synthetic Polynucleotide
taatacgactcactatagggattaaacctgttggactcgaatcatcaaggaacagaggagaccttgaatgttcgagtccaacctggcggcagcgcaaaagatg

SEQ ID NO: 91611 - DNA, 103 bp, Artificial Sequence
  Synthetic Polynucleotide
taatacgactcactatagggagtatctttcattaaacctgttggactcgaaacagaggagatcgagtatgacaggtttaaacctggcggcagcgcaaaagatg

SEQ ID NO: 91612 - DNA, 103 bp, Artificial Sequence
  Synthetic Polynucleotide
taatacgactcactatagggttacagtatgagtatctttcattaaacctgaacagaggagacaggttatgtgaaagataaacctggcggcagcgcaaaagatg

SEQ ID NO: 91613 - DNA, 103 bp, Artificial Sequence
  Synthetic Polynucleotide
taatacgactcactataggggaatcacttcctttgcgttttcgtggaaacaacagaggagagtttccatgaaaacgcaaaacctggcggcagcgcaaaagatg

SEQ ID NO: 91614 - DNA, 103 bp, Artificial Sequence
  Synthetic Polynucleotide
taatacgactcactatagggctcctgcagtttacagtatgagtatctttcaacagaggagagaaagaatgtcatactgtaacctggcggcagcgcaaaagatg

SEQ ID NO: 91615 - DNA, 103 bp, Artificial Sequence
  Synthetic Polynucleotide
taatacgactcactatagggatttgacatactcctgcagtttacagtatgaacagaggagacatactatgaactgcaggaacctggcggcagcgcaaaagatg

SEQ ID NO: 91616 - DNA, 103 bp, Artificial Sequence
  Synthetic Polynucleotide
taatacgactcactatagggacaactccttatttgacatactcctgcagtaacagaggagaactgcaatggtatgtcaaaacctggcggcagcgcaaaagatg

SEQ ID NO: 91617 - DNA, 103 bp, Artificial Sequence
  Synthetic Polynucleotide
taatacgactcactatagggcttggtggaaacaactccttatttgacataaacagaggagatatgtcatgtaaggagttaacctggcggcagcgcaaaagatg

SEQ ID NO: 91618 - DNA, 103 bp, Artificial Sequence
  Synthetic Polynucleotide
taatacgactcactatagggttcagaaggacttggtggaaacaactccttaacagaggagaaaggagatgtttccaccaaacctggcggcagcgcaaaagatg

SEQ ID NO: 91619 - DNA, 103 bp, Artificial Sequence
  Synthetic Polynucleotide
taatacgactcactataggggctcccccatttcagaaggacttggtggaaaacagaggagattccacatggtccttctgaacctggcggcagcgcaaaagatg

SEQ ID NO: 91620 - DNA, 103 bp, Artificial Sequence
  Synthetic Polynucleotide
taatacgactcactataggggtagcctctagctcccccatttcagaaggaaacagaggagatccttcatgaatgggggaaacctggcggcagcgcaaaagatg

SEQ ID NO: 91621 - DNA, 103 bp, Artificial Sequence
  Synthetic Polynucleotide
taatacgactcactataggggttttgcctggtagcctctagctcccccataacagaggagaatggggatgctagaggctaacctggcggcagcgcaaaagatg

SEQ ID NO: 91622 - DNA, 103 bp, Artificial Sequence
  Synthetic Polynucleotide
taatacgactcactatagggcagtactctggttttgcctggtagcctctaaacagaggagatagaggatgccaggcaaaaacctggcggcagcgcaaaagatg

SEQ ID NO: 91623 - DNA, 103 bp, Artificial Sequence
  Synthetic Polynucleotide
taatacgactcactatagggtggacagcaacagtactctggttttgcctgaacagaggagacaggcaatgccagagtacaacctggcggcagcgcaaaagatg

SEQ ID NO: 91624 - DNA, 103 bp, Artificial Sequence
  Synthetic Polynucleotide
taatacgactcactatagggggatgggtctgaatcacttcctttgcgtttaacagaggagaaaacgcatgggaagtgataacctggcggcagcgcaaaagatg

SEQ ID NO: 91625 - DNA, 103 bp, Artificial Sequence
  Synthetic Polynucleotide
taatacgactcactatagggctcatggctgtggacagcaacagtactctgaacagaggagacagagtatggttgctgtcaacctggcggcagcgcaaaagatg

SEQ ID NO: 91626 - DNA, 103 bp, Artificial Sequence
  Synthetic Polynucleotide
taatacgactcactatagggtgaggagtggctcatggctgtggacagcaaaacagaggagattgctgatgacagccatgaacctggcggcagcgcaaaagatg

SEQ ID NO: 91627 - DNA, 103 bp, Artificial Sequence
  Synthetic Polynucleotide
taatacgactcactataggggcaccatcactgaggagtggctcatggctgaacagaggagacagccaatggccactcctaacctggcggcagcgcaaaagatg

SEQ ID NO: 91628 - DNA, 103 bp, Artificial Sequence
  Synthetic Polynucleotide
taatacgactcactatagggatccaactgtgcaccatcactgaggagtggaacagaggagaccactcatgagtgatggtaacctggcggcagcgcaaaagatg

SEQ ID NO: 91629 - DNA, 103 bp, Artificial Sequence
  Synthetic Polynucleotide
taatacgactcactataggggggcatcgaaatccaactgtgcaccatcacaacagaggagagtgatgatgcacagttggaacctggcggcagcgcaaaagatg

SEQ ID NO: 91630 - DNA, 103 bp, Artificial Sequence
  Synthetic Polynucleotide
taatacgactcactatagggttgtcacatagggcatcgaaatccaactgtaacagaggagaacagttatgtttcgatgcaacctggcggcagcgcaaaagatg

SEQ ID NO: 91631 - DNA, 103 bp, Artificial Sequence
  Synthetic Polynucleotide
taatacgactcactatagggtgtgtcatcattgtcacatagggcatcgaaaacagaggagattcgatatgctatgtgacaacctggcggcagcgcaaaagatg

SEQ ID NO: 91632 - DNA, 103 bp, Artificial Sequence
  Synthetic Polynucleotide
taatacgactcactatagggcagccatggctgtgtcatcattgtcacataaacagaggagatatgtgatgatgatgacaaacctggcggcagcgcaaaagatg

SEQ ID NO: 91633 - DNA, 103 bp, Artificial Sequence
  Synthetic Polynucleotide
taatacgactcactatagggttcataaatgcagccatggctgtgtcatcaaacagaggagatgatgaatgagccatggcaacctggcggcagcgcaaaagatg

SEQ ID NO: 91634 - DNA, 103 bp, Artificial Sequence
  Synthetic Polynucleotide
taatacgactcactatagggttctaagtaattcataaatgcagccatggcaacagaggagagccatgatggcatttatgaacctggcggcagcgcaaaagatg

SEQ ID NO: 91635 - DNA, 103 bp, Artificial Sequence
  Synthetic Polynucleotide
taatacgactcactataggggagcttcttgggatgggtctgaatcacttcaacagaggagagaagtgatgcagacccataacctggcggcagcgcaaaagatg

SEQ ID NO: 91636 - DNA, 103 bp, Artificial Sequence
  Synthetic Polynucleotide
taatacgactcactatagggccccctctgcttctaagtaattcataaatgaacagaggagacatttaatgattacttagaacctggcggcagcgcaaaagatg

SEQ ID NO: 91637 - DNA, 103 bp, Artificial Sequence
  Synthetic Polynucleotide
taatacgactcactatagggtctcccaggcccccctctgcttctaagtaaaacagaggagattacttatgagcagagggaacctggcggcagcgcaaaagatg

SEQ ID NO: 91638 - DNA, 103 bp, Artificial Sequence
  Synthetic Polynucleotide
taatacgactcactataggggtccccagggtctcccaggcccccctctgcaacagaggagagcagagatgggcctgggaaacctggcggcagcgcaaaagatg

SEQ ID NO: 91639 - DNA, 103 bp, Artificial Sequence
  Synthetic Polynucleotide
taatacgactcactatagggtgtcactgaagtccccagggtctcccaggcaacagaggagagcctggatgaccctggggaacctggcggcagcgcaaaagatg

SEQ ID NO: 91640 - DNA, 103 bp, Artificial Sequence
  Synthetic Polynucleotide
taatacgactcactataggggtccactggatgtcactgaagtccccagggaacagaggagaccctggatgcttcagtgaaacctggcggcagcgcaaaagatg

SEQ ID NO: 91641 - DNA, 103 bp, Artificial Sequence
  Synthetic Polynucleotide
taatacgactcactataggggtttggctatgagcttcttgggatgggtctaacagaggagaagacccatgccaagaagcaacctggcggcagcgcaaaagatg

SEQ ID NO: 91642 - DNA, 103 bp, Artificial Sequence
  Synthetic Polynucleotide
taatacgactcactatagggccgcttttcagtttggctatgagcttcttgaacagaggagacaagaaatgcatagccaaaacctggcggcagcgcaaaagatg

SEQ ID NO: 91643 - DNA, 103 bp, Artificial Sequence
  Synthetic Polynucleotide
taatacgactcactatagggacactttacctcccgccgcagcctcctcttaacagaggagaaagaggatgctgcggcggaacctggcggcagcgcaaaagatg

SEQ ID NO: 91644 - DNA, 103 bp, Artificial Sequence
  Synthetic Polynucleotide
taatacgactcactatagggtatctctcctccgcttttcagtttggctataacagaggagaatagccatgctgaaaagcaacctggcggcagcgcaaaagatg

SEQ ID NO: 91645 - DNA, 103 bp, Artificial Sequence
  Synthetic Polynucleotide
taatacgactcactatagggttattcattttatctctcctccgcttttcaaacagaggagatgaaaaatggaggagagaaacctggcggcagcgcaaaagatg

SEQ ID NO: 91646 - DNA, 103 bp, Artificial Sequence
  Synthetic Polynucleotide
taatacgactcactatagggttcaatcaggttattcattttatctctcctaacagaggagaaggagaatgaaaatgaataacctggcggcagcgcaaaagatg

SEQ ID NO: 91647 - DNA, 103 bp, Artificial Sequence
  Synthetic Polynucleotide
taatacgactcactatagggcagacagttcttcaatcaggttattcatttaacagaggagaaaatgaatgacctgattgaacctggcggcagcgcaaaagatg

SEQ ID NO: 91648 - DNA, 103 bp, Artificial Sequence
  Synthetic Polynucleotide
taatacgactcactataggggggatcattgcagacagttcttcaatcaggaacagaggagacctgatatgagaactgtcaacctggcggcagcgcaaaagatg

SEQ ID NO: 91649 - DNA, 103 bp, Artificial Sequence
  Synthetic Polynucleotide
taatacgactcactataggggttgcactgagggatcattgcagacagttcaacagaggagagaactgatggcaatgatcaacctggcggcagcgcaaaagatg

SEQ ID NO: 91650 - DNA, 103 bp, Artificial Sequence
  Synthetic Polynucleotide
taatacgactcactataggggcgccatggggttgcactgagggatcattgaacagaggagacaatgaatgctcagtgcaaacctggcggcagcgcaaaagatg

SEQ ID NO: 91651 - DNA, 103 bp, Artificial Sequence
  Synthetic Polynucleotide
taatacgactcactatagggtccagtttacgcgccatggggttgcactgaaacagaggagatcagtgatgccccatggcaacctggcggcagcgcaaaagatg

SEQ ID NO: 91652 - DNA, 103 bp, Artificial Sequence
  Synthetic Polynucleotide
taatacgactcactatagggtgtaagtttgtccagtttacgcgccatgggaacagaggagacccatgatgcgtaaactgaacctggcggcagcgcaaaagatg

SEQ ID NO: 91653 - DNA, 103 bp, Artificial Sequence
  Synthetic Polynucleotide
taatacgactcactatagggttcttaaaactgtaagtttgtccagtttacaacagaggagagtaaacatgacaaacttaaacctggcggcagcgcaaaagatg

SEQ ID NO: 91654 - DNA, 103 bp, Artificial Sequence
  Synthetic Polynucleotide
taatacgactcactatagggtcctctctcaacactttacctcccgccgcaaacagaggagatgcggcatgaggtaaagtaacctggcggcagcgcaaaagatg

SEQ ID NO: 91655 - DNA, 103 bp, Artificial Sequence
  Synthetic Polynucleotide
taatacgactcactatagggtgaacagccattcttaaaactgtaagtttgaacagaggagacaaactatgagttttaagaacctggcggcagcgcaaaagatg

SEQ ID NO: 91656 - DNA, 103 bp, Artificial Sequence
  Synthetic Polynucleotide
taatacgactcactatagggtctcaagtgttgaacagccattcttaaaacaacagaggagagttttaatgatggctgttaacctggcggcagcgcaaaagatg

SEQ ID NO: 91657 - DNA, 103 bp, Artificial Sequence
  Synthetic Polynucleotide
taatacgactcactatagggcttttaaagatctcaagtgttgaacagccaaacagaggagatggctgatgaacacttgaaacctggcggcagcgcaaaagatg

SEQ ID NO: 91658 - DNA, 103 bp, Artificial Sequence
  Synthetic Polynucleotide
taatacgactcactatagggtttgtcaagccttttaaagatctcaagtgtaacagaggagaacacttatgatctttaaaaacctggcggcagcgcaaaagatg

SEQ ID NO: 91659 - DNA, 103 bp, Artificial Sequence
  Synthetic Polynucleotide
taatacgactcactatagggcacataagaatttgtcaagccttttaaagaaacagaggagatctttaatgggcttgacaaacctggcggcagcgcaaaagatg

SEQ ID NO: 91660 - DNA, 103 bp, Artificial Sequence
  Synthetic Polynucleotide
taatacgactcactatagggaattacttcccacataagaatttgtcaagcaacagaggagagcttgaatgattcttatgaacctggcggcagcgcaaaagatg

SEQ ID NO: 91661 - DNA, 103 bp, Artificial Sequence
  Synthetic Polynucleotide
taatacgactcactataggggatggtctataattacttcccacataagaaaacagaggagattcttaatggggaagtaaaacctggcggcagcgcaaaagatg

SEQ ID NO: 91662 - DNA, 103 bp, Artificial Sequence
  Synthetic Polynucleotide
taatacgactcactatagggctgaagaaatgatggtctataattacttccaacagaggagaggaagtatgtatagaccaaacctggcggcagcgcaaaagatg

SEQ ID NO: 91663 - DNA, 103 bp, Artificial Sequence
  Synthetic Polynucleotide
taatacgactcactataggggctcattatcctgaagaaatgatggtctataacagaggagaatagacatgcatttcttcaacctggcggcagcgcaaaagatg

SEQ ID NO: 91664 - DNA, 103 bp, Artificial Sequence
  Synthetic Polynucleotide
taatacgactcactatagggaaatgtctgagctcattatcctgaagaaataacagaggagaatttctatgggataatgaaacctggcggcagcgcaaaagatg

SEQ ID NO: 91665 - DNA, 103 bp, Artificial Sequence
  Synthetic Polynucleotide
taatacgactcactataggggcactggttctcctctctcaacactttaccaacagaggagaggtaaaatgttgagagagaacctggcggcagcgcaaaagatg

SEQ ID NO: 91666 - DNA, 103 bp, Artificial Sequence
  Synthetic Polynucleotide
taatacgactcactatagggcttaaggattaaatgtctgagctcattatcaacagaggagagataatatgctcagacataacctggcggcagcgcaaaagatg

SEQ ID NO: 91667 - DNA, 103 bp, Artificial Sequence
  Synthetic Polynucleotide
taatacgactcactatagggcttctgcagtcttaaggattaaatgtctgaaacagaggagatcagacatgtaatccttaaacctggcggcagcgcaaaagatg

SEQ ID NO: 91668 - DNA, 103 bp, Artificial Sequence
  Synthetic Polynucleotide
taatacgactcactatagggaataagaagccttctgcagtcttaaggattaacagaggagaaatcctatggactgcagaaacctggcggcagcgcaaaagatg

SEQ ID NO: 91669 - DNA, 103 bp, Artificial Sequence
  Synthetic Polynucleotide
taatacgactcactatagggtccaaccacaaataagaagccttctgcagtaacagaggagaactgcaatgggcttcttaaacctggcggcagcgcaaaagatg

SEQ ID NO: 91670 - DNA, 103 bp, Artificial Sequence
  Synthetic Polynucleotide
taatacgactcactatagggctctttcacatccaaccacaaataagaagcaacagaggagagcttctatgttgtggttgaacctggcggcagcgcaaaagatg

SEQ ID NO: 91671 - DNA, 103 bp, Artificial Sequence
  Synthetic Polynucleotide
taatacgactcactatagggagaatttttcctctttcacatccaaccacaaacagaggagatgtggtatgatgtgaaagaacctggcggcagcgcaaaagatg

SEQ ID NO: 91672 - DNA, 103 bp, Artificial Sequence
  Synthetic Polynucleotide
taatacgactcactatagggagaaacgaagagaatttttcctctttcacaaacagaggagatgtgaaatgggaaaaattaacctggcggcagcgcaaaagatg

SEQ ID NO: 91673 - DNA, 103 bp, Artificial Sequence
  Synthetic Polynucleotide
taatacgactcactatagggagactgacttagaaacgaagagaatttttcaacagaggagagaaaaaatgtcttcgtttaacctggcggcagcgcaaaagatg

SEQ ID NO: 91674 - DNA, 103 bp, Artificial Sequence
  Synthetic Polynucleotide
taatacgactcactatagggagtattttggagactgacttagaaacgaagaacagaggagacttcgtatgtaagtcagtaacctggcggcagcgcaaaagatg

SEQ ID NO: 91675 - DNA, 103 bp, Artificial Sequence
  Synthetic Polynucleotide
taatacgactcactatagggatcataattaagtattttggagactgacttaacagaggagaaagtcaatgtccaaaataaacctggcggcagcgcaaaagatg

SEQ ID NO: 91676 - DNA, 103 bp, Artificial Sequence
  Synthetic Polynucleotide
taatacgactcactatagggcaggagcaatgcactggttctcctctctcaaacagaggagatgagagatgagaaccagtaacctggcggcagcgcaaaagatg

SEQ ID NO: 91677 - DNA, 103 bp, Artificial Sequence
  Synthetic Polynucleotide
taatacgactcactatagggaactagcctgatcataattaagtattttggaacagaggagaccaaaaatgttaattatgaacctggcggcagcgcaaaagatg

SEQ ID NO: 91678 - DNA, 103 bp, Artificial Sequence
  Synthetic Polynucleotide
taatacgactcactatagggtgtccagtcaaactagcctgatcataattaaacagaggagataattaatgtcaggctagaacctggcggcagcgcaaaagatg

SEQ ID NO: 91679 - DNA, 103 bp, Artificial Sequence
  Synthetic Polynucleotide
taatacgactcactatagggaaataagctttgtccagtcaaactagcctgaacagaggagacaggctatgttgactggaaacctggcggcagcgcaaaagatg

SEQ ID NO: 91680 - DNA, 103 bp, Artificial Sequence
  Synthetic Polynucleotide
taatacgactcactataggggtaagaagtcaaataagctttgtccagtcaaacagaggagatgactgatgaaagcttataacctggcggcagcgcaaaagatg

SEQ ID NO: 91681 - DNA, 103 bp, Artificial Sequence
  Synthetic Polynucleotide
taatacgactcactatagggtcttttggatgtaagaagtcaaataagcttaacagaggagaaagcttatgtgacttcttaacctggcggcagcgcaaaagatg

SEQ ID NO: 91682 - DNA, 103 bp, Artificial Sequence
  Synthetic Polynucleotide
taatacgactcactatagggtttggcaacatcttttggatgtaagaagtcaacagaggagagacttcatgcatccaaaaaacctggcggcagcgcaaaagatg

SEQ ID NO: 91683 - DNA, 103 bp, Artificial Sequence
  Synthetic Polynucleotide
taatacgactcactataggggttcctttactttggcaacatcttttggataacagaggagaatccaaatgatgttgccaaacctggcggcagcgcaaaagatg

SEQ ID NO: 91684 - DNA, 103 bp, Artificial Sequence
  Synthetic Polynucleotide
taatacgactcactataggggaagaaagttgttcctttactttggcaacaaacagaggagatgttgcatgagtaaaggaaacctggcggcagcgcaaaagatg

SEQ ID NO: 91685 - DNA, 103 bp, Artificial Sequence
  Synthetic Polynucleotide
taatacgactcactatagggaatatcaaaagaagaaagttgttcctttacaacagaggagagtaaagatgcaactttctaacctggcggcagcgcaaaagatg

SEQ ID NO: 91686 - DNA, 103 bp, Artificial Sequence
  Synthetic Polynucleotide
taatacgactcactatagggctcttggtgaaatatcaaaagaagaaagttaacagaggagaaactttatgcttttgataaacctggcggcagcgcaaaagatg

SEQ ID NO: 91687 - DNA, 103 bp, Artificial Sequence
  Synthetic Polynucleotide
taatacgactcactatagggctggaaaccacaggagcaatgcactggttcaacagaggagagaaccaatgcattgctccaacctggcggcagcgcaaaagatg

SEQ ID NO: 91688 - DNA, 103 bp, Artificial Sequence
  Synthetic Polynucleotide
taatacgactcactatagggattagcttttctcttggtgaaatatcaaaaaacagaggagattttgaatgttcaccaagaacctggcggcagcgcaaaagatg

SEQ ID NO: 91689 - DNA, 103 bp, Artificial Sequence
  Synthetic Polynucleotide
taatacgactcactatagggtttggcatctattagcttttctcttggtgaaacagaggagatcaccaatggaaaagctaaacctggcggcagcgcaaaagatg

SEQ ID NO: 91690 - DNA, 103 bp, Artificial Sequence
  Synthetic Polynucleotide
taatacgactcactataggggcaaaccagttttggcatctattagcttttaacagaggagaaaaagcatgtagatgccaaacctggcggcagcgcaaaagatg

SEQ ID NO: 91691 - DNA, 103 bp, Artificial Sequence
  Synthetic Polynucleotide
taatacgactcactatagggctgtgaacttgcaaaccagttttggcatctaacagaggagaagatgcatgaactggtttaacctggcggcagcgcaaaagatg

SEQ ID NO: 91692 - DNA, 103 bp, Artificial Sequence
  Synthetic Polynucleotide
taatacgactcactataggggtggagattactgtgaacttgcaaaccagtaacagaggagaactggtatgcaagttcacaacctggcggcagcgcaaaagatg

SEQ ID NO: 91693 - DNA, 103 bp, Artificial Sequence
  Synthetic Polynucleotide
taatacgactcactatagggtccttccagcgtggagattactgtgaacttaacagaggagaaagttcatggtaatctccaacctggcggcagcgcaaaagatg

SEQ ID NO: 91694 - DNA, 103 bp, Artificial Sequence
  Synthetic Polynucleotide
taatacgactcactatagggtacacacgtgtccttccagcgtggagattaaacagaggagataatctatgcgctggaagaacctggcggcagcgcaaaagatg

SEQ ID NO: 91695 - DNA, 103 bp, Artificial Sequence
  Synthetic Polynucleotide
taatacgactcactatagggtgagccagaatacacacgtgtccttccagcaacagaggagagctggaatgacacgtgtgaacctggcggcagcgcaaaagatg

SEQ ID NO: 91696 - DNA, 103 bp, Artificial Sequence
  Synthetic Polynucleotide
taatacgactcactatagggaagatcgtcttgagccagaatacacacgtgaacagaggagacacgtgatgattctggctaacctggcggcagcgcaaaagatg

SEQ ID NO: 91697 - DNA, 103 bp, Artificial Sequence
  Synthetic Polynucleotide
taatacgactcactatagggcgacagaaaaaagatcgtcttgagccagaaaacagaggagattctggatgaagacgatcaacctggcggcagcgcaaaagatg

SEQ ID NO: 91698 - DNA, 103 bp, Artificial Sequence
  Synthetic Polynucleotide
taatacgactcactatagggactcacgcggctggaaaccacaggagcaataacagaggagaattgctatggtggtttccaacctggcggcagcgcaaaagatg

SEQ ID NO: 91699 - DNA, 103 bp, Artificial Sequence
  Synthetic Polynucleotide
taatacgactcactatagggactctttatccgacagaaaaaagatcgtctaacagaggagaagacgaatgtttttctgtaacctggcggcagcgcaaaagatg

SEQ ID NO: 91700 - DNA, 103 bp, Artificial Sequence
  Synthetic Polynucleotide
taatacgactcactatagggagattttacaactctttatccgacagaaaaaacagaggagattttctatgggataaagaaacctggcggcagcgcaaaagatg

SEQ ID NO: 91701 - DNA, 103 bp, Artificial Sequence
  Synthetic Polynucleotide
taatacgactcactatagggtctttgacagagattttacaactctttatcaacagaggagagataaaatgttgtaaaataacctggcggcagcgcaaaagatg

SEQ ID NO: 91702 - DNA, 103 bp, Artificial Sequence
  Synthetic Polynucleotide
taatacgactcactatagggtccatgctcttctttgacagagattttacaaacagaggagatgtaaaatgtctgtcaaaaacctggcggcagcgcaaaagatg

SEQ ID NO: 91703 - DNA, 103 bp, Artificial Sequence
  Synthetic Polynucleotide
taatacgactcactatagggtgggtaagcatccatgctcttctttgacagaacagaggagactgtcaatgaagagcatgaacctggcggcagcgcaaaagatg

SEQ ID NO: 91704 - DNA, 103 bp, Artificial Sequence
  Synthetic Polynucleotide
taatacgactcactatagggttctttgagttgggtaagcatccatgctctaacagaggagaagagcaatgatgcttaccaacctggcggcagcgcaaaagatg

SEQ ID NO: 91705 - DNA, 103 bp, Artificial Sequence
  Synthetic Polynucleotide
taatacgactcactataggggtgctctttcttctttgagttgggtaagcaaacagaggagatgcttaatgaactcaaagaacctggcggcagcgcaaaagatg

SEQ ID NO: 91706 - DNA, 103 bp, Artificial Sequence
  Synthetic Polynucleotide
taatacgactcactatagggagaattttctgtgctctttcttctttgagtaacagaggagaactcaaatgagaaagagcaacctggcggcagcgcaaaagatg

SEQ ID NO: 91707 - DNA, 103 bp, Artificial Sequence
  Synthetic Polynucleotide
taatacgactcactatagggtggatagtatagaattttctgtgctctttcaacagaggagagaaagaatgcagaaaattaacctggcggcagcgcaaaagatg

SEQ ID NO: 91708 - DNA, 103 bp, Artificial Sequence
  Synthetic Polynucleotide
taatacgactcactatagggaccagtgcaatggatagtatagaattttctaacagaggagaagaaaaatgtatactatcaacctggcggcagcgcaaaagatg

SEQ ID NO: 91709 - DNA, 103 bp, Artificial Sequence
  Synthetic Polynucleotide
taatacgactcactatagggttgtccctggactcacgcggctggaaaccaaacagaggagatggtttatggccgcgtgaaacctggcggcagcgcaaaagatg

SEQ ID NO: 91710 - DNA, 103 bp, Artificial Sequence
  Synthetic Polynucleotide
taatacgactcactatagggttctcaagtaaccagtgcaatggatagtataacagaggagaatactaatgattgcactgaacctggcggcagcgcaaaagatg

SEQ ID NO: 91711 - DNA, 103 bp, Artificial Sequence
  Synthetic Polynucleotide
taatacgactcactatagggggaggccagcttctcaagtaaccagtgcaaaacagaggagattgcacatgttacttgagaacctggcggcagcgcaaaagatg

SEQ ID NO: 91712 - DNA, 103 bp, Artificial Sequence
  Synthetic Polynucleotide
taatacgactcactatagggaacaatatttggaggccagcttctcaagtaaacagaggagatacttgatgagctggcctaacctggcggcagcgcaaaagatg

SEQ ID NO: 91713 - DNA, 103 bp, Artificial Sequence
  Synthetic Polynucleotide
taatacgactcactatagggcttccattccaacaatatttggaggccagcaacagaggagagctggcatgcaaatattgaacctggcggcagcgcaaaagatg

SEQ ID NO: 91714 - DNA, 103 bp, Artificial Sequence
  Synthetic Polynucleotide
taatacgactcactatagggttcctttcttcttccattccaacaatatttaacagaggagaaaatatatgtggaatggaaacctggcggcagcgcaaaagatg

SEQ ID NO: 91715 - DNA, 103 bp, Artificial Sequence
  Synthetic Polynucleotide
taatacgactcactatagggtttcttactgttcctttcttcttccattccaacagaggagaggaatgatggaagaaaggaacctggcggcagcgcaaaagatg

SEQ ID NO: 91716 - DNA, 103 bp, Artificial Sequence
  Synthetic Polynucleotide
taatacgactcactatagggtactgttgtctttcttactgttcctttcttaacagaggagaaagaaaatgacagtaagaaacctggcggcagcgcaaaagatg

SEQ ID NO: 91717 - DNA, 103 bp, Artificial Sequence
  Synthetic Polynucleotide
taatacgactcactatagggcaggtaaaattactgttgtctttcttactgaacagaggagacagtaaatgagacaacagaacctggcggcagcgcaaaagatg

SEQ ID NO: 91718 - DNA, 103 bp, Artificial Sequence
  Synthetic Polynucleotide
taatacgactcactatagggggccacaaggcaggtaaaattactgttgtcaacagaggagagacaacatgaattttaccaacctggcggcagcgcaaaagatg

SEQ ID NO: 91719 - DNA, 103 bp, Artificial Sequence
  Synthetic Polynucleotide
taatacgactcactatagggatcttccaatggccacaaggcaggtaaaataacagaggagaattttaatggccttgtggaacctggcggcagcgcaaaagatg

SEQ ID NO: 91720 - DNA, 103 bp, Artificial Sequence
  Synthetic Polynucleotide
taatacgactcactataggggctgttggtcttgtccctggactcacgcggaacagaggagaccgcgtatgtccagggacaacctggcggcagcgcaaaagatg

SEQ ID NO: 91721 - DNA, 103 bp, Artificial Sequence
  Synthetic Polynucleotide
taatacgactcactatagggtatggctgtaatcttccaatggccacaaggaacagaggagaccttgtatgcattggaagaacctggcggcagcgcaaaagatg

SEQ ID NO: 91722 - DNA, 103 bp, Artificial Sequence
  Synthetic Polynucleotide
taatacgactcactatagggtggaacaatatatggctgtaatcttccaataacagaggagaattggaatgttacagccaaacctggcggcagcgcaaaagatg

SEQ ID NO: 91723 - DNA, 103 bp, Artificial Sequence
  Synthetic Polynucleotide
taatacgactcactatagggcactgttctgtggaacaatatatggctgtaaacagaggagatacagcatgatattgttcaacctggcggcagcgcaaaagatg

SEQ ID NO: 91724 - DNA, 103 bp, Artificial Sequence
  Synthetic Polynucleotide
taatacgactcactatagggttaatctctccactgttctgtggaacaataaacagaggagatattgtatgacagaacagaacctggcggcagcgcaaaagatg

SEQ ID NO: 91725 - DNA, 103 bp, Artificial Sequence
  Synthetic Polynucleotide
taatacgactcactatagggtggtttcacattaatctctccactgttctgaacagaggagacagaacatgggagagattaacctggcggcagcgcaaaagatg

SEQ ID NO: 91726 - DNA, 103 bp, Artificial Sequence
  Synthetic Polynucleotide
taatacgactcactatagggtaaattcagttggtttcacattaatctctcaacagaggagagagagaatgatgtgaaacaacctggcggcagcgcaaaagatg

SEQ ID NO: 91727 - DNA, 103 bp, Artificial Sequence
  Synthetic Polynucleotide
taatacgactcactatagggaaccgggttataaattcagttggtttcacaaacagaggagatgtgaaatgaactgaattaacctggcggcagcgcaaaagatg

SEQ ID NO: 91728 - DNA, 103 bp, Artificial Sequence
  Synthetic Polynucleotide
taatacgactcactatagggattcactgcaaaccgggttataaattcagtaacagaggagaactgaaatgataacccggaacctggcggcagcgcaaaagatg

SEQ ID NO: 91729 - DNA, 103 bp, Artificial Sequence
  Synthetic Polynucleotide
taatacgactcactatagggcaaattttccattcactgcaaaccgggttaaacagaggagataacccatgttgcagtgaaacctggcggcagcgcaaaagatg

SEQ ID NO: 91730 - DNA, 103 bp, Artificial Sequence
  Synthetic Polynucleotide
taatacgactcactatagggtctacatagacaaattttccattcactgcaaacagaggagatgcagtatgtggaaaattaacctggcggcagcgcaaaagatg

SEQ ID NO: 91731 - DNA, 103 bp, Artificial Sequence
  Synthetic Polynucleotide
taatacgactcactatagggcttgaacactcgggtccctttgtcgcccataacagaggagaatgggcatgaaagggaccaacctggcggcagcgcaaaagatg

SEQ ID NO: 91732 - DNA, 103 bp, Artificial Sequence
  Synthetic Polynucleotide
taatacgactcactatagggcacaccatccacagggtccacgaggtcgataacagaggagaatcgacatggtggaccctaacctggcggcagcgcaaaagatg

SEQ ID NO: 91733 - DNA, 103 bp, Artificial Sequence
  Synthetic Polynucleotide
taatacgactcactataggggggcagttccacggccacgtcgccgccccgaacagaggagacggggcatggacgtggccaacctggcggcagcgcaaaagatg

SEQ ID NO: 91734 - DNA, 103 bp, Artificial Sequence
  Synthetic Polynucleotide
taatacgactcactatagggttagggtgaagggcagttccacggccacgtaacagaggagaacgtggatgtggaactgcaacctggcggcagcgcaaaagatg

SEQ ID NO: 91735 - DNA, 103 bp, Artificial Sequence
  Synthetic Polynucleotide
taatacgactcactatagggttggggtgcattagggtgaagggcagttccaacagaggagaggaactatgcttcaccctaacctggcggcagcgcaaaagatg

SEQ ID NO: 91736 - DNA, 103 bp, Artificial Sequence
  Synthetic Polynucleotide
taatacgactcactatagggctctttgggcttggggtgcattagggtgaaaacagaggagattcaccatgatgcaccccaacctggcggcagcgcaaaagatg

SEQ ID NO: 91737 - DNA, 103 bp, Artificial Sequence
  Synthetic Polynucleotide
taatacgactcactataggggcgggggttcctctttgggcttggggtgcaaacagaggagatgcaccatgagcccaaagaacctggcggcagcgcaaaagatg

SEQ ID NO: 91738 - DNA, 103 bp, Artificial Sequence
  Synthetic Polynucleotide
taatacgactcactatagggacttcccgatgcgggggttcctctttgggcaacagaggagagcccaaatgggaacccccaacctggcggcagcgcaaaagatg

SEQ ID NO: 91739 - DNA, 103 bp, Artificial Sequence
  Synthetic Polynucleotide
taatacgactcactataggggttctctggaacttcccgatgcgggggttcaacagaggagagaacccatgcatcgggaaaacctggcggcagcgcaaaagatg

SEQ ID NO: 91740 - DNA, 103 bp, Artificial Sequence
  Synthetic Polynucleotide
taatacgactcactatagggctggcgtctcgttctctggaacttcccgataacagaggagaatcgggatgttccagagaaacctggcggcagcgcaaaagatg

SEQ ID NO: 91741 - DNA, 103 bp, Artificial Sequence
  Synthetic Polynucleotide
taatacgactcactatagggttggtatctactggcgtctcgttctctggaaacagaggagatccagaatgcgagacgccaacctggcggcagcgcaaaagatg

SEQ ID NO: 91742 - DNA, 103 bp, Artificial Sequence
  Synthetic Polynucleotide
taatacgactcactatagggttctatgagattggtatctactggcgtctcaacagaggagagagacgatggtagataccaacctggcggcagcgcaaaagatg

SEQ ID NO: 91743 - DNA, 103 bp, Artificial Sequence
  Synthetic Polynucleotide
taatacgactcactatagggccaccaggaccacaccatccacagggtccaaacagaggagatggaccatgtggatggtgaacctggcggcagcgcaaaagatg

SEQ ID NO: 91744 - DNA, 103 bp, Artificial Sequence
  Synthetic Polynucleotide
taatacgactcactatagggttgtgtcaagttctatgagattggtatctaaacagaggagatagataatgatctcatagaacctggcggcagcgcaaaagatg

SEQ ID NO: 91745 - DNA, 103 bp, Artificial Sequence
  Synthetic Polynucleotide
taatacgactcactatagggtcgtcatcatttgtgtcaagttctatgagaaacagaggagatctcatatgacttgacacaacctggcggcagcgcaaaagatg

SEQ ID NO: 91746 - DNA, 103 bp, Artificial Sequence
  Synthetic Polynucleotide
taatacgactcactatagggaaatacaatgtcgtcatcatttgtgtcaagaacagaggagacttgacatgaatgatgacaacctggcggcagcgcaaaagatg

SEQ ID NO: 91747 - DNA, 103 bp, Artificial Sequence
  Synthetic Polynucleotide
taatacgactcactatagggcaaagtcctcaaatacaatgtcgtcatcataacagaggagaatgatgatgacattgtataacctggcggcagcgcaaaagatg

SEQ ID NO: 91748 - DNA, 103 bp, Artificial Sequence
  Synthetic Polynucleotide
taatacgactcactatagggctctggcgagcaaagtcctcaaatacaatgaacagaggagacattgtatgtgaggacttaacctggcggcagcgcaaaagatg

SEQ ID NO: 91749 - DNA, 103 bp, Artificial Sequence
  Synthetic Polynucleotide
taatacgactcactataggggcctttcagtctctggcgagcaaagtcctcaacagaggagagaggacatggctcgccagaacctggcggcagcgcaaaagatg

SEQ ID NO: 91750 - DNA, 103 bp, Artificial Sequence
  Synthetic Polynucleotide
taatacgactcactatagggcatccttcatgcctttcagtctctggcgagaacagaggagactcgccatggactgaaagaacctggcggcagcgcaaaagatg

SEQ ID NO: 91751 - DNA, 103 bp, Artificial Sequence
  Synthetic Polynucleotide
taatacgactcactatagggtcctccttgtcatccttcatgcctttcagtaacagaggagaactgaaatgcatgaaggaaacctggcggcagcgcaaaagatg

SEQ ID NO: 91752 - DNA, 103 bp, Artificial Sequence
  Synthetic Polynucleotide
taatacgactcactatagggatcctcctcttcctccttgtcatccttcataacagaggagaatgaagatggacaaggagaacctggcggcagcgcaaaagatg

SEQ ID NO: 91753 - DNA, 103 bp, Artificial Sequence
  Synthetic Polynucleotide
taatacgactcactatagggagccggtaccatcctcctcttcctccttgtaacagaggagaacaaggatgaagaggaggaacctggcggcagcgcaaaagatg

SEQ ID NO: 91754 - DNA, 103 bp, Artificial Sequence
  Synthetic Polynucleotide
taatacgactcactatagggtactcaggatccaccaggaccacaccatccaacagaggagaggatggatgggtcctggtaacctggcggcagcgcaaaagatg

SEQ ID NO: 91755 - DNA, 103 bp, Artificial Sequence
  Synthetic Polynucleotide
taatacgactcactatagggagctgtggagagccggtaccatcctcctctaacagaggagaagaggaatgtggtaccggaacctggcggcagcgcaaaagatg

SEQ ID NO: 91756 - DNA, 103 bp, Artificial Sequence
  Synthetic Polynucleotide
taatacgactcactatagggtctgttgttgagctgtggagagccggtaccaacagaggagaggtaccatgtctccacagaacctggcggcagcgcaaaagatg

SEQ ID NO: 91757 - DNA, 103 bp, Artificial Sequence
  Synthetic Polynucleotide
taatacgactcactatagggctctttgagatactcaggatccaccaggacaacagaggagagtcctgatggatcctgagaacctggcggcagcgcaaaagatg

SEQ ID NO: 91758 - DNA, 103 bp, Artificial Sequence
  Synthetic Polynucleotide
taatacgactcactatagggagactctccgctctttgagatactcaggataacagaggagaatcctgatgatctcaaagaacctggcggcagcgcaaaagatg

SEQ ID NO: 91759 - DNA, 103 bp, Artificial Sequence
  Synthetic Polynucleotide
taatacgactcactatagggagcgtcacatagactctccgctctttgagaaacagaggagatctcaaatggcggagagtaacctggcggcagcgcaaaagatg

SEQ ID NO: 91760 - DNA, 103 bp, Artificial Sequence
  Synthetic Polynucleotide
taatacgactcactatagggggcgcaggtcagcgtcacatagactctccgaacagaggagacggagaatgtatgtgacgaacctggcggcagcgcaaaagatg

SEQ ID NO: 91761 - DNA, 103 bp, Artificial Sequence
  Synthetic Polynucleotide
taatacgactcactatagggcatagcggaaggcgcaggtcagcgtcacataacagaggagaatgtgaatgtgacctgcgaacctggcggcagcgcaaaagatg

SEQ ID NO: 91762 - DNA, 103 bp, Artificial Sequence
  Synthetic Polynucleotide
taatacgactcactatagggtcctcccggccatagcggaaggcgcaggtcaacagaggagagacctgatgcttccgctaaacctggcggcagcgcaaaagatg

SEQ ID NO: 91763 - DNA, 103 bp, Artificial Sequence
  Synthetic Polynucleotide
taatacgactcactataggggacatccaggtcctcccggccatagcggaaaacagaggagattccgcatgggccgggagaacctggcggcagcgcaaaagatg

SEQ ID NO: 91764 - DNA, 103 bp, Artificial Sequence
  Synthetic Polynucleotide
taatacgactcactataggggactggccttcttgaacactcgggtcccttaacagaggagaaagggaatggagtgttcaaacctggcggcagcgcaaaagatg

SEQ ID NO: 91765 - DNA, 103 bp, Artificial Sequence
  Synthetic Polynucleotide
taatacgactcactatagggtcaggcccaggacatccaggtcctcccggcaacagaggagagccgggatgacctggatgaacctggcggcagcgcaaaagatg

SEQ ID NO: 91766 - DNA, 103 bp, Artificial Sequence
  Synthetic Polynucleotide
taatacgactcactatagggttgcgaaaggtcaggcccaggacatccaggaacagaggagacctggaatgcctgggcctaacctggcggcagcgcaaaagatg

SEQ ID NO: 91767 - DNA, 103 bp, Artificial Sequence
  Synthetic Polynucleotide
taatacgactcactatagggaaacaggtccttgcgaaaggtcaggcccagaacagaggagactgggcatgacctttcgcaacctggcggcagcgcaaaagatg

SEQ ID NO: 91768 - DNA, 103 bp, Artificial Sequence
  Synthetic Polynucleotide
taatacgactcactatagggcgttggccacaaacaggtccttgcgaaaggaacagaggagacctttcatgaggacctgtaacctggcggcagcgcaaaagatg

SEQ ID NO: 91769 - DNA, 103 bp, Artificial Sequence
  Synthetic Polynucleotide
taatacgactcactatagggaacgactgtacgttggccacaaacaggtccaacagaggagaggacctatgtgtggccaaaacctggcggcagcgcaaaagatg

SEQ ID NO: 91770 - DNA, 103 bp, Artificial Sequence
  Synthetic Polynucleotide
taatacgactcactatagggggccggtgggaacgactgtacgttggccacaacagaggagagtggccatggtacagtcgaacctggcggcagcgcaaaagatg

SEQ ID NO: 91771 - DNA, 103 bp, Artificial Sequence
  Synthetic Polynucleotide
taatacgactcactatagggtgtcctcgggggccggtgggaacgactgtaaacagaggagatacagtatgtcccaccggaacctggcggcagcgcaaaagatg

SEQ ID NO: 91772 - DNA, 103 bp, Artificial Sequence
  Synthetic Polynucleotide
taatacgactcactatagggaggggcttcttgtcctcgggggccggtgggaacagaggagacccaccatgccccgaggaaacctggcggcagcgcaaaagatg

SEQ ID NO: 91773 - DNA, 103 bp, Artificial Sequence
  Synthetic Polynucleotide
taatacgactcactatagggcagccgcgtcaggggcttcttgtcctcgggaacagaggagacccgagatgaagaagcccaacctggcggcagcgcaaaagatg

SEQ ID NO: 91774 - DNA, 103 bp, Artificial Sequence
  Synthetic Polynucleotide
taatacgactcactatagggggcgttcctgcagccgcgtcaggggcttctaacagaggagaagaagcatgtgacgcggcaacctggcggcagcgcaaaagatg

SEQ ID NO: 91775 - DNA, 103 bp, Artificial Sequence
  Synthetic Polynucleotide
taatacgactcactatagggtttccatttggactggccttcttgaacactaacagaggagaagtgttatggaaggccagaacctggcggcagcgcaaaagatg

SEQ ID NO: 91776 - DNA, 103 bp, Artificial Sequence
  Synthetic Polynucleotide
taatacgactcactatagggttcttgatgaggcgttcctgcagccgcgtcaacagaggagagacgcgatggcaggaacgaacctggcggcagcgcaaaagatg

SEQ ID NO: 91777 - DNA, 103 bp, Artificial Sequence
  Synthetic Polynucleotide
taatacgactcactatagggctcgcccagcttcttgatgaggcgttcctgaacagaggagacaggaaatgctcatcaagaacctggcggcagcgcaaaagatg

SEQ ID NO: 91778 - DNA, 103 bp, Artificial Sequence
  Synthetic Polynucleotide
taatacgactcactatagggggtaagcgtgctcgcccagcttcttgatgaaacagaggagatcatcaatgagctgggcgaacctggcggcagcgcaaaagatg

SEQ ID NO: 91779 - DNA, 103 bp, Artificial Sequence
  Synthetic Polynucleotide
taatacgactcactatagggaaggtgaaagggtaagcgtgctcgcccagcaacagaggagagctgggatggcacgcttaaacctggcggcagcgcaaaagatg

SEQ ID NO: 91780 - DNA, 103 bp, Artificial Sequence
  Synthetic Polynucleotide
taatacgactcactatagggagggatctcaaaggtgaaagggtaagcgtgaacagaggagacacgctatgcctttcaccaacctggcggcagcgcaaaagatg

SEQ ID NO: 91781 - DNA, 103 bp, Artificial Sequence
  Synthetic Polynucleotide
taatacgactcactataggggaaggtttggagggatctcaaaggtgaaagaacagaggagactttcaatgttgagatccaacctggcggcagcgcaaaagatg

SEQ ID NO: 91782 - DNA, 103 bp, Artificial Sequence
  Synthetic Polynucleotide
taatacgactcactatagggacagaacatggaaggtttggagggatctcaaacagaggagatgagatatgtccaaacctaacctggcggcagcgcaaaagatg

SEQ ID NO: 91783 - DNA, 103 bp, Artificial Sequence
  Synthetic Polynucleotide
taatacgactcactatagggctgcagtgtcacagaacatggaaggtttggaacagaggagaccaaacatgccatgttctaacctggcggcagcgcaaaagatg

SEQ ID NO: 91784 - DNA, 103 bp, Artificial Sequence
  Synthetic Polynucleotide
taatacgactcactatagggcgggccccggctgcagtgtcacagaacatgaacagaggagacatgttatgtgacactgcaacctggcggcagcgcaaaagatg

SEQ ID NO: 91785 - DNA, 103 bp, Artificial Sequence
  Synthetic Polynucleotide
taatacgactcactatagggcccgtgtcttcgggccccggctgcagtgtcaacagaggagagacactatggccggggccaacctggcggcagcgcaaaagatg

SEQ ID NO: 91786 - DNA, 103 bp, Artificial Sequence
  Synthetic Polynucleotide
taatacgactcactataggggacggtgagctttccatttggactggccttaacagaggagaaaggccatgccaaatggaaacctggcggcagcgcaaaagatg

SEQ ID NO: 91787 - DNA, 103 bp, Artificial Sequence
  Synthetic Polynucleotide
taatacgactcactataggggcaagccttccccgtgtcttcgggccccggaacagaggagaccggggatggaagacacgaacctggcggcagcgcaaaagatg

SEQ ID NO: 91788 - DNA, 103 bp, Artificial Sequence
  Synthetic Polynucleotide
taatacgactcactatagggagtccacaccgcaagccttccccgtgtcttaacagaggagaaagacaatgggaaggcttaacctggcggcagcgcaaaagatg

SEQ ID NO: 91789 - DNA, 103 bp, Artificial Sequence
  Synthetic Polynucleotide
taatacgactcactatagggttgacttcatagtccacaccgcaagccttcaacagaggagagaaggcatgcggtgtggaaacctggcggcagcgcaaaagatg

SEQ ID NO: 91790 - DNA, 103 bp, Artificial Sequence
  Synthetic Polynucleotide
taatacgactcactataggggcagaaggctttgacttcatagtccacaccaacagaggagaggtgtgatgtatgaagtcaacctggcggcagcgcaaaagatg

SEQ ID NO: 91791 - DNA, 103 bp, Artificial Sequence
  Synthetic Polynucleotide
taatacgactcactatagggaattctccgcgcagaaggctttgacttcataacagaggagaatgaagatgaagccttctaacctggcggcagcgcaaaagatg

SEQ ID NO: 91792 - DNA, 103 bp, Artificial Sequence
  Synthetic Polynucleotide
taatacgactcactatagggttctcctccaaattctccgcgcagaaggctaacagaggagaagccttatgcgcggagaaaacctggcggcagcgcaaaagatg

SEQ ID NO: 91793 - DNA, 103 bp, Artificial Sequence
  Synthetic Polynucleotide
taatacgactcactatagggcttgtggatcttctcctccaaattctccgcaacagaggagagcggagatgttggaggagaacctggcggcagcgcaaaagatg

SEQ ID NO: 91794 - DNA, 103 bp, Artificial Sequence
  Synthetic Polynucleotide
taatacgactcactatagggcagaattccgcttgtggatcttctcctccaaacagaggagatggaggatgagatccacaaacctggcggcagcgcaaaagatg

SEQ ID NO: 91795 - DNA, 103 bp, Artificial Sequence
  Synthetic Polynucleotide
taatacgactcactatagggaccagacgcacagaattccgcttgtggatcaacagaggagagatccaatggcggaattcaacctggcggcagcgcaaaagatg

SEQ ID NO: 91796 - DNA, 103 bp, Artificial Sequence
  Synthetic Polynucleotide
taatacgactcactatagggcttccggatgaccagacgcacagaattccgaacagaggagacggaatatggtgcgtctgaacctggcggcagcgcaaaagatg

SEQ ID NO: 91797 - DNA, 103 bp, Artificial Sequence
  Synthetic Polynucleotide
taatacgactcactatagggttcccaggtagacggtgagctttccatttgaacagaggagacaaatgatgagctcaccgaacctggcggcagcgcaaaagatg

SEQ ID NO: 91798 - DNA, 103 bp, Artificial Sequence
  Synthetic Polynucleotide
taatacgactcactatagggcatactgaaccttccggatgaccagacgcaaacagaggagatgcgtcatgtcatccggaaacctggcggcagcgcaaaagatg

SEQ ID NO: 91799 - DNA, 103 bp, Artificial Sequence
  Synthetic Polynucleotide
taatacgactcactatagggctctctggggcatactgaaccttccggatgaacagaggagacatccgatgggttcagtaaacctggcggcagcgcaaaagatg

SEQ ID NO: 91800 - DNA, 103 bp, Artificial Sequence
  Synthetic Polynucleotide
taatacgactcactatagggggggccaggcctctctggggcatactgaacaacagaggagagttcagatggccccagagaacctggcggcagcgcaaaagatg

SEQ ID NO: 91801 - DNA, 103 bp, Artificial Sequence
  Synthetic Polynucleotide
taatacgactcactatagggctgtgggctgggggccaggcctctctggggaacagaggagaccccagatgggcctggccaacctggcggcagcgcaaaagatg

SEQ ID NO: 91802 - DNA, 103 bp, Artificial Sequence
  Synthetic Polynucleotide
taatacgactcactataggggtggtctcggctgtgggctgggggccaggcaacagaggagagcctggatgccagcccacaacctggcggcagcgcaaaagatg

SEQ ID NO: 91803 - DNA, 103 bp, Artificial Sequence
  Synthetic Polynucleotide
taatacgactcactataggggaactgcctggtggtctcggctgtgggctgaacagaggagacagcccatggccgagaccaacctggcggcagcgcaaaagatg

SEQ ID NO: 91804 - DNA, 103 bp, Artificial Sequence
  Synthetic Polynucleotide
taatacgactcactatagggccgacatgaggaactgcctggtggtctcggaacagaggagaccgagaatgccaggcagtaacctggcggcagcgcaaaagatg

SEQ ID NO: 91805 - DNA, 103 bp, Artificial Sequence
  Synthetic Polynucleotide
taatacgactcactatagggaagggcttgtccgacatgaggaactgcctgaacagaggagacaggcaatgcctcatgtcaacctggcggcagcgcaaaagatg

SEQ ID NO: 91806 - DNA, 103 bp, Artificial Sequence
  Synthetic Polynucleotide
taatacgactcactatagggttctaggtgcaagggcttgtccgacatgagaacagaggagactcatgatggacaagcccaacctggcggcagcgcaaaagatg

SEQ ID NO: 91807 - DNA, 103 bp, Artificial Sequence
  Synthetic Polynucleotide
taatacgactcactatagggccagagaggcttctaggtgcaagggcttgtaacagaggagaacaagcatgtgcacctagaacctggcggcagcgcaaaagatg

SEQ ID NO: 91808 - DNA, 103 bp, Artificial Sequence
  Synthetic Polynucleotide
taatacgactcactatagggaagtcccgctttcccaggtagacggtgagcaacagaggagagctcacatgctacctgggaacctggcggcagcgcaaaagatg

SEQ ID NO: 91809 - DNA, 103 bp, Artificial Sequence
  Synthetic Polynucleotide
taatacgactcactatagggatctccttatccagagaggcttctaggtgcaacagaggagagcacctatgagcctctctaacctggcggcagcgcaaaagatg

SEQ ID NO: 91810 - DNA, 103 bp, Artificial Sequence
  Synthetic Polynucleotide
taatacgactcactatagggatggtaatagatctccttatccagagaggcaacagaggagagcctctatggataaggagaacctggcggcagcgcaaaagatg

SEQ ID NO: 91811 - DNA, 103 bp, Artificial Sequence
  Synthetic Polynucleotide
taatacgactcactatagggtgggttctccatggtaatagatctccttataacagaggagaataaggatgtctattaccaacctggcggcagcgcaaaagatg

SEQ ID NO: 91812 - DNA, 103 bp, Artificial Sequence
  Synthetic Polynucleotide
taatacgactcactatagggttgacgctgatgggttctccatggtaatagaacagaggagactattaatgtggagaaccaacctggcggcagcgcaaaagatg

SEQ ID NO: 91813 - DNA, 103 bp, Artificial Sequence
  Synthetic Polynucleotide
taatacgactcactataggggacgtggacgttgacgctgatgggttctccaacagaggagaggagaaatgatcagcgtcaacctggcggcagcgcaaaagatg

SEQ ID NO: 91814 - DNA, 103 bp, Artificial Sequence
  Synthetic Polynucleotide
taatacgactcactatagggtgttgttggtgacgtggacgttgacgctgaaacagaggagatcagcgatgacgtccacgaacctggcggcagcgcaaaagatg

SEQ ID NO: 91815 - DNA, 103 bp, Artificial Sequence
  Synthetic Polynucleotide
taatacgactcactataggggtcttgttggtgttgttggtgacgtggacgaacagaggagacgtccaatgcaccaacaaaacctggcggcagcgcaaaagatg

SEQ ID NO: 91816 - DNA, 103 bp, Artificial Sequence
  Synthetic Polynucleotide
taatacgactcactatagggcttcttcaccgtcttgttggtgttgttggtaacagaggagaaccaacatgaccaacaagaacctggcggcagcgcaaaagatg

SEQ ID NO: 91817 - DNA, 103 bp, Artificial Sequence
  Synthetic Polynucleotide
taatacgactcactatagggagatcttgatcttcttcaccgtcttgttggaacagaggagaccaacaatgcggtgaagaaacctggcggcagcgcaaaagatg

SEQ ID NO: 91818 - DNA, 103 bp, Artificial Sequence
  Synthetic Polynucleotide
taatacgactcactatagggtggcgcactgagatcttgatcttcttcaccaacagaggagaggtgaaatggatcaagataacctggcggcagcgcaaaagatg

SEQ ID NO: 91819 - DNA, 103 bp, Artificial Sequence
  Synthetic Polynucleotide
taatacgactcactataggggtggtccacaaagtcccgctttcccaggtaaacagaggagatacctgatgaagcgggacaacctggcggcagcgcaaaagatg

SEQ ID NO: 91820 - DNA, 103 bp, Artificial Sequence
  Synthetic Polynucleotide
taatacgactcactataggggtctgcatactggcgcactgagatcttgataacagaggagaatcaagatgtcagtgcgcaacctggcggcagcgcaaaagatg

SEQ ID NO: 91821 - DNA, 103 bp, Artificial Sequence
  Synthetic Polynucleotide
taatacgactcactatagggaaaggcagatgtctgcatactggcgcactgaacagaggagacagtgcatgagtatgcagaacctggcggcagcgcaaaagatg

SEQ ID NO: 91822 - DNA, 103 bp, Artificial Sequence
  Synthetic Polynucleotide
taatacgactcactataggggctgtgttgaaaaggcagatgtctgcatacaacagaggagagtatgcatgcatctgcctaacctggcggcagcgcaaaagatg

SEQ ID NO: 91823 - DNA, 103 bp, Artificial Sequence
  Synthetic Polynucleotide
taatacgactcactatagggcttgtactgagctgtgttgaaaaggcagataacagaggagaatctgcatgttcaacacaaacctggcggcagcgcaaaagatg

SEQ ID NO: 91824 - DNA, 103 bp, Artificial Sequence
  Synthetic Polynucleotide
taatacgactcactatagggcaacagggcacttgtactgagctgtgttgaaacagaggagatcaacaatgctcagtacaaacctggcggcagcgcaaaagatg

SEQ ID NO: 91825 - DNA, 103 bp, Artificial Sequence
  Synthetic Polynucleotide
taatacgactcactatagggtcttccatggcaacagggcacttgtactgaaacagaggagatcagtaatggtgccctgtaacctggcggcagcgcaaaagatg

SEQ ID NO: 91826 - DNA, 103 bp, Artificial Sequence
  Synthetic Polynucleotide
taatacgactcactataggggtcatcagcctcttccatggcaacagggcaaacagaggagatgccctatggccatggaaaacctggcggcagcgcaaaagatg

SEQ ID NO: 91827 - DNA, 103 bp, Artificial Sequence
  Synthetic Polynucleotide
taatacgactcactataggggtgccacagtgtcatcagcctcttccatggaacagaggagaccatggatgaggctgatgaacctggcggcagcgcaaaagatg

SEQ ID NO: 91828 - DNA, 103 bp, Artificial Sequence
  Synthetic Polynucleotide
taatacgactcactataggggtcgagctgggtgccacagtgtcatcagccaacagaggagaggctgaatgcactgtggcaacctggcggcagcgcaaaagatg

SEQ ID NO: 91829 - DNA, 103 bp, Artificial Sequence
  Synthetic Polynucleotide
taatacgactcactatagggcttgcagaacgtcgagctgggtgccacagtaacagaggagaactgtgatgcccagctcgaacctggcggcagcgcaaaagatg

SEQ ID NO: 91830 - DNA, 103 bp, Artificial Sequence
  Synthetic Polynucleotide
taatacgactcactatagggcgaggtcgatgtggtccacaaagtcccgctaacagaggagaagcgggatgttgtggaccaacctggcggcagcgcaaaagatg

SEQ ID NO: 91831 - DNA, 103 bp, Artificial Sequence
  Synthetic Polynucleotide
taatacgactcactataggggtgtgtagaccttgcagaacgtcgagctggaacagaggagaccagctatgcgttctgcaaacctggcggcagcgcaaaagatg

SEQ ID NO: 91832 - DNA, 103 bp, Artificial Sequence
  Synthetic Polynucleotide
taatacgactcactatagggaagggggtcagtgtgtagaccttgcagaacaacagaggagagttctgatgggtctacacaacctggcggcagcgcaaaagatg

SEQ ID NO: 91833 - DNA, 103 bp, Artificial Sequence
  Synthetic Polynucleotide
taatacgactcactatagggattggctaggaagggggtcagtgtgtagacaacagaggagagtctacatgctgacccccaacctggcggcagcgcaaaagatg

SEQ ID NO: 91834 - DNA, 103 bp, Artificial Sequence
  Synthetic Polynucleotide
taatacgactcactatagggtctctcggttattggctaggaagggggtcaaacagaggagatgacccatgtcctagccaaacctggcggcagcgcaaaagatg

SEQ ID NO: 91835 - DNA, 103 bp, Artificial Sequence
  Synthetic Polynucleotide
taatacgactcactatagggaggccccgcttctctcggttattggctaggaacagaggagacctagcatgtaaccgagaaacctggcggcagcgcaaaagatg

SEQ ID NO: 91836 - DNA, 103 bp, Artificial Sequence
  Synthetic Polynucleotide
taatacgactcactataggggtccaaggcgaggccccgcttctctcggttaacagaggagaaaccgaatgaagcggggcaacctggcggcagcgcaaaagatg

SEQ ID NO: 91837 - DNA, 103 bp, Artificial Sequence
  Synthetic Polynucleotide
taatacgactcactatagggtgagcttcccgtccaaggcgaggccccgctaacagaggagaagcgggatgtcgccttggaacctggcggcagcgcaaaagatg

SEQ ID NO: 91838 - DNA, 103 bp, Artificial Sequence
  Synthetic Polynucleotide
taatacgactcactatagggtcttcgtgcttgagcttcccgtccaaggcgaacagaggagacgccttatgcgggaagctaacctggcggcagcgcaaaagatg

SEQ ID NO: 91839 - DNA, 103 bp, Artificial Sequence
  Synthetic Polynucleotide
taatacgactcactatagggcaagttcgtgtcttcgtgcttgagcttcccaacagaggagagggaagatgaagcacgaaaacctggcggcagcgcaaaagatg

SEQ ID NO: 91840 - DNA, 103 bp, Artificial Sequence
  Synthetic Polynucleotide
taatacgactcactatagggtgctagaggccaagttcgtgtcttcgtgctaacagaggagaagcacgatgacacgaactaacctggcggcagcgcaaaagatg

SEQ ID NO: 91841 - DNA, 103 bp, Artificial Sequence
  Synthetic Polynucleotide
taatacgactcactatagggacagggtccacgaggtcgatgtggtccacaaacagaggagatgtggaatgcatcgacctaacctggcggcagcgcaaaagatg

SEQ ID NO: 91842 - DNA, 103 bp, Artificial Sequence
  Synthetic Polynucleotide
taatacgactcactatagggctcaacagggtgctagaggccaagttcgtgaacagaggagacacgaaatgggcctctagaacctggcggcagcgcaaaagatg

SEQ ID NO: 91843 - DNA, 103 bp, Artificial Sequence
  Synthetic Polynucleotide
taatacgactcactatagggggcaccttccctcaacagggtgctagaggcaacagaggagagcctctatgaccctgttgaacctggcggcagcgcaaaagatg

SEQ ID NO: 91844 - DNA, 103 bp, Artificial Sequence
  Synthetic Polynucleotide
taatacgactcactatagggtctcacggttggcaccttccctcaacagggaacagaggagaccctgtatggggaaggtgaacctggcggcagcgcaaaagatg

SEQ ID NO: 91845 - DNA, 103 bp, Artificial Sequence
  Synthetic Polynucleotide
taatacgactcactatagggatccccaggatctcacggttggcaccttccaacagaggagaggaaggatgcaaccgtgaaacctggcggcagcgcaaaagatg

SEQ ID NO: 91846 - DNA, 103 bp, Artificial Sequence
  Synthetic Polynucleotide
taatacgactcactatagggggaaacaatgatccccaggatctcacggttaacagaggagaaaccgtatgatcctggggaacctggcggcagcgcaaaagatg

SEQ ID NO: 91847 - DNA, 103 bp, Artificial Sequence
  Synthetic Polynucleotide
taatacgactcactatagggtcactttgtaggaaacaatgatccccaggaaacagaggagatcctggatgtcattgtttaacctggcggcagcgcaaaagatg

SEQ ID NO: 91848 - DNA, 103 bp, Artificial Sequence
  Synthetic Polynucleotide
taatacgactcactatagggagcttcactttcactttgtaggaaacaatgaacagaggagacattgtatgctacaaagtaacctggcggcagcgcaaaagatg

SEQ ID NO: 91849 - DNA, 103 bp, Artificial Sequence
  Synthetic Polynucleotide
taatacgactcactatagggagacaccaccagcttcactttcactttgtaaacagaggagatacaaaatgaaagtgaagaacctggcggcagcgcaaaagatg

SEQ ID NO: 91850 - DNA, 103 bp, Artificial Sequence
  Synthetic Polynucleotide
taatacgactcactatagggcgccgccccgagacaccaccagcttcacttaacagaggagaaagtgaatgtggtggtgtaacctggcggcagcgcaaaagatg

SEQ ID NO: 91851 - DNA, 103 bp, Artificial Sequence
  Synthetic Polynucleotide
taatacgactcactatagggacggccacgtcgccgccccgagacaccaccaacagaggagaggtggtatgtcggggcggaacctggcggcagcgcaaaagatg

SEQ ID NO: 91852 - DNA, 103 bp, Artificial Sequence
  Synthetic Polynucleotide
taatacgactcactataggggcagccctcctcctggtactgattgctcataacagaggagaatgagcatgcagtaccagaacctggcggcagcgcaaaagatg

SEQ ID NO: 91853 - DNA, 103 bp, Artificial Sequence
  Synthetic Polynucleotide
taatacgactcactatagggtttgcacgggctcctccggcccaggatgctaacagaggagaagcatcatgggccggaggaacctggcggcagcgcaaaagatg

SEQ ID NO: 91854 - DNA, 103 bp, Artificial Sequence
  Synthetic Polynucleotide
taatacgactcactatagggcagctggtagctggtgaacgtggtgcggtaaacagaggagataccgcatgacgttcaccaacctggcggcagcgcaaaagatg

SEQ ID NO: 91855 - DNA, 103 bp, Artificial Sequence
  Synthetic Polynucleotide
taatacgactcactatagggccagttcctccagctggtagctggtgaacgaacagaggagacgttcaatggctaccagcaacctggcggcagcgcaaaagatg

SEQ ID NO: 91856 - DNA, 103 bp, Artificial Sequence
  Synthetic Polynucleotide
taatacgactcactatagggaaggcccgctccagttcctccagctggtagaacagaggagactaccaatgggaggaactaacctggcggcagcgcaaaagatg

SEQ ID NO: 91857 - DNA, 103 bp, Artificial Sequence
  Synthetic Polynucleotide
taatacgactcactatagggcgtcttctggaaggcccgctccagttcctcaacagaggagagaggaaatggagcgggccaacctggcggcagcgcaaaagatg

SEQ ID NO: 91858 - DNA, 103 bp, Artificial Sequence
  Synthetic Polynucleotide
taatacgactcactatagggccgggtagtgcgtcttctggaaggcccgctaacagaggagaagcgggatgtccagaagaaacctggcggcagcgcaaaagatg

SEQ ID NO: 91859 - DNA, 103 bp, Artificial Sequence
  Synthetic Polynucleotide
taatacgactcactataggggtgaagacgtccgggtagtgcgtcttctggaacagaggagaccagaaatggcactacccaacctggcggcagcgcaaaagatg

SEQ ID NO: 91860 - DNA, 103 bp, Artificial Sequence
  Synthetic Polynucleotide
taatacgactcactatagggttcctccctggtgaagacgtccgggtagtgaacagaggagacactacatggacgtcttcaacctggcggcagcgcaaaagatg

SEQ ID NO: 91861 - DNA, 103 bp, Artificial Sequence
  Synthetic Polynucleotide
taatacgactcactatagggtcatggccagttcctccctggtgaagacgtaacagaggagaacgtctatgccagggaggaacctggcggcagcgcaaaagatg

SEQ ID NO: 91862 - DNA, 103 bp, Artificial Sequence
  Synthetic Polynucleotide
taatacgactcactatagggaagtccagcctcatggccagttcctccctgaacagaggagacagggaatgactggccataacctggcggcagcgcaaaagatg

SEQ ID NO: 91863 - DNA, 103 bp, Artificial Sequence
  Synthetic Polynucleotide
taatacgactcactatagggggcctcggtcaagtccagcctcatggccagaacagaggagactggccatgaggctggacaacctggcggcagcgcaaaagatg

SEQ ID NO: 91864 - DNA, 103 bp, Artificial Sequence
  Synthetic Polynucleotide
taatacgactcactataggggcaaccgcattttgcacgggctcctccggcaacagaggagagccggaatggcccgtgcaaacctggcggcagcgcaaaagatg

SEQ ID NO: 91865 - DNA, 103 bp, Artificial Sequence
  Synthetic Polynucleotide
taatacgactcactatagggcctggactcgggcctcggtcaagtccagccaacagaggagaggctggatgtgaccgaggaacctggcggcagcgcaaaagatg

SEQ ID NO: 91866 - DNA, 103 bp, Artificial Sequence
  Synthetic Polynucleotide
taatacgactcactatagggtggaaccagacctggactcgggcctcggtcaacagaggagagaccgaatgccgagtccaaacctggcggcagcgcaaaagatg

SEQ ID NO: 91867 - DNA, 103 bp, Artificial Sequence
  Synthetic Polynucleotide
taatacgactcactatagggccgacggttctggaaccagacctggactcgaacagaggagacgagtcatggtctggttcaacctggcggcagcgcaaaagatg

SEQ ID NO: 91868 - DNA, 103 bp, Artificial Sequence
  Synthetic Polynucleotide
taatacgactcactataggggccacttggcccgacggttctggaaccagaaacagaggagatctggtatgagaaccgtcaacctggcggcagcgcaaaagatg

SEQ ID NO: 91869 - DNA, 103 bp, Artificial Sequence
  Synthetic Polynucleotide
taatacgactcactatagggtcccgcttgcgccacttggcccgacggttcaacagaggagagaaccgatgggccaagtgaacctggcggcagcgcaaaagatg

SEQ ID NO: 91870 - DNA, 103 bp, Artificial Sequence
  Synthetic Polynucleotide
taatacgactcactataggggcctgccttctcccgcttgcgccacttggcaacagaggagagccaagatgcgcaagcggaacctggcggcagcgcaaaagatg

SEQ ID NO: 91871 - DNA, 103 bp, Artificial Sequence
  Synthetic Polynucleotide
taatacgactcactataggggggtctgcgcgcctgccttctcccgcttgcaacagaggagagcaagcatgagaaggcagaacctggcggcagcgcaaaagatg

SEQ ID NO: 91872 - DNA, 103 bp, Artificial Sequence
  Synthetic Polynucleotide
taatacgactcactatagggccaggggggtgggtctgcgcgcctgccttcaacagaggagagaaggcatgcgcgcagacaacctggcggcagcgcaaaagatg

SEQ ID NO: 91873 - DNA, 103 bp, Artificial Sequence
  Synthetic Polynucleotide
taatacgactcactataggggaagggcagcccaggggggtgggtctgcgcaacagaggagagcgcagatgcacccccctaacctggcggcagcgcaaaagatg

SEQ ID NO: 91874 - DNA, 103 bp, Artificial Sequence
  Synthetic Polynucleotide
taatacgactcactataggggcggccccgggaagggcagcccaggggggtaacagaggagaacccccatgggctgccctaacctggcggcagcgcaaaagatg

SEQ ID NO: 91875 - DNA, 103 bp, Artificial Sequence
  Synthetic Polynucleotide
taatacgactcactataggggcggctcccagcaaccgcattttgcacgggaacagaggagacccgtgatgaatgcggttaacctggcggcagcgcaaaagatg

SEQ ID NO: 91876 - DNA, 103 bp, Artificial Sequence
  Synthetic Polynucleotide
taatacgactcactataggggtggcggagagcggccccgggaagggcagcaacagaggagagctgccatgcccggggccaacctggcggcagcgcaaaagatg

SEQ ID NO: 91877 - DNA, 103 bp, Artificial Sequence
  Synthetic Polynucleotide
taatacgactcactataggggagcgggtgggtggcggagagcggccccggaacagaggagaccggggatgctctccgccaacctggcggcagcgcaaaagatg

SEQ ID NO: 91878 - DNA, 103 bp, Artificial Sequence
  Synthetic Polynucleotide
taatacgactcactatagggggtaggggctgagcgggtgggtggcggagaaacagaggagatctccgatgcccacccgcaacctggcggcagcgcaaaagatg

SEQ ID NO: 91879 - DNA, 103 bp, Artificial Sequence
  Synthetic Polynucleotide
taatacgactcactatagggctggcgtccaggtaggggctgagcgggtggaacagaggagaccacccatgcagcccctaaacctggcggcagcgcaaaagatg

SEQ ID NO: 91880 - DNA, 103 bp, Artificial Sequence
  Synthetic Polynucleotide
taatacgactcactatagggagggaaggggctggcgtccaggtaggggctaacagaggagaagccccatgctggacgccaacctggcggcagcgcaaaagatg

SEQ ID NO: 91881 - DNA, 103 bp, Artificial Sequence
  Synthetic Polynucleotide
taatacgactcactatagggggtggtgcggagggaaggggctggcgtccaaacagaggagatggacgatggccccttccaacctggcggcagcgcaaaagatg

SEQ ID NO: 91882 - DNA, 103 bp, Artificial Sequence
  Synthetic Polynucleotide
taatacgactcactatagggtcgagcgccgggtggtgcggagggaaggggaacagaggagaccccttatgtccgcaccaaacctggcggcagcgcaaaagatg

SEQ ID NO: 91883 - DNA, 103 bp, Artificial Sequence
  Synthetic Polynucleotide
taatacgactcactatagggccaagcggagtcgagcgccgggtggtgcggaacagaggagaccgcacatgccggcgctcaacctggcggcagcgcaaaagatg

SEQ ID NO: 91884 - DNA, 103 bp, Artificial Sequence
  Synthetic Polynucleotide
taatacgactcactatagggcagcggcagtccaagcggagtcgagcgccgaacagaggagacggcgcatgactccgcttaacctggcggcagcgcaaaagatg

SEQ ID NO: 91885 - DNA, 103 bp, Artificial Sequence
  Synthetic Polynucleotide
taatacgactcactataggggcggcggcggcagcggcagtccaagcggagaacagaggagactccgcatggactgccgcaacctggcggcagcgcaaaagatg

SEQ ID NO: 91886 - DNA, 103 bp, Artificial Sequence
  Synthetic Polynucleotide
taatacgactcactatagggcaagctctgcgcggctcccagcaaccgcataacagaggagaatgcggatgctgggagccaacctggcggcagcgcaaaagatg

SEQ ID NO: 91887 - DNA, 103 bp, Artificial Sequence
  Synthetic Polynucleotide
taatacgactcactatagggggcggcggcggcggcggcggcagcggcagtaacagaggagaactgccatggccgccgccaacctggcggcagcgcaaaagatg

SEQ ID NO: 91888 - DNA, 103 bp, Artificial Sequence
  Synthetic Polynucleotide
taatacgactcactatagggggctcgggaaggcggcggcggcggcggcggaacagaggagaccgccgatgccgccgccgaacctggcggcagcgcaaaagatg

SEQ ID NO: 91889 - DNA, 103 bp, Artificial Sequence
  Synthetic Polynucleotide
taatacgactcactatagggggcggaggtaggctcgggaaggcggcggcgaacagaggagacgccgcatgcttcccgagaacctggcggcagcgcaaaagatg

SEQ ID NO: 91890 - DNA, 103 bp, Artificial Sequence
  Synthetic Polynucleotide
taatacgactcactatagggcgagcccggaggcggaggtaggctcgggaaaacagaggagattcccgatgctacctccgaacctggcggcagcgcaaaagatg

SEQ ID NO: 91891 - DNA, 103 bp, Artificial Sequence
  Synthetic Polynucleotide
taatacgactcactataggggcaggctggccgagcccggaggcggaggtaaacagaggagatacctcatgctccgggctaacctggcggcagcgcaaaagatg

SEQ ID NO: 91892 - DNA, 103 bp, Artificial Sequence
  Synthetic Polynucleotide
taatacgactcactatagggccgctgggcggcaggctggccgagcccggaaacagaggagatccgggatgggccagcctaacctggcggcagcgcaaaagatg

SEQ ID NO: 91893 - DNA, 103 bp, Artificial Sequence
  Synthetic Polynucleotide
taatacgactcactatagggcagcggcgccccgctgggcggcaggctggcaacagaggagagccagcatgccgcccagcaacctggcggcagcgcaaaagatg

SEQ ID NO: 91894 - DNA, 103 bp, Artificial Sequence
  Synthetic Polynucleotide
taatacgactcactatagggtgctcaggcccagcggcgccccgctgggcgaacagaggagacgcccaatggggcgccgcaacctggcggcagcgcaaaagatg

SEQ ID NO: 91895 - DNA, 103 bp, Artificial Sequence
  Synthetic Polynucleotide
taatacgactcactatagggccgaggaaagtgctcaggcccagcggcgccaacagaggagaggcgccatggggcctgagaacctggcggcagcgcaaaagatg

SEQ ID NO: 91896 - DNA, 103 bp, Artificial Sequence
  Synthetic Polynucleotide
taatacgactcactatagggcactgccgctccgaggaaagtgctcaggccaacagaggagaggcctgatgactttcctcaacctggcggcagcgcaaaagatg

SEQ ID NO: 91897 - DNA, 103 bp, Artificial Sequence
  Synthetic Polynucleotide
taatacgactcactataggggcggagcaggcaagctctgcgcggctcccaaacagaggagatgggagatgcgcagagctaacctggcggcagcgcaaaagatg

SEQ ID NO: 91898 - DNA, 103 bp, Artificial Sequence
  Synthetic Polynucleotide
taatacgactcactatagggggtgtcggaacactgccgctccgaggaaagaacagaggagactttccatggagcggcagaacctggcggcagcgcaaaagatg

SEQ ID NO: 91899 - DNA, 103 bp, Artificial Sequence
  Synthetic Polynucleotide
taatacgactcactatagggatgaaagctgggtgtcggaacactgccgctaacagaggagaagcggcatggttccgacaaacctggcggcagcgcaaaagatg

SEQ ID NO: 91900 - DNA, 103 bp, Artificial Sequence
  Synthetic Polynucleotide
taatacgactcactatagggtgccgggctgatgaaagctgggtgtcggaaaacagaggagattccgaatgccagctttcaacctggcggcagcgcaaaagatg

SEQ ID NO: 91901 - DNA, 103 bp, Artificial Sequence
  Synthetic Polynucleotide
taatacgactcactataggggcctgccgaatgccgggctgatgaaagctgaacagaggagacagcttatgtcagcccggaacctggcggcagcgcaaaagatg

SEQ ID NO: 91902 - DNA, 103 bp, Artificial Sequence
  Synthetic Polynucleotide
taatacgactcactataggggtggaaaagagcctgccgaatgccgggctgaacagaggagacagcccatgattcggcagaacctggcggcagcgcaaaagatg

SEQ ID NO: 91903 - DNA, 103 bp, Artificial Sequence
  Synthetic Polynucleotide
taatacgactcactataggggggggccattgtggaaaagagcctgccgaaaacagaggagattcggcatgctcttttccaacctggcggcagcgcaaaagatg

SEQ ID NO: 91904 - DNA, 103 bp, Artificial Sequence
  Synthetic Polynucleotide
taatacgactcactatagggcgctggtcaggggggccattgtggaaaagaaacagaggagatcttttatgcaatggcccaacctggcggcagcgcaaaagatg

SEQ ID NO: 91905 - DNA, 103 bp, Artificial Sequence
  Synthetic Polynucleotide
taatacgactcactataggggcggtcgacgcgctggtcaggggggccattaacagaggagaaatggcatgcctgaccagaacctggcggcagcgcaaaagatg

SEQ ID NO: 91906 - DNA, 103 bp, Artificial Sequence
  Synthetic Polynucleotide
taatacgactcactataggggagcgcggccgcggtcgacgcgctggtcagaacagaggagactgaccatggcgtcgaccaacctggcggcagcgcaaaagatg

SEQ ID NO: 91907 - DNA, 103 bp, Artificial Sequence
  Synthetic Polynucleotide
taatacgactcactataggggctgtctcaggagcgcggccgcggtcgacgaacagaggagacgtcgaatgcggccgcgcaacctggcggcagcgcaaaagatg

SEQ ID NO: 91908 - DNA, 103 bp, Artificial Sequence
  Synthetic Polynucleotide
taatacgactcactatagggcggctggtcagcggagcaggcaagctctgcaacagaggagagcagagatggcctgctccaacctggcggcagcgcaaaagatg

SEQ ID NO: 91909 - DNA, 103 bp, Artificial Sequence
  Synthetic Polynucleotide
taatacgactcactataggggcgggtgtgggctgtctcaggagcgcggccaacagaggagaggccgcatgcctgagacaaacctggcggcagcgcaaaagatg

SEQ ID NO: 91910 - DNA, 103 bp, Artificial Sequence
  Synthetic Polynucleotide
taatacgactcactataggggccctccacggcgggtgtgggctgtctcagaacagaggagactgagaatgcccacacccaacctggcggcagcgcaaaagatg

SEQ ID NO: 91911 - DNA, 103 bp, Artificial Sequence
  Synthetic Polynucleotide
taatacgactcactatagggatgccactgcgccctccacggcgggtgtggaacagaggagaccacacatgccgtggaggaacctggcggcagcgcaaaagatg

SEQ ID NO: 91912 - DNA, 103 bp, Artificial Sequence
  Synthetic Polynucleotide
taatacgactcactatagggagggcgcccgatgccactgcgccctccacgaacagaggagacgtggaatgcgcagtggcaacctggcggcagcgcaaaagatg

SEQ ID NO: 91913 - DNA, 103 bp, Artificial Sequence
  Synthetic Polynucleotide
taatacgactcactatagggcgggtcggccagggcgcccgatgccactgcaacagaggagagcagtgatgtcgggcgccaacctggcggcagcgcaaaagatg

SEQ ID NO: 91914 - DNA, 103 bp, Artificial Sequence
  Synthetic Polynucleotide
taatacgactcactatagggccgccgtggccgggtcggccagggcgcccgaacagaggagacgggcgatgtggccgaccaacctggcggcagcgcaaaagatg

SEQ ID NO: 91915 - DNA, 103 bp, Artificial Sequence
  Synthetic Polynucleotide
taatacgactcactatagggctgtctgcggccgccgtggccgggtcggccaacagaggagaggccgaatgggccacggcaacctggcggcagcgcaaaagatg

SEQ ID NO: 91916 - DNA, 103 bp, Artificial Sequence
  Synthetic Polynucleotide
taatacgactcactatagggagaggcgcgtctgtctgcggccgccgtggcaacagaggagagccacgatggccgcagacaacctggcggcagcgcaaaagatg

SEQ ID NO: 91917 - DNA, 103 bp, Artificial Sequence
  Synthetic Polynucleotide
taatacgactcactatagggcggctatgctagaggcgcgtctgtctgcggaacagaggagaccgcagatggacgcgcctaacctggcggcagcgcaaaagatg

SEQ ID NO: 91918 - DNA, 103 bp, Artificial Sequence
  Synthetic Polynucleotide
taatacgactcactatagggagcctcagcgcggctatgctagaggcgcgtaacagaggagaacgcgcatgtagcatagcaacctggcggcagcgcaaaagatg

SEQ ID NO: 91919 - DNA, 103 bp, Artificial Sequence
  Synthetic Polynucleotide
taatacgactcactatagggcgggtcggcgcggctggtcagcggagcaggaacagaggagacctgctatgctgaccagcaacctggcggcagcgcaaaagatg

SEQ ID NO: 91920 - DNA, 103 bp, Artificial Sequence
  Synthetic Polynucleotide
taatacgactcactatagggcttggccttgagcctcagcgcggctatgctaacagaggagaagcataatggcgctgaggaacctggcggcagcgcaaaagatg

SEQ ID NO: 91921 - DNA, 103 bp, Artificial Sequence
  Synthetic Polynucleotide
taatacgactcactatagggccgcgtgctccttggccttgagcctcagcgaacagaggagacgctgaatgtcaaggccaaacctggcggcagcgcaaaagatg

SEQ ID NO: 91922 - DNA, 103 bp, Artificial Sequence
  Synthetic Polynucleotide
taatacgactcactataggggtgagctgcgccgcgtgctccttggccttgaacagaggagacaaggcatgggagcacgcaacctggcggcagcgcaaaagatg

SEQ ID NO: 91923 - DNA, 103 bp, Artificial Sequence
  Synthetic Polynucleotide
taatacgactcactataggggttgagctgcgtgagctgcgccgcgtgctcaacagaggagagagcacatggcgcagctcaacctggcggcagcgcaaaagatg

SEQ ID NO: 91924 - DNA, 103 bp, Artificial Sequence
  Synthetic Polynucleotide
taatacgactcactatagggccggcaggatgttgagctgcgtgagctgcgaacagaggagacgcagcatgcgcagctcaaacctggcggcagcgcaaaagatg

SEQ ID NO: 91925 - DNA, 103 bp, Artificial Sequence
  Synthetic Polynucleotide
taatacgactcactataggggtgctggtgcccggcaggatgttgagctgcaacagaggagagcagctatgcatcctgccaacctggcggcagcgcaaaagatg

SEQ ID NO: 91926 - DNA, 103 bp, Artificial Sequence
  Synthetic Polynucleotide
taatacgactcactatagggctccttgcccgtgctggtgcccggcaggataacagaggagaatcctgatgggcaccagcaacctggcggcagcgcaaaagatg

SEQ ID NO: 91927 - DNA, 103 bp, Artificial Sequence
  Synthetic Polynucleotide
taatacgactcactatagggcggccttttccgggtcggcgcggctggtcaaacagaggagatgaccaatggcgccgaccaacctggcggcagcgcaaaagatg

SEQ ID NO: 91928 - DNA, 103 bp, Artificial Sequence
  Synthetic Polynucleotide
taatacgactcactataggggagccttgcacggccttttccgggtcggcgaacagaggagacgccgaatgggaaaaggcaacctggcggcagcgcaaaagatg

SEQ ID NO: 91929 - DNA, 103 bp, Artificial Sequence
  Synthetic Polynucleotide
taatacgactcactataggggctcttaggggagccttgcacggccttttcaacagaggagagaaaagatggtgcaaggcaacctggcggcagcgcaaaagatg

SEQ ID NO: 91930 - DNA, 103 bp, Artificial Sequence
  Synthetic Polynucleotide
taatacgactcactataggggcctctcggagcagccctcctcctggtactaacagaggagaagtaccatgaggagggctaacctggcggcagcgcaaaagatg

SEQ ID NO: 91931 - DNA, 103 bp, Artificial Sequence
  Synthetic Polynucleotide
taatacgactcactataggggggcgctgctgctcttaggggagccttgcaaacagaggagatgcaagatgcccctaagaaacctggcggcagcgcaaaagatg

SEQ ID NO: 91932 - DNA, 103 bp, Artificial Sequence
  Synthetic Polynucleotide
taatacgactcactataggggcctcgaacggggcgctgctgctcttagggaacagaggagaccctaaatgcagcagcgcaacctggcggcagcgcaaaagatg

SEQ ID NO: 91933 - DNA, 103 bp, Artificial Sequence
  Synthetic Polynucleotide
taatacgactcactataggggtgcagctcggcctcgaacggggcgctgctaacagaggagaagcagcatgccgttcgagaacctggcggcagcgcaaaagatg

SEQ ID NO: 91934 - DNA, 103 bp, Artificial Sequence
  Synthetic Polynucleotide
taatacgactcactatagggtgggcggcaggtgcagctcggcctcgaacgaacagaggagacgttcgatgccgagctgcaacctggcggcagcgcaaaagatg

SEQ ID NO: 91935 - DNA, 103 bp, Artificial Sequence
  Synthetic Polynucleotide
taatacgactcactatagggcgccgcagcttgggcggcaggtgcagctcgaacagaggagacgagctatgcctgccgccaacctggcggcagcgcaaaagatg

SEQ ID NO: 91936 - DNA, 103 bp, Artificial Sequence
  Synthetic Polynucleotide
taatacgactcactataggggccgtacaggcgccgcagcttgggcggcagaacagaggagactgccgatgaagctgcggaacctggcggcagcgcaaaagatg

SEQ ID NO: 91937 - DNA, 103 bp, Artificial Sequence
  Synthetic Polynucleotide
taatacgactcactatagggccccgcccgggccgtacaggcgccgcagctaacagaggagaagctgcatggcctgtacgaacctggcggcagcgcaaaagatg

SEQ ID NO: 91938 - DNA, 103 bp, Artificial Sequence
  Synthetic Polynucleotide
taatacgactcactatagggaggaggcggcccccgcccgggccgtacaggaacagaggagacctgtaatgcccgggcggaacctggcggcagcgcaaaagatg

SEQ ID NO: 91939 - DNA, 103 bp, Artificial Sequence
  Synthetic Polynucleotide
taatacgactcactatagggcgcaccctgaaggaggcggcccccgcccggaacagaggagaccgggcatgggccgcctcaacctggcggcagcgcaaaagatg

SEQ ID NO: 91940 - DNA, 103 bp, Artificial Sequence
  Synthetic Polynucleotide
taatacgactcactatagggccgccgctgccgcaccctgaaggaggcggcaacagaggagagccgccatgttcagggtgaacctggcggcagcgcaaaagatg

SEQ ID NO: 91941 - DNA, 103 bp, Artificial Sequence
  Synthetic Polynucleotide
taatacgactcactatagggttgcactcgggcctctcggagcagccctccaacagaggagaggagggatgctccgagagaacctggcggcagcgcaaaagatg

SEQ ID NO: 91942 - DNA, 103 bp, Artificial Sequence
  Synthetic Polynucleotide
taatacgactcactataggggccgccgccgccgccgctgccgcaccctgaaacagaggagatcagggatgggcagcggcaacctggcggcagcgcaaaagatg

SEQ ID NO: 91943 - DNA, 103 bp, Artificial Sequence
  Synthetic Polynucleotide
taatacgactcactatagggcgccgccgccgccgccgccgccgccgctgcaacagaggagagcagcgatggcggcggcgaacctggcggcagcgcaaaagatg

SEQ ID NO: 91944 - DNA, 103 bp, Artificial Sequence
  Synthetic Polynucleotide
taatacgactcactatagggccgctgccgccgccgccgccgccgccgccgaacagaggagacggcggatgcggcggcggaacctggcggcagcgcaaaagatg

SEQ ID NO: 91945 - DNA, 103 bp, Artificial Sequence
  Synthetic Polynucleotide
taatacgactcactataggggccgtggcggccgctgccgccgccgccgccaacagaggagaggcggcatgggcggcagcaacctggcggcagcgcaaaagatg

SEQ ID NO: 91946 - DNA, 103 bp, Artificial Sequence
  Synthetic Polynucleotide
taatacgactcactatagggacccgccgtggccgtggcggccgctgccgcaacagaggagagcggcaatggccgccacgaacctggcggcagcgcaaaagatg

SEQ ID NO: 91947 - DNA, 103 bp, Artificial Sequence
  Synthetic Polynucleotide
taatacgactcactatagggccccgcgtggacccgccgtggccgtggcggaacagaggagaccgccaatgccacggcggaacctggcggcagcgcaaaagatg

SEQ ID NO: 91948 - DNA, 103 bp, Artificial Sequence
  Synthetic Polynucleotide
taatacgactcactatagggggaggggcctccccgcgtggacccgccgtgaacagaggagacacggcatgtccacgcggaacctggcggcagcgcaaaagatg

SEQ ID NO: 91949 - DNA, 103 bp, Artificial Sequence
  Synthetic Polynucleotide
taatacgactcactatagggcggtggcggcggaggggcctccccgcgtggaacagaggagaccacgcatggaggcccctaacctggcggcagcgcaaaagatg

SEQ ID NO: 91950 - DNA, 103 bp, Artificial Sequence
  Synthetic Polynucleotide
taatacgactcactataggggcgcggttggcggtggcggcggaggggcctaacagaggagaaggcccatgcgccgccacaacctggcggcagcgcaaaagatg

SEQ ID NO: 91951 - DNA, 103 bp, Artificial Sequence
  Synthetic Polynucleotide
taatacgactcactatagggtccccgggccgcgcggttggcggtggcggcaacagaggagagccgccatggccaaccgcaacctggcggcagcgcaaaagatg

SEQ ID NO: 91952 - DNA, 103 bp, Artificial Sequence
  Synthetic Polynucleotide
taatacgactcactatagggagatttacttttgcactcgggcctctcggaaacagaggagatccgagatgcccgagtgcaacctggcggcagcgcaaaagatg

SEQ ID NO: 91953 - DNA, 103 bp, Artificial Sequence
  Synthetic Polynucleotide
taatacgactcactataggggtccggccgttccccgggccgcgcggttggaacagaggagaccaaccatgcggcccgggaacctggcggcagcgcaaaagatg

SEQ ID NO: 91954 - DNA, 103 bp, Artificial Sequence
  Synthetic Polynucleotide
taatacgactcactatagggcccctgcgccgtccggccgttccccgggccaacagaggagaggcccgatgaacggccggaacctggcggcagcgcaaaagatg

SEQ ID NO: 91955 - DNA, 103 bp, Artificial Sequence
  Synthetic Polynucleotide
taatacgactcactataggggccgcggcggcccctgcgccgtccggccgtaacagaggagaacggccatgcggcgcaggaacctggcggcagcgcaaaagatg

SEQ ID NO: 91956 - DNA, 103 bp, Artificial Sequence
  Synthetic Polynucleotide
taatacgactcactatagggggccgcggctgccgcggcggcccctgcgccaacagaggagaggcgcaatggccgccgcgaacctggcggcagcgcaaaagatg

SEQ ID NO: 91957 - DNA, 103 bp, Artificial Sequence
  Synthetic Polynucleotide
taatacgactcactatagggcggcggccgcggccgcggctgccgcggcggaacagaggagaccgccgatgcagccgcggaacctggcggcagcgcaaaagatg

SEQ ID NO: 91958 - DNA, 103 bp, Artificial Sequence
  Synthetic Polynucleotide
taatacgactcactatagggtcccaggccgcggcggccgcggccgcggctaacagaggagaagccgcatgcgcggccgcaacctggcggcagcgcaaaagatg

SEQ ID NO: 91959 - DNA, 103 bp, Artificial Sequence
  Synthetic Polynucleotide
taatacgactcactatagggcttgagcgtgtcccaggccgcggcggccgcaacagaggagagcggccatggcggcctggaacctggcggcagcgcaaaagatg

SEQ ID NO: 91960 - DNA, 103 bp, Artificial Sequence
  Synthetic Polynucleotide
taatacgactcactatagggcctggctgatcttgagcgtgtcccaggccgaacagaggagacggcctatgacacgctcaaacctggcggcagcgcaaaagatg

SEQ ID NO: 91961 - DNA, 103 bp, Artificial Sequence
  Synthetic Polynucleotide
taatacgactcactatagggacctgcggcgcctggctgatcttgagcgtgaacagaggagacacgctatggatcagccaaacctggcggcagcgcaaaagatg

SEQ ID NO: 91962 - DNA, 103 bp, Artificial Sequence
  Synthetic Polynucleotide
taatacgactcactataggggctgatgctcacctgcggcgcctggctgataacagaggagaatcagcatggcgccgcagaacctggcggcagcgcaaaagatg

SEQ ID NO: 91963 - DNA, 103 bp, Artificial Sequence
  Synthetic Polynucleotide
taatacgactcactataggggcaaagttggagatttacttttgcactcggaacagaggagaccgagtatgaaagtaaataacctggcggcagcgcaaaagatg

SEQ ID NO: 91964 - DNA, 103 bp, Artificial Sequence
  Synthetic Polynucleotide
taatacgactcactatagggacttgctgcggctgatgctcacctgcggcgaacagaggagacgccgcatgtgagcatcaaacctggcggcagcgcaaaagatg

SEQ ID NO: 91965 - DNA, 103 bp, Artificial Sequence
  Synthetic Polynucleotide
taatacgactcactatagggtcgcggtacgacttgctgcggctgatgctcaacagaggagagagcatatgccgcagcaaaacctggcggcagcgcaaaagatg

SEQ ID NO: 91966 - DNA, 103 bp, Artificial Sequence
  Synthetic Polynucleotide
taatacgactcactatagggcgccccgttctcgcggtacgacttgctgcgaacagaggagacgcagcatgtcgtaccgcaacctggcggcagcgcaaaagatg

SEQ ID NO: 91967 - DNA, 103 bp, Artificial Sequence
  Synthetic Polynucleotide
taatacgactcactataggggcacgaagggcgccccgttctcgcggtacgaacagaggagacgtaccatgagaacggggaacctggcggcagcgcaaaagatg

SEQ ID NO: 91968 - DNA, 103 bp, Artificial Sequence
  Synthetic Polynucleotide
taatacgactcactatagggggcggcggcggcacgaagggcgccccgttcaacagaggagagaacggatggcccttcgtaacctggcggcagcgcaaaagatg

SEQ ID NO: 91969 - DNA, 103 bp, Artificial Sequence
  Synthetic Polynucleotide
taatacgactcactataggggtccagcgcgggcggcggcggcacgaagggaacagaggagacccttcatgccgccgccgaacctggcggcagcgcaaaagatg

SEQ ID NO: 91970 - DNA, 103 bp, Artificial Sequence
  Synthetic Polynucleotide
taatacgactcactatagggcgcccagctcgtccagcgcgggcggcggcgaacagaggagacgccgcatgccgcgctggaacctggcggcagcgcaaaagatg

SEQ ID NO: 91971 - DNA, 103 bp, Artificial Sequence
  Synthetic Polynucleotide
taatacgactcactatagggccccccgggccgcccagctcgtccagcgcgaacagaggagacgcgctatgcgagctgggaacctggcggcagcgcaaaagatg

SEQ ID NO: 91972 - DNA, 103 bp, Artificial Sequence
  Synthetic Polynucleotide
taatacgactcactataggggtgcgtgacgccccccgggccgcccagctcaacagaggagagagctgatgggcccggggaacctggcggcagcgcaaaagatg

SEQ ID NO: 91973 - DNA, 103 bp, Artificial Sequence
  Synthetic Polynucleotide
taatacgactcactataggggctcctccgggtgcgtgacgccccccgggcaacagaggagagcccggatggcgtcacgcaacctggcggcagcgcaaaagatg

SEQ ID NO: 91974 - DNA, 103 bp, Artificial Sequence
  Synthetic Polynucleotide
taatacgactcactatagggtaggaggagagcaaagttggagatttacttaacagaggagaaagtaaatgtccaactttaacctggcggcagcgcaaaagatg

SEQ ID NO: 91975 - DNA, 103 bp, Artificial Sequence
  Synthetic Polynucleotide
taatacgactcactatagggacgccgaggcgctcctccgggtgcgtgacgaacagaggagacgtcacatgcccggaggaaacctggcggcagcgcaaaagatg

SEQ ID NO: 91976 - DNA, 103 bp, Artificial Sequence
  Synthetic Polynucleotide
taatacgactcactataggggccgccggccacgccgaggcgctcctccggaacagaggagaccggagatgcgcctcggcaacctggcggcagcgcaaaagatg

SEQ ID NO: 91977 - DNA, 103 bp, Artificial Sequence
  Synthetic Polynucleotide
taatacgactcactatagggcgctgcccgggccgccggccacgccgaggcaacagaggagagcctcgatgtggccggcgaacctggcggcagcgcaaaagatg

SEQ ID NO: 91978 - DNA, 103 bp, Artificial Sequence
  Synthetic Polynucleotide
taatacgactcactataggggcagccggggcgctgcccgggccgccggccaacagaggagaggccggatgcccgggcagaacctggcggcagcgcaaaagatg

SEQ ID NO: 91979 - DNA, 103 bp, Artificial Sequence
  Synthetic Polynucleotide
taatacgactcactataggggccaccacccgcagccggggcgctgcccggaacagaggagaccgggcatggccccggctaacctggcggcagcgcaaaagatg

SEQ ID NO: 91980 - DNA, 103 bp, Artificial Sequence
  Synthetic Polynucleotide
taatacgactcactatagggcggtgccggtgccaccacccgcagccggggaacagaggagaccccggatgcgggtggtgaacctggcggcagcgcaaaagatg

SEQ ID NO: 91981 - DNA, 103 bp, Artificial Sequence
  Synthetic Polynucleotide
taatacgactcactatagggtcgtcgtcctcggtgccggtgccaccacccaacagaggagagggtggatgcaccggcacaacctggcggcagcgcaaaagatg

SEQ ID NO: 91982 - DNA, 103 bp, Artificial Sequence
  Synthetic Polynucleotide
taatacgactcactatagggcagctcctcctcgtcgtcctcggtgccggtaacagaggagaaccggcatggaggacgacaacctggcggcagcgcaaaagatg

SEQ ID NO: 91983 - DNA, 103 bp, Artificial Sequence
  Synthetic Polynucleotide
taatacgactcactatagggcgtcctccagcagctcctcctcgtcgtcctaacagaggagaaggacgatgaggaggagcaacctggcggcagcgcaaaagatg

SEQ ID NO: 91984 - DNA, 103 bp, Artificial Sequence
  Synthetic Polynucleotide
taatacgactcactatagggtcatcttcttcgtcctccagcagctcctccaacagaggagaggaggaatggctggaggaaacctggcggcagcgcaaaagatg

SEQ ID NO: 91985 - DNA, 103 bp, Artificial Sequence
  Synthetic Polynucleotide
taatacgactcactataggggtcgatgcagtaggaggagagcaaagttggaacagaggagaccaactatgctctcctccaacctggcggcagcgcaaaagatg

SEQ ID NO: 91986 - DNA, 103 bp, Artificial Sequence
  Synthetic Polynucleotide
taatacgactcactatagggttcctcgtcctcatcttcttcgtcctccagaacagaggagactggagatggaagaagataacctggcggcagcgcaaaagatg

SEQ ID NO: 91987 - DNA, 103 bp, Artificial Sequence
  Synthetic Polynucleotide
taatacgactcactataggggcagttcctcttcctcgtcctcatcttcttaacagaggagaaagaagatgaggacgaggaacctggcggcagcgcaaaagatg

SEQ ID NO: 91988 - DNA, 103 bp, Artificial Sequence
  Synthetic Polynucleotide
taatacgactcactatagggtcgtcctccagcagttcctcttcctcgtccaacagaggagaggacgaatgagaggaactaacctggcggcagcgcaaaagatg

SEQ ID NO: 91989 - DNA, 103 bp, Artificial Sequence
  Synthetic Polynucleotide
taatacgactcactatagggctcctcctcgtcgtcctccagcagttcctcaacagaggagagaggaaatgctggaggacaacctggcggcagcgcaaaagatg

SEQ ID NO: 91990 - DNA, 103 bp, Artificial Sequence
  Synthetic Polynucleotide
taatacgactcactatagggcctccagcagctcctcctcgtcgtcctccaaacagaggagatggaggatgacgaggaggaacctggcggcagcgcaaaagatg

SEQ ID NO: 91991 - DNA, 103 bp, Artificial Sequence
  Synthetic Polynucleotide
taatacgactcactatagggcgggcgtcgtcctccagcagctcctcctcgaacagaggagacgaggaatggctgctggaaacctggcggcagcgcaaaagatg

SEQ ID NO: 91992 - DNA, 103 bp, Artificial Sequence
  Synthetic Polynucleotide
taatacgactcactataggggagcagcgcgcgggcgtcgtcctccagcagaacagaggagactgctgatggacgacgccaacctggcggcagcgcaaaagatg

SEQ ID NO: 91993 - DNA, 103 bp, Artificial Sequence
  Synthetic Polynucleotide
taatacgactcactatagggggggctccttgagcagcgcgcgggcgtcgtaacagaggagaacgacgatggcgcgctgcaacctggcggcagcgcaaaagatg

SEQ ID NO: 91994 - DNA, 103 bp, Artificial Sequence
  Synthetic Polynucleotide
taatacgactcactatagggggacagcgccggggctccttgagcagcgcgaacagaggagacgcgctatgcaaggagccaacctggcggcagcgcaaaagatg

SEQ ID NO: 91995 - DNA, 103 bp, Artificial Sequence
  Synthetic Polynucleotide
taatacgactcactatagggggcggccacaggacagcgccggggctccttaacagaggagaaaggagatgcggcgctgtaacctggcggcagcgcaaaagatg

SEQ ID NO: 91996 - DNA, 103 bp, Artificial Sequence
  Synthetic Polynucleotide
taatacgactcactatagggccaggatgctgtcgatgcagtaggaggagaaacagaggagatctcctatgactgcatcgaacctggcggcagcgcaaaagatg

SEQ ID NO: 91997 - DNA, 103 bp, Artificial Sequence
  Synthetic Polynucleotide
taatacgactcactatagggcggcgccagtggcggccacaggacagcgccaacagaggagaggcgctatgctgtggccgaacctggcggcagcgcaaaagatg

SEQ ID NO: 91998 - DNA, 103 bp, Artificial Sequence
  Synthetic Polynucleotide
taatacgactcactataggggctgcggccacggcgccagtggcggccacaaacagaggagatgtggcatgcactggcgcaacctggcggcagcgcaaaagatg

SEQ ID NO: 91999 - DNA, 103 bp, Artificial Sequence
  Synthetic Polynucleotide
taatacgactcactatagggagcggcagctgctgcggccacggcgccagtaacagaggagaactggcatggtggccgcaaacctggcggcagcgcaaaagatg

SEQ ID NO: 92000 - DNA, 103 bp, Artificial Sequence
  Synthetic Polynucleotide
taatacgactcactatagggtggccactgcagcggcagctgctgcggccaaacagaggagatggccgatgcagctgccgaacctggcggcagcgcaaaagatg

SEQ ID NO: 92001 - DNA, 103 bp, Artificial Sequence
  Synthetic Polynucleotide
taatacgactcactatagggccgccctctgtggccactgcagcggcagctaacagaggagaagctgcatgtgcagtggcaacctggcggcagcgcaaaagatg

SEQ ID NO: 92002 - DNA, 103 bp, Artificial Sequence
  Synthetic Polynucleotide
taatacgactcactatagggtgacagctccccgccctctgtggccactgcaacagaggagagcagtgatgacagagggcaacctggcggcagcgcaaaagatg

SEQ ID NO: 92003 - DNA, 103 bp, Artificial Sequence
  Synthetic Polynucleotide
taatacgactcactatagggcctccttgggtgacagctccccgccctctgaacagaggagacagaggatggggagctgtaacctggcggcagcgcaaaagatg

SEQ ID NO: 92004 - DNA, 103 bp, Artificial Sequence
  Synthetic Polynucleotide
taatacgactcactatagggagcagcagctcctccttgggtgacagctccaacagaggagaggagctatgacccaaggaaacctggcggcagcgcaaaagatg

SEQ ID NO: 92005 - DNA, 103 bp, Artificial Sequence
  Synthetic Polynucleotide
taatacgactcactatagggttccgggtgcagcagcagctcctccttgggaacagaggagacccaagatggagctgctgaacctggcggcagcgcaaaagatg

SEQ ID NO: 92006 - DNA, 103 bp, Artificial Sequence
  Synthetic Polynucleotide
taatacgactcactatagggcctcagcgtcttccgggtgcagcagcagctaacagaggagaagctgcatgtgcacccggaacctggcggcagcgcaaaagatg

SEQ ID NO: 92007 - DNA, 103 bp, Artificial Sequence
  Synthetic Polynucleotide
taatacgactcactatagggctcctccggcccaggatgctgtcgatgcagaacagaggagactgcatatgcagcatcctaacctggcggcagcgcaaaagatg

SEQ ID NO: 92008 - DNA, 103 bp, Artificial Sequence
  Synthetic Polynucleotide
taatacgactcactatagggccgtccttgccctcagcgtcttccgggtgcaacagaggagagcacccatgagacgctgaaacctggcggcagcgcaaaagatg

SEQ ID NO: 92009 - DNA, 103 bp, Artificial Sequence
  Synthetic Polynucleotide
taatacgactcactataggggctgtcctcgccgtccttgccctcagcgtcaacagaggagagacgctatgggcaaggacaacctggcggcagcgcaaaagatg

SEQ ID NO: 92010 - DNA, 103 bp, Artificial Sequence
  Synthetic Polynucleotide
taatacgactcactatagggagaggcacacgctgtcctcgccgtccttgcaacagaggagagcaaggatggcgaggacaaacctggcggcagcgcaaaagatg

SEQ ID NO: 92011 - DNA, 103 bp, Artificial Sequence
  Synthetic Polynucleotide
taatacgactcactatagggctgcccgcagagaggcacacgctgtcctcgaacagaggagacgaggaatgcgtgtgcctaacctggcggcagcgcaaaagatg

SEQ ID NO: 92012 - DNA, 103 bp, Artificial Sequence
  Synthetic Polynucleotide
taatacgactcactatagggctccgagtcgctgcccgcagagaggcacacaacagaggagagtgtgcatgtctgcgggcaacctggcggcagcgcaaaagatg

SEQ ID NO: 92013 - DNA, 103 bp, Artificial Sequence
  Synthetic Polynucleotide
taatacgactcactataggggcagcccctcctccgagtcgctgcccgcagaacagaggagactgcggatggcgactcggaacctggcggcagcgcaaaagatg

SEQ ID NO: 92014 - DNA, 103 bp, Artificial Sequence
  Synthetic Polynucleotide
taatacgactcactatagggttgcgtttcagcagcccctcctccgagtcgaacagaggagacgactcatgggaggggctaacctggcggcagcgcaaaagatg

SEQ ID NO: 92015 - DNA, 103 bp, Artificial Sequence
  Synthetic Polynucleotide
taatacgactcactataggggcgcctctgtttgcgtttcagcagcccctcaacagaggagagaggggatgctgaaacgcaacctggcggcagcgcaaaagatg

SEQ ID NO: 92016 - DNA, 103 bp, Artificial Sequence
  Synthetic Polynucleotide
taatacgactcactatagggtggtgcggtagcgcctctgtttgcgtttcaaacagaggagatgaaacatgaacagaggcaacctggcggcagcgcaaaagatg

SEQ ID NO: 92017 - DNA, 103 bp, Artificial Sequence
  Synthetic Polynucleotide
taatacgactcactatagggctggtgaacgtggtgcggtagcgcctctgtaacagaggagaacagagatgctaccgcacaacctggcggcagcgcaaaagatg

SEQ ID NO: 92018 - DNA, 103 bp, Artificial Sequence
  Synthetic Polynucleotide
taatacgactcactataggggccgctctccatcttggcagagctttccataacagaggagaatggaaatgtctgccaagaacctggcggcagcgcaaaagatg

SEQ ID NO: 92019 - DNA, 103 bp, Artificial Sequence
  Synthetic Polynucleotide
taatacgactcactatagggggccgccgcggctgcggccgtggcaaagaaaacagaggagattctttatgacggccgcaaacctggcggcagcgcaaaagatg

SEQ ID NO: 92020 - DNA, 103 bp, Artificial Sequence
  Synthetic Polynucleotide
taatacgactcactatagggcggcggctgcggccgccgcggctgcggccgaacagaggagacggccgatgccgcggcggaacctggcggcagcgcaaaagatg

SEQ ID NO: 92021 - DNA, 103 bp, Artificial Sequence
  Synthetic Polynucleotide
taatacgactcactataggggctgccgctgcggcggctgcggccgccgcgaacagaggagacgcggcatgcgcagccgcaacctggcggcagcgcaaaagatg

SEQ ID NO: 92022 - DNA, 103 bp, Artificial Sequence
  Synthetic Polynucleotide
taatacgactcactatagggcgcgctctgcgctgccgctgcggcggctgcaacagaggagagcagccatggcagcggcaaacctggcggcagcgcaaaagatg

SEQ ID NO: 92023 - DNA, 103 bp, Artificial Sequence
  Synthetic Polynucleotide
taatacgactcactataggggctgctgctgcgcgctctgcgctgccgctgaacagaggagacagcggatgcgcagagcgaacctggcggcagcgcaaaagatg

SEQ ID NO: 92024 - DNA, 103 bp, Artificial Sequence
  Synthetic Polynucleotide
taatacgactcactatagggtgctgctgctgctgctgctgcgcgctctgcaacagaggagagcagagatggcagcagcaaacctggcggcagcgcaaaagatg

SEQ ID NO: 92025 - DNA, 103 bp, Artificial Sequence; identical to SEQ ID NO: 88564
  Synthetic Polynucleotide

SEQ ID NO: 92026 - DNA, 103 bp, Artificial Sequence
  Synthetic Polynucleotide
taatacgactcactataggggcgcctgctgctgctgctgctgctgctgctaacagaggagaagcagcatgagcagcagcaacctggcggcagcgcaaaagatg

SEQ ID NO: 92027 - DNA, 103 bp, Artificial Sequence
  Synthetic Polynucleotide
taatacgactcactatagggctcagctgcggcgcctgctgctgctgctgcaacagaggagagcagcaatggcagcaggcaacctggcggcagcgcaaaagatg

SEQ ID NO: 92028 - DNA, 103 bp, Artificial Sequence
  Synthetic Polynucleotide
taatacgactcactatagggggccgccggtctcagctgcggcgcctgctgaacagaggagacagcagatgccgcagctgaacctggcggcagcgcaaaagatg

SEQ ID NO: 92029 - DNA, 103 bp, Artificial Sequence
  Synthetic Polynucleotide
taatacgactcactatagggggccggcgccgccgctctccatcttggcagaacagaggagactgccaatgtggagagcgaacctggcggcagcgcaaaagatg

SEQ ID NO: 92030 - DNA, 103 bp, Artificial Sequence
  Synthetic Polynucleotide
taatacgactcactataggggctggccgtcggccgccggtctcagctgcgaacagaggagacgcagcatggaccggcggaacctggcggcagcgcaaaagatg

SEQ ID NO: 92031 - DNA, 103 bp, Artificial Sequence
  Synthetic Polynucleotide
taatacgactcactatagggccccctgagggctggccgtcggccgccggtaacagaggagaaccggcatgcgacggccaaacctggcggcagcgcaaaagatg

SEQ ID NO: 92032 - DNA, 103 bp, Artificial Sequence
  Synthetic Polynucleotide
taatacgactcactatagggcttgtgaccgccccctgagggctggccgtcaacagaggagagacggcatgccctcagggaacctggcggcagcgcaaaagatg

SEQ ID NO: 92033 - DNA, 103 bp, Artificial Sequence
  Synthetic Polynucleotide
taatacgactcactatagggtgggcgctgacttgtgaccgccccctgaggaacagaggagacctcagatggcggtcacaaacctggcggcagcgcaaaagatg

SEQ ID NO: 92034 - DNA, 103 bp, Artificial Sequence
  Synthetic Polynucleotide
taatacgactcactatagggttgacttgcttgggcgctgacttgtgaccgaacagaggagacggtcaatggtcagcgccaacctggcggcagcgcaaaagatg

SEQ ID NO: 92035 - DNA, 103 bp, Artificial Sequence
  Synthetic Polynucleotide
taatacgactcactataggggcgctgtcgcttgacttgcttgggcgctgaaacagaggagatcagcgatgaagcaagtcaacctggcggcagcgcaaaagatg

SEQ ID NO: 92036 - DNA, 103 bp, Artificial Sequence
  Synthetic Polynucleotide
taatacgactcactataggggcgaagacgagcgctgtcgcttgacttgctaacagaggagaagcaagatgagcgacagcaacctggcggcagcgcaaaagatg

SEQ ID NO: 92037 - DNA, 103 bp, Artificial Sequence
  Synthetic Polynucleotide
taatacgactcactatagggatcagttcgggcgaagacgagcgctgtcgcaacagaggagagcgacaatgctcgtcttcaacctggcggcagcgcaaaagatg

SEQ ID NO: 92038 - DNA, 103 bp, Artificial Sequence
  Synthetic Polynucleotide
taatacgactcactatagggtttgcagcgcatcagttcgggcgaagacgaaacagaggagatcgtctatgcccgaactgaacctggcggcagcgcaaaagatg

SEQ ID NO: 92039 - DNA, 103 bp, Artificial Sequence
  Synthetic Polynucleotide
taatacgactcactatagggtgagccggcgtttgcagcgcatcagttcggaacagaggagaccgaacatgtgcgctgcaaacctggcggcagcgcaaaagatg

SEQ ID NO: 92040 - DNA, 103 bp, Artificial Sequence
  Synthetic Polynucleotide
taatacgactcactatagggtggggctgctggccggcgccgccgctctccaacagaggagaggagagatgcggcgccggaacctggcggcagcgcaaaagatg

SEQ ID NO: 92041 - DNA, 103 bp, Artificial Sequence
  Synthetic Polynucleotide
taatacgactcactatagggccgctgaagttgagccggcgtttgcagcgcaacagaggagagcgctgatgacgccggctaacctggcggcagcgcaaaagatg

SEQ ID NO: 92042 - DNA, 103 bp, Artificial Sequence
  Synthetic Polynucleotide
taatacgactcactataggggtagccaaagccgctgaagttgagccggcgaacagaggagacgccggatgaacttcagcaacctggcggcagcgcaaaagatg

SEQ ID NO: 92043 - DNA, 103 bp, Artificial Sequence
  Synthetic Polynucleotide
taatacgactcactataggggcggcaggctgtagccaaagccgctgaagtaacagaggagaacttcaatggctttggctaacctggcggcagcgcaaaagatg

SEQ ID NO: 92044 - DNA, 103 bp, Artificial Sequence
  Synthetic Polynucleotide
taatacgactcactatagggggctgctgctgcggcaggctgtagccaaagaacagaggagactttggatgcagcctgccaacctggcggcagcgcaaaagatg

SEQ ID NO: 92045 - DNA, 103 bp, Artificial Sequence
  Synthetic Polynucleotide
taatacgactcactatagggcacggcggccggctgctgctgcggcaggctaacagaggagaagcctgatgcagcagcagaacctggcggcagcgcaaaagatg

SEQ ID NO: 92046 - DNA, 103 bp, Artificial Sequence
  Synthetic Polynucleotide
taatacgactcactatagggtgcggcgcgccacggcggccggctgctgctaacagaggagaagcagcatgcggccgccgaacctggcggcagcgcaaaagatg

SEQ ID NO: 92047 - DNA, 103 bp, Artificial Sequence
  Synthetic Polynucleotide
taatacgactcactatagggtcgcgctcgttgcggcgcgccacggcggccaacagaggagaggccgcatgggcgcgccgaacctggcggcagcgcaaaagatg

SEQ ID NO: 92048 - DNA, 103 bp, Artificial Sequence
  Synthetic Polynucleotide
taatacgactcactataggggcggttgcgctcgcgctcgttgcggcgcgcaacagaggagagcgcgcatgaacgagcgcaacctggcggcagcgcaaaagatg

SEQ ID NO: 92049 - DNA, 103 bp, Artificial Sequence
  Synthetic Polynucleotide
taatacgactcactatagggccaacttgacgcggttgcgctcgcgctcgtaacagaggagaacgagcatgagcgcaaccaacctggcggcagcgcaaaagatg

SEQ ID NO: 92050 - DNA, 103 bp, Artificial Sequence
  Synthetic Polynucleotide
taatacgactcactatagggcccaggttgaccaacttgacgcggttgcgcaacagaggagagcgcaaatgcgtcaagttaacctggcggcagcgcaaaagatg

SEQ ID NO: 92051 - DNA, 103 bp, Artificial Sequence
  Synthetic Polynucleotide
taatacgactcactataggggggctgcggctggggctgctggccggcgccaacagaggagaggcgccatgcagcagcccaacctggcggcagcgcaaaagatg

SEQ ID NO: 92052 - DNA, 103 bp, Artificial Sequence
  Synthetic Polynucleotide
taatacgactcactatagggggtggcaaagcccaggttgaccaacttgacaacagaggagagtcaagatggtcaacctgaacctggcggcagcgcaaaagatg

SEQ ID NO: 92053 - DNA, 103 bp, Artificial Sequence
  Synthetic Polynucleotide
taatacgactcactataggggctcccgaagggtggcaaagcccaggttgaaacagaggagatcaaccatggctttgccaaacctggcggcagcgcaaaagatg

SEQ ID NO: 92054 - DNA, 103 bp, Artificial Sequence
  Synthetic Polynucleotide
taatacgactcactatagggttggggacgtgctcccgaagggtggcaaagaacagaggagactttgcatgccttcgggaaacctggcggcagcgcaaaagatg

SEQ ID NO: 92055 - DNA, 103 bp, Artificial Sequence
  Synthetic Polynucleotide
taatacgactcactatagggggccgcgccgttggggacgtgctcccgaagaacagaggagacttcggatgcacgtccccaacctggcggcagcgcaaaagatg

SEQ ID NO: 92056 - DNA, 103 bp, Artificial Sequence
  Synthetic Polynucleotide
taatacgactcactatagggtcttcttgttggccgcgccgttggggacgtaacagaggagaacgtccatgacggcgcggaacctggcggcagcgcaaaagatg

SEQ ID NO: 92057 - DNA, 103 bp, Artificial Sequence
  Synthetic Polynucleotide
taatacgactcactatagggaccttactcatcttcttgttggccgcgccgaacagaggagacggcgcatgcaacaagaaaacctggcggcagcgcaaaagatg

SEQ ID NO: 92058 - DNA, 103 bp, Artificial Sequence
  Synthetic Polynucleotide
taatacgactcactatagggcagtgtctccaccttactcatcttcttgttaacagaggagaaacaagatgatgagtaagaacctggcggcagcgcaaaagatg

SEQ ID NO: 92059 - DNA, 103 bp, Artificial Sequence
  Synthetic Polynucleotide
taatacgactcactatagggccgccgagcgcagtgtctccaccttactcaaacagaggagatgagtaatgtggagacacaacctggcggcagcgcaaaagatg

SEQ ID NO: 92060 - DNA, 103 bp, Artificial Sequence
  Synthetic Polynucleotide
taatacgactcactatagggatgtactcgaccgccgagcgcagtgtctccaacagaggagaggagacatggcgctcggcaacctggcggcagcgcaaaagatg

SEQ ID NO: 92061 - DNA, 103 bp, Artificial Sequence
  Synthetic Polynucleotide
taatacgactcactatagggcagcgcgcggatgtactcgaccgccgagcgaacagaggagacgctcgatggtcgagtacaacctggcggcagcgcaaaagatg

SEQ ID NO: 92062 - DNA, 103 bp, Artificial Sequence
  Synthetic Polynucleotide
taatacgactcactatagggagggctgctggggctgcggctggggctgctaacagaggagaagcagcatgagccgcagcaacctggcggcagcgcaaaagatg

SEQ ID NO: 92063 - DNA, 103 bp, Artificial Sequence
  Synthetic Polynucleotide
taatacgactcactataggggcagctgctgcagcgcgcggatgtactcgaaacagaggagatcgagtatgtccgcgcgcaacctggcggcagcgcaaaagatg

SEQ ID NO: 92064 - DNA, 103 bp, Artificial Sequence
  Synthetic Polynucleotide
taatacgactcactatagggtgctcgtccagcagctgctgcagcgcgcggaacagaggagaccgcgcatggcagcagctaacctggcggcagcgcaaaagatg

SEQ ID NO: 92065 - DNA, 103 bp, Artificial Sequence
  Synthetic Polynucleotide
taatacgactcactatagggcaccgcgtcatgctcgtccagcagctgctgaacagaggagacagcagatgctggacgagaacctggcggcagcgcaaaagatg

SEQ ID NO: 92066 - DNA, 103 bp, Artificial Sequence
  Synthetic Polynucleotide
taatacgactcactatagggaggcggcgctcaccgcgtcatgctcgtccaaacagaggagatggacgatgatgacgcggaacctggcggcagcgcaaaagatg

SEQ ID NO: 92067 - DNA, 103 bp, Artificial Sequence
  Synthetic Polynucleotide
taatacgactcactatagggcctgcctggaaggcggcgctcaccgcgtcaaacagaggagatgacgcatggagcgccgcaacctggcggcagcgcaaaagatg

SEQ ID NO: 92068 - DNA, 103 bp, Artificial Sequence
  Synthetic Polynucleotide
taatacgactcactatagggcgacaggacgcctgcctggaaggcggcgctaacagaggagaagcgccatgttccaggcaaacctggcggcagcgcaaaagatg

SEQ ID NO: 92069 - DNA, 103 bp, Artificial Sequence
  Synthetic Polynucleotide
taatacgactcactatagggagatggtgggcgacaggacgcctgcctggaaacagaggagatccaggatggcgtcctgtaacctggcggcagcgcaaaagatg

SEQ ID NO: 92070 - DNA, 103 bp, Artificial Sequence
  Synthetic Polynucleotide
taatacgactcactatagggtagttgggggagatggtgggcgacaggacgaacagaggagacgtcctatggcccaccataacctggcggcagcgcaaaagatg

SEQ ID NO: 92071 - DNA, 103 bp, Artificial Sequence
  Synthetic Polynucleotide
taatacgactcactataggggtcgttggagtagttgggggagatggtgggaacagaggagacccaccatgtcccccaacaacctggcggcagcgcaaaagatg

SEQ ID NO: 92072 - DNA, 103 bp, Artificial Sequence
  Synthetic Polynucleotide
taatacgactcactatagggtggagttcaagtcgttggagtagttgggggaacagaggagacccccaatgactccaacgaacctggcggcagcgcaaaagatg

SEQ ID NO: 92073 - DNA, 103 bp, Artificial Sequence
  Synthetic Polynucleotide
taatacgactcactatagggggcggcaggaagggctgctggggctgcggcaacagaggagagccgcaatgccagcagccaacctggcggcagcgcaaaagatg

SEQ ID NO: 92074 - DNA, 103 bp, Artificial Sequence
  Synthetic Polynucleotide
taatacgactcactataggggagccggccatggagttcaagtcgttggagaacagaggagactccaaatgcttgaactcaacctggcggcagcgcaaaagatg

SEQ ID NO: 92075 - DNA, 103 bp, Artificial Sequence
  Synthetic Polynucleotide
taatacgactcactatagggtgagaccggcgagccggccatggagttcaaaacagaggagattgaacatgatggccggcaacctggcggcagcgcaaaagatg

SEQ ID NO: 92076 - DNA, 103 bp, Artificial Sequence
  Synthetic Polynucleotide
taatacgactcactatagggacgagtaggatgagaccggcgagccggccaaacagaggagatggccgatgcgccggtctaacctggcggcagcgcaaaagatg

SEQ ID NO: 92077 - DNA, 103 bp, Artificial Sequence
  Synthetic Polynucleotide
taatacgactcactatagggccctcgtccgacgagtaggatgagaccggcaacagaggagagccggtatgatcctactcaacctggcggcagcgcaaaagatg

SEQ ID NO: 92078 - DNA, 103 bp, Artificial Sequence
  Synthetic Polynucleotide
taatacgactcactataggggtcgtaagagccctcgtccgacgagtaggaaacagaggagatcctacatgtcggacgagaacctggcggcagcgcaaaagatg

SEQ ID NO: 92079 - DNA, 103 bp, Artificial Sequence
  Synthetic Polynucleotide
taatacgactcactatagggggctgagcgggtcgtaagagccctcgtccgaacagaggagacggacgatggctcttacgaacctggcggcagcgcaaaagatg

SEQ ID NO: 92080 - DNA, 103 bp, Artificial Sequence
  Synthetic Polynucleotide
taatacgactcactatagggtgctcctcggggctgagcgggtcgtaagagaacagaggagactcttaatgcccgctcagaacctggcggcagcgcaaaagatg

SEQ ID NO: 92081 - DNA, 103 bp, Artificial Sequence
  Synthetic Polynucleotide
taatacgactcactataggggagaagctcctgctcctcggggctgagcggaacagaggagaccgctcatgcccgaggagaacctggcggcagcgcaaaagatg

SEQ ID NO: 92082 - DNA, 103 bp, Artificial Sequence
  Synthetic Polynucleotide
taatacgactcactatagggtggtgaagtcgagaagctcctgctcctcggaacagaggagaccgaggatgaggagcttcaacctggcggcagcgcaaaagatg

SEQ ID NO: 92083 - DNA, 103 bp, Artificial Sequence
  Synthetic Polynucleotide
taatacgactcactatagggcagaaccagttggtgaagtcgagaagctccaacagaggagaggagctatgcgacttcacaacctggcggcagcgcaaaagatg

SEQ ID NO: 92084 - DNA, 103 bp, Artificial Sequence
  Synthetic Polynucleotide
taatacgactcactatagggacaggctgcgggcggcaggaagggctgctgaacagaggagacagcagatgttcctgccgaacctggcggcagcgcaaaagatg

SEQ ID NO: 92085 - DNA, 103 bp, Artificial Sequence
  Synthetic Polynucleotide
taatacgactcactatagggtggcaaagaaacaggctgcgggcggcaggaaacagaggagatcctgcatgccgcagcctaacctggcggcagcgcaaaagatg

SEQ ID NO: 92086 - DNA, 103 bp, Artificial Sequence
  Synthetic Polynucleotide
taatacgactcactataggggctgcggccgtggcaaagaaacaggctgcgaacagaggagacgcagcatgtttctttgcaacctggcggcagcgcaaaagatg

SEQ ID NO: 92087 - DNA, 103 bp, Artificial Sequence
  Synthetic Polynucleotide
taatacgactcactatagggcgcggacctgggcagtgtgccgccgtccataacagaggagaatggacatgggcacactgaacctggcggcagcgcaaaagatg

SEQ ID NO: 92088 - DNA, 103 bp, Artificial Sequence
  Synthetic Polynucleotide
taatacgactcactatagggcggtcgccgccgccggctgcagcgcaacagaacagaggagactgttgatgtgcagccggaacctggcggcagcgcaaaagatg

SEQ ID NO: 92089 - DNA, 103 bp, Artificial Sequence
  Synthetic Polynucleotide
taatacgactcactatagggctgcggtggccggtcgccgccgccggctgcaacagaggagagcagccatgggcggcgacaacctggcggcagcgcaaaagatg

SEQ ID NO: 92090 - DNA, 103 bp, Artificial Sequence
  Synthetic Polynucleotide
taatacgactcactatagggcctccggtctctgcggtggccggtcgccgcaacagaggagagcggcgatgggccaccgcaacctggcggcagcgcaaaagatg

SEQ ID NO: 92091 - DNA, 103 bp, Artificial Sequence
  Synthetic Polynucleotide
taatacgactcactatagggcgctgcgccgcctccggtctctgcggtggcaacagaggagagccaccatggagaccggaaacctggcggcagcgcaaaagatg

SEQ ID NO: 92092 - DNA, 103 bp, Artificial Sequence
  Synthetic Polynucleotide
taatacgactcactataggggcgctacggccgctgcgccgcctccggtctaacagaggagaagaccgatggcggcgcagaacctggcggcagcgcaaaagatg

SEQ ID NO: 92093 - DNA, 103 bp, Artificial Sequence
  Synthetic Polynucleotide
taatacgactcactatagggtcattgcgccgcgctacggccgctgcgccgaacagaggagacggcgcatgggccgtagcaacctggcggcagcgcaaaagatg

SEQ ID NO: 92094 - DNA, 103 bp, Artificial Sequence
  Synthetic Polynucleotide
taatacgactcactataggggcgctcgcgctcattgcgccgcgctacggcaacagaggagagccgtaatgcggcgcaataacctggcggcagcgcaaaagatg

SEQ ID NO: 92095 - DNA, 103 bp, Artificial Sequence
  Synthetic Polynucleotide
taatacgactcactatagggtcacgcggttgcgctcgcgctcattgcgccaacagaggagaggcgcaatgagcgcgagcaacctggcggcagcgcaaaagatg

SEQ ID NO: 92096 - DNA, 103 bp, Artificial Sequence
  Synthetic Polynucleotide
taatacgactcactatagggttcaccagcttcacgcggttgcgctcgcgcaacagaggagagcgcgaatgcaaccgcgtaacctggcggcagcgcaaaagatg

SEQ ID NO: 92097 - DNA, 103 bp, Artificial Sequence
  Synthetic Polynucleotide
taatacgactcactataggggaagcccaagttcaccagcttcacgcggttaacagaggagaaaccgcatgaagctggtgaacctggcggcagcgcaaaagatg

SEQ ID NO: 92098 - DNA, 103 bp, Artificial Sequence
  Synthetic Polynucleotide
taatacgactcactataggggcgcagggggcgcggacctgggcagtgtgcaacagaggagagcacacatgccaggtccgaacctggcggcagcgcaaaagatg

SEQ ID NO: 92099 - DNA, 103 bp, Artificial Sequence
  Synthetic Polynucleotide
taatacgactcactataggggcagcgcctggaagcccaagttcaccagctaacagaggagaagctggatgacttgggctaacctggcggcagcgcaaaagatg

SEQ ID NO: 92100 - DNA, 103 bp, Artificial Sequence
  Synthetic Polynucleotide
taatacgactcactatagggacgtgctgccgcagcgcctggaagcccaagaacagaggagacttgggatgccaggcgctaacctggcggcagcgcaaaagatg

SEQ ID NO: 92101 - DNA, 103 bp, Artificial Sequence
  Synthetic Polynucleotide
taatacgactcactataggggccgtgcggcacgtgctgccgcagcgcctgaacagaggagacaggcgatgcggcagcacaacctggcggcagcgcaaaagatg

SEQ ID NO: 92102 - DNA, 103 bp, Artificial Sequence
  Synthetic Polynucleotide
taatacgactcactatagggtgctggcgccgccgtgcggcacgtgctgccaacagaggagaggcagcatgtgccgcacgaacctggcggcagcgcaaaagatg

SEQ ID NO: 92103 - DNA, 103 bp, Artificial Sequence
  Synthetic Polynucleotide
taatacgactcactatagggctcagcttcttgctggcgccgccgtgcggcaacagaggagagccgcaatgcggcgccagaacctggcggcagcgcaaaagatg

SEQ ID NO: 92104 - DNA, 103 bp, Artificial Sequence
  Synthetic Polynucleotide
taatacgactcactatagggctccaccttgctcagcttcttgctggcgccaacagaggagaggcgccatgaagaagctgaacctggcggcagcgcaaaagatg

SEQ ID NO: 92105 - DNA, 103 bp, Artificial Sequence
  Synthetic Polynucleotide
taatacgactcactatagggagcgcagcgtctccaccttgctcagcttctaacagaggagaagaagcatggcaaggtggaacctggcggcagcgcaaaagatg

SEQ ID NO: 92106 - DNA, 103 bp, Artificial Sequence
  Synthetic Polynucleotide
taatacgactcactatagggtccacggctgagcgcagcgtctccaccttgaacagaggagacaaggtatggacgctgcgaacctggcggcagcgcaaaagatg

SEQ ID NO: 92107 - DNA, 103 bp, Artificial Sequence
  Synthetic Polynucleotide
taatacgactcactataggggcggatgtactccacggctgagcgcagcgtaacagaggagaacgctgatgtcagccgtgaacctggcggcagcgcaaaagatg

SEQ ID NO: 92108 - DNA, 103 bp, Artificial Sequence
  Synthetic Polynucleotide
taatacgactcactataggggctgcagcgcgcggatgtactccacggctgaacagaggagacagccgatgagtacatccaacctggcggcagcgcaaaagatg

SEQ ID NO: 92109 - DNA, 103 bp, Artificial Sequence
  Synthetic Polynucleotide
taatacgactcactataggggggacggggggcgcagggggcgcggacctgaacagaggagacaggtcatggccccctgcaacctggcggcagcgcaaaagatg

SEQ ID NO: 92110 - DNA, 103 bp, Artificial Sequence
  Synthetic Polynucleotide
taatacgactcactataggggccagcaggcgctgcagcgcgcggatgtacaacagaggagagtacatatgcgcgctgcaaacctggcggcagcgcaaaagatg

SEQ ID NO: 92111 - DNA, 103 bp, Artificial Sequence
  Synthetic Polynucleotide
taatacgactcactataggggtcgtgctcggccagcaggcgctgcagcgcaacagaggagagcgctgatgcgcctgctgaacctggcggcagcgcaaaagatg

SEQ ID NO: 92112 - DNA, 103 bp, Artificial Sequence
  Synthetic Polynucleotide
taatacgactcactatagggtgcgcacggcgtcgtgctcggccagcaggcaacagaggagagcctgcatgccgagcacgaacctggcggcagcgcaaaagatg

SEQ ID NO: 92113 - DNA, 103 bp, Artificial Sequence
  Synthetic Polynucleotide
taatacgactcactataggggccagcgcgttgcgcacggcgtcgtgctcgaacagaggagacgagcaatgcgccgtgcgaacctggcggcagcgcaaaagatg

SEQ ID NO: 92114 - DNA, 103 bp, Artificial Sequence
  Synthetic Polynucleotide
taatacgactcactatagggcagccctcccgccagcgcgttgcgcacggcaacagaggagagccgtgatgaacgcgctgaacctggcggcagcgcaaaagatg

SEQ ID NO: 92115 - DNA, 103 bp, Artificial Sequence
  Synthetic Polynucleotide
taatacgactcactatagggcctgcggcctcagccctcccgccagcgcgtaacagaggagaacgcgcatgcgggagggcaacctggcggcagcgcaaaagatg

SEQ ID NO: 92116 - DNA, 103 bp, Artificial Sequence
  Synthetic Polynucleotide
taatacgactcactatagggggccgcacggcctgcggcctcagccctcccaacagaggagagggaggatggaggccgcaaacctggcggcagcgcaaaagatg

SEQ ID NO: 92117 - DNA, 103 bp, Artificial Sequence
  Synthetic Polynucleotide
taatacgactcactataggggggcgcagacggccgcacggcctgcggcctaacagaggagaaggccgatggccgtgcggaacctggcggcagcgcaaaagatg

SEQ ID NO: 92118 - DNA, 103 bp, Artificial Sequence
  Synthetic Polynucleotide
taatacgactcactataggggcggcccgcggggcgcagacggccgcacggaacagaggagaccgtgcatgcgtctgcgcaacctggcggcagcgcaaaagatg

SEQ ID NO: 92119 - DNA, 103 bp, Artificial Sequence
  Synthetic Polynucleotide
taatacgactcactataggggtggtccctggcggcccgcggggcgcagacaacagaggagagtctgcatgccgcgggccaacctggcggcagcgcaaaagatg

SEQ ID NO: 92120 - DNA, 103 bp, Artificial Sequence
  Synthetic Polynucleotide
taatacgactcactataggggcagccgacagggacggggggcgcagggggaacagaggagaccccctatgccccccgtcaacctggcggcagcgcaaaagatg

SEQ ID NO: 92121 - DNA, 103 bp, Artificial Sequence
  Synthetic Polynucleotide
taatacgactcactatagggggcgaccggggtggtccctggcggcccgcgaacagaggagacgcgggatgccagggaccaacctggcggcagcgcaaaagatg

SEQ ID NO: 92122 - DNA, 103 bp, Artificial Sequence
  Synthetic Polynucleotide
taatacgactcactatagggagggcgaggcggcgaccggggtggtccctgaacagaggagacagggaatgccccggtcgaacctggcggcagcgcaaaagatg

SEQ ID NO: 92123 - DNA, 103 bp, Artificial Sequence
  Synthetic Polynucleotide
taatacgactcactataggggaagcgcgggagggcgaggcggcgaccgggaacagaggagacccggtatgcgcctcgccaacctggcggcagcgcaaaagatg

SEQ ID NO: 92124 - DNA, 103 bp, Artificial Sequence
  Synthetic Polynucleotide
taatacgactcactatagggcggggacgaagaagcgcgggagggcgaggcaacagaggagagcctcgatgtcccgcgctaacctggcggcagcgcaaaagatg

SEQ ID NO: 92125 - DNA, 103 bp, Artificial Sequence
  Synthetic Polynucleotide
taatacgactcactatagggccccgcggcccggggacgaagaagcgcgggaacagaggagacccgcgatgcttcgtcccaacctggcggcagcgcaaaagatg

SEQ ID NO: 92126 - DNA, 103 bp, Artificial Sequence
  Synthetic Polynucleotide
taatacgactcactatagggtccgagctgcccccgcggcccggggacgaaaacagaggagattcgtcatggggccgcggaacctggcggcagcgcaaaagatg

SEQ ID NO: 92127 - DNA, 103 bp, Artificial Sequence
  Synthetic Polynucleotide
taatacgactcactatagggggagccgggctccgagctgcccccgcggccaacagaggagaggccgcatgggcagctcgaacctggcggcagcgcaaaagatg

SEQ ID NO: 92128 - DNA, 103 bp, Artificial Sequence
  Synthetic Polynucleotide
taatacgactcactatagggcggaacgcggggagccgggctccgagctgcaacagaggagagcagctatgagcccggctaacctggcggcagcgcaaaagatg

SEQ ID NO: 92129 - DNA, 103 bp, Artificial Sequence
  Synthetic Polynucleotide
taatacgactcactataggggacgagtaggcggaacgcggggagccgggcaacagaggagagcccggatgcccgcgttcaacctggcggcagcgcaaaagatg

SEQ ID NO: 92130 - DNA, 103 bp, Artificial Sequence
  Synthetic Polynucleotide
taatacgactcactataggggctgtcgtccgacgagtaggcggaacgcggaacagaggagaccgcgtatggcctactcgaacctggcggcagcgcaaaagatg

SEQ ID NO: 92131 - DNA, 103 bp, Artificial Sequence
  Synthetic Polynucleotide
taatacgactcactataggggccgggcagcgcagccgacagggacgggggaacagaggagacccccgatgctgtcggctaacctggcggcagcgcaaaagatg

SEQ ID NO: 92132 - DNA, 103 bp, Artificial Sequence
  Synthetic Polynucleotide
taatacgactcactatagggcttcgcagccgctgtcgtccgacgagtaggaacagaggagacctactatgcggacgacaaacctggcggcagcgcaaaagatg

SEQ ID NO: 92133 - DNA, 103 bp, Artificial Sequence
  Synthetic Polynucleotide
taatacgactcactatagggctcagcgcgccttcgcagccgctgtcgtccaacagaggagaggacgaatgcggctgcgaaacctggcggcagcgcaaaagatg

SEQ ID NO: 92134 - DNA, 103 bp, Artificial Sequence
  Synthetic Polynucleotide
taatacgactcactatagggctccgcaggactcagcgcgccttcgcagccaacagaggagaggctgcatgggcgcgctgaacctggcggcagcgcaaaagatg

SEQ ID NO: 92135 - DNA, 103 bp, Artificial Sequence
  Synthetic Polynucleotide
taatacgactcactataggggtagctcgcgctccgcaggactcagcgcgcaacagaggagagcgcgcatggtcctgcggaacctggcggcagcgcaaaagatg

SEQ ID NO: 92136 - DNA, 103 bp, Artificial Sequence
  Synthetic Polynucleotide
taatacgactcactataggggagaagtcgagtagctcgcgctccgcaggaaacagaggagatcctgcatggcgcgagctaacctggcggcagcgcaaaagatg

SEQ ID NO: 92137 - DNA, 103 bp, Artificial Sequence
  Synthetic Polynucleotide
taatacgactcactatagggtaaccagctggagaagtcgagtagctcgcgaacagaggagacgcgagatgctcgacttcaacctggcggcagcgcaaaagatg

SEQ ID NO: 92138 - DNA, 103 bp, Artificial Sequence
  Synthetic Polynucleotide
taatacgactcactatagggagtagccccctaaccagctggagaagtcgaaacagaggagatcgactatgccagctggtaacctggcggcagcgcaaaagatg

SEQ ID NO: 92139 - DNA, 103 bp, Artificial Sequence
  Synthetic Polynucleotide
taatacgactcactataggggcgggtctccgccgggcagcgcagccgacaaacagaggagatgtcggatgcgctgcccgaacctggcggcagcgcaaaagatg

SEQ ID NO: 92140 - DNA, 103 bp, Artificial Sequence
  Synthetic Polynucleotide
taatacgactcactatagggttccggggacgcgggtctccgccgggcagcaacagaggagagctgccatgcggagacccaacctggcggcagcgcaaaagatg

SEQ ID NO: 92141 - DNA, 103 bp, Artificial Sequence
  Synthetic Polynucleotide
taatacgactcactatagggagcgcaacagttccggggacgcgggtctccaacagaggagaggagacatgcgtccccggaacctggcggcagcgcaaaagatg

SEQ ID NO: 92142 - DNA, 103 bp, Artificial Sequence
  Synthetic Polynucleotide
taatacgactcactatagggcgccggctgcagcgcaacagttccggggacaacagaggagagtccccatgactgttgcgaacctggcggcagcgcaaaagatg

SEQ ID NO: 92143 - DNA, 103 bp, Artificial Sequence
  Synthetic Polynucleotide
taatacgactcactatagggtagactagagttgcctctgttgtccatcataacagaggagaatgatgatgaacagaggcaacctggcggcagcgcaaaagatg

SEQ ID NO: 92144 - DNA, 103 bp, Artificial Sequence
  Synthetic Polynucleotide
taatacgactcactataggggtgcacgtggaaagtgaccatgggctccagaacagaggagactggagatgatggtcactaacctggcggcagcgcaaaagatg

SEQ ID NO: 92145 - DNA, 103 bp, Artificial Sequence
  Synthetic Polynucleotide
taatacgactcactataggggggcctctgggtgcacgtggaaagtgaccaaacagaggagatggtcaatgtccacgtgcaacctggcggcagcgcaaaagatg

SEQ ID NO: 92146 - DNA, 103 bp, Artificial Sequence
  Synthetic Polynucleotide
taatacgactcactataggggatgacaccggggcctctgggtgcacgtggaacagaggagaccacgtatgcccagaggcaacctggcggcagcgcaaaagatg

SEQ ID NO: 92147 - DNA, 103 bp, Artificial Sequence
  Synthetic Polynucleotide
taatacgactcactatagggagagtaaggggatgacaccggggcctctggaacagaggagaccagagatgccggtgtcaaacctggcggcagcgcaaaagatg

SEQ ID NO: 92148 - DNA, 103 bp, Artificial Sequence
  Synthetic Polynucleotide
taatacgactcactataggggcagctcctcagagtaaggggatgacaccgaacagaggagacggtgtatgccccttactaacctggcggcagcgcaaaagatg

SEQ ID NO: 92149 - DNA, 103 bp, Artificial Sequence
  Synthetic Polynucleotide
taatacgactcactatagggggcagccgtggcagctcctcagagtaagggaacagaggagacccttaatgtgaggagctaacctggcggcagcgcaaaagatg

SEQ ID NO: 92150 - DNA, 103 bp, Artificial Sequence
  Synthetic Polynucleotide
taatacgactcactataggggctgggaaaaggcagccgtggcagctcctcaacagaggagagaggagatgccacggctgaacctggcggcagcgcaaaagatg

SEQ ID NO: 92151 - DNA, 103 bp, Artificial Sequence
  Synthetic Polynucleotide
taatacgactcactatagggtaagagagtcgctgggaaaaggcagccgtgaacagaggagacacggcatgcttttcccaaacctggcggcagcgcaaaagatg

SEQ ID NO: 92152 - DNA, 103 bp, Artificial Sequence
  Synthetic Polynucleotide
taatacgactcactatagggtttcccaggataagagagtcgctgggaaaaaacagaggagattttccatgcgactctctaacctggcggcagcgcaaaagatg

SEQ ID NO: 92153 - DNA, 103 bp, Artificial Sequence
  Synthetic Polynucleotide
taatacgactcactatagggttcactgtaatttcccaggataagagagtcaacagaggagagactctatgatcctgggaaacctggcggcagcgcaaaagatg

SEQ ID NO: 92154 - DNA, 103 bp, Artificial Sequence
  Synthetic Polynucleotide
taatacgactcactataggggtttgtcaggtagactagagttgcctctgtaacagaggagaacagagatgactctagtcaacctggcggcagcgcaaaagatg

SEQ ID NO: 92155 - DNA, 103 bp, Artificial Sequence
  Synthetic Polynucleotide
taatacgactcactatagggaggggcagggttcactgtaatttcccaggaaacagaggagatcctggatgattacagtgaacctggcggcagcgcaaaagatg

SEQ ID NO: 92156 - DNA, 103 bp, Artificial Sequence
  Synthetic Polynucleotide
taatacgactcactataggggggaaagagaaggggcagggttcactgtaaaacagaggagattacagatgaccctgcccaacctggcggcagcgcaaaagatg

SEQ ID NO: 92157 - DNA, 103 bp, Artificial Sequence
  Synthetic Polynucleotide
taatacgactcactatagggataaggcatcgggaaagagaaggggcagggaacagaggagaccctgcatgttctctttcaacctggcggcagcgcaaaagatg

SEQ ID NO: 92158 - DNA, 103 bp, Artificial Sequence
  Synthetic Polynucleotide
taatacgactcactatagggtgtaatttggataaggcatcgggaaagagaaacagaggagatctcttatgcgatgccttaacctggcggcagcgcaaaagatg

SEQ ID NO: 92159 - DNA, 103 bp, Artificial Sequence
  Synthetic Polynucleotide
taatacgactcactatagggtcgcaccctctgtaatttggataaggcatcaacagaggagagatgccatgtccaaattaaacctggcggcagcgcaaaagatg

SEQ ID NO: 92160 - DNA, 103 bp, Artificial Sequence
  Synthetic Polynucleotide
taatacgactcactataggggtaggagtactcgcaccctctgtaatttggaacagaggagaccaaatatgagagggtgcaacctggcggcagcgcaaaagatg

SEQ ID NO: 92161 - DNA, 103 bp, Artificial Sequence
  Synthetic Polynucleotide
taatacgactcactatagggaggctggcccgtaggagtactcgcaccctcaacagaggagagagggtatgagtactcctaacctggcggcagcgcaaaagatg

SEQ ID NO: 92162 - DNA, 103 bp, Artificial Sequence
  Synthetic Polynucleotide
taatacgactcactatagggttccgggtgaaggctggcccgtaggagtacaacagaggagagtactcatgcgggccagcaacctggcggcagcgcaaaagatg

SEQ ID NO: 92163 - DNA, 103 bp, Artificial Sequence
  Synthetic Polynucleotide
taatacgactcactatagggctcattccttttccgggtgaaggctggcccaacagaggagagggccaatgttcacccggaacctggcggcagcgcaaaagatg

SEQ ID NO: 92164 - DNA, 103 bp, Artificial Sequence
  Synthetic Polynucleotide
taatacgactcactataggggcctttcccgctcattccttttccgggtgaaacagaggagatcacccatgaaaggaatgaacctggcggcagcgcaaaagatg

SEQ ID NO: 92165 - DNA, 103 bp, Artificial Sequence
  Synthetic Polynucleotide
taatacgactcactatagggaagataggaagtttgtcaggtagactagagaacagaggagactctagatgacctgacaaaacctggcggcagcgcaaaagatg

SEQ ID NO: 92166 - DNA, 103 bp, Artificial Sequence
  Synthetic Polynucleotide
taatacgactcactatagggttcacccgctgcctttcccgctcattccttaacagaggagaaaggaaatggcgggaaagaacctggcggcagcgcaaaagatg

SEQ ID NO: 92167 - DNA, 103 bp, Artificial Sequence
  Synthetic Polynucleotide
taatacgactcactatagggattgacacatttcacccgctgcctttcccgaacagaggagacgggaaatgcagcgggtgaacctggcggcagcgcaaaagatg

SEQ ID NO: 92168 - DNA, 103 bp, Artificial Sequence
  Synthetic Polynucleotide
taatacgactcactatagggcgtagccttcattgacacatttcacccgctaacagaggagaagcgggatgaatgtgtcaaacctggcggcagcgcaaaagatg

SEQ ID NO: 92169 - DNA, 103 bp, Artificial Sequence
  Synthetic Polynucleotide
taatacgactcactatagggcggagctgggcgtagccttcattgacacataacagaggagaatgtgtatgtgaaggctaaacctggcggcagcgcaaaagatg

SEQ ID NO: 92170 - DNA, 103 bp, Artificial Sequence
  Synthetic Polynucleotide
taatacgactcactatagggcagatgatggcggagctgggcgtagccttcaacagaggagagaaggcatggcccagctcaacctggcggcagcgcaaaagatg

SEQ ID NO: 92171 - DNA, 103 bp, Artificial Sequence
  Synthetic Polynucleotide
taatacgactcactatagggactcctctggcagatgatggcggagctgggaacagaggagacccagcatggccatcatcaacctggcggcagcgcaaaagatg

SEQ ID NO: 92172 - DNA, 103 bp, Artificial Sequence
  Synthetic Polynucleotide
taatacgactcactatagggttctccaaatactcctctggcagatgatggaacagaggagaccatcaatggccagaggaaacctggcggcagcgcaaaagatg

SEQ ID NO: 92173 - DNA, 103 bp, Artificial Sequence
  Synthetic Polynucleotide
taatacgactcactataggggctgagtcgcttctccaaatactcctctggaacagaggagaccagagatgtatttggagaacctggcggcagcgcaaaagatg

SEQ ID NO: 92174 - DNA, 103 bp, Artificial Sequence
  Synthetic Polynucleotide
taatacgactcactatagggtttccactttgctgagtcgcttctccaaataacagaggagaatttggatgagcgactcaaacctggcggcagcgcaaaagatg

SEQ ID NO: 92175 - DNA, 103 bp, Artificial Sequence
  Synthetic Polynucleotide
taatacgactcactataggggctctgagggtttccactttgctgagtcgcaacagaggagagcgactatgcaaagtggaaacctggcggcagcgcaaaagatg

SEQ ID NO: 92176 - DNA, 103 bp, Artificial Sequence
  Synthetic Polynucleotide
taatacgactcactatagggagaatcagggaagataggaagtttgtcaggaacagaggagacctgacatgcttcctatcaacctggcggcagcgcaaaagatg

SEQ ID NO: 92177 - DNA, 103 bp, Artificial Sequence
  Synthetic Polynucleotide
taatacgactcactatagggcttgatcgcagctctgagggtttccactttaacagaggagaaaagtgatgaccctcagaaacctggcggcagcgcaaaagatg

SEQ ID NO: 92178 - DNA, 103 bp, Artificial Sequence
  Synthetic Polynucleotide
taatacgactcactatagggagttaatgtacttgatcgcagctctgagggaacagaggagaccctcaatgctgcgatcaaacctggcggcagcgcaaaagatg

SEQ ID NO: 92179 - DNA, 103 bp, Artificial Sequence
  Synthetic Polynucleotide
taatacgactcactataggggactgcaggtagttaatgtacttgatcgcaaacagaggagatgcgatatggtacattaaaacctggcggcagcgcaaaagatg

SEQ ID NO: 92180 - DNA, 103 bp, Artificial Sequence
  Synthetic Polynucleotide
taatacgactcactataggggtacagaagagactgcaggtagttaatgtaaacagaggagatacattatgtacctgcagaacctggcggcagcgcaaaagatg

SEQ ID NO: 92181 - DNA, 103 bp, Artificial Sequence
  Synthetic Polynucleotide
taatacgactcactatagggctttatcagggtacagaagagactgcaggtaacagaggagaacctgcatgctcttctgtaacctggcggcagcgcaaaagatg

SEQ ID NO: 92182 - DNA, 103 bp, Artificial Sequence
  Synthetic Polynucleotide
taatacgactcactatagggttggtctcagctttatcagggtacagaagaaacagaggagatcttctatgccctgataaaacctggcggcagcgcaaaagatg

SEQ ID NO: 92183 - DNA, 103 bp, Artificial Sequence
  Synthetic Polynucleotide
taatacgactcactatagggagggttattcttggtctcagctttatcaggaacagaggagacctgatatggctgagaccaacctggcggcagcgcaaaagatg

SEQ ID NO: 92184 - DNA, 103 bp, Artificial Sequence
  Synthetic Polynucleotide
taatacgactcactatagggaaacttttccagggttattcttggtctcagaacagaggagactgagaatgagaataaccaacctggcggcagcgcaaaagatg

SEQ ID NO: 92185 - DNA, 103 bp, Artificial Sequence
  Synthetic Polynucleotide
taatacgactcactatagggatcatggaggaaacttttccagggttattcaacagaggagagaataaatgtggaaaagtaacctggcggcagcgcaaaagatg

SEQ ID NO: 92186 - DNA, 103 bp, Artificial Sequence
  Synthetic Polynucleotide
taatacgactcactatagggggtggttgctatcatggaggaaacttttccaacagaggagaggaaaaatgtcctccatgaacctggcggcagcgcaaaagatg

SEQ ID NO: 92187 - DNA, 103 bp, Artificial Sequence
  Synthetic Polynucleotide
taatacgactcactataggggcaagcgggcagaatcagggaagataggaaaacagaggagattcctaatgtccctgattaacctggcggcagcgcaaaagatg

SEQ ID NO: 92188 - DNA, 103 bp, Artificial Sequence
  Synthetic Polynucleotide
taatacgactcactatagggcatggtggctggtggttgctatcatggaggaacagaggagacctccaatgtagcaaccaaacctggcggcagcgcaaaagatg

SEQ ID NO: 92189 - DNA, 103 bp, Artificial Sequence
  Synthetic Polynucleotide
taatacgactcactatagggatagggtcagcatggtggctggtggttgctaacagaggagaagcaacatgcagccaccaaacctggcggcagcgcaaaagatg

SEQ ID NO: 92190 - DNA, 103 bp, Artificial Sequence
  Synthetic Polynucleotide
taatacgactcactatagggaattctgaacatagggtcagcatggtggctaacagaggagaagccacatggctgaccctaacctggcggcagcgcaaaagatg

SEQ ID NO: 92191 - DNA, 103 bp, Artificial Sequence
  Synthetic Polynucleotide
taatacgactcactatagggctggtcagtggcaagcgggcagaatcagggaacagaggagaccctgaatgtgcccgcttaacctggcggcagcgcaaaagatg

SEQ ID NO: 92192 - DNA, 103 bp, Artificial Sequence
  Synthetic Polynucleotide
taatacgactcactatagggatagaaggacctggtcagtggcaagcgggcaacagaggagagcccgcatgccactgaccaacctggcggcagcgcaaaagatg

SEQ ID NO: 92193 - DNA, 103 bp, Artificial Sequence
  Synthetic Polynucleotide
taatacgactcactatagggtgggctccagatagaaggacctggtcagtgaacagaggagacactgaatgggtccttctaacctggcggcagcgcaaaagatg

SEQ ID NO: 92194 - DNA, 103 bp, Artificial Sequence
  Synthetic Polynucleotide
taatacgactcactatagggaaagtgaccatgggctccagatagaaggacaacagaggagagtccttatgtctggagccaacctggcggcagcgcaaaagatg

SEQ ID NO: 92195 - DNA, 103 bp, Artificial Sequence
  Synthetic Polynucleotide
taatacgactcactatagggccgttccgccggtttacgcgtctccatcataacagaggagaatgatgatgacgcgtaaaaacctggcggcagcgcaaaagatg

SEQ ID NO: 92196 - DNA, 103 bp, Artificial Sequence
  Synthetic Polynucleotide
taatacgactcactatagggggcgaccctgagggggtccctccgcgggagaacagaggagactcccgatgagggaccccaacctggcggcagcgcaaaagatg

SEQ ID NO: 92197 - DNA, 103 bp, Artificial Sequence
  Synthetic Polynucleotide
taatacgactcactatagggccagacgcagggcgaccctgagggggtcccaacagaggagagggaccatgtcagggtcgaacctggcggcagcgcaaaagatg

SEQ ID NO: 92198 - DNA, 103 bp, Artificial Sequence
  Synthetic Polynucleotide
taatacgactcactatagggcacgcggcgtccagacgcagggcgaccctgaacagaggagacagggtatgcctgcgtctaacctggcggcagcgcaaaagatg

SEQ ID NO: 92199 - DNA, 103 bp, Artificial Sequence
  Synthetic Polynucleotide
taatacgactcactatagggccactcccagcacgcggcgtccagacgcagaacagaggagactgcgtatggacgccgcgaacctggcggcagcgcaaaagatg

SEQ ID NO: 92200 - DNA, 103 bp, Artificial Sequence
  Synthetic Polynucleotide
taatacgactcactatagggcgctgcgcgcccactcccagcacgcggcgtaacagaggagaacgccgatggctgggagtaacctggcggcagcgcaaaagatg

SEQ ID NO: 92201 - DNA, 103 bp, Artificial Sequence
  Synthetic Polynucleotide
taatacgactcactatagggcgtgcgcagccgctgcgcgcccactcccagaacagaggagactgggaatgggcgcgcagaacctggcggcagcgcaaaagatg

SEQ ID NO: 92202 - DNA, 103 bp, Artificial Sequence
  Synthetic Polynucleotide
taatacgactcactatagggctgccatccccgtgcgcagccgctgcgcgcaacagaggagagcgcgcatgggctgcgcaaacctggcggcagcgcaaaagatg

SEQ ID NO: 92203 - DNA, 103 bp, Artificial Sequence
  Synthetic Polynucleotide
taatacgactcactatagggcgggcaagtactgccatccccgtgcgcagcaacagaggagagctgcgatgggggatggcaacctggcggcagcgcaaaagatg

SEQ ID NO: 92204 - DNA, 103 bp, Artificial Sequence
  Synthetic Polynucleotide
taatacgactcactatagggtccagcggcacgggcaagtactgccatcccaacagaggagagggatgatggtacttgccaacctggcggcagcgcaaaagatg

SEQ ID NO: 92205 - DNA, 103 bp, Artificial Sequence
  Synthetic Polynucleotide
taatacgactcactataggggaaggcgctgtccagcggcacgggcaagtaaacagaggagatacttgatggtgccgctgaacctggcggcagcgcaaaagatg

SEQ ID NO: 92206 - DNA, 103 bp, Artificial Sequence
  Synthetic Polynucleotide
taatacgactcactataggggcaaggccagccgttccgccggtttacgcgaacagaggagacgcgtaatgcggcggaacaacctggcggcagcgcaaaagatg

SEQ ID NO: 92207 - DNA, 103 bp, Artificial Sequence
  Synthetic Polynucleotide
taatacgactcactatagggaggcgggctcgaaggcgctgtccagcggcaaacagaggagatgccgcatgacagcgcctaacctggcggcagcgcaaaagatg

SEQ ID NO: 92208 - DNA, 103 bp, Artificial Sequence
  Synthetic Polynucleotide
taatacgactcactatagggttgcggaggaaggcgggctcgaaggcgctgaacagaggagacagcgcatgcgagcccgcaacctggcggcagcgcaaaagatg

SEQ ID NO: 92209 - DNA, 103 bp, Artificial Sequence
  Synthetic Polynucleotide
taatacgactcactatagggctcgttgcgcttgcggaggaaggcgggctcaacagaggagagagcccatgttcctccgcaacctggcggcagcgcaaaagatg

SEQ ID NO: 92210 - DNA, 103 bp, Artificial Sequence
  Synthetic Polynucleotide
taatacgactcactataggggccgctcgcgctcgttgcgcttgcggaggaaacagaggagatcctccatgagcgcaacgaacctggcggcagcgcaaaagatg

SEQ ID NO: 92211 - DNA, 103 bp, Artificial Sequence
  Synthetic Polynucleotide
taatacgactcactatagggcgcacccgctgccgctcgcgctcgttgcgcaacagaggagagcgcaaatggcgcgagcgaacctggcggcagcgcaaaagatg

SEQ ID NO: 92212 - DNA, 103 bp, Artificial Sequence
  Synthetic Polynucleotide
taatacgactcactataggggttcacgcagcgcacccgctgccgctcgcgaacagaggagacgcgagatgcagcgggtgaacctggcggcagcgcaaaagatg

SEQ ID NO: 92213 - DNA, 103 bp, Artificial Sequence
  Synthetic Polynucleotide
taatacgactcactatagggcatagccctcgttcacgcagcgcacccgctaacagaggagaagcgggatggctgcgtgaaacctggcggcagcgcaaaagatg

SEQ ID NO: 92214 - DNA, 103 bp, Artificial Sequence
  Synthetic Polynucleotide
taatacgactcactatagggcggaggcgcgcatagccctcgttcacgcagaacagaggagactgcgtatgcgagggctaaacctggcggcagcgcaaaagatg

SEQ ID NO: 92215 - DNA, 103 bp, Artificial Sequence
  Synthetic Polynucleotide
taatacgactcactatagggcaggtggtctcggaggcgcgcatagccctcaacagaggagagagggcatggcgcgcctcaacctggcggcagcgcaaaagatg

SEQ ID NO: 92216 - DNA, 103 bp, Artificial Sequence
  Synthetic Polynucleotide
taatacgactcactataggggctcccggggcaggtggtctcggaggcgcgaacagaggagacgcgccatggagaccaccaacctggcggcagcgcaaaagatg

SEQ ID NO: 92217 - DNA, 103 bp, Artificial Sequence
  Synthetic Polynucleotide
taatacgactcactatagggagcgagtatggcaaggccagccgttccgccaacagaggagaggcggaatggctggccttaacctggcggcagcgcaaaagatg

SEQ ID NO: 92218 - DNA, 103 bp, Artificial Sequence
  Synthetic Polynucleotide
taatacgactcactatagggttgtctgccagctcccggggcaggtggtctaacagaggagaagaccaatggccccgggaaacctggcggcagcgcaaaagatg

SEQ ID NO: 92219 - DNA, 103 bp, Artificial Sequence
  Synthetic Polynucleotide
taatacgactcactataggggctgaggcgcttgtctgccagctcccggggaacagaggagaccccggatgctggcagacaacctggcggcagcgcaaaagatg

SEQ ID NO: 92220 - DNA, 103 bp, Artificial Sequence
  Synthetic Polynucleotide
taatacgactcactatagggtctccactttgctgaggcgcttgtctgccaaacagaggagatggcagatgagcgcctcaaacctggcggcagcgcaaaagatg

SEQ ID NO: 92221 - DNA, 103 bp, Artificial Sequence
  Synthetic Polynucleotide
taatacgactcactataggggcgcggagcgtctccactttgctgaggcgcaacagaggagagcgcctatgcaaagtggaaacctggcggcagcgcaaaagatg

SEQ ID NO: 92222 - DNA, 103 bp, Artificial Sequence
  Synthetic Polynucleotide
taatacgactcactataggggtcgatggcagcgcggagcgtctccactttaacagaggagaaaagtgatgacgctccgcaacctggcggcagcgcaaaagatg

SEQ ID NO: 92223 - DNA, 103 bp, Artificial Sequence
  Synthetic Polynucleotide
taatacgactcactataggggcttgatgtagtcgatggcagcgcggagcgaacagaggagacgctccatgctgccatcgaacctggcggcagcgcaaaagatg

SEQ ID NO: 92224 - DNA, 103 bp, Artificial Sequence
  Synthetic Polynucleotide
taatacgactcactatagggtcctgcaggtgcttgatgtagtcgatggcaaacagaggagatgccatatgctacatcaaaacctggcggcagcgcaaaagatg

SEQ ID NO: 92225 - DNA, 103 bp, Artificial Sequence
  Synthetic Polynucleotide
taatacgactcactatagggctccagcagctcctgcaggtgcttgatgtaaacagaggagatacatcatgcacctgcagaacctggcggcagcgcaaaagatg

SEQ ID NO: 92226 - DNA, 103 bp, Artificial Sequence
  Synthetic Polynucleotide
taatacgactcactatagggaggcctggcgctccagcagctcctgcaggtaacagaggagaacctgcatgagctgctggaacctggcggcagcgcaaaagatg

SEQ ID NO: 92227 - DNA, 103 bp, Artificial Sequence
  Synthetic Polynucleotide
taatacgactcactatagggtcgagcccccaggcctggcgctccagcagcaacagaggagagctgctatggcgccaggcaacctggcggcagcgcaaaagatg

SEQ ID NO: 92228 - DNA, 103 bp, Artificial Sequence
  Synthetic Polynucleotide
taatacgactcactatagggcgcggtgcgcagcgagtatggcaaggccagaacagaggagactggccatgccatactcgaacctggcggcagcgcaaaagatg

SEQ ID NO: 92229 - DNA, 103 bp, Artificial Sequence
  Synthetic Polynucleotide
taatacgactcactatagggggccgcgccctcgagcccccaggcctggcgaacagaggagacgccagatgtgggggctcaacctggcggcagcgcaaaagatg

SEQ ID NO: 92230 - DNA, 103 bp, Artificial Sequence
  Synthetic Polynucleotide
taatacgactcactatagggggacggcgccggccgcgccctcgagcccccaacagaggagagggggcatgagggcgcggaacctggcggcagcgcaaaagatg

SEQ ID NO: 92231 - DNA, 103 bp, Artificial Sequence
  Synthetic Polynucleotide
taatacgactcactatagggctgcgctgggggacggcgccggccgcgcccaacagaggagagggcgcatgcggcgccgtaacctggcggcagcgcaaaagatg

SEQ ID NO: 92232 - DNA, 103 bp, Artificial Sequence
  Synthetic Polynucleotide
taatacgactcactataggggcattccgccctgcgctgggggacggcgccaacagaggagaggcgccatgccccagcgcaacctggcggcagcgcaaaagatg

SEQ ID NO: 92233 - DNA, 103 bp, Artificial Sequence
  Synthetic Polynucleotide
taatacgactcactatagggcgtcgctgttgcattccgccctgcgctgggaacagaggagacccagcatggggcggaataacctggcggcagcgcaaaagatg

SEQ ID NO: 92234 - DNA, 103 bp, Artificial Sequence
  Synthetic Polynucleotide
taatacgactcactatagggttggactccccgtcgctgttgcattccgccaacagaggagaggcggaatgcaacagcgaaacctggcggcagcgcaaaagatg

SEQ ID NO: 92235 - DNA, 103 bp, Artificial Sequence
  Synthetic Polynucleotide
taatacgactcactatagggcgaagaggccttggactccccgtcgctgttaacagaggagaaacagcatgggggagtccaacctggcggcagcgcaaaagatg

SEQ ID NO: 92236 - DNA, 103 bp, Artificial Sequence
  Synthetic Polynucleotide
taatacgactcactataggggcgaaggcgccgaagaggccttggactcccaacagaggagagggagtatgaggcctcttaacctggcggcagcgcaaaagatg

SEQ ID NO: 92237 - DNA, 103 bp, Artificial Sequence
  Synthetic Polynucleotide
taatacgactcactatagggtcgctgctgggcgaaggcgccgaagaggccaacagaggagaggcctcatgggcgccttcaacctggcggcagcgcaaaagatg

SEQ ID NO: 92238 - DNA, 103 bp, Artificial Sequence
  Synthetic Polynucleotide
taatacgactcactatagggctcctcgggctcgctgctgggcgaaggcgcaacagaggagagcgcctatgcccagcagcaacctggcggcagcgcaaaagatg

SEQ ID NO: 92239 - DNA, 103 bp, Artificial Sequence
  Synthetic Polynucleotide
taatacgactcactatagggcgcccaggggcgcggtgcgcagcgagtatgaacagaggagacatactatgtgcgcaccgaacctggcggcagcgcaaaagatg

SEQ ID NO: 92240 - DNA, 103 bp, Artificial Sequence
  Synthetic Polynucleotide
taatacgactcactatagggagctgcccccctcctcgggctcgctgctggaacagaggagaccagcaatgagcccgaggaacctggcggcagcgcaaaagatg

SEQ ID NO: 92241 - DNA, 103 bp, Artificial Sequence
  Synthetic Polynucleotide
taatacgactcactataggggtccccggaacgcccaggggcgcggtgcgcaacagaggagagcgcacatggcccctgggaacctggcggcagcgcaaaagatg

SEQ ID NO: 92242 - DNA, 103 bp, Artificial Sequence
  Synthetic Polynucleotide
taatacgactcactatagggtccgggcagggtccccggaacgcccaggggaacagaggagacccctgatggttccggggaacctggcggcagcgcaaaagatg

SEQ ID NO: 92243 - DNA, 103 bp, Artificial Sequence
  Synthetic Polynucleotide
taatacgactcactatagggtccgcgggagtccgggcagggtccccggaaaacagaggagattccggatgccctgcccgaacctggcggcagcgcaaaagatg

SEQ ID NO: 92244 - DNA, 103 bp, Artificial Sequence
  Synthetic Polynucleotide
taatacgactcactatagggagggggtccctccgcgggagtccgggcaggaacagaggagacctgccatgactcccgcgaacctggcggcagcgcaaaagatg

SEQ ID NO: 92245 - DNA, 103 bp, Artificial Sequence
  Synthetic Polynucleotide
taatacgactcactatagggcaccagagcccggcagaagttattgttcataacagaggagaatgaacatgaacttctgcaacctggcggcagcgcaaaagatg

SEQ ID NO: 92246 - DNA, 103 bp, Artificial Sequence
  Synthetic Polynucleotide
taatacgactcactatagggcaggggctcggcggggggcaggggcgcctgaacagaggagacaggcgatgctgccccccaacctggcggcagcgcaaaagatg

SEQ ID NO: 92247 - DNA, 103 bp, Artificial Sequence
  Synthetic Polynucleotide
taatacgactcactataggggcacgttgcccaggggctcggcggggggcaaacagaggagatgccccatgccgagccccaacctggcggcagcgcaaaagatg

SEQ ID NO: 92248 - DNA, 103 bp, Artificial Sequence
  Synthetic Polynucleotide
taatacgactcactatagggagcaggaagggcacgttgcccaggggctcgaacagaggagacgagccatggggcaacgtaacctggcggcagcgcaaaagatg

SEQ ID NO: 92249 - DNA, 103 bp, Artificial Sequence
  Synthetic Polynucleotide
taatacgactcactataggggcccgggtacagcaggaagggcacgttgccaacagaggagaggcaacatgcccttcctgaacctggcggcagcgcaaaagatg

SEQ ID NO: 92250 - DNA, 103 bp, Artificial Sequence
  Synthetic Polynucleotide
taatacgactcactataggggctctgctgggcccgggtacagcaggaaggaacagaggagaccttccatgtgtacccggaacctggcggcagcgcaaaagatg

SEQ ID NO: 92251 - DNA, 103 bp, Artificial Sequence
  Synthetic Polynucleotide
taatacgactcactatagggtagtagggcggctctgctgggcccgggtacaacagaggagagtacccatgcccagcagaaacctggcggcagcgcaaaagatg

SEQ ID NO: 92252 - DNA, 103 bp, Artificial Sequence
  Synthetic Polynucleotide
taatacgactcactatagggataggcgtcgtagtagggcggctctgctggaacagaggagaccagcaatgccgccctacaacctggcggcagcgcaaaagatg

SEQ ID NO: 92253 - DNA, 103 bp, Artificial Sequence
  Synthetic Polynucleotide
taatacgactcactatagggacacccccgcataggcgtcgtagtagggcgaacagaggagacgccctatgacgacgcctaacctggcggcagcgcaaaagatg

SEQ ID NO: 92254 - DNA, 103 bp, Artificial Sequence
  Synthetic Polynucleotide
taatacgactcactatagggacgtaggggaacacccccgcataggcgtcgaacagaggagacgacgcatgtgcgggggtaacctggcggcagcgcaaaagatg

SEQ ID NO: 92255 - DNA, 103 bp, Artificial Sequence
  Synthetic Polynucleotide
taatacgactcactatagggggggaagggcacgtaggggaacacccccgcaacagaggagagcggggatgttcccctacaacctggcggcagcgcaaaagatg

SEQ ID NO: 92256 - DNA, 103 bp, Artificial Sequence
  Synthetic Polynucleotide
taatacgactcactataggggcctccggtccaccagagcccggcagaagtaacagaggagaacttctatggggctctggaacctggcggcagcgcaaaagatg

SEQ ID NO: 92257 - DNA, 103 bp, Artificial Sequence
  Synthetic Polynucleotide
taatacgactcactatagggcgaaggcgccggggaagggcacgtaggggaaacagaggagatcccctatgtgcccttccaacctggcggcagcgcaaaagatg

SEQ ID NO: 92258 - DNA, 103 bp, Artificial Sequence
  Synthetic Polynucleotide
taatacgactcactatagggtcgtagaccccgaaggcgccggggaagggcaacagaggagagcccttatgcggcgccttaacctggcggcagcgcaaaagatg

SEQ ID NO: 92259 - DNA, 103 bp, Artificial Sequence
  Synthetic Polynucleotide
taatacgactcactataggggaaggggtattcgtagaccccgaaggcgccaacagaggagaggcgccatgggggtctacaacctggcggcagcgcaaaagatg

SEQ ID NO: 92260 - DNA, 103 bp, Artificial Sequence
  Synthetic Polynucleotide
taatacgactcactatagggaggctggctcgaaggggtattcgtagacccaacagaggagagggtctatgaatacccctaacctggcggcagcgcaaaagatg

SEQ ID NO: 92261 - DNA, 103 bp, Artificial Sequence
  Synthetic Polynucleotide
taatacgactcactatagggttctggatgaaggctggctcgaaggggtataacagaggagaatacccatgcgagccagcaacctggcggcagcgcaaaagatg

SEQ ID NO: 92262 - DNA, 103 bp, Artificial Sequence
  Synthetic Polynucleotide
taatacgactcactatagggctcgttgcgcttctggatgaaggctggctcaacagaggagagagccaatgttcatccagaacctggcggcagcgcaaaagatg

SEQ ID NO: 92263 - DNA, 103 bp, Artificial Sequence
  Synthetic Polynucleotide
taatacgactcactataggggcctctcgcgctcgttgcgcttctggatgaaacagaggagatcatccatgagcgcaacgaacctggcggcagcgcaaaagatg

SEQ ID NO: 92264 - DNA, 103 bp, Artificial Sequence
  Synthetic Polynucleotide
taatacgactcactatagggttgactcgctgcctctcgcgctcgttgcgcaacagaggagagcgcaaatggcgcgagagaacctggcggcagcgcaaaagatg

SEQ ID NO: 92265 - DNA, 103 bp, Artificial Sequence
  Synthetic Polynucleotide
taatacgactcactataggggttgacgcacttgactcgctgcctctcgcgaacagaggagacgcgagatgcagcgagtcaacctggcggcagcgcaaaagatg

SEQ ID NO: 92266 - DNA, 103 bp, Artificial Sequence
  Synthetic Polynucleotide
taatacgactcactatagggcgtagccctcgttgacgcacttgactcgctaacagaggagaagcgagatgagtgcgtcaaacctggcggcagcgcaaaagatg

SEQ ID NO: 92267 - DNA, 103 bp, Artificial Sequence
  Synthetic Polynucleotide
taatacgactcactatagggggccccagaggcctccggtccaccagagccaacagaggagaggctctatgggaccggagaacctggcggcagcgcaaaagatg

SEQ ID NO: 92268 - DNA, 103 bp, Artificial Sequence
  Synthetic Polynucleotide
taatacgactcactatagggcggaggcgagcgtagccctcgttgacgcacaacagaggagagtgcgtatgcgagggctaaacctggcggcagcgcaaaagatg

SEQ ID NO: 92269 - DNA, 103 bp, Artificial Sequence
  Synthetic Polynucleotide
taatacgactcactataggggaggtggccgcggaggcgagcgtagccctcaacagaggagagagggcatggctcgcctcaacctggcggcagcgcaaaagatg

SEQ ID NO: 92270 - DNA, 103 bp, Artificial Sequence
  Synthetic Polynucleotide
taatacgactcactataggggggcgccggggaggtggccgcggaggcgagaacagaggagactcgccatggcggccaccaacctggcggcagcgcaaaagatg

SEQ ID NO: 92271 - DNA, 103 bp, Artificial Sequence
  Synthetic Polynucleotide
taatacgactcactatagggttctcagccagggcgccggggaggtggccgaacagaggagacggccaatgccccggcgcaacctggcggcagcgcaaaagatg

SEQ ID NO: 92272 - DNA, 103 bp, Artificial Sequence
  Synthetic Polynucleotide
taatacgactcactataggggctgagtcgcttctcagccagggcgccgggaacagaggagacccggcatgctggctgagaacctggcggcagcgcaaaagatg

SEQ ID NO: 92273 - DNA, 103 bp, Artificial Sequence
  Synthetic Polynucleotide
taatacgactcactatagggtctccaccttgctgagtcgcttctcagccaaacagaggagatggctgatgagcgactcaaacctggcggcagcgcaaaagatg

SEQ ID NO: 92274 - DNA, 103 bp, Artificial Sequence
  Synthetic Polynucleotide
taatacgactcactataggggcgcgcagcgtctccaccttgctgagtcgcaacagaggagagcgactatgcaaggtggaaacctggcggcagcgcaaaagatg

SEQ ID NO: 92275 - DNA, 103 bp, Artificial Sequence
  Synthetic Polynucleotide
taatacgactcactataggggcggatggcggcgcgcagcgtctccaccttaacagaggagaaaggtgatgacgctgcgcaacctggcggcagcgcaaaagatg

SEQ ID NO: 92276 - DNA, 103 bp, Artificial Sequence
  Synthetic Polynucleotide
taatacgactcactatagggactttatgtagcggatggcggcgcgcagcgaacagaggagacgctgcatgccgccatccaacctggcggcagcgcaaaagatg

SEQ ID NO: 92277 - DNA, 103 bp, Artificial Sequence
  Synthetic Polynucleotide
taatacgactcactatagggtcttgcaggtactttatgtagcggatggcgaacagaggagacgccatatgctacataaaaacctggcggcagcgcaaaagatg

SEQ ID NO: 92278 - DNA, 103 bp, Artificial Sequence
  Synthetic Polynucleotide
taatacgactcactataggggcagctggggggccccagaggcctccggtcaacagaggagagaccggatgcctctggggaacctggcggcagcgcaaaagatg

SEQ ID NO: 92279 - DNA, 103 bp, Artificial Sequence
  Synthetic Polynucleotide
taatacgactcactataggggctcagcagctcttgcaggtactttatgtaaacagaggagatacataatgtacctgcaaaacctggcggcagcgcaaaagatg

SEQ ID NO: 92280 - DNA, 103 bp, Artificial Sequence
  Synthetic Polynucleotide
taatacgactcactatagggcgggggccgagctcagcagctcttgcaggtaacagaggagaacctgcatgagctgctgaaacctggcggcagcgcaaaagatg

SEQ ID NO: 92281 - DNA, 103 bp, Artificial Sequence
  Synthetic Polynucleotide
taatacgactcactataggggtcgagccgtcgggggccgagctcagcagcaacagaggagagctgctatgctcggccccaacctggcggcagcgcaaaagatg

SEQ ID NO: 92282 - DNA, 103 bp, Artificial Sequence
  Synthetic Polynucleotide
taatacgactcactatagggagcggggggcgtcgagccgtcgggggccgaaacagaggagatcggccatggacggctcgaacctggcggcagcgcaaaagatg

SEQ ID NO: 92283 - DNA, 103 bp, Artificial Sequence
  Synthetic Polynucleotide
taatacgactcactatagggggccgcgggaagcggggggcgtcgagccgtaacagaggagaacggctatgcgccccccgaacctggcggcagcgcaaaagatg

SEQ ID NO: 92284 - DNA, 103 bp, Artificial Sequence
  Synthetic Polynucleotide
taatacgactcactataggggtgcccgggaggccgcgggaagcggggggcaacagaggagagcccccatgttcccgcggaacctggcggcagcgcaaaagatg

SEQ ID NO: 92285 - DNA, 103 bp, Artificial Sequence
  Synthetic Polynucleotide
taatacgactcactataggggcagggcccggtgcccgggaggccgcgggaaacagaggagatcccgcatgctcccgggcaacctggcggcagcgcaaaagatg

SEQ ID NO: 92286 - DNA, 103 bp, Artificial Sequence
  Synthetic Polynucleotide
taatacgactcactataggggcggcgcggggcagggcccggtgcccgggaaacagaggagatcccggatgccgggccctaacctggcggcagcgcaaaagatg

SEQ ID NO: 92287 - DNA, 103 bp, Artificial Sequence
  Synthetic Polynucleotide
taatacgactcactatagggggggtggcgggcggcgcggggcagggcccgaacagaggagacgggccatgccccgcgccaacctggcggcagcgcaaaagatg

SEQ ID NO: 92288 - DNA, 103 bp, Artificial Sequence
  Synthetic Polynucleotide
taatacgactcactataggggtcgggacggggggtggcgggcggcgcgggaacagaggagacccgcgatgcccgccaccaacctggcggcagcgcaaaagatg

SEQ ID NO: 92289 - DNA, 103 bp, Artificial Sequence
  Synthetic Polynucleotide
taatacgactcactatagggccagctgcatgcagctggggggccccagagaacagaggagactctggatgcccccagctaacctggcggcagcgcaaaagatg

SEQ ID NO: 92290 - DNA, 103 bp, Artificial Sequence
  Synthetic Polynucleotide
taatacgactcactatagggcgccagggcggtcgggacggggggtggcggaacagaggagaccgccaatgcccgtcccgaacctggcggcagcgcaaaagatg

SEQ ID NO: 92291 - DNA, 103 bp, Artificial Sequence
  Synthetic Polynucleotide
taatacgactcactataggggcctcgccgtcgccagggcggtcgggacggaacagaggagaccgtccatgccgccctggaacctggcggcagcgcaaaagatg

SEQ ID NO: 92292 - DNA, 103 bp, Artificial Sequence
  Synthetic Polynucleotide
taatacgactcactataggggggcgcccgggcctcgccgtcgccagggcgaacagaggagacgccctatggacggcgagaacctggcggcagcgcaaaagatg

SEQ ID NO: 92293 - DNA, 103 bp, Artificial Sequence
  Synthetic Polynucleotide
taatacgactcactatagggccagggaggagggcgcccgggcctcgccgtaacagaggagaacggcgatgcccgggcgcaacctggcggcagcgcaaaagatg

SEQ ID NO: 92294 - DNA, 103 bp, Artificial Sequence
  Synthetic Polynucleotide
taatacgactcactataggggactccggcaccagggaggagggcgcccggaacagaggagaccgggcatgctcctccctaacctggcggcagcgcaaaagatg

SEQ ID NO: 92295 - DNA, 103 bp, Artificial Sequence
  Synthetic Polynucleotide
taatacgactcactatagggggactcggatgactccggcaccagggaggaaacagaggagatcctccatggtgccggagaacctggcggcagcgcaaaagatg

SEQ ID NO: 92296 - DNA, 103 bp, Artificial Sequence
  Synthetic Polynucleotide
taatacgactcactatagggagaagcaggaggactcggatgactccggcaaacagaggagatgccggatgcatccgagtaacctggcggcagcgcaaaagatg

SEQ ID NO: 92297 - DNA, 103 bp, Artificial Sequence
  Synthetic Polynucleotide
taatacgactcactatagggggcgacggggagaagcaggaggactcggataacagaggagaatccgaatgctcctgcttaacctggcggcagcgcaaaagatg

SEQ ID NO: 92298 - DNA, 103 bp, Artificial Sequence
  Synthetic Polynucleotide
taatacgactcactatagggctccaagaaaggcgacggggagaagcaggaaacagaggagatcctgcatgtccccgtcgaacctggcggcagcgcaaaagatg

SEQ ID NO: 92299 - DNA, 103 bp, Artificial Sequence
  Synthetic Polynucleotide
taatacgactcactatagggattcctccgactccaagaaaggcgacggggaacagaggagaccccgtatgctttcttggaacctggcggcagcgcaaaagatg

SEQ ID NO: 92300 - DNA, 103 bp, Artificial Sequence
  Synthetic Polynucleotide
taatacgactcactatagggggcatgacgcccagctgcatgcagctggggaacagaggagaccccagatgcatgcagctaacctggcggcagcgcaaaagatg

SEQ ID NO: 92301 - DNA, 103 bp, Artificial Sequence
  Synthetic Polynucleotide
taatacgactcactatagggcaatgccaggattcctccgactccaagaaaaacagaggagatttcttatggtcggaggaaacctggcggcagcgcaaaagatg

SEQ ID NO: 92302 - DNA, 103 bp, Artificial Sequence
  Synthetic Polynucleotide
taatacgactcactatagggccggggagggggcatgacgcccagctgcataacagaggagaatgcagatgggcgtcatgaacctggcggcagcgcaaaagatg

SEQ ID NO: 92303 - DNA, 103 bp, Artificial Sequence
  Synthetic Polynucleotide
taatacgactcactatagggggggcgcctgccggggagggggcatgacgcaacagaggagagcgtcaatgcccctccccaacctggcggcagcgcaaaagatg

SEQ ID NO: 92304 - DNA, 103 bp, Artificial Sequence
  Synthetic Polynucleotide
taatacgactcactataggggcggggggcaggggcgcctgccggggagggaacagaggagaccctccatggcaggcgccaacctggcggcagcgcaaaagatg

SEQ ID NO: 92305 - DNA, 103 bp, Artificial Sequence
  Synthetic Polynucleotide
taatacgactcactatagggctggccaggtcctgctcctgccgccgccataacagaggagaatggcgatggcaggagcaaacctggcggcagcgcaaaagatg

SEQ ID NO: 92306 - DNA, 103 bp, Artificial Sequence
  Synthetic Polynucleotide
taatacgactcactatagggggctgctcccgctgccaccggcttcatctcaacagaggagagagatgatgccggtggcaaacctggcggcagcgcaaaagatg

SEQ ID NO: 92307 - DNA, 103 bp, Artificial Sequence
  Synthetic Polynucleotide
taatacgactcactataggggccatctttgttaaacgggtgttccaatggaacagaggagaccattgatgcacccgtttaacctggcggcagcgcaaaagatg

SEQ ID NO: 92308 - DNA, 103 bp, Artificial Sequence
  Synthetic Polynucleotide
taatacgactcactatagggtataccgatagccatctttgttaaacgggtaacagaggagaacccgtatgacaaagatgaacctggcggcagcgcaaaagatg

SEQ ID NO: 92309 - DNA, 103 bp, Artificial Sequence
  Synthetic Polynucleotide
taatacgactcactatagggtcagctagaatataccgatagccatctttgaacagaggagacaaagaatgctatcggtaaacctggcggcagcgcaaaagatg

SEQ ID NO: 92310 - DNA, 103 bp, Artificial Sequence
  Synthetic Polynucleotide
taatacgactcactatagggcggatcaggctcagctagaatataccgataaacagaggagatatcggatgattctagctaacctggcggcagcgcaaaagatg

SEQ ID NO: 92311 - DNA, 103 bp, Artificial Sequence
  Synthetic Polynucleotide
taatacgactcactatagggcaggggcgtgcggatcaggctcagctagaaaacagaggagattctagatgagcctgatcaacctggcggcagcgcaaaagatg

SEQ ID NO: 92312 - DNA, 103 bp, Artificial Sequence
  Synthetic Polynucleotide
taatacgactcactatagggttctcggggtcaggggcgtgcggatcaggcaacagaggagagcctgaatggcacgccccaacctggcggcagcgcaaaagatg

SEQ ID NO: 92313 - DNA, 103 bp, Artificial Sequence
  Synthetic Polynucleotide
taatacgactcactatagggaagttccagcttctcggggtcaggggcgtgaacagaggagacacgccatggaccccgagaacctggcggcagcgcaaaagatg

SEQ ID NO: 92314 - DNA, 103 bp, Artificial Sequence
  Synthetic Polynucleotide
taatacgactcactatagggcccagcagtcaagttccagcttctcggggtaacagaggagaaccccgatgagctggaacaacctggcggcagcgcaaaagatg

SEQ ID NO: 92315 - DNA, 103 bp, Artificial Sequence
  Synthetic Polynucleotide
taatacgactcactatagggggttttcctgcccagcagtcaagttccagcaacagaggagagctggaatgtgactgctgaacctggcggcagcgcaaaagatg

SEQ ID NO: 92316 - DNA, 103 bp, Artificial Sequence
  Synthetic Polynucleotide
taatacgactcactatagggtccaggaataggttttcctgcccagcagtcaacagaggagagactgcatggcaggaaaaaacctggcggcagcgcaaaagatg

SEQ ID NO: 92317 - DNA, 103 bp, Artificial Sequence
  Synthetic Polynucleotide
taatacgactcactatagggcaggaggagcggctgctcccgctgccaccgaacagaggagacggtggatgcgggagcagaacctggcggcagcgcaaaagatg

SEQ ID NO: 92318 - DNA, 103 bp, Artificial Sequence
  Synthetic Polynucleotide
taatacgactcactatagggtgtagaggtctccaggaataggttttcctgaacagaggagacaggaaatgctattcctgaacctggcggcagcgcaaaagatg

SEQ ID NO: 92319 - DNA, 103 bp, Artificial Sequence
  Synthetic Polynucleotide
taatacgactcactatagggaagcaggctctgtagaggtctccaggaataaacagaggagatattccatgagacctctaaacctggcggcagcgcaaaagatg

SEQ ID NO: 92320 - DNA, 103 bp, Artificial Sequence
  Synthetic Polynucleotide
taatacgactcactatagggccgttcatacaagcaggctctgtagaggtcaacagaggagagacctcatgagagcctgcaacctggcggcagcgcaaaagatg

SEQ ID NO: 92321 - DNA, 103 bp, Artificial Sequence
  Synthetic Polynucleotide
taatacgactcactatagggctaacaaaacccgttcatacaagcaggctcaacagaggagagagcctatgtgtatgaacaacctggcggcagcgcaaaagatg

SEQ ID NO: 92322 - DNA, 103 bp, Artificial Sequence
  Synthetic Polynucleotide
taatacgactcactatagggtcatgtagggctaacaaaacccgttcatacaacagaggagagtatgaatgggttttgttaacctggcggcagcgcaaaagatg

SEQ ID NO: 92323 - DNA, 103 bp, Artificial Sequence
  Synthetic Polynucleotide
taatacgactcactataggggggagctcgatcatgtagggctaacaaaacaacagaggagagttttgatggccctacataacctggcggcagcgcaaaagatg

SEQ ID NO: 92324 - DNA, 103 bp, Artificial Sequence
  Synthetic Polynucleotide
taatacgactcactatagggtctttaactggggagctcgatcatgtagggaacagaggagaccctacatgatcgagctcaacctggcggcagcgcaaaagatg

SEQ ID NO: 92325 - DNA, 103 bp, Artificial Sequence
  Synthetic Polynucleotide
taatacgactcactatagggtcatctgagatctttaactggggagctcgaaacagaggagatcgagcatgccagttaaaaacctggcggcagcgcaaaagatg

SEQ ID NO: 92326 - DNA, 103 bp, Artificial Sequence
  Synthetic Polynucleotide
taatacgactcactatagggagtcagccggtcatctgagatctttaactgaacagaggagacagttaatgatctcagataacctggcggcagcgcaaaagatg

SEQ ID NO: 92327 - DNA, 103 bp, Artificial Sequence
  Synthetic Polynucleotide
taatacgactcactatagggctccaaccacagtcagccggtcatctgagaaacagaggagatctcagatgaccggctgaaacctggcggcagcgcaaaagatg

SEQ ID NO: 92328 - DNA, 103 bp, Artificial Sequence
  Synthetic Polynucleotide
taatacgactcactatagggatcccctctccaggaggagcggctgctcccaacagaggagagggagcatgcgctcctccaacctggcggcagcgcaaaagatg

SEQ ID NO: 92329 - DNA, 103 bp, Artificial Sequence
  Synthetic Polynucleotide
taatacgactcactatagggtagcccttctctccaaccacagtcagccggaacagaggagaccggctatgtgtggttggaacctggcggcagcgcaaaagatg

SEQ ID NO: 92330 - DNA, 103 bp, Artificial Sequence
  Synthetic Polynucleotide
taatacgactcactatagggcaccatagagtagcccttctctccaaccacaacagaggagagtggttatggagaagggcaacctggcggcagcgcaaaagatg

SEQ ID NO: 92331 - DNA, 103 bp, Artificial Sequence
  Synthetic Polynucleotide
taatacgactcactataggggagaggccctcaccatagagtagcccttctaacagaggagaagaaggatgactctatggaacctggcggcagcgcaaaagatg

SEQ ID NO: 92332 - DNA, 103 bp, Artificial Sequence
  Synthetic Polynucleotide
taatacgactcactatagggcgtactccatgagaggccctcaccatagagaacagaggagactctatatggagggcctcaacctggcggcagcgcaaaagatg

SEQ ID NO: 92333 - DNA, 103 bp, Artificial Sequence
  Synthetic Polynucleotide
taatacgactcactatagggggcacctttccgtactccatgagaggccctaacagaggagaagggccatgcatggagtaaacctggcggcagcgcaaaagatg

SEQ ID NO: 92334 - DNA, 103 bp, Artificial Sequence
  Synthetic Polynucleotide
taatacgactcactatagggcaaaataccaggcacctttccgtactccataacagaggagaatggagatgggaaaggtgaacctggcggcagcgcaaaagatg

SEQ ID NO: 92335 - DNA, 103 bp, Artificial Sequence
  Synthetic Polynucleotide
taatacgactcactatagggacagtgatttcaaaataccaggcacctttcaacagaggagagaaaggatgctggtatttaacctggcggcagcgcaaaagatg

SEQ ID NO: 92336 - DNA, 103 bp, Artificial Sequence
  Synthetic Polynucleotide
taatacgactcactatagggcatctcatccacagtgatttcaaaataccaaacagaggagatggtatatggaaatcactaacctggcggcagcgcaaaagatg

SEQ ID NO: 92337 - DNA, 103 bp, Artificial Sequence
  Synthetic Polynucleotide
taatacgactcactatagggtatctggtggcatctcatccacagtgatttaacagaggagaaaatcaatgtggatgagaaacctggcggcagcgcaaaagatg

SEQ ID NO: 92338 - DNA, 103 bp, Artificial Sequence
  Synthetic Polynucleotide
taatacgactcactatagggctggcagcggtatctggtggcatctcatccaacagaggagaggatgaatggccaccagaaacctggcggcagcgcaaaagatg

SEQ ID NO: 92339 - DNA, 103 bp, Artificial Sequence
  Synthetic Polynucleotide
taatacgactcactatagggagcagcagagatcccctctccaggaggagcaacagaggagagctcctatgggagaggggaacctggcggcagcgcaaaagatg

SEQ ID NO: 92340 - DNA, 103 bp, Artificial Sequence
  Synthetic Polynucleotide
taatacgactcactatagggccaacccagtctggcagcggtatctggtggaacagaggagaccaccaatgaccgctgccaacctggcggcagcgcaaaagatg

SEQ ID NO: 92341 - DNA, 103 bp, Artificial Sequence
  Synthetic Polynucleotide
taatacgactcactatagggggggctgggaccaacccagtctggcagcggaacagaggagaccgctgatggactgggttaacctggcggcagcgcaaaagatg

SEQ ID NO: 92342 - DNA, 103 bp, Artificial Sequence
  Synthetic Polynucleotide
taatacgactcactatagggaggtttcctaggggctgggaccaacccagtaacagaggagaactgggatggtcccagccaacctggcggcagcgcaaaagatg

SEQ ID NO: 92343 - DNA, 103 bp, Artificial Sequence
  Synthetic Polynucleotide
taatacgactcactatagggaggagcttgaaggtttcctaggggctgggaaacagaggagatcccagatgctaggaaacaacctggcggcagcgcaaaagatg

SEQ ID NO: 92344 - DNA, 103 bp, Artificial Sequence
  Synthetic Polynucleotide
taatacgactcactatagggcataacctaaaggagcttgaaggtttcctaaacagaggagataggaaatgttcaagctcaacctggcggcagcgcaaaagatg

SEQ ID NO: 92345 - DNA, 103 bp, Artificial Sequence
  Synthetic Polynucleotide
taatacgactcactatagggctaaatttatcataacctaaaggagcttgaaacagaggagatcaagcatgtttaggttaaacctggcggcagcgcaaaagatg

SEQ ID NO: 92346 - DNA, 103 bp, Artificial Sequence
  Synthetic Polynucleotide
taatacgactcactatagggccaagaatagctaaatttatcataacctaaaacagaggagattaggtatggataaatttaacctggcggcagcgcaaaagatg

SEQ ID NO: 92347 - DNA, 103 bp, Artificial Sequence
  Synthetic Polynucleotide
taatacgactcactatagggttttgctccgccaagaatagctaaatttataacagaggagaataaatatggctattcttaacctggcggcagcgcaaaagatg

SEQ ID NO: 92348 - DNA, 103 bp, Artificial Sequence
  Synthetic Polynucleotide
taatacgactcactatagggttggttccctttttgctccgccaagaatagaacagaggagactattcatggcggagcaaaacctggcggcagcgcaaaagatg

SEQ ID NO: 92349 - DNA, 103 bp, Artificial Sequence
  Synthetic Polynucleotide
taatacgactcactatagggctggtggaacttggttccctttttgctccgaacagaggagacggagcatgaagggaaccaacctggcggcagcgcaaaagatg

SEQ ID NO: 92350 - DNA, 103 bp, Artificial Sequence
  Synthetic Polynucleotide
taatacgactcactatagggcaactgtcggagcagcagagatcccctctcaacagaggagagagaggatgtctctgctgaacctggcggcagcgcaaaagatg

SEQ ID NO: 92351 - DNA, 103 bp, Artificial Sequence
  Synthetic Polynucleotide
taatacgactcactatagggtgccaatggactggtggaacttggttccctaacagaggagaagggaaatgagttccaccaacctggcggcagcgcaaaagatg

SEQ ID NO: 92352 - DNA, 103 bp, Artificial Sequence
  Synthetic Polynucleotide
taatacgactcactataggggagtagtgtttgccaatggactggtggaacaacagaggagagttccaatggtccattggaacctggcggcagcgcaaaagatg

SEQ ID NO: 92353 - DNA, 103 bp, Artificial Sequence
  Synthetic Polynucleotide
taatacgactcactatagggatagccagaagagtagtgtttgccaatggaaacagaggagatccattatgaaacactacaacctggcggcagcgcaaaagatg

SEQ ID NO: 92354 - DNA, 103 bp, Artificial Sequence
  Synthetic Polynucleotide
taatacgactcactatagggctccctgtccatagccagaagagtagtgttaacagaggagaaacactatgcttctggctaacctggcggcagcgcaaaagatg

SEQ ID NO: 92355 - DNA, 103 bp, Artificial Sequence
  Synthetic Polynucleotide
taatacgactcactatagggcccaggacgtctccctgtccatagccagaaaacagaggagattctggatgtggacagggaacctggcggcagcgcaaaagatg

SEQ ID NO: 92356 - DNA, 103 bp, Artificial Sequence
  Synthetic Polynucleotide
taatacgactcactatagggaatataaaatcccaggacgtctccctgtccaacagaggagaggacagatggacgtcctgaacctggcggcagcgcaaaagatg

SEQ ID NO: 92357 - DNA, 103 bp, Artificial Sequence
  Synthetic Polynucleotide
taatacgactcactatagggcaggaagattaatataaaatcccaggacgtaacagaggagaacgtccatggattttataaacctggcggcagcgcaaaagatg

SEQ ID NO: 92358 - DNA, 103 bp, Artificial Sequence
  Synthetic Polynucleotide
taatacgactcactatagggtctgtgtcttcaggaagattaatataaaataacagaggagaattttaatgtaatcttccaacctggcggcagcgcaaaagatg

SEQ ID NO: 92359 - DNA, 103 bp, Artificial Sequence
  Synthetic Polynucleotide
taatacgactcactatagggcttggctgtctctgtgtcttcaggaagattaacagaggagaaatcttatggaagacacaaacctggcggcagcgcaaaagatg

SEQ ID NO: 92360 - DNA, 103 bp, Artificial Sequence
  Synthetic Polynucleotide
taatacgactcactatagggctggcaatgacttggctgtctctgtgtcttaacagaggagaaagacaatgagacagccaaacctggcggcagcgcaaaagatg

SEQ ID NO: 92361 - DNA, 103 bp, Artificial Sequence
  Synthetic Polynucleotide
taatacgactcactataggggaactgggctcaactgtcggagcagcagagaacagaggagactctgcatgtccgacagtaacctggcggcagcgcaaaagatg

SEQ ID NO: 92362 - DNA, 103 bp, Artificial Sequence
  Synthetic Polynucleotide
taatacgactcactatagggttgtatgtgtctggcaatgacttggctgtcaacagaggagagacagcatggtcattgccaacctggcggcagcgcaaaagatg

SEQ ID NO: 92363 - DNA, 103 bp, Artificial Sequence
  Synthetic Polynucleotide
taatacgactcactatagggagccttatctttgtatgtgtctggcaatgaaacagaggagatcattgatggacacatacaacctggcggcagcgcaaaagatg

SEQ ID NO: 92364 - DNA, 103 bp, Artificial Sequence
  Synthetic Polynucleotide
taatacgactcactatagggattttatcaaagccttatctttgtatgtgtaacagaggagaacacatatgaagataaggaacctggcggcagcgcaaaagatg

SEQ ID NO: 92365 - DNA, 103 bp, Artificial Sequence
  Synthetic Polynucleotide
taatacgactcactatagggtaactcttgaattttatcaaagccttatctaacagaggagaagataaatgtttgataaaaacctggcggcagcgcaaaagatg

SEQ ID NO: 92366 - DNA, 103 bp, Artificial Sequence
  Synthetic Polynucleotide
taatacgactcactatagggaaaatacaaataactcttgaattttatcaaaacagaggagattgataatgttcaagagtaacctggcggcagcgcaaaagatg

SEQ ID NO: 92367 - DNA, 103 bp, Artificial Sequence
  Synthetic Polynucleotide
taatacgactcactatagggctttttcctcaaaatacaaataactcttgaaacagaggagatcaagaatgatttgtattaacctggcggcagcgcaaaagatg

SEQ ID NO: 92368 - DNA, 103 bp, Artificial Sequence
  Synthetic Polynucleotide
taatacgactcactatagggtccacaaagtctttttcctcaaaatacaaaaacagaggagatttgtaatgtgaggaaaaaacctggcggcagcgcaaaagatg

SEQ ID NO: 92369 - DNA, 103 bp, Artificial Sequence
  Synthetic Polynucleotide
taatacgactcactatagggctctgctttatccacaaagtctttttcctcaacagaggagagaggaaatggactttgtgaacctggcggcagcgcaaaagatg

SEQ ID NO: 92370 - DNA, 103 bp, Artificial Sequence
  Synthetic Polynucleotide
taatacgactcactatagggtcaggctcttctctgctttatccacaaagtaacagaggagaactttgatgataaagcagaacctggcggcagcgcaaaagatg

SEQ ID NO: 92371 - DNA, 103 bp, Artificial Sequence
  Synthetic Polynucleotide
taatacgactcactatagggggagtctgcttcaggctcttctctgctttaaacagaggagataaagcatggaagagcctaacctggcggcagcgcaaaagatg

SEQ ID NO: 92372 - DNA, 103 bp, Artificial Sequence
  Synthetic Polynucleotide
taatacgactcactatagggagcctccccggaactgggctcaactgtcggaacagaggagaccgacaatggagcccagtaacctggcggcagcgcaaaagatg

SEQ ID NO: 92373 - DNA, 103 bp, Artificial Sequence
  Synthetic Polynucleotide
taatacgactcactatagggctcactatggggagtctgcttcaggctcttaacagaggagaaagagcatgaagcagactaacctggcggcagcgcaaaagatg

SEQ ID NO: 92374 - DNA, 103 bp, Artificial Sequence
  Synthetic Polynucleotide
taatacgactcactatagggaaaatattatctcactatggggagtctgctaacagaggagaagcagaatgcccatagtgaacctggcggcagcgcaaaagatg

SEQ ID NO: 92375 - DNA, 103 bp, Artificial Sequence
  Synthetic Polynucleotide
taatacgactcactatagggccatttttataaaatattatctcactatggaacagaggagaccatagatggataatattaacctggcggcagcgcaaaagatg

SEQ ID NO: 92376 - DNA, 103 bp, Artificial Sequence
  Synthetic Polynucleotide
taatacgactcactatagggttgattgacaccatttttataaaatattataacagaggagaataataatgtataaaaataacctggcggcagcgcaaaagatg

SEQ ID NO: 92377 - DNA, 103 bp, Artificial Sequence
  Synthetic Polynucleotide
taatacgactcactatagggaagccacaccttgattgacaccatttttataacagaggagaataaaaatggtgtcaatcaacctggcggcagcgcaaaagatg

SEQ ID NO: 92378 - DNA, 103 bp, Artificial Sequence
  Synthetic Polynucleotide
taatacgactcactatagggatatctttgtaagccacaccttgattgacaaacagaggagatgtcaaatgaggtgtggcaacctggcggcagcgcaaaagatg

SEQ ID NO: 92379 - DNA, 103 bp, Artificial Sequence
  Synthetic Polynucleotide
taatacgactcactatagggcccctcaaaaatatctttgtaagccacaccaacagaggagaggtgtgatgtacaaagataacctggcggcagcgcaaaagatg

SEQ ID NO: 92380 - DNA, 103 bp, Artificial Sequence
  Synthetic Polynucleotide
taatacgactcactatagggggaagtaaaccccctcaaaaatatctttgtaacagaggagaacaaagatgtttttgaggaacctggcggcagcgcaaaagatg

SEQ ID NO: 92381 - DNA, 103 bp, Artificial Sequence
  Synthetic Polynucleotide
taatacgactcactataggggagatggctgggaagtaaaccccctcaaaaaacagaggagattttgaatgggtttacttaacctggcggcagcgcaaaagatg

SEQ ID NO: 92382 - DNA, 103 bp, Artificial Sequence
  Synthetic Polynucleotide
taatacgactcactatagggcttgtacagtgagatggctgggaagtaaacaacagaggagagtttacatgccagccatcaacctggcggcagcgcaaaagatg

SEQ ID NO: 92383 - DNA, 103 bp, Artificial Sequence
  Synthetic Polynucleotide
taatacgactcactatagggccccgccttcagcctccccggaactgggctaacagaggagaagcccaatgccggggaggaacctggcggcagcgcaaaagatg

SEQ ID NO: 92384 - DNA, 103 bp, Artificial Sequence
  Synthetic Polynucleotide
taatacgactcactatagggccgtgcagctcttgtacagtgagatggctgaacagaggagacagccaatgcactgtacaaacctggcggcagcgcaaaagatg

SEQ ID NO: 92385 - DNA, 103 bp, Artificial Sequence
  Synthetic Polynucleotide
taatacgactcactatagggttaatggaaaccgtgcagctcttgtacagtaacagaggagaactgtaatggagctgcacaacctggcggcagcgcaaaagatg

SEQ ID NO: 92386 - DNA, 103 bp, Artificial Sequence
  Synthetic Polynucleotide
taatacgactcactatagggtggtccaaagttaatggaaaccgtgcagctaacagaggagaagctgcatggtttccattaacctggcggcagcgcaaaagatg

SEQ ID NO: 92387 - DNA, 103 bp, Artificial Sequence
  Synthetic Polynucleotide
taatacgactcactatagggacttgaagcatggtccaaagttaatggaaaaacagaggagatttccaatgactttggacaacctggcggcagcgcaaaagatg

SEQ ID NO: 92388 - DNA, 103 bp, Artificial Sequence
  Synthetic Polynucleotide
taatacgactcactatagggttcggaggatacttgaagcatggtccaaagaacagaggagactttggatgatgcttcaaaacctggcggcagcgcaaaagatg

SEQ ID NO: 92389 - DNA, 103 bp, Artificial Sequence
  Synthetic Polynucleotide
taatacgactcactatagggagtgagatccttcggaggatacttgaagcaaacagaggagatgcttcatgtatcctccgaacctggcggcagcgcaaaagatg

SEQ ID NO: 92390 - DNA, 103 bp, Artificial Sequence
  Synthetic Polynucleotide
taatacgactcactatagggtagggcggtaagtgagatccttcggaggataacagaggagaatcctcatgaggatctcaaacctggcggcagcgcaaaagatg

SEQ ID NO: 92391 - DNA, 103 bp, Artificial Sequence
  Synthetic Polynucleotide
taatacgactcactatagggatgtcactcatagggcggtaagtgagatccaacagaggagaggatctatgttaccgcccaacctggcggcagcgcaaaagatg

SEQ ID NO: 92392 - DNA, 103 bp, Artificial Sequence
  Synthetic Polynucleotide
taatacgactcactataggggccccagcccatgtcactcatagggcggtaaacagaggagataccgcatgatgagtgacaacctggcggcagcgcaaaagatg

SEQ ID NO: 92393 - DNA, 103 bp, Artificial Sequence
  Synthetic Polynucleotide
taatacgactcactatagggctaccacggcgccccagcccatgtcactcaaacagaggagatgagtgatgtgggctgggaacctggcggcagcgcaaaagatg

SEQ ID NO: 92394 - DNA, 103 bp, Artificial Sequence
  Synthetic Polynucleotide
taatacgactcactatagggaagtttgcctccccgccttcagcctccccgaacagaggagacggggaatgtgaaggcggaacctggcggcagcgcaaaagatg

SEQ ID NO: 92395 - DNA, 103 bp, Artificial Sequence
  Synthetic Polynucleotide
taatacgactcactatagggagggtgtgctctaccacggcgccccagcccaacagaggagagggctgatgcgccgtggtaacctggcggcagcgcaaaagatg

SEQ ID NO: 92396 - DNA, 103 bp, Artificial Sequence
  Synthetic Polynucleotide
taatacgactcactataggggacgtcagccagggtgtgctctaccacggcaacagaggagagccgtgatggagcacaccaacctggcggcagcgcaaaagatg

SEQ ID NO: 92397 - DNA, 103 bp, Artificial Sequence
  Synthetic Polynucleotide
taatacgactcactatagggcgtgatacaagacgtcagccagggtgtgctaacagaggagaagcacaatgtggctgacgaacctggcggcagcgcaaaagatg

SEQ ID NO: 92398 - DNA, 103 bp, Artificial Sequence
  Synthetic Polynucleotide
taatacgactcactatagggtctgtctccacgtgatacaagacgtcagccaacagaggagaggctgaatgcttgtatcaaacctggcggcagcgcaaaagatg

SEQ ID NO: 92399 - DNA, 103 bp, Artificial Sequence
  Synthetic Polynucleotide
taatacgactcactatagggcccatccacttctgtctccacgtgatacaaaacagaggagattgtatatggtggagacaaacctggcggcagcgcaaaagatg

SEQ ID NO: 92400 - DNA, 103 bp, Artificial Sequence
  Synthetic Polynucleotide
taatacgactcactataggggactgcgcctcccatccacttctgtctccaaacagaggagatggagaatgaagtggatgaacctggcggcagcgcaaaagatg

SEQ ID NO: 92401 - DNA, 103 bp, Artificial Sequence
  Synthetic Polynucleotide
taatacgactcactatagggtcccatgggggactgcgcctcccatccactaacagaggagaagtggaatggaggcgcagaacctggcggcagcgcaaaagatg

SEQ ID NO: 92402 - DNA, 103 bp, Artificial Sequence
  Synthetic Polynucleotide
taatacgactcactatagggtacatcgaccaagtttgcctccccgccttcaacagaggagagaaggcatggaggcaaacaacctggcggcagcgcaaaagatg

SEQ ID NO: 92403 - DNA, 103 bp, Artificial Sequence
  Synthetic Polynucleotide
taatacgactcactatagggcacccgcttcctggccaggtcctgctcctgaacagaggagacaggagatggacctggccaacctggcggcagcgcaaaagatg

SEQ ID NO: 92404 - DNA, 103 bp, Artificial Sequence
  Synthetic Polynucleotide
taatacgactcactatagggagccaccgcttacatcgaccaagtttgcctaacagaggagaaggcaaatgtggtcgatgaacctggcggcagcgcaaaagatg

SEQ ID NO: 92405 - DNA, 103 bp, Artificial Sequence
  Synthetic Polynucleotide
taatacgactcactatagggtctgtctccaagccaccgcttacatcgaccaacagaggagaggtcgaatgaagcggtggaacctggcggcagcgcaaaagatg

SEQ ID NO: 92406 - DNA, 103 bp, Artificial Sequence
  Synthetic Polynucleotide
taatacgactcactatagggattagatgattctgtctccaagccaccgctaacagaggagaagcggtatgttggagacaaacctggcggcagcgcaaaagatg

SEQ ID NO: 92407 - DNA, 103 bp, Artificial Sequence
  Synthetic Polynucleotide
taatacgactcactatagggtatcttttccattagatgattctgtctccaaacagaggagatggagaatgaatcatctaaacctggcggcagcgcaaaagatg

SEQ ID NO: 92408 - DNA, 103 bp, Artificial Sequence
  Synthetic Polynucleotide
taatacgactcactatagggccttctagtgtatcttttccattagatgataacagaggagaatcatcatgtggaaaagaaacctggcggcagcgcaaaagatg

SEQ ID NO: 92409 - DNA, 103 bp, Artificial Sequence
  Synthetic Polynucleotide
taatacgactcactatagggatccccagcaccttctagtgtatcttttccaacagaggagaggaaaaatgacactagaaaacctggcggcagcgcaaaagatg

SEQ ID NO: 92410 - DNA, 103 bp, Artificial Sequence
  Synthetic Polynucleotide
taatacgactcactatagggcctctgatgtatccccagcaccttctagtgaacagaggagacactagatggtgctggggaacctggcggcagcgcaaaagatg

SEQ ID NO: 92411 - DNA, 103 bp, Artificial Sequence
  Synthetic Polynucleotide
taatacgactcactataggggtatccatcacctctgatgtatccccagcaaacagaggagatgctggatgtacatcagaaacctggcggcagcgcaaaagatg

SEQ ID NO: 92412 - DNA, 103 bp, Artificial Sequence
  Synthetic Polynucleotide
taatacgactcactataggggcccgcctgagtatccatcacctctgatgtaacagaggagaacatcaatggtgatggataacctggcggcagcgcaaaagatg

SEQ ID NO: 92413 - DNA, 103 bp, Artificial Sequence
  Synthetic Polynucleotide
taatacgactcactatagggcatccacggagcccgcctgagtatccatcaaacagaggagatgatggatgctcaggcggaacctggcggcagcgcaaaagatg

SEQ ID NO: 92414 - DNA, 103 bp, Artificial Sequence
  Synthetic Polynucleotide
taatacgactcactatagggccaggcccggcacccgcttcctggccaggtaacagaggagaacctggatgggaagcgggaacctggcggcagcgcaaaagatg

SEQ ID NO: 92415 - DNA, 103 bp, Artificial Sequence
  Synthetic Polynucleotide
taatacgactcactatagggccattctcttcatccacggagcccgcctgaaacagaggagatcaggcatgctccgtggaaacctggcggcagcgcaaaagatg

SEQ ID NO: 92416 - DNA, 103 bp, Artificial Sequence
  Synthetic Polynucleotide
taatacgactcactatagggcaactgtcggccattctcttcatccacggaaacagaggagatccgtgatggaagagaataacctggcggcagcgcaaaagatg

SEQ ID NO: 92417 - DNA, 103 bp, Artificial Sequence
  Synthetic Polynucleotide
taatacgactcactatagggctacctcacccaactgtcggccattctcttaacagaggagaaagagaatggccgacagtaacctggcggcagcgcaaaagatg

SEQ ID NO: 92418 - DNA, 103 bp, Artificial Sequence
  Synthetic Polynucleotide
taatacgactcactatagggcattgcagctctacctcacccaactgtcggaacagaggagaccgacaatggggtgaggtaacctggcggcagcgcaaaagatg

SEQ ID NO: 92419 - DNA, 103 bp, Artificial Sequence
  Synthetic Polynucleotide
taatacgactcactatagggacaaatcccacattgcagctctacctcaccaacagaggagaggtgagatggagctgcaaaacctggcggcagcgcaaaagatg

SEQ ID NO: 92420 - DNA, 103 bp, Artificial Sequence
  Synthetic Polynucleotide
taatacgactcactatagggaccattttgtacaaatcccacattgcagctaacagaggagaagctgcatggtgggatttaacctggcggcagcgcaaaagatg

SEQ ID NO: 92421 - DNA, 103 bp, Artificial Sequence
  Synthetic Polynucleotide
taatacgactcactatagggtcagccgtgaaccattttgtacaaatcccaaacagaggagatgggatatgtacaaaatgaacctggcggcagcgcaaaagatg

SEQ ID NO: 92422 - DNA, 103 bp, Artificial Sequence
  Synthetic Polynucleotide
taatacgactcactataggggccaaatgtgtcagccgtgaaccattttgtaacagaggagaacaaaaatgttcacggctaacctggcggcagcgcaaaagatg

SEQ ID NO: 92423 - DNA, 103 bp, Artificial Sequence
  Synthetic Polynucleotide
taatacgactcactatagggaggtatctatgccaaatgtgtcagccgtgaaacagaggagatcacggatgacacatttgaacctggcggcagcgcaaaagatg

SEQ ID NO: 92424 - DNA, 103 bp, Artificial Sequence
  Synthetic Polynucleotide
taatacgactcactatagggagacaggatgaggtatctatgccaaatgtgaacagaggagacacattatgcatagatacaacctggcggcagcgcaaaagatg

SEQ ID NO: 92425 - DNA, 103 bp, Artificial Sequence
  Synthetic Polynucleotide
taatacgactcactatagggcgctcctgggccaggcccggcacccgcttcaacagaggagagaagcgatggccgggcctaacctggcggcagcgcaaaagatg

SEQ ID NO: 92426 - DNA, 103 bp, Artificial Sequence
  Synthetic Polynucleotide
taatacgactcactatagggcatgaaaggtagacaggatgaggtatctataacagaggagaatagatatgtcatcctgtaacctggcggcagcgcaaaagatg

SEQ ID NO: 92427 - DNA, 103 bp, Artificial Sequence
  Synthetic Polynucleotide
taatacgactcactatagggtgtagttggtcatgaaaggtagacaggatgaacagaggagacatcctatgtacctttcaaacctggcggcagcgcaaaagatg

SEQ ID NO: 92428 - DNA, 103 bp, Artificial Sequence
  Synthetic Polynucleotide
taatacgactcactatagggcaatgaaaactgtagttggtcatgaaaggtaacagaggagaacctttatggaccaactaaacctggcggcagcgcaaaagatg

SEQ ID NO: 92429 - DNA, 103 bp, Artificial Sequence
  Synthetic Polynucleotide
taatacgactcactataggggcagacgttgcaatgaaaactgtagttggtaacagaggagaaccaacatgagttttcataacctggcggcagcgcaaaagatg

SEQ ID NO: 92430 - DNA, 103 bp, Artificial Sequence
  Synthetic Polynucleotide
taatacgactcactatagggcactgtgatggcagacgttgcaatgaaaacaacagaggagagttttcatggcaacgtctaacctggcggcagcgcaaaagatg

SEQ ID NO: 92431 - DNA, 103 bp, Artificial Sequence
  Synthetic Polynucleotide
taatacgactcactatagggtaggtattcccactgtgatggcagacgttgaacagaggagacaacgtatgccatcacagaacctggcggcagcgcaaaagatg

SEQ ID NO: 92432 - DNA, 103 bp, Artificial Sequence
  Synthetic Polynucleotide
taatacgactcactatagggccggaggaaataggtattcccactgtgatgaacagaggagacatcacatggggaataccaacctggcggcagcgcaaaagatg

SEQ ID NO: 92433 - DNA, 103 bp, Artificial Sequence
  Synthetic Polynucleotide
taatacgactcactatagggttgcttgcttccggaggaaataggtattccaacagaggagaggaataatgatttcctccaacctggcggcagcgcaaaagatg

SEQ ID NO: 92434 - DNA, 103 bp, Artificial Sequence
  Synthetic Polynucleotide
taatacgactcactatagggtccttcaagtttgcttgcttccggaggaaaaacagaggagatttcctatggaagcaagcaacctggcggcagcgcaaaagatg

SEQ ID NO: 92435 - DNA, 103 bp, Artificial Sequence
  Synthetic Polynucleotide
taatacgactcactatagggaaggcacatttccttcaagtttgcttgcttaacagaggagaaagcaaatgaacttgaagaacctggcggcagcgcaaaagatg

SEQ ID NO: 92436 - DNA, 103 bp, Artificial Sequence
  Synthetic Polynucleotide
taatacgactcactatagggcatttgcgaccgctcctgggccaggcccggaacagaggagaccgggcatggcccaggagaacctggcggcagcgcaaaagatg

SEQ ID NO: 92437 - DNA, 103 bp, Artificial Sequence
  Synthetic Polynucleotide
taatacgactcactatagggccaaagcactaaggcacatttccttcaagtaacagaggagaacttgaatgaaatgtgccaacctggcggcagcgcaaaagatg

SEQ ID NO: 92438 - DNA, 103 bp, Artificial Sequence
  Synthetic Polynucleotide
taatacgactcactataggggtcaggttggccaaagcactaaggcacattaacagaggagaaatgtgatgtagtgctttaacctggcggcagcgcaaaagatg

SEQ ID NO: 92439 - DNA, 103 bp, Artificial Sequence
  Synthetic Polynucleotide
taatacgactcactatagggggactgccatgtcaggttggccaaagcactaacagaggagaagtgctatggccaacctgaacctggcggcagcgcaaaagatg

SEQ ID NO: 92440 - DNA, 103 bp, Artificial Sequence
  Synthetic Polynucleotide
taatacgactcactatagggcctgtgttcgggactgccatgtcaggttggaacagaggagaccaaccatgcatggcagtaacctggcggcagcgcaaaagatg

SEQ ID NO: 92441 - DNA, 103 bp, Artificial Sequence
  Synthetic Polynucleotide
taatacgactcactatagggggatgttcatcctgtgttcgggactgccataacagaggagaatggcaatgccgaacacaaacctggcggcagcgcaaaagatg

SEQ ID NO: 92442 - DNA, 103 bp, Artificial Sequence
  Synthetic Polynucleotide
taatacgactcactatagggcattgtcttcggatgttcatcctgtgttcgaacagaggagacgaacaatggatgaacataacctggcggcagcgcaaaagatg

SEQ ID NO: 92443 - DNA, 103 bp, Artificial Sequence
  Synthetic Polynucleotide
taatacgactcactatagggctttggagaacattgtcttcggatgttcataacagaggagaatgaacatgcgaagacaaaacctggcggcagcgcaaaagatg

SEQ ID NO: 92444 - DNA, 103 bp, Artificial Sequence
  Synthetic Polynucleotide
taatacgactcactatagggatatccttatctttggagaacattgtcttcaacagaggagagaagacatggttctccaaaacctggcggcagcgcaaaagatg

SEQ ID NO: 92445 - DNA, 103 bp, Artificial Sequence
  Synthetic Polynucleotide
taatacgactcactatagggaaatggtataatatccttatctttggagaaaacagaggagattctccatggataaggataacctggcggcagcgcaaaagatg

SEQ ID NO: 92446 - DNA, 103 bp, Artificial Sequence
  Synthetic Polynucleotide
taatacgactcactatagggatttatcaataaatggtataatatccttataacagaggagaataaggatgttataccataacctggcggcagcgcaaaagatg

SEQ ID NO: 92447 - DNA, 103 bp, Artificial Sequence
  Synthetic Polynucleotide
taatacgactcactataggggcccctgttgcatttgcgaccgctcctgggaacagaggagacccaggatgggtcgcaaaaacctggcggcagcgcaaaagatg

SEQ ID NO: 92448 - DNA, 103 bp, Artificial Sequence
  Synthetic Polynucleotide
taatacgactcactatagggcactcccagtatttatcaataaatggtataaacagaggagatataccatgtattgataaaacctggcggcagcgcaaaagatg

SEQ ID NO: 92449 - DNA, 103 bp, Artificial Sequence
  Synthetic Polynucleotide
taatacgactcactatagggggttgtcatgcactcccagtatttatcaataacagaggagaattgatatgtactgggagaacctggcggcagcgcaaaagatg

SEQ ID NO: 92450 - DNA, 103 bp, Artificial Sequence
  Synthetic Polynucleotide
taatacgactcactataggggtctctgtctggttgtcatgcactcccagtaacagaggagaactgggatggcatgacaaaacctggcggcagcgcaaaagatg

SEQ ID NO: 92451 - DNA, 103 bp, Artificial Sequence
  Synthetic Polynucleotide
taatacgactcactatagggattttcccaggtctctgtctggttgtcatgaacagaggagacatgacatgcagacagagaacctggcggcagcgcaaaagatg

SEQ ID NO: 92452 - DNA, 103 bp, Artificial Sequence
  Synthetic Polynucleotide
taatacgactcactatagggtggccaagtcattttcccaggtctctgtctaacagaggagaagacagatgcctgggaaaaacctggcggcagcgcaaaagatg

SEQ ID NO: 92453 - DNA, 103 bp, Artificial Sequence
  Synthetic Polynucleotide
taatacgactcactatagggcaatgttatttggccaagtcattttcccagaacagaggagactgggaatgtgacttggcaacctggcggcagcgcaaaagatg

SEQ ID NO: 92454 - DNA, 103 bp, Artificial Sequence
  Synthetic Polynucleotide
taatacgactcactatagggattgttttaacaatgttatttggccaagtcaacagaggagagacttgatgaaataacataacctggcggcagcgcaaaagatg

SEQ ID NO: 92455 - DNA, 103 bp, Artificial Sequence
  Synthetic Polynucleotide
taatacgactcactatagggttctttactcattgttttaacaatgttattaacagaggagaaataacatggttaaaacaaacctggcggcagcgcaaaagatg

SEQ ID NO: 92456 - DNA, 103 bp, Artificial Sequence
  Synthetic Polynucleotide
taatacgactcactatagggatacatctctttctttactcattgttttaaaacagaggagattaaaaatgtgagtaaagaacctggcggcagcgcaaaagatg

SEQ ID NO: 92457 - DNA, 103 bp, Artificial Sequence
  Synthetic Polynucleotide
taatacgactcactatagggtttaccaagaatacatctctttctttactcaacagaggagagagtaaatgaagagatgtaacctggcggcagcgcaaaagatg

SEQ ID NO: 92458 - DNA, 103 bp, Artificial Sequence
  Synthetic Polynucleotide
taatacgactcactatagggcccctcttctgcccctgttgcatttgcgacaacagaggagagtcgcaatggcaacagggaacctggcggcagcgcaaaagatg

SEQ ID NO: 92459 - DNA, 103 bp, Artificial Sequence
  Synthetic Polynucleotide
taatacgactcactatagggtgggtgttcctttaccaagaatacatctctaacagaggagaagagatatgttcttggtaaacctggcggcagcgcaaaagatg

SEQ ID NO: 92460 - DNA, 103 bp, Artificial Sequence
  Synthetic Polynucleotide
taatacgactcactatagggtgcctggatctgggtgttcctttaccaagaaacagaggagatcttggatgaggaacaccaacctggcggcagcgcaaaagatg

SEQ ID NO: 92461 - DNA, 103 bp, Artificial Sequence
  Synthetic Polynucleotide
taatacgactcactatagggggatctttactgcctggatctgggtgttccaacagaggagaggaacaatgagatccaggaacctggcggcagcgcaaaagatg

SEQ ID NO: 92462 - DNA, 103 bp, Artificial Sequence
  Synthetic Polynucleotide
taatacgactcactatagggatcttcttctggatctttactgcctggatcaacagaggagagatccaatgagtaaagataacctggcggcagcgcaaaagatg

SEQ ID NO: 92463 - DNA, 103 bp, Artificial Sequence
  Synthetic Polynucleotide
taatacgactcactatagggatttggggtaatcttcttctggatctttacaacagaggagagtaaagatgcagaagaagaacctggcggcagcgcaaaagatg

SEQ ID NO: 92464 - DNA, 103 bp, Artificial Sequence
  Synthetic Polynucleotide
taatacgactcactatagggaaaagtccaaatttggggtaatcttcttctaacagaggagaagaagaatgttaccccaaaacctggcggcagcgcaaaagatg

SEQ ID NO: 92465 - DNA, 103 bp, Artificial Sequence
  Synthetic Polynucleotide
taatacgactcactataggggtcctgatccaaaagtccaaatttggggtaaacagaggagataccccatgtttggacttaacctggcggcagcgcaaaagatg

SEQ ID NO: 92466 - DNA, 103 bp, Artificial Sequence
  Synthetic Polynucleotide
taatacgactcactatagggtgttactaaggtcctgatccaaaagtccaaaacagaggagattggacatgtggatcaggaacctggcggcagcgcaaaagatg

SEQ ID NO: 92467 - DNA, 103 bp, Artificial Sequence
  Synthetic Polynucleotide
taatacgactcactataggggcaggaccaatgttactaaggtcctgatccaacagaggagaggatcaatgccttagtaaaacctggcggcagcgcaaaagatg

SEQ ID NO: 92468 - DNA, 103 bp, Artificial Sequence
  Synthetic Polynucleotide
taatacgactcactataggggttgtcataagcaggaccaatgttactaagaacagaggagacttagtatgattggtcctaacctggcggcagcgcaaaagatg

SEQ ID NO: 92469 - DNA, 103 bp, Artificial Sequence
  Synthetic Polynucleotide
taatacgactcactataggggcttcatctccccctcttctgcccctgttgaacagaggagacaacagatgcagaagaggaacctggcggcagcgcaaaagatg

SEQ ID NO: 92470 - DNA, 103 bp, Artificial Sequence
  Synthetic Polynucleotide
taatacgactcactatagggtctgtttttggttgtcataagcaggaccaaaacagaggagattggtcatgcttatgacaaacctggcggcagcgcaaaagatg

SEQ ID NO: 92471 - DNA, 103 bp, Artificial Sequence
  Synthetic Polynucleotide
taatacgactcactatagggacagcactgctctgtttttggttgtcataaaacagaggagattatgaatgccaaaaacaaacctggcggcagcgcaaaagatg

SEQ ID NO: 92472 - DNA, 103 bp, Artificial Sequence
  Synthetic Polynucleotide
taatacgactcactatagggactagtagacacagcactgctctgtttttgaacagaggagacaaaaaatgagcagtgctaacctggcggcagcgcaaaagatg

SEQ ID NO: 92473 - DNA, 103 bp, Artificial Sequence
  Synthetic Polynucleotide
taatacgactcactatagggttaaattcccactagtagacacagcactgcaacagaggagagcagtgatgtgtctactaaacctggcggcagcgcaaaagatg

SEQ ID NO: 92474 - DNA, 103 bp, Artificial Sequence
  Synthetic Polynucleotide
taatacgactcactatagggattcccccatttaaattcccactagtagacaacagaggagagtctacatgtgggaatttaacctggcggcagcgcaaaagatg

SEQ ID NO: 92475 - DNA, 103 bp, Artificial Sequence
  Synthetic Polynucleotide
taatacgactcactatagggtcctgctgcaattcccccatttaaattcccaacagaggagagggaatatgaatgggggaaacctggcggcagcgcaaaagatg

SEQ ID NO: 92476 - DNA, 103 bp, Artificial Sequence
  Synthetic Polynucleotide
taatacgactcactatagggttccgctgcttcctgctgcaattcccccataacagaggagaatggggatgttgcagcagaacctggcggcagcgcaaaagatg

SEQ ID NO: 92477 - DNA, 103 bp, Artificial Sequence
  Synthetic Polynucleotide
taatacgactcactatagggcctcgtccttttccgctgcttcctgctgcaaacagaggagatgcagcatgaagcagcggaacctggcggcagcgcaaaagatg

SEQ ID NO: 92478 - DNA, 103 bp, Artificial Sequence
  Synthetic Polynucleotide
taatacgactcactataggggcgcttggctcctcgtccttttccgctgctaacagaggagaagcagcatgaaaggacgaaacctggcggcagcgcaaaagatg

SEQ ID NO: 92479 - DNA, 103 bp, Artificial Sequence
  Synthetic Polynucleotide
taatacgactcactatagggcctgctgtttgcgcttggctcctcgtccttaacagaggagaaaggacatggagccaagcaacctggcggcagcgcaaaagatg

SEQ ID NO: 92480 - DNA, 103 bp, Artificial Sequence
  Synthetic Polynucleotide
taatacgactcactataggggctgccaccggcttcatctccccctcttctaacagaggagaagaagaatgggagatgaaaacctggcggcagcgcaaaagatg

SEQ ID NO: 92481 - DNA, 103 bp, Artificial Sequence
  Synthetic Polynucleotide
taatacgactcactataggggtccctccatcctgctgtttgcgcttggctaacagaggagaagccaaatgcaaacagcaaacctggcggcagcgcaaaagatg

SEQ ID NO: 92482 - DNA, 103 bp, Artificial Sequence
  Synthetic Polynucleotide
taatacgactcactatagggggtccctgtggtccctccatcctgctgtttaacagaggagaaaacagatggatggagggaacctggcggcagcgcaaaagatg

SEQ ID NO: 92483 - DNA, 103 bp, Artificial Sequence
  Synthetic Polynucleotide
taatacgactcactatagggccttcttggtggtccctgtggtccctccataacagaggagaatggagatgccacagggaaacctggcggcagcgcaaaagatg

SEQ ID NO: 92484 - DNA, 103 bp, Artificial Sequence
  Synthetic Polynucleotide
taatacgactcactatagggtcactccgggccttcttggtggtccctgtgaacagaggagacacaggatgcaccaagaaaacctggcggcagcgcaaaagatg

SEQ ID NO: 92485 - DNA, 103 bp, Artificial Sequence
  Synthetic Polynucleotide
taatacgactcactatagggaaacaaagggtcactccgggccttcttggtaacagaggagaaccaagatggcccggagtaacctggcggcagcgcaaaagatg

SEQ ID NO: 92486 - DNA, 103 bp, Artificial Sequence
  Synthetic Polynucleotide
taatacgactcactataggggctgagcagaaaacaaagggtcactccgggaacagaggagacccggaatgaccctttgtaacctggcggcagcgcaaaagatg

SEQ ID NO: 92487 - DNA, 103 bp, Artificial Sequence
  Synthetic Polynucleotide
taatacgactcactataggggggggaaggcgctgagcagaaaacaaagggaacagaggagaccctttatgttctgctcaaacctggcggcagcgcaaaagatg

SEQ ID NO: 92488 - DNA, 103 bp, Artificial Sequence
  Synthetic Polynucleotide
taatacgactcactataggggtagccatgagggggaaggcgctgagcagaaacagaggagatctgctatgcgccttcccaacctggcggcagcgcaaaagatg

SEQ ID NO: 92489 - DNA, 103 bp, Artificial Sequence
  Synthetic Polynucleotide
taatacgactcactataggggttccaatgggtagccatgagggggaaggcaacagaggagagccttcatgctcatggctaacctggcggcagcgcaaaagatg

SEQ ID NO: 92490 - DNA, 103 bp, Artificial Sequence
  Synthetic Polynucleotide
taatacgactcactatagggttaaacgggtgttccaatgggtagccatgaaacagaggagatcatggatgcccattggaaacctggcggcagcgcaaaagatg

SEQ ID NO: 92491 - DNA, 103 bp, Artificial Sequence
  Synthetic Polynucleotide
taatacgactcactatagggtgacgtggtactcttgtgggaatcttccataacagaggagaatggaaatgtcccacaagaacctggcggcagcgcaaaagatg

SEQ ID NO: 92492 - DNA, 103 bp, Artificial Sequence
  Synthetic Polynucleotide
taatacgactcactatagggctcctcactttctgataaagatgatacctgaacagaggagacaggtaatgtctttatcaaacctggcggcagcgcaaaagatg

SEQ ID NO: 92493 - DNA, 103 bp, Artificial Sequence
  Synthetic Polynucleotide
taatacgactcactatagggagtcctgggactcctcactttctgataaagaacagaggagactttatatgaaagtgaggaacctggcggcagcgcaaaagatg

SEQ ID NO: 92494 - DNA, 103 bp, Artificial Sequence
  Synthetic Polynucleotide
taatacgactcactatagggctgtcggatgagtcctgggactcctcacttaacagaggagaaagtgaatggtcccaggaaacctggcggcagcgcaaaagatg

SEQ ID NO: 92495 - DNA, 103 bp, Artificial Sequence
  Synthetic Polynucleotide
taatacgactcactatagggggagcctatgctgtcggatgagtcctgggaaacagaggagatcccagatgtcatccgacaacctggcggcagcgcaaaagatg

SEQ ID NO: 92496 - DNA, 103 bp, Artificial Sequence
  Synthetic Polynucleotide
taatacgactcactatagggctttctgtgaggagcctatgctgtcggatgaacagaggagacatccgatggcataggctaacctggcggcagcgcaaaagatg

SEQ ID NO: 92497 - DNA, 103 bp, Artificial Sequence
  Synthetic Polynucleotide
taatacgactcactatagggatcccgtgggctttctgtgaggagcctatgaacagaggagacataggatgctcacagaaaacctggcggcagcgcaaaagatg

SEQ ID NO: 92498 - DNA, 103 bp, Artificial Sequence
  Synthetic Polynucleotide
taatacgactcactatagggccgtgctaggatcccgtgggctttctgtgaaacagaggagatcacagatggcccacgggaacctggcggcagcgcaaaagatg

SEQ ID NO: 92499 - DNA, 103 bp, Artificial Sequence
  Synthetic Polynucleotide
taatacgactcactatagggaagatgggcgccgtgctaggatcccgtgggaacagaggagacccacgatgtcctagcacaacctggcggcagcgcaaaagatg

SEQ ID NO: 92500 - DNA, 103 bp, Artificial Sequence
  Synthetic Polynucleotide
taatacgactcactatagggatttttctgtaagatgggcgccgtgctaggaacagaggagacctagcatggcgcccatcaacctggcggcagcgcaaaagatg

SEQ ID NO: 92501 - DNA, 103 bp, Artificial Sequence
  Synthetic Polynucleotide
taatacgactcactataggggtctttcaaaatttttctgtaagatgggcgaacagaggagacgcccaatgtacagaaaaaacctggcggcagcgcaaaagatg

SEQ ID NO: 92502 - DNA, 103 bp, Artificial Sequence
  Synthetic Polynucleotide
taatacgactcactataggggtgctgtctctgacgtggtactcttgtgggaacagaggagacccacaatggtaccacgtaacctggcggcagcgcaaaagatg

SEQ ID NO: 92503 - DNA, 103 bp, Artificial Sequence
  Synthetic Polynucleotide
taatacgactcactatagggcagaagataagtctttcaaaatttttctgtaacagaggagaacagaaatgttttgaaagaacctggcggcagcgcaaaagatg

SEQ ID NO: 92504 - DNA, 103 bp, Artificial Sequence
  Synthetic Polynucleotide
taatacgactcactatagggcgtgtatcttcagaagataagtctttcaaaaacagaggagatttgaaatgcttatcttcaacctggcggcagcgcaaaagatg

SEQ ID NO: 92505 - DNA, 103 bp, Artificial Sequence
  Synthetic Polynucleotide
taatacgactcactatagggttttctgccccgtgtatcttcagaagataaaacagaggagattatctatggaagatacaaacctggcggcagcgcaaaagatg

SEQ ID NO: 92506 - DNA, 103 bp, Artificial Sequence
  Synthetic Polynucleotide
taatacgactcactatagggctccgtctccttttctgccccgtgtatcttaacagaggagaaagataatgggggcagaaaacctggcggcagcgcaaaagatg

SEQ ID NO: 92507 - DNA, 103 bp, Artificial Sequence
  Synthetic Polynucleotide
taatacgactcactatagggccagaattttctccgtctccttttctgcccaacagaggagagggcagatgaggagacggaacctggcggcagcgcaaaagatg

SEQ ID NO: 92508 - DNA, 103 bp, Artificial Sequence
  Synthetic Polynucleotide
taatacgactcactatagggagcagaaactccagaattttctccgtctccaacagaggagaggagacatggaaaattctaacctggcggcagcgcaaaagatg

SEQ ID NO: 92509 - DNA, 103 bp, Artificial Sequence
  Synthetic Polynucleotide
taatacgactcactatagggaagtgacagcagcagaaactccagaattttaacagaggagaaaaattatggagtttctgaacctggcggcagcgcaaaagatg

SEQ ID NO: 92510 - DNA, 103 bp, Artificial Sequence
  Synthetic Polynucleotide
taatacgactcactatagggacagacatagaagtgacagcagcagaaactaacagaggagaagtttcatgtgctgtcacaacctggcggcagcgcaaaagatg

SEQ ID NO: 92511 - DNA, 103 bp, Artificial Sequence
  Synthetic Polynucleotide
taatacgactcactataggggggagttggaacagacatagaagtgacagcaacagaggagagctgtcatgtctatgtctaacctggcggcagcgcaaaagatg

SEQ ID NO: 92512 - DNA, 103 bp, Artificial Sequence
  Synthetic Polynucleotide
taatacgactcactatagggtctgatagatgggagttggaacagacatagaacagaggagactatgtatgttccaactcaacctggcggcagcgcaaaagatg

SEQ ID NO: 92513 - DNA, 103 bp, Artificial Sequence
  Synthetic Polynucleotide
taatacgactcactatagggccaggttgaggtgctgtctctgacgtggtaaacagaggagataccacatgagagacagcaacctggcggcagcgcaaaagatg

SEQ ID NO: 92514 - DNA, 103 bp, Artificial Sequence
  Synthetic Polynucleotide
taatacgactcactatagggccgctgctagtctgatagatgggagttggaaacagaggagatccaacatgcatctatcaaacctggcggcagcgcaaaagatg

SEQ ID NO: 92515 - DNA, 103 bp, Artificial Sequence
  Synthetic Polynucleotide
taatacgactcactatagggaatgtactgtccgctgctagtctgatagataacagaggagaatctatatgactagcagcaacctggcggcagcgcaaaagatg

SEQ ID NO: 92516 - DNA, 103 bp, Artificial Sequence
  Synthetic Polynucleotide
taatacgactcactataggggggcaatggcaatgtactgtccgctgctagaacagaggagactagcaatggacagtacaaacctggcggcagcgcaaaagatg

SEQ ID NO: 92517 - DNA, 103 bp, Artificial Sequence
  Synthetic Polynucleotide
taatacgactcactataggggctccatttggggcaatggcaatgtactgtaacagaggagaacagtaatgtgccattgcaacctggcggcagcgcaaaagatg

SEQ ID NO: 92518 - DNA, 103 bp, Artificial Sequence
  Synthetic Polynucleotide
taatacgactcactatagggcaactgtaaggctccatttggggcaatggcaacagaggagagccattatgccaaatggaaacctggcggcagcgcaaaagatg

SEQ ID NO: 92519 - DNA, 103 bp, Artificial Sequence
  Synthetic Polynucleotide
taatacgactcactatagggctggacttgccaactgtaaggctccatttgaacagaggagacaaatgatgccttacagtaacctggcggcagcgcaaaagatg

SEQ ID NO: 92520 - DNA, 103 bp, Artificial Sequence
  Synthetic Polynucleotide
taatacgactcactatagggccatctgtgcctggacttgccaactgtaagaacagaggagacttacaatgggcaagtccaacctggcggcagcgcaaaagatg

SEQ ID NO: 92521 - DNA, 103 bp, Artificial Sequence
  Synthetic Polynucleotide
taatacgactcactatagggtccctgtactccatctgtgcctggacttgcaacagaggagagcaagtatgggcacagataacctggcggcagcgcaaaagatg

SEQ ID NO: 92522 - DNA, 103 bp, Artificial Sequence
  Synthetic Polynucleotide
taatacgactcactatagggatgtctgaagtccctgtactccatctgtgcaacagaggagagcacagatggagtacaggaacctggcggcagcgcaaaagatg

SEQ ID NO: 92523 - DNA, 103 bp, Artificial Sequence
  Synthetic Polynucleotide
taatacgactcactataggggtcatggttaatgtctgaagtccctgtactaacagaggagaagtacaatgacttcagacaacctggcggcagcgcaaaagatg

SEQ ID NO: 92524 - DNA, 103 bp, Artificial Sequence
  Synthetic Polynucleotide
taatacgactcactatagggaactgctgaaccaggttgaggtgctgtctcaacagaggagagagacaatgcctcaacctaacctggcggcagcgcaaaagatg

SEQ ID NO: 92525 - DNA, 103 bp, Artificial Sequence
  Synthetic Polynucleotide
taatacgactcactataggggcctgaatttgtcatggttaatgtctgaagaacagaggagacttcagatgttaaccatgaacctggcggcagcgcaaaagatg

SEQ ID NO: 92526 - DNA, 103 bp, Artificial Sequence
  Synthetic Polynucleotide
taatacgactcactataggggctgagtactgcctgaatttgtcatggttaaacagaggagataaccaatgcaaattcagaacctggcggcagcgcaaaagatg

SEQ ID NO: 92527 - DNA, 103 bp, Artificial Sequence
  Synthetic Polynucleotide
taatacgactcactataggggttgtaccttgctgagtactgcctgaatttaacagaggagaaaattcatgcagtactcaaacctggcggcagcgcaaaagatg

SEQ ID NO: 92528 - DNA, 103 bp, Artificial Sequence
  Synthetic Polynucleotide
taatacgactcactatagggctgaagaatagttgtaccttgctgagtactaacagaggagaagtactatgcaaggtacaaacctggcggcagcgcaaaagatg

SEQ ID NO: 92529 - DNA, 103 bp, Artificial Sequence
  Synthetic Polynucleotide
taatacgactcactatagggtctgtgcatactgaagaatagttgtaccttaacagaggagaaaggtaatgctattcttcaacctggcggcagcgcaaaagatg

SEQ ID NO: 92530 - DNA, 103 bp, Artificial Sequence
  Synthetic Polynucleotide
taatacgactcactatagggccatcagaggtctgtgcatactgaagaataaacagaggagatattctatggtatgcacaaacctggcggcagcgcaaaagatg

SEQ ID NO: 92531 - DNA, 103 bp, Artificial Sequence
  Synthetic Polynucleotide
taatacgactcactatagggtatctgctgtccatcagaggtctgtgcataaacagaggagatatgcaatgacctctgataacctggcggcagcgcaaaagatg

SEQ ID NO: 92532 - DNA, 103 bp, Artificial Sequence
  Synthetic Polynucleotide
taatacgactcactatagggtgggcacaagtatctgctgtccatcagaggaacagaggagacctctgatggacagcagaaacctggcggcagcgcaaaagatg

SEQ ID NO: 92533 - DNA, 103 bp, Artificial Sequence
  Synthetic Polynucleotide
taatacgactcactatagggacctgattgctgggcacaagtatctgctgtaacagaggagaacagcaatgacttgtgccaacctggcggcagcgcaaaagatg

SEQ ID NO: 92534 - DNA, 103 bp, Artificial Sequence
  Synthetic Polynucleotide
taatacgactcactatagggttgtacgaccacctgattgctgggcacaagaacagaggagacttgtgatgagcaatcagaacctggcggcagcgcaaaagatg

SEQ ID NO: 92535 - DNA, 103 bp, Artificial Sequence
  Synthetic Polynucleotide
taatacgactcactataggggagctccctgaactgctgaaccaggttgagaacagaggagactcaacatggttcagcagaacctggcggcagcgcaaaagatg

SEQ ID NO: 92536 - DNA, 103 bp, Artificial Sequence
  Synthetic Polynucleotide
taatacgactcactatagggctgatgcagtttgtacgaccacctgattgcaacagaggagagcaatcatgtggtcgtacaacctggcggcagcgcaaaagatg

SEQ ID NO: 92537 - DNA, 103 bp, Artificial Sequence
  Synthetic Polynucleotide
taatacgactcactatagggtgcatatctcctgatgcagtttgtacgaccaacagaggagaggtcgtatgaactgcatcaacctggcggcagcgcaaaagatg

SEQ ID NO: 92538 - DNA, 103 bp, Artificial Sequence
  Synthetic Polynucleotide
taatacgactcactatagggctgatatgtttgcatatctcctgatgcagtaacagaggagaactgcaatgggagatatgaacctggcggcagcgcaaaagatg

SEQ ID NO: 92539 - DNA, 103 bp, Artificial Sequence
  Synthetic Polynucleotide
taatacgactcactatagggtagttcggatctgatatgtttgcatatctcaacagaggagagagataatgaaacatatcaacctggcggcagcgcaaaagatg

SEQ ID NO: 92540 - DNA, 103 bp, Artificial Sequence
  Synthetic Polynucleotide
taatacgactcactataggggctgaaggtgtagttcggatctgatatgttaacagaggagaaacataatggatccgaacaacctggcggcagcgcaaaagatg

SEQ ID NO: 92541 - DNA, 103 bp, Artificial Sequence
  Synthetic Polynucleotide
taatacgactcactatagggcagagaagtagctgaaggtgtagttcggataacagaggagaatccgaatgacaccttcaaacctggcggcagcgcaaaagatg

SEQ ID NO: 92542 - DNA, 103 bp, Artificial Sequence
  Synthetic Polynucleotide
taatacgactcactatagggcagtttgtggcagagaagtagctgaaggtgaacagaggagacaccttatgctacttctcaacctggcggcagcgcaaaagatg

SEQ ID NO: 92543 - DNA, 103 bp, Artificial Sequence
  Synthetic Polynucleotide
taatacgactcactataggggtcatcaccacagtttgtggcagagaagtaaacagaggagatacttcatggccacaaacaacctggcggcagcgcaaaagatg

SEQ ID NO: 92544 - DNA, 103 bp, Artificial Sequence
  Synthetic Polynucleotide
taatacgactcactatagggcacaggagatgtcatcaccacagtttgtggaacagaggagaccacaaatggtggtgatgaacctggcggcagcgcaaaagatg

SEQ ID NO: 92545 - DNA, 103 bp, Artificial Sequence
  Synthetic Polynucleotide
taatacgactcactatagggaggtgagagtcacaggagatgtcatcaccaaacagaggagatggtgaatgcatctcctgaacctggcggcagcgcaaaagatg

SEQ ID NO: 92546 - DNA, 103 bp, Artificial Sequence
  Synthetic Polynucleotide
taatacgactcactatagggtgagaaatgtgagctccctgaactgctgaaaacagaggagattcagcatgtcagggagcaacctggcggcagcgcaaaagatg

SEQ ID NO: 92547 - DNA, 103 bp, Artificial Sequence
  Synthetic Polynucleotide
taatacgactcactataggggttgtctgagaggtgagagtcacaggagataacagaggagaatctccatggactctcacaacctggcggcagcgcaaaagatg

SEQ ID NO: 92548 - DNA, 103 bp, Artificial Sequence
  Synthetic Polynucleotide
taatacgactcactatagggatctgtcttagttgtctgagaggtgagagtaacagaggagaactctcatgtctcagacaaacctggcggcagcgcaaaagatg

SEQ ID NO: 92549 - DNA, 103 bp, Artificial Sequence
  Synthetic Polynucleotide
taatacgactcactatagggattgggggtcatctgtcttagttgtctgagaacagaggagactcagaatgctaagacagaacctggcggcagcgcaaaagatg

SEQ ID NO: 92550 - DNA, 103 bp, Artificial Sequence
  Synthetic Polynucleotide
taatacgactcactatagggtctcttttcaattgggggtcatctgtcttaaacagaggagataagacatgtgacccccaaacctggcggcagcgcaaaagatg

SEQ ID NO: 92551 - DNA, 103 bp, Artificial Sequence
  Synthetic Polynucleotide
taatacgactcactatagggtaaccttatttctcttttcaattgggggtcaacagaggagagaccccatgttgaaaagaaacctggcggcagcgcaaaagatg

SEQ ID NO: 92552 - DNA, 103 bp, Artificial Sequence
  Synthetic Polynucleotide
taatacgactcactatagggtgtttttcattaaccttatttctcttttcaaacagaggagatgaaaaatgaaataaggtaacctggcggcagcgcaaaagatg

SEQ ID NO: 92553 - DNA, 103 bp, Artificial Sequence
  Synthetic Polynucleotide
taatacgactcactataggggcagcttctctgtttttcattaaccttattaacagaggagaaataagatgaatgaaaaaaacctggcggcagcgcaaaagatg

SEQ ID NO: 92554 - DNA, 103 bp, Artificial Sequence
  Synthetic Polynucleotide
taatacgactcactatagggacattctcgagcagcttctctgtttttcataacagaggagaatgaaaatgagagaagctaacctggcggcagcgcaaaagatg

SEQ ID NO: 92555 - DNA, 103 bp, Artificial Sequence
  Synthetic Polynucleotide
taatacgactcactatagggtctttctgcgacattctcgagcagcttctcaacagaggagagagaagatgctcgagaataacctggcggcagcgcaaaagatg

SEQ ID NO: 92556 - DNA, 103 bp, Artificial Sequence
  Synthetic Polynucleotide
taatacgactcactatagggtattctttcttctttctgcgacattctcgaaacagaggagatcgagaatgtcgcagaaaaacctggcggcagcgcaaaagatg

SEQ ID NO: 92557 - DNA, 103 bp, Artificial Sequence
  Synthetic Polynucleotide
taatacgactcactatagggttgagcaatatgagaaatgtgagctccctgaacagaggagacagggaatgcacatttctaacctggcggcagcgcaaaagatg

SEQ ID NO: 92558 - DNA, 103 bp, Artificial Sequence
  Synthetic Polynucleotide
taatacgactcactataggggcatttcacatattctttcttctttctgcgaacagaggagacgcagaatgaagaaagaaaacctggcggcagcgcaaaagatg

SEQ ID NO: 92559 - DNA, 103 bp, Artificial Sequence
  Synthetic Polynucleotide
taatacgactcactatagggggttttccaggcatttcacatattctttctaacagaggagaagaaagatgatgtgaaataacctggcggcagcgcaaaagatg

SEQ ID NO: 92560 - DNA, 103 bp, Artificial Sequence
  Synthetic Polynucleotide
taatacgactcactatagggactgcaactcggttttccaggcatttcacaaacagaggagatgtgaaatgcctggaaaaaacctggcggcagcgcaaaagatg

SEQ ID NO: 92561 - DNA, 103 bp, Artificial Sequence
  Synthetic Polynucleotide
taatacgactcactatagggattttccaggactgcaactcggttttccagaacagaggagactggaaatgcgagttgcaaacctggcggcagcgcaaaagatg

SEQ ID NO: 92562 - DNA, 103 bp, Artificial Sequence
  Synthetic Polynucleotide
taatacgactcactatagggttttattttgattttccaggactgcaactcaacagaggagagagttgatgtcctggaaaaacctggcggcagcgcaaaagatg

SEQ ID NO: 92563 - DNA, 103 bp, Artificial Sequence
  Synthetic Polynucleotide
taatacgactcactatagggtctattagagttttattttgattttccaggaacagaggagacctggaatgtcaaaataaaacctggcggcagcgcaaaagatg

SEQ ID NO: 92564 - DNA, 103 bp, Artificial Sequence
  Synthetic Polynucleotide
taatacgactcactatagggttttaactcttctattagagttttattttgaacagaggagacaaaatatgactctaataaacctggcggcagcgcaaaagatg

SEQ ID NO: 92565 - DNA, 103 bp, Artificial Sequence
  Synthetic Polynucleotide
taatacgactcactatagggccttcaaagtttttaactcttctattagagaacagaggagactctaaatgaagagttaaaacctggcggcagcgcaaaagatg

SEQ ID NO: 92566 - DNA, 103 bp, Artificial Sequence
  Synthetic Polynucleotide
taatacgactcactataggggaataaagatccttcaaagtttttaactctaacagaggagaagagttatgaactttgaaaacctggcggcagcgcaaaagatg

SEQ ID NO: 92567 - DNA, 103 bp, Artificial Sequence
  Synthetic Polynucleotide
taatacgactcactatagggacttttattggaataaagatccttcaaagtaacagaggagaactttgatggatctttataacctggcggcagcgcaaaagatg

SEQ ID NO: 92568 - DNA, 103 bp, Artificial Sequence
  Synthetic Polynucleotide
taatacgactcactatagggatgatacctgttgagcaatatgagaaatgtaacagaggagaacatttatgatattgctcaacctggcggcagcgcaaaagatg

SEQ ID NO: 92569 - DNA, 103 bp, Artificial Sequence
  Synthetic Polynucleotide
taatacgactcactatagggtctgataaagatgatacctgttgagcaataaacagaggagatattgcatgacaggtatcaacctggcggcagcgcaaaagatg

SEQ ID NO: 92570 - DNA, 103 bp, Artificial Sequence
  Synthetic Polynucleotide
taatacgactcactatagggggcagaattcacatgtaacttgaatttcataacagaggagaatgaaaatgaagttacataacctggcggcagcgcaaaagatg

SEQ ID NO: 92571 - DNA, 103 bp, Artificial Sequence
  Synthetic Polynucleotide
taatacgactcactatagggatcctcgttggtaaaacgctggccacatccaacagaggagaggatgtatgcagcgttttaacctggcggcagcgcaaaagatg

SEQ ID NO: 92572 - DNA, 103 bp, Artificial Sequence
  Synthetic Polynucleotide
taatacgactcactatagggacttgtactttgggtctgtggagttgtgtgaacagaggagacacacaatgccacagaccaacctggcggcagcgcaaaagatg

SEQ ID NO: 92573 - DNA, 103 bp, Artificial Sequence
  Synthetic Polynucleotide
taatacgactcactatagggtccgacgaccacttgtactttgggtctgtgaacagaggagacacagaatgaaagtacaaaacctggcggcagcgcaaaagatg

SEQ ID NO: 92574 - DNA, 103 bp, Artificial Sequence
  Synthetic Polynucleotide
taatacgactcactataggggctgctcttctccgacgaccacttgtacttaacagaggagaaagtacatgtggtcgtcgaacctggcggcagcgcaaaagatg

SEQ ID NO: 92575 - DNA, 103 bp, Artificial Sequence
  Synthetic Polynucleotide
taatacgactcactatagggatcttcgttagctgctcttctccgacgaccaacagaggagaggtcgtatgagaagagcaaacctggcggcagcgcaaaagatg

SEQ ID NO: 92576 - DNA, 103 bp, Artificial Sequence
  Synthetic Polynucleotide
taatacgactcactatagggtttcatcaggatcttcgttagctgctcttcaacagaggagagaagagatgctaacgaagaacctggcggcagcgcaaaagatg

SEQ ID NO: 92577 - DNA, 103 bp, Artificial Sequence
  Synthetic Polynucleotide
taatacgactcactatagggtttctccttttttcatcaggatcttcgttaaacagaggagataacgaatgtcctgatgaaacctggcggcagcgcaaaagatg

SEQ ID NO: 92578 - DNA, 103 bp, Artificial Sequence
  Synthetic Polynucleotide
taatacgactcactatagggctctaaaaactttctccttttttcatcaggaacagaggagacctgatatgaaaaggagaaacctggcggcagcgcaaaagatg

SEQ ID NO: 92579 - DNA, 103 bp, Artificial Sequence
  Synthetic Polynucleotide
taatacgactcactatagggctctatttcgctctaaaaactttctcctttaacagaggagaaaaggaatgagtttttagaacctggcggcagcgcaaaagatg

SEQ ID NO: 92580 - DNA, 103 bp, Artificial Sequence
  Synthetic Polynucleotide
taatacgactcactataggggaagctgctgctctatttcgctctaaaaacaacagaggagagtttttatggcgaaatagaacctggcggcagcgcaaaagatg

SEQ ID NO: 92581 - DNA, 103 bp, Artificial Sequence
  Synthetic Polynucleotide
taatacgactcactatagggtcggcatcttgaagctgctgctctatttcgaacagaggagacgaaatatggcagcagctaacctggcggcagcgcaaaagatg

SEQ ID NO: 92582 - DNA, 103 bp, Artificial Sequence
  Synthetic Polynucleotide
taatacgactcactatagggcagccaaatgatcctcgttggtaaaacgctaacagaggagaagcgttatgccaacgaggaacctggcggcagcgcaaaagatg

SEQ ID NO: 92583 - DNA, 103 bp, Artificial Sequence
  Synthetic Polynucleotide
taatacgactcactatagggtccttttttgtcggcatcttgaagctgctgaacagaggagacagcagatgcaagatgccaacctggcggcagcgcaaaagatg

SEQ ID NO: 92584 - DNA, 103 bp, Artificial Sequence
  Synthetic Polynucleotide
taatacgactcactatagggacccagactttccttttttgtcggcatcttaacagaggagaaagatgatgacaaaaaagaacctggcggcagcgcaaaagatg

SEQ ID NO: 92585 - DNA, 103 bp, Artificial Sequence
  Synthetic Polynucleotide
taatacgactcactatagggtaaagactgaacccagactttccttttttgaacagaggagacaaaaaatgaaagtctggaacctggcggcagcgcaaaagatg

SEQ ID NO: 92586 - DNA, 103 bp, Artificial Sequence
  Synthetic Polynucleotide
taatacgactcactatagggctttcttctctaaagactgaacccagacttaacagaggagaaagtctatgttcagtcttaacctggcggcagcgcaaaagatg

SEQ ID NO: 92587 - DNA, 103 bp, Artificial Sequence
  Synthetic Polynucleotide
taatacgactcactatagggaagtcttcagctttcttctctaaagactgaaacagaggagatcagtcatgagagaagaaaacctggcggcagcgcaaaagatg

SEQ ID NO: 92588 - DNA, 103 bp, Artificial Sequence
  Synthetic Polynucleotide
taatacgactcactatagggtaatgaactcaagtcttcagctttcttctcaacagaggagagagaagatggctgaagacaacctggcggcagcgcaaaagatg

SEQ ID NO: 92589 - DNA, 103 bp, Artificial Sequence
  Synthetic Polynucleotide
taatacgactcactataggggctgaccatttaatgaactcaagtcttcagaacagaggagactgaagatgtgagttcataacctggcggcagcgcaaaagatg

SEQ ID NO: 92590 - DNA, 103 bp, Artificial Sequence
  Synthetic Polynucleotide
taatacgactcactatagggtcactctgcagctgaccatttaatgaactcaacagaggagagagttcatgaaatggtcaaacctggcggcagcgcaaaagatg

SEQ ID NO: 92591 - DNA, 103 bp, Artificial Sequence
  Synthetic Polynucleotide
taatacgactcactatagggcagggtgacttcactctgcagctgaccattaacagaggagaaatggtatgctgcagagtaacctggcggcagcgcaaaagatg

SEQ ID NO: 92592 - DNA, 103 bp, Artificial Sequence
  Synthetic Polynucleotide
taatacgactcactatagggcatttctcagcagggtgacttcactctgcaaacagaggagatgcagaatgaagtcacccaacctggcggcagcgcaaaagatg

SEQ ID NO: 92593 - DNA, 103 bp, Artificial Sequence
  Synthetic Polynucleotide
taatacgactcactatagggtgtttatggacagccaaatgatcctcgttgaacagaggagacaacgaatgtcatttggcaacctggcggcagcgcaaaagatg

SEQ ID NO: 92594 - DNA, 103 bp, Artificial Sequence
  Synthetic Polynucleotide
taatacgactcactatagggtgtgccacttcatttctcagcagggtgactaacagaggagaagtcacatggctgagaaaaacctggcggcagcgcaaaagatg

SEQ ID NO: 92595 - DNA, 103 bp, Artificial Sequence
  Synthetic Polynucleotide
taatacgactcactatagggctgtttcagctgtgccacttcatttctcagaacagaggagactgagaatggaagtggcaaacctggcggcagcgcaaaagatg

SEQ ID NO: 92596 - DNA, 103 bp, Artificial Sequence
  Synthetic Polynucleotide
taatacgactcactatagggccagaagaagctgtttcagctgtgccacttaacagaggagaaagtggatgagctgaaacaacctggcggcagcgcaaaagatg

SEQ ID NO: 92597 - DNA, 103 bp, Artificial Sequence
  Synthetic Polynucleotide
taatacgactcactatagggtctttatgagccagaagaagctgtttcagcaacagaggagagctgaaatggcttcttctaacctggcggcagcgcaaaagatg

SEQ ID NO: 92598 - DNA, 103 bp, Artificial Sequence
  Synthetic Polynucleotide
taatacgactcactatagggtacagggcaatctttatgagccagaagaagaacagaggagacttcttatggctcataaaaacctggcggcagcgcaaaagatg

SEQ ID NO: 92599 - DNA, 103 bp, Artificial Sequence
  Synthetic Polynucleotide
taatacgactcactataggggcatggcggttacagggcaatctttatgagaacagaggagactcataatgattgccctgaacctggcggcagcgcaaaagatg

SEQ ID NO: 92600 - DNA, 103 bp, Artificial Sequence
  Synthetic Polynucleotide
taatacgactcactataggggatttcttctgcatggcggttacagggcaaaacagaggagattgcccatgaaccgccataacctggcggcagcgcaaaagatg

SEQ ID NO: 92601 - DNA, 103 bp, Artificial Sequence
  Synthetic Polynucleotide
taatacgactcactatagggatgatagccagatttcttctgcatggcggtaacagaggagaaccgccatgcagaagaaaaacctggcggcagcgcaaaagatg

SEQ ID NO: 92602 - DNA, 103 bp, Artificial Sequence
  Synthetic Polynucleotide
taatacgactcactatagggtatcagcagtatgatagccagatttcttctaacagaggagaagaagaatgctggctatcaacctggcggcagcgcaaaagatg

SEQ ID NO: 92603 - DNA, 103 bp, Artificial Sequence
  Synthetic Polynucleotide
taatacgactcactatagggctatcatctttatcagcagtatgatagccaaacagaggagatggctaatgtactgctgaaacctggcggcagcgcaaaagatg

SEQ ID NO: 92604 - DNA, 103 bp, Artificial Sequence
  Synthetic Polynucleotide
taatacgactcactatagggctcatgtttatgtttatggacagccaaatgaacagaggagacatttgatggtccataaaaacctggcggcagcgcaaaagatg

SEQ ID NO: 92605 - DNA, 103 bp, Artificial Sequence
  Synthetic Polynucleotide
taatacgactcactataggggtcttctgaactatcatctttatcagcagtaacagaggagaactgctatgaaagatgataacctggcggcagcgcaaaagatg

SEQ ID NO: 92606 - DNA, 103 bp, Artificial Sequence
  Synthetic Polynucleotide
taatacgactcactataggggcactgaaatgtcttctgaactatcatcttaacagaggagaaagatgatggttcagaagaacctggcggcagcgcaaaagatg

SEQ ID NO: 92607 - DNA, 103 bp, Artificial Sequence
  Synthetic Polynucleotide
taatacgactcactatagggggactactcggcactgaaatgtcttctgaaaacagaggagattcagaatgcatttcagtaacctggcggcagcgcaaaagatg

SEQ ID NO: 92608 - DNA, 103 bp, Artificial Sequence
  Synthetic Polynucleotide
taatacgactcactatagggttctgtatgtggactactcggcactgaaataacagaggagaatttcaatgccgagtagtaacctggcggcagcgcaaaagatg

SEQ ID NO: 92609 - DNA, 103 bp, Artificial Sequence
  Synthetic Polynucleotide
taatacgactcactataggggctgtatagcttctgtatgtggactactcgaacagaggagacgagtaatgcacatacagaacctggcggcagcgcaaaagatg

SEQ ID NO: 92610 - DNA, 103 bp, Artificial Sequence
  Synthetic Polynucleotide
taatacgactcactatagggaccgaactatgctgtatagcttctgtatgtaacagaggagaacatacatgagctatacaaacctggcggcagcgcaaaagatg

SEQ ID NO: 92611 - DNA, 103 bp, Artificial Sequence
  Synthetic Polynucleotide
taatacgactcactatagggggatgtgctgaccgaactatgctgtatagcaacagaggagagctataatgcatagttcgaacctggcggcagcgcaaaagatg

SEQ ID NO: 92612 - DNA, 103 bp, Artificial Sequence
  Synthetic Polynucleotide
taatacgactcactatagggtgactccattggatgtgctgaccgaactataacagaggagaatagttatgtcagcacataacctggcggcagcgcaaaagatg

SEQ ID NO: 92613 - DNA, 103 bp, Artificial Sequence
  Synthetic Polynucleotide
taatacgactcactataggggaggttgaactgactccattggatgtgctgaacagaggagacagcacatgcaatggagtaacctggcggcagcgcaaaagatg

SEQ ID NO: 92614 - DNA, 103 bp, Artificial Sequence
  Synthetic Polynucleotide
taatacgactcactatagggttctgccttggaggttgaactgactccattaacagaggagaaatggaatgagttcaaccaacctggcggcagcgcaaaagatg

SEQ ID NO: 92615 - DNA, 103 bp, Artificial Sequence
  Synthetic Polynucleotide
taatacgactcactatagggtcagtgtcatctcatgtttatgtttatggaaacagaggagatccataatgataaacatgaacctggcggcagcgcaaaagatg

SEQ ID NO: 92616 - DNA, 103 bp, Artificial Sequence
  Synthetic Polynucleotide
taatacgactcactatagggtggctacagcttctgccttggaggttgaacaacagaggagagttcaaatgccaaggcagaacctggcggcagcgcaaaagatg

SEQ ID NO: 92617 - DNA, 103 bp, Artificial Sequence
  Synthetic Polynucleotide
taatacgactcactatagggaggactgaagtggctacagcttctgccttgaacagaggagacaaggcatgagctgtagcaacctggcggcagcgcaaaagatg

SEQ ID NO: 92618 - DNA, 103 bp, Artificial Sequence
  Synthetic Polynucleotide
taatacgactcactatagggcatctgggtgaggactgaagtggctacagcaacagaggagagctgtaatgacttcagtcaacctggcggcagcgcaaaagatg

SEQ ID NO: 92619 - DNA, 103 bp, Artificial Sequence
  Synthetic Polynucleotide
taatacgactcactatagggtctggtccgccatctgggtgaggactgaagaacagaggagacttcagatgtcacccagaaacctggcggcagcgcaaaagatg

SEQ ID NO: 92620 - DNA, 103 bp, Artificial Sequence
  Synthetic Polynucleotide
taatacgactcactatagggggctctgtactctggtccgccatctgggtgaacagaggagacacccaatgggcggaccaaacctggcggcagcgcaaaagatg

SEQ ID NO: 92621 - DNA, 103 bp, Artificial Sequence
  Synthetic Polynucleotide
taatacgactcactatagggtgaaagagcaggctctgtactctggtccgcaacagaggagagcggacatgagtacagagaacctggcggcagcgcaaaagatg

SEQ ID NO: 92622 - DNA, 103 bp, Artificial Sequence
  Synthetic Polynucleotide
taatacgactcactatagggtaacgatctgtgaaagagcaggctctgtacaacagaggagagtacagatgctgctctttaacctggcggcagcgcaaaagatg

SEQ ID NO: 92623 - DNA, 103 bp, Artificial Sequence
  Synthetic Polynucleotide
taatacgactcactataggggaaggagccataacgatctgtgaaagagcaaacagaggagatgctctatgacagatcgtaacctggcggcagcgcaaaagatg

SEQ ID NO: 92624 - DNA, 103 bp, Artificial Sequence
  Synthetic Polynucleotide
taatacgactcactatagggtgactgggaggaaggagccataacgatctgaacagaggagacagatcatgatggctcctaacctggcggcagcgcaaaagatg

SEQ ID NO: 92625 - DNA, 103 bp, Artificial Sequence
  Synthetic Polynucleotide
taatacgactcactatagggctgagggctgtgactgggaggaaggagccaaacagaggagatggctcatgcctcccagtaacctggcggcagcgcaaaagatg

SEQ ID NO: 92626 - DNA, 103 bp, Artificial Sequence
  Synthetic Polynucleotide
taatacgactcactatagggggaccaaatttcagtgtcatctcatgtttaaacagaggagataaacaatggatgacactaacctggcggcagcgcaaaagatg

SEQ ID NO: 92627 - DNA, 103 bp, Artificial Sequence
  Synthetic Polynucleotide
taatacgactcactatagggattacgtgctggaccaaatttcagtgtcataacagaggagaatgacaatgaaatttggtaacctggcggcagcgcaaaagatg

SEQ ID NO: 92628 - DNA, 103 bp, Artificial Sequence
  Synthetic Polynucleotide
taatacgactcactatagggtgacactgtcattacgtgctggaccaaattaacagaggagaaatttgatgcagcacgtaaacctggcggcagcgcaaaagatg

SEQ ID NO: 92629 - DNA, 103 bp, Artificial Sequence
  Synthetic Polynucleotide
taatacgactcactatagggtcagccacaatgacactgtcattacgtgctaacagaggagaagcacgatgtgacagtgtaacctggcggcagcgcaaaagatg

SEQ ID NO: 92630 - DNA, 103 bp, Artificial Sequence
  Synthetic Polynucleotide
taatacgactcactatagggtggggtctgatcagccacaatgacactgtcaacagaggagagacagtatgattgtggctaacctggcggcagcgcaaaagatg

SEQ ID NO: 92631 - DNA, 103 bp, Artificial Sequence
  Synthetic Polynucleotide
taatacgactcactatagggtgtattgcctggcagaattcacatgtaactaacagaggagaagttacatgtgaattctgaacctggcggcagcgcaaaagatg

SEQ ID NO: 92632 - DNA, 103 bp, Artificial Sequence
  Synthetic Polynucleotide
taatacgactcactatagggttgttggtgttggggtctgatcagccacaaaacagaggagattgtggatgatcagacccaacctggcggcagcgcaaaagatg

SEQ ID NO: 92633 - DNA, 103 bp, Artificial Sequence
  Synthetic Polynucleotide
taatacgactcactatagggttcaagaatcttgttggtgttggggtctgaaacagaggagatcagacatgaacaccaacaacctggcggcagcgcaaaagatg

SEQ ID NO: 92634 - DNA, 103 bp, Artificial Sequence
  Synthetic Polynucleotide
taatacgactcactatagggttcacagtttttcaagaatcttgttggtgtaacagaggagaacaccaatgagattcttgaacctggcggcagcgcaaaagatg

SEQ ID NO: 92635 - DNA, 103 bp, Artificial Sequence
  Synthetic Polynucleotide
taatacgactcactatagggaacccacttcttcacagtttttcaagaatcaacagaggagagattctatgaaaactgtgaacctggcggcagcgcaaaagatg

SEQ ID NO: 92636 - DNA, 103 bp, Artificial Sequence
  Synthetic Polynucleotide
taatacgactcactatagggtcattaaacaaacccacttcttcacagtttaacagaggagaaaactgatgagaagtgggaacctggcggcagcgcaaaagatg

SEQ ID NO: 92637 - DNA, 103 bp, Artificial Sequence
  Synthetic Polynucleotide
taatacgactcactatagggactcgccaactcattaaacaaacccacttcaacagaggagagaagtgatgttgtttaataacctggcggcagcgcaaaagatg

SEQ ID NO: 92638 - DNA, 103 bp, Artificial Sequence
  Synthetic Polynucleotide
taatacgactcactatagggtctcaaatggactcgccaactcattaaacaaacagaggagatgtttaatgagttggcgaaacctggcggcagcgcaaaagatg

SEQ ID NO: 92639 - DNA, 103 bp, Artificial Sequence
  Synthetic Polynucleotide
taatacgactcactatagggttgaattcattctcaaatggactcgccaacaacagaggagagttggcatgtccatttgaaacctggcggcagcgcaaaagatg

SEQ ID NO: 92640 - DNA, 103 bp, Artificial Sequence
  Synthetic Polynucleotide
taatacgactcactatagggtgaagctttcttgaattcattctcaaatggaacagaggagaccatttatgaatgaattcaacctggcggcagcgcaaaagatg

SEQ ID NO: 92641 - DNA, 103 bp, Artificial Sequence
  Synthetic Polynucleotide
taatacgactcactatagggtgtcatcttctgaagctttcttgaattcataacagaggagaatgaatatgagaaagcttaacctggcggcagcgcaaaagatg

SEQ ID NO: 92642 - DNA, 103 bp, Artificial Sequence
  Synthetic Polynucleotide
taatacgactcactatagggcacaggtccttgtattgcctggcagaattcaacagaggagagaattcatgcaggcaataaacctggcggcagcgcaaaagatg

SEQ ID NO: 92643 - DNA, 103 bp, Artificial Sequence
  Synthetic Polynucleotide
taatacgactcactatagggatttttttaatgtcatcttctgaagctttcaacagaggagagaaagcatgagaagatgaaacctggcggcagcgcaaaagatg

SEQ ID NO: 92644 - DNA, 103 bp, Artificial Sequence
  Synthetic Polynucleotide
taatacgactcactatagggatctagaggcatttttttaatgtcatcttcaacagaggagagaagatatgattaaaaaaaacctggcggcagcgcaaaagatg

SEQ ID NO: 92645 - DNA, 103 bp, Artificial Sequence
  Synthetic Polynucleotide
taatacgactcactataggggaggggataaatctagaggcatttttttaaaacagaggagattaaaaatgtgcctctagaacctggcggcagcgcaaaagatg

SEQ ID NO: 92646 - DNA, 103 bp, Artificial Sequence
  Synthetic Polynucleotide
taatacgactcactatagggggtgttgcaagaggggataaatctagaggcaacagaggagagcctctatgtttatccccaacctggcggcagcgcaaaagatg

SEQ ID NO: 92647 - DNA, 103 bp, Artificial Sequence
  Synthetic Polynucleotide
taatacgactcactatagggtcttatgataggtgttgcaagaggggataaaacagaggagattatccatgcttgcaacaaacctggcggcagcgcaaaagatg

SEQ ID NO: 92648 - DNA, 103 bp, Artificial Sequence
  Synthetic Polynucleotide
taatacgactcactatagggcaattttgcttcttatgataggtgttgcaaaacagaggagattgcaaatgctatcataaaacctggcggcagcgcaaaagatg

SEQ ID NO: 92649 - DNA, 103 bp, Artificial Sequence
  Synthetic Polynucleotide
taatacgactcactataggggaaggctcctcaattttgcttcttatgataaacagaggagatatcatatgaagcaaaataacctggcggcagcgcaaaagatg

SEQ ID NO: 92650 - DNA, 103 bp, Artificial Sequence
  Synthetic Polynucleotide
taatacgactcactatagggttctacaacagaaggctcctcaattttgctaacagaggagaagcaaaatggaggagcctaacctggcggcagcgcaaaagatg

SEQ ID NO: 92651 - DNA, 103 bp, Artificial Sequence
  Synthetic Polynucleotide
taatacgactcactatagggggtgagttgtttctacaacagaaggctcctaacagaggagaaggagcatgctgttgtagaacctggcggcagcgcaaaagatg

SEQ ID NO: 92652 - DNA, 103 bp, Artificial Sequence
  Synthetic Polynucleotide
taatacgactcactatagggggactatcctggtgagttgtttctacaacaaacagaggagatgttgtatgaacaactcaaacctggcggcagcgcaaaagatg

SEQ ID NO: 92653 - DNA, 103 bp, Artificial Sequence
  Synthetic Polynucleotide
taatacgactcactatagggactcatattccacaggtccttgtattgcctaacagaggagaaggcaaatgaaggacctgaacctggcggcagcgcaaaagatg

SEQ ID NO: 92654 - DNA, 103 bp, Artificial Sequence
  Synthetic Polynucleotide
taatacgactcactataggggtgaggtaaaggactatcctggtgagttgtaacagaggagaacaactatgcaggatagtaacctggcggcagcgcaaaagatg

SEQ ID NO: 92655 - DNA, 103 bp, Artificial Sequence
  Synthetic Polynucleotide
taatacgactcactatagggtagactctgggtgaggtaaaggactatcctaacagaggagaaggataatgctttacctcaacctggcggcagcgcaaaagatg

SEQ ID NO: 92656 - DNA, 103 bp, Artificial Sequence
  Synthetic Polynucleotide
taatacgactcactatagggtcactggtagtagactctgggtgaggtaaaaacagaggagatttaccatgcccagagtcaacctggcggcagcgcaaaagatg

SEQ ID NO: 92657 - DNA, 103 bp, Artificial Sequence
  Synthetic Polynucleotide
taatacgactcactatagggttccttctcatcactggtagtagactctggaacagaggagaccagagatgactaccagtaacctggcggcagcgcaaaagatg

SEQ ID NO: 92658 - DNA, 103 bp, Artificial Sequence
  Synthetic Polynucleotide
taatacgactcactatagggccaatggtacttccttctcatcactggtagaacagaggagactaccaatgatgagaaggaacctggcggcagcgcaaaagatg

SEQ ID NO: 92659 - DNA, 103 bp, Artificial Sequence
  Synthetic Polynucleotide
taatacgactcactataggggcagtttgtgccaatggtacttccttctcaaacagaggagatgagaaatgagtaccattaacctggcggcagcgcaaaagatg

SEQ ID NO: 92660 - DNA, 103 bp, Artificial Sequence
  Synthetic Polynucleotide
taatacgactcactatagggtgtgggctgtgcagtttgtgccaatggtacaacagaggagagtaccaatggcacaaactaacctggcggcagcgcaaaagatg

SEQ ID NO: 92661 - DNA, 103 bp, Artificial Sequence
  Synthetic Polynucleotide
taatacgactcactatagggcaatagctgatgtgggctgtgcagtttgtgaacagaggagacacaaaatgcacagcccaaacctggcggcagcgcaaaagatg

SEQ ID NO: 92662 - DNA, 103 bp, Artificial Sequence
  Synthetic Polynucleotide
taatacgactcactataggggctggacgaacaatagctgatgtgggctgtaacagaggagaacagccatgatcagctataacctggcggcagcgcaaaagatg

SEQ ID NO: 92663 - DNA, 103 bp, Artificial Sequence
  Synthetic Polynucleotide
taatacgactcactatagggctgtaatgatgctggacgaacaatagctgaaacagaggagatcagctatggttcgtccaaacctggcggcagcgcaaaagatg

SEQ ID NO: 92664 - DNA, 103 bp, Artificial Sequence
  Synthetic Polynucleotide
taatacgactcactataggggtttgtcatcactcatattccacaggtcctaacagaggagaaggaccatgggaatatgaaacctggcggcagcgcaaaagatg

SEQ ID NO: 92665 - DNA, 103 bp, Artificial Sequence
  Synthetic Polynucleotide
taatacgactcactatagggcattgggaacctgtaatgatgctggacgaaaacagaggagattcgtcatgcatcattacaacctggcggcagcgcaaaagatg

SEQ ID NO: 92666 - DNA, 103 bp, Artificial Sequence
  Synthetic Polynucleotide
taatacgactcactataggggtaagcagcacattgggaacctgtaatgataacagaggagaatcattatgggttcccaaaacctggcggcagcgcaaaagatg

SEQ ID NO: 92667 - DNA, 103 bp, Artificial Sequence
  Synthetic Polynucleotide
taatacgactcactataggggtcagaacttgtaagcagcacattgggaacaacagaggagagttcccatggtgctgcttaacctggcggcagcgcaaaagatg

SEQ ID NO: 92668 - DNA, 103 bp, Artificial Sequence
  Synthetic Polynucleotide
taatacgactcactatagggttacacttgagtcagaacttgtaagcagcaaacagaggagatgctgcatgcaagttctgaacctggcggcagcgcaaaagatg

SEQ ID NO: 92669 - DNA, 103 bp, Artificial Sequence
  Synthetic Polynucleotide
taatacgactcactatagggtgctgaataattacacttgagtcagaacttaacagaggagaaagttcatgctcaagtgtaacctggcggcagcgcaaaagatg

SEQ ID NO: 92670 - DNA, 103 bp, Artificial Sequence
  Synthetic Polynucleotide
taatacgactcactatagggaggtactgcctgctgaataattacacttgaaacagaggagatcaagtatgattattcagaacctggcggcagcgcaaaagatg

SEQ ID NO: 92671 - DNA, 103 bp, Artificial Sequence
  Synthetic Polynucleotide
taatacgactcactatagggaggttggtgaaggtactgcctgctgaataaaacagaggagattattcatgaggcagtacaacctggcggcagcgcaaaagatg

SEQ ID NO: 92672 - DNA, 103 bp, Artificial Sequence
  Synthetic Polynucleotide
taatacgactcactatagggacagtacttgaggttggtgaaggtactgccaacagaggagaggcagtatgttcaccaacaacctggcggcagcgcaaaagatg

SEQ ID NO: 92673 - DNA, 103 bp, Artificial Sequence
  Synthetic Polynucleotide
taatacgactcactatagggctgggtgattacagtacttgaggttggtgaaacagaggagatcaccaatgtcaagtactaacctggcggcagcgcaaaagatg

SEQ ID NO: 92674 - DNA, 103 bp, Artificial Sequence
  Synthetic Polynucleotide
taatacgactcactatagggaggatggtgcctgggtgattacagtacttgaacagaggagacaagtaatgtaatcacccaacctggcggcagcgcaaaagatg

SEQ ID NO: 92675 - DNA, 103 bp, Artificial Sequence
  Synthetic Polynucleotide
taatacgactcactatagggcatagaaagggtttgtcatcactcatattcaacagaggagagaatatatgtgatgacaaaacctggcggcagcgcaaaagatg

SEQ ID NO: 92676 - DNA, 103 bp, Artificial Sequence
  Synthetic Polynucleotide
taatacgactcactatagggggcctgttagaggatggtgcctgggtgattaacagaggagaaatcacatgggcaccatcaacctggcggcagcgcaaaagatg

SEQ ID NO: 92677 - DNA, 103 bp, Artificial Sequence
  Synthetic Polynucleotide
taatacgactcactatagggagggacaattggcctgttagaggatggtgcaacagaggagagcaccaatgtctaacaggaacctggcggcagcgcaaaagatg

SEQ ID NO: 92678 - DNA, 103 bp, Artificial Sequence
  Synthetic Polynucleotide
taatacgactcactatagggggcctggtacagggacaattggcctgttagaacagaggagactaacaatgcaattgtccaacctggcggcagcgcaaaagatg

SEQ ID NO: 92679 - DNA, 103 bp, Artificial Sequence
  Synthetic Polynucleotide
taatacgactcactatagggagaggaaatgggcctggtacagggacaattaacagaggagaaattgtatgtgtaccaggaacctggcggcagcgcaaaagatg

SEQ ID NO: 92680 - DNA, 103 bp, Artificial Sequence
  Synthetic Polynucleotide
taatacgactcactatagggatgtaacagaagaggaaatgggcctggtacaacagaggagagtaccaatgccatttcctaacctggcggcagcgcaaaagatg

SEQ ID NO: 92681 - DNA, 103 bp, Artificial Sequence
  Synthetic Polynucleotide
taatacgactcactatagggcattaggaagatgtaacagaagaggaaatgaacagaggagacatttcatgttctgttacaacctggcggcagcgcaaaagatg

SEQ ID NO: 92682 - DNA, 103 bp, Artificial Sequence
  Synthetic Polynucleotide
taatacgactcactatagggatggtttgtccattaggaagatgtaacagaaacagaggagatctgttatgtcttcctaaaacctggcggcagcgcaaaagatg

SEQ ID NO: 92683 - DNA, 103 bp, Artificial Sequence
  Synthetic Polynucleotide
taatacgactcactatagggagcaacaggcatggtttgtccattaggaagaacagaggagacttcctatgggacaaaccaacctggcggcagcgcaaaagatg

SEQ ID NO: 92684 - DNA, 103 bp, Artificial Sequence
  Synthetic Polynucleotide
taatacgactcactatagggatgcaggaatagcaacaggcatggtttgtcaacagaggagagacaaaatgtgcctgttgaacctggcggcagcgcaaaagatg

SEQ ID NO: 92685 - DNA, 103 bp, Artificial Sequence
  Synthetic Polynucleotide
taatacgactcactatagggcttgtaattgatgcaggaatagcaacaggcaacagaggagagcctgtatgtattcctgcaacctggcggcagcgcaaaagatg

SEQ ID NO: 92686 - DNA, 103 bp, Artificial Sequence
  Synthetic Polynucleotide
taatacgactcactatagggaggcgcagtacatagaaagggtttgtcatcaacagaggagagatgacatgccctttctaaacctggcggcagcgcaaaagatg

SEQ ID NO: 92687 - DNA, 103 bp, Artificial Sequence
  Synthetic Polynucleotide
taatacgactcactatagggcacattagaacttgtaattgatgcaggaataacagaggagaattcctatgtcaattacaaacctggcggcagcgcaaaagatg

SEQ ID NO: 92688 - DNA, 103 bp, Artificial Sequence
  Synthetic Polynucleotide
taatacgactcactatagggctggaacatgcacattagaacttgtaattgaacagaggagacaattaatggttctaatgaacctggcggcagcgcaaaagatg

SEQ ID NO: 92689 - DNA, 103 bp, Artificial Sequence
  Synthetic Polynucleotide
taatacgactcactataggggggactgcagctggaacatgcacattagaaaacagaggagattctaaatggcatgttccaacctggcggcagcgcaaaagatg

SEQ ID NO: 92690 - DNA, 103 bp, Artificial Sequence
  Synthetic Polynucleotide
taatacgactcactatagggtcgaacgagtgggactgcagctggaacatgaacagaggagacatgttatggctgcagtcaacctggcggcagcgcaaaagatg

SEQ ID NO: 92691 - DNA, 103 bp, Artificial Sequence
  Synthetic Polynucleotide
taatacgactcactatagggtggtgactggtcgaacgagtgggactgcagaacagaggagactgcagatgcactcgttcaacctggcggcagcgcaaaagatg

SEQ ID NO: 92692 - DNA, 103 bp, Artificial Sequence
  Synthetic Polynucleotide
taatacgactcactatagggctaggcaccatggtgactggtcgaacgagtaacagaggagaactcgtatgaccagtcacaacctggcggcagcgcaaaagatg

SEQ ID NO: 92693 - DNA, 103 bp, Artificial Sequence
  Synthetic Polynucleotide
taatacgactcactatagggtcctggaacactaggcaccatggtgactggaacagaggagaccagtcatgatggtgcctaacctggcggcagcgcaaaagatg

SEQ ID NO: 92694 - DNA, 103 bp, Artificial Sequence
  Synthetic Polynucleotide
taatacgactcactataggggacctgggattcctggaacactaggcaccaaacagaggagatggtgcatggtgttccagaacctggcggcagcgcaaaagatg

SEQ ID NO: 92695 - DNA, 103 bp, Artificial Sequence
  Synthetic Polynucleotide
taatacgactcactatagggggagaggaaggacctgggattcctggaacaaacagaggagatgttccatgaatcccaggaacctggcggcagcgcaaaagatg

SEQ ID NO: 92696 - DNA, 103 bp, Artificial Sequence
  Synthetic Polynucleotide
taatacgactcactatagggtactggttggggagaggaaggacctgggataacagaggagaatcccaatgccttcctctaacctggcggcagcgcaaaagatg

SEQ ID NO: 92697 - DNA, 103 bp, Artificial Sequence
  Synthetic Polynucleotide
taatacgactcactatagggggccacatccaggcgcagtacatagaaaggaacagaggagacctttcatggtactgcgcaacctggcggcagcgcaaaagatg

SEQ ID NO: 92698 - DNA, 103 bp, Artificial Sequence
  Synthetic Polynucleotide
taatacgactcactatagggcttctgactgtactggttggggagaggaagaacagaggagacttcctatgcccaaccagaacctggcggcagcgcaaaagatg

SEQ ID NO: 92699 - DNA, 103 bp, Artificial Sequence
  Synthetic Polynucleotide
taatacgactcactatagggctcatttttgcttctgactgtactggttggaacagaggagaccaaccatgacagtcagaaacctggcggcagcgcaaaagatg

SEQ ID NO: 92700 - DNA, 103 bp, Artificial Sequence
  Synthetic Polynucleotide
taatacgactcactatagggagcttttaatctcatttttgcttctgactgaacagaggagacagtcaatggcaaaaatgaacctggcggcagcgcaaaagatg

SEQ ID NO: 92701 - DNA, 103 bp, Artificial Sequence
  Synthetic Polynucleotide
taatacgactcactataggggggtcaaagcagcttttaatctcatttttgaacagaggagacaaaaaatggattaaaagaacctggcggcagcgcaaaagatg

SEQ ID NO: 92702 - DNA, 103 bp, Artificial Sequence
  Synthetic Polynucleotide
taatacgactcactatagggggatgttgctgggtcaaagcagcttttaataacagaggagaattaaaatgtgctttgacaacctggcggcagcgcaaaagatg

SEQ ID NO: 92703 - DNA, 103 bp, Artificial Sequence
  Synthetic Polynucleotide
taatacgactcactatagggggtaactggaggatgttgctgggtcaaagcaacagaggagagctttgatgcagcaacataacctggcggcagcgcaaaagatg

SEQ ID NO: 92704 - DNA, 103 bp, Artificial Sequence
  Synthetic Polynucleotide
taatacgactcactatagggtatcaccattggtaactggaggatgttgctaacagaggagaagcaacatgctccagttaaacctggcggcagcgcaaaagatg

SEQ ID NO: 92705 - DNA, 103 bp, Artificial Sequence
  Synthetic Polynucleotide
taatacgactcactatagggcctttgacagtatcaccattggtaactggaaacagaggagatccagtatgcaatggtgaaacctggcggcagcgcaaaagatg

SEQ ID NO: 92706 - DNA, 103 bp, Artificial Sequence
  Synthetic Polynucleotide
taatacgactcactataggggctaccatgacctttgacagtatcaccattaacagaggagaaatggtatgactgtcaaaaacctggcggcagcgcaaaagatg

SEQ ID NO: 92707 - DNA, 103 bp, Artificial Sequence
  Synthetic Polynucleotide
taatacgactcactatagggtaaccaatccgctaccatgacctttgacagaacagaggagactgtcaatggtcatggtaaacctggcggcagcgcaaaagatg

SEQ ID NO: 92708 - DNA, 103 bp, Artificial Sequence
  Synthetic Polynucleotide
taatacgactcactataggggtaaaacgctggccacatccaggcgcagtaaacagaggagatactgcatgtggatgtggaacctggcggcagcgcaaaagatg

SEQ ID NO: 92709 - DNA, 103 bp, Artificial Sequence
  Synthetic Polynucleotide
taatacgactcactataggggactgagtcctaaccaatccgctaccatgaaacagaggagatcatggatgcggattggtaacctggcggcagcgcaaaagatg

SEQ ID NO: 92710 - DNA, 103 bp, Artificial Sequence
  Synthetic Polynucleotide
taatacgactcactatagggagattcctctgactgagtcctaaccaatccaacagaggagaggattgatgaggactcagaacctggcggcagcgcaaaagatg

SEQ ID NO: 92711 - DNA, 103 bp, Artificial Sequence
  Synthetic Polynucleotide
taatacgactcactatagggactgcggtcgagattcctctgactgagtccaacagaggagaggactcatgcagaggaataacctggcggcagcgcaaaagatg

SEQ ID NO: 92712 - DNA, 103 bp, Artificial Sequence
  Synthetic Polynucleotide
taatacgactcactatagggtgttgtaatgactgcggtcgagattcctctaacagaggagaagaggaatgtcgaccgcaaacctggcggcagcgcaaaagatg

SEQ ID NO: 92713 - DNA, 103 bp, Artificial Sequence
  Synthetic Polynucleotide
taatacgactcactatagggtgtggctggctgttgtaatgactgcggtcgaacagaggagacgaccgatgtcattacaaaacctggcggcagcgcaaaagatg

SEQ ID NO: 92714 - DNA, 103 bp, Artificial Sequence
  Synthetic Polynucleotide
taatacgactcactatagggctgtagtggatgtggctggctgttgtaatgaacagaggagacattacatgagccagccaaacctggcggcagcgcaaaagatg

SEQ ID NO: 92715 - DNA, 103 bp, Artificial Sequence
  Synthetic Polynucleotide
taatacgactcactataggggccggagtttctgtagtggatgtggctggcaacagaggagagccagcatgatccactacaacctggcggcagcgcaaaagatg

SEQ ID NO: 92716 - DNA, 103 bp, Artificial Sequence
  Synthetic Polynucleotide
taatacgactcactatagggagctggagaagccggagtttctgtagtggaaacagaggagatccactatggaaactccgaacctggcggcagcgcaaaagatg

SEQ ID NO: 92717 - DNA, 103 bp, Artificial Sequence
  Synthetic Polynucleotide
taatacgactcactataggggagttgtgtgagctggagaagccggagtttaacagaggagaaaactcatgcttctccagaacctggcggcagcgcaaaagatg

SEQ ID NO: 92718 - DNA, 103 bp, Artificial Sequence
  Synthetic Polynucleotide
taatacgactcactatagggtgggtctgtggagttgtgtgagctggagaaaacagaggagattctccatgtcacacaacaacctggcggcagcgcaaaagatg

SEQ ID NO: 92719 - DNA, 103 bp, Artificial Sequence
  Synthetic Polynucleotide
taatacgactcactatagggagagacctggcctgggtgttgaagcatcataacagaggagaatgatgatgcaacacccaaacctggcggcagcgcaaaagatg

SEQ ID NO: 92720 - DNA, 103 bp, Artificial Sequence
  Synthetic Polynucleotide
taatacgactcactatagggaaagggcgtcaggttagcaaaatcctcaaaaacagaggagatttgagatgtttgctaacaacctggcggcagcgcaaaagatg

SEQ ID NO: 92721 - DNA, 103 bp, Artificial Sequence
  Synthetic Polynucleotide
taatacgactcactatagggcttccttgacaaagggcgtcaggttagcaaaacagaggagattgctaatgtgacgccctaacctggcggcagcgcaaaagatg

SEQ ID NO: 92722 - DNA, 103 bp, Artificial Sequence
  Synthetic Polynucleotide
taatacgactcactatagggaacctcagctcttccttgacaaagggcgtcaacagaggagagacgccatgtgtcaaggaaacctggcggcagcgcaaaagatg

SEQ ID NO: 92723 - DNA, 103 bp, Artificial Sequence
  Synthetic Polynucleotide
taatacgactcactatagggctggatggcaaacctcagctcttccttgacaacagaggagagtcaagatggagctgaggaacctggcggcagcgcaaaagatg

SEQ ID NO: 92724 - DNA, 103 bp, Artificial Sequence
  Synthetic Polynucleotide
taatacgactcactatagggggtgcttgttctggatggcaaacctcagctaacagaggagaagctgaatgttgccatccaacctggcggcagcgcaaaagatg

SEQ ID NO: 92725 - DNA, 103 bp, Artificial Sequence
  Synthetic Polynucleotide
taatacgactcactatagggcggtggcagaggtgcttgttctggatggcaaacagaggagatgccatatggaacaagcaaacctggcggcagcgcaaaagatg

SEQ ID NO: 92726 - DNA, 103 bp, Artificial Sequence
  Synthetic Polynucleotide
taatacgactcactatagggagaggacatccggtggcagaggtgcttgttaacagaggagaaacaagatgctctgccacaacctggcggcagcgcaaaagatg

SEQ ID NO: 92727 - DNA, 103 bp, Artificial Sequence
  Synthetic Polynucleotide
taatacgactcactatagggattccagcgcagaggacatccggtggcagaaacagaggagatctgccatgggatgtcctaacctggcggcagcgcaaaagatg

SEQ ID NO: 92728 - DNA, 103 bp, Artificial Sequence
  Synthetic Polynucleotide
taatacgactcactatagggacagtgactgattccagcgcagaggacatcaacagaggagagatgtcatgtgcgctggaaacctggcggcagcgcaaaagatg

SEQ ID NO: 92729 - DNA, 103 bp, Artificial Sequence
  Synthetic Polynucleotide
taatacgactcactatagggtctgtcgctgacagtgactgattccagcgcaacagaggagagcgctgatgtcagtcactaacctggcggcagcgcaaaagatg

SEQ ID NO: 92730 - DNA, 103 bp, Artificial Sequence
  Synthetic Polynucleotide
taatacgactcactatagggcttccgaggcagagacctggcctgggtgttaacagaggagaaacaccatggccaggtctaacctggcggcagcgcaaaagatg

SEQ ID NO: 92731 - DNA, 103 bp, Artificial Sequence
  Synthetic Polynucleotide
taatacgactcactatagggccccgaggggtctgtcgctgacagtgactgaacagaggagacagtcaatgtcagcgacaaacctggcggcagcgcaaaagatg

SEQ ID NO: 92732 - DNA, 103 bp, Artificial Sequence
  Synthetic Polynucleotide
taatacgactcactataggggtgatggacaccccgaggggtctgtcgctgaacagaggagacagcgaatgacccctcggaacctggcggcagcgcaaaagatg

SEQ ID NO: 92733 - DNA, 103 bp, Artificial Sequence
  Synthetic Polynucleotide
taatacgactcactatagggctcggcttttgtgatggacaccccgaggggaacagaggagacccctcatggtgtccatcaacctggcggcagcgcaaaagatg

SEQ ID NO: 92734 - DNA, 103 bp, Artificial Sequence
  Synthetic Polynucleotide
taatacgactcactatagggcaggggctacctcggcttttgtgatggacaaacagaggagatgtccaatgcaaaagccgaacctggcggcagcgcaaaagatg

SEQ ID NO: 92735 - DNA, 103 bp, Artificial Sequence
  Synthetic Polynucleotide
taatacgactcactatagggtcatcttcttcaggggctacctcggcttttaacagaggagaaaaagcatgggtagccccaacctggcggcagcgcaaaagatg

SEQ ID NO: 92736 - DNA, 103 bp, Artificial Sequence
  Synthetic Polynucleotide
taatacgactcactatagggctttttcctttcatcttcttcaggggctacaacagaggagagtagccatggaagaagataacctggcggcagcgcaaaagatg

SEQ ID NO: 92737 - DNA, 103 bp, Artificial Sequence
  Synthetic Polynucleotide
taatacgactcactatagggctcgtcgcctctttttcctttcatcttcttaacagaggagaaagaagatgaaaggaaaaaacctggcggcagcgcaaaagatg

SEQ ID NO: 92738 - DNA, 103 bp, Artificial Sequence
  Synthetic Polynucleotide
taatacgactcactatagggttatttctttctcgtcgcctctttttccttaacagaggagaaaggaaatggaggcgacgaacctggcggcagcgcaaaagatg

SEQ ID NO: 92739 - DNA, 103 bp, Artificial Sequence
  Synthetic Polynucleotide
taatacgactcactatagggagctgcaatcttatttctttctcgtcgcctaacagaggagaaggcgaatggaaagaaataacctggcggcagcgcaaaagatg

SEQ ID NO: 92740 - DNA, 103 bp, Artificial Sequence
  Synthetic Polynucleotide
taatacgactcactatagggggcactttgcagctgcaatcttatttctttaacagaggagaaaagaaatgagattgcagaacctggcggcagcgcaaaagatg

SEQ ID NO: 92741 - DNA, 103 bp, Artificial Sequence
  Synthetic Polynucleotide
taatacgactcactataggggaagcactcacttccgaggcagagacctggaacagaggagaccaggtatgtgcctcggaaacctggcggcagcgcaaaagatg

SEQ ID NO: 92742 - DNA, 103 bp, Artificial Sequence
  Synthetic Polynucleotide
taatacgactcactatagggttcttgtttcggcactttgcagctgcaatcaacagaggagagattgcatgtgcaaagtgaacctggcggcagcgcaaaagatg

SEQ ID NO: 92743 - DNA, 103 bp, Artificial Sequence
  Synthetic Polynucleotide
taatacgactcactatagggcttctccttcttcttgtttcggcactttgcaacagaggagagcaaagatgcgaaacaagaacctggcggcagcgcaaaagatg

SEQ ID NO: 92744 - DNA, 103 bp, Artificial Sequence
  Synthetic Polynucleotide
taatacgactcactatagggggcactccgtcttctccttcttcttgtttcaacagaggagagaaacaatgagaaggagaaacctggcggcagcgcaaaagatg

SEQ ID NO: 92745 - DNA, 103 bp, Artificial Sequence
  Synthetic Polynucleotide
taatacgactcactatagggtctttctgcaggcactccgtcttctccttcaacagaggagagaaggaatggacggagtgaacctggcggcagcgcaaaagatg

SEQ ID NO: 92746 - DNA, 103 bp, Artificial Sequence
  Synthetic Polynucleotide
taatacgactcactatagggcttctccgactctttctgcaggcactccgtaacagaggagaacggagatgctgcagaaaaacctggcggcagcgcaaaagatg

SEQ ID NO: 92747 - DNA, 103 bp, Artificial Sequence
  Synthetic Polynucleotide
taatacgactcactatagggcactttccagcttctccgactctttctgcaaacagaggagatgcagaatgagtcggagaaacctggcggcagcgcaaaagatg

SEQ ID NO: 92748 - DNA, 103 bp, Artificial Sequence
  Synthetic Polynucleotide
taatacgactcactatagggtcagcattcacactttccagcttctccgacaacagaggagagtcggaatggctggaaagaacctggcggcagcgcaaaagatg

SEQ ID NO: 92749 - DNA, 103 bp, Artificial Sequence
  Synthetic Polynucleotide
taatacgactcactatagggagccttcagttcagcattcacactttccagaacagaggagactggaaatggtgaatgctaacctggcggcagcgcaaaagatg

SEQ ID NO: 92750 - DNA, 103 bp, Artificial Sequence
  Synthetic Polynucleotide
taatacgactcactatagggcctcaatctgagccttcagttcagcattcaaacagaggagatgaatgatgaactgaaggaacctggcggcagcgcaaaagatg

SEQ ID NO: 92751 - DNA, 103 bp, Artificial Sequence
  Synthetic Polynucleotide
taatacgactcactatagggttcttgagctcctcaatctgagccttcagtaacagaggagaactgaaatgtcagattgaaacctggcggcagcgcaaaagatg

SEQ ID NO: 92752 - DNA, 103 bp, Artificial Sequence
  Synthetic Polynucleotide
taatacgactcactataggggacgatggcagaagcactcacttccgaggcaacagaggagagcctcgatggtgagtgctaacctggcggcagcgcaaaagatg

SEQ ID NO: 92753 - DNA, 103 bp, Artificial Sequence
  Synthetic Polynucleotide
taatacgactcactatagggctgcttctcgttcttgagctcctcaatctgaacagaggagacagattatggagctcaagaacctggcggcagcgcaaaagatg

SEQ ID NO: 92754 - DNA, 103 bp, Artificial Sequence
  Synthetic Polynucleotide
taatacgactcactatagggatatcaaatgctgcttctcgttcttgagctaacagaggagaagctcaatgacgagaagcaacctggcggcagcgcaaaagatg

SEQ ID NO: 92755 - DNA, 103 bp, Artificial Sequence
  Synthetic Polynucleotide
taatacgactcactatagggttgagcatgtatatcaaatgctgcttctcgaacagaggagacgagaaatggcatttgataacctggcggcagcgcaaaagatg

SEQ ID NO: 92756 - DNA, 103 bp, Artificial Sequence
  Synthetic Polynucleotide
taatacgactcactatagggccgatgaaggttgagcatgtatatcaaatgaacagaggagacatttgatgtacatgctcaacctggcggcagcgcaaaagatg

SEQ ID NO: 92757 - DNA, 103 bp, Artificial Sequence
  Synthetic Polynucleotide
taatacgactcactatagggtacacgtgggccgatgaaggttgagcatgtaacagaggagaacatgcatgaccttcatcaacctggcggcagcgcaaaagatg

SEQ ID NO: 92758 - DNA, 103 bp, Artificial Sequence
  Synthetic Polynucleotide
taatacgactcactataggggcccggacaatacacgtgggccgatgaaggaacagaggagaccttcaatggcccacgtgaacctggcggcagcgcaaaagatg

SEQ ID NO: 92759 - DNA, 103 bp, Artificial Sequence
  Synthetic Polynucleotide
taatacgactcactatagggcccattctgagcccggacaatacacgtgggaacagaggagacccacgatgattgtccggaacctggcggcagcgcaaaagatg

SEQ ID NO: 92760 - DNA, 103 bp, Artificial Sequence
  Synthetic Polynucleotide
taatacgactcactatagggctggagtcctcccattctgagcccggacaaaacagaggagattgtccatgctcagaatgaacctggcggcagcgcaaaagatg

SEQ ID NO: 92761 - DNA, 103 bp, Artificial Sequence
  Synthetic Polynucleotide
taatacgactcactatagggctctcatcttctggagtcctcccattctgaaacagaggagatcagaaatggaggactccaacctggcggcagcgcaaaagatg

SEQ ID NO: 92762 - DNA, 103 bp, Artificial Sequence
  Synthetic Polynucleotide
taatacgactcactatagggaaagaggtttctctcatcttctggagtcctaacagaggagaaggactatggaagatgagaacctggcggcagcgcaaaagatg

SEQ ID NO: 92763 - DNA, 103 bp, Artificial Sequence
  Synthetic Polynucleotide
taatacgactcactatagggacaggcaggggacgatggcagaagcactcaaacagaggagatgagtgatgctgccatcgaacctggcggcagcgcaaaagatg

SEQ ID NO: 92764 - DNA, 103 bp, Artificial Sequence
  Synthetic Polynucleotide
taatacgactcactatagggtctgttggataaagaggtttctctcatcttaacagaggagaaagatgatggaaacctctaacctggcggcagcgcaaaagatg

SEQ ID NO: 92765 - DNA, 103 bp, Artificial Sequence
  Synthetic Polynucleotide
taatacgactcactatagggccttcttttatctgttggataaagaggtttaacagaggagaaaacctatgtatccaacaaacctggcggcagcgcaaaagatg

SEQ ID NO: 92766 - DNA, 103 bp, Artificial Sequence
  Synthetic Polynucleotide
taatacgactcactatagggctgcaatgttccttcttttatctgttggataacagaggagaatccaaatgataaaagaaaacctggcggcagcgcaaaagatg

SEQ ID NO: 92767 - DNA, 103 bp, Artificial Sequence
  Synthetic Polynucleotide
taatacgactcactatagggccaggaggggacaggcaggggacgatggcaaacagaggagatgccatatgcccctgcctaacctggcggcagcgcaaaagatg

SEQ ID NO: 92768 - DNA, 103 bp, Artificial Sequence
  Synthetic Polynucleotide
taatacgactcactatagggcaccagtgacccaggaggggacaggcagggaacagaggagaccctgcatgtcccctcctaacctggcggcagcgcaaaagatg

SEQ ID NO: 92769 - DNA, 103 bp, Artificial Sequence
  Synthetic Polynucleotide
taatacgactcactatagggaatcctcaaacaccagtgacccaggaggggaacagaggagacccctcatgggtcactggaacctggcggcagcgcaaaagatg

SEQ ID NO: 92770 - DNA, 103 bp, Artificial Sequence
  Synthetic Polynucleotide
taatacgactcactatagggaggttagcaaaatcctcaaacaccagtgacaacagaggagagtcactatggtttgaggaaacctggcggcagcgcaaaagatg

SEQ ID NO: 92771 - DNA, 103 bp, Artificial Sequence
  Synthetic Polynucleotide
taatacgactcactatagggctcgctgctcaggaagctcatttcggtcataacagaggagaatgaccatgatgagcttcaacctggcggcagcgcaaaagatg

SEQ ID NO: 92772 - DNA, 103 bp, Artificial Sequence
  Synthetic Polynucleotide
taatacgactcactatagggcacctccaggtaatcatctaagagacctagaacagaggagactaggtatgttagatgataacctggcggcagcgcaaaagatg

SEQ ID NO: 92773 - DNA, 103 bp, Artificial Sequence
  Synthetic Polynucleotide
taatacgactcactatagggctcttctatcaaatctttcaggtactggataacagaggagaatccagatgctgaaagataacctggcggcagcgcaaaagatg

SEQ ID NO: 92774 - DNA, 103 bp, Artificial Sequence
  Synthetic Polynucleotide
taatacgactcactatagggccttgcggacctcttctatcaaatctttcaaacagaggagatgaaagatgtgatagaagaacctggcggcagcgcaaaagatg

SEQ ID NO: 92775 - DNA, 103 bp, Artificial Sequence
  Synthetic Polynucleotide
taatacgactcactatagggttcccccttgccttgcggacctcttctatcaacagaggagagatagaatgggtccgcaaaacctggcggcagcgcaaaagatg

SEQ ID NO: 92776 - DNA, 103 bp, Artificial Sequence
  Synthetic Polynucleotide
taatacgactcactataggggacccttttcttcccccttgccttgcggacaacagaggagagtccgcatggcaagggggaacctggcggcagcgcaaaagatg

SEQ ID NO: 92777 - DNA, 103 bp, Artificial Sequence
  Synthetic Polynucleotide
taatacgactcactatagggagtgcttggccacctccaggtaatcatctaaacagaggagatagatgatgacctggaggaacctggcggcagcgcaaaagatg

SEQ ID NO: 92778 - DNA, 103 bp, Artificial Sequence
  Synthetic Polynucleotide
taatacgactcactatagggtgaggtttgaagtgcttggccacctccaggaacagaggagacctggaatgggccaagcaaacctggcggcagcgcaaaagatg

SEQ ID NO: 92779 - DNA, 103 bp, Artificial Sequence
  Synthetic Polynucleotide
taatacgactcactatagggggagaacccatgaggtttgaagtgcttggcaacagaggagagccaagatgttcaaacctaacctggcggcagcgcaaaagatg

SEQ ID NO: 92780 - DNA, 103 bp, Artificial Sequence
  Synthetic Polynucleotide
taatacgactcactatagggccttgtcgctggagaacccatgaggtttgaaacagaggagatcaaacatgatgggttctaacctggcggcagcgcaaaagatg

SEQ ID NO: 92781 - DNA, 103 bp, Artificial Sequence
  Synthetic Polynucleotide
taatacgactcactatagggcccgccttagccttgtcgctggagaacccaaacagaggagatgggttatgcagcgacaaaacctggcggcagcgcaaaagatg

SEQ ID NO: 92782 - DNA, 103 bp, Artificial Sequence
  Synthetic Polynucleotide
taatacgactcactatagggttcggaggagcccgccttagccttgtcgctaacagaggagaagcgacatggctaaggcgaacctggcggcagcgcaaaagatg

SEQ ID NO: 92783 - DNA, 103 bp, Artificial Sequence
  Synthetic Polynucleotide
taatacgactcactatagggcagccagccattcggaggagcccgccttagaacagaggagactaaggatggctcctccgaacctggcggcagcgcaaaagatg

SEQ ID NO: 92784 - DNA, 103 bp, Artificial Sequence
  Synthetic Polynucleotide
taatacgactcactatagggaacccatccacagccagccattcggaggagaacagaggagactcctcatgatggctggcaacctggcggcagcgcaaaagatg

SEQ ID NO: 92785 - DNA, 103 bp, Artificial Sequence
  Synthetic Polynucleotide
taatacgactcactataggggggactgaccaacccatccacagccagccaaacagaggagatggctgatggtggatgggaacctggcggcagcgcaaaagatg

SEQ ID NO: 92786 - DNA, 103 bp, Artificial Sequence
  Synthetic Polynucleotide
taatacgactcactatagggccaccaacacctcgctgctcaggaagctcaaacagaggagatgagctatgtgagcagcgaacctggcggcagcgcaaaagatg

SEQ ID NO: 92787 - DNA, 103 bp, Artificial Sequence
  Synthetic Polynucleotide
taatacgactcactatagggtgttgttggagggactgaccaacccatccaaacagaggagatggatgatgtggtcagtcaacctggcggcagcgcaaaagatg

SEQ ID NO: 92788 - DNA, 103 bp, Artificial Sequence
  Synthetic Polynucleotide
taatacgactcactatagggtcctccttgctgttgttggagggactgaccaacagaggagaggtcagatgctccaacaaaacctggcggcagcgcaaaagatg

SEQ ID NO: 92789 - DNA, 103 bp, Artificial Sequence
  Synthetic Polynucleotide
taatacgactcactatagggggagaaggcatcctccttgctgttgttggaaacagaggagatccaacatgagcaaggagaacctggcggcagcgcaaaagatg

SEQ ID NO: 92790 - DNA, 103 bp, Artificial Sequence
  Synthetic Polynucleotide
taatacgactcactatagggaatctgtcccggagaaggcatcctccttgcaacagaggagagcaaggatgatgccttctaacctggcggcagcgcaaaagatg

SEQ ID NO: 92791 - DNA, 103 bp, Artificial Sequence
  Synthetic Polynucleotide
taatacgactcactatagggtccaacatccaatctgtcccggagaaggcaaacagaggagatgccttatgcgggacagaaacctggcggcagcgcaaaagatg

SEQ ID NO: 92792 - DNA, 103 bp, Artificial Sequence
  Synthetic Polynucleotide
taatacgactcactatagggatccattttctccaacatccaatctgtcccaacagaggagagggacaatgtggatgttgaacctggcggcagcgcaaaagatg

SEQ ID NO: 92793 - DNA, 103 bp, Artificial Sequence
  Synthetic Polynucleotide
taatacgactcactatagggactccttcaaatccattttctccaacatccaacagaggagaggatgtatgagaaaatggaacctggcggcagcgcaaaagatg

SEQ ID NO: 92794 - DNA, 103 bp, Artificial Sequence
  Synthetic Polynucleotide
taatacgactcactatagggtccaagtcgaactccttcaaatccattttcaacagaggagagaaaatatgtttgaaggaaacctggcggcagcgcaaaagatg

SEQ ID NO: 92795 - DNA, 103 bp, Artificial Sequence
  Synthetic Polynucleotide
taatacgactcactatagggcaacagggcatccaagtcgaactccttcaaaacagaggagattgaagatgttcgacttgaacctggcggcagcgcaaaagatg

SEQ ID NO: 92796 - DNA, 103 bp, Artificial Sequence
  Synthetic Polynucleotide
taatacgactcactatagggcatctatacccaacagggcatccaagtcgaaacagaggagatcgactatgatgccctgtaacctggcggcagcgcaaaagatg

SEQ ID NO: 92797 - DNA, 103 bp, Artificial Sequence
  Synthetic Polynucleotide
taatacgactcactatagggatcaagtcccccaccaacacctcgctgctcaacagaggagagagcagatgggtgttggtaacctggcggcagcgcaaaagatg

SEQ ID NO: 92798 - DNA, 103 bp, Artificial Sequence
  Synthetic Polynucleotide
taatacgactcactataggggtttccaggtcatctatacccaacagggcaaacagaggagatgccctatggggtatagaaacctggcggcagcgcaaaagatg

SEQ ID NO: 92799 - DNA, 103 bp, Artificial Sequence
  Synthetic Polynucleotide
taatacgactcactatagggatctggcatggtttccaggtcatctataccaacagaggagaggtataatggacctggaaaacctggcggcagcgcaaaagatg

SEQ ID NO: 92800 - DNA, 103 bp, Artificial Sequence
  Synthetic Polynucleotide
taatacgactcactatagggtcagaaggtcatctggcatggtttccaggtaacagaggagaacctggatgccatgccagaacctggcggcagcgcaaaagatg

SEQ ID NO: 92801 - DNA, 103 bp, Artificial Sequence
  Synthetic Polynucleotide
taatacgactcactatagggtccaacgtggtcagaaggtcatctggcatgaacagaggagacatgccatgtgaccttctaacctggcggcagcgcaaaagatg

SEQ ID NO: 92802 - DNA, 103 bp, Artificial Sequence
  Synthetic Polynucleotide
taatacgactcactatagggacaagtgtcatccaacgtggtcagaaggtcaacagaggagagaccttatgaccacgttgaacctggcggcagcgcaaaagatg

SEQ ID NO: 92803 - DNA, 103 bp, Artificial Sequence
  Synthetic Polynucleotide
taatacgactcactatagggcaaagagatcacaagtgtcatccaacgtggaacagaggagaccacgtatgatgacacttaacctggcggcagcgcaaaagatg

SEQ ID NO: 92804 - DNA, 103 bp, Artificial Sequence
  Synthetic Polynucleotide
taatacgactcactatagggactaggggggcaaagagatcacaagtgtcaaacagaggagatgacacatgtgatctcttaacctggcggcagcgcaaaagatg

SEQ ID NO: 92805 - DNA, 103 bp, Artificial Sequence
  Synthetic Polynucleotide
taatacgactcactatagggagtctcctggactaggggggcaaagagatcaacagaggagagatctcatggcccccctaaacctggcggcagcgcaaaagatg

SEQ ID NO: 92806 - DNA, 103 bp, Artificial Sequence
  Synthetic Polynucleotide
taatacgactcactataggggctgcttattagtctcctggactaggggggaacagaggagaccccccatgtccaggagaaacctggcggcagcgcaaaagatg

SEQ ID NO: 92807 - DNA, 103 bp, Artificial Sequence
  Synthetic Polynucleotide
taatacgactcactataggggtctgggggggctgcttattagtctcctggaacagaggagaccaggaatgtaataagcaaacctggcggcagcgcaaaagatg

SEQ ID NO: 92808 - DNA, 103 bp, Artificial Sequence
  Synthetic Polynucleotide
taatacgactcactataggggaagggggacatcaagtcccccaccaacacaacagaggagagtgttgatgggggacttgaacctggcggcagcgcaaaagatg

SEQ ID NO: 92809 - DNA, 103 bp, Artificial Sequence
  Synthetic Polynucleotide
taatacgactcactatagggtgggttcaccgtctgggggggctgcttattaacagaggagaaataagatgcccccccagaacctggcggcagcgcaaaagatg

SEQ ID NO: 92810 - DNA, 103 bp, Artificial Sequence
  Synthetic Polynucleotide
taatacgactcactataggggatggccaattgggttcaccgtctggggggaacagaggagaccccccatgcggtgaaccaacctggcggcagcgcaaaagatg

SEQ ID NO: 92811 - DNA, 103 bp, Artificial Sequence
  Synthetic Polynucleotide
taatacgactcactatagggctttctgggagatggccaattgggttcaccaacagaggagaggtgaaatgaattggccaaacctggcggcagcgcaaaagatg

SEQ ID NO: 92812 - DNA, 103 bp, Artificial Sequence
  Synthetic Polynucleotide
taatacgactcactatagggttttgttaaactttctgggagatggccaataacagaggagaattggcatgctcccagaaaacctggcggcagcgcaaaagatg

SEQ ID NO: 92813 - DNA, 103 bp, Artificial Sequence
  Synthetic Polynucleotide
taatacgactcactatagggcctggtcgggttttgttaaactttctgggaaacagaggagatcccagatggtttaacaaaacctggcggcagcgcaaaagatg

SEQ ID NO: 92814 - DNA, 103 bp, Artificial Sequence
  Synthetic Polynucleotide
taatacgactcactatagggaagggggcaacctggtcgggttttgttaaaaacagaggagatttaacatgacccgaccaaacctggcggcagcgcaaaagatg

SEQ ID NO: 92815 - DNA, 103 bp, Artificial Sequence
  Synthetic Polynucleotide
taatacgactcactatagggtaagaaggtgaagggggcaacctggtcgggaacagaggagacccgacatggttgcccccaacctggcggcagcgcaaaagatg

SEQ ID NO: 92816 - DNA, 103 bp, Artificial Sequence
  Synthetic Polynucleotide
taatacgactcactataggggaagaggttgtaagaaggtgaagggggcaaaacagaggagattgcccatgtcaccttctaacctggcggcagcgcaaaagatg

SEQ ID NO: 92817 - DNA, 103 bp, Artificial Sequence
  Synthetic Polynucleotide
taatacgactcactatagggggggaaaggggaagaggttgtaagaaggtgaacagaggagacaccttatgacaacctctaacctggcggcagcgcaaaagatg

SEQ ID NO: 92818 - DNA, 103 bp, Artificial Sequence
  Synthetic Polynucleotide
taatacgactcactatagggcaggacccctggggaaaggggaagaggttgaacagaggagacaacctatgcccctttccaacctggcggcagcgcaaaagatg

SEQ ID NO: 92819 - DNA, 103 bp, Artificial Sequence
  Synthetic Polynucleotide
taatacgactcactatagggccgactggtcgaagggggacatcaagtcccaacagaggagagggactatgtgtccccctaacctggcggcagcgcaaaagatg

SEQ ID NO: 92820 - DNA, 103 bp, Artificial Sequence
  Synthetic Polynucleotide
taatacgactcactataggggagtggaggacaggacccctggggaaagggaacagaggagaccctttatgcaggggtccaacctggcggcagcgcaaaagatg

SEQ ID NO: 92821 - DNA, 103 bp, Artificial Sequence
  Synthetic Polynucleotide
taatacgactcactataggggaatgatctggagtggaggacaggacccctaacagaggagaaggggtatggtcctccacaacctggcggcagcgcaaaagatg

SEQ ID NO: 92822 - DNA, 103 bp, Artificial Sequence
  Synthetic Polynucleotide
taatacgactcactatagggtaaactaaaggaatgatctggagtggaggaaacagaggagatcctccatgccagatcataacctggcggcagcgcaaaagatg

SEQ ID NO: 92823 - DNA, 103 bp, Artificial Sequence
  Synthetic Polynucleotide
taatacgactcactatagggtgcccagctctaaactaaaggaatgatctgaacagaggagacagatcatgcctttagttaacctggcggcagcgcaaaagatg

SEQ ID NO: 92824 - DNA, 103 bp, Artificial Sequence
  Synthetic Polynucleotide
taatacgactcactatagggtccacttcactgcccagctctaaactaaagaacagaggagactttagatgagagctgggaacctggcggcagcgcaaaagatg

SEQ ID NO: 92825 - DNA, 103 bp, Artificial Sequence
  Synthetic Polynucleotide
taatacgactcactatagggttcagtgatatccacttcactgcccagctcaacagaggagagagctgatgagtgaagtgaacctggcggcagcgcaaaagatg

SEQ ID NO: 92826 - DNA, 103 bp, Artificial Sequence
  Synthetic Polynucleotide
taatacgactcactatagggtcctatctccttcagtgatatccacttcacaacagaggagagtgaagatgatatcactgaacctggcggcagcgcaaaagatg

SEQ ID NO: 92827 - DNA, 103 bp, Artificial Sequence
  Synthetic Polynucleotide
taatacgactcactatagggtagtctggcttcctatctccttcagtgataaacagaggagatatcacatgaggagatagaacctggcggcagcgcaaaagatg

SEQ ID NO: 92828 - DNA, 103 bp, Artificial Sequence
  Synthetic Polynucleotide
taatacgactcactataggggtaagcagtgtagtctggcttcctatctccaacagaggagaggagatatgaagccagacaacctggcggcagcgcaaaagatg

SEQ ID NO: 92829 - DNA, 103 bp, Artificial Sequence
  Synthetic Polynucleotide
taatacgactcactatagggtcatggcaacgtaagcagtgtagtctggctaacagaggagaagccagatgacactgcttaacctggcggcagcgcaaaagatg

SEQ ID NO: 92830 - DNA, 103 bp, Artificial Sequence
  Synthetic Polynucleotide
taatacgactcactataggggcccccaaacccgactggtcgaagggggacaacagaggagagtccccatgcgaccagtcaacctggcggcagcgcaaaagatg

SEQ ID NO: 92831 - DNA, 103 bp, Artificial Sequence
  Synthetic Polynucleotide
taatacgactcactatagggcactgagggatcatggcaacgtaagcagtgaacagaggagacactgcatgcgttgccataacctggcggcagcgcaaaagatg

SEQ ID NO: 92832 - DNA, 103 bp, Artificial Sequence
  Synthetic Polynucleotide
taatacgactcactatagggctcctttatgcactgagggatcatggcaacaacagaggagagttgccatgatccctcagaacctggcggcagcgcaaaagatg

SEQ ID NO: 92833 - DNA, 103 bp, Artificial Sequence
  Synthetic Polynucleotide
taatacgactcactataggggggtgtcttcctcctttatgcactgagggaaacagaggagatccctcatggcataaaggaacctggcggcagcgcaaaagatg

SEQ ID NO: 92834 - DNA, 103 bp, Artificial Sequence
  Synthetic Polynucleotide
taatacgactcactatagggttatctgaaggggtgtcttcctcctttatgaacagaggagacataaaatgggaagacacaacctggcggcagcgcaaaagatg

SEQ ID NO: 92835 - DNA, 103 bp, Artificial Sequence
  Synthetic Polynucleotide
taatacgactcactataggggccactatcattatctgaaggggtgtcttcaacagaggagagaagacatgccttcagataacctggcggcagcgcaaaagatg

SEQ ID NO: 92836 - DNA, 103 bp, Artificial Sequence
  Synthetic Polynucleotide
taatacgactcactatagggtcatacagatgccactatcattatctgaagaacagaggagacttcagatgatgatagtgaacctggcggcagcgcaaaagatg

SEQ ID NO: 92837 - DNA, 103 bp, Artificial Sequence
  Synthetic Polynucleotide
taatacgactcactataggggactctgggctcatacagatgccactatcaaacagaggagatgatagatgcatctgtataacctggcggcagcgcaaaagatg

SEQ ID NO: 92838 - DNA, 103 bp, Artificial Sequence
  Synthetic Polynucleotide
taatacgactcactatagggccccagataggactctgggctcatacagataacagaggagaatctgtatgagcccagagaacctggcggcagcgcaaaagatg

SEQ ID NO: 92839 - DNA, 103 bp, Artificial Sequence
  Synthetic Polynucleotide
taatacgactcactataggggctgaggagaccccagataggactctgggcaacagaggagagcccagatgcctatctggaacctggcggcagcgcaaaagatg

SEQ ID NO: 92840 - DNA, 103 bp, Artificial Sequence
  Synthetic Polynucleotide
taatacgactcactataggggaggggctgtgctgaggagaccccagatagaacagaggagactatctatggtctcctcaaacctggcggcagcgcaaaagatg

SEQ ID NO: 92841 - DNA, 103 bp, Artificial Sequence
  Synthetic Polynucleotide
taatacgactcactataggggctttcttcagcccccaaacccgactggtcaacagaggagagaccagatgggtttggggaacctggcggcagcgcaaaagatg

SEQ ID NO: 92842 - DNA, 103 bp, Artificial Sequence
  Synthetic Polynucleotide
taatacgactcactataggggcccctggtagaggggctgtgctgaggagaaacagaggagatctcctatgcacagccccaacctggcggcagcgcaaaagatg

SEQ ID NO: 92843 - DNA, 103 bp, Artificial Sequence
  Synthetic Polynucleotide
taatacgactcactatagggtatttggagagcccctggtagaggggctgtaacagaggagaacagccatgctaccagggaacctggcggcagcgcaaaagatg

SEQ ID NO: 92844 - DNA, 103 bp, Artificial Sequence
  Synthetic Polynucleotide
taatacgactcactataggggggaggctcctatttggagagcccctggtaaacagaggagataccagatgctctccaaaaacctggcggcagcgcaaaagatg

SEQ ID NO: 92845 - DNA, 103 bp, Artificial Sequence
  Synthetic Polynucleotide
taatacgactcactatagggacctggagatgggaggctcctatttggagaaacagaggagatctccaatgaggagcctcaacctggcggcagcgcaaaagatg

SEQ ID NO: 92846 - DNA, 103 bp, Artificial Sequence
  Synthetic Polynucleotide
taatacgactcactatagggcacagagaacacctggagatgggaggctccaacagaggagaggagccatgcatctccagaacctggcggcagcgcaaaagatg

SEQ ID NO: 92847 - DNA, 103 bp, Artificial Sequence
  Synthetic Polynucleotide
taatacgactcactatagggcgggcagacccacagagaacacctggagataacagaggagaatctccatgtgttctctgaacctggcggcagcgcaaaagatg

SEQ ID NO: 92848 - DNA, 103 bp, Artificial Sequence
  Synthetic Polynucleotide
taatacgactcactatagggaggtttgggacgggcagacccacagagaacaacagaggagagttctcatggggtctgccaacctggcggcagcgcaaaagatg

SEQ ID NO: 92849 - DNA, 103 bp, Artificial Sequence
  Synthetic Polynucleotide
taatacgactcactataggggaggatcgtaaggtttgggacgggcagaccaacagaggagaggtctgatggtcccaaacaacctggcggcagcgcaaaagatg

SEQ ID NO: 92850 - DNA, 103 bp, Artificial Sequence
  Synthetic Polynucleotide
taatacgactcactatagggttctctccaggaggatcgtaaggtttgggaaacagaggagatcccaaatgttacgatccaacctggcggcagcgcaaaagatg

SEQ ID NO: 92851 - DNA, 103 bp, Artificial Sequence
  Synthetic Polynucleotide
taatacgactcactatagggtgctaccatcttctctccaggaggatcgtaaacagaggagatacgatatgcctggagagaacctggcggcagcgcaaaagatg

SEQ ID NO: 92852 - DNA, 103 bp, Artificial Sequence
  Synthetic Polynucleotide
taatacgactcactatagggagagacctaggctttcttcagcccccaaacaacagaggagagtttggatgctgaagaaaaacctggcggcagcgcaaaagatg

SEQ ID NO: 92853 - DNA, 103 bp, Artificial Sequence
  Synthetic Polynucleotide
taatacgactcactatagggttacttttgctgctaccatcttctctccagaacagaggagactggagatgagatggtagaacctggcggcagcgcaaaagatg

SEQ ID NO: 92854 - DNA, 103 bp, Artificial Sequence
  Synthetic Polynucleotide
taatacgactcactatagggttctcaccctttacttttgctgctaccatcaacagaggagagatggtatgagcaaaagtaacctggcggcagcgcaaaagatg

SEQ ID NO: 92855 - DNA, 103 bp, Artificial Sequence
  Synthetic Polynucleotide
taatacgactcactatagggcttatccagtttctcaccctttacttttgcaacagaggagagcaaaaatgaagggtgagaacctggcggcagcgcaaaagatg

SEQ ID NO: 92856 - DNA, 103 bp, Artificial Sequence
  Synthetic Polynucleotide
taatacgactcactatagggttttcagcttcttatccagtttctcaccctaacagaggagaagggtgatgaactggataaacctggcggcagcgcaaaagatg

SEQ ID NO: 92857 - DNA, 103 bp, Artificial Sequence
  Synthetic Polynucleotide
taatacgactcactatagggtgctccatttttttcagcttcttatccagtaacagaggagaactggaatggaagctgaaaacctggcggcagcgcaaaagatg

SEQ ID NO: 92858 - DNA, 103 bp, Artificial Sequence
  Synthetic Polynucleotide
taatacgactcactatagggtgtcttgttttgctccatttttttcagcttaacagaggagaaagctgatgaaaatggagaacctggcggcagcgcaaaagatg

SEQ ID NO: 92859 - DNA, 103 bp, Artificial Sequence
  Synthetic Polynucleotide
taatacgactcactatagggtagtggctgctgtcttgttttgctccatttaacagaggagaaaatggatgaaaacaagaaacctggcggcagcgcaaaagatg

SEQ ID NO: 92860 - DNA, 103 bp, Artificial Sequence
  Synthetic Polynucleotide
taatacgactcactatagggtggcggtacctagtggctgctgtcttgtttaacagaggagaaaacaaatgagcagccacaacctggcggcagcgcaaaagatg

SEQ ID NO: 92861 - DNA, 103 bp, Artificial Sequence
  Synthetic Polynucleotide
taatacgactcactatagggcctcttcttctggcggtacctagtggctgcaacagaggagagcagccatgaggtaccgcaacctggcggcagcgcaaaagatg

SEQ ID NO: 92862 - DNA, 103 bp, Artificial Sequence
  Synthetic Polynucleotide
taatacgactcactatagggcctgctccgccctcttcttctggcggtaccaacagaggagaggtaccatgagaagaagaaacctggcggcagcgcaaaagatg

SEQ ID NO: 92863 - DNA, 103 bp, Artificial Sequence
  Synthetic Polynucleotide
taatacgactcactatagggtaatcatctaagagacctaggctttcttcaaacagaggagatgaagaatgcctaggtctaacctggcggcagcgcaaaagatg

SEQ ID NO: 92864 - DNA, 103 bp, Artificial Sequence
  Synthetic Polynucleotide
taatacgactcactataggggtaagagcctcctgctccgccctcttcttcaacagaggagagaagaaatgggcggagcaaacctggcggcagcgcaaaagatg

SEQ ID NO: 92865 - DNA, 103 bp, Artificial Sequence
  Synthetic Polynucleotide
taatacgactcactataggggcactcaccagtaagagcctcctgctccgcaacagaggagagcggagatggaggctcttaacctggcggcagcgcaaaagatg

SEQ ID NO: 92866 - DNA, 103 bp, Artificial Sequence
  Synthetic Polynucleotide
taatacgactcactatagggccagctctttgcactcaccagtaagagcctaacagaggagaaggctcatgctggtgagtaacctggcggcagcgcaaaagatg

SEQ ID NO: 92867 - DNA, 103 bp, Artificial Sequence
  Synthetic Polynucleotide
taatacgactcactatagggttcttcttttccagctctttgcactcaccaaacagaggagatggtgaatgcaaagagctaacctggcggcagcgcaaaagatg

SEQ ID NO: 92868 - DNA, 103 bp, Artificial Sequence
  Synthetic Polynucleotide
taatacgactcactatagggtagagcctcgttcttcttttccagctctttaacagaggagaaaagagatggaaaagaagaacctggcggcagcgcaaaagatg

SEQ ID NO: 92869 - DNA, 103 bp, Artificial Sequence
  Synthetic Polynucleotide
taatacgactcactatagggccctctcttttagagcctcgttcttcttttaacagaggagaaaaagaatgacgaggctcaacctggcggcagcgcaaaagatg

SEQ ID NO: 92870 - DNA, 103 bp, Artificial Sequence
  Synthetic Polynucleotide
taatacgactcactatagggagggaatccgccctctcttttagagcctcgaacagaggagacgaggcatgaaaagagagaacctggcggcagcgcaaaagatg

SEQ ID NO: 92871 - DNA, 103 bp, Artificial Sequence
  Synthetic Polynucleotide
taatacgactcactatagggctccttggccagggaatccgccctctctttaacagaggagaaaagagatggcggattccaacctggcggcagcgcaaaagatg

SEQ ID NO: 92872 - DNA, 103 bp, Artificial Sequence
  Synthetic Polynucleotide
taatacgactcactatagggggtactggatctccttggccagggaatccgaacagaggagacggattatgtggccaaggaacctggcggcagcgcaaaagatg

SEQ ID NO: 92873 - DNA, 103 bp, Artificial Sequence
  Synthetic Polynucleotide
taatacgactcactatagggaaatctttcaggtactggatctccttggccaacagaggagaggccaaatggatccagtaaacctggcggcagcgcaaaagatg

SEQ ID NO: 92874 - DNA, 103 bp, Artificial Sequence
  Synthetic Polynucleotide
taatacgactcactatagggctccagccccagggtcgccaggagtgacataacagaggagaatgtcaatgctggcgaccaacctggcggcagcgcaaaagatg

SEQ ID NO: 92875 - DNA, 103 bp, Artificial Sequence
  Synthetic Polynucleotide
taatacgactcactatagggatagggagccaggggggcaggggccgggggaacagaggagacccccgatgcctgcccccaacctggcggcagcgcaaaagatg

SEQ ID NO: 92876 - DNA, 103 bp, Artificial Sequence
  Synthetic Polynucleotide
taatacgactcactatagggcaaggacctcatagggagccaggggggcagaacagaggagactgcccatgtggctccctaacctggcggcagcgcaaaagatg

SEQ ID NO: 92877 - DNA, 103 bp, Artificial Sequence
  Synthetic Polynucleotide
taatacgactcactatagggagggctcccccaaggacctcatagggagccaacagaggagaggctccatgtgaggtcctaacctggcggcagcgcaaaagatg

SEQ ID NO: 92878 - DNA, 103 bp, Artificial Sequence
  Synthetic Polynucleotide
taatacgactcactatagggcccgccctccagggctcccccaaggacctcaacagaggagagaggtcatggggggagccaacctggcggcagcgcaaaagatg

SEQ ID NO: 92879 - DNA, 103 bp, Artificial Sequence
  Synthetic Polynucleotide
taatacgactcactatagggccactggaagcccgccctccagggctccccaacagaggagaggggagatgtggagggcgaacctggcggcagcgcaaaagatg

SEQ ID NO: 92880 - DNA, 103 bp, Artificial Sequence
  Synthetic Polynucleotide
taatacgactcactatagggggctctccccccactggaagcccgccctccaacagaggagaggagggatggcttccagtaacctggcggcagcgcaaaagatg

SEQ ID NO: 92881 - DNA, 103 bp, Artificial Sequence
  Synthetic Polynucleotide
taatacgactcactatagggacctgccaggggctctccccccactggaagaacagaggagacttccaatggggggagagaacctggcggcagcgcaaaagatg

SEQ ID NO: 92882 - DNA, 103 bp, Artificial Sequence
  Synthetic Polynucleotide
taatacgactcactatagggagaagccatcacctgccaggggctctccccaacagaggagaggggagatgccctggcagaacctggcggcagcgcaaaagatg

SEQ ID NO: 92883 - DNA, 103 bp, Artificial Sequence
  Synthetic Polynucleotide
taatacgactcactatagggatccagtcagagaagccatcacctgccaggaacagaggagacctggcatgtgatggcttaacctggcggcagcgcaaaagatg

SEQ ID NO: 92884 - DNA, 103 bp, Artificial Sequence
  Synthetic Polynucleotide
taatacgactcactatagggtcgctcagtcatccagtcagagaagccatcaacagaggagagatggcatgtctgactggaacctggcggcagcgcaaaagatg

SEQ ID NO: 92885 - DNA, 103 bp, Artificial Sequence
  Synthetic Polynucleotide
taatacgactcactatagggccctgtccagctccagccccagggtcgccaaacagaggagatggcgaatgtggggctggaacctggcggcagcgcaaaagatg

SEQ ID NO: 92886 - DNA, 103 bp, Artificial Sequence
  Synthetic Polynucleotide
taatacgactcactatagggtgaaatcaactcgctcagtcatccagtcagaacagaggagactgactatgtgactgagcaacctggcggcagcgcaaaagatg

SEQ ID NO: 92887 - DNA, 103 bp, Artificial Sequence
  Synthetic Polynucleotide
taatacgactcactatagggaggagagctgtgaaatcaactcgctcagtcaacagaggagagactgaatgagttgatttaacctggcggcagcgcaaaagatg

SEQ ID NO: 92888 - DNA, 103 bp, Artificial Sequence
  Synthetic Polynucleotide
taatacgactcactatagggctccagagggaggagagctgtgaaatcaacaacagaggagagttgatatgacagctctcaacctggcggcagcgcaaaagatg

SEQ ID NO: 92889 - DNA, 103 bp, Artificial Sequence
  Synthetic Polynucleotide
taatacgactcactataggggtaagggaggctccagagggaggagagctgaacagaggagacagctcatgtccctctggaacctggcggcagcgcaaaagatg

SEQ ID NO: 92890 - DNA, 103 bp, Artificial Sequence
  Synthetic Polynucleotide
taatacgactcactataggggtgccggggggtaagggaggctccagagggaacagaggagaccctctatggcctcccttaacctggcggcagcgcaaaagatg

SEQ ID NO: 92891 - DNA, 103 bp, Artificial Sequence
  Synthetic Polynucleotide
taatacgactcactatagggttgggggagggtgccggggggtaagggaggaacagaggagacctcccatgccccccggcaacctggcggcagcgcaaaagatg

SEQ ID NO: 92892 - DNA, 103 bp, Artificial Sequence
  Synthetic Polynucleotide
taatacgactcactatagggttggggaaggttgggggagggtgccgggggaacagaggagacccccgatgccctcccccaacctggcggcagcgcaaaagatg

SEQ ID NO: 92893 - DNA, 103 bp, Artificial Sequence
  Synthetic Polynucleotide
taatacgactcactatagggtcaggtggggttggggaaggttgggggaggaacagaggagacctcccatgaccttccccaacctggcggcagcgcaaaagatg

SEQ ID NO: 92894 - DNA, 103 bp, Artificial Sequence
  Synthetic Polynucleotide
taatacgactcactatagggagcttccaggtcaggtggggttggggaaggaacagaggagaccttccatgaccccacctaacctggcggcagcgcaaaagatg

SEQ ID NO: 92895 - DNA, 103 bp, Artificial Sequence
  Synthetic Polynucleotide
taatacgactcactataggggggaggccatagcttccaggtcaggtggggaacagaggagaccccacatgacctggaagaacctggcggcagcgcaaaagatg

SEQ ID NO: 92896 - DNA, 103 bp, Artificial Sequence
  Synthetic Polynucleotide
taatacgactcactataggggggagcagggccctgtccagctccagccccaacagaggagaggggctatggctggacagaacctggcggcagcgcaaaagatg

SEQ ID NO: 92897 - DNA, 103 bp, Artificial Sequence
  Synthetic Polynucleotide
taatacgactcactatagggttcttgaggagggaggccatagcttccaggaacagaggagacctggaatgtatggcctcaacctggcggcagcgcaaaagatg

SEQ ID NO: 92898 - DNA, 103 bp, Artificial Sequence
  Synthetic Polynucleotide
taatacgactcactatagggttccagctccttcttgaggagggaggccataacagaggagaatggccatgctcctcaagaacctggcggcagcgcaaaagatg

SEQ ID NO: 92899 - DNA, 103 bp, Artificial Sequence
  Synthetic Polynucleotide
taatacgactcactatagggcttccatctgttccagctccttcttgaggaaacagaggagatcctcaatgaggagctggaacctggcggcagcgcaaaagatg

SEQ ID NO: 92900 - DNA, 103 bp, Artificial Sequence
  Synthetic Polynucleotide
taatacgactcactatagggaggaagaagtcttccatctgttccagctccaacagaggagaggagctatgacagatggaaacctggcggcagcgcaaaagatg

SEQ ID NO: 92901 - DNA, 103 bp, Artificial Sequence
  Synthetic Polynucleotide
taatacgactcactatagggcggggcatctaggaagaagtcttccatctgaacagaggagacagatgatggacttcttcaacctggcggcagcgcaaaagatg

SEQ ID NO: 92902 - DNA, 103 bp, Artificial Sequence
  Synthetic Polynucleotide
taatacgactcactataggggtgggaggggcggggcatctaggaagaagtaacagaggagaacttctatgtagatgcccaacctggcggcagcgcaaaagatg

SEQ ID NO: 92903 - DNA, 103 bp, Artificial Sequence
  Synthetic Polynucleotide
taatacgactcactatagggggggagggtggtgggaggggcggggcatctaacagaggagaagatgcatggcccctcccaacctggcggcagcgcaaaagatg

SEQ ID NO: 92904 - DNA, 103 bp, Artificial Sequence
  Synthetic Polynucleotide
taatacgactcactatagggtagtggcggcggggagggtggtgggaggggaacagaggagacccctcatgccaccctccaacctggcggcagcgcaaaagatg

SEQ ID NO: 92905 - DNA, 103 bp, Artificial Sequence
  Synthetic Polynucleotide
taatacgactcactataggggtggtggtggtagtggcggcggggagggtgaacagaggagacaccctatgcgccgccacaacctggcggcagcgcaaaagatg

SEQ ID NO: 92906 - DNA, 103 bp, Artificial Sequence
  Synthetic Polynucleotide
taatacgactcactatagggggtggtagtggtggtggtggtagtggcggcaacagaggagagccgccatgaccaccaccaacctggcggcagcgcaaaagatg

SEQ ID NO: 92907 - DNA, 103 bp, Artificial Sequence
  Synthetic Polynucleotide
taatacgactcactatagggcccactagctgggagcagggccctgtccagaacagaggagactggacatggccctgctcaacctggcggcagcgcaaaagatg

SEQ ID NO: 92908 - DNA, 103 bp, Artificial Sequence
  Synthetic Polynucleotide
taatacgactcactatagggggagggggctggtggtagtggtggtggtggaacagaggagaccaccaatgccactaccaaacctggcggcagcgcaaaagatg

SEQ ID NO: 92909 - DNA, 103 bp, Artificial Sequence
  Synthetic Polynucleotide
taatacgactcactatagggacagggggagggagggggctggtggtagtgaacagaggagacactacatgcagccccctaacctggcggcagcgcaaaagatg

SEQ ID NO: 92910 - DNA, 103 bp, Artificial Sequence
  Synthetic Polynucleotide
taatacgactcactataggggaggggagggacagggggagggagggggctaacagaggagaagccccatgcctccccctaacctggcggcagcgcaaaagatg

SEQ ID NO: 92911 - DNA, 103 bp, Artificial Sequence
  Synthetic Polynucleotide
taatacgactcactataggggaggtcaaaggaggggagggacagggggagaacagaggagactccccatgtccctccccaacctggcggcagcgcaaaagatg

SEQ ID NO: 92912 - DNA, 103 bp, Artificial Sequence
  Synthetic Polynucleotide
taatacgactcactatagggggggctgggggaggtcaaaggaggggagggaacagaggagaccctccatgcctttgaccaacctggcggcagcgcaaaagatg

SEQ ID NO: 92913 - DNA, 103 bp, Artificial Sequence
  Synthetic Polynucleotide
taatacgactcactatagggtccaagacagggggctgggggaggtcaaagaacagaggagactttgaatgcccccagccaacctggcggcagcgcaaaagatg

SEQ ID NO: 92914 - DNA, 103 bp, Artificial Sequence
  Synthetic Polynucleotide
taatacgactcactataggggtccagagtatccaagacagggggctggggaacagaggagaccccagatgcctgtcttgaacctggcggcagcgcaaaagatg

SEQ ID NO: 92915 - DNA, 103 bp, Artificial Sequence
  Synthetic Polynucleotide
taatacgactcactatagggtggccagcaagtccagagtatccaagacagaacagaggagactgtctatgatactctggaacctggcggcagcgcaaaagatg

SEQ ID NO: 92916 - DNA, 103 bp, Artificial Sequence
  Synthetic Polynucleotide
taatacgactcactatagggcggcagtagatggccagcaagtccagagtaaacagaggagatactctatgcttgctggcaacctggcggcagcgcaaaagatg

SEQ ID NO: 92917 - DNA, 103 bp, Artificial Sequence
  Synthetic Polynucleotide
taatacgactcactatagggggcctcgttgcggcagtagatggccagcaaaacagaggagattgctgatgatctactgcaacctggcggcagcgcaaaagatg

SEQ ID NO: 92918 - DNA, 103 bp, Artificial Sequence
  Synthetic Polynucleotide
taatacgactcactataggggccatcccagcccactagctgggagcagggaacagaggagaccctgcatgcagctagtgaacctggcggcagcgcaaaagatg

SEQ ID NO: 92919 - DNA, 103 bp, Artificial Sequence
  Synthetic Polynucleotide
taatacgactcactatagggcctcctgcccggcctcgttgcggcagtagaaacagaggagatctactatggcaacgaggaacctggcggcagcgcaaaagatg

SEQ ID NO: 92920 - DNA, 103 bp, Artificial Sequence
  Synthetic Polynucleotide
taatacgactcactatagggatccccacttcctcctgcccggcctcgttgaacagaggagacaacgaatgcgggcaggaaacctggcggcagcgcaaaagatg

SEQ ID NO: 92921 - DNA, 103 bp, Artificial Sequence
  Synthetic Polynucleotide
taatacgactcactatagggcagaggcggcatccccacttcctcctgcccaacagaggagagggcagatggaagtggggaacctggcggcagcgcaaaagatg

SEQ ID NO: 92922 - DNA, 103 bp, Artificial Sequence
  Synthetic Polynucleotide
taatacgactcactataggggtggcgggggcagaggcggcatccccacttaacagaggagaaagtggatgtgccgcctcaacctggcggcagcgcaaaagatg

SEQ ID NO: 92923 - DNA, 103 bp, Artificial Sequence
  Synthetic Polynucleotide
taatacgactcactataggggggggctgctgtggcgggggcagaggcggcaacagaggagagccgccatggcccccgccaacctggcggcagcgcaaaagatg

SEQ ID NO: 92924 - DNA, 103 bp, Artificial Sequence
  Synthetic Polynucleotide
taatacgactcactatagggagaaggaggagggggctgctgtggcgggggaacagaggagacccccgatgcagcagcccaacctggcggcagcgcaaaagatg

SEQ ID NO: 92925 - DNA, 103 bp, Artificial Sequence
  Synthetic Polynucleotide
taatacgactcactataggggttgaggtggagaaggaggagggggctgctaacagaggagaagcagcatgctcctccttaacctggcggcagcgcaaaagatg

SEQ ID NO: 92926 - DNA, 103 bp, Artificial Sequence
  Synthetic Polynucleotide
taatacgactcactatagggaggcgagaaggttgaggtggagaaggaggaaacagaggagatcctccatgtccacctcaaacctggcggcagcgcaaaagatg

SEQ ID NO: 92927 - DNA, 103 bp, Artificial Sequence
  Synthetic Polynucleotide
taatacgactcactataggggtagggggccaggcgagaaggttgaggtggaacagaggagaccacctatgccttctcgcaacctggcggcagcgcaaaagatg

SEQ ID NO: 92928 - DNA, 103 bp, Artificial Sequence
  Synthetic Polynucleotide
taatacgactcactatagggcaggatgtgggtagggggccaggcgagaagaacagaggagacttctcatgtggccccctaacctggcggcagcgcaaaagatg

SEQ ID NO: 92929 - DNA, 103 bp, Artificial Sequence
  Synthetic Polynucleotide
taatacgactcactatagggtagtctacgagccatcccagcccactagctaacagaggagaagctagatggctgggatgaacctggcggcagcgcaaaagatg

SEQ ID NO: 92930 - DNA, 103 bp, Artificial Sequence
  Synthetic Polynucleotide
taatacgactcactatagggcgggtggtggcaggatgtgggtagggggccaacagaggagaggccccatgcccacatccaacctggcggcagcgcaaaagatg

SEQ ID NO: 92931 - DNA, 103 bp, Artificial Sequence
  Synthetic Polynucleotide
taatacgactcactataggggcggtcccctcgggtggtggcaggatgtggaacagaggagaccacatatggccaccaccaacctggcggcagcgcaaaagatg

SEQ ID NO: 92932 - DNA, 103 bp, Artificial Sequence
  Synthetic Polynucleotide
taatacgactcactatagggtcttttgcttgcggtcccctcgggtggtggaacagaggagaccaccaatggaggggaccaacctggcggcagcgcaaaagatg

SEQ ID NO: 92933 - DNA, 103 bp, Artificial Sequence
  Synthetic Polynucleotide
taatacgactcactatagggtggtctctcttcttttgcttgcggtcccctaacagaggagaaggggaatgcaagcaaaaaacctggcggcagcgcaaaagatg

SEQ ID NO: 92934 - DNA, 103 bp, Artificial Sequence
  Synthetic Polynucleotide
taatacgactcactatagggcgacttgttctggtctctcttcttttgcttaacagaggagaaagcaaatgaagagagacaacctggcggcagcgcaaaagatg

SEQ ID NO: 92935 - DNA, 103 bp, Artificial Sequence
  Synthetic Polynucleotide
taatacgactcactatagggtcagagccgccgacttgttctggtctctctaacagaggagaagagagatgagaacaagtaacctggcggcagcgcaaaagatg

SEQ ID NO: 92936 - DNA, 103 bp, Artificial Sequence
  Synthetic Polynucleotide
taatacgactcactatagggtggcggtacctcagagccgccgacttgttcaacagaggagagaacaaatgggcggctctaacctggcggcagcgcaaaagatg

SEQ ID NO: 92937 - DNA, 103 bp, Artificial Sequence
  Synthetic Polynucleotide
taatacgactcactatagggccgcttccgctggcggtacctcagagccgcaacagaggagagcggctatgaggtaccgcaacctggcggcagcgcaaaagatg

SEQ ID NO: 92938 - DNA, 103 bp, Artificial Sequence
  Synthetic Polynucleotide
taatacgactcactatagggcaccctctgcccgcttccgctggcggtaccaacagaggagaggtaccatgagcggaagcaacctggcggcagcgcaaaagatg

SEQ ID NO: 92939 - DNA, 103 bp, Artificial Sequence
  Synthetic Polynucleotide
taatacgactcactatagggtccagggcctcaccctctgcccgcttccgcaacagaggagagcggaaatgggcagagggaacctggcggcagcgcaaaagatg

SEQ ID NO: 92940 - DNA, 103 bp, Artificial Sequence
  Synthetic Polynucleotide
taatacgactcactataggggagtttcccatagtctacgagccatcccagaacagaggagactgggaatgctcgtagacaacctggcggcagcgcaaaagatg

SEQ ID NO: 92941 - DNA, 103 bp, Artificial Sequence
  Synthetic Polynucleotide
taatacgactcactataggggcactcgccctccagggcctcaccctctgcaacagaggagagcagagatggaggccctgaacctggcggcagcgcaaaagatg

SEQ ID NO: 92942 - DNA, 103 bp, Artificial Sequence
  Synthetic Polynucleotide
taatacgactcactatagggccagcccctggcactcgccctccagggcctaacagaggagaaggcccatgagggcgagtaacctggcggcagcgcaaaagatg

SEQ ID NO: 92943 - DNA, 103 bp, Artificial Sequence
  Synthetic Polynucleotide
taatacgactcactatagggttccgtgcctccagcccctggcactcgcccaacagaggagagggcgaatgccaggggctaacctggcggcagcgcaaaagatg

SEQ ID NO: 92944 - DNA, 103 bp, Artificial Sequence
  Synthetic Polynucleotide
taatacgactcactatagggcagctcgcgattccgtgcctccagcccctgaacagaggagacaggggatggaggcacggaacctggcggcagcgcaaaagatg

SEQ ID NO: 92945 - DNA, 103 bp, Artificial Sequence
  Synthetic Polynucleotide
taatacgactcactatagggcccgttccttcagctcgcgattccgtgcctaacagaggagaaggcacatgatcgcgagcaacctggcggcagcgcaaaagatg

SEQ ID NO: 92946 - DNA, 103 bp, Artificial Sequence
  Synthetic Polynucleotide
taatacgactcactatagggacggactctgcccgttccttcagctcgcgaaacagaggagatcgcgaatggaaggaacgaacctggcggcagcgcaaaagatg

SEQ ID NO: 92947 - DNA, 103 bp, Artificial Sequence
  Synthetic Polynucleotide
taatacgactcactatagggctcgcgctccacggactctgcccgttccttaacagaggagaaaggaaatggcagagtccaacctggcggcagcgcaaaagatg

SEQ ID NO: 92948 - DNA, 103 bp, Artificial Sequence
  Synthetic Polynucleotide
taatacgactcactatagggcgtactggatctcgcgctccacggactctgaacagaggagacagagtatgtggagcgcgaacctggcggcagcgcaaaagatg

SEQ ID NO: 92949 - DNA, 103 bp, Artificial Sequence
  Synthetic Polynucleotide
taatacgactcactatagggaggtccttgacgtactggatctcgcgctccaacagaggagaggagcgatggatccagtaaacctggcggcagcgcaaaagatg

SEQ ID NO: 92950 - DNA, 103 bp, Artificial Sequence
  Synthetic Polynucleotide
taatacgactcactatagggctcgatgagcaggtccttgacgtactggataacagaggagaatccagatggtcaaggacaacctggcggcagcgcaaaagatg

SEQ ID NO: 92951 - DNA, 103 bp, Artificial Sequence
  Synthetic Polynucleotide
taatacgactcactataggggggccggggggagtttcccatagtctacgaaacagaggagatcgtagatgatgggaaacaacctggcggcagcgcaaaagatg

SEQ ID NO: 92952 - DNA, 103 bp, Artificial Sequence
  Synthetic Polynucleotide
taatacgactcactatagggccttgtaaacctcgatgagcaggtccttgaaacagaggagatcaaggatgtgctcatcgaacctggcggcagcgcaaaagatg

SEQ ID NO: 92953 - DNA, 103 bp, Artificial Sequence
  Synthetic Polynucleotide
taatacgactcactatagggtggctccgggccttgtaaacctcgatgagcaacagaggagagctcatatgggtttacaaaacctggcggcagcgcaaaagatg

SEQ ID NO: 92954 - DNA, 103 bp, Artificial Sequence
  Synthetic Polynucleotide
taatacgactcactatagggacgggtcctctggctccgggccttgtaaacaacagaggagagtttacatggcccggagcaacctggcggcagcgcaaaagatg

SEQ ID NO: 92955 - DNA, 103 bp, Artificial Sequence
  Synthetic Polynucleotide
taatacgactcactatagggaggggggcaggggccggggggagtttcccaaacagaggagatgggaaatgccccccggcaacctggcggcagcgcaaaagatg

SEQ ID NO: 92956 - DNA, 103 bp, Artificial Sequence
  Synthetic Polynucleotide
taatacgactcactatagggggtgccggcaaccccagccggctcccccataacagaggagaatggggatgccggctgggaacctggcggcagcgcaaaagatg

SEQ ID NO: 92957 - DNA, 103 bp, Artificial Sequence
  Synthetic Polynucleotide
taatacgactcactataggggtctgtgaaataaccgagttcagcaaagagaacagaggagactctttatggaactcggtaacctggcggcagcgcaaaagatg

SEQ ID NO: 92958 - DNA, 103 bp, Artificial Sequence
  Synthetic Polynucleotide
taatacgactcactatagggagcctttaatctcgcctctaaccctagcataacagaggagaatgctaatgttagaggcgaacctggcggcagcgcaaaagatg

SEQ ID NO: 92959 - DNA, 103 bp, Artificial Sequence
  Synthetic Polynucleotide
taatacgactcactatagggctgagagggcagcctttaatctcgcctctaaacagaggagatagaggatggattaaaggaacctggcggcagcgcaaaagatg

SEQ ID NO: 92960 - DNA, 103 bp, Artificial Sequence
  Synthetic Polynucleotide
taatacgactcactatagggtgctcgttttctgagagggcagcctttaataacagaggagaattaaaatgtgccctctcaacctggcggcagcgcaaaagatg

SEQ ID NO: 92961 - DNA, 103 bp, Artificial Sequence
  Synthetic Polynucleotide
taatacgactcactatagggtttcttcagttgctcgttttctgagagggcaacagaggagagccctcatggaaaacgagaacctggcggcagcgcaaaagatg

SEQ ID NO: 92962 - DNA, 103 bp, Artificial Sequence
  Synthetic Polynucleotide
taatacgactcactatagggttccattttctttcttcagttgctcgttttaacagaggagaaaaacgatgaactgaagaaacctggcggcagcgcaaaagatg

SEQ ID NO: 92963 - DNA, 103 bp, Artificial Sequence
  Synthetic Polynucleotide
taatacgactcactatagggcgcttcagtgttccattttctttcttcagtaacagaggagaactgaaatgagaaaatggaacctggcggcagcgcaaaagatg

SEQ ID NO: 92964 - DNA, 103 bp, Artificial Sequence
  Synthetic Polynucleotide
taatacgactcactatagggatccagctgccgcttcagtgttccattttcaacagaggagagaaaatatgacactgaagaacctggcggcagcgcaaaagatg

SEQ ID NO: 92965 - DNA, 103 bp, Artificial Sequence
  Synthetic Polynucleotide
taatacgactcactatagggacacaacttcatccagctgccgcttcagtgaacagaggagacactgaatgggcagctggaacctggcggcagcgcaaaagatg

SEQ ID NO: 92966 - DNA, 103 bp, Artificial Sequence
  Synthetic Polynucleotide
taatacgactcactatagggtggttctctgacacaacttcatccagctgcaacagaggagagcagctatgtgaagttgtaacctggcggcagcgcaaaagatg

SEQ ID NO: 92967 - DNA, 103 bp, Artificial Sequence
  Synthetic Polynucleotide
taatacgactcactatagggtttaagcctctggttctctgacacaacttcaacagaggagagaagttatgtcagagaacaacctggcggcagcgcaaaagatg

SEQ ID NO: 92968 - DNA, 103 bp, Artificial Sequence
  Synthetic Polynucleotide
taatacgactcactataggggctcatcagtgtctgtgaaataaccgagttaacagaggagaaactcgatgatttcacagaacctggcggcagcgcaaaagatg

SEQ ID NO: 92969 - DNA, 103 bp, Artificial Sequence
  Synthetic Polynucleotide
taatacgactcactataggggactagggactttaagcctctggttctctgaacagaggagacagagaatgagaggcttaaacctggcggcagcgcaaaagatg

SEQ ID NO: 92970 - DNA, 103 bp, Artificial Sequence
  Synthetic Polynucleotide
taatacgactcactatagggcttcgctttggactagggactttaagcctcaacagaggagagaggctatgagtccctagaacctggcggcagcgcaaaagatg

SEQ ID NO: 92971 - DNA, 103 bp, Artificial Sequence
  Synthetic Polynucleotide
taatacgactcactatagggacagacaactcttcgctttggactagggacaacagaggagagtccctatgccaaagcgaaacctggcggcagcgcaaaagatg

SEQ ID NO: 92972 - DNA, 103 bp, Artificial Sequence
  Synthetic Polynucleotide
taatacgactcactatagggctatcatcacacagacaactcttcgctttgaacagaggagacaaagcatggagttgtctaacctggcggcagcgcaaaagatg

SEQ ID NO: 92973 - DNA, 103 bp, Artificial Sequence
  Synthetic Polynucleotide
taatacgactcactatagggaatgccaatactatcatcacacagacaactaacagaggagaagttgtatgtgtgatgataacctggcggcagcgcaaaagatg

SEQ ID NO: 92974 - DNA, 103 bp, Artificial Sequence
  Synthetic Polynucleotide
taatacgactcactatagggcagtattataaatgccaatactatcatcacaacagaggagagtgatgatggtattggcaaacctggcggcagcgcaaaagatg

SEQ ID NO: 92975 - DNA, 103 bp, Artificial Sequence
  Synthetic Polynucleotide
taatacgactcactataggggtccatagttcagtattataaatgccaataaacagaggagatattggatgttataatacaacctggcggcagcgcaaaagatg

SEQ ID NO: 92976 - DNA, 103 bp, Artificial Sequence
  Synthetic Polynucleotide
taatacgactcactatagggatgctcataggtccatagttcagtattataaacagaggagatataatatggaactatggaacctggcggcagcgcaaaagatg

SEQ ID NO: 92977 - DNA, 103 bp, Artificial Sequence
  Synthetic Polynucleotide
taatacgactcactatagggctgttccaacatgctcataggtccatagttaacagaggagaaactatatgcctatgagcaacctggcggcagcgcaaaagatg

SEQ ID NO: 92978 - DNA, 103 bp, Artificial Sequence
  Synthetic Polynucleotide
taatacgactcactatagggtcctggaatcctgttccaacatgctcatagaacagaggagactatgaatgtgttggaacaacctggcggcagcgcaaaagatg

SEQ ID NO: 92979 - DNA, 103 bp, Artificial Sequence
  Synthetic Polynucleotide
taatacgactcactatagggtccaattgcagctcatcagtgtctgtgaaaaacagaggagatttcacatgcactgatgaaacctggcggcagcgcaaaagatg

SEQ ID NO: 92980 - DNA, 103 bp, Artificial Sequence
  Synthetic Polynucleotide
taatacgactcactataggggggttcattctcctggaatcctgttccaacaacagaggagagttggaatgggattccagaacctggcggcagcgcaaaagatg

SEQ ID NO: 92981 - DNA, 103 bp, Artificial Sequence
  Synthetic Polynucleotide
taatacgactcactataggggctcacactagggttcattctcctggaatcaacagaggagagattccatgagaatgaacaacctggcggcagcgcaaaagatg

SEQ ID NO: 92982 - DNA, 103 bp, Artificial Sequence
  Synthetic Polynucleotide
taatacgactcactataggggatttgcagggctcacactagggttcattcaacagaggagagaatgaatgctagtgtgaaacctggcggcagcgcaaaagatg

SEQ ID NO: 92983 - DNA, 103 bp, Artificial Sequence
  Synthetic Polynucleotide
taatacgactcactatagggtgcctcctttgatttgcagggctcacactaaacagaggagatagtgtatgccctgcaaaaacctggcggcagcgcaaaagatg

SEQ ID NO: 92984 - DNA, 103 bp, Artificial Sequence
  Synthetic Polynucleotide
taatacgactcactatagggtcctagaaggtgcctcctttgatttgcaggaacagaggagacctgcaatgcaaaggaggaacctggcggcagcgcaaaagatg

SEQ ID NO: 92985 - DNA, 103 bp, Artificial Sequence
  Synthetic Polynucleotide
taatacgactcactatagggtagcagaaaatcctagaaggtgcctcctttaacagaggagaaaaggaatgaccttctagaacctggcggcagcgcaaaagatg

SEQ ID NO: 92986 - DNA, 103 bp, Artificial Sequence
  Synthetic Polynucleotide
taatacgactcactatagggtgtgcctctttagcagaaaatcctagaaggaacagaggagaccttctatgattttctgcaacctggcggcagcgcaaaagatg

SEQ ID NO: 92987 - DNA, 103 bp, Artificial Sequence
  Synthetic Polynucleotide
taatacgactcactatagggtgatgtgtcctgtgcctctttagcagaaaaaacagaggagattttctatgaaagaggcaaacctggcggcagcgcaaaagatg

SEQ ID NO: 92988 - DNA, 103 bp, Artificial Sequence
  Synthetic Polynucleotide
taatacgactcactatagggtaataccatctgatgtgtcctgtgcctcttaacagaggagaaagaggatgaggacacataacctggcggcagcgcaaaagatg

SEQ ID NO: 92989 - DNA, 103 bp, Artificial Sequence
  Synthetic Polynucleotide
taatacgactcactatagggtttttctggataataccatctgatgtgtccaacagaggagaggacacatgagatggtataacctggcggcagcgcaaaagatg

SEQ ID NO: 92990 - DNA, 103 bp, Artificial Sequence
  Synthetic Polynucleotide
taatacgactcactatagggatttgctgcttccaattgcagctcatcagtaacagaggagaactgatatgctgcaattgaacctggcggcagcgcaaaagatg

SEQ ID NO: 92991 - DNA, 103 bp, Artificial Sequence
  Synthetic Polynucleotide
taatacgactcactatagggtctgtagctgtttttctggataataccatcaacagaggagagatggtatgatccagaaaaacctggcggcagcgcaaaagatg

SEQ ID NO: 92992 - DNA, 103 bp, Artificial Sequence
  Synthetic Polynucleotide
taatacgactcactatagggaatgatcatatctgtagctgtttttctggaaacagaggagatccagaatgacagctacaaacctggcggcagcgcaaaagatg

SEQ ID NO: 92993 - DNA, 103 bp, Artificial Sequence
  Synthetic Polynucleotide
taatacgactcactatagggtttgaaacagaatgatcatatctgtagctgaacagaggagacagctaatgatatgatcaaacctggcggcagcgcaaaagatg

SEQ ID NO: 92994 - DNA, 103 bp, Artificial Sequence
  Synthetic Polynucleotide
taatacgactcactatagggggctttgtcatttgaaacagaatgatcataaacagaggagatatgatatgtctgtttcaaacctggcggcagcgcaaaagatg

SEQ ID NO: 92995 - DNA, 103 bp, Artificial Sequence
  Synthetic Polynucleotide
taatacgactcactataggggcaccatcagggctttgtcatttgaaacagaacagaggagactgtttatgatgacaaagaacctggcggcagcgcaaaagatg

SEQ ID NO: 92996 - DNA, 103 bp, Artificial Sequence
  Synthetic Polynucleotide
taatacgactcactatagggtcttcagttagcaccatcagggctttgtcaaacagaggagatgacaaatgcctgatggtaacctggcggcagcgcaaaagatg

SEQ ID NO: 92997 - DNA, 103 bp, Artificial Sequence
  Synthetic Polynucleotide
taatacgactcactatagggaagcaatggttcttcagttagcaccatcagaacagaggagactgatgatgctaactgaaaacctggcggcagcgcaaaagatg

SEQ ID NO: 92998 - DNA, 103 bp, Artificial Sequence
  Synthetic Polynucleotide
taatacgactcactataggggaggaatgtaaagcaatggttcttcagttaaacagaggagataactgatgaaccattgcaacctggcggcagcgcaaaagatg

SEQ ID NO: 92999 - DNA, 103 bp, Artificial Sequence
  Synthetic Polynucleotide
taatacgactcactatagggcaaggaggtggaggaatgtaaagcaatggtaacagaggagaaccattatgttacattccaacctggcggcagcgcaaaagatg

SEQ ID NO: 93000 - DNA, 103 bp, Artificial Sequence
  Synthetic Polynucleotide
taatacgactcactatagggtaggggctgacaaggaggtggaggaatgtaaacagaggagatacattatgccacctcctaacctggcggcagcgcaaaagatg

SEQ ID NO: 93001 - DNA, 103 bp, Artificial Sequence
  Synthetic Polynucleotide
taatacgactcactatagggcatacgtctcatttgctgcttccaattgcaaacagaggagatgcaatatgaagcagcaaaacctggcggcagcgcaaaagatg

SEQ ID NO: 93002 - DNA, 103 bp, Artificial Sequence
  Synthetic Polynucleotide
taatacgactcactatagggttgtgttaattaggggctgacaaggaggtgaacagaggagacacctcatggtcagccccaacctggcggcagcgcaaaagatg

SEQ ID NO: 93003 - DNA, 103 bp, Artificial Sequence
  Synthetic Polynucleotide
taatacgactcactatagggagagactctgttgtgttaattaggggctgaaacagaggagatcagccatgaattaacacaacctggcggcagcgcaaaagatg

SEQ ID NO: 93004 - DNA, 103 bp, Artificial Sequence
  Synthetic Polynucleotide
taatacgactcactatagggatttaacctgagagactctgttgtgttaataacagaggagaattaacatgacagagtctaacctggcggcagcgcaaaagatg

SEQ ID NO: 93005 - DNA, 103 bp, Artificial Sequence
  Synthetic Polynucleotide
taatacgactcactataggggaagttcatgatttaacctgagagactctgaacagaggagacagagtatgtcaggttaaaacctggcggcagcgcaaaagatg

SEQ ID NO: 93006 - DNA, 103 bp, Artificial Sequence
  Synthetic Polynucleotide
taatacgactcactatagggacccatcctcgaagttcatgatttaacctgaacagaggagacaggttatgtcatgaactaacctggcggcagcgcaaaagatg

SEQ ID NO: 93007 - DNA, 103 bp, Artificial Sequence
  Synthetic Polynucleotide
taatacgactcactatagggatgtctatgaacccatcctcgaagttcatgaacagaggagacatgaaatgcgaggatggaacctggcggcagcgcaaaagatg

SEQ ID NO: 93008 - DNA, 103 bp, Artificial Sequence
  Synthetic Polynucleotide
taatacgactcactatagggtttctacttcatgtctatgaacccatcctcaacagaggagagaggatatgttcatagacaacctggcggcagcgcaaaagatg

SEQ ID NO: 93009 - DNA, 103 bp, Artificial Sequence
  Synthetic Polynucleotide
taatacgactcactataggggacttggtcctttctacttcatgtctatgaaacagaggagatcatagatgtgaagtagaaacctggcggcagcgcaaaagatg

SEQ ID NO: 93010 - DNA, 103 bp, Artificial Sequence
  Synthetic Polynucleotide
taatacgactcactatagggcattcttcttgacttggtcctttctacttcaacagaggagagaagtaatgaggaccaagaacctggcggcagcgcaaaagatg

SEQ ID NO: 93011 - DNA, 103 bp, Artificial Sequence
  Synthetic Polynucleotide
taatacgactcactataggggattatttgtcattcttcttgacttggtccaacagaggagaggaccaatgcaagaagaaaacctggcggcagcgcaaaagatg

SEQ ID NO: 93012 - DNA, 103 bp, Artificial Sequence
  Synthetic Polynucleotide
taatacgactcactatagggaaattgttttcatacgtctcatttgctgctaacagaggagaagcagcatgtgagacgtaaacctggcggcagcgcaaaagatg

SEQ ID NO: 93013 - DNA, 103 bp, Artificial Sequence
  Synthetic Polynucleotide
taatacgactcactataggggttttctgttgattatttgtcattcttcttaacagaggagaaagaagatggacaaataaaacctggcggcagcgcaaaagatg

SEQ ID NO: 93014 - DNA, 103 bp, Artificial Sequence
  Synthetic Polynucleotide
taatacgactcactatagggaagaatacgggttttctgttgattatttgtaacagaggagaacaaatatgcaacagaaaaacctggcggcagcgcaaaagatg

SEQ ID NO: 93015 - DNA, 103 bp, Artificial Sequence
  Synthetic Polynucleotide
taatacgactcactataggggagcaccctgaagaatacgggttttctgttaacagaggagaaacagaatgcccgtattcaacctggcggcagcgcaaaagatg

SEQ ID NO: 93016 - DNA, 103 bp, Artificial Sequence
  Synthetic Polynucleotide
taatacgactcactatagggccctgttccagagcaccctgaagaatacggaacagaggagaccgtatatgtcagggtgcaacctggcggcagcgcaaaagatg

SEQ ID NO: 93017 - DNA, 103 bp, Artificial Sequence
  Synthetic Polynucleotide
taatacgactcactatagggagaatttgagccctgttccagagcaccctgaacagaggagacagggtatgctggaacagaacctggcggcagcgcaaaagatg

SEQ ID NO: 93018 - DNA, 103 bp, Artificial Sequence
  Synthetic Polynucleotide
taatacgactcactatagggccatcagctgagaatttgagccctgttccaaacagaggagatggaacatggctcaaattaacctggcggcagcgcaaaagatg

SEQ ID NO: 93019 - DNA, 103 bp, Artificial Sequence
  Synthetic Polynucleotide
taatacgactcactatagggtattgaacagccatcagctgagaatttgagaacagaggagactcaaaatgtcagctgataacctggcggcagcgcaaaagatg

SEQ ID NO: 93020 - DNA, 103 bp, Artificial Sequence
  Synthetic Polynucleotide
taatacgactcactatagggggtttctgtgtattgaacagccatcagctgaacagaggagacagctgatggctgttcaaaacctggcggcagcgcaaaagatg

SEQ ID NO: 93021 - DNA, 103 bp, Artificial Sequence
  Synthetic Polynucleotide
taatacgactcactatagggtactactagtggtttctgtgtattgaacagaacagaggagactgttcatgacacagaaaaacctggcggcagcgcaaaagatg

SEQ ID NO: 93022 - DNA, 103 bp, Artificial Sequence
  Synthetic Polynucleotide
taatacgactcactatagggttcctgctgatactactagtggtttctgtgaacagaggagacacagaatgcactagtagaacctggcggcagcgcaaaagatg

SEQ ID NO: 93023 - DNA, 103 bp, Artificial Sequence
  Synthetic Polynucleotide
taatacgactcactatagggaagattatcaaaattgttttcatacgtctcaacagaggagagagacgatggaaaacaataacctggcggcagcgcaaaagatg

SEQ ID NO: 93024 - DNA, 103 bp, Artificial Sequence
  Synthetic Polynucleotide
taatacgactcactatagggactccctgagttcctgctgatactactagtaacagaggagaactagtatgatcagcaggaacctggcggcagcgcaaaagatg

SEQ ID NO: 93025 - DNA, 103 bp, Artificial Sequence
  Synthetic Polynucleotide
taatacgactcactatagggcttgtagctcactccctgagttcctgctgaaacagaggagatcagcaatgactcagggaaacctggcggcagcgcaaaagatg

SEQ ID NO: 93026 - DNA, 103 bp, Artificial Sequence
  Synthetic Polynucleotide
taatacgactcactataggggcataatacacttgtagctcactccctgagaacagaggagactcaggatgtgagctacaaacctggcggcagcgcaaaagatg

SEQ ID NO: 93027 - DNA, 103 bp, Artificial Sequence
  Synthetic Polynucleotide
taatacgactcactatagggtctgggtgaagcataatacacttgtagctcaacagaggagagagctaatggtgtattataacctggcggcagcgcaaaagatg

SEQ ID NO: 93028 - DNA, 103 bp, Artificial Sequence
  Synthetic Polynucleotide
taatacgactcactatagggcttgataacttctgggtgaagcataatacaaacagaggagatgtattatgcttcacccaaacctggcggcagcgcaaaagatg

SEQ ID NO: 93029 - DNA, 103 bp, Artificial Sequence
  Synthetic Polynucleotide
taatacgactcactatagggtcaaaaaagtcttgataacttctgggtgaaaacagaggagattcaccatgaagttatcaaacctggcggcagcgcaaaagatg

SEQ ID NO: 93030 - DNA, 103 bp, Artificial Sequence
  Synthetic Polynucleotide
taatacgactcactataggggcggatggcttcaaaaaagtcttgataactaacagaggagaagttatatggacttttttaacctggcggcagcgcaaaagatg

SEQ ID NO: 93031 - DNA, 103 bp, Artificial Sequence
  Synthetic Polynucleotide
taatacgactcactatagggctccccttctgcggatggcttcaaaaaagtaacagaggagaacttttatgaagccatccaacctggcggcagcgcaaaagatg

SEQ ID NO: 93032 - DNA, 103 bp, Artificial Sequence
  Synthetic Polynucleotide
taatacgactcactatagggtaaaatgtgtctccccttctgcggatggctaacagaggagaagccatatgcagaaggggaacctggcggcagcgcaaaagatg

SEQ ID NO: 93033 - DNA, 103 bp, Artificial Sequence
  Synthetic Polynucleotide
taatacgactcactatagggtgacacaacataaaatgtgtctccccttctaacagaggagaagaaggatggacacatttaacctggcggcagcgcaaaagatg

SEQ ID NO: 93034 - DNA, 103 bp, Artificial Sequence
  Synthetic Polynucleotide
taatacgactcactatagggaatcaaaatcaagattatcaaaattgttttaacagaggagaaaaacaatgttgataatcaacctggcggcagcgcaaaagatg

SEQ ID NO: 93035 - DNA, 103 bp, Artificial Sequence
  Synthetic Polynucleotide
taatacgactcactatagggcccttcgaaatgacacaacataaaatgtgtaacagaggagaacacatatgatgttgtgtaacctggcggcagcgcaaaagatg

SEQ ID NO: 93036 - DNA, 103 bp, Artificial Sequence
  Synthetic Polynucleotide
taatacgactcactatagggagcaggtgatcccttcgaaatgacacaacaaacagaggagatgttgtatgatttcgaagaacctggcggcagcgcaaaagatg

SEQ ID NO: 93037 - DNA, 103 bp, Artificial Sequence
  Synthetic Polynucleotide
taatacgactcactatagggagctggtaacagcaggtgatcccttcgaaaaacagaggagatttcgaatggatcacctgaacctggcggcagcgcaaaagatg

SEQ ID NO: 93038 - DNA, 103 bp, Artificial Sequence
  Synthetic Polynucleotide
taatacgactcactatagggtatgggtggtagctggtaacagcaggtgataacagaggagaatcaccatgtgttaccagaacctggcggcagcgcaaaagatg

SEQ ID NO: 93039 - DNA, 103 bp, Artificial Sequence
  Synthetic Polynucleotide
taatacgactcactataggggtggtcttgttatgggtggtagctggtaacaacagaggagagttaccatgtaccacccaaacctggcggcagcgcaaaagatg

SEQ ID NO: 93040 - DNA, 103 bp, Artificial Sequence
  Synthetic Polynucleotide
taatacgactcactatagggttttggtcttgtggtcttgttatgggtggtaacagaggagaaccaccatgaacaagaccaacctggcggcagcgcaaaagatg

SEQ ID NO: 93041 - DNA, 103 bp, Artificial Sequence
  Synthetic Polynucleotide
taatacgactcactatagggcaattgacatttttggtcttgtggtcttgtaacagaggagaacaagaatgcaagaccaaaacctggcggcagcgcaaaagatg

SEQ ID NO: 93042 - DNA, 103 bp, Artificial Sequence
  Synthetic Polynucleotide
taatacgactcactataggggctggtaacacaattgacatttttggtcttaacagaggagaaagaccatgaatgtcaataacctggcggcagcgcaaaagatg

SEQ ID NO: 93043 - DNA, 103 bp, Artificial Sequence
  Synthetic Polynucleotide
taatacgactcactatagggtatgtttattgctggtaacacaattgacataacagaggagaatgtcaatggtgttaccaaacctggcggcagcgcaaaagatg

SEQ ID NO: 93044 - DNA, 103 bp, Artificial Sequence
  Synthetic Polynucleotide
taatacgactcactatagggcattctcatttatgtttattgctggtaacaaacagaggagatgttacatgcaataaacaaacctggcggcagcgcaaaagatg

SEQ ID NO: 93045 - DNA, 103 bp, Artificial Sequence
  Synthetic Polynucleotide
taatacgactcactatagggatcaaatccaaatcaaaatcaagattatcaaacagaggagatgataaatgtgattttgaaacctggcggcagcgcaaaagatg

SEQ ID NO: 93046 - DNA, 103 bp, Artificial Sequence
  Synthetic Polynucleotide
taatacgactcactatagggccattgatcacattctcatttatgtttattaacagaggagaaataaaatgaaatgagaaaacctggcggcagcgcaaaagatg

SEQ ID NO: 93047 - DNA, 103 bp, Artificial Sequence
  Synthetic Polynucleotide
taatacgactcactataggggtagtcctgcccattgatcacattctcattaacagaggagaaatgagatggtgatcaataacctggcggcagcgcaaaagatg

SEQ ID NO: 93048 - DNA, 103 bp, Artificial Sequence
  Synthetic Polynucleotide
taatacgactcactatagggtcatcacttcgtagtcctgcccattgatcaaacagaggagatgatcaatgggcaggactaacctggcggcagcgcaaaagatg

SEQ ID NO: 93049 - DNA, 103 bp, Artificial Sequence
  Synthetic Polynucleotide
taatacgactcactatagggtcaatctgcatcatcacttcgtagtcctgcaacagaggagagcaggaatgcgaagtgataacctggcggcagcgcaaaagatg

SEQ ID NO: 93050 - DNA, 103 bp, Artificial Sequence
  Synthetic Polynucleotide
taatacgactcactatagggcacctgacagtcaatctgcatcatcacttcaacagaggagagaagtgatgatgcagattaacctggcggcagcgcaaaagatg

SEQ ID NO: 93051 - DNA, 103 bp, Artificial Sequence
  Synthetic Polynucleotide
taatacgactcactatagggtggtgtccatcacctgacagtcaatctgcaaacagaggagatgcagaatgactgtcaggaacctggcggcagcgcaaaagatg

SEQ ID NO: 93052 - DNA, 103 bp, Artificial Sequence
  Synthetic Polynucleotide
taatacgactcactatagggtggaggatcctggtgtccatcacctgacagaacagaggagactgtcaatggatggacacaacctggcggcagcgcaaaagatg

SEQ ID NO: 93053 - DNA, 103 bp, Artificial Sequence
  Synthetic Polynucleotide
taatacgactcactatagggacttttgatatggaggatcctggtgtccataacagaggagaatggacatgaggatcctcaacctggcggcagcgcaaaagatg

SEQ ID NO: 93054 - DNA, 103 bp, Artificial Sequence
  Synthetic Polynucleotide
taatacgactcactataggggaactgacgaacttttgatatggaggatccaacagaggagaggatccatgatatcaaaaaacctggcggcagcgcaaaagatg

SEQ ID NO: 93055 - DNA, 103 bp, Artificial Sequence
  Synthetic Polynucleotide
taatacgactcactatagggaggtaaggaggaactgacgaacttttgataaacagaggagatatcaaatgttcgtcagtaacctggcggcagcgcaaaagatg

SEQ ID NO: 93056 - DNA, 103 bp, Artificial Sequence
  Synthetic Polynucleotide
taatacgactcactatagggctcccaaggcatcaaatccaaatcaaaatcaacagaggagagattttatgttggatttgaacctggcggcagcgcaaaagatg

SEQ ID NO: 93057 - DNA, 103 bp, Artificial Sequence
  Synthetic Polynucleotide
taatacgactcactatagggctgatctcggaggtaaggaggaactgacgaaacagaggagatcgtcaatgcctccttacaacctggcggcagcgcaaaagatg

SEQ ID NO: 93058 - DNA, 103 bp, Artificial Sequence
  Synthetic Polynucleotide
taatacgactcactataggggattcctctgctgatctcggaggtaaggagaacagaggagactccttatgtccgagatcaacctggcggcagcgcaaaagatg

SEQ ID NO: 93059 - DNA, 103 bp, Artificial Sequence
  Synthetic Polynucleotide
taatacgactcactataggggtgttggtttgattcctctgctgatctcggaacagaggagaccgagaatggcagaggaaaacctggcggcagcgcaaaagatg

SEQ ID NO: 93060 - DNA, 103 bp, Artificial Sequence
  Synthetic Polynucleotide
taatacgactcactataggggccaaagaaggtgttggtttgattcctctgaacagaggagacagaggatgcaaaccaacaacctggcggcagcgcaaaagatg

SEQ ID NO: 93061 - DNA, 103 bp, Artificial Sequence
  Synthetic Polynucleotide
taatacgactcactatagggcgggaggggagccaaagaaggtgttggtttaacagaggagaaaaccaatgccttctttgaacctggcggcagcgcaaaagatg

SEQ ID NO: 93062 - DNA, 103 bp, Artificial Sequence
  Synthetic Polynucleotide
taatacgactcactatagggtctgtggctgcgggaggggagccaaagaagaacagaggagacttcttatgctcccctccaacctggcggcagcgcaaaagatg

SEQ ID NO: 93063 - DNA, 103 bp, Artificial Sequence
  Synthetic Polynucleotide
taatacgactcactataggggtgggttgcctctgtggctgcgggaggggaaacagaggagatcccctatggcagccacaaacctggcggcagcgcaaaagatg

SEQ ID NO: 93064 - DNA, 103 bp, Artificial Sequence
  Synthetic Polynucleotide
taatacgactcactatagggtgctgacaacgtgggttgcctctgtggctgaacagaggagacagccaatgaggcaacccaacctggcggcagcgcaaaagatg

SEQ ID NO: 93065 - DNA, 103 bp, Artificial Sequence
  Synthetic Polynucleotide
taatacgactcactatagggtcagggatggtgctgacaacgtgggttgccaacagaggagaggcaacatgcgttgtcagaacctggcggcagcgcaaaagatg

SEQ ID NO: 93066 - DNA, 103 bp, Artificial Sequence
  Synthetic Polynucleotide
taatacgactcactatagggttgtaatgactcagggatggtgctgacaacaacagaggagagttgtcatgaccatccctaacctggcggcagcgcaaaagatg

SEQ ID NO: 93067 - DNA, 103 bp, Artificial Sequence
  Synthetic Polynucleotide
taatacgactcactataggggtgactccatggtgccggcaaccccagccgaacagaggagacggctgatgttgccggcaaacctggcggcagcgcaaaagatg

SEQ ID NO: 93068 - DNA, 103 bp, Artificial Sequence
  Synthetic Polynucleotide
taatacgactcactatagggaaatgtctgactcccaaggcatcaaatccaaacagaggagatggattatgtgccttgggaacctggcggcagcgcaaaagatg

SEQ ID NO: 93069 - DNA, 103 bp, Artificial Sequence
  Synthetic Polynucleotide
taatacgactcactatagggttgatgtcccaaatgtctgactcccaaggcaacagaggagagccttgatggtcagacataacctggcggcagcgcaaaagatg

SEQ ID NO: 93070 - DNA, 103 bp, Artificial Sequence
  Synthetic Polynucleotide
taatacgactcactataggggatttggttgttgatgtcccaaatgtctgaaacagaggagatcagacatgtgggacatcaacctggcggcagcgcaaaagatg

SEQ ID NO: 93071 - DNA, 103 bp, Artificial Sequence
  Synthetic Polynucleotide
taatacgactcactatagggtaactgtacagatttggttgttgatgtcccaacagaggagagggacaatgacaaccaaaaacctggcggcagcgcaaaagatg

SEQ ID NO: 93072 - DNA, 103 bp, Artificial Sequence
  Synthetic Polynucleotide
taatacgactcactatagggttaatatctttaactgtacagatttggttgaacagaggagacaaccaatgctgtacagtaacctggcggcagcgcaaaagatg

SEQ ID NO: 93073 - DNA, 103 bp, Artificial Sequence
  Synthetic Polynucleotide
taatacgactcactatagggaggttctgccttaatatctttaactgtacaaacagaggagatgtacaatgaaagatattaacctggcggcagcgcaaaagatg

SEQ ID NO: 93074 - DNA, 103 bp, Artificial Sequence
  Synthetic Polynucleotide
taatacgactcactatagggaaagtggctgaggttctgccttaatatcttaacagaggagaaagataatgaggcagaacaacctggcggcagcgcaaaagatg

SEQ ID NO: 93075 - DNA, 103 bp, Artificial Sequence
  Synthetic Polynucleotide
taatacgactcactataggggaggctggagaaagtggctgaggttctgccaacagaggagaggcagaatgtcagccactaacctggcggcagcgcaaaagatg

SEQ ID NO: 93076 - DNA, 103 bp, Artificial Sequence
  Synthetic Polynucleotide
taatacgactcactatagggataacttgaggaggctggagaaagtggctgaacagaggagacagccaatgtctccagccaacctggcggcagcgcaaaagatg

SEQ ID NO: 93077 - DNA, 103 bp, Artificial Sequence
  Synthetic Polynucleotide
taatacgactcactatagggacgagactgaataacttgaggaggctggagaacagaggagactccagatgcctcaagttaacctggcggcagcgcaaaagatg

SEQ ID NO: 93078 - DNA, 103 bp, Artificial Sequence
  Synthetic Polynucleotide
taatacgactcactataggggggctaaaaggtgactccatggtgccggcaaacagaggagatgccggatgcatggagtcaacctggcggcagcgcaaaagatg

SEQ ID NO: 93079 - DNA, 103 bp, Artificial Sequence
  Synthetic Polynucleotide
taatacgactcactataggggaccgaggagacgagactgaataacttgagaacagaggagactcaagatgttcagtctcaacctggcggcagcgcaaaagatg

SEQ ID NO: 93080 - DNA, 103 bp, Artificial Sequence
  Synthetic Polynucleotide
taatacgactcactatagggagagtccactgaccgaggagacgagactgaaacagaggagatcagtcatgtctcctcggaacctggcggcagcgcaaaagatg

SEQ ID NO: 93081 - DNA, 103 bp, Artificial Sequence
  Synthetic Polynucleotide
taatacgactcactatagggttgaagaataagagtccactgaccgaggagaacagaggagactcctcatgcagtggactaacctggcggcagcgcaaaagatg

SEQ ID NO: 93082 - DNA, 103 bp, Artificial Sequence
  Synthetic Polynucleotide
taatacgactcactatagggacatgctgagttgaagaataagagtccactaacagaggagaagtggaatgttattcttcaacctggcggcagcgcaaaagatg

SEQ ID NO: 93083 - DNA, 103 bp, Artificial Sequence
  Synthetic Polynucleotide
taatacgactcactatagggctcctcaggaacatgctgagttgaagaataaacagaggagatattctatgactcagcataacctggcggcagcgcaaaagatg

SEQ ID NO: 93084 - DNA, 103 bp, Artificial Sequence
  Synthetic Polynucleotide
taatacgactcactatagggacaaatccaactcctcaggaacatgctgagaacagaggagactcagcatgttcctgaggaacctggcggcagcgcaaaagatg

SEQ ID NO: 93085 - DNA, 103 bp, Artificial Sequence
  Synthetic Polynucleotide
taatacgactcactataggggaactagaagacaaatccaactcctcaggaaacagaggagatcctgaatggttggatttaacctggcggcagcgcaaaagatg

SEQ ID NO: 93086 - DNA, 103 bp, Artificial Sequence
  Synthetic Polynucleotide
taatacgactcactatagggagacatctgagaactagaagacaaatccaaaacagaggagattggatatgtcttctagtaacctggcggcagcgcaaaagatg

SEQ ID NO: 93087 - DNA, 103 bp, Artificial Sequence
  Synthetic Polynucleotide
taatacgactcactatagggaggaaaggggagacatctgagaactagaagaacagaggagacttctaatgctcagatgtaacctggcggcagcgcaaaagatg

SEQ ID NO: 93088 - DNA, 103 bp, Artificial Sequence
  Synthetic Polynucleotide
taatacgactcactatagggtcaccatataaggaaaggggagacatctgaaacagaggagatcagatatgtcccctttcaacctggcggcagcgcaaaagatg

SEQ ID NO: 93089 - DNA, 103 bp, Artificial Sequence
  Synthetic Polynucleotide
taatacgactcactatagggaaagagtcccgggctaaaaggtgactccataacagaggagaatggagatgccttttagcaacctggcggcagcgcaaaagatg

SEQ ID NO: 93090 - DNA, 103 bp, Artificial Sequence
  Synthetic Polynucleotide
taatacgactcactatagggattagagttttcaccatataaggaaaggggaacagaggagaccccttatgttatatggtaacctggcggcagcgcaaaagatg

SEQ ID NO: 93091 - DNA, 103 bp, Artificial Sequence
  Synthetic Polynucleotide
taatacgactcactatagggaagagagactattagagttttcaccatataaacagaggagatatatgatgaaaactctaaacctggcggcagcgcaaaagatg

SEQ ID NO: 93092 - DNA, 103 bp, Artificial Sequence
  Synthetic Polynucleotide
taatacgactcactatagggggctccgctgaagagagactattagagtttaacagaggagaaaactcatgtagtctctcaacctggcggcagcgcaaaagatg

SEQ ID NO: 93093 - DNA, 103 bp, Artificial Sequence
  Synthetic Polynucleotide
taatacgactcactatagggttccttcagtggctccgctgaagagagactaacagaggagaagtctcatgtcagcggagaacctggcggcagcgcaaaagatg

SEQ ID NO: 93094 - DNA, 103 bp, Artificial Sequence
  Synthetic Polynucleotide
taatacgactcactatagggcaggcttatcttccttcagtggctccgctgaacagaggagacagcggatgcactgaaggaacctggcggcagcgcaaaagatg

SEQ ID NO: 93095 - DNA, 103 bp, Artificial Sequence
  Synthetic Polynucleotide
taatacgactcactatagggggaccagtgacaggcttatcttccttcagtaacagaggagaactgaaatgagataagccaacctggcggcagcgcaaaagatg

SEQ ID NO: 93096 - DNA, 103 bp, Artificial Sequence
  Synthetic Polynucleotide
taatacgactcactatagggcttgttcctaggaccagtgacaggcttatcaacagaggagagataagatggtcactggtaacctggcggcagcgcaaaagatg

SEQ ID NO: 93097 - DNA, 103 bp, Artificial Sequence
  Synthetic Polynucleotide
taatacgactcactatagggcattttcagtcttgttcctaggaccagtgaaacagaggagatcactgatgctaggaacaaacctggcggcagcgcaaaagatg

SEQ ID NO: 93098 - DNA, 103 bp, Artificial Sequence
  Synthetic Polynucleotide
taatacgactcactatagggggagtcagtccattttcagtcttgttcctaaacagaggagataggaaatggactgaaaaaacctggcggcagcgcaaaagatg

SEQ ID NO: 93099 - DNA, 103 bp, Artificial Sequence
  Synthetic Polynucleotide
taatacgactcactatagggttttttctttggagtcagtccattttcagtaacagaggagaactgaaatgggactgactaacctggcggcagcgcaaaagatg

SEQ ID NO: 93100 - DNA, 103 bp, Artificial Sequence
  Synthetic Polynucleotide
taatacgactcactatagggccagcctgtgaaagagtcccgggctaaaagaacagaggagacttttaatgcgggactctaacctggcggcagcgcaaaagatg

SEQ ID NO: 93101 - DNA, 103 bp, Artificial Sequence
  Synthetic Polynucleotide
taatacgactcactatagggtcacctgaatttttttctttggagtcagtcaacagaggagagactgaatgcaaagaaaaaacctggcggcagcgcaaaagatg

SEQ ID NO: 93102 - DNA, 103 bp, Artificial Sequence
  Synthetic Polynucleotide
taatacgactcactatagggggttttgaattcacctgaatttttttctttaacagaggagaaaagaaatgaattcaggtaacctggcggcagcgcaaaagatg

SEQ ID NO: 93103 - DNA, 103 bp, Artificial Sequence
  Synthetic Polynucleotide
taatacgactcactatagggctgaattgaaggttttgaattcacctgaataacagaggagaattcagatgaattcaaaaaacctggcggcagcgcaaaagatg

SEQ ID NO: 93104 - DNA, 103 bp, Artificial Sequence
  Synthetic Polynucleotide
taatacgactcactatagggaaggcttgggctgaattgaaggttttgaataacagaggagaattcaaatgcttcaattcaacctggcggcagcgcaaaagatg

SEQ ID NO: 93105 - DNA, 103 bp, Artificial Sequence
  Synthetic Polynucleotide
taatacgactcactatagggggaagcaataaaggcttgggctgaattgaaaacagaggagattcaatatggcccaagccaacctggcggcagcgcaaaagatg

SEQ ID NO: 93106 - DNA, 103 bp, Artificial Sequence
  Synthetic Polynucleotide
taatacgactcactataggggggtgctgctggaagcaataaaggcttgggaacagaggagacccaagatgttattgcttaacctggcggcagcgcaaaagatg

SEQ ID NO: 93107 - DNA, 103 bp, Artificial Sequence
  Synthetic Polynucleotide
taatacgactcactatagggtttgagtcttgggtgctgctggaagcaataaacagaggagatattgcatgcagcagcacaacctggcggcagcgcaaaagatg

SEQ ID NO: 93108 - DNA, 103 bp, Artificial Sequence
  Synthetic Polynucleotide
taatacgactcactatagggctggagtttgtttgagtcttgggtgctgctaacagaggagaagcagcatgcaagactcaaacctggcggcagcgcaaaagatg

SEQ ID NO: 93109 - DNA, 103 bp, Artificial Sequence
  Synthetic Polynucleotide
taatacgactcactatagggtgctggaacactggagtttgtttgagtcttaacagaggagaaagactatgacaaactccaacctggcggcagcgcaaaagatg

SEQ ID NO: 93110 - DNA, 103 bp, Artificial Sequence
  Synthetic Polynucleotide
taatacgactcactatagggtgatggtttttgctggaacactggagtttgaacagaggagacaaactatggtgttccagaacctggcggcagcgcaaaagatg

SEQ ID NO: 93111 - DNA, 103 bp, Artificial Sequence
  Synthetic Polynucleotide
taatacgactcactatagggcaatcttcatccagcctgtgaaagagtcccaacagaggagagggactatgtcacaggctaacctggcggcagcgcaaaagatg

SEQ ID NO: 93112 - DNA, 103 bp, Artificial Sequence
  Synthetic Polynucleotide
taatacgactcactataggggtctgaataatgatggtttttgctggaacaaacagaggagatgttccatgaaaaaccataacctggcggcagcgcaaaagatg

SEQ ID NO: 93113 - DNA, 103 bp, Artificial Sequence
  Synthetic Polynucleotide
taatacgactcactatagggcgttggtactgtctgaataatgatggttttaacagaggagaaaaaccatgattattcagaacctggcggcagcgcaaaagatg

SEQ ID NO: 93114 - DNA, 103 bp, Artificial Sequence
  Synthetic Polynucleotide
taatacgactcactatagggatggcataagcgttggtactgtctgaataaaacagaggagattattcatgcagtaccaaaacctggcggcagcgcaaaagatg

SEQ ID NO: 93115 - DNA, 103 bp, Artificial Sequence
  Synthetic Polynucleotide
taatacgactcactatagggtgctttgccaatggcataagcgttggtactaacagaggagaagtaccatggcttatgccaacctggcggcagcgcaaaagatg

SEQ ID NO: 93116 - DNA, 103 bp, Artificial Sequence
  Synthetic Polynucleotide
taatacgactcactatagggaattggttgctgctttgccaatggcataagaacagaggagacttatgatgttggcaaagaacctggcggcagcgcaaaagatg

SEQ ID NO: 93117 - DNA, 103 bp, Artificial Sequence
  Synthetic Polynucleotide
taatacgactcactataggggtaaactgataattggttgctgctttgccaaacagaggagatggcaaatgagcaaccaaaacctggcggcagcgcaaaagatg

SEQ ID NO: 93118 - DNA, 103 bp, Artificial Sequence
  Synthetic Polynucleotide
taatacgactcactatagggggtgcaggttgtaaactgataattggttgcaacagaggagagcaaccatgtatcagtttaacctggcggcagcgcaaaagatg

SEQ ID NO: 93119 - DNA, 103 bp, Artificial Sequence
  Synthetic Polynucleotide
taatacgactcactataggggcctttagtgggtgcaggttgtaaactgataacagaggagaatcagtatgcaacctgcaaacctggcggcagcgcaaaagatg

SEQ ID NO: 93120 - DNA, 103 bp, Artificial Sequence
  Synthetic Polynucleotide
taatacgactcactatagggaaaccgtctggcctttagtgggtgcaggttaacagaggagaaacctgatgccactaaagaacctggcggcagcgcaaaagatg

SEQ ID NO: 93121 - DNA, 103 bp, Artificial Sequence
  Synthetic Polynucleotide
taatacgactcactatagggtgagacagcaaaaccgtctggcctttagtgaacagaggagacactaaatgccagacggtaacctggcggcagcgcaaaagatg

SEQ ID NO: 93122 - DNA, 103 bp, Artificial Sequence
  Synthetic Polynucleotide
taatacgactcactatagggagcagaatcccaatcttcatccagcctgtgaacagaggagacacaggatggatgaagataacctggcggcagcgcaaaagatg

SEQ ID NO: 93123 - DNA, 103 bp, Artificial Sequence
  Synthetic Polynucleotide
taatacgactcactatagggcacagtaggctgagacagcaaaaccgtctgaacagaggagacagacgatgttgctgtctaacctggcggcagcgcaaaagatg

SEQ ID NO: 93124 - DNA, 103 bp, Artificial Sequence
  Synthetic Polynucleotide
taatacgactcactataggggaagttgtaccacagtaggctgagacagcaaacagaggagatgctgtatgagcctactgaacctggcggcagcgcaaaagatg

SEQ ID NO: 93125 - DNA, 103 bp, Artificial Sequence
  Synthetic Polynucleotide
taatacgactcactatagggccaggtgcttgaagttgtaccacagtaggcaacagaggagagcctacatgggtacaactaacctggcggcagcgcaaaagatg

SEQ ID NO: 93126 - DNA, 103 bp, Artificial Sequence
  Synthetic Polynucleotide
taatacgactcactataggggggcagaactccaggtgcttgaagttgtacaacagaggagagtacaaatgcaagcacctaacctggcggcagcgcaaaagatg

SEQ ID NO: 93127 - DNA, 103 bp, Artificial Sequence
  Synthetic Polynucleotide
taatacgactcactataggggctgagcagagggcagaactccaggtgcttaacagaggagaaagcacatggagttctgcaacctggcggcagcgcaaaagatg

SEQ ID NO: 93128 - DNA, 103 bp, Artificial Sequence
  Synthetic Polynucleotide
taatacgactcactataggggcaaggactggctgagcagagggcagaactaacagaggagaagttctatgctctgctcaaacctggcggcagcgcaaaagatg

SEQ ID NO: 93129 - DNA, 103 bp, Artificial Sequence
  Synthetic Polynucleotide
taatacgactcactatagggcccagcaacagcaaggactggctgagcagaaacagaggagatctgctatgccagtccttaacctggcggcagcgcaaaagatg

SEQ ID NO: 93130 - DNA, 103 bp, Artificial Sequence
  Synthetic Polynucleotide
taatacgactcactataggggtgtgactcccccagcaacagcaaggactgaacagaggagacagtccatgctgttgctgaacctggcggcagcgcaaaagatg

SEQ ID NO: 93131 - DNA, 103 bp, Artificial Sequence
  Synthetic Polynucleotide
taatacgactcactatagggttagggagctgtgtgactcccccagcaacaaacagaggagatgttgcatggggagtcacaacctggcggcagcgcaaaagatg

SEQ ID NO: 93132 - DNA, 103 bp, Artificial Sequence
  Synthetic Polynucleotide
taatacgactcactatagggcaccacgtgattagggagctgtgtgactccaacagaggagaggagtcatgcagctccctaacctggcggcagcgcaaaagatg

SEQ ID NO: 93133 - DNA, 103 bp, Artificial Sequence
  Synthetic Polynucleotide
taatacgactcactatagggcagcaaagagagcagaatcccaatcttcataacagaggagaatgaagatggggattctgaacctggcggcagcgcaaaagatg

SEQ ID NO: 93134 - DNA, 103 bp, Artificial Sequence
  Synthetic Polynucleotide
taatacgactcactataggggtaccacattcaccacgtgattagggagctaacagaggagaagctccatgatcacgtggaacctggcggcagcgcaaaagatg

SEQ ID NO: 93135 - DNA, 103 bp, Artificial Sequence
  Synthetic Polynucleotide
taatacgactcactataggggaaggggctggtaccacattcaccacgtgaaacagaggagatcacgtatggaatgtggtaacctggcggcagcgcaaaagatg

SEQ ID NO: 93136 - DNA, 103 bp, Artificial Sequence
  Synthetic Polynucleotide
taatacgactcactataggggctattcgctgaaggggctggtaccacattaacagaggagaaatgtgatgccagcccctaacctggcggcagcgcaaaagatg

SEQ ID NO: 93137 - DNA, 103 bp, Artificial Sequence
  Synthetic Polynucleotide
taatacgactcactatagggcattcactgggctattcgctgaaggggctgaacagaggagacagcccatgcagcgaataaacctggcggcagcgcaaaagatg

SEQ ID NO: 93138 - DNA, 103 bp, Artificial Sequence
  Synthetic Polynucleotide
taatacgactcactataggggaaagttttccattcactgggctattcgctaacagaggagaagcgaaatgcccagtgaaaacctggcggcagcgcaaaagatg

SEQ ID NO: 93139 - DNA, 103 bp, Artificial Sequence
  Synthetic Polynucleotide
taatacgactcactatagggtttagtcacggaaagttttccattcactggaacagaggagaccagtgatgggaaaacttaacctggcggcagcgcaaaagatg

SEQ ID NO: 93140 - DNA, 103 bp, Artificial Sequence
  Synthetic Polynucleotide
taatacgactcactataggggtaggacaggtttagtcacggaaagttttcaacagaggagagaaaacatgccgtgactaaacctggcggcagcgcaaaagatg

SEQ ID NO: 93141 - DNA, 103 bp, Artificial Sequence
  Synthetic Polynucleotide
taatacgactcactatagggatggtactttgtaggacaggtttagtcacgaacagaggagacgtgacatgacctgtcctaacctggcggcagcgcaaaagatg

SEQ ID NO: 93142 - DNA, 103 bp, Artificial Sequence
  Synthetic Polynucleotide
taatacgactcactataggggacatttctcatggtactttgtaggacaggaacagaggagacctgtcatgcaaagtaccaacctggcggcagcgcaaaagatg

SEQ ID NO: 93143 - DNA, 103 bp, Artificial Sequence
  Synthetic Polynucleotide
taatacgactcactatagggtatctgaaccgacatttctcatggtactttaacagaggagaaaagtaatgtgagaaatgaacctggcggcagcgcaaaagatg

SEQ ID NO: 93144 - DNA, 103 bp, Artificial Sequence
  Synthetic Polynucleotide
taatacgactcactatagggtaaccgagttcagcaaagagagcagaatccaacagaggagaggattcatgtctctttgcaacctggcggcagcgcaaaagatg

SEQ ID NO: 93145 - DNA, 103 bp, Artificial Sequence
  Synthetic Polynucleotide
taatacgactcactatagggagcacagcaatatctgaaccgacatttctcaacagaggagagagaaaatgcggttcagaaacctggcggcagcgcaaaagatg

SEQ ID NO: 93146 - DNA, 103 bp, Artificial Sequence
  Synthetic Polynucleotide
taatacgactcactatagggctgtctccttagcacagcaatatctgaaccaacagaggagaggttcaatgattgctgtgaacctggcggcagcgcaaaagatg

SEQ ID NO: 93147 - DNA, 103 bp, Artificial Sequence
  Synthetic Polynucleotide
taatacgactcactatagggtcatacgttgctgtctccttagcacagcaaaacagaggagattgctgatgtaaggagacaacctggcggcagcgcaaaagatg

SEQ ID NO: 93148 - DNA, 103 bp, Artificial Sequence
  Synthetic Polynucleotide
taatacgactcactatagggcgattttttatcatacgttgctgtctccttaacagaggagaaaggagatggcaacgtataacctggcggcagcgcaaaagatg

SEQ ID NO: 93149 - DNA, 103 bp, Artificial Sequence
  Synthetic Polynucleotide
taatacgactcactatagggagcggattctcgattttttatcatacgttgaacagaggagacaacgtatgataaaaaataacctggcggcagcgcaaaagatg

SEQ ID NO: 93150 - DNA, 103 bp, Artificial Sequence
  Synthetic Polynucleotide
taatacgactcactataggggagactgacaagcggattctcgattttttaaacagaggagataaaaaatggagaatccgaacctggcggcagcgcaaaagatg

SEQ ID NO: 93151 - DNA, 103 bp, Artificial Sequence
  Synthetic Polynucleotide
taatacgactcactatagggttcttcttgcgagactgacaagcggattctaacagaggagaagaatcatgttgtcagtcaacctggcggcagcgcaaaagatg

SEQ ID NO: 93152 - DNA, 103 bp, Artificial Sequence
  Synthetic Polynucleotide
taatacgactcactatagggatattctttcttcttcttgcgagactgacaaacagaggagatgtcagatgcgcaagaagaacctggcggcagcgcaaaagatg

SEQ ID NO: 93153 - DNA, 103 bp, Artificial Sequence
  Synthetic Polynucleotide
taatacgactcactatagggaccctagcatatattctttcttcttcttgcaacagaggagagcaagaatgagaaagaataacctggcggcagcgcaaaagatg

SEQ ID NO: 93154 - DNA, 103 bp, Artificial Sequence
  Synthetic Polynucleotide
taatacgactcactatagggctcgcctctaaccctagcatatattctttcaacagaggagagaaagaatgtatgctaggaacctggcggcagcgcaaaagatg

SEQ ID NO: 93155 - DNA, 103 bp, Artificial Sequence
  Synthetic Polynucleotide
taatacgactcactatagggaatctcgctgagcagcatcagctccgccataacagaggagaatggcgatgctgatgctgaacctggcggcagcgcaaaagatg

SEQ ID NO: 93156 - DNA, 103 bp, Artificial Sequence
  Synthetic Polynucleotide
taatacgactcactatagggttcatctaggccagaatacaaggtgctgttaacagaggagaaacagcatgttgtattctaacctggcggcagcgcaaaagatg

SEQ ID NO: 93157 - DNA, 103 bp, Artificial Sequence
  Synthetic Polynucleotide
taatacgactcactataggggcaggctgactcccggttcttgatcattcgaacagaggagacgaatgatgaagaaccggaacctggcggcagcgcaaaagatg

SEQ ID NO: 93158 - DNA, 103 bp, Artificial Sequence
  Synthetic Polynucleotide
taatacgactcactatagggtccgggactggcaggctgactcccggttctaacagaggagaagaaccatgagtcagcctaacctggcggcagcgcaaaagatg

SEQ ID NO: 93159 - DNA, 103 bp, Artificial Sequence
  Synthetic Polynucleotide
taatacgactcactatagggttcttctttctccgggactggcaggctgacaacagaggagagtcagcatgccagtcccgaacctggcggcagcgcaaaagatg

SEQ ID NO: 93160 - DNA, 103 bp, Artificial Sequence
  Synthetic Polynucleotide
taatacgactcactatagggcagatactctttcttctttctccgggactgaacagaggagacagtccatgagaaagaagaacctggcggcagcgcaaaagatg

SEQ ID NO: 93161 - DNA, 103 bp, Artificial Sequence
  Synthetic Polynucleotide
taatacgactcactatagggccagtccctgcagatactctttcttctttcaacagaggagagaaagaatgaagagtatcaacctggcggcagcgcaaaagatg

SEQ ID NO: 93162 - DNA, 103 bp, Artificial Sequence
  Synthetic Polynucleotide
taatacgactcactatagggagccgagcctccagtccctgcagatactctaacagaggagaagagtaatggcagggactaacctggcggcagcgcaaaagatg

SEQ ID NO: 93163 - DNA, 103 bp, Artificial Sequence
  Synthetic Polynucleotide
taatacgactcactatagggtactgcttgcagccgagcctccagtccctgaacagaggagacagggaatggaggctcggaacctggcggcagcgcaaaagatg

SEQ ID NO: 93164 - DNA, 103 bp, Artificial Sequence
  Synthetic Polynucleotide
taatacgactcactatagggtgtcagccagtactgcttgcagccgagcctaacagaggagaaggctcatgtgcaagcagaacctggcggcagcgcaaaagatg

SEQ ID NO: 93165 - DNA, 103 bp, Artificial Sequence
  Synthetic Polynucleotide
taatacgactcactatagggagctgctggttgtcagccagtactgcttgcaacagaggagagcaagcatgactggctgaaacctggcggcagcgcaaaagatg

SEQ ID NO: 93166 - DNA, 103 bp, Artificial Sequence
  Synthetic Polynucleotide
taatacgactcactatagggctctcggcggagctgctggttgtcagccagaacagaggagactggctatgaaccagcagaacctggcggcagcgcaaaagatg

SEQ ID NO: 93167 - DNA, 103 bp, Artificial Sequence
  Synthetic Polynucleotide
taatacgactcactatagggcctcggccacttcatctaggccagaatacaaacagaggagatgtattatggcctagatgaacctggcggcagcgcaaaagatg

SEQ ID NO: 93168 - DNA, 103 bp, Artificial Sequence
  Synthetic Polynucleotide
taatacgactcactataggggggcagcattctctcggcggagctgctggtaacagaggagaaccagcatgtccgccgagaacctggcggcagcgcaaaagatg

SEQ ID NO: 93169 - DNA, 103 bp, Artificial Sequence
  Synthetic Polynucleotide
taatacgactcactatagggcgccgccggagggcagcattctctcggcggaacagaggagaccgccgatggaatgctgcaacctggcggcagcgcaaaagatg

SEQ ID NO: 93170 - DNA, 103 bp, Artificial Sequence
  Synthetic Polynucleotide
taatacgactcactatagggggcctccagccgccgccggagggcagcattaacagaggagaaatgctatgctccggcggaacctggcggcagcgcaaaagatg

SEQ ID NO: 93171 - DNA, 103 bp, Artificial Sequence
  Synthetic Polynucleotide
taatacgactcactatagggcagccagcagggcctccagccgccgccggaaacagaggagatccggcatgggctggaggaacctggcggcagcgcaaaagatg

SEQ ID NO: 93172 - DNA, 103 bp, Artificial Sequence
  Synthetic Polynucleotide
taatacgactcactatagggtcgctgttttcagccagcagggcctccagcaacagaggagagctggaatgcctgctggcaacctggcggcagcgcaaaagatg

SEQ ID NO: 93173 - DNA, 103 bp, Artificial Sequence
  Synthetic Polynucleotide
taatacgactcactatagggtaacttgagctcgctgttttcagccagcagaacagaggagactgctgatggaaaacagcaacctggcggcagcgcaaaagatg

SEQ ID NO: 93174 - DNA, 103 bp, Artificial Sequence
  Synthetic Polynucleotide
taatacgactcactatagggttccagaccctaacttgagctcgctgttttaacagaggagaaaaacaatgagctcaagtaacctggcggcagcgcaaaagatg

SEQ ID NO: 93175 - DNA, 103 bp, Artificial Sequence
  Synthetic Polynucleotide
taatacgactcactatagggaccttcctgtttccagaccctaacttgagcaacagaggagagctcaaatgagggtctggaacctggcggcagcgcaaaagatg

SEQ ID NO: 93176 - DNA, 103 bp, Artificial Sequence
  Synthetic Polynucleotide
taatacgactcactataggggatgcagaccaccttcctgtttccagacccaacagaggagagggtctatgaacaggaagaacctggcggcagcgcaaaagatg

SEQ ID NO: 93177 - DNA, 103 bp, Artificial Sequence
  Synthetic Polynucleotide
taatacgactcactatagggggaagaccatgatgcagaccaccttcctgtaacagaggagaacaggaatgtggtctgcaaacctggcggcagcgcaaaagatg

SEQ ID NO: 93178 - DNA, 103 bp, Artificial Sequence
  Synthetic Polynucleotide
taatacgactcactatagggtgcgtctgctcctcggccacttcatctaggaacagaggagacctagaatgagtggccgaaacctggcggcagcgcaaaagatg

SEQ ID NO: 93179 - DNA, 103 bp, Artificial Sequence
  Synthetic Polynucleotide
taatacgactcactatagggatgaagagaaggaagaccatgatgcagaccaacagaggagaggtctgatgcatggtcttaacctggcggcagcgcaaaagatg

SEQ ID NO: 93180 - DNA, 103 bp, Artificial Sequence
  Synthetic Polynucleotide
taatacgactcactataggggttgaaggcaatgaagagaaggaagaccataacagaggagaatggtcatgcttctcttcaacctggcggcagcgcaaaagatg

SEQ ID NO: 93181 - DNA, 103 bp, Artificial Sequence
  Synthetic Polynucleotide
taatacgactcactatagggcaggtccaaagttgaaggcaatgaagagaaaacagaggagattctctatgttgccttcaaacctggcggcagcgcaaaagatg

SEQ ID NO: 93182 - DNA, 103 bp, Artificial Sequence
  Synthetic Polynucleotide
taatacgactcactatagggctgatgctgacaggtccaaagttgaaggcaaacagaggagatgccttatgctttggaccaacctggcggcagcgcaaaagatg

SEQ ID NO: 93183 - DNA, 103 bp, Artificial Sequence
  Synthetic Polynucleotide
taatacgactcactatagggaggaggctcactgatgctgacaggtccaaaaacagaggagatttggaatggtcagcatcaacctggcggcagcgcaaaagatg

SEQ ID NO: 93184 - DNA, 103 bp, Artificial Sequence
  Synthetic Polynucleotide
taatacgactcactatagggtgggagctgaaggaggctcactgatgctgaaacagaggagatcagcaatggtgagcctcaacctggcggcagcgcaaaagatg

SEQ ID NO: 93185 - DNA, 103 bp, Artificial Sequence
  Synthetic Polynucleotide
taatacgactcactatagggcgaggagagatgggagctgaaggaggctcaaacagaggagatgagccatgttcagctccaacctggcggcagcgcaaaagatg

SEQ ID NO: 93186 - DNA, 103 bp, Artificial Sequence
  Synthetic Polynucleotide
taatacgactcactatagggcttgttcatccgaggagagatgggagctgaaacagaggagatcagctatgatctctcctaacctggcggcagcgcaaaagatg

SEQ ID NO: 93187 - DNA, 103 bp, Artificial Sequence
  Synthetic Polynucleotide
taatacgactcactataggggaggctcccccttgttcatccgaggagagaaacagaggagatctctcatgggatgaacaaacctggcggcagcgcaaaagatg

SEQ ID NO: 93188 - DNA, 103 bp, Artificial Sequence
  Synthetic Polynucleotide
taatacgactcactatagggctccggggttgaggctcccccttgttcatcaacagaggagagatgaaatggggggagccaacctggcggcagcgcaaaagatg

SEQ ID NO: 93189 - DNA, 103 bp, Artificial Sequence
  Synthetic Polynucleotide
taatacgactcactatagggacggaagagctgcgtctgctcctcggccacaacagaggagagtggccatggagcagacgaacctggcggcagcgcaaaagatg

SEQ ID NO: 93190 - DNA, 103 bp, Artificial Sequence
  Synthetic Polynucleotide
taatacgactcactatagggcagcaagtgtctccggggttgaggctccccaacagaggagaggggagatgcaaccccggaacctggcggcagcgcaaaagatg

SEQ ID NO: 93191 - DNA, 103 bp, Artificial Sequence
  Synthetic Polynucleotide
taatacgactcactatagggctgagaaccccagcaagtgtctccggggttaacagaggagaaaccccatggacacttgcaacctggcggcagcgcaaaagatg

SEQ ID NO: 93192 - DNA, 103 bp, Artificial Sequence
  Synthetic Polynucleotide
taatacgactcactatagggggctcttgctctgagaaccccagcaagtgtaacagaggagaacacttatgggggttctcaacctggcggcagcgcaaaagatg

SEQ ID NO: 93193 - DNA, 103 bp, Artificial Sequence
  Synthetic Polynucleotide
taatacgactcactatagggtccctgaactggctcttgctctgagaacccaacagaggagagggttcatggagcaagagaacctggcggcagcgcaaaagatg

SEQ ID NO: 93194 - DNA, 103 bp, Artificial Sequence
  Synthetic Polynucleotide
taatacgactcactataggggaggttcaactccctgaactggctcttgctaacagaggagaagcaagatgcagttcaggaacctggcggcagcgcaaaagatg

SEQ ID NO: 93195 - DNA, 103 bp, Artificial Sequence
  Synthetic Polynucleotide
taatacgactcactataggggacccctggagaggttcaactccctgaactaacagaggagaagttcaatgagttgaaccaacctggcggcagcgcaaaagatg

SEQ ID NO: 93196 - DNA, 103 bp, Artificial Sequence
  Synthetic Polynucleotide
taatacgactcactataggggccctgggaggacccctggagaggttcaacaacagaggagagttgaaatgctccaggggaacctggcggcagcgcaaaagatg

SEQ ID NO: 93197 - DNA, 103 bp, Artificial Sequence
  Synthetic Polynucleotide
taatacgactcactataggggctccttagggccctgggaggacccctggaaacagaggagatccaggatgcctcccaggaacctggcggcagcgcaaaagatg

SEQ ID NO: 93198 - DNA, 103 bp, Artificial Sequence
  Synthetic Polynucleotide
taatacgactcactatagggctgggctggggctccttagggccctgggagaacagaggagactcccaatgccctaaggaaacctggcggcagcgcaaaagatg

SEQ ID NO: 93199 - DNA, 103 bp, Artificial Sequence
  Synthetic Polynucleotide
taatacgactcactataggggtctgtggggctgggctggggctccttaggaacagaggagacctaagatgccccagcccaacctggcggcagcgcaaaagatg

SEQ ID NO: 93200 - DNA, 103 bp, Artificial Sequence
  Synthetic Polynucleotide
taatacgactcactataggggctccgggcaacggaagagctgcgtctgctaacagaggagaagcagaatgagctcttccaacctggcggcagcgcaaaagatg

SEQ ID NO: 93201 - DNA, 103 bp, Artificial Sequence
  Synthetic Polynucleotide
taatacgactcactatagggaactgggctggtctgtggggctgggctgggaacagaggagacccagcatggccccacagaacctggcggcagcgcaaaagatg

SEQ ID NO: 93202 - DNA, 103 bp, Artificial Sequence
  Synthetic Polynucleotide
taatacgactcactatagggaggttgctgaaactgggctggtctgtggggaacagaggagaccccacatgccagcccagaacctggcggcagcgcaaaagatg

SEQ ID NO: 93203 - DNA, 103 bp, Artificial Sequence
  Synthetic Polynucleotide
taatacgactcactataggggaaggctgtcaggttgctgaaactgggctgaacagaggagacagcccatgttcagcaacaacctggcggcagcgcaaaagatg

SEQ ID NO: 93204 - DNA, 103 bp, Artificial Sequence
  Synthetic Polynucleotide
taatacgactcactatagggcgcccccagggaaggctgtcaggttgctgaaacagaggagatcagcaatgtgacagcctaacctggcggcagcgcaaaagatg

SEQ ID NO: 93205 - DNA, 103 bp, Artificial Sequence
  Synthetic Polynucleotide
taatacgactcactatagggagctccttggcgcccccagggaaggctgtcaacagaggagagacagcatgccctgggggaacctggcggcagcgcaaaagatg

SEQ ID NO: 93206 - DNA, 103 bp, Artificial Sequence
  Synthetic Polynucleotide
taatacgactcactatagggtcttagtagtagctccttggcgcccccaggaacagaggagacctgggatggccaaggagaacctggcggcagcgcaaaagatg

SEQ ID NO: 93207 - DNA, 103 bp, Artificial Sequence
  Synthetic Polynucleotide
taatacgactcactatagggggtctaggtctcttagtagtagctccttggaacagaggagaccaaggatgtactactaaaacctggcggcagcgcaaaagatg

SEQ ID NO: 93208 - DNA, 103 bp, Artificial Sequence
  Synthetic Polynucleotide
taatacgactcactatagggaggaagagctggtctaggtctcttagtagtaacagaggagaactactatgagacctagaaacctggcggcagcgcaaaagatg

SEQ ID NO: 93209 - DNA, 103 bp, Artificial Sequence
  Synthetic Polynucleotide
taatacgactcactatagggatcagaggagaggaagagctggtctaggtcaacagaggagagacctaatgcagctcttcaacctggcggcagcgcaaaagatg

SEQ ID NO: 93210 - DNA, 103 bp, Artificial Sequence
  Synthetic Polynucleotide
taatacgactcactatagggagtgccggcaatcagaggagaggaagagctaacagaggagaagctctatgtctcctctgaacctggcggcagcgcaaaagatg

SEQ ID NO: 93211 - DNA, 103 bp, Artificial Sequence
  Synthetic Polynucleotide
taatacgactcactataggggggacatcctgctccgggcaacggaagagcaacagaggagagctcttatgttgcccggaaacctggcggcagcgcaaaagatg

SEQ ID NO: 93212 - DNA, 103 bp, Artificial Sequence
  Synthetic Polynucleotide
taatacgactcactataggggtgcggttgaagtgccggcaatcagaggagaacagaggagactcctcatgttgccggcaaacctggcggcagcgcaaaagatg

SEQ ID NO: 93213 - DNA, 103 bp, Artificial Sequence
  Synthetic Polynucleotide
taatacgactcactatagggcagggactcagtgcggttgaagtgccggcaaacagaggagatgccggatgttcaaccgcaacctggcggcagcgcaaaagatg

SEQ ID NO: 93214 - DNA, 103 bp, Artificial Sequence
  Synthetic Polynucleotide
taatacgactcactatagggcagcaagcctcagggactcagtgcggttgaaacagaggagatcaaccatgctgagtcccaacctggcggcagcgcaaaagatg

SEQ ID NO: 93215 - DNA, 103 bp, Artificial Sequence
  Synthetic Polynucleotide
taatacgactcactatagggctcaactcgtcagcaagcctcagggactcaaacagaggagatgagtcatggaggcttgcaacctggcggcagcgcaaaagatg

SEQ ID NO: 93216 - DNA, 103 bp, Artificial Sequence
  Synthetic Polynucleotide
taatacgactcactataggggacccagccactcaactcgtcagcaagcctaacagaggagaaggcttatggacgagttgaacctggcggcagcgcaaaagatg

SEQ ID NO: 93217 - DNA, 103 bp, Artificial Sequence
  Synthetic Polynucleotide
taatacgactcactatagggggtggcgctggacccagccactcaactcgtaacagaggagaacgagtatggtggctgggaacctggcggcagcgcaaaagatg

SEQ ID NO: 93218 - DNA, 103 bp, Artificial Sequence
  Synthetic Polynucleotide
taatacgactcactatagggcggcctctctggtggcgctggacccagccaaacagaggagatggctgatgccagcgccaaacctggcggcagcgcaaaagatg

SEQ ID NO: 93219 - DNA, 103 bp, Artificial Sequence
  Synthetic Polynucleotide
taatacgactcactataggggatcttcctccggcctctctggtggcgctgaacagaggagacagcgcatgcagagaggcaacctggcggcagcgcaaaagatg

SEQ ID NO: 93220 - DNA, 103 bp, Artificial Sequence
  Synthetic Polynucleotide
taatacgactcactatagggccctctgagggatcttcctccggcctctctaacagaggagaagagagatgggaggaagaaacctggcggcagcgcaaaagatg

SEQ ID NO: 93221 - DNA, 103 bp, Artificial Sequence
  Synthetic Polynucleotide
taatacgactcactatagggctctcctgggccctctgagggatcttcctcaacagaggagagaggaaatgccctcagagaacctggcggcagcgcaaaagatg

SEQ ID NO: 93222 - DNA, 103 bp, Artificial Sequence
  Synthetic Polynucleotide
taatacgactcactataggggccgtcaaacgggacatcctgctccgggcaaacagaggagatgcccgatgcaggatgtcaacctggcggcagcgcaaaagatg

SEQ ID NO: 93223 - DNA, 103 bp, Artificial Sequence
  Synthetic Polynucleotide
taatacgactcactatagggagacttctgtctctcctgggccctctgaggaacagaggagacctcagatggcccaggagaacctggcggcagcgcaaaagatg

SEQ ID NO: 93224 - DNA, 103 bp, Artificial Sequence
  Synthetic Polynucleotide
taatacgactcactatagggtccgtggctgagacttctgtctctcctgggaacagaggagacccaggatggacagaagtaacctggcggcagcgcaaaagatg

SEQ ID NO: 93225 - DNA, 103 bp, Artificial Sequence
  Synthetic Polynucleotide
taatacgactcactatagggggtgacttcttccgtggctgagacttctgtaacagaggagaacagaaatgtcagccacgaacctggcggcagcgcaaaagatg

SEQ ID NO: 93226 - DNA, 103 bp, Artificial Sequence
  Synthetic Polynucleotide
taatacgactcactatagggcttaactggaggtgacttcttccgtggctgaacagaggagacagccaatgaagaagtcaaacctggcggcagcgcaaaagatg

SEQ ID NO: 93227 - DNA, 103 bp, Artificial Sequence
  Synthetic Polynucleotide
taatacgactcactatagggtggggactgccttaactggaggtgacttctaacagaggagaagaagtatgctccagttaaacctggcggcagcgcaaaagatg

SEQ ID NO: 93228 - DNA, 103 bp, Artificial Sequence
  Synthetic Polynucleotide
taatacgactcactataggggggggttggatggggactgccttaactggaaacagaggagatccagtatgggcagtcccaacctggcggcagcgcaaaagatg

SEQ ID NO: 93229 - DNA, 103 bp, Artificial Sequence
  Synthetic Polynucleotide
taatacgactcactatagggtgggggtccagggggttggatggggactgcaacagaggagagcagtcatgatccaacccaacctggcggcagcgcaaaagatg

SEQ ID NO: 93230 - DNA, 103 bp, Artificial Sequence
  Synthetic Polynucleotide
taatacgactcactatagggaatccctttctgggggtccagggggttggaaacagaggagatccaacatgctggaccccaacctggcggcagcgcaaaagatg

SEQ ID NO: 93231 - DNA, 103 bp, Artificial Sequence
  Synthetic Polynucleotide
taatacgactcactatagggtggcccacagaatccctttctgggggtccaaacagaggagatggaccatgagaaagggaaacctggcggcagcgcaaaagatg

SEQ ID NO: 93232 - DNA, 103 bp, Artificial Sequence
  Synthetic Polynucleotide
taatacgactcactatagggtagttgcagctggcccacagaatccctttcaacagaggagagaaaggatgtctgtgggcaacctggcggcagcgcaaaagatg

SEQ ID NO: 93233 - DNA, 103 bp, Artificial Sequence
  Synthetic Polynucleotide
taatacgactcactatagggccagggagctgccgtcaaacgggacatcctaacagaggagaaggatgatgcgtttgacgaacctggcggcagcgcaaaagatg

SEQ ID NO: 93234 - DNA, 103 bp, Artificial Sequence
  Synthetic Polynucleotide
taatacgactcactatagggggtggcgatatagttgcagctggcccacagaacagaggagactgtggatgagctgcaacaacctggcggcagcgcaaaagatg

SEQ ID NO: 93235 - DNA, 103 bp, Artificial Sequence
  Synthetic Polynucleotide
taatacgactcactataggggaacggtctgggtggcgatatagttgcagcaacagaggagagctgcaatgatatcgccaaacctggcggcagcgcaaaagatg

SEQ ID NO: 93236 - DNA, 103 bp, Artificial Sequence
  Synthetic Polynucleotide
taatacgactcactatagggtgctggctgcgaacggtctgggtggcgataaacagaggagatatcgcatgccagaccgtaacctggcggcagcgcaaaagatg

SEQ ID NO: 93237 - DNA, 103 bp, Artificial Sequence
  Synthetic Polynucleotide
taatacgactcactatagggcatccaagaatgctggctgcgaacggtctgaacagaggagacagaccatgcgcagccagaacctggcggcagcgcaaaagatg

SEQ ID NO: 93238 - DNA, 103 bp, Artificial Sequence
  Synthetic Polynucleotide
taatacgactcactatagggcggtcaattgcatccaagaatgctggctgcaacagaggagagcagccatgattcttggaaacctggcggcagcgcaaaagatg

SEQ ID NO: 93239 - DNA, 103 bp, Artificial Sequence
  Synthetic Polynucleotide
taatacgactcactataggggtcttcccgtcggtcaattgcatccaagaaaacagaggagattcttgatggcaattgacaacctggcggcagcgcaaaagatg

SEQ ID NO: 93240 - DNA, 103 bp, Artificial Sequence
  Synthetic Polynucleotide
taatacgactcactatagggcataaaatgtgtcttcccgtcggtcaattgaacagaggagacaattgatggacgggaagaacctggcggcagcgcaaaagatg

SEQ ID NO: 93241 - DNA, 103 bp, Artificial Sequence
  Synthetic Polynucleotide
taatacgactcactatagggaaagagacaacataaaatgtgtcttcccgtaacagaggagaacgggaatgcacattttaaacctggcggcagcgcaaaagatg

SEQ ID NO: 93242 - DNA, 103 bp, Artificial Sequence
  Synthetic Polynucleotide
taatacgactcactataggggtcccttcggaaagagacaacataaaatgtaacagaggagaacatttatggttgtctctaacctggcggcagcgcaaaagatg

SEQ ID NO: 93243 - DNA, 103 bp, Artificial Sequence
  Synthetic Polynucleotide
taatacgactcactataggggcagcaggtggtcccttcggaaagagacaaaacagaggagattgtctatgtccgaagggaacctggcggcagcgcaaaagatg

SEQ ID NO: 93244 - DNA, 103 bp, Artificial Sequence
  Synthetic Polynucleotide
taatacgactcactatagggatccccacgtccagggagctgccgtcaaacaacagaggagagtttgaatgcagctccctaacctggcggcagcgcaaaagatg

SEQ ID NO: 93245 - DNA, 103 bp, Artificial Sequence
  Synthetic Polynucleotide
taatacgactcactatagggatggctgggagcagcaggtggtcccttcggaacagaggagaccgaagatgccacctgctaacctggcggcagcgcaaaagatg

SEQ ID NO: 93246 - DNA, 103 bp, Artificial Sequence
  Synthetic Polynucleotide
taatacgactcactataggggttgtggctgatggctgggagcagcaggtgaacagaggagacacctgatgctcccagccaacctggcggcagcgcaaaagatg

SEQ ID NO: 93247 - DNA, 103 bp, Artificial Sequence
  Synthetic Polynucleotide
taatacgactcactataggggggaggtcttgttgtggctgatggctgggaaacagaggagatcccagatgtcagccacaaacctggcggcagcgcaaaagatg

SEQ ID NO: 93248 - DNA, 103 bp, Artificial Sequence
  Synthetic Polynucleotide
taatacgactcactatagggatcttgggccgggaggtcttgttgtggctgaacagaggagacagccaatgcaagacctcaacctggcggcagcgcaaaagatg

SEQ ID NO: 93249 - DNA, 103 bp, Artificial Sequence
  Synthetic Polynucleotide
taatacgactcactatagggcaccagggacatcttgggccgggaggtcttaacagaggagaaagaccatgcggcccaagaacctggcggcagcgcaaaagatg

SEQ ID NO: 93250 - DNA, 103 bp, Artificial Sequence
  Synthetic Polynucleotide
taatacgactcactatagggtggcaggcatcaccagggacatcttgggccaacagaggagaggcccaatgtgtccctggaacctggcggcagcgcaaaagatg

SEQ ID NO: 93251 - DNA, 103 bp, Artificial Sequence
  Synthetic Polynucleotide
taatacgactcactatagggttgggggccatggcaggcatcaccagggacaacagaggagagtccctatggatgcctgcaacctggcggcagcgcaaaagatg

SEQ ID NO: 93252 - DNA, 103 bp, Artificial Sequence
  Synthetic Polynucleotide
taatacgactcactatagggcagggtctcattgggggccatggcaggcataacagaggagaatgcctatgatggcccccaacctggcggcagcgcaaaagatg

SEQ ID NO: 93253 - DNA, 103 bp, Artificial Sequence
  Synthetic Polynucleotide
taatacgactcactatagggcacggcctgacagggtctcattgggggccaaacagaggagatggcccatgatgagacccaacctggcggcagcgcaaaagatg

SEQ ID NO: 93254 - DNA, 103 bp, Artificial Sequence
  Synthetic Polynucleotide
taatacgactcactatagggcccggggccccacggcctgacagggtctcaaacagaggagatgagacatggtcaggccgaacctggcggcagcgcaaaagatg

SEQ ID NO: 93255 - DNA, 103 bp, Artificial Sequence
  Synthetic Polynucleotide
taatacgactcactataggggctgacatccatccccacgtccagggagctaacagaggagaagctccatggacgtggggaacctggcggcagcgcaaaagatg

SEQ ID NO: 93256 - DNA, 103 bp, Artificial Sequence
  Synthetic Polynucleotide
taatacgactcactatagggctcatagtcccccggggccccacggcctgaaacagaggagatcaggcatgggggccccgaacctggcggcagcgcaaaagatg

SEQ ID NO: 93257 - DNA, 103 bp, Artificial Sequence
  Synthetic Polynucleotide
taatacgactcactataggggcatcatctcctcatagtcccccggggcccaacagaggagagggcccatggggactatgaacctggcggcagcgcaaaagatg

SEQ ID NO: 93258 - DNA, 103 bp, Artificial Sequence
  Synthetic Polynucleotide
taatacgactcactatagggcactcgatctgcatcatctcctcatagtccaacagaggagaggactaatgggagatgataacctggcggcagcgcaaaagatg

SEQ ID NO: 93259 - DNA, 103 bp, Artificial Sequence
  Synthetic Polynucleotide
taatacgactcactatagggcatgacctcacactcgatctgcatcatctcaacagaggagagagatgatgcagatcgagaacctggcggcagcgcaaaagatg

SEQ ID NO: 93260 - DNA, 103 bp, Artificial Sequence
  Synthetic Polynucleotide
taatacgactcactatagggccctggtgtccatgacctcacactcgatctaacagaggagaagatcgatggtgaggtcaaacctggcggcagcgcaaaagatg

SEQ ID NO: 93261 - DNA, 103 bp, Artificial Sequence
  Synthetic Polynucleotide
taatacgactcactatagggatgtgaatcaccctggtgtccatgacctcaaacagaggagatgaggtatgggacaccagaacctggcggcagcgcaaaagatg

SEQ ID NO: 93262 - DNA, 103 bp, Artificial Sequence
  Synthetic Polynucleotide
taatacgactcactatagggggaggtcttgatgtgaatcaccctggtgtcaacagaggagagacaccatggtgattcacaacctggcggcagcgcaaaagatg

SEQ ID NO: 93263 - DNA, 103 bp, Artificial Sequence
  Synthetic Polynucleotide
taatacgactcactatagggggggcactgtggaggtcttgatgtgaatcaaacagaggagatgattcatgtcaagacctaacctggcggcagcgcaaaagatg

SEQ ID NO: 93264 - DNA, 103 bp, Artificial Sequence
  Synthetic Polynucleotide
taatacgactcactatagggcggagcgaggggggcactgtggaggtcttgaacagaggagacaagacatgcacagtgccaacctggcggcagcgcaaaagatg

SEQ ID NO: 93265 - DNA, 103 bp, Artificial Sequence
  Synthetic Polynucleotide
taatacgactcactatagggtggctgttttcggagcgaggggggcactgtaacagaggagaacagtgatgccctcgctcaacctggcggcagcgcaaaagatg

SEQ ID NO: 93266 - DNA, 103 bp, Artificial Sequence
  Synthetic Polynucleotide
taatacgactcactatagggtcgggtcagcaatctcgctgagcagcatcaaacagaggagatgatgcatgtcagcgagaaacctggcggcagcgcaaaagatg

SEQ ID NO: 93267 - DNA, 103 bp, Artificial Sequence
  Synthetic Polynucleotide
taatacgactcactataggggctcagaggggctgacatccatccccacgtaacagaggagaacgtggatgtggatgtcaaacctggcggcagcgcaaaagatg

SEQ ID NO: 93268 - DNA, 103 bp, Artificial Sequence
  Synthetic Polynucleotide
taatacgactcactataggggggttggggatggctgttttcggagcgaggaacagaggagacctcgcatggaaaacagcaacctggcggcagcgcaaaagatg

SEQ ID NO: 93269 - DNA, 103 bp, Artificial Sequence
  Synthetic Polynucleotide
taatacgactcactataggggcattgcctggggttggggatggctgttttaacagaggagaaaaacaatgatccccaacaacctggcggcagcgcaaaagatg

SEQ ID NO: 93270 - DNA, 103 bp, Artificial Sequence
  Synthetic Polynucleotide
taatacgactcactataggggccacctgtggcattgcctggggttggggaaacagaggagatccccaatgccaggcaataacctggcggcagcgcaaaagatg

SEQ ID NO: 93271 - DNA, 103 bp, Artificial Sequence
  Synthetic Polynucleotide
taatacgactcactatagggctggcaaggggccacctgtggcattgcctgaacagaggagacaggcaatgccacaggtgaacctggcggcagcgcaaaagatg

SEQ ID NO: 93272 - DNA, 103 bp, Artificial Sequence
  Synthetic Polynucleotide
taatacgactcactataggggctgcagagactggcaaggggccacctgtgaacagaggagacacaggatgccccttgccaacctggcggcagcgcaaaagatg

SEQ ID NO: 93273 - DNA, 103 bp, Artificial Sequence
  Synthetic Polynucleotide
taatacgactcactatagggggcctggctggctgcagagactggcaagggaacagaggagacccttgatggtctctgcaaacctggcggcagcgcaaaagatg

SEQ ID NO: 93274 - DNA, 103 bp, Artificial Sequence
  Synthetic Polynucleotide
taatacgactcactatagggaggcctggtgggcctggctggctgcagagaaacagaggagatctctgatgccagccaggaacctggcggcagcgcaaaagatg

SEQ ID NO: 93275 - DNA, 103 bp, Artificial Sequence
  Synthetic Polynucleotide
taatacgactcactatagggggctggtgggaggcctggtgggcctggctgaacagaggagacagccaatgccaccaggcaacctggcggcagcgcaaaagatg

SEQ ID NO: 93276 - DNA, 103 bp, Artificial Sequence
  Synthetic Polynucleotide
taatacgactcactataggggaggtagaggggctggtgggaggcctggtgaacagaggagacaccagatgtcccaccagaacctggcggcagcgcaaaagatg

SEQ ID NO: 93277 - DNA, 103 bp, Artificial Sequence
  Synthetic Polynucleotide
taatacgactcactatagggagggatgattgaggtagaggggctggtgggaacagaggagacccaccatgccctctaccaacctggcggcagcgcaaaagatg

SEQ ID NO: 93278 - DNA, 103 bp, Artificial Sequence
  Synthetic Polynucleotide
taatacgactcactatagggtcccatgggggctcagaggggctgacatccaacagaggagaggatgtatgcccctctgaaacctggcggcagcgcaaaagatg

SEQ ID NO: 93279 - DNA, 103 bp, Artificial Sequence
  Synthetic Polynucleotide
taatacgactcactatagggcggcaggagttcccatgggggctcagagggaacagaggagaccctctatgcccccatggaacctggcggcagcgcaaaagatg

SEQ ID NO: 93280 - DNA, 103 bp, Artificial Sequence
  Synthetic Polynucleotide
taatacgactcactatagggctgggaagatcggcaggagttcccatggggaacagaggagaccccatatgaactcctgcaacctggcggcagcgcaaaagatg

SEQ ID NO: 93281 - DNA, 103 bp, Artificial Sequence
  Synthetic Polynucleotide
taatacgactcactatagggacctgaagatctgggaagatcggcaggagtaacagaggagaactcctatggatcttcccaacctggcggcagcgcaaaagatg

SEQ ID NO: 93282 - DNA, 103 bp, Artificial Sequence
  Synthetic Polynucleotide
taatacgactcactatagggctcagacttcacctgaagatctgggaagataacagaggagaatcttcatggatcttcagaacctggcggcagcgcaaaagatg

SEQ ID NO: 93283 - DNA, 103 bp, Artificial Sequence
  Synthetic Polynucleotide
taatacgactcactataggggggaagatggctcagacttcacctgaagataacagaggagaatcttcatgtgaagtctgaacctggcggcagcgcaaaagatg

SEQ ID NO: 93284 - DNA, 103 bp, Artificial Sequence
  Synthetic Polynucleotide
taatacgactcactataggggaagagcagggggaagatggctcagacttcaacagaggagagaagtcatggccatcttcaacctggcggcagcgcaaaagatg

SEQ ID NO: 93285 - DNA, 103 bp, Artificial Sequence
  Synthetic Polynucleotide
taatacgactcactataggggagggaggaggaagagcagggggaagatggaacagaggagaccatctatgccctgctctaacctggcggcagcgcaaaagatg

SEQ ID NO: 93286 - DNA, 103 bp, Artificial Sequence
  Synthetic Polynucleotide
taatacgactcactatagggactcggagctgagggaggaggaagagcaggaacagaggagacctgctatgcctcctcccaacctggcggcagcgcaaaagatg

SEQ ID NO: 93287 - DNA, 103 bp, Artificial Sequence
  Synthetic Polynucleotide
taatacgactcactatagggaagaaacgcgtcgggtcagcaatctcgctgaacagaggagacagcgaatgtgctgacccaacctggcggcagcgcaaaagatg

SEQ ID NO: 93288 - DNA, 103 bp, Artificial Sequence
  Synthetic Polynucleotide
taatacgactcactatagggagacgcgatgactcggagctgagggaggagaacagaggagactcctcatgcagctccgaaacctggcggcagcgcaaaagatg

SEQ ID NO: 93289 - DNA, 103 bp, Artificial Sequence
  Synthetic Polynucleotide
taatacgactcactatagggctctgtggagagacgcgatgactcggagctaacagaggagaagctccatgtcatcgcgtaacctggcggcagcgcaaaagatg

SEQ ID NO: 93290 - DNA, 103 bp, Artificial Sequence
  Synthetic Polynucleotide
taatacgactcactatagggcgctggatggctctgtggagagacgcgatgaacagaggagacatcgcatgtctccacagaacctggcggcagcgcaaaagatg

SEQ ID NO: 93291 - DNA, 103 bp, Artificial Sequence
  Synthetic Polynucleotide
taatacgactcactatagggccaagagcctcgctggatggctctgtggagaacagaggagactccacatggccatccagaacctggcggcagcgcaaaagatg

SEQ ID NO: 93292 - DNA, 103 bp, Artificial Sequence
  Synthetic Polynucleotide
taatacgactcactatagggctcccctaccccaagagcctcgctggatggaacagaggagaccatccatggaggctcttaacctggcggcagcgcaaaagatg

SEQ ID NO: 93293 - DNA, 103 bp, Artificial Sequence
  Synthetic Polynucleotide
taatacgactcactatagggcatggagcacctcccctaccccaagagcctaacagaggagaaggctcatggggtaggggaacctggcggcagcgcaaaagatg

SEQ ID NO: 93294 - DNA, 103 bp, Artificial Sequence
  Synthetic Polynucleotide
taatacgactcactatagggtctgtcttcacatggagcacctcccctaccaacagaggagaggtaggatgggtgctccaaacctggcggcagcgcaaaagatg

SEQ ID NO: 93295 - DNA, 103 bp, Artificial Sequence
  Synthetic Polynucleotide
taatacgactcactatagggtgccaaggactctgtcttcacatggagcacaacagaggagagtgctcatggtgaagacaaacctggcggcagcgcaaaagatg

SEQ ID NO: 93296 - DNA, 103 bp, Artificial Sequence
  Synthetic Polynucleotide
taatacgactcactatagggacagtgggggtgccaaggactctgtcttcaaacagaggagatgaagaatgagtccttggaacctggcggcagcgcaaaagatg

SEQ ID NO: 93297 - DNA, 103 bp, Artificial Sequence
  Synthetic Polynucleotide
taatacgactcactatagggcccaggagacacagtgggggtgccaaggacaacagaggagagtccttatgacccccactaacctggcggcagcgcaaaagatg

SEQ ID NO: 93298 - DNA, 103 bp, Artificial Sequence
  Synthetic Polynucleotide
taatacgactcactataggggttgtcggtgaagaaacgcgtcgggtcagcaacagaggagagctgacatgacgcgtttcaacctggcggcagcgcaaaagatg

SEQ ID NO: 93299 - DNA, 103 bp, Artificial Sequence
  Synthetic Polynucleotide
taatacgactcactatagggtgggtcatctcccaggagacacagtgggggaacagaggagacccccaatgtgtctcctgaacctggcggcagcgcaaaagatg

SEQ ID NO: 93300 - DNA, 103 bp, Artificial Sequence
  Synthetic Polynucleotide
taatacgactcactatagggatgaggatgttgggtcatctcccaggagacaacagaggagagtctccatggagatgaccaacctggcggcagcgcaaaagatg

SEQ ID NO: 93301 - DNA, 103 bp, Artificial Sequence
  Synthetic Polynucleotide
taatacgactcactatagggacggtttcaaatgaggatgttgggtcatctaacagaggagaagatgaatgaacatcctcaacctggcggcagcgcaaaagatg

SEQ ID NO: 93302 - DNA, 103 bp, Artificial Sequence
  Synthetic Polynucleotide
taatacgactcactataggggttgatctggacggtttcaaatgaggatgtaacagaggagaacatccatgtttgaaaccaacctggcggcagcgcaaaagatg

SEQ ID NO: 93303 - DNA, 103 bp, Artificial Sequence
  Synthetic Polynucleotide
taatacgactcactatagggtggggataacgttgatctggacggtttcaaaacagaggagattgaaaatgtccagatcaaacctggcggcagcgcaaaagatg

SEQ ID NO: 93304 - DNA, 103 bp, Artificial Sequence
  Synthetic Polynucleotide
taatacgactcactatagggtcatcagaggtggggataacgttgatctggaacagaggagaccagatatgcgttatcccaacctggcggcagcgcaaaagatg

SEQ ID NO: 93305 - DNA, 103 bp, Artificial Sequence
  Synthetic Polynucleotide
taatacgactcactatagggatctgaggaatcatcagaggtggggataacaacagaggagagttatcatgacctctgataacctggcggcagcgcaaaagatg

SEQ ID NO: 93306 - DNA, 103 bp, Artificial Sequence
  Synthetic Polynucleotide
taatacgactcactatagggtggtctggacatctgaggaatcatcagaggaacagaggagacctctgatgattcctcagaacctggcggcagcgcaaaagatg

SEQ ID NO: 93307 - DNA, 103 bp, Artificial Sequence
  Synthetic Polynucleotide
taatacgactcactatagggggttctatcttggtctggacatctgaggaaaacagaggagattcctcatgtgtccagacaacctggcggcagcgcaaaagatg

SEQ ID NO: 93308 - DNA, 103 bp, Artificial Sequence
  Synthetic Polynucleotide
taatacgactcactatagggtggagagacaggttctatcttggtctggacaacagaggagagtccagatgaagatagaaaacctggcggcagcgcaaaagatg

SEQ ID NO: 93309 - DNA, 103 bp, Artificial Sequence
  Synthetic Polynucleotide
taatacgactcactatagggggctaagcaggttgtcggtgaagaaacgcgaacagaggagacgcgttatgtcaccgacaaacctggcggcagcgcaaaagatg

SEQ ID NO: 93310 - DNA, 103 bp, Artificial Sequence
  Synthetic Polynucleotide
taatacgactcactatagggcggaagaacatggagagacaggttctatctaacagaggagaagatagatgctgtctctcaacctggcggcagcgcaaaagatg

SEQ ID NO: 93311 - DNA, 103 bp, Artificial Sequence
  Synthetic Polynucleotide
taatacgactcactatagggtcagagttgacggaagaacatggagagacaaacagaggagatgtctcatgatgttcttcaacctggcggcagcgcaaaagatg

SEQ ID NO: 93312 - DNA, 103 bp, Artificial Sequence
  Synthetic Polynucleotide
taatacgactcactatagggcagggaggcctcagagttgacggaagaacaaacagaggagatgttctatggtcaactctaacctggcggcagcgcaaaagatg

SEQ ID NO: 93313 - DNA, 103 bp, Artificial Sequence
  Synthetic Polynucleotide
taatacgactcactatagggcggctgagagcagggaggcctcagagttgaaacagaggagatcaactatgaggcctcccaacctggcggcagcgcaaaagatg

SEQ ID NO: 93314 - DNA, 103 bp, Artificial Sequence
  Synthetic Polynucleotide
taatacgactcactatagggctggaggagtcggctgagagcagggaggccaacagaggagaggcctcatggctctcagcaacctggcggcagcgcaaaagatg

SEQ ID NO: 93315 - DNA, 103 bp, Artificial Sequence
  Synthetic Polynucleotide
taatacgactcactatagggaaaagcctggctggaggagtcggctgagagaacagaggagactctcaatggactcctccaacctggcggcagcgcaaaagatg

SEQ ID NO: 93316 - DNA, 103 bp, Artificial Sequence
  Synthetic Polynucleotide
taatacgactcactatagggcctctcctataaaagcctggctggaggagtaacagaggagaactcctatggccaggcttaacctggcggcagcgcaaaagatg

SEQ ID NO: 93317 - DNA, 103 bp, Artificial Sequence
  Synthetic Polynucleotide
taatacgactcactatagggtccaggacctcctctcctataaaagcctggaacagaggagaccaggcatgtataggagaaacctggcggcagcgcaaaagatg

SEQ ID NO: 93318 - DNA, 103 bp, Artificial Sequence
  Synthetic Polynucleotide
taatacgactcactatagggtgtcttcacttccaggacctcctctcctataacagaggagaataggaatggaggtcctgaacctggcggcagcgcaaaagatg

SEQ ID NO: 93319 - DNA, 103 bp, Artificial Sequence
  Synthetic Polynucleotide
taatacgactcactatagggacagggactctgtcttcacttccaggacctaacagaggagaaggtccatgaagtgaagaaacctggcggcagcgcaaaagatg

SEQ ID NO: 93320 - DNA, 103 bp, Artificial Sequence
  Synthetic Polynucleotide
taatacgactcactatagggcagtcctccgggctaagcaggttgtcggtgaacagaggagacaccgaatgcctgcttagaacctggcggcagcgcaaaagatg

SEQ ID NO: 93321 - DNA, 103 bp, Artificial Sequence
  Synthetic Polynucleotide
taatacgactcactatagggcctgaaggggacagggactctgtcttcactaacagaggagaagtgaaatgagagtccctaacctggcggcagcgcaaaagatg

SEQ ID NO: 93322 - DNA, 103 bp, Artificial Sequence
  Synthetic Polynucleotide
taatacgactcactatagggcaggaggcatcctgaaggggacagggactcaacagaggagagagtccatgtccccttcaaacctggcggcagcgcaaaagatg

SEQ ID NO: 93323 - DNA, 103 bp, Artificial Sequence
  Synthetic Polynucleotide
taatacgactcactatagggggacatcccacaggaggcatcctgaaggggaacagaggagaccccttatggatgcctccaacctggcggcagcgcaaaagatg

SEQ ID NO: 93324 - DNA, 103 bp, Artificial Sequence
  Synthetic Polynucleotide
taatacgactcactataggggagggggctgggacatcccacaggaggcataacagaggagaatgcctatggtgggatgtaacctggcggcagcgcaaaagatg

SEQ ID NO: 93325 - DNA, 103 bp, Artificial Sequence
  Synthetic Polynucleotide
taatacgactcactatagggagctccaagtgagggggctgggacatcccaaacagaggagatgggatatgccagcccccaacctggcggcagcgcaaaagatg

SEQ ID NO: 93326 - DNA, 103 bp, Artificial Sequence
  Synthetic Polynucleotide
taatacgactcactatagggtgatctggacagctccaagtgagggggctgaacagaggagacagcccatgcacttggagaacctggcggcagcgcaaaagatg

SEQ ID NO: 93327 - DNA, 103 bp, Artificial Sequence
  Synthetic Polynucleotide
taatacgactcactataggggggcccatgctgatctggacagctccaagtaacagaggagaacttggatgtgtccagataacctggcggcagcgcaaaagatg

SEQ ID NO: 93328 - DNA, 103 bp, Artificial Sequence
  Synthetic Polynucleotide
taatacgactcactatagggatcaagggatgggcccatgctgatctggacaacagaggagagtccagatgagcatgggcaacctggcggcagcgcaaaagatg

SEQ ID NO: 93329 - DNA, 103 bp, Artificial Sequence
  Synthetic Polynucleotide
taatacgactcactatagggctgaggagccatcaagggatgggcccatgcaacagaggagagcatggatgcatcccttgaacctggcggcagcgcaaaagatg

SEQ ID NO: 93330 - DNA, 103 bp, Artificial Sequence
  Synthetic Polynucleotide
taatacgactcactatagggagggctttgcctgaggagccatcaagggataacagaggagaatccctatgtggctcctcaacctggcggcagcgcaaaagatg

SEQ ID NO: 93331 - DNA, 103 bp, Artificial Sequence
  Synthetic Polynucleotide
taatacgactcactatagggctgcagaccccagtcctccgggctaagcagaacagaggagactgcttatgccggaggacaacctggcggcagcgcaaaagatg

SEQ ID NO: 93332 - DNA, 103 bp, Artificial Sequence
  Synthetic Polynucleotide
taatacgactcactatagggccgggtgggcagggctttgcctgaggagccaacagaggagaggctccatgggcaaagccaacctggcggcagcgcaaaagatg

SEQ ID NO: 93333 - DNA, 103 bp, Artificial Sequence
  Synthetic Polynucleotide
taatacgactcactataggggtggcggcttccgggtgggcagggctttgcaacagaggagagcaaagatgtgcccacccaacctggcggcagcgcaaaagatg

SEQ ID NO: 93334 - DNA, 103 bp, Artificial Sequence
  Synthetic Polynucleotide
taatacgactcactatagggttgggctgcagtggcggcttccgggtgggcaacagaggagagcccacatggaagccgccaacctggcggcagcgcaaaagatg

SEQ ID NO: 93335 - DNA, 103 bp, Artificial Sequence
  Synthetic Polynucleotide
taatacgactcactatagggcactacaggtttgggctgcagtggcggcttaacagaggagaaagccgatgctgcagcccaacctggcggcagcgcaaaagatg

SEQ ID NO: 93336 - DNA, 103 bp, Artificial Sequence
  Synthetic Polynucleotide
taatacgactcactatagggcagtggttagcactacaggtttgggctgcaaacagaggagatgcagcatgaacctgtagaacctggcggcagcgcaaaagatg

SEQ ID NO: 93337 - DNA, 103 bp, Artificial Sequence
  Synthetic Polynucleotide
taatacgactcactatagggggcattgggacagtggttagcactacaggtaacagaggagaacctgtatggctaaccacaacctggcggcagcgcaaaagatg

SEQ ID NO: 93338 - DNA, 103 bp, Artificial Sequence
  Synthetic Polynucleotide
taatacgactcactatagggagctctggatggcattgggacagtggttagaacagaggagactaaccatggtcccaatgaacctggcggcagcgcaaaagatg

SEQ ID NO: 93339 - DNA, 103 bp, Artificial Sequence
  Synthetic Polynucleotide
taatacgactcactatagggtgggaggcacagctctggatggcattgggaaacagaggagatcccaaatgcatccagagaacctggcggcagcgcaaaagatg

SEQ ID NO: 93340 - DNA, 103 bp, Artificial Sequence
  Synthetic Polynucleotide
taatacgactcactatagggactgtggtgctgggaggcacagctctggataacagaggagaatccagatgtgtgcctccaacctggcggcagcgcaaaagatg

SEQ ID NO: 93341 - DNA, 103 bp, Artificial Sequence
  Synthetic Polynucleotide
taatacgactcactatagggctgcagaaggactgtggtgctgggaggcacaacagaggagagtgcctatgagcaccacaaacctggcggcagcgcaaaagatg

SEQ ID NO: 93342 - DNA, 103 bp, Artificial Sequence
  Synthetic Polynucleotide
taatacgactcactatagggaggtgctgttctgcagaccccagtcctccgaacagaggagacggaggatgggggtctgcaacctggcggcagcgcaaaagatg

SEQ ID NO: 93343 - DNA, 103 bp, Artificial Sequence
  Synthetic Polynucleotide
taatacgactcactatagggggacgagggactgcagaaggactgtggtgcaacagaggagagcaccaatgtccttctgcaacctggcggcagcgcaaaagatg

SEQ ID NO: 93344 - DNA, 103 bp, Artificial Sequence
  Synthetic Polynucleotide
taatacgactcactataggggggggtggctggacgagggactgcagaaggaacagaggagaccttctatggtccctcgtaacctggcggcagcgcaaaagatg

SEQ ID NO: 93345 - DNA, 103 bp, Artificial Sequence
  Synthetic Polynucleotide
taatacgactcactatagggtggggacactgggggtggctggacgagggaaacagaggagatccctcatgcagccacccaacctggcggcagcgcaaaagatg

SEQ ID NO: 93346 - DNA, 103 bp, Artificial Sequence
  Synthetic Polynucleotide
taatacgactcactatagggtgaggacaactggggacactgggggtggctaacagaggagaagccacatgcagtgtcccaacctggcggcagcgcaaaagatg

SEQ ID NO: 93347 - DNA, 103 bp, Artificial Sequence
  Synthetic Polynucleotide
taatacgactcactataggggcaccctggatgaggacaactggggacactaacagaggagaagtgtcatgagttgtcctaacctggcggcagcgcaaaagatg

SEQ ID NO: 93348 - DNA, 103 bp, Artificial Sequence
  Synthetic Polynucleotide
taatacgactcactataggggactcgaatagcaccctggatgaggacaacaacagaggagagttgtcatgatccagggtaacctggcggcagcgcaaaagatg

SEQ ID NO: 93349 - DNA, 103 bp, Artificial Sequence
  Synthetic Polynucleotide
taatacgactcactatagggcttcaggctggactcgaatagcaccctggaaacagaggagatccaggatgctattcgagaacctggcggcagcgcaaaagatg

SEQ ID NO: 93350 - DNA, 103 bp, Artificial Sequence
  Synthetic Polynucleotide
taatacgactcactatagggggagccggcccttcaggctggactcgaataaacagaggagatattcgatgccagcctgaaacctggcggcagcgcaaaagatg

SEQ ID NO: 93351 - DNA, 103 bp, Artificial Sequence
  Synthetic Polynucleotide
taatacgactcactatagggtggtagagagggagccggcccttcaggctgaacagaggagacagcctatggggccggctaacctggcggcagcgcaaaagatg

SEQ ID NO: 93352 - DNA, 103 bp, Artificial Sequence
  Synthetic Polynucleotide
taatacgactcactatagggtctcaggccgtggtagagagggagccggccaacagaggagaggccggatgcctctctacaacctggcggcagcgcaaaagatg

SEQ ID NO: 93353 - DNA, 103 bp, Artificial Sequence
  Synthetic Polynucleotide
taatacgactcactatagggccagaatacaaggtgctgttctgcagacccaacagaggagagggtctatggaacagcacaacctggcggcagcgcaaaagatg

SEQ ID NO: 93354 - DNA, 103 bp, Artificial Sequence
  Synthetic Polynucleotide
taatacgactcactatagggatgctcttcctctcaggccgtggtagagagaacagaggagactctctatgacggcctgaaacctggcggcagcgcaaaagatg

SEQ ID NO: 93355 - DNA, 103 bp, Artificial Sequence
  Synthetic Polynucleotide
taatacgactcactatagggagcgggaacgatgctcttcctctcaggccgaacagaggagacggcctatgaggaagagcaacctggcggcagcgcaaaagatg

SEQ ID NO: 93356 - DNA, 103 bp, Artificial Sequence
  Synthetic Polynucleotide
taatacgactcactatagggcaggcataggagcgggaacgatgctcttccaacagaggagaggaagaatgtcgttcccgaacctggcggcagcgcaaaagatg

SEQ ID NO: 93357 - DNA, 103 bp, Artificial Sequence
  Synthetic Polynucleotide
taatacgactcactatagggcaggagtttccaggcataggagcgggaacgaacagaggagacgttccatgtcctatgccaacctggcggcagcgcaaaagatg

SEQ ID NO: 93358 - DNA, 103 bp, Artificial Sequence
  Synthetic Polynucleotide
taatacgactcactatagggttcaggcgggcaggagtttccaggcataggaacagaggagacctatgatgggaaactccaacctggcggcagcgcaaaagatg

SEQ ID NO: 93359 - DNA, 103 bp, Artificial Sequence
  Synthetic Polynucleotide
taatacgactcactatagggttgcatccacttcaggcgggcaggagtttcaacagaggagagaaactatggcccgcctgaacctggcggcagcgcaaaagatg

SEQ ID NO: 93360 - DNA, 103 bp, Artificial Sequence
  Synthetic Polynucleotide
taatacgactcactatagggttcagcagctttgcatccacttcaggcgggaacagaggagacccgccatgagtggatgcaacctggcggcagcgcaaaagatg

SEQ ID NO: 93361 - DNA, 103 bp, Artificial Sequence
  Synthetic Polynucleotide
taatacgactcactatagggctgctgccgcttcagcagctttgcatccacaacagaggagagtggatatgaagctgctgaacctggcggcagcgcaaaagatg

SEQ ID NO: 93362 - DNA, 103 bp, Artificial Sequence
  Synthetic Polynucleotide
taatacgactcactatagggtgatcattcgctgctgccgcttcagcagctaacagaggagaagctgcatgagcggcagcaacctggcggcagcgcaaaagatg

SEQ ID NO: 93363 - DNA, 103 bp, Artificial Sequence
  Synthetic Polynucleotide
taatacgactcactatagggtcccggttcttgatcattcgctgctgccgcaacagaggagagcggcaatggcgaatgataacctggcggcagcgcaaaagatg

SEQ ID NO: 93364 - DNA, 103 bp, Artificial Sequence
  Synthetic Polynucleotide
taatacgactcactatagggcgccgccgccgccgcctccgaggccgccataacagaggagaatggcgatgtcggaggcgaacctggcggcagcgcaaaagatg

SEQ ID NO: 93365 - DNA, 103 bp, Artificial Sequence
  Synthetic Polynucleotide
taatacgactcactatagggcgggggcacccacgggcccgaggcggcggcaacagaggagagccgccatgtcgggcccgaacctggcggcagcgcaaaagatg

SEQ ID NO: 93366 - DNA, 103 bp, Artificial Sequence
  Synthetic Polynucleotide
taatacgactcactatagggagcccctgtggcagagccctgatcaacaccaacagaggagaggtgttatgcagggctctaacctggcggcagcgcaaaagatg

SEQ ID NO: 93367 - DNA, 103 bp, Artificial Sequence
  Synthetic Polynucleotide
taatacgactcactatagggttaagtgcacagcccctgtggcagagccctaacagaggagaagggctatgccacaggggaacctggcggcagcgcaaaagatg

SEQ ID NO: 93368 - DNA, 103 bp, Artificial Sequence
  Synthetic Polynucleotide
taatacgactcactataggggacaagggcattaagtgcacagcccctgtgaacagaggagacacaggatgtgtgcacttaacctggcggcagcgcaaaagatg

SEQ ID NO: 93369 - DNA, 103 bp, Artificial Sequence
  Synthetic Polynucleotide
taatacgactcactatagggggttcctactgacaagggcattaagtgcacaacagaggagagtgcacatgatgcccttgaacctggcggcagcgcaaaagatg

SEQ ID NO: 93370 - DNA, 103 bp, Artificial Sequence
  Synthetic Polynucleotide
taatacgactcactatagggcgaggatcagggttcctactgacaagggcaaacagaggagatgccctatgcagtaggaaaacctggcggcagcgcaaaagatg

SEQ ID NO: 93371 - DNA, 103 bp, Artificial Sequence
  Synthetic Polynucleotide
taatacgactcactataggggaatctaggccgaggatcagggttcctactaacagaggagaagtaggatgcctgatcctaacctggcggcagcgcaaaagatg

SEQ ID NO: 93372 - DNA, 103 bp, Artificial Sequence
  Synthetic Polynucleotide
taatacgactcactataggggcaagcctctgaatctaggccgaggatcagaacagaggagactgatcatgggcctagataacctggcggcagcgcaaaagatg

SEQ ID NO: 93373 - DNA, 103 bp, Artificial Sequence
  Synthetic Polynucleotide
taatacgactcactatagggccttaagagagcaagcctctgaatctaggcaacagaggagagcctagatgcagaggcttaacctggcggcagcgcaaaagatg

SEQ ID NO: 93374 - DNA, 103 bp, Artificial Sequence
  Synthetic Polynucleotide
taatacgactcactatagggggtaggctctccttaagagagcaagcctctaacagaggagaagaggcatgctctcttaaaacctggcggcagcgcaaaagatg

SEQ ID NO: 93375 - DNA, 103 bp, Artificial Sequence
  Synthetic Polynucleotide
taatacgactcactatagggtttgaaaagaggtaggctctccttaagagaaacagaggagatctcttatggagagcctaaacctggcggcagcgcaaaagatg

SEQ ID NO: 93376 - DNA, 103 bp, Artificial Sequence
  Synthetic Polynucleotide
taatacgactcactataggggtcggggtcccgggggcacccacgggcccgaacagaggagacgggccatggggtgccccaacctggcggcagcgcaaaagatg

SEQ ID NO: 93377 - DNA, 103 bp, Artificial Sequence
  Synthetic Polynucleotide
taatacgactcactataggggattagcaattttgaaaagaggtaggctctaacagaggagaagagccatgctcttttcaaacctggcggcagcgcaaaagatg

SEQ ID NO: 93378 - DNA, 103 bp, Artificial Sequence
  Synthetic Polynucleotide
taatacgactcactatagggccagcaataggattagcaattttgaaaagaaacagaggagatcttttatgaattgctaaaacctggcggcagcgcaaaagatg

SEQ ID NO: 93379 - DNA, 103 bp, Artificial Sequence
  Synthetic Polynucleotide
taatacgactcactatagggtattggctcaccagcaataggattagcaataacagaggagaattgctatgcctattgctaacctggcggcagcgcaaaagatg

SEQ ID NO: 93380 - DNA, 103 bp, Artificial Sequence
  Synthetic Polynucleotide
taatacgactcactatagggcaccagtacttattggctcaccagcaatagaacagaggagactattgatggtgagccaaaacctggcggcagcgcaaaagatg

SEQ ID NO: 93381 - DNA, 103 bp, Artificial Sequence
  Synthetic Polynucleotide
taatacgactcactatagggttcacttgaacaccagtacttattggctcaaacagaggagatgagccatgaagtactggaacctggcggcagcgcaaaagatg

SEQ ID NO: 93382 - DNA, 103 bp, Artificial Sequence
  Synthetic Polynucleotide
taatacgactcactatagggtttaccaaagttcacttgaacaccagtactaacagaggagaagtactatggttcaagtgaacctggcggcagcgcaaaagatg

SEQ ID NO: 93383 - DNA, 103 bp, Artificial Sequence
  Synthetic Polynucleotide
taatacgactcactatagggtagatggacttttaccaaagttcacttgaaaacagaggagattcaagatgactttggtaaacctggcggcagcgcaaaagatg

SEQ ID NO: 93384 - DNA, 103 bp, Artificial Sequence
  Synthetic Polynucleotide
taatacgactcactatagggtgtaaaggattagatggacttttaccaaagaacagaggagactttggatgaagtccatcaacctggcggcagcgcaaaagatg

SEQ ID NO: 93385 - DNA, 103 bp, Artificial Sequence
  Synthetic Polynucleotide
taatacgactcactatagggccctagttcttgtaaaggattagatggactaacagaggagaagtccaatgaatcctttaaacctggcggcagcgcaaaagatg

SEQ ID NO: 93386 - DNA, 103 bp, Artificial Sequence
  Synthetic Polynucleotide
taatacgactcactataggggacacgtgttccctagttcttgtaaaggataacagaggagaatccttatgaagaactagaacctggcggcagcgcaaaagatg

SEQ ID NO: 93387 - DNA, 103 bp, Artificial Sequence
  Synthetic Polynucleotide
taatacgactcactatagggctgcccctcagtcggggtcccgggggcaccaacagaggagaggtgccatggggaccccgaacctggcggcagcgcaaaagatg

SEQ ID NO: 93388 - DNA, 103 bp, Artificial Sequence
  Synthetic Polynucleotide
taatacgactcactatagggctattcttttgacacgtgttccctagttctaacagaggagaagaactatggaacacgtgaacctggcggcagcgcaaaagatg

SEQ ID NO: 93389 - DNA, 103 bp, Artificial Sequence
  Synthetic Polynucleotide
taatacgactcactatagggtgaagaaatgctattcttttgacacgtgttaacagaggagaaacacgatgcaaaagaataacctggcggcagcgcaaaagatg

SEQ ID NO: 93390 - DNA, 103 bp, Artificial Sequence
  Synthetic Polynucleotide
taatacgactcactataggggcacgttgattgaagaaatgctattcttttaacagaggagaaaaagaatggcatttcttaacctggcggcagcgcaaaagatg

SEQ ID NO: 93391 - DNA, 103 bp, Artificial Sequence
  Synthetic Polynucleotide
taatacgactcactatagggagatctgtctgcacgttgattgaagaaatgaacagaggagacatttcatgaatcaacgtaacctggcggcagcgcaaaagatg

SEQ ID NO: 93392 - DNA, 103 bp, Artificial Sequence
  Synthetic Polynucleotide
taatacgactcactatagggggcataagacagatctgtctgcacgttgataacagaggagaatcaacatgcagacagataacctggcggcagcgcaaaagatg

SEQ ID NO: 93393 - DNA, 103 bp, Artificial Sequence
  Synthetic Polynucleotide
taatacgactcactatagggagttttgtgaggcataagacagatctgtctaacagaggagaagacagatgtgtcttatgaacctggcggcagcgcaaaagatg

SEQ ID NO: 93394 - DNA, 103 bp, Artificial Sequence
  Synthetic Polynucleotide
taatacgactcactataggggaaggtataaagttttgtgaggcataagacaacagaggagagtcttaatgctcacaaaaaacctggcggcagcgcaaaagatg

SEQ ID NO: 93395 - DNA, 103 bp, Artificial Sequence
  Synthetic Polynucleotide
taatacgactcactatagggccactgtgcagaaggtataaagttttgtgaaacagaggagatcacaaatgtttatacctaacctggcggcagcgcaaaagatg

SEQ ID NO: 93396 - DNA, 103 bp, Artificial Sequence
  Synthetic Polynucleotide
taatacgactcactatagggcagcagtggcccactgtgcagaaggtataaaacagaggagattatacatgctgcacagtaacctggcggcagcgcaaaagatg

SEQ ID NO: 93397 - DNA, 103 bp, Artificial Sequence
  Synthetic Polynucleotide
taatacgactcactatagggacagaggaatcagcagtggcccactgtgcaaacagaggagatgcacaatgggccactgcaacctggcggcagcgcaaaagatg

SEQ ID NO: 93398 - DNA, 103 bp, Artificial Sequence
  Synthetic Polynucleotide
taatacgactcactatagggccgcggccggctgcccctcagtcggggtccaacagaggagaggacccatgctgaggggcaacctggcggcagcgcaaaagatg

SEQ ID NO: 93399 - DNA, 103 bp, Artificial Sequence
  Synthetic Polynucleotide
taatacgactcactatagggacaagacgacacagaggaatcagcagtggcaacagaggagagccactatggattcctctaacctggcggcagcgcaaaagatg

SEQ ID NO: 93400 - DNA, 103 bp, Artificial Sequence
  Synthetic Polynucleotide
taatacgactcactatagggcagtttgagaacaagacgacacagaggaataacagaggagaattcctatgtgtcgtcttaacctggcggcagcgcaaaagatg

SEQ ID NO: 93401 - DNA, 103 bp, Artificial Sequence
  Synthetic Polynucleotide
taatacgactcactatagggaacgacaaatcagtttgagaacaagacgacaacagaggagagtcgtcatgttctcaaacaacctggcggcagcgcaaaagatg

SEQ ID NO: 93402 - DNA, 103 bp, Artificial Sequence
  Synthetic Polynucleotide
taatacgactcactatagggttgagaatcaaacgacaaatcagtttgagaaacagaggagatctcaaatggatttgtcgaacctggcggcagcgcaaaagatg

SEQ ID NO: 93403 - DNA, 103 bp, Artificial Sequence
  Synthetic Polynucleotide
taatacgactcactataggggaagagacacttgagaatcaaacgacaaataacagaggagaatttgtatgttgattctcaacctggcggcagcgcaaaagatg

SEQ ID NO: 93404 - DNA, 103 bp, Artificial Sequence
  Synthetic Polynucleotide
taatacgactcactatagggacactaatgggaagagacacttgagaatcaaacagaggagatgattcatgagtgtctctaacctggcggcagcgcaaaagatg

SEQ ID NO: 93405 - DNA, 103 bp, Artificial Sequence
  Synthetic Polynucleotide
taatacgactcactatagggctgagtgtgaacactaatgggaagagacacaacagaggagagtgtctatgcccattagtaacctggcggcagcgcaaaagatg

SEQ ID NO: 93406 - DNA, 103 bp, Artificial Sequence
  Synthetic Polynucleotide
taatacgactcactataggggcaaaaatgtctgagtgtgaacactaatggaacagaggagaccattaatgttcacactcaacctggcggcagcgcaaaagatg

SEQ ID NO: 93407 - DNA, 103 bp, Artificial Sequence
  Synthetic Polynucleotide
taatacgactcactatagggttagagctgggcaaaaatgtctgagtgtgaaacagaggagatcacacatggacatttttaacctggcggcagcgcaaaagatg

SEQ ID NO: 93408 - DNA, 103 bp, Artificial Sequence
  Synthetic Polynucleotide
taatacgactcactatagggtgaagttaccttagagctgggcaaaaatgtaacagaggagaacatttatgcccagctctaacctggcggcagcgcaaaagatg

SEQ ID NO: 93409 - DNA, 103 bp, Artificial Sequence
  Synthetic Polynucleotide
taatacgactcactatagggcccccgcgggccgcggccggctgcccctcaaacagaggagatgagggatggccggccgcaacctggcggcagcgcaaaagatg

SEQ ID NO: 93410 - DNA, 103 bp, Artificial Sequence
  Synthetic Polynucleotide
taatacgactcactatagggcagctatagatgaagttaccttagagctggaacagaggagaccagctatgaggtaacttaacctggcggcagcgcaaaagatg

SEQ ID NO: 93411 - DNA, 103 bp, Artificial Sequence
  Synthetic Polynucleotide
taatacgactcactatagggtcagtctgagcagctatagatgaagttaccaacagaggagaggtaacatgatctatagcaacctggcggcagcgcaaaagatg

SEQ ID NO: 93412 - DNA, 103 bp, Artificial Sequence
  Synthetic Polynucleotide
taatacgactcactatagggcataaatgcatcagtctgagcagctatagaaacagaggagatctataatggctcagactaacctggcggcagcgcaaaagatg

SEQ ID NO: 93413 - DNA, 103 bp, Artificial Sequence
  Synthetic Polynucleotide
taatacgactcactatagggaacaggtgtccataaatgcatcagtctgagaacagaggagactcagaatgatgcatttaaacctggcggcagcgcaaaagatg

SEQ ID NO: 93414 - DNA, 103 bp, Artificial Sequence
  Synthetic Polynucleotide
taatacgactcactatagggcctgactggaaacaggtgtccataaatgcaaacagaggagatgcattatgggacacctgaacctggcggcagcgcaaaagatg

SEQ ID NO: 93415 - DNA, 103 bp, Artificial Sequence
  Synthetic Polynucleotide
taatacgactcactatagggggagaccccacctgactggaaacaggtgtcaacagaggagagacaccatgttccagtcaaacctggcggcagcgcaaaagatg

SEQ ID NO: 93416 - DNA, 103 bp, Artificial Sequence
  Synthetic Polynucleotide
taatacgactcactataggggagtttctctggagaccccacctgactggaaacagaggagatccagtatggtggggtctaacctggcggcagcgcaaaagatg

SEQ ID NO: 93417 - DNA, 103 bp, Artificial Sequence
  Synthetic Polynucleotide
taatacgactcactatagggccactggtttgagtttctctggagaccccaaacagaggagatggggtatgcagagaaacaacctggcggcagcgcaaaagatg

SEQ ID NO: 93418 - DNA, 103 bp, Artificial Sequence
  Synthetic Polynucleotide
taatacgactcactatagggactttctatcccactggtttgagtttctctaacagaggagaagagaaatgcaaaccagtaacctggcggcagcgcaaaagatg

SEQ ID NO: 93419 - DNA, 103 bp, Artificial Sequence
  Synthetic Polynucleotide
taatacgactcactatagggcatccgttggactttctatcccactggtttaacagaggagaaaaccaatgggatagaaaaacctggcggcagcgcaaaagatg

SEQ ID NO: 93420 - DNA, 103 bp, Artificial Sequence
  Synthetic Polynucleotide
taatacgactcactatagggtgctgcgtcgcccccgcgggccgcggccggaacagaggagaccggccatggcccgcgggaacctggcggcagcgcaaaagatg

SEQ ID NO: 93421 - DNA, 103 bp, Artificial Sequence
  Synthetic Polynucleotide
taatacgactcactatagggtgtacatggtcatccgttggactttctatcaacagaggagagatagaatgtccaacggaaacctggcggcagcgcaaaagatg

SEQ ID NO: 93422 - DNA, 103 bp, Artificial Sequence
  Synthetic Polynucleotide
taatacgactcactatagggttggtccatctgtacatggtcatccgttggaacagaggagaccaacgatggaccatgtaaacctggcggcagcgcaaaagatg

SEQ ID NO: 93423 - DNA, 103 bp, Artificial Sequence
  Synthetic Polynucleotide
taatacgactcactatagggacattccagcttggtccatctgtacatggtaacagaggagaaccatgatgagatggaccaacctggcggcagcgcaaaagatg

SEQ ID NO: 93424 - DNA, 103 bp, Artificial Sequence
  Synthetic Polynucleotide
taatacgactcactatagggatgtctccgcacattccagcttggtccatcaacagaggagagatggaatgagctggaataacctggcggcagcgcaaaagatg

SEQ ID NO: 93425 - DNA, 103 bp, Artificial Sequence
  Synthetic Polynucleotide
taatacgactcactatagggactctcaaaaatgtctccgcacattccagcaacagaggagagctggaatgtgcggagacaacctggcggcagcgcaaaagatg

SEQ ID NO: 93426 - DNA, 103 bp, Artificial Sequence
  Synthetic Polynucleotide
taatacgactcactatagggatgaatgaacactctcaaaaatgtctccgcaacagaggagagcggagatgtttttgagaaacctggcggcagcgcaaaagatg

SEQ ID NO: 93427 - DNA, 103 bp, Artificial Sequence
  Synthetic Polynucleotide
taatacgactcactatagggacattatatgatgaatgaacactctcaaaaaacagaggagattttgaatgtgttcattcaacctggcggcagcgcaaaagatg

SEQ ID NO: 93428 - DNA, 103 bp, Artificial Sequence
  Synthetic Polynucleotide
taatacgactcactatagggacctgtagcaacattatatgatgaatgaacaacagaggagagttcatatgtcatataataacctggcggcagcgcaaaagatg

SEQ ID NO: 93429 - DNA, 103 bp, Artificial Sequence
  Synthetic Polynucleotide
taatacgactcactatagggttataatgttacctgtagcaacattatatgaacagaggagacatataatgttgctacagaacctggcggcagcgcaaaagatg

SEQ ID NO: 93430 - DNA, 103 bp, Artificial Sequence
  Synthetic Polynucleotide
taatacgactcactatagggaaactgttgcttataatgttacctgtagcaaacagaggagatgctacatgtaacattataacctggcggcagcgcaaaagatg

SEQ ID NO: 93431 - DNA, 103 bp, Artificial Sequence
  Synthetic Polynucleotide
taatacgactcactataggggacagcgggctgctgcgtcgcccccgcgggaacagaggagacccgcgatggcgacgcagaacctggcggcagcgcaaaagatg

SEQ ID NO: 93432 - DNA, 103 bp, Artificial Sequence
  Synthetic Polynucleotide
taatacgactcactatagggctctgctactaaactgttgcttataatgttaacagaggagaaacattatgagcaacagtaacctggcggcagcgcaaaagatg

SEQ ID NO: 93433 - DNA, 103 bp, Artificial Sequence
  Synthetic Polynucleotide
taatacgactcactataggggagttactgtctctgctactaaactgttgcaacagaggagagcaacaatgtagtagcagaacctggcggcagcgcaaaagatg

SEQ ID NO: 93434 - DNA, 103 bp, Artificial Sequence
  Synthetic Polynucleotide
taatacgactcactatagggaacaaactatgagttactgtctctgctactaacagaggagaagtagcatggacagtaacaacctggcggcagcgcaaaagatg

SEQ ID NO: 93435 - DNA, 103 bp, Artificial Sequence
  Synthetic Polynucleotide
taatacgactcactatagggattctgaggtaacaaactatgagttactgtaacagaggagaacagtaatgcatagtttgaacctggcggcagcgcaaaagatg

SEQ ID NO: 93436 - DNA, 103 bp, Artificial Sequence
  Synthetic Polynucleotide
taatacgactcactatagggtcttaggctcattctgaggtaacaaactataacagaggagaatagttatgtacctcagaaacctggcggcagcgcaaaagatg

SEQ ID NO: 93437 - DNA, 103 bp, Artificial Sequence
  Synthetic Polynucleotide
taatacgactcactatagggtgatttaaagtcttaggctcattctgaggtaacagaggagaacctcaatgtgagcctaaaacctggcggcagcgcaaaagatg

SEQ ID NO: 93438 - DNA, 103 bp, Artificial Sequence
  Synthetic Polynucleotide
taatacgactcactatagggctcaatatcttgatttaaagtcttaggctcaacagaggagagagcctatgactttaaataacctggcggcagcgcaaaagatg

SEQ ID NO: 93439 - DNA, 103 bp, Artificial Sequence
  Synthetic Polynucleotide
taatacgactcactataggggtgcagatttctcaatatcttgatttaaagaacagaggagactttaaatgaagatattgaacctggcggcagcgcaaaagatg

SEQ ID NO: 93440 - DNA, 103 bp, Artificial Sequence
  Synthetic Polynucleotide
taatacgactcactatagggtttataattggtgcagatttctcaatatctaacagaggagaagatatatggaaatctgcaacctggcggcagcgcaaaagatg

SEQ ID NO: 93441 - DNA, 103 bp, Artificial Sequence
  Synthetic Polynucleotide
taatacgactcactatagggtgcactgaaatttataattggtgcagatttaacagaggagaaaatctatgccaattataaacctggcggcagcgcaaaagatg

SEQ ID NO: 93442 - DNA, 103 bp, Artificial Sequence
  Synthetic Polynucleotide
taatacgactcactataggggcggcgcggggacagcgggctgctgcgtcgaacagaggagacgacgcatgagcccgctgaacctggcggcagcgcaaaagatg

SEQ ID NO: 93443 - DNA, 103 bp, Artificial Sequence
  Synthetic Polynucleotide
taatacgactcactatagggtactattctgtgcactgaaatttataattgaacagaggagacaattaatgatttcagtgaacctggcggcagcgcaaaagatg

SEQ ID NO: 93444 - DNA, 103 bp, Artificial Sequence
  Synthetic Polynucleotide
taatacgactcactataggggaaggaagcatactattctgtgcactgaaaaacagaggagatttcagatgacagaatagaacctggcggcagcgcaaaagatg

SEQ ID NO: 93445 - DNA, 103 bp, Artificial Sequence
  Synthetic Polynucleotide
taatacgactcactatagggcatgttctgtgaaggaagcatactattctgaacagaggagacagaatatgatgcttcctaacctggcggcagcgcaaaagatg

SEQ ID NO: 93446 - DNA, 103 bp, Artificial Sequence
  Synthetic Polynucleotide
taatacgactcactataggggattatctgtcatgttctgtgaaggaagcaaacagaggagatgcttcatgcacagaacaaacctggcggcagcgcaaaagatg

SEQ ID NO: 93447 - DNA, 103 bp, Artificial Sequence
  Synthetic Polynucleotide
taatacgactcactataggggtttgggtctgattatctgtcatgttctgtaacagaggagaacagaaatggacagataaaacctggcggcagcgcaaaagatg

SEQ ID NO: 93448 - DNA, 103 bp, Artificial Sequence
  Synthetic Polynucleotide
taatacgactcactatagggtaaatctatggtttgggtctgattatctgtaacagaggagaacagatatgcagacccaaaacctggcggcagcgcaaaagatg

SEQ ID NO: 93449 - DNA, 103 bp, Artificial Sequence
  Synthetic Polynucleotide
taatacgactcactatagggaatcacttaataaatctatggtttgggtctaacagaggagaagacccatgccatagattaacctggcggcagcgcaaaagatg

SEQ ID NO: 93450 - DNA, 103 bp, Artificial Sequence
  Synthetic Polynucleotide
taatacgactcactatagggatgttttccaaatcacttaataaatctatgaacagaggagacatagaatgattaagtgaaacctggcggcagcgcaaaagatg

SEQ ID NO: 93451 - DNA, 103 bp, Artificial Sequence
  Synthetic Polynucleotide
taatacgactcactatagggacttgacaagatgttttccaaatcacttaaaacagaggagattaagtatgttggaaaacaacctggcggcagcgcaaaagatg

SEQ ID NO: 93452 - DNA, 103 bp, Artificial Sequence
  Synthetic Polynucleotide
taatacgactcactatagggcaggcagattacttgacaagatgttttccaaacagaggagatggaaaatgtcttgtcaaaacctggcggcagcgcaaaagatg

SEQ ID NO: 93453 - DNA, 103 bp, Artificial Sequence
  Synthetic Polynucleotide
taatacgactcactatagggtcccccgccggcggcgcggggacagcgggcaacagaggagagcccgcatgccccgcgccaacctggcggcagcgcaaaagatg

SEQ ID NO: 93454 - DNA, 103 bp, Artificial Sequence
  Synthetic Polynucleotide
taatacgactcactatagggaatgtctgagcaggcagattacttgacaagaacagaggagacttgtcatgtaatctgccaacctggcggcagcgcaaaagatg

SEQ ID NO: 93455 - DNA, 103 bp, Artificial Sequence
  Synthetic Polynucleotide
taatacgactcactatagggacgatgatccaatgtctgagcaggcagattaacagaggagaaatctgatggctcagacaaacctggcggcagcgcaaaagatg

SEQ ID NO: 93456 - DNA, 103 bp, Artificial Sequence
  Synthetic Polynucleotide
taatacgactcactatagggacaaaagactacgatgatccaatgtctgagaacagaggagactcagaatgtggatcatcaacctggcggcagcgcaaaagatg

SEQ ID NO: 93457 - DNA, 103 bp, Artificial Sequence
  Synthetic Polynucleotide
taatacgactcactatagggtttgtgtcagacaaaagactacgatgatccaacagaggagaggatcaatgtagtcttttaacctggcggcagcgcaaaagatg

SEQ ID NO: 93458 - DNA, 103 bp, Artificial Sequence
  Synthetic Polynucleotide
taatacgactcactatagggaggtccaggatttgtgtcagacaaaagactaacagaggagaagtcttatgtctgacacaaacctggcggcagcgcaaaagatg

SEQ ID NO: 93459 - DNA, 103 bp, Artificial Sequence
  Synthetic Polynucleotide
taatacgactcactataggggctgggtgtcaggtccaggatttgtgtcagaacagaggagactgacaatgatcctggacaacctggcggcagcgcaaaagatg

SEQ ID NO: 93460 - DNA, 103 bp, Artificial Sequence
  Synthetic Polynucleotide
taatacgactcactatagggccagatgggagctgggtgtcaggtccaggaaacagaggagatcctggatgtgacacccaaacctggcggcagcgcaaaagatg

SEQ ID NO: 93461 - DNA, 103 bp, Artificial Sequence
  Synthetic Polynucleotide
taatacgactcactatagggctgggctgggccagatgggagctgggtgtcaacagaggagagacaccatgctcccatctaacctggcggcagcgcaaaagatg

SEQ ID NO: 93462 - DNA, 103 bp, Artificial Sequence
  Synthetic Polynucleotide
taatacgactcactatagggttccggggttctgggctgggccagatgggaaacagaggagatcccatatggcccagcccaacctggcggcagcgcaaaagatg

SEQ ID NO: 93463 - DNA, 103 bp, Artificial Sequence
  Synthetic Polynucleotide
taatacgactcactatagggtcaaaatcgattccggggttctgggctgggaacagaggagacccagcatggaaccccggaacctggcggcagcgcaaaagatg

SEQ ID NO: 93464 - DNA, 103 bp, Artificial Sequence
  Synthetic Polynucleotide
taatacgactcactatagggctggatcagctcccccgccggcggcgcgggaacagaggagacccgcgatgccggcggggaacctggcggcagcgcaaaagatg

SEQ ID NO: 93465 - DNA, 103 bp, Artificial Sequence
  Synthetic Polynucleotide
taatacgactcactatagggctcttcgatatcaaaatcgattccggggttaacagaggagaaaccccatgatcgattttaacctggcggcagcgcaaaagatg

SEQ ID NO: 93466 - DNA, 103 bp, Artificial Sequence
  Synthetic Polynucleotide
taatacgactcactatagggccgaaaagaactcttcgatatcaaaatcgaaacagaggagatcgattatgatatcgaagaacctggcggcagcgcaaaagatg

SEQ ID NO: 93467 - DNA, 103 bp, Artificial Sequence
  Synthetic Polynucleotide
taatacgactcactatagggatatttgaggccgaaaagaactcttcgataaacagaggagatatcgaatggttcttttcaacctggcggcagcgcaaaagatg

SEQ ID NO: 93468 - DNA, 103 bp, Artificial Sequence
  Synthetic Polynucleotide
taatacgactcactatagggttgagtctggatatttgaggccgaaaagaaaacagaggagattctttatggcctcaaataacctggcggcagcgcaaaagatg

SEQ ID NO: 93469 - DNA, 103 bp, Artificial Sequence
  Synthetic Polynucleotide
taatacgactcactatagggtctcttcagtttgagtctggatatttgaggaacagaggagacctcaaatgtccagactcaacctggcggcagcgcaaaagatg

SEQ ID NO: 93470 - DNA, 103 bp, Artificial Sequence
  Synthetic Polynucleotide
taatacgactcactatagggctaagttcactctcttcagtttgagtctggaacagaggagaccagacatgaactgaagaaacctggcggcagcgcaaaagatg

SEQ ID NO: 93471 - DNA, 103 bp, Artificial Sequence
  Synthetic Polynucleotide
taatacgactcactatagggggtcatggtgctaagttcactctcttcagtaacagaggagaactgaaatgagtgaacttaacctggcggcagcgcaaaagatg

SEQ ID NO: 93472 - DNA, 103 bp, Artificial Sequence
  Synthetic Polynucleotide
taatacgactcactatagggctggctcggtggtcatggtgctaagttcacaacagaggagagtgaacatggcaccatgaaacctggcggcagcgcaaaagatg

SEQ ID NO: 93473 - DNA, 103 bp, Artificial Sequence
  Synthetic Polynucleotide
taatacgactcactataggggactccaagactggctcggtggtcatggtgaacagaggagacaccatatgcaccgagccaacctggcggcagcgcaaaagatg

SEQ ID NO: 93474 - DNA, 103 bp, Artificial Sequence
  Synthetic Polynucleotide
taatacgactcactatagggtatgtccagtgactccaagactggctcggtaacagaggagaaccgagatggtcttggagaacctggcggcagcgcaaaagatg

SEQ ID NO: 93475 - DNA, 103 bp, Artificial Sequence
  Synthetic Polynucleotide
taatacgactcactatagggccgcggaccccgccgccgccgccgcctccgaacagaggagacggaggatgcggcggcggaacctggcggcagcgcaaaagatg

SEQ ID NO: 93476 - DNA, 103 bp, Artificial Sequence
  Synthetic Polynucleotide
taatacgactcactatagggtcaccgacggctggatcagctcccccgccgaacagaggagacggcggatgagctgatccaacctggcggcagcgcaaaagatg

SEQ ID NO: 93477 - DNA, 103 bp, Artificial Sequence
  Synthetic Polynucleotide
taatacgactcactatagggtttgagtctctatgtccagtgactccaagaaacagaggagatcttggatgcactggacaaacctggcggcagcgcaaaagatg

SEQ ID NO: 93478 - DNA, 103 bp, Artificial Sequence
  Synthetic Polynucleotide
taatacgactcactatagggaagaagtccgtttgagtctctatgtccagtaacagaggagaactggaatgagagactcaaacctggcggcagcgcaaaagatg

SEQ ID NO: 93479 - DNA, 103 bp, Artificial Sequence
  Synthetic Polynucleotide
taatacgactcactatagggatctgcgagtaagaagtccgtttgagtctcaacagaggagagagactatgacggacttcaacctggcggcagcgcaaaagatg

SEQ ID NO: 93480 - DNA, 103 bp, Artificial Sequence
  Synthetic Polynucleotide
taatacgactcactataggggagcagaggtatctgcgagtaagaagtccgaacagaggagacggactatgtactcgcagaacctggcggcagcgcaaaagatg

SEQ ID NO: 93481 - DNA, 103 bp, Artificial Sequence
  Synthetic Polynucleotide
taatacgactcactatagggccataggactgagcagaggtatctgcgagtaacagaggagaactcgcatgtacctctgcaacctggcggcagcgcaaaagatg

SEQ ID NO: 93482 - DNA, 103 bp, Artificial Sequence
  Synthetic Polynucleotide
taatacgactcactatagggtcccctacacccataggactgagcagaggtaacagaggagaacctctatgcagtcctataacctggcggcagcgcaaaagatg

SEQ ID NO: 93483 - DNA, 103 bp, Artificial Sequence
  Synthetic Polynucleotide
taatacgactcactatagggagttagaatttcccctacacccataggactaacagaggagaagtcctatgggtgtagggaacctggcggcagcgcaaaagatg

SEQ ID NO: 93484 - DNA, 103 bp, Artificial Sequence
  Synthetic Polynucleotide
taatacgactcactatagggaggcctaagaagttagaatttcccctacacaacagaggagagtgtagatgaaattctaaaacctggcggcagcgcaaaagatg

SEQ ID NO: 93485 - DNA, 103 bp, Artificial Sequence
  Synthetic Polynucleotide
taatacgactcactatagggaaacatctcaaggcctaagaagttagaattaacagaggagaaattctatgttcttaggcaacctggcggcagcgcaaaagatg

SEQ ID NO: 93486 - DNA, 103 bp, Artificial Sequence
  Synthetic Polynucleotide
taatacgactcactatagggtctgtgtgtcaaacatctcaaggcctaagaaacagaggagatcttagatgttgagatgtaacctggcggcagcgcaaaagatg

SEQ ID NO: 93487 - DNA, 103 bp, Artificial Sequence
  Synthetic Polynucleotide
taatacgactcactataggggacagctcgctcaccgacggctggatcagcaacagaggagagctgatatggccgtcggtaacctggcggcagcgcaaaagatg

SEQ ID NO: 93488 - DNA, 103 bp, Artificial Sequence
  Synthetic Polynucleotide
taatacgactcactatagggtctgtctgtgtctgtgtgtcaaacatctcaaacagaggagatgagatatgtgacacacaaacctggcggcagcgcaaaagatg

SEQ ID NO: 93489 - DNA, 103 bp, Artificial Sequence
  Synthetic Polynucleotide
taatacgactcactatagggaaagtttaagtctgtctgtgtctgtgtgtcaacagaggagagacacaatgacacagacaaacctggcggcagcgcaaaagatg

SEQ ID NO: 93490 - DNA, 103 bp, Artificial Sequence
  Synthetic Polynucleotide
taatacgactcactatagggtgtctaagaaaaagtttaagtctgtctgtgaacagaggagacacagaatgacttaaactaacctggcggcagcgcaaaagatg

SEQ ID NO: 93491 - DNA, 103 bp, Artificial Sequence
  Synthetic Polynucleotide
taatacgactcactatagggtgagggctactgtctaagaaaaagtttaagaacagaggagacttaaaatgtttcttagaaacctggcggcagcgcaaaagatg

SEQ ID NO: 93492 - DNA, 103 bp, Artificial Sequence
  Synthetic Polynucleotide
taatacgactcactatagggcagaggcagatgagggctactgtctaagaaaacagaggagattcttaatgagtagccctaacctggcggcagcgcaaaagatg

SEQ ID NO: 93493 - DNA, 103 bp, Artificial Sequence
  Synthetic Polynucleotide
taatacgactcactataggggaatacttcccagaggcagatgagggctacaacagaggagagtagccatgatctgcctcaacctggcggcagcgcaaaagatg

SEQ ID NO: 93494 - DNA, 103 bp, Artificial Sequence
  Synthetic Polynucleotide
taatacgactcactataggggagtgtttcagaatacttcccagaggcagaaacagaggagatctgccatggggaagtataacctggcggcagcgcaaaagatg

SEQ ID NO: 93495 - DNA, 103 bp, Artificial Sequence
  Synthetic Polynucleotide
taatacgactcactatagggggaaaagctggagtgtttcagaatacttccaacagaggagaggaagtatgctgaaacacaacctggcggcagcgcaaaagatg

SEQ ID NO: 93496 - DNA, 103 bp, Artificial Sequence
  Synthetic Polynucleotide
taatacgactcactatagggcagtactcacggaaaagctggagtgtttcaaacagaggagatgaaacatgccagcttttaacctggcggcagcgcaaaagatg

SEQ ID NO: 93497 - DNA, 103 bp, Artificial Sequence
  Synthetic Polynucleotide
taatacgactcactatagggtcagatgaatcagtactcacggaaaagctgaacagaggagacagcttatgcgtgagtacaacctggcggcagcgcaaaagatg

SEQ ID NO: 93498 - DNA, 103 bp, Artificial Sequence
  Synthetic Polynucleotide
taatacgactcactatagggcacggcccgggacagctcgctcaccgacggaacagaggagaccgtcgatgagcgagctgaacctggcggcagcgcaaaagatg

SEQ ID NO: 93499 - DNA, 103 bp, Artificial Sequence
  Synthetic Polynucleotide
taatacgactcactatagggggtctctgtgtcagatgaatcagtactcacaacagaggagagtgagtatggattcatctaacctggcggcagcgcaaaagatg

SEQ ID NO: 93500 - DNA, 103 bp, Artificial Sequence
  Synthetic Polynucleotide
taatacgactcactatagggcttcagtttgggtctctgtgtcagatgaataacagaggagaattcatatgacacagagaaacctggcggcagcgcaaaagatg

SEQ ID NO: 93501 - DNA, 103 bp, Artificial Sequence
  Synthetic Polynucleotide
taatacgactcactataggggtggagactccttcagtttgggtctctgtgaacagaggagacacagaatgccaaactgaaacctggcggcagcgcaaaagatg

SEQ ID NO: 93502 - DNA, 103 bp, Artificial Sequence
  Synthetic Polynucleotide
taatacgactcactatagggatttttagcagtggagactccttcagtttgaacagaggagacaaactatgggagtctccaacctggcggcagcgcaaaagatg

SEQ ID NO: 93503 - DNA, 103 bp, Artificial Sequence
  Synthetic Polynucleotide
taatacgactcactataggggagcaggtatatttttagcagtggagactcaacagaggagagagtctatgctgctaaaaaacctggcggcagcgcaaaagatg

SEQ ID NO: 93504 - DNA, 103 bp, Artificial Sequence
  Synthetic Polynucleotide
taatacgactcactatagggttgctttctagagcaggtatatttttagcaaacagaggagatgctaaatgtatacctgcaacctggcggcagcgcaaaagatg

SEQ ID NO: 93505 - DNA, 103 bp, Artificial Sequence
  Synthetic Polynucleotide
taatacgactcactatagggcaactgaactttgctttctagagcaggtataacagaggagaatacctatgctagaaagcaacctggcggcagcgcaaaagatg

SEQ ID NO: 93506 - DNA, 103 bp, Artificial Sequence
  Synthetic Polynucleotide
taatacgactcactatagggctgtactgttcaactgaactttgctttctaaacagaggagatagaaaatgaagttcagtaacctggcggcagcgcaaaagatg

SEQ ID NO: 93507 - DNA, 103 bp, Artificial Sequence
  Synthetic Polynucleotide
taatacgactcactataggggtctgtgtttctgtactgttcaactgaactaacagaggagaagttcaatggaacagtacaacctggcggcagcgcaaaagatg

SEQ ID NO: 93508 - DNA, 103 bp, Artificial Sequence
  Synthetic Polynucleotide
taatacgactcactatagggagaactcatggtctgtgtttctgtactgttaacagaggagaaacagtatggaaacacagaacctggcggcagcgcaaaagatg

SEQ ID NO: 93509 - DNA, 103 bp, Artificial Sequence
  Synthetic Polynucleotide
taatacgactcactatagggtgttggtccgcacggcccgggacagctcgcaacagaggagagcgagcatgcccgggccgaacctggcggcagcgcaaaagatg

SEQ ID NO: 93510 - DNA, 103 bp, Artificial Sequence
  Synthetic Polynucleotide
taatacgactcactatagggtttcaaacccagaactcatggtctgtgtttaacagaggagaaaacacatgccatgagttaacctggcggcagcgcaaaagatg

SEQ ID NO: 93511 - DNA, 103 bp, Artificial Sequence
  Synthetic Polynucleotide
taatacgactcactatagggctccccagggtttcaaacccagaactcatgaacagaggagacatgagatgtgggtttgaaacctggcggcagcgcaaaagatg

SEQ ID NO: 93512 - DNA, 103 bp, Artificial Sequence
  Synthetic Polynucleotide
taatacgactcactataggggaagaacaagctccccagggtttcaaacccaacagaggagagggtttatgaccctggggaacctggcggcagcgcaaaagatg

SEQ ID NO: 93513 - DNA, 103 bp, Artificial Sequence
  Synthetic Polynucleotide
taatacgactcactatagggcgttgctggtgaagaacaagctccccagggaacagaggagaccctggatggcttgttctaacctggcggcagcgcaaaagatg

SEQ ID NO: 93514 - DNA, 103 bp, Artificial Sequence
  Synthetic Polynucleotide
taatacgactcactataggggtctgagtttcgttgctggtgaagaacaagaacagaggagacttgttatgcaccagcaaaacctggcggcagcgcaaaagatg

SEQ ID NO: 93515 - DNA, 103 bp, Artificial Sequence
  Synthetic Polynucleotide
taatacgactcactatagggatccattgctgtctgagtttcgttgctggtaacagaggagaaccagcatggaaactcagaacctggcggcagcgcaaaagatg

SEQ ID NO: 93516 - DNA, 103 bp, Artificial Sequence
  Synthetic Polynucleotide
taatacgactcactataggggaagaaagtcatccattgctgtctgagtttaacagaggagaaaactcatgcagcaatggaacctggcggcagcgcaaaagatg

SEQ ID NO: 93517 - DNA, 103 bp, Artificial Sequence
  Synthetic Polynucleotide
taatacgactcactatagggagatcagccagaagaaagtcatccattgctaacagaggagaagcaatatgtgactttctaacctggcggcagcgcaaaagatg

SEQ ID NO: 93518 - DNA, 103 bp, Artificial Sequence
  Synthetic Polynucleotide
taatacgactcactataggggttccaggccagatcagccagaagaaagtcaacagaggagagactttatgctggctgataacctggcggcagcgcaaaagatg

SEQ ID NO: 93519 - DNA, 103 bp, Artificial Sequence
  Synthetic Polynucleotide
taatacgactcactatagggactccatcgtgttccaggccagatcagccaaacagaggagatggctgatgtggcctggaaacctggcggcagcgcaaaagatg

SEQ ID NO: 93520 - DNA, 103 bp, Artificial Sequence
  Synthetic Polynucleotide
taatacgactcactataggggtgcacaggatgttggtccgcacggcccggaacagaggagaccgggcatggcggaccaaaacctggcggcagcgcaaaagatg

SEQ ID NO: 93521 - DNA, 103 bp, Artificial Sequence
  Synthetic Polynucleotide
taatacgactcactatagggctgaactgagactccatcgtgttccaggccaacagaggagaggcctgatgcacgatggaaacctggcggcagcgcaaaagatg

SEQ ID NO: 93522 - DNA, 103 bp, Artificial Sequence
  Synthetic Polynucleotide
taatacgactcactatagggttctacagagctgaactgagactccatcgtaacagaggagaacgatgatgtctcagttcaacctggcggcagcgcaaaagatg

SEQ ID NO: 93523 - DNA, 103 bp, Artificial Sequence
  Synthetic Polynucleotide
taatacgactcactatagggaagtctgggtttctacagagctgaactgagaacagaggagactcagtatggctctgtagaacctggcggcagcgcaaaagatg

SEQ ID NO: 93524 - DNA, 103 bp, Artificial Sequence
  Synthetic Polynucleotide
taatacgactcactatagggggttccgcagaagtctgggtttctacagagaacagaggagactctgtatgaacccagacaacctggcggcagcgcaaaagatg

SEQ ID NO: 93525 - DNA, 103 bp, Artificial Sequence
  Synthetic Polynucleotide
taatacgactcactataggggactgtgtgtggttccgcagaagtctgggtaacagaggagaacccagatgtctgcggaaaacctggcggcagcgcaaaagatg

SEQ ID NO: 93526 - DNA, 103 bp, Artificial Sequence
  Synthetic Polynucleotide
taatacgactcactatagggagaagttggagactgtgtgtggttccgcagaacagaggagactgcggatgcacacacagaacctggcggcagcgcaaaagatg

SEQ ID NO: 93527 - DNA, 103 bp, Artificial Sequence
  Synthetic Polynucleotide
taatacgactcactataggggccgcgcacggtgcacaggatgttggtccgaacagaggagacggaccatgatcctgtgcaacctggcggcagcgcaaaagatg

SEQ ID NO: 93528 - DNA, 103 bp, Artificial Sequence
  Synthetic Polynucleotide
taatacgactcactatagggtcttgccgcagccgcgcacggtgcacaggaaacagaggagatcctgtatgccgtgcgcgaacctggcggcagcgcaaaagatg

SEQ ID NO: 93529 - DNA, 103 bp, Artificial Sequence
  Synthetic Polynucleotide
taatacgactcactatagggttgggcaggatcttgccgcagccgcgcacgaacagaggagacgtgcgatgctgcggcaaaacctggcggcagcgcaaaagatg

SEQ ID NO: 93530 - DNA, 103 bp, Artificial Sequence
  Synthetic Polynucleotide
taatacgactcactatagggcgcggggctgttgggcaggatcttgccgcaaacagaggagatgcggcatgatcctgcccaacctggcggcagcgcaaaagatg

SEQ ID NO: 93531 - DNA, 103 bp, Artificial Sequence
  Synthetic Polynucleotide
taatacgactcactataggggcatgttgagcgcggggctgttgggcaggaaacagaggagatcctgcatgacagccccgaacctggcggcagcgcaaaagatg

SEQ ID NO: 93532 - DNA, 103 bp, Artificial Sequence
  Synthetic Polynucleotide
taatacgactcactataggggccgccagagccgcggaccccgccgccgccaacagaggagaggcggcatgggggtccgcaacctggcggcagcgcaaaagatg

SEQ ID NO: 93533 - DNA, 103 bp, Artificial Sequence
  Synthetic Polynucleotide
taatacgactcactatagggttgactaggtgcatgttgagcgcggggctgaacagaggagacagcccatggctcaacataacctggcggcagcgcaaaagatg

SEQ ID NO: 93534 - DNA, 103 bp, Artificial Sequence
  Synthetic Polynucleotide
taatacgactcactataggggcggtggctcttgactaggtgcatgttgagaacagaggagactcaacatgcacctagtcaacctggcggcagcgcaaaagatg

SEQ ID NO: 93535 - DNA, 103 bp, Artificial Sequence
  Synthetic Polynucleotide
taatacgactcactatagggcatcctgcaggcggtggctcttgactaggtaacagaggagaacctagatgagagccaccaacctggcggcagcgcaaaagatg

SEQ ID NO: 93536 - DNA, 103 bp, Artificial Sequence
  Synthetic Polynucleotide
taatacgactcactatagggttgactatgccatcctgcaggcggtggctcaacagaggagagagccaatgcctgcaggaaacctggcggcagcgcaaaagatg

SEQ ID NO: 93537 - DNA, 103 bp, Artificial Sequence
  Synthetic Polynucleotide
taatacgactcactatagggtattgttggattgactatgccatcctgcagaacagaggagactgcagatgggcatagtcaacctggcggcagcgcaaaagatg

SEQ ID NO: 93538 - DNA, 103 bp, Artificial Sequence
  Synthetic Polynucleotide
taatacgactcactatagggaatcttttcttattgttggattgactatgcaacagaggagagcatagatgatccaacaaaacctggcggcagcgcaaaagatg

SEQ ID NO: 93539 - DNA, 103 bp, Artificial Sequence
  Synthetic Polynucleotide
taatacgactcactatagggccagttttcaaatcttttcttattgttggaaacagaggagatccaacatgaagaaaagaaacctggcggcagcgcaaaagatg

SEQ ID NO: 93540 - DNA, 103 bp, Artificial Sequence
  Synthetic Polynucleotide
taatacgactcactataggggaatttcggtccagttttcaaatcttttctaacagaggagaagaaaaatgttgaaaactaacctggcggcagcgcaaaagatg

SEQ ID NO: 93541 - DNA, 103 bp, Artificial Sequence
  Synthetic Polynucleotide
taatacgactcactataggggacagcagtagaatttcggtccagttttcaaacagaggagatgaaaaatggaccgaaataacctggcggcagcgcaaaagatg

SEQ ID NO: 93542 - DNA, 103 bp, Artificial Sequence
  Synthetic Polynucleotide
taatacgactcactatagggccttcaattggacagcagtagaatttcggtaacagaggagaaccgaaatgctactgctgaacctggcggcagcgcaaaagatg

SEQ ID NO: 93543 - DNA, 103 bp, Artificial Sequence
  Synthetic Polynucleotide
taatacgactcactatagggccgggcacccgccgccagagccgcggacccaacagaggagagggtccatggctctggcgaacctggcggcagcgcaaaagatg

SEQ ID NO: 93544 - DNA, 103 bp, Artificial Sequence
  Synthetic Polynucleotide
taatacgactcactatagggtctggggcagccttcaattggacagcagtaaacagaggagatactgcatgccaattgaaaacctggcggcagcgcaaaagatg

SEQ ID NO: 93545 - DNA, 103 bp, Artificial Sequence
  Synthetic Polynucleotide
taatacgactcactatagggtctcagggcctctggggcagccttcaattgaacagaggagacaattgatggctgccccaaacctggcggcagcgcaaaagatg

SEQ ID NO: 93546 - DNA, 103 bp, Artificial Sequence
  Synthetic Polynucleotide
taatacgactcactataggggaaaacggtctctcagggcctctggggcagaacagaggagactgcccatgaggccctgaaacctggcggcagcgcaaaagatg

SEQ ID NO: 93547 - DNA, 103 bp, Artificial Sequence
  Synthetic Polynucleotide
taatacgactcactatagggagaaaactgagaaaacggtctctcagggccaacagaggagaggccctatgagaccgtttaacctggcggcagcgcaaaagatg

SEQ ID NO: 93548 - DNA, 103 bp, Artificial Sequence
  Synthetic Polynucleotide
taatacgactcactataggggttttacgagagaaaactgagaaaacggtcaacagaggagagaccgtatgctcagttttaacctggcggcagcgcaaaagatg

SEQ ID NO: 93549 - DNA, 103 bp, Artificial Sequence
  Synthetic Polynucleotide
taatacgactcactatagggataaagtgctgttttacgagagaaaactgaaacagaggagatcagttatgtctcgtaaaaacctggcggcagcgcaaaagatg

SEQ ID NO: 93550 - DNA, 103 bp, Artificial Sequence
  Synthetic Polynucleotide
taatacgactcactatagggatgcattttcataaagtgctgttttacgagaacagaggagactcgtaatgcagcactttaacctggcggcagcgcaaaagatg

SEQ ID NO: 93551 - DNA, 103 bp, Artificial Sequence
  Synthetic Polynucleotide
taatacgactcactatagggtcttctcagcatgcattttcataaagtgctaacagaggagaagcactatgtgaaaatgcaacctggcggcagcgcaaaagatg

SEQ ID NO: 93552 - DNA, 103 bp, Artificial Sequence
  Synthetic Polynucleotide
taatacgactcactatagggcatttgtgcttcttctcagcatgcattttcaacagaggagagaaaatatgtgctgagaaaacctggcggcagcgcaaaagatg

SEQ ID NO: 93553 - DNA, 103 bp, Artificial Sequence
  Synthetic Polynucleotide
taatacgactcactataggggcacttactacatttgtgcttcttctcagcaacagaggagagctgagatgaagcacaaaaacctggcggcagcgcaaaagatg

SEQ ID NO: 93554 - DNA, 103 bp, Artificial Sequence
  Synthetic Polynucleotide
taatacgactcactatagggccgggacggcccgggcacccgccgccagagaacagaggagactctggatgcgggtgcccaacctggcggcagcgcaaaagatg

SEQ ID NO: 93555 - DNA, 103 bp, Artificial Sequence
  Synthetic Polynucleotide
taatacgactcactatagggacgaattgctgcacttactacatttgtgctaacagaggagaagcacaatggtagtaagtaacctggcggcagcgcaaaagatg

SEQ ID NO: 93556 - DNA, 103 bp, Artificial Sequence
  Synthetic Polynucleotide
taatacgactcactatagggtctgtaccgtacgaattgctgcacttactaaacagaggagatagtaaatgcagcaattcaacctggcggcagcgcaaaagatg

SEQ ID NO: 93557 - DNA, 103 bp, Artificial Sequence
  Synthetic Polynucleotide
taatacgactcactatagggcaggtcccattctgtaccgtacgaattgctaacagaggagaagcaatatgtacggtacaaacctggcggcagcgcaaaagatg

SEQ ID NO: 93558 - DNA, 103 bp, Artificial Sequence
  Synthetic Polynucleotide
taatacgactcactatagggcatgtcttttcaggtcccattctgtaccgtaacagaggagaacggtaatgaatgggaccaacctggcggcagcgcaaaagatg

SEQ ID NO: 93559 - DNA, 103 bp, Artificial Sequence
  Synthetic Polynucleotide
taatacgactcactatagggcagtcctctgcatgtcttttcaggtcccataacagaggagaatgggaatggaaaagacaaacctggcggcagcgcaaaagatg

SEQ ID NO: 93560 - DNA, 103 bp, Artificial Sequence
  Synthetic Polynucleotide
taatacgactcactatagggggtcttgccacagtcctctgcatgtcttttaacagaggagaaaaagaatggcagaggacaacctggcggcagcgcaaaagatg

SEQ ID NO: 93561 - DNA, 103 bp, Artificial Sequence
  Synthetic Polynucleotide
taatacgactcactatagggtgcaccggaaggtcttgccacagtcctctgaacagaggagacagaggatggtggcaagaaacctggcggcagcgcaaaagatg

SEQ ID NO: 93562 - DNA, 103 bp, Artificial Sequence
  Synthetic Polynucleotide
taatacgactcactatagggcagccgcatgtgcaccggaaggtcttgccaaacagaggagatggcaaatgcttccggtgaacctggcggcagcgcaaaagatg

SEQ ID NO: 93563 - DNA, 103 bp, Artificial Sequence
  Synthetic Polynucleotide
taatacgactcactatagggggcgtagggacagccgcatgtgcaccggaaaacagaggagattccggatgacatgcggcaacctggcggcagcgcaaaagatg

SEQ ID NO: 93564 - DNA, 103 bp, Artificial Sequence
  Synthetic Polynucleotide
taatacgactcactatagggctgttctactggcgtagggacagccgcatgaacagaggagacatgcgatggtccctacgaacctggcggcagcgcaaaagatg

SEQ ID NO: 93565 - DNA, 103 bp, Artificial Sequence
  Synthetic Polynucleotide
taatacgactcactataggggtcgtggccgccgggacggcccgggcacccaacagaggagagggtgcatgggccgtcccaacctggcggcagcgcaaaagatg

SEQ ID NO: 93566 - DNA, 103 bp, Artificial Sequence
  Synthetic Polynucleotide
taatacgactcactataggggactgcagtgctgttctactggcgtagggaaacagaggagatccctaatgcagtagaacaacctggcggcagcgcaaaagatg

SEQ ID NO: 93567 - DNA, 103 bp, Artificial Sequence
  Synthetic Polynucleotide
taatacgactcactataggggtagatgtgagactgcagtgctgttctactaacagaggagaagtagaatggcactgcagaacctggcggcagcgcaaaagatg

SEQ ID NO: 93568 - DNA, 103 bp, Artificial Sequence
  Synthetic Polynucleotide
taatacgactcactataggggcccagttcggtagatgtgagactgcagtgaacagaggagacactgcatgctcacatctaacctggcggcagcgcaaaagatg

SEQ ID NO: 93569 - DNA, 103 bp, Artificial Sequence
  Synthetic Polynucleotide
taatacgactcactatagggggtatctcgtgcccagttcggtagatgtgaaacagaggagatcacatatgccgaactggaacctggcggcagcgcaaaagatg

SEQ ID NO: 93570 - DNA, 103 bp, Artificial Sequence
  Synthetic Polynucleotide
taatacgactcactataggggtgttctgcaggtatctcgtgcccagttcgaacagaggagacgaactatgcacgagataaacctggcggcagcgcaaaagatg

SEQ ID NO: 93571 - DNA, 103 bp, Artificial Sequence
  Synthetic Polynucleotide
taatacgactcactataggggtgggtccctgtgttctgcaggtatctcgtaacagaggagaacgagaatgctgcagaacaacctggcggcagcgcaaaagatg

SEQ ID NO: 93572 - DNA, 103 bp, Artificial Sequence
  Synthetic Polynucleotide
taatacgactcactatagggttcttactaggtgggtccctgtgttctgcaaacagaggagatgcagaatgcagggacccaacctggcggcagcgcaaaagatg

SEQ ID NO: 93573 - DNA, 103 bp, Artificial Sequence
  Synthetic Polynucleotide
taatacgactcactatagggcattttccttttcttactaggtgggtccctaacagaggagaagggacatgcctagtaagaacctggcggcagcgcaaaagatg

SEQ ID NO: 93574 - DNA, 103 bp, Artificial Sequence
  Synthetic Polynucleotide
taatacgactcactatagggcacagttttccattttccttttcttactagaacagaggagactagtaatgaaaggaaaaaacctggcggcagcgcaaaagatg

SEQ ID NO: 93575 - DNA, 103 bp, Artificial Sequence
  Synthetic Polynucleotide
taatacgactcactatagggtggttttgtgcacagttttccattttccttaacagaggagaaaggaaatgggaaaactgaacctggcggcagcgcaaaagatg

SEQ ID NO: 93576 - DNA, 103 bp, Artificial Sequence
  Synthetic Polynucleotide
taatacgactcactatagggggcggctcctgtcgtggccgccgggacggcaacagaggagagccgtcatggcggccacgaacctggcggcagcgcaaaagatg

SEQ ID NO: 93577 - DNA, 103 bp, Artificial Sequence
  Synthetic Polynucleotide
taatacgactcactatagggggataacttctggttttgtgcacagttttcaacagaggagagaaaacatggcacaaaacaacctggcggcagcgcaaaagatg

SEQ ID NO: 93578 - DNA, 103 bp, Artificial Sequence
  Synthetic Polynucleotide
taatacgactcactatagggtggtcttgttggataacttctggttttgtgaacagaggagacacaaaatgagaagttataacctggcggcagcgcaaaagatg

SEQ ID NO: 93579 - DNA, 103 bp, Artificial Sequence
  Synthetic Polynucleotide
taatacgactcactatagggaatgattcaatggtcttgttggataacttcaacagaggagagaagttatgcaacaagacaacctggcggcagcgcaaaagatg

SEQ ID NO: 93580 - DNA, 103 bp, Artificial Sequence
  Synthetic Polynucleotide
taatacgactcactatagggttggttgttcaatgattcaatggtcttgttaacagaggagaaacaagatgattgaatcaaacctggcggcagcgcaaaagatg

SEQ ID NO: 93581 - DNA, 103 bp, Artificial Sequence
  Synthetic Polynucleotide
taatacgactcactatagggtagggattggttggttgttcaatgattcaaaacagaggagattgaatatgtgaacaaccaacctggcggcagcgcaaaagatg

SEQ ID NO: 93582 - DNA, 103 bp, Artificial Sequence
  Synthetic Polynucleotide
taatacgactcactataggggtgtctggtctagggattggttggttgttcaacagaggagagaacaaatgaccaatcccaacctggcggcagcgcaaaagatg

SEQ ID NO: 93583 - DNA, 103 bp, Artificial Sequence
  Synthetic Polynucleotide
taatacgactcactatagggtagttcttgagtgtctggtctagggattggaacagaggagaccaatcatgagaccagacaacctggcggcagcgcaaaagatg

SEQ ID NO: 93584 - DNA, 103 bp, Artificial Sequence
  Synthetic Polynucleotide
taatacgactcactatagggctgaagcttctagttcttgagtgtctggtcaacagaggagagaccagatgctcaagaacaacctggcggcagcgcaaaagatg

SEQ ID NO: 93585 - DNA, 103 bp, Artificial Sequence
  Synthetic Polynucleotide
taatacgactcactatagggagctttatttctgaagcttctagttcttgaaacagaggagatcaagaatgagaagcttcaacctggcggcagcgcaaaagatg

SEQ ID NO: 93586 - DNA, 103 bp, Artificial Sequence
  Synthetic Polynucleotide
taatacgactcactatagggagatggttctagctttatttctgaagcttcaacagaggagagaagctatggaaataaagaacctggcggcagcgcaaaagatg

SEQ ID NO: 93587 - DNA, 103 bp, Artificial Sequence
  Synthetic Polynucleotide
taatacgactcactatagggaggcggcggcggcggctcctgtcgtggccgaacagaggagacggccaatgcaggagccgaacctggcggcagcgcaaaagatg

SEQ ID NO: 93588 - DNA, 103 bp, Artificial Sequence
  Synthetic Polynucleotide
taatacgactcactatagggagtcttcaaaagatggttctagctttatttaacagaggagaaaataaatgtagaaccataacctggcggcagcgcaaaagatg

SEQ ID NO: 93589 - DNA, 103 bp, Artificial Sequence
  Synthetic Polynucleotide
taatacgactcactataggggagccacaagagtcttcaaaagatggttctaacagaggagaagaaccatgttttgaagaaacctggcggcagcgcaaaagatg

SEQ ID NO: 93590 - DNA, 103 bp, Artificial Sequence
  Synthetic Polynucleotide
taatacgactcactataggggtcagtgttagagccacaagagtcttcaaaaacagaggagatttgaaatgtcttgtggcaacctggcggcagcgcaaaagatg

SEQ ID NO: 93591 - DNA, 103 bp, Artificial Sequence
  Synthetic Polynucleotide
taatacgactcactataggggagtctgcttgtcagtgttagagccacaagaacagaggagacttgtgatgctaacactgaacctggcggcagcgcaaaagatg

SEQ ID NO: 93592 - DNA, 103 bp, Artificial Sequence
  Synthetic Polynucleotide
taatacgactcactatagggggtgttgtaagagtctgcttgtcagtgttaaacagaggagataacacatgcaagcagacaacctggcggcagcgcaaaagatg

SEQ ID NO: 93593 - DNA, 103 bp, Artificial Sequence
  Synthetic Polynucleotide
taatacgactcactatagggatatctcggtggtgttgtaagagtctgcttaacagaggagaaagcagatgcttacaacaaacctggcggcagcgcaaaagatg

SEQ ID NO: 93594 - DNA, 103 bp, Artificial Sequence
  Synthetic Polynucleotide
taatacgactcactatagggacttctgaggatatctcggtggtgttgtaaaacagaggagattacaaatgcaccgagataacctggcggcagcgcaaaagatg

SEQ ID NO: 93595 - DNA, 103 bp, Artificial Sequence
  Synthetic Polynucleotide
taatacgactcactatagggggtaaaagcaacttctgaggatatctcggtaacagaggagaaccgagatgtcctcagaaaacctggcggcagcgcaaaagatg

SEQ ID NO: 93596 - DNA, 103 bp, Artificial Sequence
  Synthetic Polynucleotide
taatacgactcactatagggtttgggctttggtaaaagcaacttctgaggaacagaggagacctcagatgttgcttttaaacctggcggcagcgcaaaagatg

SEQ ID NO: 93597 - DNA, 103 bp, Artificial Sequence
  Synthetic Polynucleotide
taatacgactcactatagggccaaagccactttgggctttggtaaaagcaaacagaggagatgctttatgcaaagcccaaacctggcggcagcgcaaaagatg

SEQ ID NO: 93598 - DNA, 103 bp, Artificial Sequence
  Synthetic Polynucleotide
taatacgactcactatagggcacgggcccgaggcggcggcggcggctcctaacagaggagaaggagcatgcgccgccgcaacctggcggcagcgcaaaagatg

SEQ ID NO: 93599 - DNA, 103 bp, Artificial Sequence
  Synthetic Polynucleotide
taatacgactcactatagggggtagtttaaccaaagccactttgggctttaacagaggagaaaagccatgagtggctttaacctggcggcagcgcaaaagatg

SEQ ID NO: 93600 - DNA, 103 bp, Artificial Sequence
  Synthetic Polynucleotide
taatacgactcactatagggctgcatcacgggtagtttaaccaaagccacaacagaggagagtggctatggttaaactaaacctggcggcagcgcaaaagatg

SEQ ID NO: 93601 - DNA, 103 bp, Artificial Sequence
  Synthetic Polynucleotide
taatacgactcactatagggtgacagaaaactgcatcacgggtagtttaaaacagaggagattaaacatgccgtgatgcaacctggcggcagcgcaaaagatg

SEQ ID NO: 93602 - DNA, 103 bp, Artificial Sequence
  Synthetic Polynucleotide
taatacgactcactatagggaagacaggcatgacagaaaactgcatcacgaacagaggagacgtgatatggttttctgtaacctggcggcagcgcaaaagatg

SEQ ID NO: 93603 - DNA, 103 bp, Artificial Sequence
  Synthetic Polynucleotide
taatacgactcactatagggtgtaggcacaaagacaggcatgacagaaaaaacagaggagattttctatgatgcctgtcaacctggcggcagcgcaaaagatg

SEQ ID NO: 93604 - DNA, 103 bp, Artificial Sequence
  Synthetic Polynucleotide
taatacgactcactatagggaggagtcggctgtaggcacaaagacaggcaaacagaggagatgcctgatgttgtgcctaaacctggcggcagcgcaaaagatg

SEQ ID NO: 93605 - DNA, 103 bp, Artificial Sequence
  Synthetic Polynucleotide
taatacgactcactatagggggctgggctgaggagtcggctgtaggcacaaacagaggagatgtgccatgagccgactcaacctggcggcagcgcaaaagatg

SEQ ID NO: 93606 - DNA, 103 bp, Artificial Sequence
  Synthetic Polynucleotide
taatacgactcactatagggtaacaccacaggctgggctgaggagtcggcaacagaggagagccgacatgtcagcccagaacctggcggcagcgcaaaagatg

SEQ ID NO: 93607 - DNA, 103 bp, Artificial Sequence
  Synthetic Polynucleotide
taatacgactcactataggggatcaacacctaacaccacaggctgggctgaacagaggagacagcccatgctgtggtgtaacctggcggcagcgcaaaagatg

SEQ ID NO: 93608 - DNA, 103 bp, Artificial Sequence
  Synthetic Polynucleotide
taatacgactcactataggggcagagccctgatcaacacctaacaccacaaacagaggagatgtggtatgaggtgttgaaacctggcggcagcgcaaaagatg

SEQ ID NO: 93609 - DNA, 103 bp, Artificial Sequence
  Synthetic Polynucleotide
taatacgactcactatagggccactcttctgcatgcagcaggcgggacataacagaggagaatgtccatgctgctgcataacctggcggcagcgcaaaagatg

SEQ ID NO: 93610 - DNA, 103 bp, Artificial Sequence
  Synthetic Polynucleotide
taatacgactcactatagggagttgcaggtggctgcggcggcggcggcggaacagaggagaccgccgatgccgccgcagaacctggcggcagcgcaaaagatg

SEQ ID NO: 93611 - DNA, 103 bp, Artificial Sequence
  Synthetic Polynucleotide
taatacgactcactatagggttccccgtcgcttctgtgggaccgaggcgaaacagaggagatcgcctatgtcccacagaaacctggcggcagcgcaaaagatg

SEQ ID NO: 93612 - DNA, 103 bp, Artificial Sequence
  Synthetic Polynucleotide
taatacgactcactatagggggggggaaaattccccgtcgcttctgtgggaacagaggagacccacaatggcgacggggaacctggcggcagcgcaaaagatg

SEQ ID NO: 93613 - DNA, 103 bp, Artificial Sequence
  Synthetic Polynucleotide
taatacgactcactatagggtaatgggaatggggggaaaattccccgtcgaacagaggagacgacggatgattttccccaacctggcggcagcgcaaaagatg

SEQ ID NO: 93614 - DNA, 103 bp, Artificial Sequence
  Synthetic Polynucleotide
taatacgactcactatagggcgagtcactgtaatgggaatggggggaaaaaacagaggagattttccatgcattcccataacctggcggcagcgcaaaagatg

SEQ ID NO: 93615 - DNA, 103 bp, Artificial Sequence
  Synthetic Polynucleotide
taatacgactcactatagggttgcctcatccgagtcactgtaatgggaataacagaggagaattcccatgacagtgactaacctggcggcagcgcaaaagatg

SEQ ID NO: 93616 - DNA, 103 bp, Artificial Sequence
  Synthetic Polynucleotide
taatacgactcactatagggtcgcctgcaaagttgcaggtggctgcggcgaacagaggagacgccgcatgcacctgcaaaacctggcggcagcgcaaaagatg

SEQ ID NO: 93617 - DNA, 103 bp, Artificial Sequence
  Synthetic Polynucleotide
taatacgactcactatagggggatgctctctcgcctgcaaagttgcaggtaacagaggagaacctgcatgtttgcaggcaacctggcggcagcgcaaaagatg

SEQ ID NO: 93618 - DNA, 103 bp, Artificial Sequence
  Synthetic Polynucleotide
taatacgactcactatagggcgggtagacgggatgctctctcgcctgcaaaacagaggagattgcagatgagagagcataacctggcggcagcgcaaaagatg

SEQ ID NO: 93619 - DNA, 103 bp, Artificial Sequence
  Synthetic Polynucleotide
taatacgactcactatagggacagctcaggcgggtagacgggatgctctcaacagaggagagagagcatgccgtctaccaacctggcggcagcgcaaaagatg

SEQ ID NO: 93620 - DNA, 103 bp, Artificial Sequence
  Synthetic Polynucleotide
taatacgactcactatagggtccaggagggacagctcaggcgggtagacgaacagaggagacgtctaatggcctgagctaacctggcggcagcgcaaaagatg

SEQ ID NO: 93621 - DNA, 103 bp, Artificial Sequence
  Synthetic Polynucleotide
taatacgactcactataggggtcggtgctgtccaggagggacagctcaggaacagaggagacctgagatgtccctcctgaacctggcggcagcgcaaaagatg

SEQ ID NO: 93622 - DNA, 103 bp, Artificial Sequence
  Synthetic Polynucleotide
taatacgactcactatagggaggcgcgtgggtcggtgctgtccaggagggaacagaggagaccctccatgacagcaccgaacctggcggcagcgcaaaagatg

SEQ ID NO: 93623 - DNA, 103 bp, Artificial Sequence
  Synthetic Polynucleotide
taatacgactcactatagggggagccagccaggcgcgtgggtcggtgctgaacagaggagacagcacatgcccacgcgcaacctggcggcagcgcaaaagatg

SEQ ID NO: 93624 - DNA, 103 bp, Artificial Sequence
  Synthetic Polynucleotide
taatacgactcactatagggctgcaaagtgggagccagccaggcgcgtggaacagaggagaccacgcatgtggctggctaacctggcggcagcgcaaaagatg

SEQ ID NO: 93625 - DNA, 103 bp, Artificial Sequence
  Synthetic Polynucleotide
taatacgactcactatagggtcacttcagcccactcttctgcatgcagcaaacagaggagatgctgcatgcagaagagtaacctggcggcagcgcaaaagatg

SEQ ID NO: 93626 - DNA, 103 bp, Artificial Sequence
  Synthetic Polynucleotide
taatacgactcactatagggtgcagatgccctgcaaagtgggagccagccaacagaggagaggctggatgccactttgcaacctggcggcagcgcaaaagatg

SEQ ID NO: 93627 - DNA, 103 bp, Artificial Sequence
  Synthetic Polynucleotide
taatacgactcactataggggcgcgtgccgtgcagatgccctgcaaagtgaacagaggagacactttatggggcatctgaacctggcggcagcgcaaaagatg

SEQ ID NO: 93628 - DNA, 103 bp, Artificial Sequence
  Synthetic Polynucleotide
taatacgactcactatagggatactgggcggcgcgtgccgtgcagatgccaacagaggagaggcatcatgacggcacgcaacctggcggcagcgcaaaagatg

SEQ ID NO: 93629 - DNA, 103 bp, Artificial Sequence
  Synthetic Polynucleotide
taatacgactcactatagggaatgtagcaaatactgggcggcgcgtgccgaacagaggagacggcacatgccgcccagtaacctggcggcagcgcaaaagatg

SEQ ID NO: 93630 - DNA, 103 bp, Artificial Sequence
  Synthetic Polynucleotide
taatacgactcactatagggagctccggggaatgtagcaaatactgggcgaacagaggagacgcccaatgtttgctacaaacctggcggcagcgcaaaagatg

SEQ ID NO: 93631 - DNA, 103 bp, Artificial Sequence
  Synthetic Polynucleotide
taatacgactcactatagggtgaggcacccagctccggggaatgtagcaaaacagaggagattgctaatgtccccggagaacctggcggcagcgcaaaagatg

SEQ ID NO: 93632 - DNA, 103 bp, Artificial Sequence
  Synthetic Polynucleotide
taatacgactcactatagggcagcggcctctgaggcacccagctccggggaacagaggagaccccggatgtgggtgcctaacctggcggcagcgcaaaagatg

SEQ ID NO: 93633 - DNA, 103 bp, Artificial Sequence
  Synthetic Polynucleotide
taatacgactcactatagggtcccggggcgcagcggcctctgaggcacccaacagaggagagggtgcatgagaggccgcaacctggcggcagcgcaaaagatg

SEQ ID NO: 93634 - DNA, 103 bp, Artificial Sequence
  Synthetic Polynucleotide
taatacgactcactataggggtccacctcgtcccggggcgcagcggcctcaacagaggagagaggccatggcgccccggaacctggcggcagcgcaaaagatg

SEQ ID NO: 93635 - DNA, 103 bp, Artificial Sequence
  Synthetic Polynucleotide
taatacgactcactatagggccccccggccgtccacctcgtcccggggcgaacagaggagacgccccatgacgaggtggaacctggcggcagcgcaaaagatg

SEQ ID NO: 93636 - DNA, 103 bp, Artificial Sequence
  Synthetic Polynucleotide
taatacgactcactatagggcccaactccttcacttcagcccactcttctaacagaggagaagaagaatgggctgaagtaacctggcggcagcgcaaaagatg

SEQ ID NO: 93637 - DNA, 103 bp, Artificial Sequence
  Synthetic Polynucleotide
taatacgactcactatagggcttaccagctccccccggccgtccacctcgaacagaggagacgaggtatgcggccggggaacctggcggcagcgcaaaagatg

SEQ ID NO: 93638 - DNA, 103 bp, Artificial Sequence
  Synthetic Polynucleotide
taatacgactcactataggggctgctcctccttaccagctccccccggccaacagaggagaggccggatggagctggtaaacctggcggcagcgcaaaagatg

SEQ ID NO: 93639 - DNA, 103 bp, Artificial Sequence
  Synthetic Polynucleotide
taatacgactcactatagggtggcaccgccgctgctcctccttaccagctaacagaggagaagctggatgggaggagcaaacctggcggcagcgcaaaagatg

SEQ ID NO: 93640 - DNA, 103 bp, Artificial Sequence
  Synthetic Polynucleotide
taatacgactcactatagggttgctgctgctggcaccgccgctgctcctcaacagaggagagaggagatgcggcggtgcaacctggcggcagcgcaaaagatg

SEQ ID NO: 93641 - DNA, 103 bp, Artificial Sequence
  Synthetic Polynucleotide
taatacgactcactatagggcccggggctcttgctgctgctggcaccgccaacagaggagaggcggtatgagcagcagcaacctggcggcagcgcaaaagatg

SEQ ID NO: 93642 - DNA, 103 bp, Artificial Sequence
  Synthetic Polynucleotide
taatacgactcactatagggctttcaccggcccggggctcttgctgctgcaacagaggagagcagcaatgagagccccgaacctggcggcagcgcaaaagatg

SEQ ID NO: 93643 - DNA, 103 bp, Artificial Sequence
  Synthetic Polynucleotide
taatacgactcactatagggtgttcccgcactttcaccggcccggggctcaacagaggagagagcccatggccggtgaaaacctggcggcagcgcaaaagatg

SEQ ID NO: 93644 - DNA, 103 bp, Artificial Sequence
  Synthetic Polynucleotide
taatacgactcactatagggcttgcacagctgttcccgcactttcaccggaacagaggagaccggtgatggtgcgggaaaacctggcggcagcgcaaaagatg

SEQ ID NO: 93645 - DNA, 103 bp, Artificial Sequence
  Synthetic Polynucleotide
taatacgactcactatagggcgcctttcagcttgcacagctgttcccgcaaacagaggagatgcgggatgagctgtgcaaacctggcggcagcgcaaaagatg

SEQ ID NO: 93646 - DNA, 103 bp, Artificial Sequence
  Synthetic Polynucleotide
taatacgactcactatagggaccaccaccccgcctttcagcttgcacagcaacagaggagagctgtgatggctgaaaggaacctggcggcagcgcaaaagatg

SEQ ID NO: 93647 - DNA, 103 bp, Artificial Sequence
  Synthetic Polynucleotide
taatacgactcactatagggatggtggtctcccaactccttcacttcagcaacagaggagagctgaaatgaaggagttgaacctggcggcagcgcaaaagatg

SEQ ID NO: 93648 - DNA, 103 bp, Artificial Sequence
  Synthetic Polynucleotide
taatacgactcactatagggcagctcgtctaccaccaccccgcctttcagaacagaggagactgaaaatgggggtggtgaacctggcggcagcgcaaaagatg

SEQ ID NO: 93649 - DNA, 103 bp, Artificial Sequence
  Synthetic Polynucleotide
taatacgactcactatagggggctgcagcccagctcgtctaccaccacccaacagaggagagggtggatgtagacgagcaacctggcggcagcgcaaaagatg

SEQ ID NO: 93650 - DNA, 103 bp, Artificial Sequence
  Synthetic Polynucleotide
taatacgactcactataggggcccgttggcggctgcagcccagctcgtctaacagaggagaagacgaatggggctgcagaacctggcggcagcgcaaaagatg

SEQ ID NO: 93651 - DNA, 103 bp, Artificial Sequence
  Synthetic Polynucleotide
taatacgactcactataggggctggaaggggcccgttggcggctgcagccaacagaggagaggctgcatgcgccaacggaacctggcggcagcgcaaaagatg

SEQ ID NO: 93652 - DNA, 103 bp, Artificial Sequence
  Synthetic Polynucleotide
taatacgactcactatagggtcacctgtttgctggaaggggcccgttggcaacagaggagagccaacatgccccttccaaacctggcggcagcgcaaaagatg

SEQ ID NO: 93653 - DNA, 103 bp, Artificial Sequence
  Synthetic Polynucleotide
taatacgactcactatagggtgcaccccattcacctgtttgctggaagggaacagaggagacccttcatgcaaacaggtaacctggcggcagcgcaaaagatg

SEQ ID NO: 93654 - DNA, 103 bp, Artificial Sequence
  Synthetic Polynucleotide
taatacgactcactatagggtctctgcttctgcaccccattcacctgtttaacagaggagaaaacagatgaatggggtgaacctggcggcagcgcaaaagatg

SEQ ID NO: 93655 - DNA, 103 bp, Artificial Sequence
  Synthetic Polynucleotide
taatacgactcactatagggctgctagccgtctctgcttctgcaccccataacagaggagaatggggatgagaagcagaaacctggcggcagcgcaaaagatg

SEQ ID NO: 93656 - DNA, 103 bp, Artificial Sequence
  Synthetic Polynucleotide
taatacgactcactatagggctggcgttggctgctagccgtctctgcttcaacagaggagagaagcaatgacggctagcaacctggcggcagcgcaaaagatg

SEQ ID NO: 93657 - DNA, 103 bp, Artificial Sequence
  Synthetic Polynucleotide
taatacgactcactataggggcgccgctccctggcgttggctgctagccgaacagaggagacggctaatggccaacgccaacctggcggcagcgcaaaagatg

SEQ ID NO: 93658 - DNA, 103 bp, Artificial Sequence
  Synthetic Polynucleotide
taatacgactcactatagggggggctggcgatggtggtctcccaactcctaacagaggagaaggagtatggagaccaccaacctggcggcagcgcaaaagatg

SEQ ID NO: 93659 - DNA, 103 bp, Artificial Sequence
  Synthetic Polynucleotide
taatacgactcactatagggcatgcatcctgcgccgctccctggcgttggaacagaggagaccaacgatggggagcggcaacctggcggcagcgcaaaagatg

SEQ ID NO: 93660 - DNA, 103 bp, Artificial Sequence
  Synthetic Polynucleotide
taatacgactcactatagggtggttcagcccatgcatcctgcgccgctccaacagaggagaggagcgatgcaggatgcaaacctggcggcagcgcaaaagatg

SEQ ID NO: 93661 - DNA, 103 bp, Artificial Sequence
  Synthetic Polynucleotide
taatacgactcactataggggtcgaaggcgtggttcagcccatgcatcctaacagaggagaaggatgatggggctgaacaacctggcggcagcgcaaaagatg

SEQ ID NO: 93662 - DNA, 103 bp, Artificial Sequence
  Synthetic Polynucleotide
taatacgactcactatagggtgcgcagctggtcgaaggcgtggttcagccaacagaggagaggctgaatgacgccttcgaacctggcggcagcgcaaaagatg

SEQ ID NO: 93663 - DNA, 103 bp, Artificial Sequence
  Synthetic Polynucleotide
taatacgactcactataggggggataacattgcgcagctggtcgaaggcgaacagaggagacgccttatgccagctgcgaacctggcggcagcgcaaaagatg

SEQ ID NO: 93664 - DNA, 103 bp, Artificial Sequence
  Synthetic Polynucleotide
taatacgactcactataggggttgaacgacgggataacattgcgcagctgaacagaggagacagctgatgaatgttatcaacctggcggcagcgcaaaagatg

SEQ ID NO: 93665 - DNA, 103 bp, Artificial Sequence
  Synthetic Polynucleotide
taatacgactcactatagggtcttgtcgttgttgaacgacgggataacataacagaggagaatgttaatgcgtcgttcaaacctggcggcagcgcaaaagatg

SEQ ID NO: 93666 - DNA, 103 bp, Artificial Sequence
  Synthetic Polynucleotide
taatacgactcactatagggttggacagcttcttgtcgttgttgaacgacaacagaggagagtcgttatgcaacgacaaaacctggcggcagcgcaaaagatg

SEQ ID NO: 93667 - DNA, 103 bp, Artificial Sequence
  Synthetic Polynucleotide
taatacgactcactatagggggtctcatatttggacagcttcttgtcgttaacagaggagaaacgacatgaagctgtccaacctggcggcagcgcaaaagatg

SEQ ID NO: 93668 - DNA, 103 bp, Artificial Sequence
  Synthetic Polynucleotide
taatacgactcactatagggccatctgcagggtctcatatttggacagctaacagaggagaagctgtatgaatatgagaaacctggcggcagcgcaaaagatg

SEQ ID NO: 93669 - DNA, 103 bp, Artificial Sequence
  Synthetic Polynucleotide
taatacgactcactatagggtgatgcggctggggctggcgatggtggtctaacagaggagaagaccaatgtcgccagccaacctggcggcagcgcaaaagatg

SEQ ID NO: 93670 - DNA, 103 bp, Artificial Sequence
  Synthetic Polynucleotide
taatacgactcactatagggtagatttgggccatctgcagggtctcatataacagaggagaatatgaatgcctgcagataacctggcggcagcgcaaaagatg

SEQ ID NO: 93671 - DNA, 103 bp, Artificial Sequence
  Synthetic Polynucleotide
taatacgactcactatagggggcgttgatgtagatttgggccatctgcagaacagaggagactgcagatggcccaaatcaacctggcggcagcgcaaaagatg

SEQ ID NO: 93672 - DNA, 103 bp, Artificial Sequence
  Synthetic Polynucleotide
taatacgactcactataggggctcggacaaggcgttgatgtagatttgggaacagaggagacccaaaatgacatcaacgaacctggcggcagcgcaaaagatg

SEQ ID NO: 93673 - DNA, 103 bp, Artificial Sequence
  Synthetic Polynucleotide
taatacgactcactataggggtttgtagcagctcggacaaggcgttgatgaacagaggagacatcaaatgcttgtccgaaacctggcggcagcgcaaaagatg

SEQ ID NO: 93674 - DNA, 103 bp, Artificial Sequence
  Synthetic Polynucleotide
taatacgactcactatagggtccgctgggcgtttgtagcagctcggacaaaacagaggagattgtccatgctgctacaaaacctggcggcagcgcaaaagatg

SEQ ID NO: 93675 - DNA, 103 bp, Artificial Sequence
  Synthetic Polynucleotide
taatacgactcactataggggctgttcccctccgctgggcgtttgtagcaaacagaggagatgctacatgcgcccagcgaacctggcggcagcgcaaaagatg

SEQ ID NO: 93676 - DNA, 103 bp, Artificial Sequence
  Synthetic Polynucleotide
taatacgactcactatagggggcggcggtggctgttcccctccgctgggcaacagaggagagcccagatgaggggaacaaacctggcggcagcgcaaaagatg

SEQ ID NO: 93677 - DNA, 103 bp, Artificial Sequence
  Synthetic Polynucleotide
taatacgactcactatagggggaggctggaggcggcggtggctgttccccaacagaggagaggggaaatgccaccgccgaacctggcggcagcgcaaaagatg

SEQ ID NO: 93678 - DNA, 103 bp, Artificial Sequence
  Synthetic Polynucleotide
taatacgactcactatagggcgcttttgcaggaggctggaggcggcggtgaacagaggagacaccgcatgctccagcctaacctggcggcagcgcaaaagatg

SEQ ID NO: 93679 - DNA, 103 bp, Artificial Sequence
  Synthetic Polynucleotide
taatacgactcactatagggtggtggtggtcgcttttgcaggaggctggaaacagaggagatccagcatgctgcaaaagaacctggcggcagcgcaaaagatg

SEQ ID NO: 93680 - DNA, 103 bp, Artificial Sequence
  Synthetic Polynucleotide
taatacgactcactatagggttgcgggagatgatgcggctggggctggcgaacagaggagacgccagatgcagccgcataacctggcggcagcgcaaaagatg

SEQ ID NO: 93681 - DNA, 103 bp, Artificial Sequence
  Synthetic Polynucleotide
taatacgactcactatagggggtgcgaaggtggtggtggtcgcttttgcaaacagaggagatgcaaaatggaccaccacaacctggcggcagcgcaaaagatg

SEQ ID NO: 93682 - DNA, 103 bp, Artificial Sequence
  Synthetic Polynucleotide
taatacgactcactatagggaggaggccgcggtgcgaaggtggtggtggtaacagaggagaaccaccatgaccttcgcaaacctggcggcagcgcaaaagatg

SEQ ID NO: 93683 - DNA, 103 bp, Artificial Sequence
  Synthetic Polynucleotide
taatacgactcactatagggcccccttcataggaggccgcggtgcgaaggaacagaggagaccttcgatgcgcggcctcaacctggcggcagcgcaaaagatg

SEQ ID NO: 93684 - DNA, 103 bp, Artificial Sequence
  Synthetic Polynucleotide
taatacgactcactataggggttgcccgcgcccccttcataggaggccgcaacagaggagagcggccatgtatgaagggaacctggcggcagcgcaaaagatg

SEQ ID NO: 93685 - DNA, 103 bp, Artificial Sequence
  Synthetic Polynucleotide
taatacgactcactatagggctgcggtcgcgttgcccgcgcccccttcataacagaggagaatgaagatggcgcgggcaaacctggcggcagcgcaaaagatg

SEQ ID NO: 93686 - DNA, 103 bp, Artificial Sequence
  Synthetic Polynucleotide
taatacgactcactatagggtgagccccagctgcggtcgcgttgcccgcgaacagaggagacgcgggatgcgcgaccgcaacctggcggcagcgcaaaagatg

SEQ ID NO: 93687 - DNA, 103 bp, Artificial Sequence
  Synthetic Polynucleotide
taatacgactcactatagggggaagcctgctgagccccagctgcggtcgcaacagaggagagcgaccatggctggggctaacctggcggcagcgcaaaagatg

SEQ ID NO: 93688 - DNA, 103 bp, Artificial Sequence
  Synthetic Polynucleotide
taatacgactcactatagggggctccctccggaagcctgctgagccccagaacagaggagactggggatgagcaggcttaacctggcggcagcgcaaaagatg

SEQ ID NO: 93689 - DNA, 103 bp, Artificial Sequence
  Synthetic Polynucleotide
taatacgactcactataggggtcggccgctggctccctccggaagcctgcaacagaggagagcaggcatgcggagggagaacctggcggcagcgcaaaagatg

SEQ ID NO: 93690 - DNA, 103 bp, Artificial Sequence
  Synthetic Polynucleotide
taatacgactcactatagggcccgggcggggtcggccgctggctccctccaacagaggagaggagggatgcagcggccgaacctggcggcagcgcaaaagatg

SEQ ID NO: 93691 - DNA, 103 bp, Artificial Sequence
  Synthetic Polynucleotide
taatacgactcactataggggcggcggcggttgcgggagatgatgcggctaacagaggagaagccgcatgatctcccgcaacctggcggcagcgcaaaagatg

SEQ ID NO: 93692 - DNA, 103 bp, Artificial Sequence
  Synthetic Polynucleotide
taatacgactcactatagggtccggcaactcccgggcggggtcggccgctaacagaggagaagcggcatgccccgcccgaacctggcggcagcgcaaaagatg

SEQ ID NO: 93693 - DNA, 103 bp, Artificial Sequence
  Synthetic Polynucleotide
taatacgactcactataggggagaagcgagtccggcaactcccgggcgggaacagaggagacccgccatggagttgccgaacctggcggcagcgcaaaagatg

SEQ ID NO: 93694 - DNA, 103 bp, Artificial Sequence
  Synthetic Polynucleotide
taatacgactcactatagggagctggggctgagaagcgagtccggcaactaacagaggagaagttgcatgactcgcttcaacctggcggcagcgcaaaagatg

SEQ ID NO: 93695 - DNA, 103 bp, Artificial Sequence
  Synthetic Polynucleotide
taatacgactcactatagggctcccgcagaagctggggctgagaagcgagaacagaggagactcgctatgcagccccagaacctggcggcagcgcaaaagatg

SEQ ID NO: 93696 - DNA, 103 bp, Artificial Sequence
  Synthetic Polynucleotide
taatacgactcactatagggaccgagtaccctcccgcagaagctggggctaacagaggagaagccccatgttctgcgggaacctggcggcagcgcaaaagatg

SEQ ID NO: 93697 - DNA, 103 bp, Artificial Sequence
  Synthetic Polynucleotide
taatacgactcactataggggtccagctgcaccgagtaccctcccgcagaaacagaggagatctgcgatggggtactcgaacctggcggcagcgcaaaagatg

SEQ ID NO: 93698 - DNA, 103 bp, Artificial Sequence
  Synthetic Polynucleotide
taatacgactcactatagggagtgcagagcgtccagctgcaccgagtaccaacagaggagaggtactatgtgcagctggaacctggcggcagcgcaaaagatg

SEQ ID NO: 93699 - DNA, 103 bp, Artificial Sequence
  Synthetic Polynucleotide
taatacgactcactatagggaaagtcgagaagtgcagagcgtccagctgcaacagaggagagcagctatgcgctctgcaaacctggcggcagcgcaaaagatg

SEQ ID NO: 93700 - DNA, 103 bp, Artificial Sequence
  Synthetic Polynucleotide
taatacgactcactataggggctgtcctcgaaagtcgagaagtgcagagcaacagaggagagctctgatgttctcgactaacctggcggcagcgcaaaagatg

SEQ ID NO: 93701 - DNA, 103 bp, Artificial Sequence
  Synthetic Polynucleotide
taatacgactcactatagggctgtcagggcgctgtcctcgaaagtcgagaaacagaggagatctcgaatgtcgaggacaaacctggcggcagcgcaaaagatg

SEQ ID NO: 93702 - DNA, 103 bp, Artificial Sequence
  Synthetic Polynucleotide
taatacgactcactatagggggctgcggcggcggcggcggttgcgggagaaacagaggagatctcccatgaccgccgccaacctggcggcagcgcaaaagatg

SEQ ID NO: 93703 - DNA, 103 bp, Artificial Sequence
  Synthetic Polynucleotide
taatacgactcactataggggccatcatcgctgtcagggcgctgtcctcgaacagaggagacgaggaatgcgccctgacaacctggcggcagcgcaaaagatg

SEQ ID NO: 93704 - DNA, 103 bp, Artificial Sequence
  Synthetic Polynucleotide
taatacgactcactatagggattcttttgcgccatcatcgctgtcagggcaacagaggagagccctgatggcgatgatgaacctggcggcagcgcaaaagatg

SEQ ID NO: 93705 - DNA, 103 bp, Artificial Sequence
  Synthetic Polynucleotide
taatacgactcactatagggaaggagacaaattcttttgcgccatcatcgaacagaggagacgatgaatgcgcaaaagaaacctggcggcagcgcaaaagatg

SEQ ID NO: 93706 - DNA, 103 bp, Artificial Sequence
  Synthetic Polynucleotide
taatacgactcactatagggccggggagagaaggagacaaattcttttgcaacagaggagagcaaaaatgtttgtctccaacctggcggcagcgcaaaagatg

SEQ ID NO: 93707 - DNA, 103 bp, Artificial Sequence
  Synthetic Polynucleotide
taatacgactcactatagggcaagatgctcccggggagagaaggagacaaaacagaggagattgtctatgtctctccccaacctggcggcagcgcaaaagatg

SEQ ID NO: 93708 - DNA, 103 bp, Artificial Sequence
  Synthetic Polynucleotide
taatacgactcactataggggcactggctgcaagatgctcccggggagagaacagaggagactctccatgggagcatctaacctggcggcagcgcaaaagatg

SEQ ID NO: 93709 - DNA, 103 bp, Artificial Sequence
  Synthetic Polynucleotide
taatacgactcactatagggttttcctcctgcactggctgcaagatgctcaacagaggagagagcatatggcagccagtaacctggcggcagcgcaaaagatg

SEQ ID NO: 93710 - DNA, 103 bp, Artificial Sequence
  Synthetic Polynucleotide
taatacgactcactatagggagttttgctgttttcctcctgcactggctgaacagaggagacagccaatgcaggaggaaaacctggcggcagcgcaaaagatg

SEQ ID NO: 93711 - DNA, 103 bp, Artificial Sequence
  Synthetic Polynucleotide
taatacgactcactatagggaccgaggcgaagttttgctgttttcctcctaacagaggagaaggaggatgacagcaaaaaacctggcggcagcgcaaaagatg

SEQ ID NO: 93712 - DNA, 103 bp, Artificial Sequence
  Synthetic Polynucleotide
taatacgactcactatagggcttctgtgggaccgaggcgaagttttgctgaacagaggagacagcaaatgttcgcctcgaacctggcggcagcgcaaaagatg

SEQ ID NO: 93713 - DNA, 103 bp, Artificial Sequence
  Synthetic Polynucleotide
taatacgactcactatagggcccgtcctcgaggaccgggatgtgcttcataacagaggagaatgaagatgatcccggtcaacctggcggcagcgcaaaagatg

SEQ ID NO: 93714 - DNA, 103 bp, Artificial Sequence
  Synthetic Polynucleotide
taatacgactcactatagggatagccgttcgcgcgccgcgccggctccttaacagaggagaaaggagatggcgcggcgcaacctggcggcagcgcaaaagatg

SEQ ID NO: 93715 - DNA, 103 bp, Artificial Sequence
  Synthetic Polynucleotide
taatacgactcactatagggggaaagttttatagccgttcgcgcgccgcgaacagaggagacgcggcatgcgaacggctaacctggcggcagcgcaaaagatg

SEQ ID NO: 93716 - DNA, 103 bp, Artificial Sequence
  Synthetic Polynucleotide
taatacgactcactatagggaagtccagtcggaaagttttatagccgttcaacagaggagagaacggatgtaaaactttaacctggcggcagcgcaaaagatg

SEQ ID NO: 93717 - DNA, 103 bp, Artificial Sequence
  Synthetic Polynucleotide
taatacgactcactataggggggcgcttccaagtccagtcggaaagttttaacagaggagaaaaactatgcgactggacaacctggcggcagcgcaaaagatg

SEQ ID NO: 93718 - DNA, 103 bp, Artificial Sequence
  Synthetic Polynucleotide
taatacgactcactatagggcgcggggctcgggcgcttccaagtccagtcaacagaggagagactggatgtggaagcgcaacctggcggcagcgcaaaagatg

SEQ ID NO: 93719 - DNA, 103 bp, Artificial Sequence
  Synthetic Polynucleotide
taatacgactcactataggggtggctacggcgcggggctcgggcgcttccaacagaggagaggaagcatgcgagccccgaacctggcggcagcgcaaaagatg

SEQ ID NO: 93720 - DNA, 103 bp, Artificial Sequence
  Synthetic Polynucleotide
taatacgactcactatagggcagcccgttggtggctacggcgcggggctcaacagaggagagagcccatggccgtagccaacctggcggcagcgcaaaagatg

SEQ ID NO: 93721 - DNA, 103 bp, Artificial Sequence
  Synthetic Polynucleotide
taatacgactcactatagggtcctgtcccgcagcccgttggtggctacggaacagaggagaccgtagatgccaacgggcaacctggcggcagcgcaaaagatg

SEQ ID NO: 93722 - DNA, 103 bp, Artificial Sequence
  Synthetic Polynucleotide
taatacgactcactatagggagccgatgggtcctgtcccgcagcccgttgaacagaggagacaacggatggcgggacagaacctggcggcagcgcaaaagatg

SEQ ID NO: 93723 - DNA, 103 bp, Artificial Sequence
  Synthetic Polynucleotide
taatacgactcactataggggaccggctgcagccgatgggtcctgtcccgaacagaggagacgggacatgacccatcggaacctggcggcagcgcaaaagatg

SEQ ID NO: 93724 - DNA, 103 bp, Artificial Sequence
  Synthetic Polynucleotide
taatacgactcactatagggtcttccacggcccgtcctcgaggaccgggaaacagaggagatcccggatgtcgaggacgaacctggcggcagcgcaaaagatg

SEQ ID NO: 93725 - DNA, 103 bp, Artificial Sequence
  Synthetic Polynucleotide
taatacgactcactatagggccggtaccgggaccggctgcagccgatgggaacagaggagacccatcatgtgcagccggaacctggcggcagcgcaaaagatg

SEQ ID NO: 93726 - DNA, 103 bp, Artificial Sequence
  Synthetic Polynucleotide
taatacgactcactatagggggcaccggcaccggtaccgggaccggctgcaacagaggagagcagccatgcccggtaccaacctggcggcagcgcaaaagatg

SEQ ID NO: 93727 - DNA, 103 bp, Artificial Sequence
  Synthetic Polynucleotide
taatacgactcactatagggcactgggactggcaccggcaccggtaccggaacagaggagaccggtaatggtgccggtgaacctggcggcagcgcaaaagatg

SEQ ID NO: 93728 - DNA, 103 bp, Artificial Sequence
  Synthetic Polynucleotide
taatacgactcactatagggcggccggcgccactgggactggcaccggcaaacagaggagatgccggatgcagtcccagaacctggcggcagcgcaaaagatg

SEQ ID NO: 93729 - DNA, 103 bp, Artificial Sequence
  Synthetic Polynucleotide
taatacgactcactatagggcttgggggaacggccggcgccactgggactaacagaggagaagtcccatgggcgccggcaacctggcggcagcgcaaaagatg

SEQ ID NO: 93730 - DNA, 103 bp, Artificial Sequence
  Synthetic Polynucleotide
taatacgactcactatagggcgtgccccctcttgggggaacggccggcgcaacagaggagagcgccgatggttcccccaaacctggcggcagcgcaaaagatg

SEQ ID NO: 93731 - DNA, 103 bp, Artificial Sequence
  Synthetic Polynucleotide
taatacgactcactatagggcggctgtgtccgtgccccctcttgggggaaaacagaggagattccccatggagggggcaaacctggcggcagcgcaaaagatg

SEQ ID NO: 93732 - DNA, 103 bp, Artificial Sequence
  Synthetic Polynucleotide
taatacgactcactatagggccgcgctccccggctgtgtccgtgccccctaacagaggagaagggggatgggacacagcaacctggcggcagcgcaaaagatg

SEQ ID NO: 93733 - DNA, 103 bp, Artificial Sequence
  Synthetic Polynucleotide
taatacgactcactatagggccgagagcccccgcgctccccggctgtgtcaacagaggagagacacaatgggggagcgcaacctggcggcagcgcaaaagatg

SEQ ID NO: 93734 - DNA, 103 bp, Artificial Sequence
  Synthetic Polynucleotide
taatacgactcactatagggcctcgggcgcccgagagcccccgcgctcccaacagaggagagggagcatgggggctctcaacctggcggcagcgcaaaagatg

SEQ ID NO: 93735 - DNA, 103 bp, Artificial Sequence
  Synthetic Polynucleotide
taatacgactcactatagggacgcacacggtcttccacggcccgtcctcgaacagaggagacgaggaatggccgtggaaaacctggcggcagcgcaaaagatg

SEQ ID NO: 93736 - DNA, 103 bp, Artificial Sequence
  Synthetic Polynucleotide
taatacgactcactataggggcgtcggagacctcgggcgcccgagagcccaacagaggagagggctcatgggcgcccgaaacctggcggcagcgcaaaagatg

SEQ ID NO: 93737 - DNA, 103 bp, Artificial Sequence
  Synthetic Polynucleotide
taatacgactcactataggggcgtttccgcgcgtcggagacctcgggcgcaacagaggagagcgcccatggtctccgacaacctggcggcagcgcaaaagatg

SEQ ID NO: 93738 - DNA, 103 bp, Artificial Sequence
  Synthetic Polynucleotide
taatacgactcactataggggggcgaagcagcgtttccgcgcgtcggagaaacagaggagatctccgatgcgcggaaacaacctggcggcagcgcaaaagatg

SEQ ID NO: 93739 - DNA, 103 bp, Artificial Sequence
  Synthetic Polynucleotide
taatacgactcactatagggactgcgcctagggcgaagcagcgtttccgcaacagaggagagcggaaatgctgcttcgcaacctggcggcagcgcaaaagatg

SEQ ID NO: 93740 - DNA, 103 bp, Artificial Sequence
  Synthetic Polynucleotide
taatacgactcactatagggtcctggccccactgcgcctagggcgaagcaaacagaggagatgcttcatgctaggcgcaaacctggcggcagcgcaaaagatg

SEQ ID NO: 93741 - DNA, 103 bp, Artificial Sequence
  Synthetic Polynucleotide
taatacgactcactataggggcgtggggagtcctggccccactgcgcctaaacagaggagataggcgatgtggggccagaacctggcggcagcgcaaaagatg

SEQ ID NO: 93742 - DNA, 103 bp, Artificial Sequence
  Synthetic Polynucleotide
taatacgactcactatagggggcggcggcggcgtggggagtcctggccccaacagaggagaggggccatgactccccacaacctggcggcagcgcaaaagatg

SEQ ID NO: 93743 - DNA, 103 bp, Artificial Sequence
  Synthetic Polynucleotide
taatacgactcactatagggaggaggcggcggcggcggcggcgtggggagaacagaggagactccccatgccgccgccgaacctggcggcagcgcaaaagatg

SEQ ID NO: 93744 - DNA, 103 bp, Artificial Sequence
  Synthetic Polynucleotide
taatacgactcactatagggtctggggcgcaggaggcggcggcggcggcgaacagaggagacgccgcatgcgccgcctcaacctggcggcagcgcaaaagatg

SEQ ID NO: 93745 - DNA, 103 bp, Artificial Sequence
  Synthetic Polynucleotide
taatacgactcactatagggggtgcctggctctggggcgcaggaggcggcaacagaggagagccgccatgtgcgccccaaacctggcggcagcgcaaaagatg

SEQ ID NO: 93746 - DNA, 103 bp, Artificial Sequence
  Synthetic Polynucleotide
taatacgactcactatagggcagctccttcacgcacacggtcttccacggaacagaggagaccgtggatgaccgtgtgcaacctggcggcagcgcaaaagatg

SEQ ID NO: 93747 - DNA, 103 bp, Artificial Sequence
  Synthetic Polynucleotide
taatacgactcactatagggtgggcccccaggtgcctggctctggggcgcaacagaggagagcgcccatgagccaggcaaacctggcggcagcgcaaaagatg

SEQ ID NO: 93748 - DNA, 103 bp, Artificial Sequence
  Synthetic Polynucleotide
taatacgactcactataggggctgtgcctctgggcccccaggtgcctggcaacagaggagagccaggatgctgggggccaacctggcggcagcgcaaaagatg

SEQ ID NO: 93749 - DNA, 103 bp, Artificial Sequence
  Synthetic Polynucleotide
taatacgactcactatagggtcccggaaaggctgtgcctctgggcccccaaacagaggagatgggggatgagaggcacaaacctggcggcagcgcaaaagatg

SEQ ID NO: 93750 - DNA, 103 bp, Artificial Sequence
  Synthetic Polynucleotide
taatacgactcactatagggcagacccggctcccggaaaggctgtgcctcaacagaggagagaggcaatgcctttccggaacctggcggcagcgcaaaagatg

SEQ ID NO: 93751 - DNA, 103 bp, Artificial Sequence
  Synthetic Polynucleotide
taatacgactcactatagggtgcgaggacgcagacccggctcccggaaagaacagaggagactttccatgagccgggtcaacctggcggcagcgcaaaagatg

SEQ ID NO: 93752 - DNA, 103 bp, Artificial Sequence
  Synthetic Polynucleotide
taatacgactcactatagggcacagcaagatgcgaggacgcagacccggcaacagaggagagccgggatggcgtcctcgaacctggcggcagcgcaaaagatg

SEQ ID NO: 93753 - DNA, 103 bp, Artificial Sequence
  Synthetic Polynucleotide
taatacgactcactataggggggcggtgcgcacagcaagatgcgaggacgaacagaggagacgtcctatgatcttgctgaacctggcggcagcgcaaaagatg

SEQ ID NO: 93754 - DNA, 103 bp, Artificial Sequence
  Synthetic Polynucleotide
taatacgactcactatagggcggggcgcgcgggcggtgcgcacagcaagaaacagaggagatcttgcatggcgcaccgcaacctggcggcagcgcaaaagatg

SEQ ID NO: 93755 - DNA, 103 bp, Artificial Sequence
  Synthetic Polynucleotide
taatacgactcactataggggctgacggcgcggggcgcgcgggcggtgcgaacagaggagacgcaccatgcgcgcgcccaacctggcggcagcgcaaaagatg

SEQ ID NO: 93756 - DNA, 103 bp, Artificial Sequence
  Synthetic Polynucleotide
taatacgactcactatagggtgctgggggtgctgacggcgcggggcgcgcaacagaggagagcgcgcatggcgccgtcaaacctggcggcagcgcaaaagatg

SEQ ID NO: 93757 - DNA, 103 bp, Artificial Sequence
  Synthetic Polynucleotide
taatacgactcactatagggtaaggccgttcagctccttcacgcacacggaacagaggagaccgtgtatgtgaaggagcaacctggcggcagcgcaaaagatg

SEQ ID NO: 93758 - DNA, 103 bp, Artificial Sequence
  Synthetic Polynucleotide
taatacgactcactataggggcgctggcggtgctgggggtgctgacggcgaacagaggagacgccgtatgcacccccagaacctggcggcagcgcaaaagatg

SEQ ID NO: 93759 - DNA, 103 bp, Artificial Sequence
  Synthetic Polynucleotide
taatacgactcactataggggactccgggggcgctggcggtgctgggggtaacagaggagaacccccatgaccgccagcaacctggcggcagcgcaaaagatg

SEQ ID NO: 93760 - DNA, 103 bp, Artificial Sequence
  Synthetic Polynucleotide
taatacgactcactataggggcgcacagtggactccgggggcgctggcggaacagaggagaccgccaatgcccccggagaacctggcggcagcgcaaaagatg

SEQ ID NO: 93761 - DNA, 103 bp, Artificial Sequence
  Synthetic Polynucleotide
taatacgactcactatagggggggcgcagggcgcacagtggactccggggaacagaggagaccccggatgccactgtgcaacctggcggcagcgcaaaagatg

SEQ ID NO: 93762 - DNA, 103 bp, Artificial Sequence
  Synthetic Polynucleotide
taatacgactcactataggggggcgcgtcgggggcgcagggcgcacagtgaacagaggagacactgtatgccctgcgccaacctggcggcagcgcaaaagatg

SEQ ID NO: 93763 - DNA, 103 bp, Artificial Sequence
  Synthetic Polynucleotide
taatacgactcactatagggactttccccggggcgcgtcgggggcgcaggaacagaggagacctgcgatgccgacgcgcaacctggcggcagcgcaaaagatg

SEQ ID NO: 93764 - DNA, 103 bp, Artificial Sequence
  Synthetic Polynucleotide
taatacgactcactatagggacgagtaggaactttccccggggcgcgtcgaacagaggagacgacgcatgccggggaaaaacctggcggcagcgcaaaagatg

SEQ ID NO: 93765 - DNA, 103 bp, Artificial Sequence
  Synthetic Polynucleotide
taatacgactcactatagggtgtgaaattgacgagtaggaactttccccgaacagaggagacggggaatgttcctactcaacctggcggcagcgcaaaagatg

SEQ ID NO: 93766 - DNA, 103 bp, Artificial Sequence
  Synthetic Polynucleotide
taatacgactcactataggggtaaattacgtgtgaaattgacgagtaggaaacagaggagatcctacatgtcaatttcaaacctggcggcagcgcaaaagatg

SEQ ID NO: 93767 - DNA, 103 bp, Artificial Sequence
  Synthetic Polynucleotide
taatacgactcactatagggggtggttattgtaaattacgtgtgaaattgaacagaggagacaatttatgacgtaatttaacctggcggcagcgcaaaagatg

SEQ ID NO: 93768 - DNA, 103 bp, Artificial Sequence
  Synthetic Polynucleotide
taatacgactcactatagggttgagcttcttaaggccgttcagctccttcaacagaggagagaaggaatggaacggcctaacctggcggcagcgcaaaagatg

SEQ ID NO: 93769 - DNA, 103 bp, Artificial Sequence
  Synthetic Polynucleotide
taatacgactcactataggggaggaatcctggtggttattgtaaattacgaacagaggagacgtaatatgcaataaccaaacctggcggcagcgcaaaagatg

SEQ ID NO: 93770 - DNA, 103 bp, Artificial Sequence
  Synthetic Polynucleotide
taatacgactcactatagggaggcgacgcggaggaatcctggtggttattaacagaggagaaataacatgcaggattccaacctggcggcagcgcaaaagatg

SEQ ID NO: 93771 - DNA, 103 bp, Artificial Sequence
  Synthetic Polynucleotide
taatacgactcactataggggtcgtttcctaggcgacgcggaggaatcctaacagaggagaaggattatgccgcgtcgcaacctggcggcagcgcaaaagatg

SEQ ID NO: 93772 - DNA, 103 bp, Artificial Sequence
  Synthetic Polynucleotide
taatacgactcactataggggcttcgcccggtcgtttcctaggcgacgcgaacagaggagacgcgtcatgtaggaaacgaacctggcggcagcgcaaaagatg

SEQ ID NO: 93773 - DNA, 103 bp, Artificial Sequence
  Synthetic Polynucleotide
taatacgactcactatagggggcggcagtcgcttcgcccggtcgtttcctaacagaggagaaggaaaatgccgggcgaaaacctggcggcagcgcaaaagatg

SEQ ID NO: 93774 - DNA, 103 bp, Artificial Sequence
  Synthetic Polynucleotide
taatacgactcactatagggtctcggaggaggcggcagtcgcttcgcccgaacagaggagacgggcgatgcgactgccgaacctggcggcagcgcaaaagatg

SEQ ID NO: 93775 - DNA, 103 bp, Artificial Sequence
  Synthetic Polynucleotide
taatacgactcactatagggagggctttgatctcggaggaggcggcagtcaacagaggagagactgcatgctcctccgaaacctggcggcagcgcaaaagatg

SEQ ID NO: 93776 - DNA, 103 bp, Artificial Sequence
  Synthetic Polynucleotide
taatacgactcactatagggggtctgctgcagggctttgatctcggaggaaacagaggagatcctccatgatcaaagccaacctggcggcagcgcaaaagatg

SEQ ID NO: 93777 - DNA, 103 bp, Artificial Sequence
  Synthetic Polynucleotide
taatacgactcactatagggggagcctccgggtctgctgcagggctttgaaacagaggagatcaaagatgtgcagcagaaacctggcggcagcgcaaaagatg

SEQ ID NO: 93778 - DNA, 103 bp, Artificial Sequence
  Synthetic Polynucleotide
taatacgactcactataggggcgttcgccaggagcctccgggtctgctgcaacagaggagagcagcaatgccggaggctaacctggcggcagcgcaaaagatg

SEQ ID NO: 93779 - DNA, 103 bp, Artificial Sequence
  Synthetic Polynucleotide
taatacgactcactataggggcctttccgcttgagcttcttaaggccgttaacagaggagaaacggcatgaagaagctcaacctggcggcagcgcaaaagatg

SEQ ID NO: 93780 - DNA, 103 bp, Artificial Sequence
  Synthetic Polynucleotide
taatacgactcactatagggccgctccctggcgttcgccaggagcctccgaacagaggagacggaggatgctggcgaacaacctggcggcagcgcaaaagatg

SEQ ID NO: 93781 - DNA, 103 bp, Artificial Sequence
  Synthetic Polynucleotide
taatacgactcactataggggcacccgcgtccgctccctggcgttcgccaaacagaggagatggcgaatgccagggagcaacctggcggcagcgcaaaagatg

SEQ ID NO: 93782 - DNA, 103 bp, Artificial Sequence
  Synthetic Polynucleotide
taatacgactcactatagggctgatggtgtgcacccgcgtccgctccctgaacagaggagacagggaatggacgcgggtaacctggcggcagcgcaaaagatg

SEQ ID NO: 93783 - DNA, 103 bp, Artificial Sequence
  Synthetic Polynucleotide
taatacgactcactataggggaaggctgcgctgatggtgtgcacccgcgtaacagaggagaacgcggatgcacaccatcaacctggcggcagcgcaaaagatg

SEQ ID NO: 93784 - DNA, 103 bp, Artificial Sequence
  Synthetic Polynucleotide
taatacgactcactatagggtgagcgcctcgaaggctgcgctgatggtgtaacagaggagaacaccaatggcgcagcctaacctggcggcagcgcaaaagatg

SEQ ID NO: 93785 - DNA, 103 bp, Artificial Sequence
  Synthetic Polynucleotide
taatacgactcactatagggacctgcttcctgagcgcctcgaaggctgcgaacagaggagacgcagcatgcgaggcgctaacctggcggcagcgcaaaagatg

SEQ ID NO: 93786 - DNA, 103 bp, Artificial Sequence
  Synthetic Polynucleotide
taatacgactcactataggggtagcacggcacctgcttcctgagcgcctcaacagaggagagaggcgatgaggaagcagaacctggcggcagcgcaaaagatg

SEQ ID NO: 93787 - DNA, 103 bp, Artificial Sequence
  Synthetic Polynucleotide
taatacgactcactataggggcccatatgagtagcacggcacctgcttccaacagaggagaggaagcatgtgccgtgctaacctggcggcagcgcaaaagatg

SEQ ID NO: 93788 - DNA, 103 bp, Artificial Sequence
  Synthetic Polynucleotide
taatacgactcactataggggacagcttctgcccatatgagtagcacggcaacagaggagagccgtgatgctcatatggaacctggcggcagcgcaaaagatg

SEQ ID NO: 93789 - DNA, 103 bp, Artificial Sequence
  Synthetic Polynucleotide
taatacgactcactatagggggccagtttggacagcttctgcccatatgaaacagaggagatcatatatgcagaagctgaacctggcggcagcgcaaaagatg

SEQ ID NO: 93790 - DNA, 103 bp, Artificial Sequence
  Synthetic Polynucleotide
taatacgactcactatagggccggctccttgcctttccgcttgagcttctaacagaggagaagaagcatgagcggaaagaacctggcggcagcgcaaaagatg

SEQ ID NO: 93791 - DNA, 103 bp, Artificial Sequence
  Synthetic Polynucleotide
taatacgactcactatagggtcctcaggatggccagtttggacagcttctaacagaggagaagaagcatgccaaactggaacctggcggcagcgcaaaagatg

SEQ ID NO: 93792 - DNA, 103 bp, Artificial Sequence
  Synthetic Polynucleotide
taatacgactcactatagggttacaggcgatcctcaggatggccagtttgaacagaggagacaaactatgcatcctgagaacctggcggcagcgcaaaagatg

SEQ ID NO: 93793 - DNA, 103 bp, Artificial Sequence
  Synthetic Polynucleotide
taatacgactcactatagggcaggatgtagttacaggcgatcctcaggataacagaggagaatcctgatgatcgcctgtaacctggcggcagcgcaaaagatg

SEQ ID NO: 93794 - DNA, 103 bp, Artificial Sequence
  Synthetic Polynucleotide
taatacgactcactataggggcgccagggacaggatgtagttacaggcgaaacagaggagatcgcctatgactacatccaacctggcggcagcgcaaaagatg

SEQ ID NO: 93795 - DNA, 103 bp, Artificial Sequence
  Synthetic Polynucleotide
taatacgactcactatagggtcagccagccgcgccagggacaggatgtagaacagaggagactacatatggtccctggcaacctggcggcagcgcaaaagatg

SEQ ID NO: 93796 - DNA, 103 bp, Artificial Sequence
  Synthetic Polynucleotide
taatacgactcactataggggtagtcaaggtcagccagccgcgccagggaaacagaggagatccctgatgcggctggctaacctggcggcagcgcaaaagatg

SEQ ID NO: 93797 - DNA, 103 bp, Artificial Sequence
  Synthetic Polynucleotide
taatacgactcactatagggggtcggcactgtagtcaaggtcagccagccaacagaggagaggctggatgaccttgactaacctggcggcagcgcaaaagatg

SEQ ID NO: 93798 - DNA, 103 bp, Artificial Sequence
  Synthetic Polynucleotide
taatacgactcactatagggaggttgctgtggtcggcactgtagtcaaggaacagaggagaccttgaatgcagtgccgaaacctggcggcagcgcaaaagatg

SEQ ID NO: 93799 - DNA, 103 bp, Artificial Sequence
  Synthetic Polynucleotide
taatacgactcactatagggggagaagctgaggttgctgtggtcggcactaacagaggagaagtgccatgcacagcaacaacctggcggcagcgcaaaagatg

SEQ ID NO: 93800 - DNA, 103 bp, Artificial Sequence
  Synthetic Polynucleotide
taatacgactcactataggggcacacactcggagaagctgaggttgctgtaacagaggagaacagcaatgtcagcttctaacctggcggcagcgcaaaagatg

SEQ ID NO: 93801 - DNA, 103 bp, Artificial Sequence
  Synthetic Polynucleotide
taatacgactcactataggggcgcgccgcgccggctccttgcctttccgcaacagaggagagcggaaatgcaaggagccaacctggcggcagcgcaaaagatg

SEQ ID NO: 93802 - DNA, 103 bp, Artificial Sequence
  Synthetic Polynucleotide
taatacgactcactataggggtgcagcgctgcacacactcggagaagctgaacagaggagacagcttatgcgagtgtgtaacctggcggcagcgcaaaagatg

SEQ ID NO: 93803 - DNA, 103 bp, Artificial Sequence
  Synthetic Polynucleotide
taatacgactcactatagggcagggtgcgggtgcagcgctgcacacactcaacagaggagagagtgtatgcagcgctgcaacctggcggcagcgcaaaagatg

SEQ ID NO: 93804 - DNA, 103 bp, Artificial Sequence
  Synthetic Polynucleotide
taatacgactcactatagggcctcggcctgcagggtgcgggtgcagcgctaacagaggagaagcgctatgcccgcacccaacctggcggcagcgcaaaagatg

SEQ ID NO: 93805 - DNA, 103 bp, Artificial Sequence
  Synthetic Polynucleotide
taatacgactcactatagggttggcacgtccctcggcctgcagggtgcggaacagaggagaccgcacatggcaggccgaaacctggcggcagcgcaaaagatg

SEQ ID NO: 93806 - DNA, 103 bp, Artificial Sequence
  Synthetic Polynucleotide
taatacgactcactatagggcttgcgcttcttggcacgtccctcggcctgaacagaggagacaggccatgggacgtgccaacctggcggcagcgcaaaagatg

SEQ ID NO: 93807 - DNA, 103 bp, Artificial Sequence
  Synthetic Polynucleotide
taatacgactcactatagggttcttgtttctcgtggaagatggactccataacagaggagaatggagatgatcttccacaacctggcggcagcgcaaaagatg

SEQ ID NO: 93808 - DNA, 103 bp, Artificial Sequence
  Synthetic Polynucleotide
taatacgactcactatagggcagctgatgtgcaattgaggataattccacaacagaggagagtggaaatgtcctcaattaacctggcggcagcgcaaaagatg

SEQ ID NO: 93809 - DNA, 103 bp, Artificial Sequence
  Synthetic Polynucleotide
taatacgactcactatagggaagcatgtcttcttcactcatagcatcaccaacagaggagaggtgatatgatgagtgaaaacctggcggcagcgcaaaagatg

SEQ ID NO: 93810 - DNA, 103 bp, Artificial Sequence
  Synthetic Polynucleotide
taatacgactcactatagggcagctgcctgaagcatgtcttcttcactcaaacagaggagatgagtgatgaagacatgcaacctggcggcagcgcaaaagatg

SEQ ID NO: 93811 - DNA, 103 bp, Artificial Sequence
  Synthetic Polynucleotide
taatacgactcactataggggacatggtcacagctgcctgaagcatgtctaacagaggagaagacatatgtcaggcagcaacctggcggcagcgcaaaagatg

SEQ ID NO: 93812 - DNA, 103 bp, Artificial Sequence
  Synthetic Polynucleotide
taatacgactcactatagggagtttctaaagacatggtcacagctgcctgaacagaggagacaggcaatggtgaccatgaacctggcggcagcgcaaaagatg

SEQ ID NO: 93813 - DNA, 103 bp, Artificial Sequence
  Synthetic Polynucleotide
taatacgactcactatagggcatttctgacagtttctaaagacatggtcaaacagaggagatgaccaatgctttagaaaaacctggcggcagcgcaaaagatg

SEQ ID NO: 93814 - DNA, 103 bp, Artificial Sequence
  Synthetic Polynucleotide
taatacgactcactataggggttttcaaatcatttctgacagtttctaaaaacagaggagatttagaatgtgtcagaaaaacctggcggcagcgcaaaagatg

SEQ ID NO: 93815 - DNA, 103 bp, Artificial Sequence
  Synthetic Polynucleotide
taatacgactcactatagggttttccttctgttttcaaatcatttctgacaacagaggagagtcagaatggatttgaaaaacctggcggcagcgcaaaagatg

SEQ ID NO: 93816 - DNA, 103 bp, Artificial Sequence
  Synthetic Polynucleotide
taatacgactcactatagggcctcctcatccagctgatgtgcaattgaggaacagaggagacctcaaatgcacatcagcaacctggcggcagcgcaaaagatg

SEQ ID NO: 93817 - DNA, 103 bp, Artificial Sequence
  Synthetic Polynucleotide
taatacgactcactatagggctcatcctctcctcctcatccagctgatgtaacagaggagaacatcaatgggatgaggaaacctggcggcagcgcaaaagatg

SEQ ID NO: 93818 - DNA, 103 bp, Artificial Sequence
  Synthetic Polynucleotide
taatacgactcactatagggttctgccattctcatcctctcctcctcatcaacagaggagagatgagatggagaggatgaacctggcggcagcgcaaaagatg

SEQ ID NO: 93819 - DNA, 103 bp, Artificial Sequence
  Synthetic Polynucleotide
taatacgactcactatagggtaactcctccttctgccattctcatcctctaacagaggagaagaggaatggaatggcagaacctggcggcagcgcaaaagatg

SEQ ID NO: 93820 - DNA, 103 bp, Artificial Sequence
  Synthetic Polynucleotide
taatacgactcactatagggtcttcactagtaactcctccttctgccattaacagaggagaaatggcatgaggaggagtaacctggcggcagcgcaaaagatg

SEQ ID NO: 93821 - DNA, 103 bp, Artificial Sequence
  Synthetic Polynucleotide
taatacgactcactatagggcgtgcgataatcttcactagtaactcctccaacagaggagaggaggaatgactagtgaaaacctggcggcagcgcaaaagatg

SEQ ID NO: 93822 - DNA, 103 bp, Artificial Sequence
  Synthetic Polynucleotide
taatacgactcactataggggctgtaaaaacgtgcgataatcttcactagaacagaggagactagtgatgattatcgcaaacctggcggcagcgcaaaagatg

SEQ ID NO: 93823 - DNA, 103 bp, Artificial Sequence
  Synthetic Polynucleotide
taatacgactcactatagggccagaaggctgctgtaaaaacgtgcgataaaacagaggagattatcgatggtttttacaaacctggcggcagcgcaaaagatg

SEQ ID NO: 93824 - DNA, 103 bp, Artificial Sequence
  Synthetic Polynucleotide
taatacgactcactatagggatccatatttccagaaggctgctgtaaaaaaacagaggagatttttaatgcagccttctaacctggcggcagcgcaaaagatg

SEQ ID NO: 93825 - DNA, 103 bp, Artificial Sequence
  Synthetic Polynucleotide
taatacgactcactatagggaaagtgagccttcttgtttctcgtggaagaaacagaggagatcttccatgagaaacaagaacctggcggcagcgcaaaagatg

SEQ ID NO: 93826 - DNA, 103 bp, Artificial Sequence
  Synthetic Polynucleotide
taatacgactcactatagggaaccactgtcatccatatttccagaaggctaacagaggagaagccttatggaaatatggaacctggcggcagcgcaaaagatg

SEQ ID NO: 93827 - DNA, 103 bp, Artificial Sequence
  Synthetic Polynucleotide
taatacgactcactatagggatagagaaaaaaccactgtcatccatatttaacagaggagaaaatatatgtgacagtggaacctggcggcagcgcaaaagatg

SEQ ID NO: 93828 - DNA, 103 bp, Artificial Sequence
  Synthetic Polynucleotide
taatacgactcactatagggtataacctgaatagagaaaaaaccactgtcaacagaggagagacagtatgtttttctctaacctggcggcagcgcaaaagatg

SEQ ID NO: 93829 - DNA, 103 bp, Artificial Sequence
  Synthetic Polynucleotide
taatacgactcactatagggaggcattgcttataacctgaatagagaaaaaacagaggagattttctatgttcaggttaaacctggcggcagcgcaaaagatg

SEQ ID NO: 93830 - DNA, 103 bp, Artificial Sequence
  Synthetic Polynucleotide
taatacgactcactatagggcaaactttcaaggcattgcttataacctgaaacagaggagatcaggtatgaagcaatgcaacctggcggcagcgcaaaagatg

SEQ ID NO: 93831 - DNA, 103 bp, Artificial Sequence
  Synthetic Polynucleotide
taatacgactcactatagggttctaaaccccaaactttcaaggcattgctaacagaggagaagcaatatgttgaaagttaacctggcggcagcgcaaaagatg

SEQ ID NO: 93832 - DNA, 103 bp, Artificial Sequence
  Synthetic Polynucleotide
taatacgactcactatagggacaggattagttctaaaccccaaactttcaaacagaggagatgaaagatgggggtttagaacctggcggcagcgcaaaagatg

SEQ ID NO: 93833 - DNA, 103 bp, Artificial Sequence
  Synthetic Polynucleotide
taatacgactcactatagggggactgttgaacaggattagttctaaacccaacagaggagagggtttatgactaatcctaacctggcggcagcgcaaaagatg

SEQ ID NO: 93834 - DNA, 103 bp, Artificial Sequence
  Synthetic Polynucleotide
taatacgactcactatagggctgatactctggactgttgaacaggattagaacagaggagactaatcatgttcaacagtaacctggcggcagcgcaaaagatg

SEQ ID NO: 93835 - DNA, 103 bp, Artificial Sequence
  Synthetic Polynucleotide
taatacgactcactatagggtcctgagcctctgatactctggactgttgaaacagaggagatcaacaatgcagagtatcaacctggcggcagcgcaaaagatg

SEQ ID NO: 93836 - DNA, 103 bp, Artificial Sequence
  Synthetic Polynucleotide
taatacgactcactatagggtgttgagcacaaagtgagccttcttgtttcaacagaggagagaaacaatgaggctcactaacctggcggcagcgcaaaagatg

SEQ ID NO: 93837 - DNA, 103 bp, Artificial Sequence
  Synthetic Polynucleotide
taatacgactcactatagggataggatcgatcctgagcctctgatactctaacagaggagaagagtaatggaggctcagaacctggcggcagcgcaaaagatg

SEQ ID NO: 93838 - DNA, 103 bp, Artificial Sequence
  Synthetic Polynucleotide
taatacgactcactatagggtctttcatttataggatcgatcctgagcctaacagaggagaaggctcatgatcgatcctaacctggcggcagcgcaaaagatg

SEQ ID NO: 93839 - DNA, 103 bp, Artificial Sequence
  Synthetic Polynucleotide
taatacgactcactatagggatataaatgatctttcatttataggatcgaaacagaggagatcgatcatgtaaatgaaaaacctggcggcagcgcaaaagatg

SEQ ID NO: 93840 - DNA, 103 bp, Artificial Sequence
  Synthetic Polynucleotide
taatacgactcactatagggttataattgcatataaatgatctttcatttaacagaggagaaaatgaatgatcatttataacctggcggcagcgcaaaagatg

SEQ ID NO: 93841 - DNA, 103 bp, Artificial Sequence
  Synthetic Polynucleotide
taatacgactcactatagggccagtgttccttataattgcatataaatgaaacagaggagatcatttatgtgcaattataacctggcggcagcgcaaaagatg

SEQ ID NO: 93842 - DNA, 103 bp, Artificial Sequence
  Synthetic Polynucleotide
taatacgactcactatagggtaactgtaaaccagtgttccttataattgcaacagaggagagcaattatgaggaacactaacctggcggcagcgcaaaagatg

SEQ ID NO: 93843 - DNA, 103 bp, Artificial Sequence
  Synthetic Polynucleotide
taatacgactcactatagggcctaattttctaactgtaaaccagtgttccaacagaggagaggaacaatggtttacagtaacctggcggcagcgcaaaagatg

SEQ ID NO: 93844 - DNA, 103 bp, Artificial Sequence
  Synthetic Polynucleotide
taatacgactcactatagggccactgttttcctaattttctaactgtaaaaacagaggagatttacaatgagaaaattaaacctggcggcagcgcaaaagatg

SEQ ID NO: 93845 - DNA, 103 bp, Artificial Sequence
  Synthetic Polynucleotide
taatacgactcactatagggtcaagttaaaccactgttttcctaattttcaacagaggagagaaaatatggaaaacagtaacctggcggcagcgcaaaagatg

SEQ ID NO: 93846 - DNA, 103 bp, Artificial Sequence
  Synthetic Polynucleotide
taatacgactcactatagggaagagagaattcaagttaaaccactgttttaacagaggagaaaaacaatggtttaacttaacctggcggcagcgcaaaagatg

SEQ ID NO: 93847 - DNA, 103 bp, Artificial Sequence
  Synthetic Polynucleotide
taatacgactcactatagggattcaggcaatgttgagcacaaagtgagccaacagaggagaggctcaatgtgtgctcaaaacctggcggcagcgcaaaagatg

SEQ ID NO: 93848 - DNA, 103 bp, Artificial Sequence
  Synthetic Polynucleotide
taatacgactcactatagggtggacccgtcaagagagaattcaagttaaaaacagaggagatttaacatgaattctctcaacctggcggcagcgcaaaagatg

SEQ ID NO: 93849 - DNA, 103 bp, Artificial Sequence
  Synthetic Polynucleotide
taatacgactcactatagggatattaattctggacccgtcaagagagaataacagaggagaattctcatgtgacgggtcaacctggcggcagcgcaaaagatg

SEQ ID NO: 93850 - DNA, 103 bp, Artificial Sequence
  Synthetic Polynucleotide
taatacgactcactatagggtatgtatctgatattaattctggacccgtcaacagaggagagacgggatgagaattaataacctggcggcagcgcaaaagatg

SEQ ID NO: 93851 - DNA, 103 bp, Artificial Sequence
  Synthetic Polynucleotide
taatacgactcactatagggaagtgcaagatatgtatctgatattaattcaacagaggagagaattaatgtcagatacaaacctggcggcagcgcaaaagatg

SEQ ID NO: 93852 - DNA, 103 bp, Artificial Sequence
  Synthetic Polynucleotide
taatacgactcactataggggagccaagaaaagtgcaagatatgtatctgaacagaggagacagataatgatcttgcacaacctggcggcagcgcaaaagatg

SEQ ID NO: 93853 - DNA, 103 bp, Artificial Sequence
  Synthetic Polynucleotide
taatacgactcactatagggtgttgtaattgagccaagaaaagtgcaagaaacagaggagatcttgcatgtttcttggcaacctggcggcagcgcaaaagatg

SEQ ID NO: 93854 - DNA, 103 bp, Artificial Sequence
  Synthetic Polynucleotide
taatacgactcactatagggataaccttcctgttgtaattgagccaagaaaacagaggagattcttgatgcaattacaaaacctggcggcagcgcaaaagatg

SEQ ID NO: 93855 - DNA, 103 bp, Artificial Sequence
  Synthetic Polynucleotide
taatacgactcactatagggcaaatatagaataaccttcctgttgtaattaacagaggagaaattacatgaggaaggttaacctggcggcagcgcaaaagatg

SEQ ID NO: 93856 - DNA, 103 bp, Artificial Sequence
  Synthetic Polynucleotide
taatacgactcactatagggcccttaacgacaaatatagaataaccttccaacagaggagaggaaggatgttctatattaacctggcggcagcgcaaaagatg

SEQ ID NO: 93857 - DNA, 103 bp, Artificial Sequence
  Synthetic Polynucleotide
taatacgactcactatagggtggcagatcacccttaacgacaaatatagaaacagaggagatctataatggtcgttaagaacctggcggcagcgcaaaagatg

SEQ ID NO: 93858 - DNA, 103 bp, Artificial Sequence
  Synthetic Polynucleotide
taatacgactcactataggggcaataagttattcaggcaatgttgagcacaacagaggagagtgctcatgattgcctgaaacctggcggcagcgcaaaagatg

SEQ ID NO: 93859 - DNA, 103 bp, Artificial Sequence
  Synthetic Polynucleotide
taatacgactcactatagggcttcgcaatctggcagatcacccttaacgaaacagaggagatcgttaatggtgatctgcaacctggcggcagcgcaaaagatg

SEQ ID NO: 93860 - DNA, 103 bp, Artificial Sequence
  Synthetic Polynucleotide
taatacgactcactatagggagttggtcagcttcgcaatctggcagatcaaacagaggagatgatctatgagattgcgaaacctggcggcagcgcaaaagatg

SEQ ID NO: 93861 - DNA, 103 bp, Artificial Sequence
  Synthetic Polynucleotide
taatacgactcactatagggcatctgcaggagttggtcagcttcgcaatcaacagaggagagattgcatggctgaccaaaacctggcggcagcgcaaaagatg

SEQ ID NO: 93862 - DNA, 103 bp, Artificial Sequence
  Synthetic Polynucleotide
taatacgactcactatagggggaccctaatcatctgcaggagttggtcagaacagaggagactgaccatgtcctgcagaaacctggcggcagcgcaaaagatg

SEQ ID NO: 93863 - DNA, 103 bp, Artificial Sequence
  Synthetic Polynucleotide
taatacgactcactatagggtgcatctgttggaccctaatcatctgcaggaacagaggagacctgcaatggattagggtaacctggcggcagcgcaaaagatg

SEQ ID NO: 93864 - DNA, 103 bp, Artificial Sequence
  Synthetic Polynucleotide
taatacgactcactatagggttttggtcgatgcatctgttggaccctaataacagaggagaattaggatgcaacagatgaacctggcggcagcgcaaaagatg

SEQ ID NO: 93865 - DNA, 103 bp, Artificial Sequence
  Synthetic Polynucleotide
taatacgactcactatagggctccaataagttttggtcgatgcatctgttaacagaggagaaacagaatgatcgaccaaaacctggcggcagcgcaaaagatg

SEQ ID NO: 93866 - DNA, 103 bp, Artificial Sequence
  Synthetic Polynucleotide
taatacgactcactataggggctaattcttctccaataagttttggtcgaaacagaggagatcgaccatgacttattggaacctggcggcagcgcaaaagatg

SEQ ID NO: 93867 - DNA, 103 bp, Artificial Sequence
  Synthetic Polynucleotide
taatacgactcactatagggttttagttgtgctaattcttctccaataagaacagaggagacttattatggaagaattaaacctggcggcagcgcaaaagatg

SEQ ID NO: 93868 - DNA, 103 bp, Artificial Sequence
  Synthetic Polynucleotide
taatacgactcactatagggctctttgctcttttagttgtgctaattcttaacagaggagaaagaatatgcacaactaaaacctggcggcagcgcaaaagatg

SEQ ID NO: 93869 - DNA, 103 bp, Artificial Sequence
  Synthetic Polynucleotide
taatacgactcactatagggtattctccttgcaataagttattcaggcaaaacagaggagattgcctatgtaacttattaacctggcggcagcgcaaaagatg

SEQ ID NO: 93870 - DNA, 103 bp, Artificial Sequence
  Synthetic Polynucleotide
taatacgactcactataggggttttatggactctttgctcttttagttgtaacagaggagaacaactatgagagcaaagaacctggcggcagcgcaaaagatg

SEQ ID NO: 93871 - DNA, 103 bp, Artificial Sequence
  Synthetic Polynucleotide
taatacgactcactatagggttccaggtctgttttatggactctttgctcaacagaggagagagcaaatggtccataaaaacctggcggcagcgcaaaagatg

SEQ ID NO: 93872 - DNA, 103 bp, Artificial Sequence
  Synthetic Polynucleotide
taatacgactcactatagggctaacactcgttccaggtctgttttatggaaacagaggagatccataatgcagacctggaacctggcggcagcgcaaaagatg

SEQ ID NO: 93873 - DNA, 103 bp, Artificial Sequence
  Synthetic Polynucleotide
taatacgactcactatagggtcatttgcttctaacactcgttccaggtctaacagaggagaagacctatgacgagtgttaacctggcggcagcgcaaaagatg

SEQ ID NO: 93874 - DNA, 103 bp, Artificial Sequence
  Synthetic Polynucleotide
taatacgactcactatagggtcctgagccatcatttgcttctaacactcgaacagaggagacgagtgatggaagcaaataacctggcggcagcgcaaaagatg

SEQ ID NO: 93875 - DNA, 103 bp, Artificial Sequence
  Synthetic Polynucleotide
taatacgactcactatagggcgtctaacattcctgagccatcatttgcttaacagaggagaaagcaaatgatggctcagaacctggcggcagcgcaaaagatg

SEQ ID NO: 93876 - DNA, 103 bp, Artificial Sequence
  Synthetic Polynucleotide
taatacgactcactatagggtcctcatcttcgtctaacattcctgagccaaacagaggagatggctcatgaatgttagaaacctggcggcagcgcaaaagatg

SEQ ID NO: 93877 - DNA, 103 bp, Artificial Sequence
  Synthetic Polynucleotide
taatacgactcactatagggctgcaaatcctcctcatcttcgtctaacataacagaggagaatgttaatggaagatgagaacctggcggcagcgcaaaagatg

SEQ ID NO: 93878 - DNA, 103 bp, Artificial Sequence
  Synthetic Polynucleotide
taatacgactcactatagggccagagccctctgcaaatcctcctcatcttaacagaggagaaagatgatgaggatttgcaacctggcggcagcgcaaaagatg

SEQ ID NO: 93879 - DNA, 103 bp, Artificial Sequence
  Synthetic Polynucleotide
taatacgactcactatagggcgacttagtgccagagccctctgcaaatccaacagaggagaggatttatggagggctctaacctggcggcagcgcaaaagatg

SEQ ID NO: 93880 - DNA, 103 bp, Artificial Sequence
  Synthetic Polynucleotide
taatacgactcactatagggagggctaaaatattctccttgcaataagttaacagaggagaaacttaatgcaaggagaaaacctggcggcagcgcaaaagatg

SEQ ID NO: 93881 - DNA, 103 bp, Artificial Sequence
  Synthetic Polynucleotide
taatacgactcactatagggaatttcttggcgacttagtgccagagccctaacagaggagaagggctatggcactaagtaacctggcggcagcgcaaaagatg

SEQ ID NO: 93882 - DNA, 103 bp, Artificial Sequence
  Synthetic Polynucleotide
taatacgactcactatagggcttccatgtcaatttcttggcgacttagtgaacagaggagacactaaatggccaagaaaaacctggcggcagcgcaaaagatg

SEQ ID NO: 93883 - DNA, 103 bp, Artificial Sequence
  Synthetic Polynucleotide
taatacgactcactataggggcttcctcatcttccatgtcaatttcttggaacagaggagaccaagaatgtgacatggaaacctggcggcagcgcaaaagatg

SEQ ID NO: 93884 - DNA, 103 bp, Artificial Sequence
  Synthetic Polynucleotide
taatacgactcactataggggcggagatctgcttcctcatcttccatgtcaacagaggagagacatgatggatgaggaaaacctggcggcagcgcaaaagatg

SEQ ID NO: 93885 - DNA, 103 bp, Artificial Sequence
  Synthetic Polynucleotide
taatacgactcactataggggaatagccctgcggagatctgcttcctcataacagaggagaatgaggatgcagatctccaacctggcggcagcgcaaaagatg

SEQ ID NO: 93886 - DNA, 103 bp, Artificial Sequence
  Synthetic Polynucleotide
taatacgactcactatagggatacttagctgaatagccctgcggagatctaacagaggagaagatctatgcagggctataacctggcggcagcgcaaaagatg

SEQ ID NO: 93887 - DNA, 103 bp, Artificial Sequence
  Synthetic Polynucleotide
taatacgactcactatagggactaccttgcatacttagctgaatagccctaacagaggagaagggctatgcagctaagtaacctggcggcagcgcaaaagatg

SEQ ID NO: 93888 - DNA, 103 bp, Artificial Sequence
  Synthetic Polynucleotide
taatacgactcactatagggtgtttctggaactaccttgcatacttagctaacagaggagaagctaaatgtgcaaggtaaacctggcggcagcgcaaaagatg

SEQ ID NO: 93889 - DNA, 103 bp, Artificial Sequence
  Synthetic Polynucleotide
taatacgactcactatagggtcttgagatatgtttctggaactaccttgcaacagaggagagcaaggatgttccagaaaaacctggcggcagcgcaaaagatg

SEQ ID NO: 93890 - DNA, 103 bp, Artificial Sequence
  Synthetic Polynucleotide
taatacgactcactatagggctgtgtcatatcttgagatatgtttctggaaacagaggagatccagaatgatatctcaaaacctggcggcagcgcaaaagatg

SEQ ID NO: 93891 - DNA, 103 bp, Artificial Sequence
  Synthetic Polynucleotide
taatacgactcactatagggataattccacagggctaaaatattctccttaacagaggagaaaggagatgattttagccaacctggcggcagcgcaaaagatg

SEQ ID NO: 93892 - DNA, 103 bp, Artificial Sequence
  Synthetic Polynucleotide
taatacgactcactatagggtacctgatgtctgtgtcatatcttgagataaacagaggagatatctcatgatatgacacaacctggcggcagcgcaaaagatg

SEQ ID NO: 93893 - DNA, 103 bp, Artificial Sequence
  Synthetic Polynucleotide
taatacgactcactataggggtaagatttgtacctgatgtctgtgtcataaacagaggagatatgacatggacatcaggaacctggcggcagcgcaaaagatg

SEQ ID NO: 93894 - DNA, 103 bp, Artificial Sequence
  Synthetic Polynucleotide
taatacgactcactatagggctcttctgaagtaagatttgtacctgatgtaacagaggagaacatcaatgacaaatcttaacctggcggcagcgcaaaagatg

SEQ ID NO: 93895 - DNA, 103 bp, Artificial Sequence
  Synthetic Polynucleotide
taatacgactcactatagggtcttccgaagctcttctgaagtaagatttgaacagaggagacaaatcatgcttcagaagaacctggcggcagcgcaaaagatg

SEQ ID NO: 93896 - DNA, 103 bp, Artificial Sequence
  Synthetic Polynucleotide
taatacgactcactataggggcttctcgtctcttccgaagctcttctgaaaacagaggagattcagaatggcttcggaaaacctggcggcagcgcaaaagatg

SEQ ID NO: 93897 - DNA, 103 bp, Artificial Sequence
  Synthetic Polynucleotide
taatacgactcactatagggttcaaagtaggcttctcgtctcttccgaagaacagaggagacttcggatgagacgagaaaacctggcggcagcgcaaaagatg

SEQ ID NO: 93898 - DNA, 103 bp, Artificial Sequence
  Synthetic Polynucleotide
taatacgactcactataggggctgctgtttttcaaagtaggcttctcgtcaacagaggagagacgagatgcctactttgaacctggcggcagcgcaaaagatg

SEQ ID NO: 93899 - DNA, 103 bp, Artificial Sequence
  Synthetic Polynucleotide
taatacgactcactatagggtgctgcttttgctgctgtttttcaaagtagaacagaggagactacttatgaaaacagcaaacctggcggcagcgcaaaagatg

SEQ ID NO: 93900 - DNA, 103 bp, Artificial Sequence
  Synthetic Polynucleotide
taatacgactcactatagggctgctgctgttgctgcttttgctgctgtttaacagaggagaaaacagatgcaaaagcagaacctggcggcagcgcaaaagatg

SEQ ID NO: 93901 - DNA, 103 bp, Artificial Sequence
  Synthetic Polynucleotide
taatacgactcactataggggctgctgctgctgctgctgttgctgcttttaacagaggagaaaaagcatgaacagcagcaacctggcggcagcgcaaaagatg

SEQ ID NO: 93902 - DNA, 103 bp, Artificial Sequence
  Synthetic Polynucleotide
taatacgactcactataggggcaattgaggataattccacagggctaaaaaacagaggagattttagatgtgtggaattaacctggcggcagcgcaaaagatg

SEQ ID NO: 93903 - DNA, 103 bp, Artificial Sequence
  Synthetic Polynucleotide
taatacgactcactatagggtccccctgctgctgctgctgctgctgctgtaacagaggagaacagcaatggcagcagcaaacctggcggcagcgcaaaagatg

SEQ ID NO: 93904 - DNA, 103 bp, Artificial Sequence
  Synthetic Polynucleotide
taatacgactcactatagggtcctgataggtccccctgctgctgctgctgaacagaggagacagcagatgcagcaggggaacctggcggcagcgcaaaagatg

SEQ ID NO: 93905 - DNA, 103 bp, Artificial Sequence
  Synthetic Polynucleotide
taatacgactcactataggggtgaactctgtcctgataggtccccctgctaacagaggagaagcaggatgacctatcagaacctggcggcagcgcaaaagatg

SEQ ID NO: 93906 - DNA, 103 bp, Artificial Sequence
  Synthetic Polynucleotide
taatacgactcactatagggtcacatggatgtgaactctgtcctgataggaacagaggagacctatcatgacagagttcaacctggcggcagcgcaaaagatg

SEQ ID NO: 93907 - DNA, 103 bp, Artificial Sequence
  Synthetic Polynucleotide
taatacgactcactatagggggctggcctttcacatggatgtgaactctgaacagaggagacagagtatgcatccatgtaacctggcggcagcgcaaaagatg

SEQ ID NO: 93908 - DNA, 103 bp, Artificial Sequence
  Synthetic Polynucleotide
taatacgactcactatagggctgaactggtggctggcctttcacatggataacagaggagaatccatatgaaaggccagaacctggcggcagcgcaaaagatg

SEQ ID NO: 93909 - DNA, 103 bp, Artificial Sequence
  Synthetic Polynucleotide
taatacgactcactatagggccaagtgctcctgaactggtggctggccttaacagaggagaaaggccatgcaccagttcaacctggcggcagcgcaaaagatg

SEQ ID NO: 93910 - DNA, 103 bp, Artificial Sequence
  Synthetic Polynucleotide
taatacgactcactatagggtagatcactcccaagtgctcctgaactggtaacagaggagaaccagtatgggagcacttaacctggcggcagcgcaaaagatg

SEQ ID NO: 93911 - DNA, 103 bp, Artificial Sequence
  Synthetic Polynucleotide
taatacgactcactatagggtagcatcacctagatcactcccaagtgctcaacagaggagagagcacatgggagtgatcaacctggcggcagcgcaaaagatg

SEQ ID NO: 93912 - DNA, 103 bp, Artificial Sequence
  Synthetic Polynucleotide
taatacgactcactatagggtcttcactcatagcatcacctagatcactcaacagaggagagagtgaatgaggtgatgcaacctggcggcagcgcaaaagatg

SEQ ID NO: 93913 - DNA, 103 bp, Artificial Sequence
  Synthetic Polynucleotide
taatacgactcactatagggggcaaaaaccgagttctcactcagagacataacagaggagaatgtctatgagtgagaacaacctggcggcagcgcaaaagatg

SEQ ID NO: 93914 - DNA, 103 bp, Artificial Sequence
  Synthetic Polynucleotide
taatacgactcactatagggcacaaagatggtgacatcgcacagcacatcaacagaggagagatgtgatgtgcgatgtcaacctggcggcagcgcaaaagatg

SEQ ID NO: 93915 - DNA, 103 bp, Artificial Sequence
  Synthetic Polynucleotide
taatacgactcactatagggcataccagcaaaattcaagtcaccatattgaacagaggagacaatatatggacttgaataacctggcggcagcgcaaaagatg

SEQ ID NO: 93916 - DNA, 103 bp, Artificial Sequence
  Synthetic Polynucleotide
taatacgactcactatagggttgtgttttgcataccagcaaaattcaagtaacagaggagaacttgaatgttgctggtaaacctggcggcagcgcaaaagatg

SEQ ID NO: 93917 - DNA, 103 bp, Artificial Sequence
  Synthetic Polynucleotide
taatacgactcactataggggttaacactgttgtgttttgcataccagcaaacagaggagatgctggatggcaaaacacaacctggcggcagcgcaaaagatg

SEQ ID NO: 93918 - DNA, 103 bp, Artificial Sequence
  Synthetic Polynucleotide
taatacgactcactatagggaggcttttctgttaacactgttgtgttttgaacagaggagacaaaacatgacagtgttaaacctggcggcagcgcaaaagatg

SEQ ID NO: 93919 - DNA, 103 bp, Artificial Sequence
  Synthetic Polynucleotide
taatacgactcactatagggtacctgacaaaggcttttctgttaacactgaacagaggagacagtgtatgcagaaaagcaacctggcggcagcgcaaaagatg

SEQ ID NO: 93920 - DNA, 103 bp, Artificial Sequence
  Synthetic Polynucleotide
taatacgactcactatagggtggacgtctgtacctgacaaaggcttttctaacagaggagaagaaaaatgtttgtcaggaacctggcggcagcgcaaaagatg

SEQ ID NO: 93921 - DNA, 103 bp, Artificial Sequence
  Synthetic Polynucleotide
taatacgactcactatagggtgttttttcttggacgtctgtacctgacaaaacagaggagattgtcaatgacagacgtcaacctggcggcagcgcaaaagatg

SEQ ID NO: 93922 - DNA, 103 bp, Artificial Sequence
  Synthetic Polynucleotide
taatacgactcactatagggtttcaccaaatgttttttcttggacgtctgaacagaggagacagacgatgaagaaaaaaaacctggcggcagcgcaaaagatg

SEQ ID NO: 93923 - DNA, 103 bp, Artificial Sequence
  Synthetic Polynucleotide
taatacgactcactatagggaaatcctgactttcaccaaatgttttttctaacagaggagaagaaaaatgatttggtgaaacctggcggcagcgcaaaagatg

SEQ ID NO: 93924 - DNA, 103 bp, Artificial Sequence
  Synthetic Polynucleotide
taatacgactcactatagggtttcaaaggtaaatcctgactttcaccaaaaacagaggagatttggtatgagtcaggataacctggcggcagcgcaaaagatg

SEQ ID NO: 93925 - DNA, 103 bp, Artificial Sequence
  Synthetic Polynucleotide
taatacgactcactataggggctgtccctccacaaagatggtgacatcgcaacagaggagagcgatgatgccatctttgaacctggcggcagcgcaaaagatg

SEQ ID NO: 93926 - DNA, 103 bp, Artificial Sequence
  Synthetic Polynucleotide
taatacgactcactatagggccaagtcggatttcaaaggtaaatcctgacaacagaggagagtcaggatgtacctttgaaacctggcggcagcgcaaaagatg

SEQ ID NO: 93927 - DNA, 103 bp, Artificial Sequence
  Synthetic Polynucleotide
taatacgactcactatagggtccctggtgcccaagtcggatttcaaaggtaacagaggagaacctttatgatccgacttaacctggcggcagcgcaaaagatg

SEQ ID NO: 93928 - DNA, 103 bp, Artificial Sequence
  Synthetic Polynucleotide
taatacgactcactatagggactactatcttccctggtgcccaagtcggaaacagaggagatccgacatgggcaccaggaacctggcggcagcgcaaaagatg

SEQ ID NO: 93929 - DNA, 103 bp, Artificial Sequence
  Synthetic Polynucleotide
taatacgactcactatagggtagatgcaacactactatcttccctggtgcaacagaggagagcaccaatgaagatagtaaacctggcggcagcgcaaaagatg

SEQ ID NO: 93930 - DNA, 103 bp, Artificial Sequence
  Synthetic Polynucleotide
taatacgactcactatagggctcctatcactagatgcaacactactatctaacagaggagaagatagatgtgttgcatcaacctggcggcagcgcaaaagatg

SEQ ID NO: 93931 - DNA, 103 bp, Artificial Sequence
  Synthetic Polynucleotide
taatacgactcactatagggctccacactactcctatcactagatgcaacaacagaggagagttgcaatgagtgataggaacctggcggcagcgcaaaagatg

SEQ ID NO: 93932 - DNA, 103 bp, Artificial Sequence
  Synthetic Polynucleotide
taatacgactcactatagggccacttctcgctccacactactcctatcacaacagaggagagtgataatggtagtgtggaacctggcggcagcgcaaaagatg

SEQ ID NO: 93933 - DNA, 103 bp, Artificial Sequence
  Synthetic Polynucleotide
taatacgactcactatagggaggtgttctgccacttctcgctccacactaaacagaggagatagtgtatggcgagaagtaacctggcggcagcgcaaaagatg

SEQ ID NO: 93934 - DNA, 103 bp, Artificial Sequence
  Synthetic Polynucleotide
taatacgactcactataggggccttttgctaggtgttctgccacttctcgaacagaggagacgagaaatggcagaacacaacctggcggcagcgcaaaagatg

SEQ ID NO: 93935 - DNA, 103 bp, Artificial Sequence
  Synthetic Polynucleotide
taatacgactcactatagggcactccagaagccttttgctaggtgttctgaacagaggagacagaacatgtagcaaaagaacctggcggcagcgcaaaagatg

SEQ ID NO: 93936 - DNA, 103 bp, Artificial Sequence
  Synthetic Polynucleotide
taatacgactcactataggggcgcggaaccgctgtccctccacaaagatgaacagaggagacatcttatgggagggacaaacctggcggcagcgcaaaagatg

SEQ ID NO: 93937 - DNA, 103 bp, Artificial Sequence
  Synthetic Polynucleotide
taatacgactcactatagggctgcaaatgtcactccagaagccttttgctaacagaggagaagcaaaatgcttctggagaacctggcggcagcgcaaaagatg

SEQ ID NO: 93938 - DNA, 103 bp, Artificial Sequence
  Synthetic Polynucleotide
taatacgactcactatagggagtgtccgtgctgcaaatgtcactccagaaaacagaggagattctggatggacatttgcaacctggcggcagcgcaaaagatg

SEQ ID NO: 93939 - DNA, 103 bp, Artificial Sequence
  Synthetic Polynucleotide
taatacgactcactatagggtttggcaaggagtgtccgtgctgcaaatgtaacagaggagaacatttatggcacggacaaacctggcggcagcgcaaaagatg

SEQ ID NO: 93940 - DNA, 103 bp, Artificial Sequence
  Synthetic Polynucleotide
taatacgactcactataggggataactgcatttggcaaggagtgtccgtgaacagaggagacacggaatgtccttgccaaacctggcggcagcgcaaaagatg

SEQ ID NO: 93941 - DNA, 103 bp, Artificial Sequence
  Synthetic Polynucleotide
taatacgactcactatagggcacagcaggtgataactgcatttggcaaggaacagaggagaccttgcatgatgcagttaaacctggcggcagcgcaaaagatg

SEQ ID NO: 93942 - DNA, 103 bp, Artificial Sequence
  Synthetic Polynucleotide
taatacgactcactatagggcatctttggccacagcaggtgataactgcaaacagaggagatgcagtatgcacctgctgaacctggcggcagcgcaaaagatg

SEQ ID NO: 93943 - DNA, 103 bp, Artificial Sequence
  Synthetic Polynucleotide
taatacgactcactatagggtgttctgagccatctttggccacagcaggtaacagaggagaacctgcatgggccaaagaaacctggcggcagcgcaaaagatg

SEQ ID NO: 93944 - DNA, 103 bp, Artificial Sequence
  Synthetic Polynucleotide
taatacgactcactatagggctgtgagatctgttctgagccatctttggcaacagaggagagccaaaatgggctcagaaaacctggcggcagcgcaaaagatg

SEQ ID NO: 93945 - DNA, 103 bp, Artificial Sequence
  Synthetic Polynucleotide
taatacgactcactatagggcagaccgtttctgtgagatctgttctgagcaacagaggagagctcagatgagatctcacaacctggcggcagcgcaaaagatg

SEQ ID NO: 93946 - DNA, 103 bp, Artificial Sequence
  Synthetic Polynucleotide
taatacgactcactatagggcacggacactcagaccgtttctgtgagatcaacagaggagagatctcatggaaacggtcaacctggcggcagcgcaaaagatg

SEQ ID NO: 93947 - DNA, 103 bp, Artificial Sequence
  Synthetic Polynucleotide
taatacgactcactatagggggaccggtgagcgcggaaccgctgtccctcaacagaggagagagggaatgcggttccgcaacctggcggcagcgcaaaagatg

SEQ ID NO: 93948 - DNA, 103 bp, Artificial Sequence
  Synthetic Polynucleotide
taatacgactcactataggggatacctaaccacggacactcagaccgtttaacagaggagaaaacggatggagtgtccgaacctggcggcagcgcaaaagatg

SEQ ID NO: 93949 - DNA, 103 bp, Artificial Sequence
  Synthetic Polynucleotide
taatacgactcactatagggcactaatcctgatacctaaccacggacactaacagaggagaagtgtcatgggttaggtaaacctggcggcagcgcaaaagatg

SEQ ID NO: 93950 - DNA, 103 bp, Artificial Sequence
  Synthetic Polynucleotide
taatacgactcactatagggtctgggctctcactaatcctgatacctaacaacagaggagagttaggatgcaggattagaacctggcggcagcgcaaaagatg

SEQ ID NO: 93951 - DNA, 103 bp, Artificial Sequence
  Synthetic Polynucleotide
taatacgactcactatagggttgacctggttctgggctctcactaatcctaacagaggagaaggattatggagagcccaaacctggcggcagcgcaaaagatg

SEQ ID NO: 93952 - DNA, 103 bp, Artificial Sequence
  Synthetic Polynucleotide
taatacgactcactatagggtgaaagtcctttgacctggttctgggctctaacagaggagaagagccatgaaccaggtcaacctggcggcagcgcaaaagatg

SEQ ID NO: 93953 - DNA, 103 bp, Artificial Sequence
  Synthetic Polynucleotide
taatacgactcactatagggcttaatgttgtgaaagtcctttgacctggtaacagaggagaaccaggatgaaggactttaacctggcggcagcgcaaaagatg

SEQ ID NO: 93954 - DNA, 103 bp, Artificial Sequence
  Synthetic Polynucleotide
taatacgactcactataggggttgacagaacttaatgttgtgaaagtcctaacagaggagaaggactatgacaacattaaacctggcggcagcgcaaaagatg

SEQ ID NO: 93955 - DNA, 103 bp, Artificial Sequence
  Synthetic Polynucleotide
taatacgactcactatagggtaaaagggcagttgacagaacttaatgttgaacagaggagacaacatatggttctgtcaaacctggcggcagcgcaaaagatg

SEQ ID NO: 93956 - DNA, 103 bp, Artificial Sequence
  Synthetic Polynucleotide
taatacgactcactatagggagagtacttataaaagggcagttgacagaaaacagaggagattctgtatgctgccctttaacctggcggcagcgcaaaagatg

SEQ ID NO: 93957 - DNA, 103 bp, Artificial Sequence
  Synthetic Polynucleotide
taatacgactcactatagggttcagtactcagagtacttataaaagggcaaacagaggagatgccctatgataagtactaacctggcggcagcgcaaaagatg

SEQ ID NO: 93958 - DNA, 103 bp, Artificial Sequence
  Synthetic Polynucleotide
taatacgactcactatagggccgccagcacggaccggtgagcgcggaaccaacagaggagaggttccatgctcaccggtaacctggcggcagcgcaaaagatg

SEQ ID NO: 93959 - DNA, 103 bp, Artificial Sequence
  Synthetic Polynucleotide
taatacgactcactatagggttgaacagccttcagtactcagagtacttaaacagaggagataagtaatgtgagtactgaacctggcggcagcgcaaaagatg

SEQ ID NO: 93960 - DNA, 103 bp, Artificial Sequence
  Synthetic Polynucleotide
taatacgactcactatagggtccaaattgcttgaacagccttcagtactcaacagaggagagagtacatgaggctgttcaacctggcggcagcgcaaaagatg

SEQ ID NO: 93961 - DNA, 103 bp, Artificial Sequence
  Synthetic Polynucleotide
taatacgactcactataggggtttccaatttccaaattgcttgaacagccaacagaggagaggctgtatgagcaatttgaacctggcggcagcgcaaaagatg

SEQ ID NO: 93962 - DNA, 103 bp, Artificial Sequence
  Synthetic Polynucleotide
taatacgactcactatagggcataatcatcgtttccaatttccaaattgcaacagaggagagcaattatgaaattggaaaacctggcggcagcgcaaaagatg

SEQ ID NO: 93963 - DNA, 103 bp, Artificial Sequence
  Synthetic Polynucleotide
taatacgactcactatagggggttctgaaacataatcatcgtttccaattaacagaggagaaattggatgcgatgattaaacctggcggcagcgcaaaagatg

SEQ ID NO: 93964 - DNA, 103 bp, Artificial Sequence
  Synthetic Polynucleotide
taatacgactcactatagggttcttgctggggttctgaaacataatcatcaacagaggagagatgatatggtttcagaaaacctggcggcagcgcaaaagatg

SEQ ID NO: 93965 - DNA, 103 bp, Artificial Sequence
  Synthetic Polynucleotide
taatacgactcactatagggatgggcaaggttcttgctggggttctgaaaaacagaggagatttcagatgcccagcaagaacctggcggcagcgcaaaagatg

SEQ ID NO: 93966 - DNA, 103 bp, Artificial Sequence
  Synthetic Polynucleotide
taatacgactcactatagggacacaagcatatgggcaaggttcttgctggaacagaggagaccagcaatgaccttgcccaacctggcggcagcgcaaaagatg

SEQ ID NO: 93967 - DNA, 103 bp, Artificial Sequence
  Synthetic Polynucleotide
taatacgactcactatagggcaagctaatgacacaagcatatgggcaaggaacagaggagaccttgcatgtatgcttgtaacctggcggcagcgcaaaagatg

SEQ ID NO: 93968 - DNA, 103 bp, Artificial Sequence
  Synthetic Polynucleotide
taatacgactcactatagggagtcgtctcccaagctaatgacacaagcataacagaggagaatgcttatgtcattagctaacctggcggcagcgcaaaagatg

SEQ ID NO: 93969 - DNA, 103 bp, Artificial Sequence
  Synthetic Polynucleotide
taatacgactcactatagggctgctgcatgccgccagcacggaccggtgaaacagaggagatcaccgatgcgtgctggcaacctggcggcagcgcaaaagatg

SEQ ID NO: 93970 - DNA, 103 bp, Artificial Sequence
  Synthetic Polynucleotide
taatacgactcactatagggtccgtctcagagtcgtctcccaagctaatgaacagaggagacattagatggggagacgaaacctggcggcagcgcaaaagatg

SEQ ID NO: 93971 - DNA, 103 bp, Artificial Sequence
  Synthetic Polynucleotide
taatacgactcactatagggtccttcggtgtccgtctcagagtcgtctccaacagaggagaggagacatgtctgagacgaacctggcggcagcgcaaaagatg

SEQ ID NO: 93972 - DNA, 103 bp, Artificial Sequence
  Synthetic Polynucleotide
taatacgactcactatagggattcactgtctccttcggtgtccgtctcagaacagaggagactgagaatgacaccgaagaacctggcggcagcgcaaaagatg

SEQ ID NO: 93973 - DNA, 103 bp, Artificial Sequence
  Synthetic Polynucleotide
taatacgactcactataggggctgaacaggattcactgtctccttcggtgaacagaggagacaccgaatgagacagtgaaacctggcggcagcgcaaaagatg

SEQ ID NO: 93974 - DNA, 103 bp, Artificial Sequence
  Synthetic Polynucleotide
taatacgactcactatagggttgttctctggctgaacaggattcactgtcaacagaggagagacagtatgtcctgttcaaacctggcggcagcgcaaaagatg

SEQ ID NO: 93975 - DNA, 103 bp, Artificial Sequence
  Synthetic Polynucleotide
taatacgactcactatagggcctcacattcttgttctctggctgaacaggaacagaggagacctgttatgccagagaacaacctggcggcagcgcaaaagatg

SEQ ID NO: 93976 - DNA, 103 bp, Artificial Sequence
  Synthetic Polynucleotide
taatacgactcactatagggggcagttttacctcacattcttgttctctgaacagaggagacagagaatgagaatgtgaaacctggcggcagcgcaaaagatg

SEQ ID NO: 93977 - DNA, 103 bp, Artificial Sequence
  Synthetic Polynucleotide
taatacgactcactatagggtgcattgaatggcagttttacctcacattcaacagaggagagaatgtatggtaaaactgaacctggcggcagcgcaaaagatg

SEQ ID NO: 93978 - DNA, 103 bp, Artificial Sequence
  Synthetic Polynucleotide
taatacgactcactatagggttatccgttgtgcattgaatggcagttttaaacagaggagataaaacatgcattcaatgaacctggcggcagcgcaaaagatg

SEQ ID NO: 93979 - DNA, 103 bp, Artificial Sequence
  Synthetic Polynucleotide
taatacgactcactataggggacagtgaaattatccgttgtgcattgaataacagaggagaattcaaatgacaacggataacctggcggcagcgcaaaagatg

SEQ ID NO: 93980 - DNA, 103 bp, Artificial Sequence
  Synthetic Polynucleotide
taatacgactcactataggggtggaagtaactgctgcatgccgccagcacaacagaggagagtgctgatggcatgcagcaacctggcggcagcgcaaaagatg

SEQ ID NO: 93981 - DNA, 103 bp, Artificial Sequence
  Synthetic Polynucleotide
taatacgactcactatagggatcatttcgagacagtgaaattatccgttgaacagaggagacaacggatgatttcactgaacctggcggcagcgcaaaagatg

SEQ ID NO: 93982 - DNA, 103 bp, Artificial Sequence
  Synthetic Polynucleotide
taatacgactcactatagggaggactgaaaatcatttcgagacagtgaaaaacagaggagatttcacatgctcgaaatgaacctggcggcagcgcaaaagatg

SEQ ID NO: 93983 - DNA, 103 bp, Artificial Sequence
  Synthetic Polynucleotide
taatacgactcactatagggattttcaacaaggactgaaaatcatttcgaaacagaggagatcgaaaatgttttcagtcaacctggcggcagcgcaaaagatg

SEQ ID NO: 93984 - DNA, 103 bp, Artificial Sequence
  Synthetic Polynucleotide
taatacgactcactatagggaagcttgtgcattttcaacaaggactgaaaaacagaggagatttcagatgttgttgaaaaacctggcggcagcgcaaaagatg

SEQ ID NO: 93985 - DNA, 103 bp, Artificial Sequence
  Synthetic Polynucleotide
taatacgactcactataggggttctggagtaagcttgtgcattttcaacaaacagaggagatgttgaatgtgcacaagcaacctggcggcagcgcaaaagatg

SEQ ID NO: 93986 - DNA, 103 bp, Artificial Sequence
  Synthetic Polynucleotide
taatacgactcactatagggcaatccagctgttctggagtaagcttgtgcaacagaggagagcacaaatgtactccagaaacctggcggcagcgcaaaagatg

SEQ ID NO: 93987 - DNA, 103 bp, Artificial Sequence
  Synthetic Polynucleotide
taatacgactcactatagggatcatggatacaatccagctgttctggagtaacagaggagaactccaatgcagctggataacctggcggcagcgcaaaagatg

SEQ ID NO: 93988 - DNA, 103 bp, Artificial Sequence
  Synthetic Polynucleotide
taatacgactcactatagggttcttcgaatatcatggatacaatccagctaacagaggagaagctggatggtatccatgaacctggcggcagcgcaaaagatg

SEQ ID NO: 93989 - DNA, 103 bp, Artificial Sequence
  Synthetic Polynucleotide
taatacgactcactatagggtttttacttcttcttcgaatatcatggataaacagaggagatatccaatgtattcgaagaacctggcggcagcgcaaaagatg

SEQ ID NO: 93990 - DNA, 103 bp, Artificial Sequence
  Synthetic Polynucleotide
taatacgactcactatagggagcaattctgtttttacttcttcttcgaataacagaggagaattcgaatgagaagtaaaaacctggcggcagcgcaaaagatg

SEQ ID NO: 93991 - DNA, 103 bp, Artificial Sequence
  Synthetic Polynucleotide
taatacgactcactatagggcgattcttgagtggaagtaactgctgcatgaacagaggagacatgcaatggttacttccaacctggcggcagcgcaaaagatg

SEQ ID NO: 93992 - DNA, 103 bp, Artificial Sequence
  Synthetic Polynucleotide
taatacgactcactatagggagcgctgtgcagcaattctgtttttacttcaacagaggagagaagtaatgacagaattgaacctggcggcagcgcaaaagatg

SEQ ID NO: 93993 - DNA, 103 bp, Artificial Sequence
  Synthetic Polynucleotide
taatacgactcactatagggctcttgcgacagcgctgtgcagcaattctgaacagaggagacagaatatgtgcacagcgaacctggcggcagcgcaaaagatg

SEQ ID NO: 93994 - DNA, 103 bp, Artificial Sequence
  Synthetic Polynucleotide
taatacgactcactataggggtcaagttttctcttgcgacagcgctgtgcaacagaggagagcacagatgtgtcgcaagaacctggcggcagcgcaaaagatg

SEQ ID NO: 93995 - DNA, 103 bp, Artificial Sequence
  Synthetic Polynucleotide
taatacgactcactatagggtctgtatacagtcaagttttctcttgcgacaacagaggagagtcgcaatggaaaacttgaacctggcggcagcgcaaaagatg

SEQ ID NO: 93996 - DNA, 103 bp, Artificial Sequence
  Synthetic Polynucleotide
taatacgactcactataggggattcaagattctgtatacagtcaagttttaacagaggagaaaaactatgctgtatacaaacctggcggcagcgcaaaagatg

SEQ ID NO: 93997 - DNA, 103 bp, Artificial Sequence
  Synthetic Polynucleotide
taatacgactcactatagggctcaatttctgattcaagattctgtatacaaacagaggagatgtataatgaatcttgaaaacctggcggcagcgcaaaagatg

SEQ ID NO: 93998 - DNA, 103 bp, Artificial Sequence
  Synthetic Polynucleotide
taatacgactcactatagggtttgcagcttctcaatttctgattcaagataacagaggagaatcttgatgcagaaattgaacctggcggcagcgcaaaagatg

SEQ ID NO: 93999 - DNA, 103 bp, Artificial Sequence
  Synthetic Polynucleotide
taatacgactcactatagggtccttttcactttgcagcttctcaatttctaacagaggagaagaaatatggaagctgcaaacctggcggcagcgcaaaagatg

SEQ ID NO: 94000 - DNA, 103 bp, Artificial Sequence
  Synthetic Polynucleotide
taatacgactcactatagggcaacaagctctccttttcactttgcagcttaacagaggagaaagctgatgagtgaaaagaacctggcggcagcgcaaaagatg

SEQ ID NO: 94001 - DNA, 103 bp, Artificial Sequence
  Synthetic Polynucleotide
taatacgactcactatagggctctttccttcaacaagctctccttttcacaacagaggagagtgaaaatgagagcttgtaacctggcggcagcgcaaaagatg

SEQ ID NO: 94002 - DNA, 103 bp, Artificial Sequence
  Synthetic Polynucleotide
taatacgactcactataggggcctggcctacgattcttgagtggaagtaaaacagaggagattacttatgctcaagaataacctggcggcagcgcaaaagatg

SEQ ID NO: 94003 - DNA, 103 bp, Artificial Sequence
  Synthetic Polynucleotide
taatacgactcactatagggaaaatgtgatctctttccttcaacaagctcaacagaggagagagcttatggaaggaaagaacctggcggcagcgcaaaagatg

SEQ ID NO: 94004 - DNA, 103 bp, Artificial Sequence
  Synthetic Polynucleotide
taatacgactcactatagggcagagttgacaaaatgtgatctctttccttaacagaggagaaaggaaatggatcacattaacctggcggcagcgcaaaagatg

SEQ ID NO: 94005 - DNA, 103 bp, Artificial Sequence
  Synthetic Polynucleotide
taatacgactcactatagggttgtctcacccagagttgacaaaatgtgataacagaggagaatcacaatgtgtcaactcaacctggcggcagcgcaaaagatg

SEQ ID NO: 94006 - DNA, 103 bp, Artificial Sequence
  Synthetic Polynucleotide
taatacgactcactatagggaggttctgctttgtctcacccagagttgacaacagaggagagtcaacatggggtgagacaacctggcggcagcgcaaaagatg

SEQ ID NO: 94007 - DNA, 103 bp, Artificial Sequence
  Synthetic Polynucleotide
taatacgactcactatagggaagtccagttaggttctgctttgtctcaccaacagaggagaggtgagatgaagcagaacaacctggcggcagcgcaaaagatg

SEQ ID NO: 94008 - DNA, 103 bp, Artificial Sequence
  Synthetic Polynucleotide
taatacgactcactatagggctttctggcaaagtccagttaggttctgctaacagaggagaagcagaatgtaactggacaacctggcggcagcgcaaaagatg

SEQ ID NO: 94009 - DNA, 103 bp, Artificial Sequence
  Synthetic Polynucleotide
taatacgactcactatagggtctttacaaactttctggcaaagtccagttaacagaggagaaactggatgttgccagaaaacctggcggcagcgcaaaagatg

SEQ ID NO: 94010 - DNA, 103 bp, Artificial Sequence
  Synthetic Polynucleotide
taatacgactcactatagggcagagctgcttctttacaaactttctggcaaacagaggagatgccagatggtttgtaaaaacctggcggcagcgcaaaagatg

SEQ ID NO: 94011 - DNA, 103 bp, Artificial Sequence
  Synthetic Polynucleotide
taatacgactcactataggggttcttgactcagagctgcttctttacaaaaacagaggagatttgtaatgaagcagctcaacctggcggcagcgcaaaagatg

SEQ ID NO: 94012 - DNA, 103 bp, Artificial Sequence
  Synthetic Polynucleotide
taatacgactcactatagggatctgtatttgttcttgactcagagctgctaacagaggagaagcagcatggagtcaagaaacctggcggcagcgcaaaagatg

SEQ ID NO: 94013 - DNA, 103 bp, Artificial Sequence
  Synthetic Polynucleotide
taatacgactcactatagggctctccatcagcctggcctacgattcttgaaacagaggagatcaagaatggtaggccagaacctggcggcagcgcaaaagatg

SEQ ID NO: 94014 - DNA, 103 bp, Artificial Sequence
  Synthetic Polynucleotide
taatacgactcactatagggcttggcgagtatctgtatttgttcttgactaacagaggagaagtcaaatgcaaatacagaacctggcggcagcgcaaaagatg

SEQ ID NO: 94015 - DNA, 103 bp, Artificial Sequence
  Synthetic Polynucleotide
taatacgactcactatagggcagctgagtacttggcgagtatctgtatttaacagaggagaaaatacatgtactcgccaaacctggcggcagcgcaaaagatg

SEQ ID NO: 94016 - DNA, 103 bp, Artificial Sequence
  Synthetic Polynucleotide
taatacgactcactataggggggcaatctgcagctgagtacttggcgagtaacagaggagaactcgcatggtactcagcaacctggcggcagcgcaaaagatg

SEQ ID NO: 94017 - DNA, 103 bp, Artificial Sequence
  Synthetic Polynucleotide
taatacgactcactatagggaaatgaaagtgggcaatctgcagctgagtaaacagaggagatactcaatggcagattgcaacctggcggcagcgcaaaagatg

SEQ ID NO: 94018 - DNA, 103 bp, Artificial Sequence
  Synthetic Polynucleotide
taatacgactcactatagggcagaaattaaaaatgaaagtgggcaatctgaacagaggagacagattatgcactttcataacctggcggcagcgcaaaagatg

SEQ ID NO: 94019 - DNA, 103 bp, Artificial Sequence
  Synthetic Polynucleotide
taatacgactcactatagggttatctttttcagaaattaaaaatgaaagtaacagaggagaactttcatgtttaatttcaacctggcggcagcgcaaaagatg

SEQ ID NO: 94020 - DNA, 103 bp, Artificial Sequence
  Synthetic Polynucleotide
taatacgactcactatagggaggagtacttttatctttttcagaaattaaaacagaggagattaattatggaaaaagataacctggcggcagcgcaaaagatg

SEQ ID NO: 94021 - DNA, 103 bp, Artificial Sequence
  Synthetic Polynucleotide
taatacgactcactataggggttcaccatcaggagtacttttatctttttaacagaggagaaaaaagatgaaagtactcaacctggcggcagcgcaaaagatg

SEQ ID NO: 94022 - DNA, 103 bp, Artificial Sequence
  Synthetic Polynucleotide
taatacgactcactatagggggtaacgccagttcaccatcaggagtacttaacagaggagaaagtacatgtgatggtgaaacctggcggcagcgcaaaagatg

SEQ ID NO: 94023 - DNA, 103 bp, Artificial Sequence
  Synthetic Polynucleotide
taatacgactcactataggggaaaattgatggtaacgccagttcaccatcaacagaggagagatggtatgctggcgttaaacctggcggcagcgcaaaagatg

SEQ ID NO: 94024 - DNA, 103 bp, Artificial Sequence
  Synthetic Polynucleotide
taatacgactcactatagggaagattcataggcaaaaaccgagttctcacaacagaggagagtgagaatgcggtttttgaacctggcggcagcgcaaaagatg

SEQ ID NO: 94025 - DNA, 103 bp, Artificial Sequence
  Synthetic Polynucleotide
taatacgactcactatagggtaatgttcagctctccatcagcctggcctaaacagaggagataggccatgctgatggagaacctggcggcagcgcaaaagatg

SEQ ID NO: 94026 - DNA, 103 bp, Artificial Sequence
  Synthetic Polynucleotide
taatacgactcactatagggcagataaactgaaaattgatggtaacgccaaacagaggagatggcgtatgcatcaatttaacctggcggcagcgcaaaagatg

SEQ ID NO: 94027 - DNA, 103 bp, Artificial Sequence
  Synthetic Polynucleotide
taatacgactcactatagggggaggccggtcagataaactgaaaattgataacagaggagaatcaatatgcagtttatcaacctggcggcagcgcaaaagatg

SEQ ID NO: 94028 - DNA, 103 bp, Artificial Sequence
  Synthetic Polynucleotide
taatacgactcactatagggcagcactgctggaggccggtcagataaactaacagaggagaagtttaatggaccggcctaacctggcggcagcgcaaaagatg

SEQ ID NO: 94029 - DNA, 103 bp, Artificial Sequence
  Synthetic Polynucleotide
taatacgactcactatagggcacagggaggcagcactgctggaggccggtaacagaggagaaccggcatgcagcagtgcaacctggcggcagcgcaaaagatg

SEQ ID NO: 94030 - DNA, 103 bp, Artificial Sequence
  Synthetic Polynucleotide
taatacgactcactatagggtttcctctggcacagggaggcagcactgctaacagaggagaagcagtatggcctccctgaacctggcggcagcgcaaaagatg

SEQ ID NO: 94031 - DNA, 103 bp, Artificial Sequence
  Synthetic Polynucleotide
taatacgactcactatagggaggctcactgtttcctctggcacagggaggaacagaggagacctcccatggccagaggaaacctggcggcagcgcaaaagatg

SEQ ID NO: 94032 - DNA, 103 bp, Artificial Sequence
  Synthetic Polynucleotide
taatacgactcactataggggcgcgtagccaggctcactgtttcctctggaacagaggagaccagagatgacagtgagcaacctggcggcagcgcaaaagatg

SEQ ID NO: 94033 - DNA, 103 bp, Artificial Sequence
  Synthetic Polynucleotide
taatacgactcactatagggtcctgccctcgcgcgtagccaggctcactgaacagaggagacagtgaatgtggctacgcaacctggcggcagcgcaaaagatg

SEQ ID NO: 94034 - DNA, 103 bp, Artificial Sequence
  Synthetic Polynucleotide
taatacgactcactatagggctgctgggactcctgccctcgcgcgtagccaacagaggagaggctacatgcgagggcagaacctggcggcagcgcaaaagatg

SEQ ID NO: 94035 - DNA, 103 bp, Artificial Sequence
  Synthetic Polynucleotide
taatacgactcactatagggctgtggacatctgctgggactcctgccctcaacagaggagagagggcatgagtcccagcaacctggcggcagcgcaaaagatg

SEQ ID NO: 94036 - DNA, 103 bp, Artificial Sequence
  Synthetic Polynucleotide
taatacgactcactatagggtctggaagagtaatgttcagctctccatcaaacagaggagatgatggatggctgaacataacctggcggcagcgcaaaagatg

SEQ ID NO: 94037 - DNA, 103 bp, Artificial Sequence
  Synthetic Polynucleotide
taatacgactcactatagggtcagaggtggctgtggacatctgctgggacaacagaggagagtcccaatggatgtccacaacctggcggcagcgcaaaagatg

SEQ ID NO: 94038 - DNA, 103 bp, Artificial Sequence
  Synthetic Polynucleotide
taatacgactcactatagggcccagcttgctcagaggtggctgtggacataacagaggagaatgtccatggccacctctaacctggcggcagcgcaaaagatg

SEQ ID NO: 94039 - DNA, 103 bp, Artificial Sequence
  Synthetic Polynucleotide
taatacgactcactataggggttccgcaggcccagcttgctcagaggtggaacagaggagaccacctatgagcaagctgaacctggcggcagcgcaaaagatg

SEQ ID NO: 94040 - DNA, 103 bp, Artificial Sequence
  Synthetic Polynucleotide
taatacgactcactatagggtgacgacactgttccgcaggcccagcttgcaacagaggagagcaagcatggcctgcggaaacctggcggcagcgcaaaagatg

SEQ ID NO: 94041 - DNA, 103 bp, Artificial Sequence
  Synthetic Polynucleotide
taatacgactcactatagggcccaccactctgacgacactgttccgcaggaacagaggagacctgcgatgcagtgtcgtaacctggcggcagcgcaaaagatg

SEQ ID NO: 94042 - DNA, 103 bp, Artificial Sequence
  Synthetic Polynucleotide
taatacgactcactatagggaatctgagatcccaccactctgacgacactaacagaggagaagtgtcatgagagtggtgaacctggcggcagcgcaaaagatg

SEQ ID NO: 94043 - DNA, 103 bp, Artificial Sequence
  Synthetic Polynucleotide
taatacgactcactatagggtgctgacagaaatctgagatcccaccactcaacagaggagagagtggatggatctcagaaacctggcggcagcgcaaaagatg

SEQ ID NO: 94044 - DNA, 103 bp, Artificial Sequence
  Synthetic Polynucleotide
taatacgactcactatagggatcagtcatctgctgacagaaatctgagataacagaggagaatctcaatgttctgtcagaacctggcggcagcgcaaaagatg

SEQ ID NO: 94045 - DNA, 103 bp, Artificial Sequence
  Synthetic Polynucleotide
taatacgactcactatagggtagtacatttatcagtcatctgctgacagaaacagaggagatctgtcatgagatgactgaacctggcggcagcgcaaaagatg

SEQ ID NO: 94046 - DNA, 103 bp, Artificial Sequence
  Synthetic Polynucleotide
taatacgactcactatagggtactcatcagtagtacatttatcagtcatcaacagaggagagatgacatgtaaatgtacaacctggcggcagcgcaaaagatg

SEQ ID NO: 94047 - DNA, 103 bp, Artificial Sequence
  Synthetic Polynucleotide
taatacgactcactatagggtgtcacctcttctggaagagtaatgttcagaacagaggagactgaacatgactcttccaaacctggcggcagcgcaaaagatg

SEQ ID NO: 94048 - DNA, 103 bp, Artificial Sequence
  Synthetic Polynucleotide
taatacgactcactatagggatcctttaactgtcacctcttctggaagagaacagaggagactcttcatgaagaggtgaaacctggcggcagcgcaaaagatg

SEQ ID NO: 94049 - DNA, 103 bp, Artificial Sequence
  Synthetic Polynucleotide
taatacgactcactatagggaaaggttcaaatcctttaactgtcacctctaacagaggagaagaggtatgagttaaaggaacctggcggcagcgcaaaagatg

SEQ ID NO: 94050 - DNA, 103 bp, Artificial Sequence
  Synthetic Polynucleotide
taatacgactcactatagggaaactgaattaaaggttcaaatcctttaacaacagaggagagttaaaatgtttgaacctaacctggcggcagcgcaaaagatg

SEQ ID NO: 94051 - DNA, 103 bp, Artificial Sequence
  Synthetic Polynucleotide
taatacgactcactatagggcagtgtaggcaaactgaattaaaggttcaaaacagaggagattgaacatgtaattcagtaacctggcggcagcgcaaaagatg

SEQ ID NO: 94052 - DNA, 103 bp, Artificial Sequence
  Synthetic Polynucleotide
taatacgactcactatagggatcagtttagcagtgtaggcaaactgaattaacagaggagaaattcaatgtgcctacacaacctggcggcagcgcaaaagatg

SEQ ID NO: 94053 - DNA, 103 bp, Artificial Sequence
  Synthetic Polynucleotide
taatacgactcactatagggtttacttaaaatcagtttagcagtgtaggcaacagaggagagcctacatggctaaactgaacctggcggcagcgcaaaagatg

SEQ ID NO: 94054 - DNA, 103 bp, Artificial Sequence
  Synthetic Polynucleotide
taatacgactcactatagggccacattctctttacttaaaatcagtttagaacagaggagactaaacatgttttaagtaaacctggcggcagcgcaaaagatg

SEQ ID NO: 94055 - DNA, 103 bp, Artificial Sequence
  Synthetic Polynucleotide
taatacgactcactatagggctatgcacagaagattcataggcaaaaaccaacagaggagaggttttatgctatgaatcaacctggcggcagcgcaaaagatg

SEQ ID NO: 94056 - DNA, 103 bp, Artificial Sequence
  Synthetic Polynucleotide
taatacgactcactatagggcacacttcatccacattctctttacttaaaaacagaggagatttaagatgagagaatgtaacctggcggcagcgcaaaagatg

SEQ ID NO: 94057 - DNA, 103 bp, Artificial Sequence
  Synthetic Polynucleotide
taatacgactcactatagggcacacatttgcacacttcatccacattctcaacagaggagagagaatatggatgaagtgaacctggcggcagcgcaaaagatg

SEQ ID NO: 94058 - DNA, 103 bp, Artificial Sequence
  Synthetic Polynucleotide
taatacgactcactatagggttaaaaactccacacatttgcacacttcataacagaggagaatgaagatggcaaatgtgaacctggcggcagcgcaaaagatg

SEQ ID NO: 94059 - DNA, 103 bp, Artificial Sequence
  Synthetic Polynucleotide
taatacgactcactatagggttatgtacacttaaaaactccacacatttgaacagaggagacaaatgatgggagtttttaacctggcggcagcgcaaaagatg

SEQ ID NO: 94060 - DNA, 103 bp, Artificial Sequence
  Synthetic Polynucleotide
taatacgactcactatagggttcctcaatattatgtacacttaaaaactcaacagaggagagagtttatgagtgtacataacctggcggcagcgcaaaagatg

SEQ ID NO: 94061 - DNA, 103 bp, Artificial Sequence
  Synthetic Polynucleotide
taatacgactcactataggggaaagcaggattcctcaatattatgtacacaacagaggagagtgtacatgatattgaggaacctggcggcagcgcaaaagatg

SEQ ID NO: 94062 - DNA, 103 bp, Artificial Sequence
  Synthetic Polynucleotide
taatacgactcactatagggttcagaaactgaaagcaggattcctcaataaacagaggagatattgaatgatcctgcttaacctggcggcagcgcaaaagatg

SEQ ID NO: 94063 - DNA, 103 bp, Artificial Sequence
  Synthetic Polynucleotide
taatacgactcactatagggaaacttaaatttcagaaactgaaagcaggaaacagaggagatcctgcatgcagtttctgaacctggcggcagcgcaaaagatg

SEQ ID NO: 94064 - DNA, 103 bp, Artificial Sequence
  Synthetic Polynucleotide
taatacgactcactatagggtggagtccaaaaacttaaatttcagaaactaacagaggagaagtttcatgaatttaagtaacctggcggcagcgcaaaagatg

SEQ ID NO: 94065 - DNA, 103 bp, Artificial Sequence
  Synthetic Polynucleotide
taatacgactcactatagggtggtctgcagtggagtccaaaaacttaaataacagaggagaatttaaatgtttggactcaacctggcggcagcgcaaaagatg

SEQ ID NO: 94066 - DNA, 103 bp, Artificial Sequence
  Synthetic Polynucleotide
taatacgactcactatagggaacattggtgctatgcacagaagattcataaacagaggagatatgaaatgtctgtgcataacctggcggcagcgcaaaagatg

SEQ ID NO: 94067 - DNA, 103 bp, Artificial Sequence
  Synthetic Polynucleotide
taatacgactcactataggggcattcttgctggtctgcagtggagtccaaaacagaggagattggacatgactgcagacaacctggcggcagcgcaaaagatg

SEQ ID NO: 94068 - DNA, 103 bp, Artificial Sequence
  Synthetic Polynucleotide
taatacgactcactatagggtttttcttgggcattcttgctggtctgcagaacagaggagactgcagatgagcaagaataacctggcggcagcgcaaaagatg

SEQ ID NO: 94069 - DNA, 103 bp, Artificial Sequence
  Synthetic Polynucleotide
taatacgactcactataggggaaaagcatttttttcttgggcattcttgcaacagaggagagcaagaatgcccaagaaaaacctggcggcagcgcaaaagatg

SEQ ID NO: 94070 - DNA, 103 bp, Artificial Sequence
  Synthetic Polynucleotide
taatacgactcactatagggacagtgtgatgaaaagcatttttttcttggaacagaggagaccaagaatgaaatgctttaacctggcggcagcgcaaaagatg

SEQ ID NO: 94071 - DNA, 103 bp, Artificial Sequence
  Synthetic Polynucleotide
taatacgactcactatagggctgttttctgacagtgtgatgaaaagcattaacagaggagaaatgctatgcatcacactaacctggcggcagcgcaaaagatg

SEQ ID NO: 94072 - DNA, 103 bp, Artificial Sequence
  Synthetic Polynucleotide
taatacgactcactatagggagtttaaggtctgttttctgacagtgtgataacagaggagaatcacaatgtcagaaaacaacctggcggcagcgcaaaagatg

SEQ ID NO: 94073 - DNA, 103 bp, Artificial Sequence
  Synthetic Polynucleotide
taatacgactcactatagggcaaaagtgaaagtttaaggtctgttttctgaacagaggagacagaaaatggaccttaaaaacctggcggcagcgcaaaagatg

SEQ ID NO: 94074 - DNA, 103 bp, Artificial Sequence
  Synthetic Polynucleotide
taatacgactcactatagggccctctggtccaaaagtgaaagtttaaggtaacagaggagaaccttaatgtttcactttaacctggcggcagcgcaaaagatg

SEQ ID NO: 94075 - DNA, 103 bp, Artificial Sequence
  Synthetic Polynucleotide
taatacgactcactataggggtttctagatccctctggtccaaaagtgaaaacagaggagattcactatgggaccagagaacctggcggcagcgcaaaagatg

SEQ ID NO: 94076 - DNA, 103 bp, Artificial Sequence
  Synthetic Polynucleotide
taatacgactcactatagggcacttcatcagtttctagatccctctggtcaacagaggagagaccagatggatctagaaaacctggcggcagcgcaaaagatg

SEQ ID NO: 94077 - DNA, 103 bp, Artificial Sequence
  Synthetic Polynucleotide
taatacgactcactatagggggctgagtaaaacattggtgctatgcacagaacagaggagactgtgcatggcaccaatgaacctggcggcagcgcaaaagatg

SEQ ID NO: 94078 - DNA, 103 bp, Artificial Sequence
  Synthetic Polynucleotide
taatacgactcactataggggaaattcctccacttcatcagtttctagataacagaggagaatctagatgctgatgaagaacctggcggcagcgcaaaagatg

SEQ ID NO: 94079 - DNA, 103 bp, Artificial Sequence
  Synthetic Polynucleotide
taatacgactcactatagggttattttccagaaattcctccacttcatcaaacagaggagatgatgaatgggaggaattaacctggcggcagcgcaaaagatg

SEQ ID NO: 94080 - DNA, 103 bp, Artificial Sequence
  Synthetic Polynucleotide
taatacgactcactatagggctgaacatttttattttccagaaattcctcaacagaggagagaggaaatgctggaaaataacctggcggcagcgcaaaagatg

SEQ ID NO: 94081 - DNA, 103 bp, Artificial Sequence
  Synthetic Polynucleotide
taatacgactcactatagggactgaggagtctgaacatttttattttccaaacagaggagatggaaaatgaaaatgttcaacctggcggcagcgcaaaagatg

SEQ ID NO: 94082 - DNA, 103 bp, Artificial Sequence
  Synthetic Polynucleotide
taatacgactcactatagggcggagtttacactgaggagtctgaacatttaacagaggagaaaatgtatggactcctcaaacctggcggcagcgcaaaagatg

SEQ ID NO: 94083 - DNA, 103 bp, Artificial Sequence
  Synthetic Polynucleotide
taatacgactcactatagggttgatacctgcggagtttacactgaggagtaacagaggagaactcctatgtgtaaactcaacctggcggcagcgcaaaagatg

SEQ ID NO: 94084 - DNA, 103 bp, Artificial Sequence
  Synthetic Polynucleotide
taatacgactcactatagggttgcatttccttgatacctgcggagtttacaacagaggagagtaaacatggcaggtatcaacctggcggcagcgcaaaagatg

SEQ ID NO: 94085 - DNA, 103 bp, Artificial Sequence
  Synthetic Polynucleotide
taatacgactcactatagggggtgaggcttttgcatttccttgatacctgaacagaggagacaggtaatgaggaaatgcaacctggcggcagcgcaaaagatg

SEQ ID NO: 94086 - DNA, 103 bp, Artificial Sequence
  Synthetic Polynucleotide
taatacgactcactatagggttgtagaggaggtgaggcttttgcatttccaacagaggagaggaaatatgaaagcctcaaacctggcggcagcgcaaaagatg

SEQ ID NO: 94087 - DNA, 103 bp, Artificial Sequence
  Synthetic Polynucleotide
taatacgactcactatagggtggcactgtcttgtagaggaggtgaggcttaacagaggagaaagcctatgctcctctacaacctggcggcagcgcaaaagatg

SEQ ID NO: 94088 - DNA, 103 bp, Artificial Sequence
  Synthetic Polynucleotide
taatacgactcactatagggtggtcattaaggctgagtaaaacattggtgaacagaggagacaccaaatgtttactcagaacctggcggcagcgcaaaagatg

SEQ ID NO: 94089 - DNA, 103 bp, Artificial Sequence
  Synthetic Polynucleotide
taatacgactcactatagggtatgtctgactggcactgtcttgtagaggaaacagaggagatcctctatgagacagtgcaacctggcggcagcgcaaaagatg

SEQ ID NO: 94090 - DNA, 103 bp, Artificial Sequence
  Synthetic Polynucleotide
taatacgactcactatagggcatggactcatatgtctgactggcactgtcaacagaggagagacagtatgagtcagacaaacctggcggcagcgcaaaagatg

SEQ ID NO: 94091 - DNA, 103 bp, Artificial Sequence
  Synthetic Polynucleotide
taatacgactcactatagggtctctaagcacatggactcatatgtctgacaacagaggagagtcagaatgatgagtccaaacctggcggcagcgcaaaagatg

SEQ ID NO: 94092 - DNA, 103 bp, Artificial Sequence
  Synthetic Polynucleotide
taatacgactcactataggggcagcatccttctctaagcacatggactcaaacagaggagatgagtcatggtgcttagaaacctggcggcagcgcaaaagatg

SEQ ID NO: 94093 - DNA, 103 bp, Artificial Sequence
  Synthetic Polynucleotide
taatacgactcactatagggcaaggccagagcagcatccttctctaagcaaacagaggagatgcttaatgaaggatgctaacctggcggcagcgcaaaagatg

SEQ ID NO: 94094 - DNA, 103 bp, Artificial Sequence
  Synthetic Polynucleotide
taatacgactcactatagggataaagaaggcaaggccagagcagcatcctaacagaggagaaggatgatgctctggcctaacctggcggcagcgcaaaagatg

SEQ ID NO: 94095 - DNA, 103 bp, Artificial Sequence
  Synthetic Polynucleotide
taatacgactcactatagggtatttggggcataaagaaggcaaggccagaaacagaggagatctggcatggccttctttaacctggcggcagcgcaaaagatg

SEQ ID NO: 94096 - DNA, 103 bp, Artificial Sequence
  Synthetic Polynucleotide
taatacgactcactataggggaattttctgtatttggggcataaagaaggaacagaggagaccttctatgtgccccaaaaacctggcggcagcgcaaaagatg

SEQ ID NO: 94097 - DNA, 103 bp, Artificial Sequence
  Synthetic Polynucleotide
taatacgactcactatagggatgctttttggaattttctgtatttggggcaacagaggagagccccaatgacagaaaataacctggcggcagcgcaaaagatg

SEQ ID NO: 94098 - DNA, 103 bp, Artificial Sequence
  Synthetic Polynucleotide
taatacgactcactatagggtcagttccaaatgctttttggaattttctgaacagaggagacagaaaatgccaaaaagcaacctggcggcagcgcaaaagatg

SEQ ID NO: 94099 - DNA, 103 bp, Artificial Sequence
  Synthetic Polynucleotide
taatacgactcactatagggtttcttccgctggtcattaaggctgagtaaaacagaggagattactcatgcttaatgacaacctggcggcagcgcaaaagatg

SEQ ID NO: 94100 - DNA, 103 bp, Artificial Sequence
  Synthetic Polynucleotide
taatacgactcactatagggacggactctgtcagttccaaatgctttttgaacagaggagacaaaaaatgtttggaactaacctggcggcagcgcaaaagatg

SEQ ID NO: 94101 - DNA, 103 bp, Artificial Sequence
  Synthetic Polynucleotide
taatacgactcactatagggattccccagtacggactctgtcagttccaaaacagaggagattggaaatgacagagtccaacctggcggcagcgcaaaagatg

SEQ ID NO: 94102 - DNA, 103 bp, Artificial Sequence
  Synthetic Polynucleotide
taatacgactcactatagggttgacactagattccccagtacggactctgaacagaggagacagagtatgtactggggaaacctggcggcagcgcaaaagatg

SEQ ID NO: 94103 - DNA, 103 bp, Artificial Sequence
  Synthetic Polynucleotide
taatacgactcactatagggatgaatgtctttgacactagattccccagtaacagaggagaactgggatgtctagtgtcaacctggcggcagcgcaaaagatg

SEQ ID NO: 94104 - DNA, 103 bp, Artificial Sequence
  Synthetic Polynucleotide
taatacgactcactataggggaacagaagcatgaatgtctttgacactagaacagaggagactagtgatgaagacattcaacctggcggcagcgcaaaagatg

SEQ ID NO: 94105 - DNA, 103 bp, Artificial Sequence
  Synthetic Polynucleotide
taatacgactcactatagggtcatttggctgaacagaagcatgaatgtctaacagaggagaagacatatgtgcttctgtaacctggcggcagcgcaaaagatg

SEQ ID NO: 94106 - DNA, 103 bp, Artificial Sequence
  Synthetic Polynucleotide
taatacgactcactatagggttcagacctttcatttggctgaacagaagcaacagaggagagcttctatgcagccaaataacctggcggcagcgcaaaagatg

SEQ ID NO: 94107 - DNA, 103 bp, Artificial Sequence
  Synthetic Polynucleotide
taatacgactcactatagggggcattcattttcagacctttcatttggctaacagaggagaagccaaatgaaaggtctgaacctggcggcagcgcaaaagatg

SEQ ID NO: 94108 - DNA, 103 bp, Artificial Sequence
  Synthetic Polynucleotide
taatacgactcactatagggactcctcccaggcattcattttcagaccttaacagaggagaaaggtcatgaaatgaatgaacctggcggcagcgcaaaagatg

SEQ ID NO: 94109 - DNA, 103 bp, Artificial Sequence
  Synthetic Polynucleotide
taatacgactcactatagggacactccgggactcctcccaggcattcattaacagaggagaaatgaaatgctgggaggaaacctggcggcagcgcaaaagatg

SEQ ID NO: 94110 - DNA, 103 bp, Artificial Sequence
  Synthetic Polynucleotide
taatacgactcactatagggacagcacatctttcttccgctggtcattaaaacagaggagattaatgatgagcggaagaaacctggcggcagcgcaaaagatg

SEQ ID NO: 94111 - DNA, 103 bp, Artificial Sequence
  Synthetic Polynucleotide
taatacgactcactataggggcaaatctctacactccgggactcctcccaaacagaggagatgggagatgtcccggagtaacctggcggcagcgcaaaagatg

SEQ ID NO: 94112 - DNA, 103 bp, Artificial Sequence
  Synthetic Polynucleotide
taatacgactcactatagggaacatcacctgcaaatctctacactccgggaacagaggagacccggaatgtagagatttaacctggcggcagcgcaaaagatg

SEQ ID NO: 94113 - DNA, 103 bp, Artificial Sequence
  Synthetic Polynucleotide
taatacgactcactataggggtcacattttaacatcacctgcaaatctctaacagaggagaagagatatgcaggtgatgaacctggcggcagcgcaaaagatg

SEQ ID NO: 94114 - DNA, 103 bp, Artificial Sequence
  Synthetic Polynucleotide
taatacgactcactatagggatttactttcgtcacattttaacatcacctaacagaggagaaggtgaatgtaaaatgtgaacctggcggcagcgcaaaagatg

SEQ ID NO: 94115 - DNA, 103 bp, Artificial Sequence
  Synthetic Polynucleotide
taatacgactcactatagggtccattgctaatttactttcgtcacattttaacagaggagaaaaatgatgcgaaagtaaaacctggcggcagcgcaaaagatg

SEQ ID NO: 94116 - DNA, 103 bp, Artificial Sequence
  Synthetic Polynucleotide
taatacgactcactatagggttcttcaggttccattgctaatttactttcaacagaggagagaaagtatgttagcaatgaacctggcggcagcgcaaaagatg

SEQ ID NO: 94117 - DNA, 103 bp, Artificial Sequence
  Synthetic Polynucleotide
taatacgactcactatagggctttcttcgtttcttcaggttccattgctaaacagaggagatagcaaatgaacctgaagaacctggcggcagcgcaaaagatg

SEQ ID NO: 94118 - DNA, 103 bp, Artificial Sequence
  Synthetic Polynucleotide
taatacgactcactataggggaagcaggatctttcttcgtttcttcaggtaacagaggagaacctgaatgaacgaagaaaacctggcggcagcgcaaaagatg

SEQ ID NO: 94119 - DNA, 103 bp, Artificial Sequence
  Synthetic Polynucleotide
taatacgactcactatagggtgggcactgagaagcaggatctttcttcgtaacagaggagaacgaagatggatcctgctaacctggcggcagcgcaaaagatg

SEQ ID NO: 94120 - DNA, 103 bp, Artificial Sequence
  Synthetic Polynucleotide
taatacgactcactatagggatttttcagttgggcactgagaagcaggataacagaggagaatcctgatgctcagtgccaacctggcggcagcgcaaaagatg

SEQ ID NO: 94121 - DNA, 103 bp, Artificial Sequence
  Synthetic Polynucleotide
taatacgactcactataggggtgacatcgcacagcacatctttcttccgcaacagaggagagcggaaatgagatgtgctaacctggcggcagcgcaaaagatg

SEQ ID NO: 94122 - DNA, 103 bp, Artificial Sequence
  Synthetic Polynucleotide
taatacgactcactataggggtcacttctgatttttcagttgggcactgaaacagaggagatcagtgatgaactgaaaaaacctggcggcagcgcaaaagatg

SEQ ID NO: 94123 - DNA, 103 bp, Artificial Sequence
  Synthetic Polynucleotide
taatacgactcactatagggggggaaaggagtcacttctgatttttcagtaacagaggagaactgaaatgtcagaagtgaacctggcggcagcgcaaaagatg

SEQ ID NO: 94124 - DNA, 103 bp, Artificial Sequence
  Synthetic Polynucleotide
taatacgactcactatagggaagaattgtgggggaaaggagtcacttctgaacagaggagacagaagatgctcctttccaacctggcggcagcgcaaaagatg

SEQ ID NO: 94125 - DNA, 103 bp, Artificial Sequence
  Synthetic Polynucleotide
taatacgactcactataggggggtctatggaagaattgtgggggaaaggaaacagaggagatcctttatgccacaattcaacctggcggcagcgcaaaagatg

SEQ ID NO: 94126 - DNA, 103 bp, Artificial Sequence
  Synthetic Polynucleotide
taatacgactcactatagggaagtccatgagggtctatggaagaattgtgaacagaggagacacaatatgtccatagacaacctggcggcagcgcaaaagatg

SEQ ID NO: 94127 - DNA, 103 bp, Artificial Sequence
  Synthetic Polynucleotide
taatacgactcactatagggacaaagaataaagtccatgagggtctatggaacagaggagaccatagatgctcatggacaacctggcggcagcgcaaaagatg

SEQ ID NO: 94128 - DNA, 103 bp, Artificial Sequence
  Synthetic Polynucleotide
taatacgactcactatagggtgtaaaagagacaaagaataaagtccatgaaacagaggagatcatggatgttattctttaacctggcggcagcgcaaaagatg

SEQ ID NO: 94129 - DNA, 103 bp, Artificial Sequence
  Synthetic Polynucleotide
taatacgactcactataggggtcatatgtgtgtaaaagagacaaagaataaacagaggagatattctatgtctcttttaaacctggcggcagcgcaaaagatg

SEQ ID NO: 94130 - DNA, 103 bp, Artificial Sequence
  Synthetic Polynucleotide
taatacgactcactatagggcaccatattggtcatatgtgtgtaaaagagaacagaggagactctttatgacacatatgaacctggcggcagcgcaaaagatg

SEQ ID NO: 94131 - DNA, 103 bp, Artificial Sequence
  Synthetic Polynucleotide
taatacgactcactatagggaaattcaagtcaccatattggtcatatgtgaacagaggagacacataatgccaatatggaacctggcggcagcgcaaaagatg

SEQ ID NO: 94132 - DNA, 103 bp, Artificial Sequence
  Synthetic Polynucleotide
taatacgactcactataggggggggagtcaggcttctcatccacagacataacagaggagaatgtctatggatgagaagaacctggcggcagcgcaaaagatg

SEQ ID NO: 94133 - DNA, 103 bp, Artificial Sequence
  Synthetic Polynucleotide
taatacgactcactatagggagtcacgtcacagagaatatcctttttccgaacagaggagacggaaaatggatattctcaacctggcggcagcgcaaaagatg

SEQ ID NO: 94134 - DNA, 103 bp, Artificial Sequence
  Synthetic Polynucleotide
taatacgactcactataggggcaggagggcgaggccacgctcctggatctaacagaggagaagatccatgagcgtggccaacctggcggcagcgcaaaagatg

SEQ ID NO: 94135 - DNA, 103 bp, Artificial Sequence
  Synthetic Polynucleotide
taatacgactcactataggggagaccttaagcaggagggcgaggccacgcaacagaggagagcgtggatgcgccctcctaacctggcggcagcgcaaaagatg

SEQ ID NO: 94136 - DNA, 103 bp, Artificial Sequence
  Synthetic Polynucleotide
taatacgactcactatagggatgctgaacagagaccttaagcaggagggcaacagaggagagccctcatgcttaaggtcaacctggcggcagcgcaaaagatg

SEQ ID NO: 94137 - DNA, 103 bp, Artificial Sequence
  Synthetic Polynucleotide
taatacgactcactatagggacttttcgttatgctgaacagagaccttaaaacagaggagattaaggatgctgttcagcaacctggcggcagcgcaaaagatg

SEQ ID NO: 94138 - DNA, 103 bp, Artificial Sequence
  Synthetic Polynucleotide
taatacgactcactatagggacagctccacacttttcgttatgctgaacaaacagaggagatgttcaatgtaacgaaaaaacctggcggcagcgcaaaagatg

SEQ ID NO: 94139 - DNA, 103 bp, Artificial Sequence
  Synthetic Polynucleotide
taatacgactcactatagggggcaggccagacagctccacacttttcgttaacagaggagaaacgaaatgtgtggagctaacctggcggcagcgcaaaagatg

SEQ ID NO: 94140 - DNA, 103 bp, Artificial Sequence
  Synthetic Polynucleotide
taatacgactcactatagggagatgtactgggcaggccagacagctccacaacagaggagagtggagatgtctggcctgaacctggcggcagcgcaaaagatg

SEQ ID NO: 94141 - DNA, 103 bp, Artificial Sequence
  Synthetic Polynucleotide
taatacgactcactatagggagtgctgctgagatgtactgggcaggccagaacagaggagactggccatgccagtacataacctggcggcagcgcaaaagatg

SEQ ID NO: 94142 - DNA, 103 bp, Artificial Sequence
  Synthetic Polynucleotide
taatacgactcactatagggctcctggcaaagtgctgctgagatgtactgaacagaggagacagtacatgtcagcagcaaacctggcggcagcgcaaaagatg

SEQ ID NO: 94143 - DNA, 103 bp, Artificial Sequence
  Synthetic Polynucleotide
taatacgactcactataggggcaggctggactcctggcaaagtgctgctgaacagaggagacagcagatgtttgccaggaacctggcggcagcgcaaaagatg

SEQ ID NO: 94144 - DNA, 103 bp, Artificial Sequence
  Synthetic Polynucleotide
taatacgactcactatagggccacgatcaaagtcacgtcacagagaatataacagaggagaatattcatggtgacgtgaaacctggcggcagcgcaaaagatg

SEQ ID NO: 94145 - DNA, 103 bp, Artificial Sequence
  Synthetic Polynucleotide
taatacgactcactatagggtgtcaaaagggcaggctggactcctggcaaaacagaggagattgccaatggtccagcctaacctggcggcagcgcaaaagatg

SEQ ID NO: 94146 - DNA, 103 bp, Artificial Sequence
  Synthetic Polynucleotide
taatacgactcactataggggtgatccccttgtcaaaagggcaggctggaaacagaggagatccagcatgcccttttgaaacctggcggcagcgcaaaagatg

SEQ ID NO: 94147 - DNA, 103 bp, Artificial Sequence
  Synthetic Polynucleotide
taatacgactcactataggggtcaccctgagtgatccccttgtcaaaaggaacagaggagaccttttatgaaggggatcaacctggcggcagcgcaaaagatg

SEQ ID NO: 94148 - DNA, 103 bp, Artificial Sequence
  Synthetic Polynucleotide
taatacgactcactatagggcagttttaaggtcaccctgagtgatcccctaacagaggagaaggggaatgctcagggtgaacctggcggcagcgcaaaagatg

SEQ ID NO: 94149 - DNA, 103 bp, Artificial Sequence
  Synthetic Polynucleotide
taatacgactcactatagggggggtgtagtcagttttaaggtcaccctgaaacagaggagatcagggatgccttaaaacaacctggcggcagcgcaaaagatg

SEQ ID NO: 94150 - DNA, 103 bp, Artificial Sequence
  Synthetic Polynucleotide
taatacgactcactatagggccctgtgaaaggggtgtagtcagttttaagaacagaggagacttaaaatggactacaccaacctggcggcagcgcaaaagatg

SEQ ID NO: 94151 - DNA, 103 bp, Artificial Sequence
  Synthetic Polynucleotide
taatacgactcactataggggtccataattccctgtgaaaggggtgtagtaacagaggagaactacaatgctttcacagaacctggcggcagcgcaaaagatg

SEQ ID NO: 94152 - DNA, 103 bp, Artificial Sequence
  Synthetic Polynucleotide
taatacgactcactatagggacgtggggctgtccataattccctgtgaaaaacagaggagatttcacatggaattatggaacctggcggcagcgcaaaagatg

SEQ ID NO: 94153 - DNA, 103 bp, Artificial Sequence
  Synthetic Polynucleotide
taatacgactcactatagggcttctggcccacgtggggctgtccataattaacagaggagaaattatatgcagccccacaacctggcggcagcgcaaaagatg

SEQ ID NO: 94154 - DNA, 103 bp, Artificial Sequence
  Synthetic Polynucleotide
taatacgactcactatagggtggacacctccttctggcccacgtggggctaacagaggagaagccccatgtgggccagaaacctggcggcagcgcaaaagatg

SEQ ID NO: 94155 - DNA, 103 bp, Artificial Sequence
  Synthetic Polynucleotide
taatacgactcactatagggtccttcctctccacgatcaaagtcacgtcaaacagaggagatgacgtatgtttgatcgtaacctggcggcagcgcaaaagatg

SEQ ID NO: 94156 - DNA, 103 bp, Artificial Sequence
  Synthetic Polynucleotide
taatacgactcactatagggatggtgaagttggacacctccttctggcccaacagaggagagggccaatgggaggtgtcaacctggcggcagcgcaaaagatg

SEQ ID NO: 94157 - DNA, 103 bp, Artificial Sequence
  Synthetic Polynucleotide
taatacgactcactataggggggcgaccccatggtgaagttggacacctcaacagaggagagaggtgatgaacttcaccaacctggcggcagcgcaaaagatg

SEQ ID NO: 94158 - DNA, 103 bp, Artificial Sequence
  Synthetic Polynucleotide
taatacgactcactataggggccccctgaggggcgaccccatggtgaagtaacagaggagaacttcaatgtggggtcgcaacctggcggcagcgcaaaagatg

SEQ ID NO: 94159 - DNA, 103 bp, Artificial Sequence
  Synthetic Polynucleotide
taatacgactcactatagggtccaacccaggccccctgaggggcgaccccaacagaggagaggggtcatgcctcaggggaacctggcggcagcgcaaaagatg

SEQ ID NO: 94160 - DNA, 103 bp, Artificial Sequence
  Synthetic Polynucleotide
taatacgactcactatagggacagagagcctccaacccaggccccctgagaacagaggagactcaggatgcctgggttgaacctggcggcagcgcaaaagatg

SEQ ID NO: 94161 - DNA, 103 bp, Artificial Sequence
  Synthetic Polynucleotide
taatacgactcactatagggcctcctgtttacagagagcctccaacccagaacagaggagactgggtatgaggctctctaacctggcggcagcgcaaaagatg

SEQ ID NO: 94162 - DNA, 103 bp, Artificial Sequence
  Synthetic Polynucleotide
taatacgactcactatagggtccagctctccctcctgtttacagagagccaacagaggagaggctctatgtaaacaggaaacctggcggcagcgcaaaagatg

SEQ ID NO: 94163 - DNA, 103 bp, Artificial Sequence
  Synthetic Polynucleotide
taatacgactcactataggggctcctccggtccagctctccctcctgtttaacagaggagaaaacagatgggagagctgaacctggcggcagcgcaaaagatg

SEQ ID NO: 94164 - DNA, 103 bp, Artificial Sequence
  Synthetic Polynucleotide
taatacgactcactatagggagaagatcacgctcctccggtccagctctcaacagaggagagagagcatgaccggaggaaacctggcggcagcgcaaaagatg

SEQ ID NO: 94165 - DNA, 103 bp, Artificial Sequence
  Synthetic Polynucleotide
taatacgactcactataggggcgctggaggagaagatcacgctcctccggaacagaggagaccggagatgcgtgatcttaacctggcggcagcgcaaaagatg

SEQ ID NO: 94166 - DNA, 103 bp, Artificial Sequence
  Synthetic Polynucleotide
taatacgactcactatagggggcccggaactccttcctctccacgatcaaaacagaggagattgatcatggagaggaagaacctggcggcagcgcaaaagatg

SEQ ID NO: 94167 - DNA, 103 bp, Artificial Sequence
  Synthetic Polynucleotide
taatacgactcactatagggttggtcacaagcgctggaggagaagatcacaacagaggagagtgatcatgtcctccagcaacctggcggcagcgcaaaagatg

SEQ ID NO: 94168 - DNA, 103 bp, Artificial Sequence
  Synthetic Polynucleotide
taatacgactcactatagggaggtgctcacttggtcacaagcgctggaggaacagaggagacctccaatgcttgtgaccaacctggcggcagcgcaaaagatg

SEQ ID NO: 94169 - DNA, 103 bp, Artificial Sequence
  Synthetic Polynucleotide
taatacgactcactataggggaatgcaccgaggtgctcacttggtcacaaaacagaggagattgtgaatgagtgagcacaacctggcggcagcgcaaaagatg

SEQ ID NO: 94170 - DNA, 103 bp, Artificial Sequence
  Synthetic Polynucleotide
taatacgactcactatagggcccagaataagaatgcaccgaggtgctcacaacagaggagagtgagcatgtcggtgcataacctggcggcagcgcaaaagatg

SEQ ID NO: 94171 - DNA, 103 bp, Artificial Sequence
  Synthetic Polynucleotide
taatacgactcactatagggaactgctcaccccagaataagaatgcaccgaacagaggagacggtgcatgcttattctgaacctggcggcagcgcaaaagatg

SEQ ID NO: 94172 - DNA, 103 bp, Artificial Sequence
  Synthetic Polynucleotide
taatacgactcactatagggtctttgtccaaactgctcaccccagaataaaacagaggagattattcatgggtgagcagaacctggcggcagcgcaaaagatg

SEQ ID NO: 94173 - DNA, 103 bp, Artificial Sequence
  Synthetic Polynucleotide
taatacgactcactatagggctcagagaggtctttgtccaaactgctcacaacagaggagagtgagcatgttggacaaaaacctggcggcagcgcaaaagatg

SEQ ID NO: 94174 - DNA, 103 bp, Artificial Sequence
  Synthetic Polynucleotide
taatacgactcactatagggttggcaccggctcagagaggtctttgtccaaacagaggagatggacaatgacctctctgaacctggcggcagcgcaaaagatg

SEQ ID NO: 94175 - DNA, 103 bp, Artificial Sequence
  Synthetic Polynucleotide
taatacgactcactatagggcacagaccctttggcaccggctcagagaggaacagaggagacctctcatggccggtgccaacctggcggcagcgcaaaagatg

SEQ ID NO: 94176 - DNA, 103 bp, Artificial Sequence
  Synthetic Polynucleotide
taatacgactcactatagggggctcccacccacagaccctttggcaccggaacagaggagaccggtgatgaagggtctgaacctggcggcagcgcaaaagatg

SEQ ID NO: 94177 - DNA, 103 bp, Artificial Sequence
  Synthetic Polynucleotide
taatacgactcactatagggcagcccggtgggcccggaactccttcctctaacagaggagaagaggaatgagttccgggaacctggcggcagcgcaaaagatg

SEQ ID NO: 94178 - DNA, 103 bp, Artificial Sequence
  Synthetic Polynucleotide
taatacgactcactataggggggactggccggctcccacccacagaccctaacagaggagaagggtcatggggtgggagaacctggcggcagcgcaaaagatg

SEQ ID NO: 94179 - DNA, 103 bp, Artificial Sequence
  Synthetic Polynucleotide
taatacgactcactataggggagctggggagggactggccggctcccaccaacagaggagaggtgggatgcggccagtcaacctggcggcagcgcaaaagatg

SEQ ID NO: 94180 - DNA, 103 bp, Artificial Sequence
  Synthetic Polynucleotide
taatacgactcactataggggtaggcctgcgagctggggagggactggccaacagaggagaggccagatgctccccagcaacctggcggcagcgcaaaagatg

SEQ ID NO: 94181 - DNA, 103 bp, Artificial Sequence
  Synthetic Polynucleotide
taatacgactcactatagggcaccgtgggagtaggcctgcgagctggggaaacagaggagatccccaatgcgcaggcctaacctggcggcagcgcaaaagatg

SEQ ID NO: 94182 - DNA, 103 bp, Artificial Sequence
  Synthetic Polynucleotide
taatacgactcactataggggccatcagcccaccgtgggagtaggcctgcaacagaggagagcaggcatgctcccacggaacctggcggcagcgcaaaagatg

SEQ ID NO: 94183 - DNA, 103 bp, Artificial Sequence
  Synthetic Polynucleotide
taatacgactcactatagggcaagtggtcggccatcagcccaccgtgggaaacagaggagatcccacatggggctgatgaacctggcggcagcgcaaaagatg

SEQ ID NO: 94184 - DNA, 103 bp, Artificial Sequence
  Synthetic Polynucleotide
taatacgactcactatagggtccttcctggcaagtggtcggccatcagccaacagaggagaggctgaatgccgaccactaacctggcggcagcgcaaaagatg

SEQ ID NO: 94185 - DNA, 103 bp, Artificial Sequence
  Synthetic Polynucleotide
taatacgactcactatagggttgggccgcatccttcctggcaagtggtcgaacagaggagacgaccaatggccaggaagaacctggcggcagcgcaaaagatg

SEQ ID NO: 94186 - DNA, 103 bp, Artificial Sequence
  Synthetic Polynucleotide
taatacgactcactataggggcagctggtgttgggccgcatccttcctggaacagaggagaccaggaatgatgcggcccaacctggcggcagcgcaaaagatg

SEQ ID NO: 94187 - DNA, 103 bp, Artificial Sequence
  Synthetic Polynucleotide
taatacgactcactatagggttggtaccgggcagctggtgttgggccgcaaacagaggagatgcggcatgacaccagctaacctggcggcagcgcaaaagatg

SEQ ID NO: 94188 - DNA, 103 bp, Artificial Sequence
  Synthetic Polynucleotide
taatacgactcactataggggcggccagcacagcccggtgggcccggaacaacagaggagagttccgatgccaccgggcaacctggcggcagcgcaaaagatg

SEQ ID NO: 94189 - DNA, 103 bp, Artificial Sequence
  Synthetic Polynucleotide
taatacgactcactatagggcagactttgattggtaccgggcagctggtgaacagaggagacaccagatgcccggtaccaacctggcggcagcgcaaaagatg

SEQ ID NO: 94190 - DNA, 103 bp, Artificial Sequence
  Synthetic Polynucleotide
taatacgactcactatagggtgagcgagggcagactttgattggtaccggaacagaggagaccggtaatgatcaaagtcaacctggcggcagcgcaaaagatg

SEQ ID NO: 94191 - DNA, 103 bp, Artificial Sequence
  Synthetic Polynucleotide
taatacgactcactatagggccaaggggggtgagcgagggcagactttgaaacagaggagatcaaagatggccctcgctaacctggcggcagcgcaaaagatg

SEQ ID NO: 94192 - DNA, 103 bp, Artificial Sequence
  Synthetic Polynucleotide
taatacgactcactataggggtcctggtctccaaggggggtgagcgagggaacagaggagaccctcgatgaccccccttaacctggcggcagcgcaaaagatg

SEQ ID NO: 94193 - DNA, 103 bp, Artificial Sequence
  Synthetic Polynucleotide
taatacgactcactatagggggaagtcctggtcctggtctccaaggggggaacagaggagaccccccatggagaccaggaacctggcggcagcgcaaaagatg

SEQ ID NO: 94194 - DNA, 103 bp, Artificial Sequence
  Synthetic Polynucleotide
taatacgactcactatagggagcaggagctggaagtcctggtcctggtctaacagaggagaagaccaatgccaggacttaacctggcggcagcgcaaaagatg

SEQ ID NO: 94195 - DNA, 103 bp, Artificial Sequence
  Synthetic Polynucleotide
taatacgactcactataggggaataggaagagcaggagctggaagtcctgaacagaggagacaggacatgcagctcctgaacctggcggcagcgcaaaagatg

SEQ ID NO: 94196 - DNA, 103 bp, Artificial Sequence
  Synthetic Polynucleotide
taatacgactcactatagggctccgcgtaggaataggaagagcaggagctaacagaggagaagctccatgtcttcctataacctggcggcagcgcaaaagatg

SEQ ID NO: 94197 - DNA, 103 bp, Artificial Sequence
  Synthetic Polynucleotide
taatacgactcactatagggcgctcccgtcctccgcgtaggaataggaagaacagaggagacttcctatgcctacgcggaacctggcggcagcgcaaaagatg

SEQ ID NO: 94198 - DNA, 103 bp, Artificial Sequence
  Synthetic Polynucleotide
taatacgactcactatagggggtgagcccccgctcccgtcctccgcgtagaacagaggagactacgcatgggacgggagaacctggcggcagcgcaaaagatg

SEQ ID NO: 94199 - DNA, 103 bp, Artificial Sequence
  Synthetic Polynucleotide
taatacgactcactatagggttcactgcatgcggccagcacagcccggtgaacagaggagacaccggatggtgctggccaacctggcggcagcgcaaaagatg

SEQ ID NO: 94200 - DNA, 103 bp, Artificial Sequence
  Synthetic Polynucleotide
taatacgactcactataggggaggctgcagggtgagcccccgctcccgtcaacagaggagagacgggatggggggctcaaacctggcggcagcgcaaaagatg

SEQ ID NO: 94201 - DNA, 103 bp, Artificial Sequence
  Synthetic Polynucleotide
taatacgactcactatagggcacagagagggaggctgcagggtgagccccaacagaggagaggggctatgcctgcagccaacctggcggcagcgcaaaagatg

SEQ ID NO: 94202 - DNA, 103 bp, Artificial Sequence
  Synthetic Polynucleotide
taatacgactcactataggggaggagaactcacagagagggaggctgcagaacagaggagactgcagatgccctctctgaacctggcggcagcgcaaaagatg

SEQ ID NO: 94203 - DNA, 103 bp, Artificial Sequence
  Synthetic Polynucleotide
taatacgactcactatagggacagggcgaggaggagaactcacagagaggaacagaggagacctctcatggagttctccaacctggcggcagcgcaaaagatg

SEQ ID NO: 94204 - DNA, 103 bp, Artificial Sequence
  Synthetic Polynucleotide
taatacgactcactatagggctccctgggaacagggcgaggaggagaactaacagaggagaagttctatgcctcgccctaacctggcggcagcgcaaaagatg

SEQ ID NO: 94205 - DNA, 103 bp, Artificial Sequence
  Synthetic Polynucleotide
taatacgactcactatagggaggaatctggctccctgggaacagggcgagaacagaggagactcgccatgttcccagggaacctggcggcagcgcaaaagatg

SEQ ID NO: 94206 - DNA, 103 bp, Artificial Sequence
  Synthetic Polynucleotide
taatacgactcactatagggttctgtggcaaggaatctggctccctgggaaacagaggagatcccagatggccagattcaacctggcggcagcgcaaaagatg

SEQ ID NO: 94207 - DNA, 103 bp, Artificial Sequence
  Synthetic Polynucleotide
taatacgactcactataggggttcctgatgttctgtggcaaggaatctggaacagaggagaccagatatgttgccacagaacctggcggcagcgcaaaagatg

SEQ ID NO: 94208 - DNA, 103 bp, Artificial Sequence
  Synthetic Polynucleotide
taatacgactcactatagggatcaggcctggttcctgatgttctgtggcaaacagaggagatgccacatgacatcaggaaacctggcggcagcgcaaaagatg

SEQ ID NO: 94209 - DNA, 103 bp, Artificial Sequence
  Synthetic Polynucleotide
taatacgactcactatagggtccatctcccatcaggcctggttcctgatgaacagaggagacatcagatgccaggcctgaacctggcggcagcgcaaaagatg

SEQ ID NO: 94210 - DNA, 103 bp, Artificial Sequence
  Synthetic Polynucleotide
taatacgactcactataggggccaaaaatattcactgcatgcggccagcaaacagaggagatgctggatgcatgcagtgaacctggcggcagcgcaaaagatg

SEQ ID NO: 94211 - DNA, 103 bp, Artificial Sequence
  Synthetic Polynucleotide
taatacgactcactatagggggttgtacattccatctcccatcaggcctgaacagaggagacaggccatgtgggagatgaacctggcggcagcgcaaaagatg

SEQ ID NO: 94212 - DNA, 103 bp, Artificial Sequence
  Synthetic Polynucleotide
taatacgactcactatagggggccgcacttggttgtacattccatctcccaacagaggagagggagaatgaatgtacaaaacctggcggcagcgcaaaagatg

SEQ ID NO: 94213 - DNA, 103 bp, Artificial Sequence
  Synthetic Polynucleotide
taatacgactcactatagggtttaatttggggccgcacttggttgtacataacagaggagaatgtacatgcaagtgcggaacctggcggcagcgcaaaagatg

SEQ ID NO: 94214 - DNA, 103 bp, Artificial Sequence
  Synthetic Polynucleotide
taatacgactcactatagggactgctcacatttaatttggggccgcacttaacagaggagaaagtgcatgcccaaattaaacctggcggcagcgcaaaagatg

SEQ ID NO: 94215 - DNA, 103 bp, Artificial Sequence
  Synthetic Polynucleotide
taatacgactcactataggggttccataagactgctcacatttaatttggaacagaggagaccaaatatgatgtgagcaaacctggcggcagcgcaaaagatg

SEQ ID NO: 94216 - DNA, 103 bp, Artificial Sequence
  Synthetic Polynucleotide
taatacgactcactatagggactggagttggttccataagactgctcacaaacagaggagatgtgagatgtcttatggaaacctggcggcagcgcaaaagatg

SEQ ID NO: 94217 - DNA, 103 bp, Artificial Sequence
  Synthetic Polynucleotide
taatacgactcactatagggcggattcgtcactggagttggttccataagaacagaggagacttatgatgccaactccaaacctggcggcagcgcaaaagatg

SEQ ID NO: 94218 - DNA, 103 bp, Artificial Sequence
  Synthetic Polynucleotide
taatacgactcactataggggagaacgatccggattcgtcactggagttgaacagaggagacaactcatgtgacgaatcaacctggcggcagcgcaaaagatg

SEQ ID NO: 94219 - DNA, 103 bp, Artificial Sequence
  Synthetic Polynucleotide
taatacgactcactataggggtctgcttccgagaacgatccggattcgtcaacagaggagagacgaaatgggatcgttcaacctggcggcagcgcaaaagatg

SEQ ID NO: 94220 - DNA, 103 bp, Artificial Sequence
  Synthetic Polynucleotide
taatacgactcactatagggacgactcactgtctgcttccgagaacgatcaacagaggagagatcgtatgcggaagcagaacctggcggcagcgcaaaagatg

SEQ ID NO: 94221 - DNA, 103 bp, Artificial Sequence
  Synthetic Polynucleotide
taatacgactcactatagggaccagcgcctgccaaaaatattcactgcataacagaggagaatgcagatgatatttttgaacctggcggcagcgcaaaagatg

SEQ ID NO: 94222 - DNA, 103 bp, Artificial Sequence
  Synthetic Polynucleotide
taatacgactcactatagggtgcacaggacacgactcactgtctgcttccaacagaggagaggaagcatgcagtgagtcaacctggcggcagcgcaaaagatg

SEQ ID NO: 94223 - DNA, 103 bp, Artificial Sequence
  Synthetic Polynucleotide
taatacgactcactataggggcccctgtcctgcacaggacacgactcactaacagaggagaagtgagatgtgtcctgtgaacctggcggcagcgcaaaagatg

SEQ ID NO: 94224 - DNA, 103 bp, Artificial Sequence
  Synthetic Polynucleotide
taatacgactcactatagggttacctcctggcccctgtcctgcacaggacaacagaggagagtcctgatgaggacagggaacctggcggcagcgcaaaagatg

SEQ ID NO: 94225 - DNA, 103 bp, Artificial Sequence
  Synthetic Polynucleotide
taatacgactcactatagggaaaggaagttttacctcctggcccctgtccaacagaggagaggacagatgccaggaggtaacctggcggcagcgcaaaagatg

SEQ ID NO: 94226 - DNA, 103 bp, Artificial Sequence
  Synthetic Polynucleotide
taatacgactcactatagggatctacaggaaaaggaagttttacctcctgaacagaggagacaggagatgaaacttcctaacctggcggcagcgcaaaagatg

SEQ ID NO: 94227 - DNA, 103 bp, Artificial Sequence
  Synthetic Polynucleotide
taatacgactcactatagggctgtgatttgatctacaggaaaaggaagttaacagaggagaaacttcatgttcctgtagaacctggcggcagcgcaaaagatg

SEQ ID NO: 94228 - DNA, 103 bp, Artificial Sequence
  Synthetic Polynucleotide
taatacgactcactatagggcttggaagatctgtgatttgatctacaggaaacagaggagatcctgtatgtcaaatcacaacctggcggcagcgcaaaagatg

SEQ ID NO: 94229 - DNA, 103 bp, Artificial Sequence
  Synthetic Polynucleotide
taatacgactcactataggggaaatcgttccttggaagatctgtgatttgaacagaggagacaaatcatggatcttccaaacctggcggcagcgcaaaagatg

SEQ ID NO: 94230 - DNA, 103 bp, Artificial Sequence
  Synthetic Polynucleotide
taatacgactcactatagggtcatcatctggaaatcgttccttggaagataacagaggagaatcttcatgggaacgattaacctggcggcagcgcaaaagatg

SEQ ID NO: 94231 - DNA, 103 bp, Artificial Sequence
  Synthetic Polynucleotide
taatacgactcactatagggtgcattttaatcatcatctggaaatcgttcaacagaggagagaacgaatgccagatgataacctggcggcagcgcaaaagatg

SEQ ID NO: 94232 - DNA, 103 bp, Artificial Sequence
  Synthetic Polynucleotide
taatacgactcactatagggtgtctgtccaaccagcgcctgccaaaaataaacagaggagatattttatgcaggcgctgaacctggcggcagcgcaaaagatg

SEQ ID NO: 94233 - DNA, 103 bp, Artificial Sequence
  Synthetic Polynucleotide
taatacgactcactatagggggttagcttgtgcattttaatcatcatctgaacagaggagacagatgatgattaaaatgaacctggcggcagcgcaaaagatg

SEQ ID NO: 94234 - DNA, 103 bp, Artificial Sequence
  Synthetic Polynucleotide
taatacgactcactatagggactgttctgaggttagcttgtgcattttaaaacagaggagattaaaaatgacaagctaaaacctggcggcagcgcaaaagatg

SEQ ID NO: 94235 - DNA, 103 bp, Artificial Sequence
  Synthetic Polynucleotide
taatacgactcactatagggataaactctaactgttctgaggttagcttgaacagaggagacaagctatgctcagaacaaacctggcggcagcgcaaaagatg

SEQ ID NO: 94236 - DNA, 103 bp, Artificial Sequence
  Synthetic Polynucleotide
taatacgactcactataggggacatcatgaataaactctaactgttctgaaacagaggagatcagaaatgttagagtttaacctggcggcagcgcaaaagatg

SEQ ID NO: 94237 - DNA, 103 bp, Artificial Sequence
  Synthetic Polynucleotide
taatacgactcactatagggtgcgccgtcggacatcatgaataaactctaaacagaggagatagagtatgttcatgatgaacctggcggcagcgcaaaagatg

SEQ ID NO: 94238 - DNA, 103 bp, Artificial Sequence
  Synthetic Polynucleotide
taatacgactcactatagggcggttcttgctgcgccgtcggacatcatgaaacagaggagatcatgaatgccgacggcgaacctggcggcagcgcaaaagatg

SEQ ID NO: 94239 - DNA, 103 bp, Artificial Sequence
  Synthetic Polynucleotide
taatacgactcactatagggggccgcgatgcggttcttgctgcgccgtcgaacagaggagacgacggatgagcaagaacaacctggcggcagcgcaaaagatg

SEQ ID NO: 94240 - DNA, 103 bp, Artificial Sequence
  Synthetic Polynucleotide
taatacgactcactatagggggcagcgctgggccgcgatgcggttcttgcaacagaggagagcaagaatggcatcgcggaacctggcggcagcgcaaaagatg

SEQ ID NO: 94241 - DNA, 103 bp, Artificial Sequence
  Synthetic Polynucleotide
taatacgactcactatagggttccttttgcggcagcgctgggccgcgatgaacagaggagacatcgcatgccagcgctgaacctggcggcagcgcaaaagatg

SEQ ID NO: 94242 - DNA, 103 bp, Artificial Sequence
  Synthetic Polynucleotide
taatacgactcactatagggacagtccagtttccttttgcggcagcgctgaacagaggagacagcgcatgcgcaaaaggaacctggcggcagcgcaaaagatg

SEQ ID NO: 94243 - DNA, 103 bp, Artificial Sequence
  Synthetic Polynucleotide
taatacgactcactatagggacacatacatgggggagtcaggcttctcataacagaggagaatgagaatgctgactcccaacctggcggcagcgcaaaagatg

SEQ ID NO: 94244 - DNA, 103 bp, Artificial Sequence
  Synthetic Polynucleotide
taatacgactcactatagggaatcattttttgtctgtccaaccagcgcctaacagaggagaaggcgcatgttggacagaaacctggcggcagcgcaaaagatg

SEQ ID NO: 94245 - DNA, 103 bp, Artificial Sequence
  Synthetic Polynucleotide
taatacgactcactatagggaattctgaatacagtccagtttccttttgcaacagaggagagcaaaaatgaactggactaacctggcggcagcgcaaaagatg

SEQ ID NO: 94246 - DNA, 103 bp, Artificial Sequence
  Synthetic Polynucleotide
taatacgactcactatagggtcacattctaaattctgaatacagtccagtaacagaggagaactggaatgtattcagaaaacctggcggcagcgcaaaagatg

SEQ ID NO: 94247 - DNA, 103 bp, Artificial Sequence
  Synthetic Polynucleotide
taatacgactcactatagggtttgcggatttcacattctaaattctgaataacagaggagaattcagatgttagaatgtaacctggcggcagcgcaaaagatg

SEQ ID NO: 94248 - DNA, 103 bp, Artificial Sequence
  Synthetic Polynucleotide
taatacgactcactatagggcacacaccaatttgcggatttcacattctaaacagaggagatagaatatgaaatccgcaaacctggcggcagcgcaaaagatg

SEQ ID NO: 94249 - DNA, 103 bp, Artificial Sequence
  Synthetic Polynucleotide
taatacgactcactatagggttctctttctcacacaccaatttgcggattaacagaggagaaatccgatgattggtgtgaacctggcggcagcgcaaaagatg

SEQ ID NO: 94250 - DNA, 103 bp, Artificial Sequence
  Synthetic Polynucleotide
taatacgactcactatagggtgacaacagtttctctttctcacacaccaaaacagaggagattggtgatggagaaagagaacctggcggcagcgcaaaagatg

SEQ ID NO: 94251 - DNA, 103 bp, Artificial Sequence
  Synthetic Polynucleotide
taatacgactcactataggggattcctctctgacaacagtttctctttctaacagaggagaagaaagatgaactgttgtaacctggcggcagcgcaaaagatg

SEQ ID NO: 94252 - DNA, 103 bp, Artificial Sequence
  Synthetic Polynucleotide
taatacgactcactataggggctttcagttgattcctctctgacaacagtaacagaggagaactgttatgagagaggaaaacctggcggcagcgcaaaagatg

SEQ ID NO: 94253 - DNA, 103 bp, Artificial Sequence
  Synthetic Polynucleotide
taatacgactcactatagggccccatgcatgctttcagttgattcctctcaacagaggagagagaggatgcaactgaaaaacctggcggcagcgcaaaagatg

SEQ ID NO: 94254 - DNA, 103 bp, Artificial Sequence
  Synthetic Polynucleotide
taatacgactcactatagggccaacagttcccccatgcatgctttcagttaacagaggagaaactgaatgcatgcatggaacctggcggcagcgcaaaagatg

SEQ ID NO: 94255 - DNA, 103 bp, Artificial Sequence
  Synthetic Polynucleotide
taatacgactcactatagggctgaccaccaaatcattttttgtctgtccaaacagaggagatggacaatgaaaaaatgaaacctggcggcagcgcaaaagatg

SEQ ID NO: 94256 - DNA, 103 bp, Artificial Sequence
  Synthetic Polynucleotide
taatacgactcactataggggagaagttgtccaacagttcccccatgcataacagaggagaatgcatatgggaactgttaacctggcggcagcgcaaaagatg

SEQ ID NO: 94257 - DNA, 103 bp, Artificial Sequence
  Synthetic Polynucleotide
taatacgactcactatagggggaaaggcaggagaagttgtccaacagttcaacagaggagagaactgatggacaacttcaacctggcggcagcgcaaaagatg

SEQ ID NO: 94258 - DNA, 103 bp, Artificial Sequence
  Synthetic Polynucleotide
taatacgactcactatagggaaacttcctgggaaaggcaggagaagttgtaacagaggagaacaactatgcctgcctttaacctggcggcagcgcaaaagatg

SEQ ID NO: 94259 - DNA, 103 bp, Artificial Sequence
  Synthetic Polynucleotide
taatacgactcactatagggatgtctcggcaaacttcctgggaaaggcagaacagaggagactgcctatgccaggaagtaacctggcggcagcgcaaaagatg

SEQ ID NO: 94260 - DNA, 103 bp, Artificial Sequence
  Synthetic Polynucleotide
taatacgactcactatagggggggctctggatgtctcggcaaacttcctgaacagaggagacaggaaatgtgccgagacaacctggcggcagcgcaaaagatg

SEQ ID NO: 94261 - DNA, 103 bp, Artificial Sequence
  Synthetic Polynucleotide
taatacgactcactatagggggatctgctcggggctctggatgtctcggcaacagaggagagccgagatgtccagagccaacctggcggcagcgcaaaagatg

SEQ ID NO: 94262 - DNA, 103 bp, Artificial Sequence
  Synthetic Polynucleotide
taatacgactcactatagggtgcagggcctggatctgctcggggctctggaacagaggagaccagagatgcgagcagataacctggcggcagcgcaaaagatg

SEQ ID NO: 94263 - DNA, 103 bp, Artificial Sequence
  Synthetic Polynucleotide
taatacgactcactataggggcaataccgatgcagggcctggatctgctcaacagaggagagagcagatgcaggccctgaacctggcggcagcgcaaaagatg

SEQ ID NO: 94264 - DNA, 103 bp, Artificial Sequence
  Synthetic Polynucleotide
taatacgactcactatagggtgaggacagggcaataccgatgcagggcctaacagaggagaaggcccatgatcggtattaacctggcggcagcgcaaaagatg

SEQ ID NO: 94265 - DNA, 103 bp, Artificial Sequence
  Synthetic Polynucleotide
taatacgactcactatagggtccatgggtctgaggacagggcaataccgaaacagaggagatcggtaatgccctgtcctaacctggcggcagcgcaaaagatg

SEQ ID NO: 94266 - DNA, 103 bp, Artificial Sequence
  Synthetic Polynucleotide
taatacgactcactatagggctcaggcaagctgaccaccaaatcatttttaacagaggagaaaaaatatgttggtggtcaacctggcggcagcgcaaaagatg

SEQ ID NO: 94267 - DNA, 103 bp, Artificial Sequence
  Synthetic Polynucleotide
taatacgactcactatagggcgtgggcaagtccatgggtctgaggacaggaacagaggagacctgtcatgagacccatgaacctggcggcagcgcaaaagatg

SEQ ID NO: 94268 - DNA, 103 bp, Artificial Sequence
  Synthetic Polynucleotide
taatacgactcactatagggtactggaggccgtgggcaagtccatgggtcaacagaggagagacccaatgacttgcccaaacctggcggcagcgcaaaagatg

SEQ ID NO: 94269 - DNA, 103 bp, Artificial Sequence
  Synthetic Polynucleotide
taatacgactcactataggggcagggttaatactggaggccgtgggcaagaacagaggagacttgccatgggcctccagaacctggcggcagcgcaaaagatg

SEQ ID NO: 94270 - DNA, 103 bp, Artificial Sequence
  Synthetic Polynucleotide
taatacgactcactatagggacccaagggcgcagggttaatactggaggcaacagaggagagcctccatgattaaccctaacctggcggcagcgcaaaagatg

SEQ ID NO: 94271 - DNA, 103 bp, Artificial Sequence
  Synthetic Polynucleotide
taatacgactcactatagggtctgctcagcacccaagggcgcagggttaaaacagaggagattaaccatgcgcccttggaacctggcggcagcgcaaaagatg

SEQ ID NO: 94272 - DNA, 103 bp, Artificial Sequence
  Synthetic Polynucleotide
taatacgactcactataggggccgcaatgttctgctcagcacccaagggcaacagaggagagcccttatgtgctgagcaaacctggcggcagcgcaaaagatg

SEQ ID NO: 94273 - DNA, 103 bp, Artificial Sequence
  Synthetic Polynucleotide
taatacgactcactataggggcattgggaggccgcaatgttctgctcagcaacagaggagagctgagatgaacattgcgaacctggcggcagcgcaaaagatg

SEQ ID NO: 94274 - DNA, 103 bp, Artificial Sequence
  Synthetic Polynucleotide
taatacgactcactatagggcccccactgcgcattgggaggccgcaatgtaacagaggagaacattgatgcctcccaataacctggcggcagcgcaaaagatg

SEQ ID NO: 94275 - DNA, 103 bp, Artificial Sequence
  Synthetic Polynucleotide
taatacgactcactatagggggcacgttttcccccactgcgcattgggagaacagaggagactcccaatgcgcagtgggaacctggcggcagcgcaaaagatg

SEQ ID NO: 94276 - DNA, 103 bp, Artificial Sequence
  Synthetic Polynucleotide
taatacgactcactatagggcaagcagcagggcacgttttcccccactgcaacagaggagagcagtgatggaaaacgtgaacctggcggcagcgcaaaagatg

SEQ ID NO: 94277 - DNA, 103 bp, Artificial Sequence
  Synthetic Polynucleotide
taatacgactcactatagggctgtgacctcctcaggcaagctgaccaccaaacagaggagatggtggatggcttgcctgaacctggcggcagcgcaaaagatg

SEQ ID NO: 94278 - DNA, 103 bp, Artificial Sequence
  Synthetic Polynucleotide
taatacgactcactatagggcgcctggctccaagcagcagggcacgttttaacagaggagaaaaacgatgcctgctgctaacctggcggcagcgcaaaagatg

SEQ ID NO: 94279 - DNA, 103 bp, Artificial Sequence
  Synthetic Polynucleotide
taatacgactcactataggggggggagccgcgcctggctccaagcagcagaacagaggagactgctgatgggagccaggaacctggcggcagcgcaaaagatg

SEQ ID NO: 94280 - DNA, 103 bp, Artificial Sequence
  Synthetic Polynucleotide
taatacgactcactatagggggggggtccggggggagccgcgcctggctcaacagaggagagagccaatggcggctcccaacctggcggcagcgcaaaagatg

SEQ ID NO: 94281 - DNA, 103 bp, Artificial Sequence
  Synthetic Polynucleotide
taatacgactcactatagggtgggtgcccaggggggtccggggggagccgaacagaggagacggctcatgccggaccccaacctggcggcagcgcaaaagatg

SEQ ID NO: 94282 - DNA, 103 bp, Artificial Sequence
  Synthetic Polynucleotide
taatacgactcactataggggaggtgttgctgggtgcccaggggggtccgaacagaggagacggaccatgctgggcaccaacctggcggcagcgcaaaagatg

SEQ ID NO: 94283 - DNA, 103 bp, Artificial Sequence
  Synthetic Polynucleotide
taatacgactcactatagggacaattctcggaggtgttgctgggtgcccaaacagaggagatgggcaatgagcaacaccaacctggcggcagcgcaaaagatg

SEQ ID NO: 94284 - DNA, 103 bp, Artificial Sequence
  Synthetic Polynucleotide
taatacgactcactatagggtcccagaggtacaattctcggaggtgttgcaacagaggagagcaacaatgccgagaattaacctggcggcagcgcaaaagatg

SEQ ID NO: 94285 - DNA, 103 bp, Artificial Sequence
  Synthetic Polynucleotide
taatacgactcactatagggtctagtctcctcccagaggtacaattctcgaacagaggagacgagaaatgtacctctggaacctggcggcagcgcaaaagatg

SEQ ID NO: 94286 - DNA, 103 bp, Artificial Sequence
  Synthetic Polynucleotide
taatacgactcactataggggtcagtgccttctagtctcctcccagaggtaacagaggagaacctctatgaggagactaaacctggcggcagcgcaaaagatg

SEQ ID NO: 94287 - DNA, 103 bp, Artificial Sequence
  Synthetic Polynucleotide
taatacgactcactatagggaggttcccgggtcagtgccttctagtctccaacagaggagaggagacatgaaggcactgaacctggcggcagcgcaaaagatg

SEQ ID NO: 94288 - DNA, 103 bp, Artificial Sequence
  Synthetic Polynucleotide
taatacgactcactatagggaagcccctggctgtgacctcctcaggcaagaacagaggagacttgccatgggaggtcacaacctggcggcagcgcaaaagatg

SEQ ID NO: 94289 - DNA, 103 bp, Artificial Sequence
  Synthetic Polynucleotide
taatacgactcactatagggctctctgagaaggttcccgggtcagtgcctaacagaggagaaggcacatgcccgggaacaacctggcggcagcgcaaaagatg

SEQ ID NO: 94290 - DNA, 103 bp, Artificial Sequence
  Synthetic Polynucleotide
taatacgactcactatagggaggaggtcctctctctgagaaggttcccggaacagaggagaccgggaatgttctcagagaacctggcggcagcgcaaaagatg

SEQ ID NO: 94291 - DNA, 103 bp, Artificial Sequence
  Synthetic Polynucleotide
taatacgactcactatagggtgggttcaagaggaggtcctctctctgagaaacagaggagatctcagatggaggacctcaacctggcggcagcgcaaaagatg

SEQ ID NO: 94292 - DNA, 103 bp, Artificial Sequence
  Synthetic Polynucleotide
taatacgactcactataggggtttggctcctgggttcaagaggaggtcctaacagaggagaaggaccatgtcttgaaccaacctggcggcagcgcaaaagatg

SEQ ID NO: 94293 - DNA, 103 bp, Artificial Sequence
  Synthetic Polynucleotide
taatacgactcactatagggcacggtcactgtttggctcctgggttcaagaacagaggagacttgaaatgaggagccaaaacctggcggcagcgcaaaagatg

SEQ ID NO: 94294 - DNA, 103 bp, Artificial Sequence
  Synthetic Polynucleotide
taatacgactcactatagggggcagaagtccacggtcactgtttggctccaacagaggagaggagccatgcagtgaccgaacctggcggcagcgcaaaagatg

SEQ ID NO: 94295 - DNA, 103 bp, Artificial Sequence
  Synthetic Polynucleotide
taatacgactcactataggggtcatttcctggcagaagtccacggtcactaacagaggagaagtgacatgggacttctgaacctggcggcagcgcaaaagatg

SEQ ID NO: 94296 - DNA, 103 bp, Artificial Sequence
  Synthetic Polynucleotide
taatacgactcactatagggacacttatcagtcatttcctggcagaagtcaacagaggagagacttcatgcaggaaatgaacctggcggcagcgcaaaagatg

SEQ ID NO: 94297 - DNA, 103 bp, Artificial Sequence
  Synthetic Polynucleotide
taatacgactcactatagggcgtcagttgtacacttatcagtcatttcctaacagaggagaaggaaaatgctgataagtaacctggcggcagcgcaaaagatg

SEQ ID NO: 94298 - DNA, 103 bp, Artificial Sequence
  Synthetic Polynucleotide
taatacgactcactatagggctgggctgttcgtcagttgtacacttatcaaacagaggagatgataaatgtacaactgaaacctggcggcagcgcaaaagatg

SEQ ID NO: 94299 - DNA, 103 bp, Artificial Sequence
  Synthetic Polynucleotide
taatacgactcactatagggcagcggcccaaagcccctggctgtgacctcaacagaggagagaggtcatggccaggggcaacctggcggcagcgcaaaagatg

SEQ ID NO: 94300 - DNA, 103 bp, Artificial Sequence
  Synthetic Polynucleotide
taatacgactcactatagggataatctttcctgggctgttcgtcagttgtaacagaggagaacaactatggaacagcccaacctggcggcagcgcaaaagatg

SEQ ID NO: 94301 - DNA, 103 bp, Artificial Sequence
  Synthetic Polynucleotide
taatacgactcactatagggcaaactgtaacagcggcccaaagcccctggaacagaggagaccagggatgttgggccgcaacctggcggcagcgcaaaagatg

SEQ ID NO: 94302 - DNA, 103 bp, Artificial Sequence
  Synthetic Polynucleotide
taatacgactcactataggggcagtgtaggcaaactgtaacagcggcccaaacagaggagatgggccatggttacagttaacctggcggcagcgcaaaagatg

SEQ ID NO: 94303 - DNA, 103 bp, Artificial Sequence
  Synthetic Polynucleotide
taatacgactcactatagggtaacagcttggcagtgtaggcaaactgtaaaacagaggagattacagatggcctacactaacctggcggcagcgcaaaagatg

SEQ ID NO: 94304 - DNA, 103 bp, Artificial Sequence
  Synthetic Polynucleotide
taatacgactcactatagggctctgctgagtaacagcttggcagtgtaggaacagaggagacctacaatgccaagctgtaacctggcggcagcgcaaaagatg

SEQ ID NO: 94305 - DNA, 103 bp, Artificial Sequence
  Synthetic Polynucleotide
taatacgactcactataggggtggactcatacacatacatgggggagtcaaacagaggagatgactcatgcatgtatgtaacctggcggcagcgcaaaagatg

SEQ ID NO: 94306 - DNA, 103 bp, Artificial Sequence
  Synthetic Polynucleotide
taatacgactcactatagggcggatgttttctctgctgagtaacagcttgaacagaggagacaagctatgactcagcagaacctggcggcagcgcaaaagatg

SEQ ID NO: 94307 - DNA, 103 bp, Artificial Sequence
  Synthetic Polynucleotide
taatacgactcactataggggatgacctcgcggatgttttctctgctgagaacagaggagactcagcatggaaaacatcaacctggcggcagcgcaaaagatg

SEQ ID NO: 94308 - DNA, 103 bp, Artificial Sequence
  Synthetic Polynucleotide
taatacgactcactatagggcagcacagcggatgacctcgcggatgttttaacagaggagaaaaacaatggcgaggtcaaacctggcggcagcgcaaaagatg

SEQ ID NO: 94309 - DNA, 103 bp, Artificial Sequence
  Synthetic Polynucleotide
taatacgactcactatagggcgcaggaactcagcacagcggatgacctcgaacagaggagacgaggtatgccgctgtgcaacctggcggcagcgcaaaagatg

SEQ ID NO: 94310 - DNA, 103 bp, Artificial Sequence
  Synthetic Polynucleotide
taatacgactcactataggggttgtgcatgcgcaggaactcagcacagcgaacagaggagacgctgtatggagttcctgaacctggcggcagcgcaaaagatg

SEQ ID NO: 94311 - DNA, 103 bp, Artificial Sequence
  Synthetic Polynucleotide
taatacgactcactatagggagtcctccaggttgtgcatgcgcaggaactaacagaggagaagttccatggcatgcacaaacctggcggcagcgcaaaagatg

SEQ ID NO: 94312 - DNA, 103 bp, Artificial Sequence
  Synthetic Polynucleotide
taatacgactcactatagggctgaagcaggagtcctccaggttgtgcatgaacagaggagacatgcaatgcctggaggaaacctggcggcagcgcaaaagatg

SEQ ID NO: 94313 - DNA, 103 bp, Artificial Sequence
  Synthetic Polynucleotide
taatacgactcactatagggctgcaggaagctgaagcaggagtcctccagaacagaggagactggagatgtcctgcttcaacctggcggcagcgcaaaagatg

SEQ ID NO: 94314 - DNA, 103 bp, Artificial Sequence
  Synthetic Polynucleotide
taatacgactcactatagggggagctgggtctgcaggaagctgaagcaggaacagaggagacctgctatggcttcctgcaacctggcggcagcgcaaaagatg

SEQ ID NO: 94315 - DNA, 103 bp, Artificial Sequence
  Synthetic Polynucleotide
taatacgactcactatagggtcactgttcaggagctgggtctgcaggaagaacagaggagacttcctatggacccagctaacctggcggcagcgcaaaagatg

SEQ ID NO: 94316 - DNA, 103 bp, Artificial Sequence
  Synthetic Polynucleotide
taatacgactcactataggggcagtggactgtggactcatacacatacataacagaggagaatgtatatgtatgagtccaacctggcggcagcgcaaaagatg

SEQ ID NO: 94317 - DNA, 103 bp, Artificial Sequence
  Synthetic Polynucleotide
taatacgactcactatagggcaggccatcctcactgttcaggagctgggtaacagaggagaacccagatgctgaacagtaacctggcggcagcgcaaaagatg

SEQ ID NO: 94318 - DNA, 103 bp, Artificial Sequence
  Synthetic Polynucleotide
taatacgactcactatagggggcacacaaacaggccatcctcactgttcaaacagaggagatgaacaatgaggatggccaacctggcggcagcgcaaaagatg

SEQ ID NO: 94319 - DNA, 103 bp, Artificial Sequence
  Synthetic Polynucleotide
taatacgactcactataggggcatccttccggcacacaaacaggccatccaacagaggagaggatggatggtttgtgtgaacctggcggcagcgcaaaagatg

SEQ ID NO: 94320 - DNA, 103 bp, Artificial Sequence
  Synthetic Polynucleotide
taatacgactcactatagggctggcacgcagcatccttccggcacacaaaaacagaggagatttgtgatgcggaaggataacctggcggcagcgcaaaagatg

SEQ ID NO: 94321 - DNA, 103 bp, Artificial Sequence
  Synthetic Polynucleotide
taatacgactcactatagggcgtgtgggcgctggcacgcagcatccttccaacagaggagaggaaggatgctgcgtgccaacctggcggcagcgcaaaagatg

SEQ ID NO: 94322 - DNA, 103 bp, Artificial Sequence
  Synthetic Polynucleotide
taatacgactcactatagggtcgcagtcctcgtgtgggcgctggcacgcaaacagaggagatgcgtgatggcgcccacaaacctggcggcagcgcaaaagatg

SEQ ID NO: 94323 - DNA, 103 bp, Artificial Sequence
  Synthetic Polynucleotide
taatacgactcactatagggtgcagagttctcgcagtcctcgtgtgggcgaacagaggagacgcccaatggaggactgcaacctggcggcagcgcaaaagatg

SEQ ID NO: 94324 - DNA, 103 bp, Artificial Sequence
  Synthetic Polynucleotide
taatacgactcactatagggcctcctctcctgcagagttctcgcagtcctaacagaggagaaggactatgagaactctgaacctggcggcagcgcaaaagatg

SEQ ID NO: 94325 - DNA, 103 bp, Artificial Sequence
  Synthetic Polynucleotide
taatacgactcactatagggtcttcatcctcctcctctcctgcagagttcaacagaggagagaactcatgaggagaggaaacctggcggcagcgcaaaagatg

SEQ ID NO: 94326 - DNA, 103 bp, Artificial Sequence
  Synthetic Polynucleotide
taatacgactcactatagggcgtctcctcctcttcatcctcctcctctccaacagaggagaggagagatggaggatgaaaacctggcggcagcgcaaaagatg

SEQ ID NO: 94327 - DNA, 103 bp, Artificial Sequence
  Synthetic Polynucleotide
taatacgactcactatagggggatgttggtgcagtggactgtggactcataacagaggagaatgagtatgcagtccactaacctggcggcagcgcaaaagatg

SEQ ID NO: 94328 - DNA, 103 bp, Artificial Sequence
  Synthetic Polynucleotide
taatacgactcactatagggctgaatccatcgtctcctcctcttcatcctaacagaggagaaggatgatgaggaggagaaacctggcggcagcgcaaaagatg

SEQ ID NO: 94329 - DNA, 103 bp, Artificial Sequence
  Synthetic Polynucleotide
taatacgactcactatagggttggccgtctctgaatccatcgtctcctccaacagaggagaggaggaatggatggattcaacctggcggcagcgcaaaagatg

SEQ ID NO: 94330 - DNA, 103 bp, Artificial Sequence
  Synthetic Polynucleotide
taatacgactcactataggggcaagccatcttggccgtctctgaatccataacagaggagaatggatatggagacggccaacctggcggcagcgcaaaagatg

SEQ ID NO: 94331 - DNA, 103 bp, Artificial Sequence
  Synthetic Polynucleotide
taatacgactcactatagggggtccctggggcaagccatcttggccgtctaacagaggagaagacggatgagatggcttaacctggcggcagcgcaaaagatg

SEQ ID NO: 94332 - DNA, 103 bp, Artificial Sequence
  Synthetic Polynucleotide
taatacgactcactatagggggaagcatctggtccctggggcaagccatcaacagaggagagatggcatgccccagggaaacctggcggcagcgcaaaagatg

SEQ ID NO: 94333 - DNA, 103 bp, Artificial Sequence
  Synthetic Polynucleotide
taatacgactcactataggggatgggctctggaagcatctggtccctgggaacagaggagacccaggatgcagatgcttaacctggcggcagcgcaaaagatg

SEQ ID NO: 94334 - DNA, 103 bp, Artificial Sequence
  Synthetic Polynucleotide
taatacgactcactatagggcctcaaagctgatgggctctggaagcatctaacagaggagaagatgcatgcagagcccaaacctggcggcagcgcaaaagatg

SEQ ID NO: 94335 - DNA, 103 bp, Artificial Sequence
  Synthetic Polynucleotide
taatacgactcactatagggatggcggcggcctcaaagctgatgggctctaacagaggagaagagccatgcagctttgaaacctggcggcagcgcaaaagatg

SEQ ID NO: 94336 - DNA, 103 bp, Artificial Sequence
  Synthetic Polynucleotide
taatacgactcactatagggtgctacggggatggcggcggcctcaaagctaacagaggagaagctttatggccgccgccaacctggcggcagcgcaaaagatg

SEQ ID NO: 94337 - DNA, 103 bp, Artificial Sequence
  Synthetic Polynucleotide
taatacgactcactatagggcttccttctctgctacggggatggcggcggaacagaggagaccgccgatgtccccgtagaacctggcggcagcgcaaaagatg

SEQ ID NO: 94338 - DNA, 103 bp, Artificial Sequence
  Synthetic Polynucleotide
taatacgactcactatagggaggcccaggaggatgttggtgcagtggactaacagaggagaagtccaatgcaccaacataacctggcggcagcgcaaaagatg

SEQ ID NO: 94339 - DNA, 103 bp, Artificial Sequence
  Synthetic Polynucleotide
taatacgactcactatagggagcagggcttcttccttctctgctacggggaacagaggagaccccgtatgagagaaggaaacctggcggcagcgcaaaagatg

SEQ ID NO: 94340 - DNA, 103 bp, Artificial Sequence
  Synthetic Polynucleotide
taatacgactcactatagggaggctcgggcagcagggcttcttccttctcaacagaggagagagaagatggaagccctgaacctggcggcagcgcaaaagatg

SEQ ID NO: 94341 - DNA, 103 bp, Artificial Sequence
  Synthetic Polynucleotide
taatacgactcactatagggtgggcacgtcaggctcgggcagcagggcttaacagaggagaaagcccatgtgcccgagcaacctggcggcagcgcaaaagatg

SEQ ID NO: 94342 - DNA, 103 bp, Artificial Sequence
  Synthetic Polynucleotide
taatacgactcactatagggttggtgtctgtgggcacgtcaggctcgggcaacagaggagagcccgaatgtgacgtgccaacctggcggcagcgcaaaagatg

SEQ ID NO: 94343 - DNA, 103 bp, Artificial Sequence
  Synthetic Polynucleotide
taatacgactcactatagggtgagctctccttggtgtctgtgggcacgtcaacagaggagagacgtgatgacagacaccaacctggcggcagcgcaaaagatg

SEQ ID NO: 94344 - DNA, 103 bp, Artificial Sequence
  Synthetic Polynucleotide
taatacgactcactatagggcgtccttttctgagctctccttggtgtctgaacagaggagacagacaatgaggagagctaacctggcggcagcgcaaaagatg

SEQ ID NO: 94345 - DNA, 103 bp, Artificial Sequence
  Synthetic Polynucleotide
taatacgactcactatagggtgcgttaacgcgtccttttctgagctctccaacagaggagaggagagatgagaaaaggaaacctggcggcagcgcaaaagatg

SEQ ID NO: 94346 - DNA, 103 bp, Artificial Sequence
  Synthetic Polynucleotide
taatacgactcactatagggtctggggtactgcgttaacgcgtccttttcaacagaggagagaaaagatggcgttaacgaacctggcggcagcgcaaaagatg

SEQ ID NO: 94347 - DNA, 103 bp, Artificial Sequence
  Synthetic Polynucleotide
taatacgactcactatagggatttcttgtatctggggtactgcgttaacgaacagaggagacgttaaatgagtaccccaaacctggcggcagcgcaaaagatg

SEQ ID NO: 94348 - DNA, 103 bp, Artificial Sequence
  Synthetic Polynucleotide
taatacgactcactataggggcaagctggtatttcttgtatctggggtacaacagaggagagtacccatgatacaagaaaacctggcggcagcgcaaaagatg

SEQ ID NO: 94349 - DNA, 103 bp, Artificial Sequence
  Synthetic Polynucleotide
taatacgactcactatagggctggtcattgaggcccaggaggatgttggtaacagaggagaaccaacatgctcctgggcaacctggcggcagcgcaaaagatg

SEQ ID NO: 94350 - DNA, 103 bp, Artificial Sequence
  Synthetic Polynucleotide
taatacgactcactatagggcttggtacatgcaagctggtatttcttgtaaacagaggagatacaagatgtaccagcttaacctggcggcagcgcaaaagatg

SEQ ID NO: 94351 - DNA, 103 bp, Artificial Sequence
  Synthetic Polynucleotide
taatacgactcactatagggtatagacattcttggtacatgcaagctggtaacagaggagaaccagcatgcatgtaccaaacctggcggcagcgcaaaagatg

SEQ ID NO: 94352 - DNA, 103 bp, Artificial Sequence
  Synthetic Polynucleotide
taatacgactcactataggggatgatgcattatagacattcttggtacataacagaggagaatgtacatggaatgtctaaacctggcggcagcgcaaaagatg

SEQ ID NO: 94353 - DNA, 103 bp, Artificial Sequence
  Synthetic Polynucleotide
taatacgactcactatagggggtactgtgtgatgatgcattatagacattaacagaggagaaatgtcatgaatgcatcaaacctggcggcagcgcaaaagatg

SEQ ID NO: 94354 - DNA, 103 bp, Artificial Sequence
  Synthetic Polynucleotide
taatacgactcactatagggcaaaacctgaggtactgtgtgatgatgcataacagaggagaatgcatatgcacacagtaaacctggcggcagcgcaaaagatg

SEQ ID NO: 94355 - DNA, 103 bp, Artificial Sequence
  Synthetic Polynucleotide
taatacgactcactatagggaatgtgcttgcaaaacctgaggtactgtgtaacagaggagaacacagatgctcaggtttaacctggcggcagcgcaaaagatg

SEQ ID NO: 94356 - DNA, 103 bp, Artificial Sequence
  Synthetic Polynucleotide
taatacgactcactatagggatcttcccggaatgtgcttgcaaaacctgaaacagaggagatcaggtatggcaagcacaaacctggcggcagcgcaaaagatg

SEQ ID NO: 94357 - DNA, 103 bp, Artificial Sequence
  Synthetic Polynucleotide
taatacgactcactatagggtgctagagttatcttcccggaatgtgcttgaacagaggagacaagcaatgtccgggaagaacctggcggcagcgcaaaagatg

SEQ ID NO: 94358 - DNA, 103 bp, Artificial Sequence
  Synthetic Polynucleotide
taatacgactcactatagggttgaggctgttgctagagttatcttcccggaacagaggagaccgggaatgtaactctagaacctggcggcagcgcaaaagatg

SEQ ID NO: 94359 - DNA, 103 bp, Artificial Sequence
  Synthetic Polynucleotide
taatacgactcactatagggaagccccggcttgaggctgttgctagagttaacagaggagaaactctatgaacagcctcaacctggcggcagcgcaaaagatg

SEQ ID NO: 94360 - DNA, 103 bp, Artificial Sequence
  Synthetic Polynucleotide
taatacgactcactatagggcctttttccgctggtcattgaggcccaggaaacagaggagatcctggatgtcaatgaccaacctggcggcagcgcaaaagatg

SEQ ID NO: 94361 - DNA, 103 bp, Artificial Sequence
  Synthetic Polynucleotide
taatacgactcactataggggccccctggcaagccccggcttgaggctgtaacagaggagaacagccatgagccggggcaacctggcggcagcgcaaaagatg

SEQ ID NO: 94362 - DNA, 103 bp, Artificial Sequence
  Synthetic Polynucleotide
taatacgactcactatagggcttttaatctgccccctggcaagccccggcaacagaggagagccgggatgtgccaggggaacctggcggcagcgcaaaagatg

SEQ ID NO: 94363 - DNA, 103 bp, Artificial Sequence
  Synthetic Polynucleotide
taatacgactcactataggggggcggctcacttttaatctgccccctggcaacagaggagagccaggatgcagattaaaaacctggcggcagcgcaaaagatg

SEQ ID NO: 94364 - DNA, 103 bp, Artificial Sequence
  Synthetic Polynucleotide
taatacgactcactatagggtctcttcactgggcggctcacttttaatctaacagaggagaagattaatggtgagccgcaacctggcggcagcgcaaaagatg

SEQ ID NO: 94365 - DNA, 103 bp, Artificial Sequence
  Synthetic Polynucleotide
taatacgactcactatagggtcttcctcattctcttcactgggcggctcaaacagaggagatgagccatgcagtgaagaaacctggcggcagcgcaaaagatg

SEQ ID NO: 94366 - DNA, 103 bp, Artificial Sequence
  Synthetic Polynucleotide
taatacgactcactatagggcgtgatgctctcttcctcattctcttcactaacagaggagaagtgaaatgaatgaggaaaacctggcggcagcgcaaaagatg

SEQ ID NO: 94367 - DNA, 103 bp, Artificial Sequence
  Synthetic Polynucleotide
taatacgactcactatagggacaggcagagcgtgatgctctcttcctcataacagaggagaatgaggatgagagcatcaaacctggcggcagcgcaaaagatg

SEQ ID NO: 94368 - DNA, 103 bp, Artificial Sequence
  Synthetic Polynucleotide
taatacgactcactatagggtcatctccagacaggcagagcgtgatgctcaacagaggagagagcatatggctctgcctaacctggcggcagcgcaaaagatg

SEQ ID NO: 94369 - DNA, 103 bp, Artificial Sequence
  Synthetic Polynucleotide
taatacgactcactatagggggcgtcaggctcatctccagacaggcagagaacagaggagactctgcatgtctggagataacctggcggcagcgcaaaagatg

SEQ ID NO: 94370 - DNA, 103 bp, Artificial Sequence
  Synthetic Polynucleotide
taatacgactcactatagggctctgtccttggcgtcaggctcatctccagaacagaggagactggagatgagcctgacgaacctggcggcagcgcaaaagatg

SEQ ID NO: 94371 - DNA, 103 bp, Artificial Sequence
  Synthetic Polynucleotide
taatacgactcactatagggcagagaatatcctttttccgctggtcattgaacagaggagacaatgaatggcggaaaaaaacctggcggcagcgcaaaagatg

SEQ ID NO: 94372 - DNA, 103 bp, Artificial Sequence
  Synthetic Polynucleotide
taatacgactcactatagggacatcccccgctctgtccttggcgtcaggcaacagaggagagcctgaatgcaaggacagaacctggcggcagcgcaaaagatg

SEQ ID NO: 94373 - DNA, 103 bp, Artificial Sequence
  Synthetic Polynucleotide
taatacgactcactataggggtccatctcgacatcccccgctctgtccttaacagaggagaaaggacatggcgggggataacctggcggcagcgcaaaagatg

SEQ ID NO: 94374 - DNA, 103 bp, Artificial Sequence
  Synthetic Polynucleotide
taatacgactcactataggggctgtttccggtccatctcgacatcccccgaacagaggagacgggggatgtcgagatggaacctggcggcagcgcaaaagatg

SEQ ID NO: 94375 - DNA, 103 bp, Artificial Sequence
  Synthetic Polynucleotide
taatacgactcactataggggcagggctgggctgtttccggtccatctcgaacagaggagacgagatatgccggaaacaaacctggcggcagcgcaaaagatg

SEQ ID NO: 94376 - DNA, 103 bp, Artificial Sequence
  Synthetic Polynucleotide
taatacgactcactataggggggggtaggggcagggctgggctgtttccgaacagaggagacggaaaatgcccagccctaacctggcggcagcgcaaaagatg

SEQ ID NO: 94377 - DNA, 103 bp, Artificial Sequence
  Synthetic Polynucleotide
taatacgactcactatagggctggggccgtgggggtaggggcagggctggaacagaggagaccagccatgcccctacccaacctggcggcagcgcaaaagatg

SEQ ID NO: 94378 - DNA, 103 bp, Artificial Sequence
  Synthetic Polynucleotide
taatacgactcactataggggcggccccagctggggccgtgggggtagggaacagaggagaccctacatgcacggccccaacctggcggcagcgcaaaagatg

SEQ ID NO: 94379 - DNA, 103 bp, Artificial Sequence
  Synthetic Polynucleotide
taatacgactcactatagggctccaggcaggcggccccagctggggccgtaacagaggagaacggccatggctggggccaacctggcggcagcgcaaaagatg

SEQ ID NO: 94380 - DNA, 103 bp, Artificial Sequence
  Synthetic Polynucleotide
taatacgactcactatagggtcctggatctctccaggcaggcggccccagaacagaggagactggggatgcctgcctggaacctggcggcagcgcaaaagatg

SEQ ID NO: 94381 - DNA, 103 bp, Artificial Sequence
  Synthetic Polynucleotide
taatacgactcactataggggaggccacgctcctggatctctccaggcagaacagaggagactgcctatggagatccagaacctggcggcagcgcaaaagatg

SEQ ID NO: 94382 - DNA, 103 bp, Artificial Sequence
  Synthetic Polynucleotide
taatacgactcactataggggtcgatcccaaagccattggagccttccataacagaggagaatggaaatgtccaatggcaacctggcggcagcgcaaaagatg

SEQ ID NO: 94383 - DNA, 103 bp, Artificial Sequence
  Synthetic Polynucleotide
taatacgactcactatagggtggactcagctccaggggcgaacggcagtcaacagaggagagactgcatgtcgcccctgaacctggcggcagcgcaaaagatg

SEQ ID NO: 94384 - DNA, 103 bp, Artificial Sequence
  Synthetic Polynucleotide
taatacgactcactatagggtctctgagcgtggactcagctccaggggcgaacagaggagacgccccatgagctgagtcaacctggcggcagcgcaaaagatg

SEQ ID NO: 94385 - DNA, 103 bp, Artificial Sequence
  Synthetic Polynucleotide
taatacgactcactatagggtcgctgctgctctctgagcgtggactcagcaacagaggagagctgagatgacgctcagaaacctggcggcagcgcaaaagatg

SEQ ID NO: 94386 - DNA, 103 bp, Artificial Sequence
  Synthetic Polynucleotide
taatacgactcactatagggcgaagagcagtcgctgctgctctctgagcgaacagaggagacgctcaatgagcagcagcaacctggcggcagcgcaaaagatg

SEQ ID NO: 94387 - DNA, 103 bp, Artificial Sequence
  Synthetic Polynucleotide
taatacgactcactataggggagaggctggcgaagagcagtcgctgctgcaacagaggagagcagcaatgactgctcttaacctggcggcagcgcaaaagatg

SEQ ID NO: 94388 - DNA, 103 bp, Artificial Sequence
  Synthetic Polynucleotide
taatacgactcactatagggtcccttcctggagaggctggcgaagagcagaacagaggagactgctcatggccagcctcaacctggcggcagcgcaaaagatg

SEQ ID NO: 94389 - DNA, 103 bp, Artificial Sequence
  Synthetic Polynucleotide
taatacgactcactatagggctccaaacagtcccttcctggagaggctggaacagaggagaccagccatgccaggaaggaacctggcggcagcgcaaaagatg

SEQ ID NO: 94390 - DNA, 103 bp, Artificial Sequence
  Synthetic Polynucleotide
taatacgactcactataggggggtccccgtctccaaacagtcccttcctgaacagaggagacaggaaatgactgtttggaacctggcggcagcgcaaaagatg

SEQ ID NO: 94391 - DNA, 103 bp, Artificial Sequence
  Synthetic Polynucleotide
taatacgactcactatagggccaggccgtggggtccccgtctccaaacagaacagaggagactgtttatggacggggacaacctggcggcagcgcaaaagatg

SEQ ID NO: 94392 - DNA, 103 bp, Artificial Sequence
  Synthetic Polynucleotide
taatacgactcactatagggggatgccccgccaggccgtggggtccccgtaacagaggagaacggggatgccacggcctaacctggcggcagcgcaaaagatg

SEQ ID NO: 94393 - DNA, 103 bp, Artificial Sequence
  Synthetic Polynucleotide
taatacgactcactatagggagagaatggagtcgatcccaaagccattggaacagaggagaccaatgatgttgggatcgaacctggcggcagcgcaaaagatg

SEQ ID NO: 94394 - DNA, 103 bp, Artificial Sequence
  Synthetic Polynucleotide
taatacgactcactatagggaacctgggccggatgccccgccaggccgtgaacagaggagacacggcatggcggggcataacctggcggcagcgcaaaagatg

SEQ ID NO: 94395 - DNA, 103 bp, Artificial Sequence
  Synthetic Polynucleotide
taatacgactcactatagggtgggagtccaaacctgggccggatgccccgaacagaggagacggggcatgcggcccaggaacctggcggcagcgcaaaagatg

SEQ ID NO: 94396 - DNA, 103 bp, Artificial Sequence
  Synthetic Polynucleotide
taatacgactcactataggggggctgcaggtgggagtccaaacctgggccaacagaggagaggcccaatgttggactccaacctggcggcagcgcaaaagatg

SEQ ID NO: 94397 - DNA, 103 bp, Artificial Sequence
  Synthetic Polynucleotide
taatacgactcactatagggagagctgcccgggctgcaggtgggagtccaaacagaggagatggactatgacctgcagcaacctggcggcagcgcaaaagatg

SEQ ID NO: 94398 - DNA, 103 bp, Artificial Sequence
  Synthetic Polynucleotide
taatacgactcactataggggccggggctgagagctgcccgggctgcaggaacagaggagacctgcaatgcgggcagctaacctggcggcagcgcaaaagatg

SEQ ID NO: 94399 - DNA, 103 bp, Artificial Sequence
  Synthetic Polynucleotide
taatacgactcactataggggcgcgactgggccggggctgagagctgcccaacagaggagagggcagatgtcagccccgaacctggcggcagcgcaaaagatg

SEQ ID NO: 94400 - DNA, 103 bp, Artificial Sequence
  Synthetic Polynucleotide
taatacgactcactatagggaggtgacggtgcgcgactgggccggggctgaacagaggagacagcccatgcccagtcgcaacctggcggcagcgcaaaagatg

SEQ ID NO: 94401 - DNA, 103 bp, Artificial Sequence
  Synthetic Polynucleotide
taatacgactcactatagggagaaaggaggaggtgacggtgcgcgactggaacagaggagaccagtcatgcaccgtcacaacctggcggcagcgcaaaagatg

SEQ ID NO: 94402 - DNA, 103 bp, Artificial Sequence
  Synthetic Polynucleotide
taatacgactcactataggggtccctgatcagaaaggaggaggtgacggtaacagaggagaaccgtcatgtcctcctttaacctggcggcagcgcaaaagatg

SEQ ID NO: 94403 - DNA, 103 bp, Artificial Sequence
  Synthetic Polynucleotide
taatacgactcactatagggcggcaaggatgtccctgatcagaaaggaggaacagaggagacctcctatgtgatcagggaacctggcggcagcgcaaaagatg

SEQ ID NO: 94404 - DNA, 103 bp, Artificial Sequence
  Synthetic Polynucleotide
taatacgactcactataggggcgcggtgggagagaatggagtcgatcccaaacagaggagatgggatatgctccattctaacctggcggcagcgcaaaagatg

SEQ ID NO: 94405 - DNA, 103 bp, Artificial Sequence
  Synthetic Polynucleotide
taatacgactcactatagggggtttgcagtcggcaaggatgtccctgatcaacagaggagagatcagatgcatccttgcaacctggcggcagcgcaaaagatg

SEQ ID NO: 94406 - DNA, 103 bp, Artificial Sequence
  Synthetic Polynucleotide
taatacgactcactatagggggccgcgagtggtttgcagtcggcaaggataacagaggagaatccttatggactgcaaaaacctggcggcagcgcaaaagatg

SEQ ID NO: 94407 - DNA, 103 bp, Artificial Sequence
  Synthetic Polynucleotide
taatacgactcactatagggagggtgcacaggccgcgagtggtttgcagtaacagaggagaactgcaatgcactcgcggaacctggcggcagcgcaaaagatg

SEQ ID NO: 94408 - DNA, 103 bp, Artificial Sequence
  Synthetic Polynucleotide
taatacgactcactatagggctgctagagtagggtgcacaggccgcgagtaacagaggagaactcgcatgctgtgcaccaacctggcggcagcgcaaaagatg

SEQ ID NO: 94409 - DNA, 103 bp, Artificial Sequence
  Synthetic Polynucleotide
taatacgactcactatagggcggctgcccgctgctagagtagggtgcacaaacagaggagatgtgcaatgtactctagcaacctggcggcagcgcaaaagatg

SEQ ID NO: 94410 - DNA, 103 bp, Artificial Sequence
  Synthetic Polynucleotide
taatacgactcactatagggcaggggctgccggctgcccgctgctagagtaacagaggagaactctaatggcgggcagcaacctggcggcagcgcaaaagatg

SEQ ID NO: 94411 - DNA, 103 bp, Artificial Sequence
  Synthetic Polynucleotide
taatacgactcactatagggcccccaggctcaggggctgccggctgcccgaacagaggagacgggcaatgggcagccccaacctggcggcagcgcaaaagatg

SEQ ID NO: 94412 - DNA, 103 bp, Artificial Sequence
  Synthetic Polynucleotide
taatacgactcactatagggcgcaaggcggcccccaggctcaggggctgcaacagaggagagcagccatggagcctgggaacctggcggcagcgcaaaagatg

SEQ ID NO: 94413 - DNA, 103 bp, Artificial Sequence
  Synthetic Polynucleotide
taatacgactcactatagggcggccttggccgcaaggcggcccccaggctaacagaggagaagcctgatggccgccttgaacctggcggcagcgcaaaagatg

SEQ ID NO: 94414 - DNA, 103 bp, Artificial Sequence
  Synthetic Polynucleotide
taatacgactcactatagggaagtcctccgcggccttggccgcaaggcggaacagaggagaccgcctatgggccaaggcaacctggcggcagcgcaaaagatg

SEQ ID NO: 94415 - DNA, 103 bp, Artificial Sequence
  Synthetic Polynucleotide
taatacgactcactatagggggggctgcccgcgcggtgggagagaatggaaacagaggagatccattatgtcccaccgcaacctggcggcagcgcaaaagatg

SEQ ID NO: 94416 - DNA, 103 bp, Artificial Sequence
  Synthetic Polynucleotide
taatacgactcactatagggcttgtctctaaagtcctccgcggccttggcaacagaggagagccaagatggcggaggacaacctggcggcagcgcaaaagatg

SEQ ID NO: 94417 - DNA, 103 bp, Artificial Sequence
  Synthetic Polynucleotide
taatacgactcactatagggttttgtccagcttgtctctaaagtcctccgaacagaggagacggaggatgttagagacaaacctggcggcagcgcaaaagatg

SEQ ID NO: 94418 - DNA, 103 bp, Artificial Sequence
  Synthetic Polynucleotide
taatacgactcactatagggttgctgccacttttgtccagcttgtctctaaacagaggagatagagaatggctggacaaaacctggcggcagcgcaaaagatg

SEQ ID NO: 94419 - DNA, 103 bp, Artificial Sequence
  Synthetic Polynucleotide
taatacgactcactatagggcgatgaggcgttgctgccacttttgtccagaacagaggagactggacatgagtggcagcaacctggcggcagcgcaaaagatg

SEQ ID NO: 94420 - DNA, 103 bp, Artificial Sequence
  Synthetic Polynucleotide
taatacgactcactatagggactcagagtccgatgaggcgttgctgccacaacagaggagagtggcaatgacgcctcataacctggcggcagcgcaaaagatg

SEQ ID NO: 94421 - DNA, 103 bp, Artificial Sequence
  Synthetic Polynucleotide
taatacgactcactatagggttcactttatactcagagtccgatgaggcgaacagaggagacgcctcatgggactctgaaacctggcggcagcgcaaaagatg

SEQ ID NO: 94422 - DNA, 103 bp, Artificial Sequence
  Synthetic Polynucleotide
taatacgactcactataggggccctcctccttcactttatactcagagtcaacagaggagagactctatgtataaagtgaacctggcggcagcgcaaaagatg

SEQ ID NO: 94423 - DNA, 103 bp, Artificial Sequence
  Synthetic Polynucleotide
taatacgactcactatagggtctcgcggtcgccctcctccttcactttataacagaggagaataaagatgaggaggaggaacctggcggcagcgcaaaagatg

SEQ ID NO: 94424 - DNA, 103 bp, Artificial Sequence
  Synthetic Polynucleotide
taatacgactcactataggggagctggagatctcgcggtcgccctcctccaacagaggagaggaggaatgcgaccgcgaaacctggcggcagcgcaaaagatg

SEQ ID NO: 94425 - DNA, 103 bp, Artificial Sequence
  Synthetic Polynucleotide
taatacgactcactatagggactgtccctggagctggagatctcgcggtcaacagaggagagaccgcatgatctccagcaacctggcggcagcgcaaaagatg

SEQ ID NO: 94426 - DNA, 103 bp, Artificial Sequence
  Synthetic Polynucleotide
taatacgactcactatagggtgggaagggcggggctgcccgcgcggtgggaacagaggagacccaccatgcgggcagccaacctggcggcagcgcaaaagatg

SEQ ID NO: 94427 - DNA, 103 bp, Artificial Sequence
  Synthetic Polynucleotide
taatacgactcactataggggcaccgggggactgtccctggagctggagaaacagaggagatctccaatgccagggacaaacctggcggcagcgcaaaagatg

SEQ ID NO: 94428 - DNA, 103 bp, Artificial Sequence
  Synthetic Polynucleotide
taatacgactcactatagggtttttcaggcgcaccgggggactgtccctgaacagaggagacagggaatgtcccccggtaacctggcggcagcgcaaaagatg

SEQ ID NO: 94429 - DNA, 103 bp, Artificial Sequence
  Synthetic Polynucleotide
taatacgactcactatagggcttgcgtggctttttcaggcgcaccgggggaacagaggagacccccgatgcgcctgaaaaacctggcggcagcgcaaaagatg

SEQ ID NO: 94430 - DNA, 103 bp, Artificial Sequence
  Synthetic Polynucleotide
taatacgactcactatagggccgtgcgcgccttgcgtggctttttcaggcaacagaggagagcctgaatgagccacgcaaacctggcggcagcgcaaaagatg

SEQ ID NO: 94431 - DNA, 103 bp, Artificial Sequence
  Synthetic Polynucleotide
taatacgactcactatagggtcggtgaaggccgtgcgcgccttgcgtggcaacagaggagagccacgatgggcgcgcacaacctggcggcagcgcaaaagatg

SEQ ID NO: 94432 - DNA, 103 bp, Artificial Sequence
  Synthetic Polynucleotide
taatacgactcactatagggcagctgatggtcggtgaaggccgtgcgcgcaacagaggagagcgcgcatggccttcaccaacctggcggcagcgcaaaagatg

SEQ ID NO: 94433 - DNA, 103 bp, Artificial Sequence
  Synthetic Polynucleotide
taatacgactcactatagggccagctgcgccagctgatggtcggtgaaggaacagaggagaccttcaatgaccatcagcaacctggcggcagcgcaaaagatg

SEQ ID NO: 94434 - DNA, 103 bp, Artificial Sequence
  Synthetic Polynucleotide
taatacgactcactatagggaagctgcgctccagctgcgccagctgatggaacagaggagaccatcaatgggcgcagctaacctggcggcagcgcaaaagatg

SEQ ID NO: 94435 - DNA, 103 bp, Artificial Sequence
  Synthetic Polynucleotide
taatacgactcactatagggctgccgctcgaagctgcgctccagctgcgcaacagaggagagcgcagatggagcgcagcaacctggcggcagcgcaaaagatg

SEQ ID NO: 94436 - DNA, 103 bp, Artificial Sequence
  Synthetic Polynucleotide
taatacgactcactatagggtcaggtacttctgccgctcgaagctgcgctaacagaggagaagcgcaatgtcgagcggcaacctggcggcagcgcaaaagatg

SEQ ID NO: 94437 - DNA, 103 bp, Artificial Sequence
  Synthetic Polynucleotide
taatacgactcactataggggggtcccccttgggaagggcggggctgcccaacagaggagagggcagatgcgcccttccaacctggcggcagcgcaaaagatg

SEQ ID NO: 94438 - DNA, 103 bp, Artificial Sequence
  Synthetic Polynucleotide
taatacgactcactatagggtcctgcacgctcaggtacttctgccgctcgaacagaggagacgagcgatggaagtacctaacctggcggcagcgcaaaagatg

SEQ ID NO: 94439 - DNA, 103 bp, Artificial Sequence
  Synthetic Polynucleotide
taatacgactcactatagggctccatgcggtcctgcacgctcaggtacttaacagaggagaaagtacatgagcgtgcagaacctggcggcagcgcaaaagatg

SEQ ID NO: 94440 - DNA, 103 bp, Artificial Sequence
  Synthetic Polynucleotide
taatacgactcactatagggaggcggcgagctccatgcggtcctgcacgcaacagaggagagcgtgcatgaccgcatggaacctggcggcagcgcaaaagatg

SEQ ID NO: 94441 - DNA, 103 bp, Artificial Sequence
  Synthetic Polynucleotide
taatacgactcactatagggaggttgagcgaggcggcgagctccatgcggaacagaggagaccgcatatggctcgccgcaacctggcggcagcgcaaaagatg

SEQ ID NO: 94442 - DNA, 103 bp, Artificial Sequence
  Synthetic Polynucleotide
taatacgactcactatagggcgtgtcggtgaggttgagcgaggcggcgagaacagaggagactcgccatgtcgctcaacaacctggcggcagcgcaaaagatg

SEQ ID NO: 94443 - DNA, 103 bp, Artificial Sequence
  Synthetic Polynucleotide
taatacgactcactatagggtcttgacctgcgtgtcggtgaggttgagcgaacagaggagacgctcaatgtcaccgacaaacctggcggcagcgcaaaagatg

SEQ ID NO: 94444 - DNA, 103 bp, Artificial Sequence
  Synthetic Polynucleotide
taatacgactcactatagggtggtaccaggtcttgacctgcgtgtcggtgaacagaggagacaccgaatggcaggtcaaaacctggcggcagcgcaaaagatg

SEQ ID NO: 94445 - DNA, 103 bp, Artificial Sequence
  Synthetic Polynucleotide
taatacgactcactatagggcctgcggttctggtaccaggtcttgacctgaacagaggagacaggtcatgacctggtacaacctggcggcagcgcaaaagatg

SEQ ID NO: 94446 - DNA, 103 bp, Artificial Sequence
  Synthetic Polynucleotide
taatacgactcactatagggtccatttagtcctgcggttctggtaccaggaacagaggagacctggtatgagaaccgcaaacctggcggcagcgcaaaagatg

SEQ ID NO: 94447 - DNA, 103 bp, Artificial Sequence
  Synthetic Polynucleotide
taatacgactcactataggggtctgtcgcttccatttagtcctgcggttcaacagaggagagaaccgatggactaaatgaacctggcggcagcgcaaaagatg

SEQ ID NO: 94448 - DNA, 103 bp, Artificial Sequence
  Synthetic Polynucleotide
taatacgactcactatagggcccgagcaaggggtcccccttgggaagggcaacagaggagagcccttatgaagggggacaacctggcggcagcgcaaaagatg

SEQ ID NO: 94449 - DNA, 103 bp, Artificial Sequence
  Synthetic Polynucleotide
taatacgactcactatagggcccgacggccgtctgtcgcttccatttagtaacagaggagaactaaaatgaagcgacagaacctggcggcagcgcaaaagatg

SEQ ID NO: 94450 - DNA, 103 bp, Artificial Sequence
  Synthetic Polynucleotide
taatacgactcactataggggcagctccaacccgacggccgtctgtcgctaacagaggagaagcgacatgcggccgtcgaacctggcggcagcgcaaaagatg

SEQ ID NO: 94451 - DNA, 103 bp, Artificial Sequence
  Synthetic Polynucleotide
taatacgactcactataggggcctccgccagcagctccaacccgacggccaacagaggagaggccgtatggttggagctaacctggcggcagcgcaaaagatg

SEQ ID NO: 94452 - DNA, 103 bp, Artificial Sequence
  Synthetic Polynucleotide
taatacgactcactataggggtaattgcctgcctccgccagcagctccaaaacagaggagattggagatgctggcggagaacctggcggcagcgcaaaagatg

SEQ ID NO: 94453 - DNA, 103 bp, Artificial Sequence
  Synthetic Polynucleotide
taatacgactcactatagggggagcgctgagtaattgcctgcctccgccaaacagaggagatggcggatgcaggcaattaacctggcggcagcgcaaaagatg

SEQ ID NO: 94454 - DNA, 103 bp, Artificial Sequence
  Synthetic Polynucleotide
taatacgactcactatagggaacatccgctggagcgctgagtaattgcctaacagaggagaaggcaaatgctcagcgctaacctggcggcagcgcaaaagatg

SEQ ID NO: 94455 - DNA, 103 bp, Artificial Sequence
  Synthetic Polynucleotide
taatacgactcactatagggaggcgacgggaacatccgctggagcgctgaaacagaggagatcagcgatgcagcggatgaacctggcggcagcgcaaaagatg

SEQ ID NO: 94456 - DNA, 103 bp, Artificial Sequence
  Synthetic Polynucleotide
taatacgactcactatagggggtagaaataaggcgacgggaacatccgctaacagaggagaagcggaatgtcccgtcgcaacctggcggcagcgcaaaagatg

SEQ ID NO: 94457 - DNA, 103 bp, Artificial Sequence
  Synthetic Polynucleotide
taatacgactcactatagggagactctgcgggtagaaataaggcgacgggaacagaggagacccgtcatgttatttctaaacctggcggcagcgcaaaagatg

SEQ ID NO: 94458 - DNA, 103 bp, Artificial Sequence
  Synthetic Polynucleotide
taatacgactcactataggggttggaaaccagactctgcgggtagaaataaacagaggagatatttcatgccgcagagtaacctggcggcagcgcaaaagatg

SEQ ID NO: 94459 - DNA, 103 bp, Artificial Sequence
  Synthetic Polynucleotide
taatacgactcactatagggaacggcagtccccgagcaaggggtccccctaacagaggagaagggggatgccttgctcgaacctggcggcagcgcaaaagatg

SEQ ID NO: 94460 - DNA, 103 bp, Artificial Sequence
  Synthetic Polynucleotide
taatacgactcactatagggcggggtccaggttggaaaccagactctgcgaacagaggagacgcagaatgtggtttccaaacctggcggcagcgcaaaagatg

SEQ ID NO: 94461 - DNA, 103 bp, Artificial Sequence
  Synthetic Polynucleotide
taatacgactcactatagggagcgccgcgccggggtccaggttggaaaccaacagaggagaggtttcatgcctggacccaacctggcggcagcgcaaaagatg

SEQ ID NO: 94462 - DNA, 103 bp, Artificial Sequence
  Synthetic Polynucleotide
taatacgactcactataggggtacaggtagagcgccgcgccggggtccagaacagaggagactggacatgggcgcggcgaacctggcggcagcgcaaaagatg

SEQ ID NO: 94463 - DNA, 103 bp, Artificial Sequence
  Synthetic Polynucleotide
taatacgactcactatagggtggggccgcggtacaggtagagcgccgcgcaacagaggagagcgcggatgtctacctgtaacctggcggcagcgcaaaagatg

SEQ ID NO: 94464 - DNA, 103 bp, Artificial Sequence
  Synthetic Polynucleotide
taatacgactcactatagggggcggcgcgctggggccgcggtacaggtagaacagaggagactacctatgccgcggcccaacctggcggcagcgcaaaagatg

SEQ ID NO: 94465 - DNA, 103 bp, Artificial Sequence
  Synthetic Polynucleotide
taatacgactcactataggggagagcaggcggcggcgcgctggggccgcgaacagaggagacgcggcatgagcgcgccgaacctggcggcagcgcaaaagatg

SEQ ID NO: 94466 - DNA, 103 bp, Artificial Sequence
  Synthetic Polynucleotide
taatacgactcactataggggaggtctctggagagcaggcggcggcgcgcaacagaggagagcgcgcatgcgcctgctcaacctggcggcagcgcaaaagatg

SEQ ID NO: 94467 - DNA, 103 bp, Artificial Sequence
  Synthetic Polynucleotide
taatacgactcactatagggcggggcaccagaggtctctggagagcaggcaacagaggagagcctgcatgccagagaccaacctggcggcagcgcaaaagatg

SEQ ID NO: 94468 - DNA, 103 bp, Artificial Sequence
  Synthetic Polynucleotide
taatacgactcactataggggatgaggatgcggggcaccagaggtctctgaacagaggagacagagaatgctggtgcccaacctggcggcagcgcaaaagatg

SEQ ID NO: 94469 - DNA, 103 bp, Artificial Sequence
  Synthetic Polynucleotide
taatacgactcactatagggggagtccgtggatgaggatgcggggcaccaaacagaggagatggtgcatggcatcctcaaacctggcggcagcgcaaaagatg

SEQ ID NO: 94470 - DNA, 103 bp, Artificial Sequence
  Synthetic Polynucleotide
taatacgactcactatagggtccaggggcgaacggcagtccccgagcaagaacagaggagacttgctatgggactgccgaacctggcggcagcgcaaaagatg

SEQ ID NO: 94471 - DNA, 103 bp, Artificial Sequence
  Synthetic Polynucleotide
taatacgactcactatagggctggcgccctggagtccgtggatgaggatgaacagaggagacatcctatgccacggactaacctggcggcagcgcaaaagatg

SEQ ID NO: 94472 - DNA, 103 bp, Artificial Sequence
  Synthetic Polynucleotide
taatacgactcactataggggggcggctcgctggcgccctggagtccgtgaacagaggagacacggaatgcagggcgccaacctggcggcagcgcaaaagatg

SEQ ID NO: 94473 - DNA, 103 bp, Artificial Sequence
  Synthetic Polynucleotide
taatacgactcactataggggcagcggcgggggcggctcgctggcgccctaacagaggagaagggcgatggcgagccgcaacctggcggcagcgcaaaagatg

SEQ ID NO: 94474 - DNA, 103 bp, Artificial Sequence
  Synthetic Polynucleotide
taatacgactcactataggggccagggggggcagcggcgggggcggctcgaacagaggagacgagccatgcccgccgctaacctggcggcagcgcaaaagatg

SEQ ID NO: 94475 - DNA, 103 bp, Artificial Sequence
  Synthetic Polynucleotide
taatacgactcactataggggaggacgccggccagggggggcagcggcggaacagaggagaccgccgatgccccccctgaacctggcggcagcgcaaaagatg

SEQ ID NO: 94476 - DNA, 103 bp, Artificial Sequence
  Synthetic Polynucleotide
taatacgactcactatagggcggcgcgtgggaggacgccggccaggggggaacagaggagaccccccatgccggcgtccaacctggcggcagcgcaaaagatg

SEQ ID NO: 94477 - DNA, 103 bp, Artificial Sequence
  Synthetic Polynucleotide
taatacgactcactatagggcgaggctgcgcggcgcgtgggaggacgccgaacagaggagacggcgtatgcccacgcgcaacctggcggcagcgcaaaagatg

SEQ ID NO: 94478 - DNA, 103 bp, Artificial Sequence
  Synthetic Polynucleotide
taatacgactcactatagggactcgacccgctggccccttccattgtcataacagaggagaatgacaatggaaggggccaacctggcggcagcgcaaaagatg

SEQ ID NO: 94479 - DNA, 103 bp, Artificial Sequence
  Synthetic Polynucleotide
taatacgactcactatagggggtcctggcctcaccgagcgggcggaaatcaacagaggagagatttcatgccgctcggtaacctggcggcagcgcaaaagatg

SEQ ID NO: 94480 - DNA, 103 bp, Artificial Sequence
  Synthetic Polynucleotide
taatacgactcactataggggctgctgtacatggcagcggcagccgccgcaacagaggagagcggcgatggccgctgccaacctggcggcagcgcaaaagatg

SEQ ID NO: 94481 - DNA, 103 bp, Artificial Sequence
  Synthetic Polynucleotide
taatacgactcactatagggtccggtacatgctgctgtacatggcagcggaacagaggagaccgctgatgtgtacagcaaacctggcggcagcgcaaaagatg

SEQ ID NO: 94482 - DNA, 103 bp, Artificial Sequence
  Synthetic Polynucleotide
taatacgactcactataggggctggaggagtccggtacatgctgctgtacaacagaggagagtacagatgcatgtaccgaacctggcggcagcgcaaaagatg

SEQ ID NO: 94483 - DNA, 103 bp, Artificial Sequence
  Synthetic Polynucleotide
taatacgactcactataggggggatggggtgctggaggagtccggtacataacagaggagaatgtacatgactcctccaaacctggcggcagcgcaaaagatg

SEQ ID NO: 94484 - DNA, 103 bp, Artificial Sequence
  Synthetic Polynucleotide
taatacgactcactataggggctgcagctggggatggggtgctggaggagaacagaggagactcctcatgcaccccatcaacctggcggcagcgcaaaagatg

SEQ ID NO: 94485 - DNA, 103 bp, Artificial Sequence
  Synthetic Polynucleotide
taatacgactcactatagggaccaggggccgctgcagctggggatggggtaacagaggagaaccccaatgccagctgcaaacctggcggcagcgcaaaagatg

SEQ ID NO: 94486 - DNA, 103 bp, Artificial Sequence
  Synthetic Polynucleotide
taatacgactcactatagggcacacggggcaccaggggccgctgcagctgaacagaggagacagctgatgcggcccctgaacctggcggcagcgcaaaagatg

SEQ ID NO: 94487 - DNA, 103 bp, Artificial Sequence
  Synthetic Polynucleotide
taatacgactcactatagggcgtggatgagcacacggggcaccaggggccaacagaggagaggccccatgtgccccgtgaacctggcggcagcgcaaaagatg

SEQ ID NO: 94488 - DNA, 103 bp, Artificial Sequence
  Synthetic Polynucleotide
taatacgactcactatagggggccctaggccgtggatgagcacacggggcaacagaggagagccccgatggctcatccaaacctggcggcagcgcaaaagatg

SEQ ID NO: 94489 - DNA, 103 bp, Artificial Sequence
  Synthetic Polynucleotide
taatacgactcactatagggctgtcccccaggccctaggccgtggatgagaacagaggagactcatcatgggcctagggaacctggcggcagcgcaaaagatg

SEQ ID NO: 94490 - DNA, 103 bp, Artificial Sequence
  Synthetic Polynucleotide
taatacgactcactatagggtaaaatccgcggtcctggcctcaccgagcgaacagaggagacgctcgatgaggccaggaaacctggcggcagcgcaaaagatg

SEQ ID NO: 94491 - DNA, 103 bp, Artificial Sequence
  Synthetic Polynucleotide
taatacgactcactatagggtaagggctggctgtcccccaggccctaggcaacagaggagagcctagatgctgggggacaacctggcggcagcgcaaaagatg

SEQ ID NO: 94492 - DNA, 103 bp, Artificial Sequence
  Synthetic Polynucleotide
taatacgactcactataggggacaatggattaagggctggctgtcccccaaacagaggagatgggggatggccagccctaacctggcggcagcgcaaaagatg

SEQ ID NO: 94493 - DNA, 103 bp, Artificial Sequence
  Synthetic Polynucleotide
taatacgactcactataggggatggggctggacaatggattaagggctggaacagaggagaccagccatgaatccattgaacctggcggcagcgcaaaagatg

SEQ ID NO: 94494 - DNA, 103 bp, Artificial Sequence
  Synthetic Polynucleotide
taatacgactcactataggggggtgcctgggatggggctggacaatggataacagaggagaatccatatgccagccccaaacctggcggcagcgcaaaagatg

SEQ ID NO: 94495 - DNA, 103 bp, Artificial Sequence
  Synthetic Polynucleotide
taatacgactcactatagggcgggggtgtggggtgcctgggatggggctgaacagaggagacagcccatgcccaggcacaacctggcggcagcgcaaaagatg

SEQ ID NO: 94496 - DNA, 103 bp, Artificial Sequence
  Synthetic Polynucleotide
taatacgactcactataggggcctgactcctaaaatccgcggtcctggccaacagaggagaggccagatgcgcggatttaacctggcggcagcgcaaaagatg

SEQ ID NO: 94497 - DNA, 103 bp, Artificial Sequence
  Synthetic Polynucleotide
taatacgactcactatagggagatggggtggcctgactcctaaaatccgcaacagaggagagcggatatgaggagtcagaacctggcggcagcgcaaaagatg

SEQ ID NO: 94498 - DNA, 103 bp, Artificial Sequence
  Synthetic Polynucleotide
taatacgactcactatagggccgaacagggagatggggtggcctgactccaacagaggagaggagtcatgccaccccataacctggcggcagcgcaaaagatg

SEQ ID NO: 94499 - DNA, 103 bp, Artificial Sequence
  Synthetic Polynucleotide
taatacgactcactataggggtatcaatctccgaacagggagatggggtgaacagaggagacaccccatgtccctgttcaacctggcggcagcgcaaaagatg

SEQ ID NO: 94500 - DNA, 103 bp, Artificial Sequence
  Synthetic Polynucleotide
taatacgactcactatagggcgtccctacggtatcaatctccgaacagggaacagaggagaccctgtatggagattgataacctggcggcagcgcaaaagatg

SEQ ID NO: 94501 - DNA, 103 bp, Artificial Sequence
  Synthetic Polynucleotide
taatacgactcactatagggaagaaggcgccgtccctacggtatcaatctaacagaggagaagattgatgccgtagggaaacctggcggcagcgcaaaagatg

SEQ ID NO: 94502 - DNA, 103 bp, Artificial Sequence
  Synthetic Polynucleotide
taatacgactcactataggggagataggagaagaaggcgccgtccctacgaacagaggagacgtaggatgggcgccttcaacctggcggcagcgcaaaagatg

SEQ ID NO: 94503 - DNA, 103 bp, Artificial Sequence
  Synthetic Polynucleotide
taatacgactcactatagggcatggtgactgagataggagaagaaggcgcaacagaggagagcgcctatgtctcctatcaacctggcggcagcgcaaaagatg

SEQ ID NO: 94504 - DNA, 103 bp, Artificial Sequence
  Synthetic Polynucleotide
taatacgactcactatagggctattccaaaactcgacccgctggccccttaacagaggagaaaggggatggcgggtcgaaacctggcggcagcgcaaaagatg

SEQ ID NO: 94505 - DNA, 103 bp, Artificial Sequence
  Synthetic Polynucleotide
taatacgactcactatagggccgggggctccatggtgactgagataggagaacagaggagactcctaatgcagtcaccaaacctggcggcagcgcaaaagatg

SEQ ID NO: 94506 - DNA, 103 bp, Artificial Sequence
  Synthetic Polynucleotide
taatacgactcactatagggagatgcggctccgggggctccatggtgactaacagaggagaagtcacatgggagcccccaacctggcggcagcgcaaaagatg

SEQ ID NO: 94507 - DNA, 103 bp, Artificial Sequence
  Synthetic Polynucleotide
taatacgactcactataggggtctgctaccagatgcggctccgggggctcaacagaggagagagcccatggagccgcataacctggcggcagcgcaaaagatg

SEQ ID NO: 94508 - DNA, 103 bp, Artificial Sequence
  Synthetic Polynucleotide
taatacgactcactataggggctgggtcgcgtctgctaccagatgcggctaacagaggagaagccgcatgtggtagcagaacctggcggcagcgcaaaagatg

SEQ ID NO: 94509 - DNA, 103 bp, Artificial Sequence
  Synthetic Polynucleotide
taatacgactcactatagggtggtgatgatgctgggtcgcgtctgctaccaacagaggagaggtagcatgcgcgacccaaacctggcggcagcgcaaaagatg

SEQ ID NO: 94510 - DNA, 103 bp, Artificial Sequence
  Synthetic Polynucleotide
taatacgactcactataggggtggtggaggtggtgatgatgctgggtcgcaacagaggagagcgaccatgcatcatcacaacctggcggcagcgcaaaagatg

SEQ ID NO: 94511 - DNA, 103 bp, Artificial Sequence
  Synthetic Polynucleotide
taatacgactcactataggggctgctggctgtggtggaggtggtgatgataacagaggagaatcatcatgacctccaccaacctggcggcagcgcaaaagatg

SEQ ID NO: 94512 - DNA, 103 bp, Artificial Sequence
  Synthetic Polynucleotide
taatacgactcactatagggggcggcggcggctgctggctgtggtggaggaacagaggagacctccaatgcagccagcaaacctggcggcagcgcaaaagatg

SEQ ID NO: 94513 - DNA, 103 bp, Artificial Sequence
  Synthetic Polynucleotide
taatacgactcactatagggggccgcggccggcggcggcggctgctggctaacagaggagaagccagatgccgccgccgaacctggcggcagcgcaaaagatg

SEQ ID NO: 94514 - DNA, 103 bp, Artificial Sequence
  Synthetic Polynucleotide
taatacgactcactatagggtttgcgtcggggccgcggccggcggcggcgaacagaggagacgccgcatgcggccgcggaacctggcggcagcgcaaaagatg

SEQ ID NO: 94515 - DNA, 103 bp, Artificial Sequence
  Synthetic Polynucleotide
taatacgactcactatagggaaaatcgtgtctattccaaaactcgacccgaacagaggagacgggtcatgttttggaataacctggcggcagcgcaaaagatg

SEQ ID NO: 94516 - DNA, 103 bp, Artificial Sequence
  Synthetic Polynucleotide
taatacgactcactatagggggctgcaaactttgcgtcggggccgcggccaacagaggagaggccgcatgcccgacgcaaacctggcggcagcgcaaaagatg

SEQ ID NO: 94517 - DNA, 103 bp, Artificial Sequence
  Synthetic Polynucleotide
taatacgactcactatagggttggggcaaaggctgcaaactttgcgtcggaacagaggagaccgacgatgagtttgcagaacctggcggcagcgcaaaagatg

SEQ ID NO: 94518 - DNA, 103 bp, Artificial Sequence
  Synthetic Polynucleotide
taatacgactcactataggggctgctgctgttggggcaaaggctgcaaacaacagaggagagtttgcatgctttgccccaacctggcggcagcgcaaaagatg

SEQ ID NO: 94519 - DNA, 103 bp, Artificial Sequence
  Synthetic Polynucleotide
taatacgactcactatagggggcggcagcggctgctgctgttggggcaaaaacagaggagatttgccatgacagcagcaaacctggcggcagcgcaaaagatg

SEQ ID NO: 94520 - DNA, 103 bp, Artificial Sequence
  Synthetic Polynucleotide
taatacgactcactatagggcggctgctgtggcggcagcggctgctgctgaacagaggagacagcagatgccgctgccgaacctggcggcagcgcaaaagatg

SEQ ID NO: 94521 - DNA, 103 bp, Artificial Sequence
  Synthetic Polynucleotide
taatacgactcactataggggcggcggcggcggctgctgtggcggcagcgaacagaggagacgctgcatgcacagcagcaacctggcggcagcgcaaaagatg

SEQ ID NO: 94522 - DNA, 103 bp, Artificial Sequence
  Synthetic Polynucleotide
taatacgactcactatagggtgctgggggggcggcggcggcggctgctgtaacagaggagaacagcaatggccgccgccaacctggcggcagcgcaaaagatg

SEQ ID NO: 94523 - DNA, 103 bp, Artificial Sequence
  Synthetic Polynucleotide
taatacgactcactatagggcgagcccagctgctgggggggcggcggcggaacagaggagaccgccgatgcccccccagaacctggcggcagcgcaaaagatg

SEQ ID NO: 94524 - DNA, 103 bp, Artificial Sequence
  Synthetic Polynucleotide
taatacgactcactatagggccgaggcggccgagcccagctgctggggggaacagaggagaccccccatgagctgggctaacctggcggcagcgcaaaagatg

SEQ ID NO: 94525 - DNA, 103 bp, Artificial Sequence
  Synthetic Polynucleotide
taatacgactcactataggggtcctgggggccgaggcggccgagcccagcaacagaggagagctgggatgggccgcctcaacctggcggcagcgcaaaagatg

SEQ ID NO: 94526 - DNA, 103 bp, Artificial Sequence
  Synthetic Polynucleotide
taatacgactcactatagggggcactggacaaaatcgtgtctattccaaaaacagaggagatttggaatggacacgattaacctggcggcagcgcaaaagatg

SEQ ID NO: 94527 - DNA, 103 bp, Artificial Sequence
  Synthetic Polynucleotide
taatacgactcactatagggagacgtggaagtcctgggggccgaggcggcaacagaggagagccgccatggcccccaggaacctggcggcagcgcaaaagatg

SEQ ID NO: 94528 - DNA, 103 bp, Artificial Sequence
  Synthetic Polynucleotide
taatacgactcactatagggttaaaaaagaagacgtggaagtcctgggggaacagaggagacccccaatgcttccacgtaacctggcggcagcgcaaaagatg

SEQ ID NO: 94529 - DNA, 103 bp, Artificial Sequence
  Synthetic Polynucleotide
taatacgactcactatagggatgtccttaattaaaaaagaagacgtggaaaacagaggagattccacatgttcttttttaacctggcggcagcgcaaaagatg

SEQ ID NO: 94530 - DNA, 103 bp, Artificial Sequence
  Synthetic Polynucleotide
taatacgactcactataggggtcgcccaagatgtccttaattaaaaaagaaacagaggagatcttttatgattaaggacaacctggcggcagcgcaaaagatg

SEQ ID NO: 94531 - DNA, 103 bp, Artificial Sequence
  Synthetic Polynucleotide
taatacgactcactataggggaggtttgctgtcgcccaagatgtccttaaaacagaggagattaaggatgtcttgggcgaacctggcggcagcgcaaaagatg

SEQ ID NO: 94532 - DNA, 103 bp, Artificial Sequence
  Synthetic Polynucleotide
taatacgactcactatagggcatgccgccagaggtttgctgtcgcccaagaacagaggagacttgggatgcagcaaaccaacctggcggcagcgcaaaagatg

SEQ ID NO: 94533 - DNA, 103 bp, Artificial Sequence
  Synthetic Polynucleotide
taatacgactcactataggggtagggtgcacatgccgccagaggtttgctaacagaggagaagcaaaatgctggcggcaaacctggcggcagcgcaaaagatg

SEQ ID NO: 94534 - DNA, 103 bp, Artificial Sequence
  Synthetic Polynucleotide
taatacgactcactatagggcgctggtgctgtagggtgcacatgccgccaaacagaggagatggcggatggtgcaccctaacctggcggcagcgcaaaagatg

SEQ ID NO: 94535 - DNA, 103 bp, Artificial Sequence
  Synthetic Polynucleotide
taatacgactcactatagggggagaggatacgctggtgctgtagggtgcaaacagaggagatgcaccatgcagcaccagaacctggcggcagcgcaaaagatg

SEQ ID NO: 94536 - DNA, 103 bp, Artificial Sequence
  Synthetic Polynucleotide
taatacgactcactatagggggtgtggtggggagaggatacgctggtgctaacagaggagaagcaccatggtatcctctaacctggcggcagcgcaaaagatg

SEQ ID NO: 94537 - DNA, 103 bp, Artificial Sequence
  Synthetic Polynucleotide
taatacgactcactatagggtgcctgaactggcactggacaaaatcgtgtaacagaggagaacacgaatgtgtccagtgaacctggcggcagcgcaaaagatg

SEQ ID NO: 94538 - DNA, 103 bp, Artificial Sequence
  Synthetic Polynucleotide
taatacgactcactatagggcctgcttcggggtgtggtggggagaggataaacagaggagatatcctatgcccaccacaaacctggcggcagcgcaaaagatg

SEQ ID NO: 94539 - DNA, 103 bp, Artificial Sequence
  Synthetic Polynucleotide
taatacgactcactataggggcgttgctctcctgcttcggggtgtggtggaacagaggagaccaccaatgcccgaagcaaacctggcggcagcgcaaaagatg

SEQ ID NO: 94540 - DNA, 103 bp, Artificial Sequence
  Synthetic Polynucleotide
taatacgactcactatagggctcgtgcactgcgttgctctcctgcttcggaacagaggagaccgaagatggagagcaacaacctggcggcagcgcaaaagatg

SEQ ID NO: 94541 - DNA, 103 bp, Artificial Sequence
  Synthetic Polynucleotide
taatacgactcactataggggcctgaagctctcgtgcactgcgttgctctaacagaggagaagagcaatgcagtgcacgaacctggcggcagcgcaaaagatg

SEQ ID NO: 94542 - DNA, 103 bp, Artificial Sequence
  Synthetic Polynucleotide
taatacgactcactatagggtcgagctttggcctgaagctctcgtgcactaacagaggagaagtgcaatggagcttcagaacctggcggcagcgcaaaagatg

SEQ ID NO: 94543 - DNA, 103 bp, Artificial Sequence
  Synthetic Polynucleotide
taatacgactcactataggggtcctcctgctcgagctttggcctgaagctaacagaggagaagcttcatgccaaagctcaacctggcggcagcgcaaaagatg

SEQ ID NO: 94544 - DNA, 103 bp, Artificial Sequence
  Synthetic Polynucleotide
taatacgactcactatagggtggtcttgctgtcctcctgctcgagctttgaacagaggagacaaagcatgagcaggaggaacctggcggcagcgcaaaagatg

SEQ ID NO: 94545 - DNA, 103 bp, Artificial Sequence
  Synthetic Polynucleotide
taatacgactcactatagggttgtcgagtttggtcttgctgtcctcctgcaacagaggagagcaggaatgcagcaagacaacctggcggcagcgcaaaagatg

SEQ ID NO: 94546 - DNA, 103 bp, Artificial Sequence
  Synthetic Polynucleotide
taatacgactcactatagggatcctcccgcttgtcgagtttggtcttgctaacagaggagaagcaagatgaaactcgacaacctggcggcagcgcaaaagatg

SEQ ID NO: 94547 - DNA, 103 bp, Artificial Sequence
  Synthetic Polynucleotide
taatacgactcactatagggcgctctgggaatcctcccgcttgtcgagttaacagaggagaaactcgatgagcgggaggaacctggcggcagcgcaaaagatg

SEQ ID NO: 94548 - DNA, 103 bp, Artificial Sequence
  Synthetic Polynucleotide
taatacgactcactatagggatgcctgggctgcctgaactggcactggacaacagaggagagtccagatgcagttcaggaacctggcggcagcgcaaaagatg

SEQ ID NO: 94549 - DNA, 103 bp, Artificial Sequence
  Synthetic Polynucleotide
taatacgactcactatagggcatttgatgtcgctctgggaatcctcccgcaacagaggagagcgggaatgttcccagagaacctggcggcagcgcaaaagatg

SEQ ID NO: 94550 - DNA, 103 bp, Artificial Sequence
  Synthetic Polynucleotide
taatacgactcactatagggtgtcccgtggcatttgatgtcgctctgggaaacagaggagatcccagatggacatcaaaaacctggcggcagcgcaaaagatg

SEQ ID NO: 94551 - DNA, 103 bp, Artificial Sequence
  Synthetic Polynucleotide
taatacgactcactatagggcttcctcctttgtcccgtggcatttgatgtaacagaggagaacatcaatggccacgggaaacctggcggcagcgcaaaagatg

SEQ ID NO: 94552 - DNA, 103 bp, Artificial Sequence
  Synthetic Polynucleotide
taatacgactcactatagggtcccggtctccttcctcctttgtcccgtggaacagaggagaccacggatgaaaggaggaaacctggcggcagcgcaaaagatg

SEQ ID NO: 94553 - DNA, 103 bp, Artificial Sequence
  Synthetic Polynucleotide
taatacgactcactatagggactcgtaatctcccggtctccttcctccttaacagaggagaaaggagatgggagaccggaacctggcggcagcgcaaaagatg

SEQ ID NO: 94554 - DNA, 103 bp, Artificial Sequence
  Synthetic Polynucleotide
taatacgactcactatagggtctcacggctactcgtaatctcccggtctcaacagaggagagagaccatgagattacgaaacctggcggcagcgcaaaagatg

SEQ ID NO: 94555 - DNA, 103 bp, Artificial Sequence
  Synthetic Polynucleotide
taatacgactcactatagggacagggggactctcacggctactcgtaatcaacagaggagagattacatgtagccgtgaaacctggcggcagcgcaaaagatg

SEQ ID NO: 94556 - DNA, 103 bp, Artificial Sequence
  Synthetic Polynucleotide
taatacgactcactatagggcttggctctcacagggggactctcacggctaacagaggagaagccgtatgagtccccctaacctggcggcagcgcaaaagatg

SEQ ID NO: 94557 - DNA, 103 bp, Artificial Sequence
  Synthetic Polynucleotide
taatacgactcactatagggttcgaggcttcttggctctcacagggggacaacagaggagagtccccatgtgagagccaaacctggcggcagcgcaaaagatg

SEQ ID NO: 94558 - DNA, 103 bp, Artificial Sequence
  Synthetic Polynucleotide
taatacgactcactataggggtccttgcttttcgaggcttcttggctctcaacagaggagagagagcatggaagcctcgaacctggcggcagcgcaaaagatg

SEQ ID NO: 94559 - DNA, 103 bp, Artificial Sequence
  Synthetic Polynucleotide
taatacgactcactatagggtccattcatcatgcctgggctgcctgaactaacagaggagaagttcaatgagcccaggcaacctggcggcagcgcaaaagatg

SEQ ID NO: 94560 - DNA, 103 bp, Artificial Sequence
  Synthetic Polynucleotide
taatacgactcactatagggggaaaaagctgtccttgcttttcgaggcttaacagaggagaaagcctatgaaagcaaggaacctggcggcagcgcaaaagatg

SEQ ID NO: 94561 - DNA, 103 bp, Artificial Sequence
  Synthetic Polynucleotide
taatacgactcactataggggctggtggtcggaaaaagctgtccttgcttaacagaggagaaagcaaatgcagctttttaacctggcggcagcgcaaaagatg

SEQ ID NO: 94562 - DNA, 103 bp, Artificial Sequence
  Synthetic Polynucleotide
taatacgactcactatagggagttgattgagctggtggtcggaaaaagctaacagaggagaagctttatgcgaccaccaaacctggcggcagcgcaaaagatg

SEQ ID NO: 94563 - DNA, 103 bp, Artificial Sequence
  Synthetic Polynucleotide
taatacgactcactataggggctacgctccagttgattgagctggtggtcaacagaggagagaccacatgctcaatcaaaacctggcggcagcgcaaaagatg

SEQ ID NO: 94564 - DNA, 103 bp, Artificial Sequence
  Synthetic Polynucleotide
taatacgactcactataggggccgctcaaagctacgctccagttgattgaaacagaggagatcaatcatgtggagcgtaaacctggcggcagcgcaaaagatg

SEQ ID NO: 94565 - DNA, 103 bp, Artificial Sequence
  Synthetic Polynucleotide
taatacgactcactatagggaggtacttctgccgctcaaagctacgctccaacagaggagaggagcgatgctttgagcgaacctggcggcagcgcaaaagatg

SEQ ID NO: 94566 - DNA, 103 bp, Artificial Sequence
  Synthetic Polynucleotide
taatacgactcactatagggctgcacgctcaggtacttctgccgctcaaaaacagaggagatttgagatgcagaagtacaacctggcggcagcgcaaaagatg

SEQ ID NO: 94567 - DNA, 103 bp, Artificial Sequence
  Synthetic Polynucleotide
taatacgactcactatagggccatgcgatcctgcacgctcaggtacttctaacagaggagaagaagtatgtgagcgtgcaacctggcggcagcgcaaaagatg

SEQ ID NO: 94568 - DNA, 103 bp, Artificial Sequence
  Synthetic Polynucleotide
taatacgactcactataggggcagccaggtccatgcgatcctgcacgctcaacagaggagagagcgtatgggatcgcataacctggcggcagcgcaaaagatg

SEQ ID NO: 94569 - DNA, 103 bp, Artificial Sequence
  Synthetic Polynucleotide
taatacgactcactataggggttgagcgctgcagccaggtccatgcgatcaacagaggagagatcgcatggacctggctaacctggcggcagcgcaaaagatg

SEQ ID NO: 94570 - DNA, 103 bp, Artificial Sequence
  Synthetic Polynucleotide
taatacgactcactatagggggcggaaatctccattcatcatgcctgggcaacagaggagagcccagatgtgatgaatgaacctggcggcagcgcaaaagatg

SEQ ID NO: 94571 - DNA, 103 bp, Artificial Sequence
  Synthetic Polynucleotide
taatacgactcactatagggtgtcagtgaggttgagcgctgcagccaggtaacagaggagaacctggatgcagcgctcaaacctggcggcagcgcaaaagatg

SEQ ID NO: 94572 - DNA, 103 bp, Artificial Sequence
  Synthetic Polynucleotide
taatacgactcactatagggttgacttgggtgtcagtgaggttgagcgctaacagaggagaagcgctatgcctcactgaaacctggcggcagcgcaaaagatg

SEQ ID NO: 94573 - DNA, 103 bp, Artificial Sequence
  Synthetic Polynucleotide
taatacgactcactataggggtaccaggtcttgacttgggtgtcagtgagaacagaggagactcactatgacccaagtcaacctggcggcagcgcaaaagatg

SEQ ID NO: 94574 - DNA, 103 bp, Artificial Sequence
  Synthetic Polynucleotide
taatacgactcactatagggtgcggttctggtaccaggtcttgacttgggaacagaggagacccaagatgagacctggtaacctggcggcagcgcaaaagatg

SEQ ID NO: 94575 - DNA, 103 bp, Artificial Sequence
  Synthetic Polynucleotide
taatacgactcactatagggcacttggtcctgcggttctggtaccaggtcaacagaggagagacctgatgccagaaccgaacctggcggcagcgcaaaagatg

SEQ ID NO: 94576 - DNA, 103 bp, Artificial Sequence
  Synthetic Polynucleotide
taatacgactcactatagggctgccgcttccacttggtcctgcggttctgaacagaggagacagaacatgaggaccaagaacctggcggcagcgcaaaagatg

SEQ ID NO: 94577 - DNA, 103 bp, Artificial Sequence
  Synthetic Polynucleotide
taatacgactcactatagggccaccgctgtctgccgcttccacttggtccaacagaggagaggaccaatgggaagcggcaacctggcggcagcgcaaaagatg

SEQ ID NO: 94578 - DNA, 103 bp, Artificial Sequence
  Synthetic Polynucleotide
taatacgactcactatagggaactccaggcccaccgctgtctgccgcttcaacagaggagagaagcgatggacagcggtaacctggcggcagcgcaaaagatg

SEQ ID NO: 94579 - DNA, 103 bp, Artificial Sequence
  Synthetic Polynucleotide
taatacgactcactatagggctcggccagcaactccaggcccaccgctgtaacagaggagaacagcgatgggcctggagaacctggcggcagcgcaaaagatg

SEQ ID NO: 94580 - DNA, 103 bp, Artificial Sequence
  Synthetic Polynucleotide
taatacgactcactatagggagttccctgcctcggccagcaactccaggcaacagaggagagcctggatgtgctggccgaacctggcggcagcgcaaaagatg

SEQ ID NO: 94581 - DNA, 103 bp, Artificial Sequence
  Synthetic Polynucleotide
taatacgactcactatagggtcaccgagcgggcggaaatctccattcatcaacagaggagagatgaaatgagatttccgaacctggcggcagcgcaaaagatg

SEQ ID NO: 94582 - DNA, 103 bp, Artificial Sequence
  Synthetic Polynucleotide
taatacgactcactatagggagcgccgagtagttccctgcctcggccagcaacagaggagagctggcatgggcagggaaaacctggcggcagcgcaaaagatg

SEQ ID NO: 94583 - DNA, 103 bp, Artificial Sequence
  Synthetic Polynucleotide
taatacgactcactatagggcatcctctgcagcgccgagtagttccctgcaacagaggagagcagggatgtactcggcgaacctggcggcagcgcaaaagatg

SEQ ID NO: 94584 - DNA, 103 bp, Artificial Sequence
  Synthetic Polynucleotide
taatacgactcactataggggcgatggaaacatcctctgcagcgccgagtaacagaggagaactcggatgtgcagaggaaacctggcggcagcgcaaaagatg

SEQ ID NO: 94585 - DNA, 103 bp, Artificial Sequence
  Synthetic Polynucleotide
taatacgactcactatagggtagaaataaggcgatggaaacatcctctgcaacagaggagagcagagatggtttccatcaacctggcggcagcgcaaaagatg

SEQ ID NO: 94586 - DNA, 103 bp, Artificial Sequence
  Synthetic Polynucleotide
taatacgactcactataggggcttgggtgatagaaataaggcgatggaaaaacagaggagatttccaatgccttatttcaacctggcggcagcgcaaaagatg

SEQ ID NO: 94587 - DNA, 103 bp, Artificial Sequence
  Synthetic Polynucleotide
taatacgactcactatagggtgcccagcaggcttgggtgatagaaataagaacagaggagacttattatgatcacccaaaacctggcggcagcgcaaaagatg

SEQ ID NO: 94588 - DNA, 103 bp, Artificial Sequence
  Synthetic Polynucleotide
taatacgactcactatagggctgtccatgctgcccagcaggcttgggtgaaacagaggagatcacccatgcctgctgggaacctggcggcagcgcaaaagatg

SEQ ID NO: 94589 - DNA, 103 bp, Artificial Sequence
  Synthetic Polynucleotide
taatacgactcactatagggcgccgtagtgctgtccatgctgcccagcagaacagaggagactgctgatgagcatggacaacctggcggcagcgcaaaagatg

SEQ ID NO: 94590 - DNA, 103 bp, Artificial Sequence
  Synthetic Polynucleotide
taatacgactcactatagggcagccgccgccgccgtagtgctgtccatgcaacagaggagagcatggatggcactacggaacctggcggcagcgcaaaagatg

SEQ ID NO: 94591 - DNA, 103 bp, Artificial Sequence
  Synthetic Polynucleotide
taatacgactcactatagggatggcagcggcagccgccgccgccgtagtgaacagaggagacactacatgggcggcggcaacctggcggcagcgcaaaagatg

SEQ ID NO: 94592 - DNA, 103 bp, Artificial Sequence
  Synthetic Polynucleotide
taatacgactcactatagggcgcggcgcccggctcccccggccgctgcataacagaggagaatgcagatgccgggggagaacctggcggcagcgcaaaagatg

SEQ ID NO: 94593 - DNA, 103 bp, Artificial Sequence
  Synthetic Polynucleotide
taatacgactcactatagggcccgggtggctccgtgaggatctcctcaataacagaggagaattgagatgatcctcacgaacctggcggcagcgcaaaagatg

SEQ ID NO: 94594 - DNA, 103 bp, Artificial Sequence
  Synthetic Polynucleotide
taatacgactcactatagggcgcccttgggcccgggtggctccgtgaggaaacagaggagatcctcaatgagccacccgaacctggcggcagcgcaaaagatg

SEQ ID NO: 94595 - DNA, 103 bp, Artificial Sequence
  Synthetic Polynucleotide
taatacgactcactataggggcgggcgcggcgcccttgggcccgggtggcaacagaggagagccaccatggcccaagggaacctggcggcagcgcaaaagatg

SEQ ID NO: 94596 - DNA, 103 bp, Artificial Sequence
  Synthetic Polynucleotide
taatacgactcactatagggagcggcggctgcgggcgcggcgcccttgggaacagaggagacccaagatggccgcgcccaacctggcggcagcgcaaaagatg

SEQ ID NO: 94597 - DNA, 103 bp, Artificial Sequence
  Synthetic Polynucleotide
taatacgactcactatagggccgccgcggcagcggcggctgcgggcgcggaacagaggagaccgcgcatgcagccgccgaacctggcggcagcgcaaaagatg

SEQ ID NO: 94598 - DNA, 103 bp, Artificial Sequence
  Synthetic Polynucleotide
taatacgactcactatagggagcagctcgcccgccgcggcagcggcggctaacagaggagaagccgcatgtgccgcggcaacctggcggcagcgcaaaagatg

SEQ ID NO: 94599 - DNA, 103 bp, Artificial Sequence
  Synthetic Polynucleotide
taatacgactcactataggggccgaacttcagcagctcgcccgccgcggcaacagaggagagccgcgatgggcgagctgaacctggcggcagcgcaaaagatg

SEQ ID NO: 94600 - DNA, 103 bp, Artificial Sequence
  Synthetic Polynucleotide
taatacgactcactataggggcgcctgcacgccgaacttcagcagctcgcaacagaggagagcgagcatgtgaagttcgaacctggcggcagcgcaaaagatg

SEQ ID NO: 94601 - DNA, 103 bp, Artificial Sequence
  Synthetic Polynucleotide
taatacgactcactataggggccgccagcagcgcctgcacgccgaacttcaacagaggagagaagttatgcgtgcaggcaacctggcggcagcgcaaaagatg

SEQ ID NO: 94602 - DNA, 103 bp, Artificial Sequence
  Synthetic Polynucleotide
taatacgactcactataggggaagggccgcgccgccagcagcgcctgcacaacagaggagagtgcagatgctgctggcgaacctggcggcagcgcaaaagatg

SEQ ID NO: 94603 - DNA, 103 bp, Artificial Sequence
  Synthetic Polynucleotide
taatacgactcactatagggggccgaagcgcgcggcgcccggctcccccgaacagaggagacgggggatgcgggcgccgaacctggcggcagcgcaaaagatg

SEQ ID NO: 94604 - DNA, 103 bp, Artificial Sequence
  Synthetic Polynucleotide
taatacgactcactatagggggtggctgtggaagggccgcgccgccagcaaacagaggagatgctggatgcgcggccctaacctggcggcagcgcaaaagatg

SEQ ID NO: 94605 - DNA, 103 bp, Artificial Sequence
  Synthetic Polynucleotide
taatacgactcactatagggagcacggccaggtggctgtggaagggccgcaacagaggagagcggccatgccacagccaaacctggcggcagcgcaaaagatg

SEQ ID NO: 94606 - DNA, 103 bp, Artificial Sequence
  Synthetic Polynucleotide
taatacgactcactatagggctcggccttcagcacggccaggtggctgtgaacagaggagacacagcatgctggccgtgaacctggcggcagcgcaaaagatg

SEQ ID NO: 94607 - DNA, 103 bp, Artificial Sequence
  Synthetic Polynucleotide
taatacgactcactatagggccgccgcctgctcggccttcagcacggccaaacagaggagatggccgatgtgaaggccgaacctggcggcagcgcaaaagatg

SEQ ID NO: 94608 - DNA, 103 bp, Artificial Sequence
  Synthetic Polynucleotide
taatacgactcactatagggaacttgaacaccgccgcctgctcggccttcaacagaggagagaaggcatggcaggcggcaacctggcggcagcgcaaaagatg

SEQ ID NO: 94609 - DNA, 103 bp, Artificial Sequence
  Synthetic Polynucleotide
taatacgactcactatagggcgccagtgggaacttgaacaccgccgcctgaacagaggagacaggcgatggtgttcaagaacctggcggcagcgcaaaagatg

SEQ ID NO: 94610 - DNA, 103 bp, Artificial Sequence
  Synthetic Polynucleotide
taatacgactcactatagggagcccagcggcgccagtgggaacttgaacaaacagaggagatgttcaatgtcccactggaacctggcggcagcgcaaaagatg

SEQ ID NO: 94611 - DNA, 103 bp, Artificial Sequence
  Synthetic Polynucleotide
taatacgactcactatagggagccctgaacagcccagcggcgccagtgggaacagaggagacccactatggccgctgggaacctggcggcagcgcaaaagatg

SEQ ID NO: 94612 - DNA, 103 bp, Artificial Sequence
  Synthetic Polynucleotide
taatacgactcactatagggcgcagagctcagccctgaacagcccagcggaacagaggagaccgctgatgtgttcagggaacctggcggcagcgcaaaagatg

SEQ ID NO: 94613 - DNA, 103 bp, Artificial Sequence
  Synthetic Polynucleotide
taatacgactcactatagggccgccagcaacgcagagctcagccctgaacaacagaggagagttcagatgtgagctctgaacctggcggcagcgcaaaagatg

SEQ ID NO: 94614 - DNA, 103 bp, Artificial Sequence
  Synthetic Polynucleotide
taatacgactcactatagggccctcgggcgggccgaagcgcgcggcgcccaacagaggagagggcgcatggcgcttcggaacctggcggcagcgcaaaagatg

SEQ ID NO: 94615 - DNA, 103 bp, Artificial Sequence
  Synthetic Polynucleotide
taatacgactcactatagggccgggccctgccgccagcaacgcagagctcaacagaggagagagctcatggttgctggcaacctggcggcagcgcaaaagatg

SEQ ID NO: 94616 - DNA, 103 bp, Artificial Sequence
  Synthetic Polynucleotide
taatacgactcactataggggccgggcagcccgggccctgccgccagcaaaacagaggagattgctgatggcagggcccaacctggcggcagcgcaaaagatg

SEQ ID NO: 94617 - DNA, 103 bp, Artificial Sequence
  Synthetic Polynucleotide
taatacgactcactatagggcacccgcggcgccgggcagcccgggccctgaacagaggagacagggcatgggctgcccgaacctggcggcagcgcaaaagatg

SEQ ID NO: 94618 - DNA, 103 bp, Artificial Sequence
  Synthetic Polynucleotide
taatacgactcactatagggaggtgtggcgcacccgcggcgccgggcagcaacagaggagagctgccatgcgccgcgggaacctggcggcagcgcaaaagatg

SEQ ID NO: 94619 - DNA, 103 bp, Artificial Sequence
  Synthetic Polynucleotide
taatacgactcactatagggctcgagcggcaggtgtggcgcacccgcggcaacagaggagagccgcgatggcgccacacaacctggcggcagcgcaaaagatg

SEQ ID NO: 94620 - DNA, 103 bp, Artificial Sequence
  Synthetic Polynucleotide
taatacgactcactatagggggagctgcaactcgagcggcaggtgtggcgaacagaggagacgccacatgtgccgctcgaacctggcggcagcgcaaaagatg

SEQ ID NO: 94621 - DNA, 103 bp, Artificial Sequence
  Synthetic Polynucleotide
taatacgactcactatagggagcttcccgcggagctgcaactcgagcggcaacagaggagagccgctatggttgcagctaacctggcggcagcgcaaaagatg

SEQ ID NO: 94622 - DNA, 103 bp, Artificial Sequence
  Synthetic Polynucleotide
taatacgactcactatagggtgccgcctccagcttcccgcggagctgcaaaacagaggagattgcagatgcgcgggaagaacctggcggcagcgcaaaagatg

SEQ ID NO: 94623 - DNA, 103 bp, Artificial Sequence
  Synthetic Polynucleotide
taatacgactcactatagggccccagggcctgccgcctccagcttcccgcaacagaggagagcgggaatgtggaggcggaacctggcggcagcgcaaaagatg

SEQ ID NO: 94624 - DNA, 103 bp, Artificial Sequence
  Synthetic Polynucleotide
taatacgactcactataggggtgcctggctccccagggcctgccgcctccaacagaggagaggaggcatgaggccctggaacctggcggcagcgcaaaagatg

SEQ ID NO: 94625 - DNA, 103 bp, Artificial Sequence
  Synthetic Polynucleotide
taatacgactcactataggggtccgcgcagccctcgggcgggccgaagcgaacagaggagacgcttcatgccgcccgagaacctggcggcagcgcaaaagatg

SEQ ID NO: 94626 - DNA, 103 bp, Artificial Sequence
  Synthetic Polynucleotide
taatacgactcactatagggcttggctttggtgcctggctccccagggccaacagaggagaggccctatggagccaggcaacctggcggcagcgcaaaagatg

SEQ ID NO: 94627 - DNA, 103 bp, Artificial Sequence
  Synthetic Polynucleotide
taatacgactcactataggggacgccccttcttggctttggtgcctggctaacagaggagaagccagatgccaaagccaaacctggcggcagcgcaaaagatg

SEQ ID NO: 94628 - DNA, 103 bp, Artificial Sequence
  Synthetic Polynucleotide
taatacgactcactataggggtgcggctccgacgccccttcttggctttgaacagaggagacaaagcatggaaggggcgaacctggcggcagcgcaaaagatg

SEQ ID NO: 94629 - DNA, 103 bp, Artificial Sequence
  Synthetic Polynucleotide
taatacgactcactatagggggtgaacacagtgcggctccgacgccccttaacagaggagaaaggggatgcggagccgcaacctggcggcagcgcaaaagatg

SEQ ID NO: 94630 - DNA, 103 bp, Artificial Sequence
  Synthetic Polynucleotide
taatacgactcactataggggctgcagctcggtgaacacagtgcggctccaacagaggagaggagccatgctgtgttcaaacctggcggcagcgcaaaagatg

SEQ ID NO: 94631 - DNA, 103 bp, Artificial Sequence
  Synthetic Polynucleotide
taatacgactcactatagggaggcccatcagctgcagctcggtgaacacaaacagaggagatgtgttatgcgagctgcaaacctggcggcagcgcaaaagatg

SEQ ID NO: 94632 - DNA, 103 bp, Artificial Sequence
  Synthetic Polynucleotide
taatacgactcactataggggcgtttctccaggcccatcagctgcagctcaacagaggagagagctgatgctgatgggcaacctggcggcagcgcaaaagatg

SEQ ID NO: 94633 - DNA, 103 bp, Artificial Sequence
  Synthetic Polynucleotide
taatacgactcactataggggcttctcgaagcgtttctccaggcccatcaaacagaggagatgatggatgtggagaaacaacctggcggcagcgcaaaagatg

SEQ ID NO: 94634 - DNA, 103 bp, Artificial Sequence
  Synthetic Polynucleotide
taatacgactcactatagggaggtacttctgcttctcgaagcgtttctccaacagaggagaggagaaatgcttcgagaaaacctggcggcagcgcaaaagatg

SEQ ID NO: 94635 - DNA, 103 bp, Artificial Sequence
  Synthetic Polynucleotide
taatacgactcactatagggcggcgtggaaaggtacttctgcttctcgaaaacagaggagattcgagatgcagaagtacaacctggcggcagcgcaaaagatg

SEQ ID NO: 94636 - DNA, 103 bp, Artificial Sequence
  Synthetic Polynucleotide
taatacgactcactataggggcggccggtggtccgcgcagccctcgggcgaacagaggagacgcccgatggctgcgcggaacctggcggcagcgcaaaagatg

SEQ ID NO: 94637 - DNA, 103 bp, Artificial Sequence
  Synthetic Polynucleotide
taatacgactcactatagggctattctgtccggcgtggaaaggtacttctaacagaggagaagaagtatgtttccacgcaacctggcggcagcgcaaaagatg

SEQ ID NO: 94638 - DNA, 103 bp, Artificial Sequence
  Synthetic Polynucleotide
taatacgactcactatagggtcagcaagatctattctgtccggcgtggaaaacagaggagattccacatgggacagaataacctggcggcagcgcaaaagatg

SEQ ID NO: 94639 - DNA, 103 bp, Artificial Sequence
  Synthetic Polynucleotide
taatacgactcactataggggcccagggactcagcaagatctattctgtcaacagaggagagacagaatggatcttgctaacctggcggcagcgcaaaagatg

SEQ ID NO: 94640 - DNA, 103 bp, Artificial Sequence
  Synthetic Polynucleotide
taatacgactcactatagggactggctcaggcccagggactcagcaagataacagaggagaatcttgatgagtccctggaacctggcggcagcgcaaaagatg

SEQ ID NO: 94641 - DNA, 103 bp, Artificial Sequence
  Synthetic Polynucleotide
taatacgactcactatagggttcacctgcaactggctcaggcccagggacaacagaggagagtccctatgcctgagccaaacctggcggcagcgcaaaagatg

SEQ ID NO: 94642 - DNA, 103 bp, Artificial Sequence
  Synthetic Polynucleotide
taatacgactcactataggggtaccacgtcttcacctgcaactggctcagaacagaggagactgagcatgttgcaggtgaacctggcggcagcgcaaaagatg

SEQ ID NO: 94643 - DNA, 103 bp, Artificial Sequence
  Synthetic Polynucleotide
taatacgactcactatagggtccgattctggtaccacgtcttcacctgcaaacagaggagatgcaggatgagacgtggtaacctggcggcagcgcaaaagatg

SEQ ID NO: 94644 - DNA, 103 bp, Artificial Sequence
  Synthetic Polynucleotide
taatacgactcactatagggcacttcatcctccgattctggtaccacgtcaacagaggagagacgtgatgccagaatcgaacctggcggcagcgcaaaagatg

SEQ ID NO: 94645 - DNA, 103 bp, Artificial Sequence
  Synthetic Polynucleotide
taatacgactcactatagggtattttcttccacttcatcctccgattctgaacagaggagacagaatatgaggatgaagaacctggcggcagcgcaaaagatg

SEQ ID NO: 94646 - DNA, 103 bp, Artificial Sequence
  Synthetic Polynucleotide
taatacgactcactatagggcctgcagcactattttcttccacttcatccaacagaggagaggatgaatgggaagaaaaaacctggcggcagcgcaaaagatg

SEQ ID NO: 94647 - DNA, 103 bp, Artificial Sequence
  Synthetic Polynucleotide
taatacgactcactatagggcgatagcggtgcggccggtggtccgcgcagaacagaggagactgcgcatgccaccggccaacctggcggcagcgcaaaagatg

SEQ ID NO: 94648 - DNA, 103 bp, Artificial Sequence
  Synthetic Polynucleotide
taatacgactcactatagggaggccgccgccctgcagcactattttcttcaacagaggagagaagaaatgagtgctgcaaacctggcggcagcgcaaaagatg

SEQ ID NO: 94649 - DNA, 103 bp, Artificial Sequence
  Synthetic Polynucleotide
taatacgactcactataggggggagactccaggccgccgccctgcagcacaacagaggagagtgctgatgggcggcggcaacctggcggcagcgcaaaagatg

SEQ ID NO: 94650 - DNA, 103 bp, Artificial Sequence
  Synthetic Polynucleotide
taatacgactcactatagggtgggcttggtgggagactccaggccgccgcaacagaggagagcggcgatgtggagtctcaacctggcggcagcgcaaaagatg

SEQ ID NO: 94651 - DNA, 103 bp, Artificial Sequence
  Synthetic Polynucleotide
taatacgactcactatagggggccgccccttgggcttggtgggagactccaacagaggagaggagtcatgcaccaagccaacctggcggcagcgcaaaagatg

SEQ ID NO: 94652 - DNA, 103 bp, Artificial Sequence
  Synthetic Polynucleotide
taatacgactcactataggggttcttcttgggccgccccttgggcttggtaacagaggagaaccaagatgaaggggcggaacctggcggcagcgcaaaagatg

SEQ ID NO: 94653 - DNA, 103 bp, Artificial Sequence
  Synthetic Polynucleotide
taatacgactcactatagggttggaattgagttcttcttgggccgcccctaacagaggagaaggggcatgccaagaagaaacctggcggcagcgcaaaagatg

SEQ ID NO: 94654 - DNA, 103 bp, Artificial Sequence
  Synthetic Polynucleotide
taatacgactcactatagggtgctcgctcgttggaattgagttcttcttgaacagaggagacaagaaatgctcaattccaacctggcggcagcgcaaaagatg

SEQ ID NO: 94655 - DNA, 103 bp, Artificial Sequence
  Synthetic Polynucleotide
taatacgactcactatagggctcagtaagctgctcgctcgttggaattgaaacagaggagatcaattatgacgagcgagaacctggcggcagcgcaaaagatg

SEQ ID NO: 94656 - DNA, 103 bp, Artificial Sequence
  Synthetic Polynucleotide
taatacgactcactatagggcgcgctcctgctcagtaagctgctcgctcgaacagaggagacgagcgatgagcttactgaacctggcggcagcgcaaaagatg

SEQ ID NO: 94657 - DNA, 103 bp, Artificial Sequence
  Synthetic Polynucleotide
taatacgactcactataggggcatccttggcgcgctcctgctcagtaagcaacagaggagagcttacatggcaggagcgaacctggcggcagcgcaaaagatg

SEQ ID NO: 94658 - DNA, 103 bp, Artificial Sequence
  Synthetic Polynucleotide
taatacgactcactatagggcatgaagctgcgatagcggtgcggccggtgaacagaggagacaccggatgcaccgctataacctggcggcagcgcaaaagatg

SEQ ID NO: 94659 - DNA, 103 bp, Artificial Sequence
  Synthetic Polynucleotide
taatacgactcactatagggcggtttctctgcatccttggcgcgctcctgaacagaggagacaggagatggccaaggataacctggcggcagcgcaaaagatg

SEQ ID NO: 94660 - DNA, 103 bp, Artificial Sequence
  Synthetic Polynucleotide
taatacgactcactataggggcacctccgccggtttctctgcatccttggaacagaggagaccaaggatgcagagaaacaacctggcggcagcgcaaaagatg

SEQ ID NO: 94661 - DNA, 103 bp, Artificial Sequence
  Synthetic Polynucleotide
taatacgactcactatagggggctcgcccggcacctccgccggtttctctaacagaggagaagagaaatgggcggaggtaacctggcggcagcgcaaaagatg

SEQ ID NO: 94662 - DNA, 103 bp, Artificial Sequence
  Synthetic Polynucleotide
taatacgactcactatagggcctgtcgctgggctcgcccggcacctccgcaacagaggagagcggagatgccgggcgagaacctggcggcagcgcaaaagatg

SEQ ID NO: 94663 - DNA, 103 bp, Artificial Sequence
  Synthetic Polynucleotide
taatacgactcactatagggcctcgcggctcctgtcgctgggctcgcccgaacagaggagacgggcgatgccagcgacaaacctggcggcagcgcaaaagatg

SEQ ID NO: 94664 - DNA, 103 bp, Artificial Sequence
  Synthetic Polynucleotide
taatacgactcactatagggtctcctcaatcatgaagctgcgatagcggtaacagaggagaaccgctatggcagcttcaaacctggcggcagcgcaaaagatg

SEQ ID NO: 94665 - DNA, 103 bp, Artificial Sequence
  Synthetic Polynucleotide
taatacgactcactatagggtccgtgaggatctcctcaatcatgaagctgaacagaggagacagcttatggattgaggaaacctggcggcagcgcaaaagatg

SEQ ID NO: 94666 - DNA, 103 bp, Artificial Sequence
  Synthetic Polynucleotide
taatacgactcactataggggctcagcctcagctcggcgtggcagtgcataacagaggagaatgcacatgcacgccgagaacctggcggcagcgcaaaagatg

SEQ ID NO: 94667 - DNA, 103 bp, Artificial Sequence
  Synthetic Polynucleotide
taatacgactcactatagggctcaaagtaatcgcaggtctccttggagagaacagaggagactctccatggagacctgcaacctggcggcagcgcaaaagatg

SEQ ID NO: 94668 - DNA, 103 bp, Artificial Sequence
  Synthetic Polynucleotide
taatacgactcactataggggggaaagtttctcaaagtaatcgcaggtctaacagaggagaagacctatgattactttgaacctggcggcagcgcaaaagatg

SEQ ID NO: 94669 - DNA, 103 bp, Artificial Sequence
  Synthetic Polynucleotide
taatacgactcactatagggacggagtagagggaaagtttctcaaagtaaaacagaggagattacttatggaaactttcaacctggcggcagcgcaaaagatg

SEQ ID NO: 94670 - DNA, 103 bp, Artificial Sequence
  Synthetic Polynucleotide
taatacgactcactatagggcgacgggcacacggagtagagggaaagtttaacagaggagaaaacttatgctctactccaacctggcggcagcgcaaaagatg

SEQ ID NO: 94671 - DNA, 103 bp, Artificial Sequence
  Synthetic Polynucleotide
taatacgactcactataggggcacgaccagcgacgggcacacggagtagaaacagaggagatctactatgtgtgcccgtaacctggcggcagcgcaaaagatg

SEQ ID NO: 94672 - DNA, 103 bp, Artificial Sequence
  Synthetic Polynucleotide
taatacgactcactatagggggcttgggtcgcacgaccagcgacgggcacaacagaggagagtgcccatggctggtcgtaacctggcggcagcgcaaaagatg

SEQ ID NO: 94673 - DNA, 103 bp, Artificial Sequence
  Synthetic Polynucleotide
taatacgactcactatagggggaatgcaggggcttgggtcgcacgaccagaacagaggagactggtcatgcgacccaagaacctggcggcagcgcaaaagatg

SEQ ID NO: 94674 - DNA, 103 bp, Artificial Sequence
  Synthetic Polynucleotide
taatacgactcactatagggagcccgtacaggaatgcaggggcttgggtcaacagaggagagacccaatgccctgcattaacctggcggcagcgcaaaagatg

SEQ ID NO: 94675 - DNA, 103 bp, Artificial Sequence
  Synthetic Polynucleotide
taatacgactcactatagggagggaaggggagcccgtacaggaatgcaggaacagaggagacctgcaatgctgtacgggaacctggcggcagcgcaaaagatg

SEQ ID NO: 94676 - DNA, 103 bp, Artificial Sequence
  Synthetic Polynucleotide
taatacgactcactatagggatatgcccgcagggaaggggagcccgtacaaacagaggagatgtacgatgtccccttccaacctggcggcagcgcaaaagatg

SEQ ID NO: 94677 - DNA, 103 bp, Artificial Sequence
  Synthetic Polynucleotide
taatacgactcactatagggggccgggcgagctcagcctcagctcggcgtaacagaggagaacgccgatgtgaggctgaaacctggcggcagcgcaaaagatg

SEQ ID NO: 94678 - DNA, 103 bp, Artificial Sequence
  Synthetic Polynucleotide
taatacgactcactatagggagaggagcggatatgcccgcagggaaggggaacagaggagaccccttatgtgcgggcataacctggcggcagcgcaaaagatg

SEQ ID NO: 94679 - DNA, 103 bp, Artificial Sequence
  Synthetic Polynucleotide
taatacgactcactataggggtgatcaccgagaggagcggatatgcccgcaacagaggagagcgggcatgtccgctcctaacctggcggcagcgcaaaagatg

SEQ ID NO: 94680 - DNA, 103 bp, Artificial Sequence
  Synthetic Polynucleotide
taatacgactcactataggggggctggcgggtgatcaccgagaggagcggaacagaggagaccgctcatgtcggtgatcaacctggcggcagcgcaaaagatg

SEQ ID NO: 94681 - DNA, 103 bp, Artificial Sequence
  Synthetic Polynucleotide
taatacgactcactatagggagatgacagtgggctggcgggtgatcaccgaacagaggagacggtgaatgcccgccagcaacctggcggcagcgcaaaagatg

SEQ ID NO: 94682 - DNA, 103 bp, Artificial Sequence
  Synthetic Polynucleotide
taatacgactcactatagggaccaggtgggagatgacagtgggctggcggaacagaggagaccgccaatgcactgtcataacctggcggcagcgcaaaagatg

SEQ ID NO: 94683 - DNA, 103 bp, Artificial Sequence
  Synthetic Polynucleotide
taatacgactcactatagggggtggcagggaccaggtgggagatgacagtaacagaggagaactgtcatgtcccacctgaacctggcggcagcgcaaaagatg

SEQ ID NO: 94684 - DNA, 103 bp, Artificial Sequence
  Synthetic Polynucleotide
taatacgactcactatagggcgattcccggggtggcagggaccaggtgggaacagaggagacccaccatgtccctgccaaacctggcggcagcgcaaaagatg

SEQ ID NO: 94685 - DNA, 103 bp, Artificial Sequence
  Synthetic Polynucleotide
taatacgactcactatagggagtgcctgggcgattcccggggtggcagggaacagaggagaccctgcatgcccgggaataacctggcggcagcgcaaaagatg

SEQ ID NO: 94686 - DNA, 103 bp, Artificial Sequence
  Synthetic Polynucleotide
taatacgactcactataggggtggcaggacagtgcctgggcgattcccggaacagaggagaccgggaatggcccaggcaaacctggcggcagcgcaaaagatg

SEQ ID NO: 94687 - DNA, 103 bp, Artificial Sequence
  Synthetic Polynucleotide
taatacgactcactatagggcggtgacctggtggcaggacagtgcctgggaacagaggagacccaggatgtgtcctgccaacctggcggcagcgcaaaagatg

SEQ ID NO: 94688 - DNA, 103 bp, Artificial Sequence
  Synthetic Polynucleotide
taatacgactcactataggggctttgagctggccgggcgagctcagcctcaacagaggagagaggctatgctcgcccggaacctggcggcagcgcaaaagatg

SEQ ID NO: 94689 - DNA, 103 bp, Artificial Sequence
  Synthetic Polynucleotide
taatacgactcactataggggagaccgcctcggtgacctggtggcaggacaacagaggagagtcctgatgccaggtcacaacctggcggcagcgcaaaagatg

SEQ ID NO: 94690 - DNA, 103 bp, Artificial Sequence
  Synthetic Polynucleotide
taatacgactcactatagggggcctcagcagagaccgcctcggtgacctgaacagaggagacaggtcatggaggcggtcaacctggcggcagcgcaaaagatg

SEQ ID NO: 94691 - DNA, 103 bp, Artificial Sequence
  Synthetic Polynucleotide
taatacgactcactatagggcgccccctggggcctcagcagagaccgcctaacagaggagaaggcggatgctgctgaggaacctggcggcagcgcaaaagatg

SEQ ID NO: 94692 - DNA, 103 bp, Artificial Sequence
  Synthetic Polynucleotide
taatacgactcactataggggctagggcctcgccccctggggcctcagcaaacagaggagatgctgaatgcccagggggaacctggcggcagcgcaaaagatg

SEQ ID NO: 94693 - DNA, 103 bp, Artificial Sequence
  Synthetic Polynucleotide
taatacgactcactatagggctcgctgctggctagggcctcgccccctggaacagaggagaccagggatggaggccctaaacctggcggcagcgcaaaagatg

SEQ ID NO: 94694 - DNA, 103 bp, Artificial Sequence
  Synthetic Polynucleotide
taatacgactcactatagggccgtctctgactcgctgctggctagggcctaacagaggagaaggcccatgccagcagcgaacctggcggcagcgcaaaagatg

SEQ ID NO: 94695 - DNA, 103 bp, Artificial Sequence
  Synthetic Polynucleotide
taatacgactcactataggggtgggctgttccgtctctgactcgctgctgaacagaggagacagcagatggtcagagacaacctggcggcagcgcaaaagatg

SEQ ID NO: 94696 - DNA, 103 bp, Artificial Sequence
  Synthetic Polynucleotide
taatacgactcactatagggctgtcggggcgtgggctgttccgtctctgaaacagaggagatcagagatggaacagcccaacctggcggcagcgcaaaagatg

SEQ ID NO: 94697 - DNA, 103 bp, Artificial Sequence
  Synthetic Polynucleotide
taatacgactcactatagggggggcttcttctgtcggggcgtgggctgttaacagaggagaaacagcatgcgccccgacaacctggcggcagcgcaaaagatg

SEQ ID NO: 94698 - DNA, 103 bp, Artificial Sequence
  Synthetic Polynucleotide
taatacgactcactatagggcgactccggcggggcttcttctgtcggggcaacagaggagagccccgatggaagaagccaacctggcggcagcgcaaaagatg

SEQ ID NO: 94699 - DNA, 103 bp, Artificial Sequence
  Synthetic Polynucleotide
taatacgactcactatagggccgcctggctgctttgagctggccgggcgaaacagaggagatcgcccatgcagctcaaaaacctggcggcagcgcaaaagatg

SEQ ID NO: 94700 - DNA, 103 bp, Artificial Sequence
  Synthetic Polynucleotide
taatacgactcactataggggaagatggtgcgactccggcggggcttcttaacagaggagaaagaagatgcgccggagtaacctggcggcagcgcaaaagatg

SEQ ID NO: 94701 - DNA, 103 bp, Artificial Sequence
  Synthetic Polynucleotide
taatacgactcactataggggcagctcggtgaagatggtgcgactccggcaacagaggagagccggaatggcaccatctaacctggcggcagcgcaaaagatg

SEQ ID NO: 94702 - DNA, 103 bp, Artificial Sequence
  Synthetic Polynucleotide
taatacgactcactatagggcccatgagctgcagctcggtgaagatggtgaacagaggagacaccatatgcaccgagctaacctggcggcagcgcaaaagatg

SEQ ID NO: 94703 - DNA, 103 bp, Artificial Sequence
  Synthetic Polynucleotide
taatacgactcactatagggcttctccaggcccatgagctgcagctcggtaacagaggagaaccgagatgcagctcatgaacctggcggcagcgcaaaagatg

SEQ ID NO: 94704 - DNA, 103 bp, Artificial Sequence
  Synthetic Polynucleotide
taatacgactcactatagggtctggaatttcttctccaggcccatgagctaacagaggagaagctcaatggcctggagaaacctggcggcagcgcaaaagatg

SEQ ID NO: 94705 - DNA, 103 bp, Artificial Sequence
  Synthetic Polynucleotide
taatacgactcactatagggtacttctgcttctggaatttcttctccaggaacagaggagacctggaatggaaattccaaacctggcggcagcgcaaaagatg

SEQ ID NO: 94706 - DNA, 103 bp, Artificial Sequence
  Synthetic Polynucleotide
taatacgactcactatagggggttgacaaatacttctgcttctggaatttaacagaggagaaaattcatgaagcagaagaacctggcggcagcgcaaaagatg

SEQ ID NO: 94707 - DNA, 103 bp, Artificial Sequence
  Synthetic Polynucleotide
taatacgactcactatagggacctgtctggggttgacaaatacttctgctaacagaggagaagcagaatgatttgtcaaaacctggcggcagcgcaaaagatg

SEQ ID NO: 94708 - DNA, 103 bp, Artificial Sequence
  Synthetic Polynucleotide
taatacgactcactataggggccaagtccaacctgtctggggttgacaaaaacagaggagatttgtcatgcccagacagaacctggcggcagcgcaaaagatg

SEQ ID NO: 94709 - DNA, 103 bp, Artificial Sequence
  Synthetic Polynucleotide
taatacgactcactatagggcagagactgagccaagtccaacctgtctggaacagaggagaccagacatgttggacttgaacctggcggcagcgcaaaagatg

SEQ ID NO: 94710 - DNA, 103 bp, Artificial Sequence
  Synthetic Polynucleotide
taatacgactcactatagggtcttgtagcgccgcctggctgctttgagctaacagaggagaagctcaatgcagccaggcaacctggcggcagcgcaaaagatg

SEQ ID NO: 94711 - DNA, 103 bp, Artificial Sequence
  Synthetic Polynucleotide
taatacgactcactataggggagtgagtcccagagactgagccaagtccaaacagaggagatggactatgctcagtctcaacctggcggcagcgcaaaagatg

SEQ ID NO: 94712 - DNA, 103 bp, Artificial Sequence
  Synthetic Polynucleotide
taatacgactcactatagggacctgcagctgagtgagtcccagagactgaaacagaggagatcagtcatggggactcacaacctggcggcagcgcaaaagatg

SEQ ID NO: 94713 - DNA, 103 bp, Artificial Sequence
  Synthetic Polynucleotide
taatacgactcactatagggccaggtcttcacctgcagctgagtgagtccaacagaggagaggactcatgcagctgcagaacctggcggcagcgcaaaagatg

SEQ ID NO: 94714 - DNA, 103 bp, Artificial Sequence
  Synthetic Polynucleotide
taatacgactcactataggggattctgataccaggtcttcacctgcagctaacagaggagaagctgcatgtgaagacctaacctggcggcagcgcaaaagatg

SEQ ID NO: 94715 - DNA, 103 bp, Artificial Sequence
  Synthetic Polynucleotide
taatacgactcactatagggttcatcctgcgattctgataccaggtcttcaacagaggagagaagacatggtatcagaaaacctggcggcagcgcaaaagatg

SEQ ID NO: 94716 - DNA, 103 bp, Artificial Sequence
  Synthetic Polynucleotide
taatacgactcactatagggtttcttccatttcatcctgcgattctgataaacagaggagatatcagatgcgcaggatgaacctggcggcagcgcaaaagatg

SEQ ID NO: 94717 - DNA, 103 bp, Artificial Sequence
  Synthetic Polynucleotide
taatacgactcactatagggtaagaaccattttcttccatttcatcctgcaacagaggagagcaggaatgaatggaagaaacctggcggcagcgcaaaagatg

SEQ ID NO: 94718 - DNA, 103 bp, Artificial Sequence
  Synthetic Polynucleotide
taatacgactcactatagggtgtccacctttaagaaccattttcttccataacagaggagaatggaaatgaatggttctaacctggcggcagcgcaaaagatg

SEQ ID NO: 94719 - DNA, 103 bp, Artificial Sequence
  Synthetic Polynucleotide
taatacgactcactataggggggtgcttcctgtccacctttaagaaccataacagaggagaatggttatgaaaggtggaaacctggcggcagcgcaaaagatg

SEQ ID NO: 94720 - DNA, 103 bp, Artificial Sequence
  Synthetic Polynucleotide
taatacgactcactatagggtgggttttgtgggtgcttcctgtccaccttaacagaggagaaaggtgatgaggaagcacaacctggcggcagcgcaaaagatg

SEQ ID NO: 94721 - DNA, 103 bp, Artificial Sequence
  Synthetic Polynucleotide
taatacgactcactatagggatcatgaaagtcttgtagcgccgcctggctaacagaggagaagccagatggcgctacaaaacctggcggcagcgcaaaagatg

SEQ ID NO: 94722 - DNA, 103 bp, Artificial Sequence
  Synthetic Polynucleotide
taatacgactcactataggggggcgacctttgggttttgtgggtgcttccaacagaggagaggaagcatgcacaaaaccaacctggcggcagcgcaaaagatg

SEQ ID NO: 94723 - DNA, 103 bp, Artificial Sequence
  Synthetic Polynucleotide
taatacgactcactataggggttcttcttggggcgacctttgggttttgtaacagaggagaacaaaaatgaaaggtcgcaacctggcggcagcgcaaaagatg

SEQ ID NO: 94724 - DNA, 103 bp, Artificial Sequence
  Synthetic Polynucleotide
taatacgactcactatagggtggggatggagttcttcttggggcgaccttaacagaggagaaaggtcatgccaagaagaaacctggcggcagcgcaaaagatg

SEQ ID NO: 94725 - DNA, 103 bp, Artificial Sequence
  Synthetic Polynucleotide
taatacgactcactatagggtcttctgatgtggggatggagttcttcttgaacagaggagacaagaaatgctccatcccaacctggcggcagcgcaaaagatg

SEQ ID NO: 94726 - DNA, 103 bp, Artificial Sequence
  Synthetic Polynucleotide
taatacgactcactatagggagcttcaatctcttctgatgtggggatggaaacagaggagatccatcatgacatcagaaaacctggcggcagcgcaaaagatg

SEQ ID NO: 94727 - DNA, 103 bp, Artificial Sequence
  Synthetic Polynucleotide
taatacgactcactatagggtcttctcttcagcttcaatctcttctgatgaacagaggagacatcagatgagattgaagaacctggcggcagcgcaaaagatg

SEQ ID NO: 94728 - DNA, 103 bp, Artificial Sequence
  Synthetic Polynucleotide
taatacgactcactatagggtggctgttcatcttctcttcagcttcaatcaacagaggagagattgaatgtgaagagaaaacctggcggcagcgcaaaagatg

SEQ ID NO: 94729 - DNA, 103 bp, Artificial Sequence
  Synthetic Polynucleotide
taatacgactcactatagggaccctgggcctggctgttcatcttctcttcaacagaggagagaagagatgatgaacagcaacctggcggcagcgcaaaagatg

SEQ ID NO: 94730 - DNA, 103 bp, Artificial Sequence
  Synthetic Polynucleotide
taatacgactcactataggggctgctcctgaccctgggcctggctgttcaaacagaggagatgaacaatgaggcccaggaacctggcggcagcgcaaaagatg

SEQ ID NO: 94731 - DNA, 103 bp, Artificial Sequence
  Synthetic Polynucleotide
taatacgactcactataggggagggctccagctgctcctgaccctgggccaacagaggagaggcccaatgtcaggagcaaacctggcggcagcgcaaaagatg

SEQ ID NO: 94732 - DNA, 103 bp, Artificial Sequence
  Synthetic Polynucleotide
taatacgactcactataggggatctcgtcgatcatgaaagtcttgtagcgaacagaggagacgctacatgactttcatgaacctggcggcagcgcaaaagatg

SEQ ID NO: 94733 - DNA, 103 bp, Artificial Sequence
  Synthetic Polynucleotide
taatacgactcactatagggctgcccctgagagggctccagctgctcctgaacagaggagacaggagatgctggagcccaacctggcggcagcgcaaaagatg

SEQ ID NO: 94734 - DNA, 103 bp, Artificial Sequence
  Synthetic Polynucleotide
taatacgactcactatagggagagctcctcctgcccctgagagggctccaaacagaggagatggagcatgctcaggggcaacctggcggcagcgcaaaagatg

SEQ ID NO: 94735 - DNA, 103 bp, Artificial Sequence
  Synthetic Polynucleotide
taatacgactcactatagggtgtgcttcacagagctcctcctgcccctgaaacagaggagatcagggatgggaggagctaacctggcggcagcgcaaaagatg

SEQ ID NO: 94736 - DNA, 103 bp, Artificial Sequence
  Synthetic Polynucleotide
taatacgactcactatagggtttcggttcctgtgcttcacagagctcctcaacagaggagagaggagatgtgtgaagcaaacctggcggcagcgcaaaagatg

SEQ ID NO: 94737 - DNA, 103 bp, Artificial Sequence
  Synthetic Polynucleotide
taatacgactcactatagggcatcacgtgctttcggttcctgtgcttcacaacagaggagagtgaagatgaggaaccgaaacctggcggcagcgcaaaagatg

SEQ ID NO: 94738 - DNA, 103 bp, Artificial Sequence
  Synthetic Polynucleotide
taatacgactcactatagggtctaaggggacatcacgtgctttcggttccaacagaggagaggaaccatgagcacgtgaaacctggcggcagcgcaaaagatg

SEQ ID NO: 94739 - DNA, 103 bp, Artificial Sequence
  Synthetic Polynucleotide
taatacgactcactatagggctctgccatctctaaggggacatcacgtgcaacagaggagagcacgtatggtccccttaaacctggcggcagcgcaaaagatg

SEQ ID NO: 94740 - DNA, 103 bp, Artificial Sequence
  Synthetic Polynucleotide
taatacgactcactatagggggtctggtggctctgccatctctaaggggaaacagaggagatcccctatgagatggcagaacctggcggcagcgcaaaagatg

SEQ ID NO: 94741 - DNA, 103 bp, Artificial Sequence
  Synthetic Polynucleotide
taatacgactcactatagggtcctggggcgggtctggtggctctgccatcaacagaggagagatggcatggccaccagaaacctggcggcagcgcaaaagatg

SEQ ID NO: 94742 - DNA, 103 bp, Artificial Sequence
  Synthetic Polynucleotide
taatacgactcactatagggtattggcaactcctggggcgggtctggtggaacagaggagaccaccaatgccgccccagaacctggcggcagcgcaaaagatg

SEQ ID NO: 94743 - DNA, 103 bp, Artificial Sequence
  Synthetic Polynucleotide
taatacgactcactatagggccttggagaggatctcgtcgatcatgaaagaacagaggagactttcaatgtcgacgagaaacctggcggcagcgcaaaagatg

SEQ ID NO: 94744 - DNA, 103 bp, Artificial Sequence
  Synthetic Polynucleotide
taatacgactcactatagggccgaagagggtattggcaactcctggggcgaacagaggagacgccccatgagttgccaaaacctggcggcagcgcaaaagatg

SEQ ID NO: 94745 - DNA, 103 bp, Artificial Sequence
  Synthetic Polynucleotide
taatacgactcactatagggggtgggggttccgaagagggtattggcaacaacagaggagagttgccatgaccctcttcaacctggcggcagcgcaaaagatg

SEQ ID NO: 94746 - DNA, 103 bp, Artificial Sequence
  Synthetic Polynucleotide
taatacgactcactatagggttagcttaatggtgggggttccgaagagggaacagaggagaccctctatggaacccccaaacctggcggcagcgcaaaagatg

SEQ ID NO: 94747 - DNA, 103 bp, Artificial Sequence
  Synthetic Polynucleotide
taatacgactcactatagggtcgcaggtctccttggagaggatctcgtcgaacagaggagacgacgaatgcctctccaaaacctggcggcagcgcaaaagatg

SEQ ID NO: 94748 - DNA, 103 bp, Artificial Sequence
  Synthetic Polynucleotide
taatacgactcactatagggcttcttcttcttgctgagcttgcctcccataacagaggagaatgggaatgaagctcagcaacctggcggcagcgcaaaagatg

SEQ ID NO: 94749 - DNA, 103 bp, Artificial Sequence
  Synthetic Polynucleotide
taatacgactcactatagggactctccttcggggtcccctcctcttccgtaacagaggagaacggaaatggaggggaccaacctggcggcagcgcaaaagatg

SEQ ID NO: 94750 - DNA, 103 bp, Artificial Sequence
  Synthetic Polynucleotide
taatacgactcactatagggcctggggctcactctccttcggggtcccctaacagaggagaaggggaatgcgaaggagaaacctggcggcagcgcaaaagatg

SEQ ID NO: 94751 - DNA, 103 bp, Artificial Sequence
  Synthetic Polynucleotide
taatacgactcactatagggtctgcggccgcctggggctcactctccttcaacagaggagagaaggaatgtgagccccaaacctggcggcagcgcaaaagatg

SEQ ID NO: 94752 - DNA, 103 bp, Artificial Sequence
  Synthetic Polynucleotide
taatacgactcactatagggctcggcgggctctgcggccgcctggggctcaacagaggagagagcccatggcggccgcaaacctggcggcagcgcaaaagatg

SEQ ID NO: 94753 - DNA, 103 bp, Artificial Sequence
  Synthetic Polynucleotide
taatacgactcactatagggcctccttggcctcggcgggctctgcggccgaacagaggagacggccgatgagcccgccgaacctggcggcagcgcaaaagatg

SEQ ID NO: 94754 - DNA, 103 bp, Artificial Sequence
  Synthetic Polynucleotide
taatacgactcactatagggttctccttgccctccttggcctcggcgggcaacagaggagagcccgcatgggccaaggaaacctggcggcagcgcaaaagatg

SEQ ID NO: 94755 - DNA, 103 bp, Artificial Sequence
  Synthetic Polynucleotide
taatacgactcactatagggctggtcgggcttctccttgccctccttggcaacagaggagagccaagatgggcaaggagaacctggcggcagcgcaaaagatg

SEQ ID NO: 94756 - DNA, 103 bp, Artificial Sequence
  Synthetic Polynucleotide
taatacgactcactatagggcctcggcgtcctggtcgggcttctccttgcaacagaggagagcaaggatgagcccgaccaacctggcggcagcgcaaaagatg

SEQ ID NO: 94757 - DNA, 103 bp, Artificial Sequence
  Synthetic Polynucleotide
taatacgactcactatagggtcggccttgccctcggcgtcctggtcgggcaacagaggagagcccgaatgggacgccgaaacctggcggcagcgcaaaagatg

SEQ ID NO: 94758 - DNA, 103 bp, Artificial Sequence
  Synthetic Polynucleotide
taatacgactcactatagggctccttctcctcggccttgccctcggcgtcaacagaggagagacgccatgggcaaggccaacctggcggcagcgcaaaagatg

SEQ ID NO: 94759 - DNA, 103 bp, Artificial Sequence
  Synthetic Polynucleotide
taatacgactcactatagggcattgtagcccttcttcttcttgctgagctaacagaggagaagctcaatgagaagaagaaacctggcggcagcgcaaaagatg

SEQ ID NO: 94760 - DNA, 103 bp, Artificial Sequence
  Synthetic Polynucleotide
taatacgactcactatagggccttctcgccctccttctcctcggccttgcaacagaggagagcaaggatgaggagaaggaacctggcggcagcgcaaaagatg

SEQ ID NO: 94761 - DNA, 103 bp, Artificial Sequence
  Synthetic Polynucleotide
taatacgactcactataggggccgccgcgtccttctcgccctccttctccaacagaggagaggagaaatggggcgagaaaacctggcggcagcgcaaaagatg

SEQ ID NO: 94762 - DNA, 103 bp, Artificial Sequence
  Synthetic Polynucleotide
taatacgactcactatagggctccttggcagccgccgcgtccttctcgccaacagaggagaggcgagatggacgcggcgaacctggcggcagcgcaaaagatg

SEQ ID NO: 94763 - DNA, 103 bp, Artificial Sequence
  Synthetic Polynucleotide
taatacgactcactatagggtcggggcctcctccttggcagccgccgcgtaacagaggagaacgcggatgctgccaaggaacctggcggcagcgcaaaagatg

SEQ ID NO: 94764 - DNA, 103 bp, Artificial Sequence
  Synthetic Polynucleotide
taatacgactcactatagggggctccgccttcggggcctcctccttggcaaacagaggagatgccaaatgggaggccccaacctggcggcagcgcaaaagatg

SEQ ID NO: 94765 - DNA, 103 bp, Artificial Sequence
  Synthetic Polynucleotide
taatacgactcactatagggcgtcttctcgggctccgccttcggggcctcaacagaggagagaggccatgaaggcggagaacctggcggcagcgcaaaagatg

SEQ ID NO: 94766 - DNA, 103 bp, Artificial Sequence
  Synthetic Polynucleotide
taatacgactcactatagggccgcgccctccgtcttctcgggctccgcctaacagaggagaaggcggatgccgagaagaaacctggcggcagcgcaaaagatg

SEQ ID NO: 94767 - DNA, 103 bp, Artificial Sequence
  Synthetic Polynucleotide
taatacgactcactatagggttggcctctgccgcgccctccgtcttctcgaacagaggagacgagaaatgggagggcgcaacctggcggcagcgcaaaagatg

SEQ ID NO: 94768 - DNA, 103 bp, Artificial Sequence
  Synthetic Polynucleotide
taatacgactcactataggggggctcagccttggcctctgccgcgccctcaacagaggagagagggcatggcagaggccaacctggcggcagcgcaaaagatg

SEQ ID NO: 94769 - DNA, 103 bp, Artificial Sequence
  Synthetic Polynucleotide
taatacgactcactataggggcgccttcgggggctcagccttggcctctgaacagaggagacagaggatgaggctgagcaacctggcggcagcgcaaaagatg

SEQ ID NO: 94770 - DNA, 103 bp, Artificial Sequence
  Synthetic Polynucleotide
taatacgactcactatagggtcgtcgttcacattgtagcccttcttcttcaacagaggagagaagaaatggggctacaaaacctggcggcagcgcaaaagatg

SEQ ID NO: 94771 - DNA, 103 bp, Artificial Sequence
  Synthetic Polynucleotide
taatacgactcactatagggtcctgctcgggcgccttcgggggctcagccaacagaggagaggctgaatgcccgaaggcaacctggcggcagcgcaaaagatg

SEQ ID NO: 94772 - DNA, 103 bp, Artificial Sequence
  Synthetic Polynucleotide
taatacgactcactatagggggccgcctgctcctgctcgggcgccttcggaacagaggagaccgaagatgcccgagcagaacctggcggcagcgcaaaagatg

SEQ ID NO: 94773 - DNA, 103 bp, Artificial Sequence
  Synthetic Polynucleotide
taatacgactcactatagggcggggccgggggccgcctgctcctgctcggaacagaggagaccgagcatgagcaggcggaacctggcggcagcgcaaaagatg

SEQ ID NO: 94774 - DNA, 103 bp, Artificial Sequence
  Synthetic Polynucleotide
taatacgactcactatagggccgcccgcagcggggccgggggccgcctgcaacagaggagagcaggcatgccccggcccaacctggcggcagcgcaaaagatg

SEQ ID NO: 94775 - DNA, 103 bp, Artificial Sequence
  Synthetic Polynucleotide
taatacgactcactataggggggggcctcgccgcccgcagcggggccgggaacagaggagacccggcatggctgcgggcaacctggcggcagcgcaaaagatg

SEQ ID NO: 94776 - DNA, 103 bp, Artificial Sequence
  Synthetic Polynucleotide
taatacgactcactatagggcagcagctttgggggcctcgccgcccgcagaacagaggagactgcggatggcgaggcccaacctggcggcagcgcaaaagatg

SEQ ID NO: 94777 - DNA, 103 bp, Artificial Sequence
  Synthetic Polynucleotide
taatacgactcactataggggcggcggcctcagcagctttgggggcctcgaacagaggagacgaggcatgcaaagctgcaacctggcggcagcgcaaaagatg

SEQ ID NO: 94778 - DNA, 103 bp, Artificial Sequence
  Synthetic Polynucleotide
taatacgactcactatagggggccggggccgcggcggcctcagcagctttaacagaggagaaaagctatggaggccgccaacctggcggcagcgcaaaagatg

SEQ ID NO: 94779 - DNA, 103 bp, Artificial Sequence
  Synthetic Polynucleotide
taatacgactcactatagggccgcgctctcggccggggccgcggcggcctaacagaggagaaggccgatgcggccccggaacctggcggcagcgcaaaagatg

SEQ ID NO: 94780 - DNA, 103 bp, Artificial Sequence
  Synthetic Polynucleotide
taatacgactcactataggggcggcaggggccgcgctctcggccggggccaacagaggagaggccccatgcgagagcgcaacctggcggcagcgcaaaagatg

SEQ ID NO: 94781 - DNA, 103 bp, Artificial Sequence
  Synthetic Polynucleotide
taatacgactcactatagggcttggctttctcgtcgttcacattgtagccaacagaggagaggctacatggtgaacgacaacctggcggcagcgcaaaagatg

SEQ ID NO: 94782 - DNA, 103 bp, Artificial Sequence
  Synthetic Polynucleotide
taatacgactcactatagggctcctccccggcggcaggggccgcgctctcaacagaggagagagagcatggcccctgccaacctggcggcagcgcaaaagatg

SEQ ID NO: 94783 - DNA, 103 bp, Artificial Sequence
  Synthetic Polynucleotide
taatacgactcactatagggccttgctgggctcctccccggcggcaggggaacagaggagacccctgatgccggggaggaacctggcggcagcgcaaaagatg

SEQ ID NO: 94784 - DNA, 103 bp, Artificial Sequence
  Synthetic Polynucleotide
taatacgactcactatagggtccccttcctccttgctgggctcctccccgaacagaggagacggggaatggcccagcaaaacctggcggcagcgcaaaagatg

SEQ ID NO: 94785 - DNA, 103 bp, Artificial Sequence
  Synthetic Polynucleotide
taatacgactcactatagggctttttgggttccccttcctccttgctgggaacagaggagacccagcatggaggaagggaacctggcggcagcgcaaaagatg

SEQ ID NO: 94786 - DNA, 103 bp, Artificial Sequence
  Synthetic Polynucleotide
taatacgactcactataggggcgcctcagtctttttgggttccccttcctaacagaggagaaggaagatgaacccaaaaaacctggcggcagcgcaaaagatg

SEQ ID NO: 94787 - DNA, 103 bp, Artificial Sequence
  Synthetic Polynucleotide
taatacgactcactatagggggagctgcgggcgcctcagtctttttgggtaacagaggagaacccaaatggactgaggcaacctggcggcagcgcaaaagatg

SEQ ID NO: 94788 - DNA, 103 bp, Artificial Sequence
  Synthetic Polynucleotide
taatacgactcactatagggctgggcggcaggagctgcgggcgcctcagtaacagaggagaactgagatgcccgcagctaacctggcggcagcgcaaaagatg

SEQ ID NO: 94789 - DNA, 103 bp, Artificial Sequence
  Synthetic Polynucleotide
taatacgactcactatagggttttggtctcctgggcggcaggagctgcggaacagaggagaccgcagatgctgccgcccaacctggcggcagcgcaaaagatg

SEQ ID NO: 94790 - DNA, 103 bp, Artificial Sequence
  Synthetic Polynucleotide
taatacgactcactataggggccccgtcacttttggtctcctgggcggcaaacagaggagatgccgcatgggagaccaaaacctggcggcagcgcaaaagatg

SEQ ID NO: 94791 - DNA, 103 bp, Artificial Sequence
  Synthetic Polynucleotide
taatacgactcactatagggtgaagctggggccccgtcacttttggtctcaacagaggagagagaccatgagtgacgggaacctggcggcagcgcaaaagatg

SEQ ID NO: 94792 - DNA, 103 bp, Artificial Sequence
  Synthetic Polynucleotide
taatacgactcactatagggtgtctttctccttggctttctcgtcgttcaaacagaggagatgaacgatgagaaagccaaacctggcggcagcgcaaaagatg

SEQ ID NO: 94793 - DNA, 103 bp, Artificial Sequence
  Synthetic Polynucleotide
taatacgactcactataggggttttgagtctgaagctggggccccgtcacaacagaggagagtgacgatgccccagcttaacctggcggcagcgcaaaagatg

SEQ ID NO: 94794 - DNA, 103 bp, Artificial Sequence
  Synthetic Polynucleotide
taatacgactcactataggggagctgccgggttttgagtctgaagctgggaacagaggagacccagcatgagactcaaaaacctggcggcagcgcaaaagatg

SEQ ID NO: 94795 - DNA, 103 bp, Artificial Sequence
  Synthetic Polynucleotide
taatacgactcactatagggggcagcctccgagctgccgggttttgagtcaacagaggagagactcaatgcccggcagcaacctggcggcagcgcaaaagatg

SEQ ID NO: 94796 - DNA, 103 bp, Artificial Sequence
  Synthetic Polynucleotide
taatacgactcactatagggtggaagagggggcagcctccgagctgccggaacagaggagaccggcaatgcggaggctgaacctggcggcagcgcaaaagatg

SEQ ID NO: 94797 - DNA, 103 bp, Artificial Sequence
  Synthetic Polynucleotide
taatacgactcactatagggggggtctccttggaagagggggcagcctccaacagaggagaggaggcatgcccctcttcaacctggcggcagcgcaaaagatg

SEQ ID NO: 94798 - DNA, 103 bp, Artificial Sequence
  Synthetic Polynucleotide
taatacgactcactatagggcgtggctgcgggggtctccttggaagagggaacagaggagaccctctatgaaggagaccaacctggcggcagcgcaaaagatg

SEQ ID NO: 94799 - DNA, 103 bp, Artificial Sequence
  Synthetic Polynucleotide
taatacgactcactatagggtaggcgcttccgtggctgcgggggtctcctaacagaggagaaggagaatgccgcagccaaacctggcggcagcgcaaaagatg

SEQ ID NO: 94800 - DNA, 103 bp, Artificial Sequence
  Synthetic Polynucleotide
taatacgactcactatagggggtgtggaactaggcgcttccgtggctgcgaacagaggagacgcagcatgggaagcgccaacctggcggcagcgcaaaagatg

SEQ ID NO: 94801 - DNA, 103 bp, Artificial Sequence
  Synthetic Polynucleotide
taatacgactcactatagggctgggccttgggtgtggaactaggcgcttcaacagaggagagaagcgatgagttccacaaacctggcggcagcgcaaaagatg

SEQ ID NO: 94802 - DNA, 103 bp, Artificial Sequence
  Synthetic Polynucleotide
taatacgactcactatagggctgcggggccctgggccttgggtgtggaacaacagaggagagttccaatgccaaggcccaacctggcggcagcgcaaaagatg

SEQ ID NO: 94803 - DNA, 103 bp, Artificial Sequence
  Synthetic Polynucleotide
taatacgactcactatagggtcggccttcttgtctttctccttggctttcaacagaggagagaaagcatgggagaaagaaacctggcggcagcgcaaaagatg

SEQ ID NO: 94804 - DNA, 103 bp, Artificial Sequence
  Synthetic Polynucleotide
taatacgactcactatagggtctgcagaggctgcggggccctgggccttgaacagaggagacaaggcatggggccccgcaacctggcggcagcgcaaaagatg

SEQ ID NO: 94805 - DNA, 103 bp, Artificial Sequence
  Synthetic Polynucleotide
taatacgactcactatagggcttgggctcttctgcagaggctgcggggccaacagaggagaggccccatggcctctgcaaacctggcggcagcgcaaaagatg

SEQ ID NO: 94806 - DNA, 103 bp, Artificial Sequence
  Synthetic Polynucleotide
taatacgactcactatagggcctccaccggcttgggctcttctgcagaggaacagaggagacctctgatgaagagcccaaacctggcggcagcgcaaaagatg

SEQ ID NO: 94807 - DNA, 103 bp, Artificial Sequence
  Synthetic Polynucleotide
taatacgactcactataggggctgccggggcctccaccggcttgggctctaacagaggagaagagccatggccggtggaaacctggcggcagcgcaaaagatg

SEQ ID NO: 94808 - DNA, 103 bp, Artificial Sequence
  Synthetic Polynucleotide
taatacgactcactataggggtcggaattagctgccggggcctccaccggaacagaggagaccggtgatggccccggcaaacctggcggcagcgcaaaagatg

SEQ ID NO: 94809 - DNA, 103 bp, Artificial Sequence
  Synthetic Polynucleotide
taatacgactcactatagggttacggtttggtcggaattagctgccggggaacagaggagaccccggatgctaattccgaacctggcggcagcgcaaaagatg

SEQ ID NO: 94810 - DNA, 103 bp, Artificial Sequence
  Synthetic Polynucleotide
taatacgactcactatagggtctttcacggttacggtttggtcggaattaaacagaggagataattcatgccaaaccgtaacctggcggcagcgcaaaagatg

SEQ ID NO: 94811 - DNA, 103 bp, Artificial Sequence
  Synthetic Polynucleotide
taatacgactcactatagggcgccgcgccctcggccttcttgtctttctcaacagaggagagagaaaatgaagaaggccaacctggcggcagcgcaaaagatg

SEQ ID NO: 94812 - DNA, 103 bp, Artificial Sequence
  Synthetic Polynucleotide
taatacgactcactatagggcctcttccgtcgccgcgccctcggccttctaacagaggagaagaaggatgagggcgcggaacctggcggcagcgcaaaagatg

SEQ ID NO: 94813 - DNA, 103 bp, Artificial Sequence
  Synthetic Polynucleotide
taatacgactcactatagggggggtcccctcctcttccgtcgccgcgcccaacagaggagagggcgcatggacggaagaaacctggcggcagcgcaaaagatg

SEQ ID NO: 94814 - DNA, 103 bp, Artificial Sequence
  Synthetic Polynucleotide
taatacgactcactatagggggagtcactgctgtcggagctgtgaggcataacagaggagaatgcctatgagctccgacaacctggcggcagcgcaaaagatg

SEQ ID NO: 94815 - DNA, 103 bp, Artificial Sequence
  Synthetic Polynucleotide
taatacgactcactatagggggcggcaatacgatttttctccctcctctgaacagaggagacagaggatggagaaaaataacctggcggcagcgcaaaagatg

SEQ ID NO: 94816 - DNA, 103 bp, Artificial Sequence
  Synthetic Polynucleotide
taatacgactcactatagggggctcttctgggcggcaatacgatttttctaacagaggagaagaaaaatggtattgccgaacctggcggcagcgcaaaagatg

SEQ ID NO: 94817 - DNA, 103 bp, Artificial Sequence
  Synthetic Polynucleotide
taatacgactcactatagggtgcctctgtcggctcttctgggcggcaataaacagaggagatattgcatgccagaagagaacctggcggcagcgcaaaagatg

SEQ ID NO: 94818 - DNA, 103 bp, Artificial Sequence
  Synthetic Polynucleotide
taatacgactcactatagggcttctgtgtctgcctctgtcggctcttctgaacagaggagacagaagatgcgacagaggaacctggcggcagcgcaaaagatg

SEQ ID NO: 94819 - DNA, 103 bp, Artificial Sequence
  Synthetic Polynucleotide
taatacgactcactataggggggtgtcggccttctgtgtctgcctctgtcaacagaggagagacagaatgagacacagaaacctggcggcagcgcaaaagatg

SEQ ID NO: 94820 - DNA, 103 bp, Artificial Sequence
  Synthetic Polynucleotide
taatacgactcactatagggtccaggtgcagggtgtcggccttctgtgtcaacagaggagagacacaatgggccgacacaacctggcggcagcgcaaaagatg

SEQ ID NO: 94821 - DNA, 103 bp, Artificial Sequence
  Synthetic Polynucleotide
taatacgactcactataggggtcttcgctctccaggtgcagggtgtcggcaacagaggagagccgacatgctgcacctgaacctggcggcagcgcaaaagatg

SEQ ID NO: 94822 - DNA, 103 bp, Artificial Sequence
  Synthetic Polynucleotide
taatacgactcactataggggtttctccaggtcttcgctctccaggtgcaaacagaggagatgcaccatgagagcgaagaacctggcggcagcgcaaaagatg

SEQ ID NO: 94823 - DNA, 103 bp, Artificial Sequence
  Synthetic Polynucleotide
taatacgactcactataggggccgcgttctgtttctccaggtcttcgctcaacagaggagagagcgaatgcctggagaaaacctggcggcagcgcaaaagatg

SEQ ID NO: 94824 - DNA, 103 bp, Artificial Sequence
  Synthetic Polynucleotide
taatacgactcactatagggcttgcgtagagccgcgttctgtttctccagaacagaggagactggagatgcagaacgcgaacctggcggcagcgcaaaagatg

SEQ ID NO: 94825 - DNA, 103 bp, Artificial Sequence
  Synthetic Polynucleotide
taatacgactcactatagggggctgaagctggagtcactgctgtcggagcaacagaggagagctccgatggcagtgactaacctggcggcagcgcaaaagatg

SEQ ID NO: 94826 - DNA, 103 bp, Artificial Sequence
  Synthetic Polynucleotide
taatacgactcactataggggcttgatctccttgcgtagagccgcgttctaacagaggagaagaacgatgctctacgcaaacctggcggcagcgcaaaagatg

SEQ ID NO: 94827 - DNA, 103 bp, Artificial Sequence
  Synthetic Polynucleotide
taatacgactcactatagggtctgtgagctgcttgatctccttgcgtagaaacagaggagatctacgatgggagatcaaaacctggcggcagcgcaaaagatg

SEQ ID NO: 94828 - DNA, 103 bp, Artificial Sequence
  Synthetic Polynucleotide
taatacgactcactatagggcttcagttcctctgtgagctgcttgatctcaacagaggagagagatcatgcagctcacaaacctggcggcagcgcaaaagatg

SEQ ID NO: 94829 - DNA, 103 bp, Artificial Sequence
  Synthetic Polynucleotide
taatacgactcactatagggacgtgaagtacttcagttcctctgtgagctaacagaggagaagctcaatgaggaactgaaacctggcggcagcgcaaaagatg

SEQ ID NO: 94830 - DNA, 103 bp, Artificial Sequence
  Synthetic Polynucleotide
taatacgactcactatagggttcagcaccgacgtgaagtacttcagttccaacagaggagaggaactatggtacttcacaacctggcggcagcgcaaaagatg

SEQ ID NO: 94831 - DNA, 103 bp, Artificial Sequence
  Synthetic Polynucleotide
taatacgactcactatagggctcgtggctgttcagcaccgacgtgaagtaaacagaggagatacttcatgtcggtgctgaacctggcggcagcgcaaaagatg

SEQ ID NO: 94832 - DNA, 103 bp, Artificial Sequence
  Synthetic Polynucleotide
taatacgactcactatagggagcacaggggctcgtggctgttcagcaccgaacagaggagacggtgcatgacagccacgaacctggcggcagcgcaaaagatg

SEQ ID NO: 94833 - DNA, 103 bp, Artificial Sequence
  Synthetic Polynucleotide
taatacgactcactataggggccagcaccgagcacaggggctcgtggctgaacagaggagacagccaatggcccctgtgaacctggcggcagcgcaaaagatg

SEQ ID NO: 94834 - DNA, 103 bp, Artificial Sequence
  Synthetic Polynucleotide
taatacgactcactatagggcgtgctggcggccagcaccgagcacaggggaacagaggagacccctgatgtcggtgctgaacctggcggcagcgcaaaagatg

SEQ ID NO: 94835 - DNA, 103 bp, Artificial Sequence
  Synthetic Polynucleotide
taatacgactcactatagggggggcgagggcgtgctggcggccagcaccgaacagaggagacggtgcatgccgccagcaaacctggcggcagcgcaaaagatg

SEQ ID NO: 94836 - DNA, 103 bp, Artificial Sequence
  Synthetic Polynucleotide
taatacgactcactatagggggaggagagcggctgaagctggagtcactgaacagaggagacagtgaatgcagcttcagaacctggcggcagcgcaaaagatg

SEQ ID NO: 94837 - DNA, 103 bp, Artificial Sequence
  Synthetic Polynucleotide
taatacgactcactatagggaccacctcggggggcgagggcgtgctggcgaacagaggagacgccagatggccctcgccaacctggcggcagcgcaaaagatg

SEQ ID NO: 94838 - DNA, 103 bp, Artificial Sequence
  Synthetic Polynucleotide
taatacgactcactatagggggcgctgtacaccacctcggggggcgagggaacagaggagaccctcgatgcccgaggtgaacctggcggcagcgcaaaagatg

SEQ ID NO: 94839 - DNA, 103 bp, Artificial Sequence
  Synthetic Polynucleotide
taatacgactcactatagggggaatgcgtgggcgctgtacaccacctcggaacagaggagaccgaggatgtgtacagcgaacctggcggcagcgcaaaagatg

SEQ ID NO: 94840 - DNA, 103 bp, Artificial Sequence
  Synthetic Polynucleotide
taatacgactcactatagggtgaggttggtggaatgcgtgggcgctgtacaacagaggagagtacagatgccacgcattaacctggcggcagcgcaaaagatg

SEQ ID NO: 94841 - DNA, 103 bp, Artificial Sequence
  Synthetic Polynucleotide
taatacgactcactatagggggagctgacatgaggttggtggaatgcgtgaacagaggagacacgcaatgcaccaacctaacctggcggcagcgcaaaagatg

SEQ ID NO: 94842 - DNA, 103 bp, Artificial Sequence
  Synthetic Polynucleotide
taatacgactcactatagggggaagcgcggggagctgacatgaggttggtaacagaggagaaccaacatgatgtcagctaacctggcggcagcgcaaaagatg

SEQ ID NO: 94843 - DNA, 103 bp, Artificial Sequence
  Synthetic Polynucleotide
taatacgactcactatagggtttgccagggggaggagagcggctgaagctaacagaggagaagcttcatgcgctctcctaacctggcggcagcgcaaaagatg

SEQ ID NO: 94844 - DNA, 103 bp, Artificial Sequence
  Synthetic Polynucleotide
taatacgactcactatagggatgagtcctgtttgccagggggaggagagcaacagaggagagctctcatgcccctggcaaacctggcggcagcgcaaaagatg

SEQ ID NO: 94845 - DNA, 103 bp, Artificial Sequence
  Synthetic Polynucleotide
taatacgactcactatagggacatcatcagatgagtcctgtttgccagggaacagaggagaccctggatgacaggactcaacctggcggcagcgcaaaagatg

SEQ ID NO: 94846 - DNA, 103 bp, Artificial Sequence
  Synthetic Polynucleotide
taatacgactcactatagggaactcttctcacatcatcagatgagtcctgaacagaggagacaggacatgtctgatgataacctggcggcagcgcaaaagatg

SEQ ID NO: 94847 - DNA, 103 bp, Artificial Sequence
  Synthetic Polynucleotide
taatacgactcactatagggccctcctctgaactcttctcacatcatcagaacagaggagactgatgatgtgagaagagaacctggcggcagcgcaaaagatg

SEQ ID NO: 94848 - DNA, 103 bp, Artificial Sequence
  Synthetic Polynucleotide
taatacgactcactatagggcgatttttctccctcctctgaactcttctcaacagaggagagagaagatgtcagaggagaacctggcggcagcgcaaaagatg

SEQ ID NO: 94849 - DNA, 103 bp, Artificial Sequence
  Synthetic Polynucleotide
taatacgactcactatagggcagcagcccattgcccccacagaggtgcataacagaggagaatgcacatgtgtgggggcaacctggcggcagcgcaaaagatg

SEQ ID NO: 94850 - DNA, 103 bp, Artificial Sequence
  Synthetic Polynucleotide
taatacgactcactataggggtctgtgtgcttctgccggcttcgctgggcaacagaggagagcccagatgagccggcagaacctggcggcagcgcaaaagatg

SEQ ID NO: 94851 - DNA, 103 bp, Artificial Sequence
  Synthetic Polynucleotide
taatacgactcactatagggcgtctgccttgtctgtgtgcttctgccggcaacagaggagagccggcatgagcacacagaacctggcggcagcgcaaaagatg

SEQ ID NO: 94852 - DNA, 103 bp, Artificial Sequence
  Synthetic Polynucleotide
taatacgactcactatagggtggtgcagggcgtctgccttgtctgtgtgcaacagaggagagcacacatgcaaggcagaaacctggcggcagcgcaaaagatg

SEQ ID NO: 94853 - DNA, 103 bp, Artificial Sequence
  Synthetic Polynucleotide
taatacgactcactatagggctcgtgctgctggtgcagggcgtctgccttaacagaggagaaaggcaatggccctgcacaacctggcggcagcgcaaaagatg

SEQ ID NO: 94854 - DNA, 103 bp, Artificial Sequence
  Synthetic Polynucleotide
taatacgactcactatagggtttccagagactcgtgctgctggtgcagggaacagaggagaccctgcatgagcagcacgaacctggcggcagcgcaaaagatg

SEQ ID NO: 94855 - DNA, 103 bp, Artificial Sequence
  Synthetic Polynucleotide
taatacgactcactatagggaggttgtctttttccagagactcgtgctgcaacagaggagagcagcaatggtctctggaaacctggcggcagcgcaaaagatg

SEQ ID NO: 94856 - DNA, 103 bp, Artificial Sequence
  Synthetic Polynucleotide
taatacgactcactatagggccgcagggcgaggttgtctttttccagagaaacagaggagatctctgatgaaagacaacaacctggcggcagcgcaaaagatg

SEQ ID NO: 94857 - DNA, 103 bp, Artificial Sequence
  Synthetic Polynucleotide
taatacgactcactatagggggatctccttccgcagggcgaggttgtcttaacagaggagaaagacaatgtcgccctgcaacctggcggcagcgcaaaagatg

SEQ ID NO: 94858 - DNA, 103 bp, Artificial Sequence
  Synthetic Polynucleotide
taatacgactcactatagggtgcagggactggatctccttccgcagggcgaacagaggagacgccctatggaaggagataacctggcggcagcgcaaaagatg

SEQ ID NO: 94859 - DNA, 103 bp, Artificial Sequence
  Synthetic Polynucleotide
taatacgactcactatagggcagctcggcctgcagggactggatctccttaacagaggagaaaggagatgcagtccctgaacctggcggcagcgcaaaagatg

SEQ ID NO: 94860 - DNA, 103 bp, Artificial Sequence
  Synthetic Polynucleotide
taatacgactcactatagggctgtctgggtcagcagcccattgcccccacaacagaggagagtggggatgatgggctgcaacctggcggcagcgcaaaagatg

SEQ ID NO: 94861 - DNA, 103 bp, Artificial Sequence
  Synthetic Polynucleotide
taatacgactcactatagggtccaccacgccagctcggcctgcagggactaacagaggagaagtcccatgaggccgagcaacctggcggcagcgcaaaagatg

SEQ ID NO: 94862 - DNA, 103 bp, Artificial Sequence
  Synthetic Polynucleotide
taatacgactcactatagggagggtccggctccaccacgccagctcggccaacagaggagaggccgaatgggcgtggtgaacctggcggcagcgcaaaagatg

SEQ ID NO: 94863 - DNA, 103 bp, Artificial Sequence
  Synthetic Polynucleotide
taatacgactcactatagggatgcacgtgcagggtccggctccaccacgcaacagaggagagcgtggatgagccggaccaacctggcggcagcgcaaaagatg

SEQ ID NO: 94864 - DNA, 103 bp, Artificial Sequence
  Synthetic Polynucleotide
taatacgactcactatagggacaggcgctcatgcacgtgcagggtccggcaacagaggagagccggaatgtgcacgtgcaacctggcggcagcgcaaaagatg

SEQ ID NO: 94865 - DNA, 103 bp, Artificial Sequence
  Synthetic Polynucleotide
taatacgactcactatagggtccatggggcacaggcgctcatgcacgtgcaacagaggagagcacgtatgtgagcgcctaacctggcggcagcgcaaaagatg

SEQ ID NO: 94866 - DNA, 103 bp, Artificial Sequence
  Synthetic Polynucleotide
taatacgactcactatagggggaggcacaatccatggggcacaggcgctcaacagaggagagagcgcatgtgccccatgaacctggcggcagcgcaaaagatg

SEQ ID NO: 94867 - DNA, 103 bp, Artificial Sequence
  Synthetic Polynucleotide
taatacgactcactataggggagctgagcaggaggcacaatccatggggcaacagaggagagccccaatgattgtgcctaacctggcggcagcgcaaaagatg

SEQ ID NO: 94868 - DNA, 103 bp, Artificial Sequence
  Synthetic Polynucleotide
taatacgactcactatagggaggagccctggagctgagcaggaggcacaaaacagaggagattgtgcatgctgctcagcaacctggcggcagcgcaaaagatg

SEQ ID NO: 94869 - DNA, 103 bp, Artificial Sequence
  Synthetic Polynucleotide
taatacgactcactatagggccagcagcccaggagccctggagctgagcaaacagaggagatgctcaatgccagggctcaacctggcggcagcgcaaaagatg

SEQ ID NO: 94870 - DNA, 103 bp, Artificial Sequence
  Synthetic Polynucleotide
taatacgactcactatagggcagcctggtcccagcagcccaggagccctgaacagaggagacagggcatgtgggctgctaacctggcggcagcgcaaaagatg

SEQ ID NO: 94871 - DNA, 103 bp, Artificial Sequence
  Synthetic Polynucleotide
taatacgactcactatagggtccttggggtctgtctgggtcagcagcccaaacagaggagatgggctatggacccagacaacctggcggcagcgcaaaagatg

SEQ ID NO: 94872 - DNA, 103 bp, Artificial Sequence
  Synthetic Polynucleotide
taatacgactcactatagggaggagcccctcagcctggtcccagcagcccaacagaggagagggctgatgggaccaggcaacctggcggcagcgcaaaagatg

SEQ ID NO: 94873 - DNA, 103 bp, Artificial Sequence
  Synthetic Polynucleotide
taatacgactcactataggggccagggcccaggagcccctcagcctggtcaacagaggagagaccagatggaggggctcaacctggcggcagcgcaaaagatg

SEQ ID NO: 94874 - DNA, 103 bp, Artificial Sequence
  Synthetic Polynucleotide
taatacgactcactataggggtccctgtgggccagggcccaggagcccctaacagaggagaaggggcatgtgggccctgaacctggcggcagcgcaaaagatg

SEQ ID NO: 94875 - DNA, 103 bp, Artificial Sequence
  Synthetic Polynucleotide
taatacgactcactatagggcagccatgttgtccctgtgggccagggcccaacagaggagagggcccatgcccacagggaacctggcggcagcgcaaaagatg

SEQ ID NO: 94876 - DNA, 103 bp, Artificial Sequence
  Synthetic Polynucleotide
taatacgactcactatagggctgctcccggcagccatgttgtccctgtggaacagaggagaccacagatgcaacatggcaacctggcggcagcgcaaaagatg

SEQ ID NO: 94877 - DNA, 103 bp, Artificial Sequence
  Synthetic Polynucleotide
taatacgactcactatagggacagctccagctgctcccggcagccatgttaacagaggagaaacatgatggccgggagcaacctggcggcagcgcaaaagatg

SEQ ID NO: 94878 - DNA, 103 bp, Artificial Sequence
  Synthetic Polynucleotide
taatacgactcactatagggggggtctggaacagctccagctgctcccggaacagaggagaccgggaatggctggagctaacctggcggcagcgcaaaagatg

SEQ ID NO: 94879 - DNA, 103 bp, Artificial Sequence
  Synthetic Polynucleotide
taatacgactcactatagggacaggaacccggggtctggaacagctccagaacagaggagactggagatgttccagaccaacctggcggcagcgcaaaagatg

SEQ ID NO: 94880 - DNA, 103 bp, Artificial Sequence
  Synthetic Polynucleotide
taatacgactcactataggggagctgggtaacaggaacccggggtctggaaacagaggagatccagaatgcgggttcctaacctggcggcagcgcaaaagatg

SEQ ID NO: 94881 - DNA, 103 bp, Artificial Sequence
  Synthetic Polynucleotide
taatacgactcactataggggagagcggctgagctgggtaacaggaacccaacagaggagagggttcatgttacccagcaacctggcggcagcgcaaaagatg

SEQ ID NO: 94882 - DNA, 103 bp, Artificial Sequence
  Synthetic Polynucleotide
taatacgactcactatagggcctttgttgctccttggggtctgtctgggtaacagaggagaacccagatggaccccaagaacctggcggcagcgcaaaagatg

SEQ ID NO: 94883 - DNA, 103 bp, Artificial Sequence
  Synthetic Polynucleotide
taatacgactcactatagggtggacctggagagagcggctgagctgggtaaacagaggagatacccaatgcagccgctcaacctggcggcagcgcaaaagatg

SEQ ID NO: 94884 - DNA, 103 bp, Artificial Sequence
  Synthetic Polynucleotide
taatacgactcactatagggcatgaggctgtggacctggagagagcggctaacagaggagaagccgcatgctccaggtcaacctggcggcagcgcaaaagatg

SEQ ID NO: 94885 - DNA, 103 bp, Artificial Sequence
  Synthetic Polynucleotide
taatacgactcactatagggctgggagaatcatgaggctgtggacctggaaacagaggagatccaggatgacagcctcaaacctggcggcagcgcaaaagatg

SEQ ID NO: 94886 - DNA, 103 bp, Artificial Sequence
  Synthetic Polynucleotide
taatacgactcactatagggctggaggaggctgggagaatcatgaggctgaacagaggagacagcctatggattctcccaacctggcggcagcgcaaaagatg

SEQ ID NO: 94887 - DNA, 103 bp, Artificial Sequence
  Synthetic Polynucleotide
taatacgactcactataggggcagggggcactggaggaggctgggagaataacagaggagaattctcatggcctcctccaacctggcggcagcgcaaaagatg

SEQ ID NO: 94888 - DNA, 103 bp, Artificial Sequence
  Synthetic Polynucleotide
taatacgactcactataggggacagtgagggcagggggcactggaggaggaacagaggagacctcctatggtgccccctaacctggcggcagcgcaaaagatg

SEQ ID NO: 94889 - DNA, 103 bp, Artificial Sequence
  Synthetic Polynucleotide
taatacgactcactatagggggggccaagggacagtgagggcagggggcaaacagaggagatgccccatgccctcactgaacctggcggcagcgcaaaagatg

SEQ ID NO: 94890 - DNA, 103 bp, Artificial Sequence
  Synthetic Polynucleotide
taatacgactcactatagggcaaccacagcggggccaagggacagtgaggaacagaggagacctcacatgcccttggccaacctggcggcagcgcaaaagatg

SEQ ID NO: 94891 - DNA, 103 bp, Artificial Sequence
  Synthetic Polynucleotide
taatacgactcactatagggggaggttcagcaaccacagcggggccaaggaacagaggagaccttggatgcgctgtggtaacctggcggcagcgcaaaagatg

SEQ ID NO: 94892 - DNA, 103 bp, Artificial Sequence
  Synthetic Polynucleotide
taatacgactcactatagggcagctggacaggaggttcagcaaccacagcaacagaggagagctgtgatggctgaacctaacctggcggcagcgcaaaagatg

SEQ ID NO: 94893 - DNA, 103 bp, Artificial Sequence
  Synthetic Polynucleotide
taatacgactcactatagggtcttcagctgcctttgttgctccttggggtaacagaggagaaccccaatgagcaacaaaaacctggcggcagcgcaaaagatg

SEQ ID NO: 94894 - DNA, 103 bp, Artificial Sequence
  Synthetic Polynucleotide
taatacgactcactatagggggctgggggacagctggacaggaggttcagaacagaggagactgaacatgctgtccagcaacctggcggcagcgcaaaagatg

SEQ ID NO: 94895 - DNA, 103 bp, Artificial Sequence
  Synthetic Polynucleotide
taatacgactcactatagggaacaggagagggctgggggacagctggacaaacagaggagatgtccaatggtcccccagaacctggcggcagcgcaaaagatg

SEQ ID NO: 94896 - DNA, 103 bp, Artificial Sequence
  Synthetic Polynucleotide
taatacgactcactataggggtgcgaggcaaacaggagagggctgggggaaacagaggagatcccccatgcctctcctgaacctggcggcagcgcaaaagatg

SEQ ID NO: 94897 - DNA, 103 bp, Artificial Sequence
  Synthetic Polynucleotide
taatacgactcactatagggtggaaccagtgtgcgaggcaaacaggagagaacagaggagactctccatgttgcctcgcaacctggcggcagcgcaaaagatg

SEQ ID NO: 94898 - DNA, 103 bp, Artificial Sequence
  Synthetic Polynucleotide
taatacgactcactatagggccctgcaggctggaaccagtgtgcgaggcaaacagaggagatgcctcatgcactggttcaacctggcggcagcgcaaaagatg

SEQ ID NO: 94899 - DNA, 103 bp, Artificial Sequence
  Synthetic Polynucleotide
taatacgactcactatagggagaggaagacccctgcaggctggaaccagtaacagaggagaactggtatgagcctgcagaacctggcggcagcgcaaaagatg

SEQ ID NO: 94900 - DNA, 103 bp, Artificial Sequence
  Synthetic Polynucleotide
taatacgactcactatagggcactgagcttagaggaagacccctgcaggcaacagaggagagcctgcatgggtcttcctaacctggcggcagcgcaaaagatg

SEQ ID NO: 94901 - DNA, 103 bp, Artificial Sequence
  Synthetic Polynucleotide
taatacgactcactatagggggctggagggcactgagcttagaggaagacaacagaggagagtcttcatgtaagctcagaacctggcggcagcgcaaaagatg

SEQ ID NO: 94902 - DNA, 103 bp, Artificial Sequence
  Synthetic Polynucleotide
taatacgactcactatagggcgtgaggctgggctggagggcactgagcttaacagaggagaaagctcatggccctccagaacctggcggcagcgcaaaagatg

SEQ ID NO: 94903 - DNA, 103 bp, Artificial Sequence
  Synthetic Polynucleotide
taatacgactcactatagggcagtttgggccgtgaggctgggctggagggaacagaggagaccctccatgccagcctcaaacctggcggcagcgcaaaagatg

SEQ ID NO: 94904 - DNA, 103 bp, Artificial Sequence
  Synthetic Polynucleotide
taatacgactcactatagggttcttctgcttcttcagctgcctttgttgcaacagaggagagcaacaatggcagctgaaaacctggcggcagcgcaaaagatg

SEQ ID NO: 94905 - DNA, 103 bp, Artificial Sequence
  Synthetic Polynucleotide
taatacgactcactatagggtgtggaggggcagtttgggccgtgaggctgaacagaggagacagcctatgggcccaaacaacctggcggcagcgcaaaagatg

SEQ ID NO: 94906 - DNA, 103 bp, Artificial Sequence
  Synthetic Polynucleotide
taatacgactcactatagggctcgaggggctgtggaggggcagtttgggcaacagaggagagcccaaatggcccctccaaacctggcggcagcgcaaaagatg

SEQ ID NO: 94907 - DNA, 103 bp, Artificial Sequence
  Synthetic Polynucleotide
taatacgactcactataggggatgctccagctcgaggggctgtggaggggaacagaggagacccctcatgagcccctcgaacctggcggcagcgcaaaagatg

SEQ ID NO: 94908 - DNA, 103 bp, Artificial Sequence
  Synthetic Polynucleotide
taatacgactcactatagggcctctggtgggatgctccagctcgaggggcaacagaggagagcccctatggctggagcaaacctggcggcagcgcaaaagatg

SEQ ID NO: 94909 - DNA, 103 bp, Artificial Sequence
  Synthetic Polynucleotide
taatacgactcactatagggccccagcttccctctggtgggatgctccagaacagaggagactggagatgcccaccagaaacctggcggcagcgcaaaagatg

SEQ ID NO: 94910 - DNA, 103 bp, Artificial Sequence
  Synthetic Polynucleotide
taatacgactcactatagggcgggagaggaccccagcttccctctggtggaacagaggagaccaccaatgggaagctggaacctggcggcagcgcaaaagatg

SEQ ID NO: 94911 - DNA, 103 bp, Artificial Sequence
  Synthetic Polynucleotide
taatacgactcactataggggaagggttgtcgggagaggaccccagcttcaacagaggagagaagctatggtcctctccaacctggcggcagcgcaaaagatg

SEQ ID NO: 94912 - DNA, 103 bp, Artificial Sequence
  Synthetic Polynucleotide
taatacgactcactatagggcagggcagaggaagggttgtcgggagaggaaacagaggagatcctctatggacaaccctaacctggcggcagcgcaaaagatg

SEQ ID NO: 94913 - DNA, 103 bp, Artificial Sequence
  Synthetic Polynucleotide
taatacgactcactataggggtgcaagccccagggcagaggaagggttgtaacagaggagaacaaccatgcctctgcccaacctggcggcagcgcaaaagatg

SEQ ID NO: 94914 - DNA, 103 bp, Artificial Sequence
  Synthetic Polynucleotide
taatacgactcactatagggctctgcagacgtgcaagccccagggcagagaacagaggagactctgcatgggggcttgcaacctggcggcagcgcaaaagatg

SEQ ID NO: 94915 - DNA, 103 bp, Artificial Sequence
  Synthetic Polynucleotide
taatacgactcactatagggggctgcccggttcttctgcttcttcagctgaacagaggagacagctgatgaagcagaagaacctggcggcagcgcaaaagatg

SEQ ID NO: 94916 - DNA, 103 bp, Artificial Sequence
  Synthetic Polynucleotide
taatacgactcactataggggtgctccctgctctgcagacgtgcaagcccaacagaggagagggcttatgcgtctgcagaacctggcggcagcgcaaaagatg

SEQ ID NO: 94917 - DNA, 103 bp, Artificial Sequence
  Synthetic Polynucleotide
taatacgactcactataggggagcaggtttgtgctccctgctctgcagacaacagaggagagtctgcatggcagggagcaacctggcggcagcgcaaaagatg

SEQ ID NO: 94918 - DNA, 103 bp, Artificial Sequence
  Synthetic Polynucleotide
taatacgactcactataggggctgctgagagagcaggtttgtgctccctgaacagaggagacagggaatgcaaacctgcaacctggcggcagcgcaaaagatg

SEQ ID NO: 94919 - DNA, 103 bp, Artificial Sequence
  Synthetic Polynucleotide
taatacgactcactatagggttgccaagtggctgctgagagagcaggtttaacagaggagaaaacctatgctctcagcaaacctggcggcagcgcaaaagatg

SEQ ID NO: 94920 - DNA, 103 bp, Artificial Sequence
  Synthetic Polynucleotide
taatacgactcactatagggcaaccagcccttgccaagtggctgctgagaaacagaggagatctcagatgccacttggcaacctggcggcagcgcaaaagatg

SEQ ID NO: 94921 - DNA, 103 bp, Artificial Sequence
  Synthetic Polynucleotide
taatacgactcactatagggctgggatccacaaccagcccttgccaagtgaacagaggagacacttgatgagggctggtaacctggcggcagcgcaaaagatg

SEQ ID NO: 94922 - DNA, 103 bp, Artificial Sequence
  Synthetic Polynucleotide
taatacgactcactatagggagggtgagggctgggatccacaaccagcccaacagaggagagggctgatggtggatcccaacctggcggcagcgcaaaagatg

SEQ ID NO: 94923 - DNA, 103 bp, Artificial Sequence
  Synthetic Polynucleotide
taatacgactcactatagggaggccaggagagggtgagggctgggatccaaacagaggagatggatcatggccctcaccaacctggcggcagcgcaaaagatg

SEQ ID NO: 94924 - DNA, 103 bp, Artificial Sequence
  Synthetic Polynucleotide
taatacgactcactatagggagcagaggaaaggccaggagagggtgagggaacagaggagaccctcaatgtctcctggcaacctggcggcagcgcaaaagatg

SEQ ID NO: 94925 - DNA, 103 bp, Artificial Sequence
  Synthetic Polynucleotide
taatacgactcactatagggagcagaggagagcagaggaaaggccaggagaacagaggagactcctgatgtttcctctgaacctggcggcagcgcaaaagatg

SEQ ID NO: 94926 - DNA, 103 bp, Artificial Sequence
  Synthetic Polynucleotide
taatacgactcactatagggttcgctgggcggctgcccggttcttctgctaacagaggagaagcagaatgaccgggcagaacctggcggcagcgcaaaagatg

SEQ ID NO: 94927 - DNA, 103 bp, Artificial Sequence
  Synthetic Polynucleotide
taatacgactcactatagggagtggacttgagcagaggagagcagaggaaaacagaggagattcctcatgtctcctctgaacctggcggcagcgcaaaagatg

SEQ ID NO: 94928 - DNA, 103 bp, Artificial Sequence
  Synthetic Polynucleotide
taatacgactcactatagggttctgccggcttcgctgggcggctgcccggaacagaggagaccgggcatgcgcccagcgaacctggcggcagcgcaaaagatg

SEQ ID NO: 94929 - DNA, 103 bp, Artificial Sequence
  Synthetic Polynucleotide
taatacgactcactataggggctgccggcggccgggagcccttgcgacataacagaggagaatgtcgatggggctcccgaacctggcggcagcgcaaaagatg

SEQ ID NO: 94930 - DNA, 103 bp, Artificial Sequence
  Synthetic Polynucleotide
taatacgactcactatagggtcggaccttcctgtcatcatcctcagggctaacagaggagaagccctatggatgatgacaacctggcggcagcgcaaaagatg

SEQ ID NO: 94931 - DNA, 103 bp, Artificial Sequence
  Synthetic Polynucleotide
taatacgactcactatagggtttctctccttcggaccttcctgtcatcataacagaggagaatgatgatgggaaggtccaacctggcggcagcgcaaaagatg

SEQ ID NO: 94932 - DNA, 103 bp, Artificial Sequence
  Synthetic Polynucleotide
taatacgactcactatagggactcggtttttttctctccttcggaccttcaacagaggagagaaggtatgaaggagagaaacctggcggcagcgcaaaagatg

SEQ ID NO: 94933 - DNA, 103 bp, Artificial Sequence
  Synthetic Polynucleotide
taatacgactcactatagggctgagcagcaactcggtttttttctctcctaacagaggagaaggagaatgaaaaaccgaaacctggcggcagcgcaaaagatg

SEQ ID NO: 94934 - DNA, 103 bp, Artificial Sequence
  Synthetic Polynucleotide
taatacgactcactatagggtccgacttctctgagcagcaactcggttttaacagaggagaaaaaccatgttgctgctcaacctggcggcagcgcaaaagatg

SEQ ID NO: 94935 - DNA, 103 bp, Artificial Sequence
  Synthetic Polynucleotide
taatacgactcactataggggtctgcttcttccgacttctctgagcagcaaacagaggagatgctgcatggagaagtcgaacctggcggcagcgcaaaagatg

SEQ ID NO: 94936 - DNA, 103 bp, Artificial Sequence
  Synthetic Polynucleotide
taatacgactcactatagggagccttctgggtctgcttcttccgacttctaacagaggagaagaagtatgaagaagcagaacctggcggcagcgcaaaagatg

SEQ ID NO: 94937 - DNA, 103 bp, Artificial Sequence
  Synthetic Polynucleotide
taatacgactcactatagggggagcttgtcagccttctgggtctgcttctaacagaggagaagaagcatgcccagaaggaacctggcggcagcgcaaaagatg

SEQ ID NO: 94938 - DNA, 103 bp, Artificial Sequence
  Synthetic Polynucleotide
taatacgactcactatagggtattcctcatggagcttgtcagccttctggaacagaggagaccagaaatgtgacaagctaacctggcggcagcgcaaaagatg

SEQ ID NO: 94939 - DNA, 103 bp, Artificial Sequence
  Synthetic Polynucleotide
taatacgactcactatagggcaggctctcatattcctcatggagcttgtcaacagaggagagacaagatgcatgaggaaaacctggcggcagcgcaaaagatg

SEQ ID NO: 94940 - DNA, 103 bp, Artificial Sequence
  Synthetic Polynucleotide
taatacgactcactatagggtctgcaggacgctgccggcggccgggagccaacagaggagaggctccatgccgccggcaaacctggcggcagcgcaaaagatg

SEQ ID NO: 94941 - DNA, 103 bp, Artificial Sequence
  Synthetic Polynucleotide
taatacgactcactatagggtttcttgctccaggctctcatattcctcataacagaggagaatgaggatgatgagagccaacctggcggcagcgcaaaagatg

SEQ ID NO: 94942 - DNA, 103 bp, Artificial Sequence
  Synthetic Polynucleotide
taatacgactcactatagggagcatggtgttttcttgctccaggctctcaaacagaggagatgagagatgggagcaagaaacctggcggcagcgcaaaagatg

SEQ ID NO: 94943 - DNA, 103 bp, Artificial Sequence
  Synthetic Polynucleotide
taatacgactcactatagggctctctccgcagcatggtgttttcttgctcaacagaggagagagcaaatgaacaccatgaacctggcggcagcgcaaaagatg

SEQ ID NO: 94944 - DNA, 103 bp, Artificial Sequence
  Synthetic Polynucleotide
taatacgactcactataggggcttcccgatctctctccgcagcatggtgtaacagaggagaacaccaatgtgcggagagaacctggcggcagcgcaaaagatg

SEQ ID NO: 94945 - DNA, 103 bp, Artificial Sequence
  Synthetic Polynucleotide
taatacgactcactatagggtcctctgtcagcttcccgatctctctccgcaacagaggagagcggagatggatcgggaaaacctggcggcagcgcaaaagatg

SEQ ID NO: 94946 - DNA, 103 bp, Artificial Sequence
  Synthetic Polynucleotide
taatacgactcactataggggtgcttcagctcctctgtcagcttcccgataacagaggagaatcgggatgctgacagagaacctggcggcagcgcaaaagatg

SEQ ID NO: 94947 - DNA, 103 bp, Artificial Sequence
  Synthetic Polynucleotide
taatacgactcactatagggcctctgtcaggtgcttcagctcctctgtcaaacagaggagatgacagatgagctgaagcaacctggcggcagcgcaaaagatg

SEQ ID NO: 94948 - DNA, 103 bp, Artificial Sequence
  Synthetic Polynucleotide
taatacgactcactatagggtccttcagtgcctctgtcaggtgcttcagcaacagaggagagctgaaatgcctgacagaaacctggcggcagcgcaaaagatg

SEQ ID NO: 94949 - DNA, 103 bp, Artificial Sequence
  Synthetic Polynucleotide
taatacgactcactatagggcttctcgtgctccttcagtgcctctgtcagaacagaggagactgacaatggcactgaagaacctggcggcagcgcaaaagatg

SEQ ID NO: 94950 - DNA, 103 bp, Artificial Sequence
  Synthetic Polynucleotide
taatacgactcactataggggcgggcacatcttctcgtgctccttcagtgaacagaggagacactgaatgagcacgagaaacctggcggcagcgcaaaagatg

SEQ ID NO: 94951 - DNA, 103 bp, Artificial Sequence
  Synthetic Polynucleotide
taatacgactcactataggggcgacgctcctctgcaggacgctgccggcgaacagaggagacgccggatgcgtcctgcaaacctggcggcagcgcaaaagatg

SEQ ID NO: 94952 - DNA, 103 bp, Artificial Sequence
  Synthetic Polynucleotide
taatacgactcactatagggcagagcagcagcgggcacatcttctcgtgcaacagaggagagcacgaatggatgtgcccaacctggcggcagcgcaaaagatg

SEQ ID NO: 94953 - DNA, 103 bp, Artificial Sequence
  Synthetic Polynucleotide
taatacgactcactataggggttcatagggcagagcagcagcgggcacataacagaggagaatgtgcatgctgctgctcaacctggcggcagcgcaaaagatg

SEQ ID NO: 94954 - DNA, 103 bp, Artificial Sequence
  Synthetic Polynucleotide
taatacgactcactatagggctggcacaaagttcatagggcagagcagcaaacagaggagatgctgcatggccctatgaaacctggcggcagcgcaaaagatg

SEQ ID NO: 94955 - DNA, 103 bp, Artificial Sequence
  Synthetic Polynucleotide
taatacgactcactatagggcggggaggcactggcacaaagttcatagggaacagaggagaccctatatgctttgtgccaacctggcggcagcgcaaaagatg

SEQ ID NO: 94956 - DNA, 103 bp, Artificial Sequence
  Synthetic Polynucleotide
taatacgactcactatagggagggtccggccggggaggcactggcacaaaaacagaggagatttgtgatggtgcctcccaacctggcggcagcgcaaaagatg

SEQ ID NO: 94957 - DNA, 103 bp, Artificial Sequence
  Synthetic Polynucleotide
taatacgactcactatagggagccggccacagggtccggccggggaggcaaacagaggagatgcctcatgggccggaccaacctggcggcagcgcaaaagatg

SEQ ID NO: 94958 - DNA, 103 bp, Artificial Sequence
  Synthetic Polynucleotide
taatacgactcactatagggcggggcaagcagccggccacagggtccggcaacagaggagagccggaatgtgtggccggaacctggcggcagcgcaaaagatg

SEQ ID NO: 94959 - DNA, 103 bp, Artificial Sequence
  Synthetic Polynucleotide
taatacgactcactatagggcccgggcgccgcgacgctcctctgcaggacaacagaggagagtcctgatgaggagcgtcaacctggcggcagcgcaaaagatg

SEQ ID NO: 94960 - DNA, 103 bp, Artificial Sequence
  Synthetic Polynucleotide
taatacgactcactataggggcggctggttcccgggcgccgcgacgctccaacagaggagaggagcgatgcggcgcccgaacctggcggcagcgcaaaagatg

SEQ ID NO: 94961 - DNA, 103 bp, Artificial Sequence
  Synthetic Polynucleotide
taatacgactcactatagggggctgcggctgcggctggttcccgggcgccaacagaggagaggcgccatggaaccagccaacctggcggcagcgcaaaagatg

SEQ ID NO: 94962 - DNA, 103 bp, Artificial Sequence
  Synthetic Polynucleotide
taatacgactcactatagggctgctgctgcggctgcggctgcggctggttaacagaggagaaaccagatgcagccgcagaacctggcggcagcgcaaaagatg

SEQ ID NO: 94963 - DNA, 103 bp, Artificial Sequence
  Synthetic Polynucleotide
taatacgactcactatagggcctcagggctctgctgctgcggctgcggctaacagaggagaagccgcatgcgcagcagcaacctggcggcagcgcaaaagatg

SEQ ID NO: 94964 - DNA, 103 bp, Artificial Sequence
  Synthetic Polynucleotide
taatacgactcactatagggctgtcatcatcctcagggctctgctgctgcaacagaggagagcagcaatggagccctgaaacctggcggcagcgcaaaagatg

SEQ ID NO: 94965 - DNA, 103 bp, Artificial Sequence
  Synthetic Polynucleotide
taatacgactcactataggggttaaaatggtcgtttgcctccatttccataacagaggagaatggaaatggaggcaaacaacctggcggcagcgcaaaagatg

SEQ ID NO: 94966 - DNA, 103 bp, Artificial Sequence
  Synthetic Polynucleotide
taatacgactcactatagggcatgggagacccgttagtgtagaggccctcaacagaggagagagggcatgtacactaacaacctggcggcagcgcaaaagatg

SEQ ID NO: 94967 - DNA, 103 bp, Artificial Sequence
  Synthetic Polynucleotide
taatacgactcactatagggaagggcagaaatcacagggctgtcctcaagaacagaggagacttgagatgagccctgtgaacctggcggcagcgcaaaagatg

SEQ ID NO: 94968 - DNA, 103 bp, Artificial Sequence
  Synthetic Polynucleotide
taatacgactcactatagggaagggcaatcaagggcagaaatcacagggcaacagaggagagccctgatgtttctgcccaacctggcggcagcgcaaaagatg

SEQ ID NO: 94969 - DNA, 103 bp, Artificial Sequence
  Synthetic Polynucleotide
taatacgactcactatagggttattgagggaagggcaatcaagggcagaaaacagaggagattctgcatgtgattgcccaacctggcggcagcgcaaaagatg

SEQ ID NO: 94970 - DNA, 103 bp, Artificial Sequence
  Synthetic Polynucleotide
taatacgactcactatagggggcagtagcattattgagggaagggcaatcaacagaggagagattgcatgtccctcaataacctggcggcagcgcaaaagatg

SEQ ID NO: 94971 - DNA, 103 bp, Artificial Sequence
  Synthetic Polynucleotide
taatacgactcactatagggggagactgaaggcagtagcattattgagggaacagaggagaccctcaatgatgctactgaacctggcggcagcgcaaaagatg

SEQ ID NO: 94972 - DNA, 103 bp, Artificial Sequence
  Synthetic Polynucleotide
taatacgactcactatagggtcatctgccaggagactgaaggcagtagcaaacagaggagatgctacatgcttcagtctaacctggcggcagcgcaaaagatg

SEQ ID NO: 94973 - DNA, 103 bp, Artificial Sequence
  Synthetic Polynucleotide
taatacgactcactatagggtgtttgactatcatctgccaggagactgaaaacagaggagattcagtatgctggcagataacctggcggcagcgcaaaagatg

SEQ ID NO: 94974 - DNA, 103 bp, Artificial Sequence
  Synthetic Polynucleotide
taatacgactcactatagggtagaggttgatgtttgactatcatctgccaaacagaggagatggcagatgatagtcaaaaacctggcggcagcgcaaaagatg

SEQ ID NO: 94975 - DNA, 103 bp, Artificial Sequence
  Synthetic Polynucleotide
taatacgactcactatagggctggcaaagatagaggttgatgtttgactaaacagaggagatagtcaatgatcaacctcaacctggcggcagcgcaaaagatg

SEQ ID NO: 94976 - DNA, 103 bp, Artificial Sequence
  Synthetic Polynucleotide
taatacgactcactatagggagaggtgggactggcaaagatagaggttgaaacagaggagatcaaccatgatctttgccaacctggcggcagcgcaaaagatg

SEQ ID NO: 94977 - DNA, 103 bp, Artificial Sequence
  Synthetic Polynucleotide
taatacgactcactataggggggggaagttcatgggagacccgttagtgtaacagaggagaacactaatgggtctcccaaacctggcggcagcgcaaaagatg

SEQ ID NO: 94978 - DNA, 103 bp, Artificial Sequence
  Synthetic Polynucleotide
taatacgactcactatagggggacaggtggagaggtgggactggcaaagaaacagaggagatctttgatggtcccacctaacctggcggcagcgcaaaagatg

SEQ ID NO: 94979 - DNA, 103 bp, Artificial Sequence
  Synthetic Polynucleotide
taatacgactcactataggggactcccctaggacaggtggagaggtgggaaacagaggagatcccacatgtccacctgtaacctggcggcagcgcaaaagatg

SEQ ID NO: 94980 - DNA, 103 bp, Artificial Sequence
  Synthetic Polynucleotide
taatacgactcactatagggttgcaggacagactcccctaggacaggtggaacagaggagaccacctatgctaggggagaacctggcggcagcgcaaaagatg

SEQ ID NO: 94981 - DNA, 103 bp, Artificial Sequence
  Synthetic Polynucleotide
taatacgactcactatagggagctgttatcttgcaggacagactcccctaaacagaggagataggggatgctgtcctgcaacctggcggcagcgcaaaagatg

SEQ ID NO: 94982 - DNA, 103 bp, Artificial Sequence
  Synthetic Polynucleotide
taatacgactcactatagggttcaggtcaaagctgttatcttgcaggacaaacagaggagatgtcctatgagataacagaacctggcggcagcgcaaaagatg

SEQ ID NO: 94983 - DNA, 103 bp, Artificial Sequence
  Synthetic Polynucleotide
taatacgactcactatagggactaccattattcaggtcaaagctgttatcaacagaggagagataacatgtttgacctgaacctggcggcagcgcaaaagatg

SEQ ID NO: 94984 - DNA, 103 bp, Artificial Sequence
  Synthetic Polynucleotide
taatacgactcactataggggttcagcgtcactaccattattcaggtcaaaacagaggagattgaccatgataatggtaaacctggcggcagcgcaaaagatg

SEQ ID NO: 94985 - DNA, 103 bp, Artificial Sequence
  Synthetic Polynucleotide
taatacgactcactatagggatttcttcctgttcagcgtcactaccattaaacagaggagataatggatgtgacgctgaaacctggcggcagcgcaaaagatg

SEQ ID NO: 94986 - DNA, 103 bp, Artificial Sequence
  Synthetic Polynucleotide
taatacgactcactatagggttgagtttccatttcttcctgttcagcgtcaacagaggagagacgctatgcaggaagaaaacctggcggcagcgcaaaagatg

SEQ ID NO: 94987 - DNA, 103 bp, Artificial Sequence
  Synthetic Polynucleotide
taatacgactcactatagggagtctgaagattgagtttccatttcttcctaacagaggagaaggaagatgtggaaactcaacctggcggcagcgcaaaagatg

SEQ ID NO: 94988 - DNA, 103 bp, Artificial Sequence
  Synthetic Polynucleotide
taatacgactcactatagggttcccttgctgggggaagttcatgggagacaacagaggagagtctccatggaacttcccaacctggcggcagcgcaaaagatg

SEQ ID NO: 94989 - DNA, 103 bp, Artificial Sequence
  Synthetic Polynucleotide
taatacgactcactataggggatggtgggaagtctgaagattgagtttccaacagaggagaggaaacatgatcttcagaaacctggcggcagcgcaaaagatg

SEQ ID NO: 94990 - DNA, 103 bp, Artificial Sequence
  Synthetic Polynucleotide
taatacgactcactatagggctgggtcagggatggtgggaagtctgaagaaacagaggagatcttcaatgttcccaccaaacctggcggcagcgcaaaagatg

SEQ ID NO: 94991 - DNA, 103 bp, Artificial Sequence
  Synthetic Polynucleotide
taatacgactcactatagggcaggagctggctgggtcagggatggtgggaaacagaggagatcccacatgccctgacccaacctggcggcagcgcaaaagatg

SEQ ID NO: 94992 - DNA, 103 bp, Artificial Sequence
  Synthetic Polynucleotide
taatacgactcactataggggatgactgatcaggagctggctgggtcaggaacagaggagacctgacatggccagctccaacctggcggcagcgcaaaagatg

SEQ ID NO: 94993 - DNA, 103 bp, Artificial Sequence
  Synthetic Polynucleotide
taatacgactcactatagggctgaatagtggatgactgatcaggagctggaacagaggagaccagctatggatcagtcaaacctggcggcagcgcaaaagatg

SEQ ID NO: 94994 - DNA, 103 bp, Artificial Sequence
  Synthetic Polynucleotide
taatacgactcactatagggctggatgtagctgaatagtggatgactgataacagaggagaatcagtatgccactattcaacctggcggcagcgcaaaagatg

SEQ ID NO: 94995 - DNA, 103 bp, Artificial Sequence
  Synthetic Polynucleotide
taatacgactcactatagggggtgaggttgctggatgtagctgaatagtgaacagaggagacactatatggctacatccaacctggcggcagcgcaaaagatg

SEQ ID NO: 94996 - DNA, 103 bp, Artificial Sequence
  Synthetic Polynucleotide
taatacgactcactatagggcgagactgctggtgaggttgctggatgtagaacagaggagactacatatggcaacctcaaacctggcggcagcgcaaaagatg

SEQ ID NO: 94997 - DNA, 103 bp, Artificial Sequence
  Synthetic Polynucleotide
taatacgactcactatagggaggttgttggcgagactgctggtgaggttgaacagaggagacaacctatgcagcagtctaacctggcggcagcgcaaaagatg

SEQ ID NO: 94998 - DNA, 103 bp, Artificial Sequence
  Synthetic Polynucleotide
taatacgactcactatagggactgctggggaggttgttggcgagactgctaacagaggagaagcagtatggccaacaacaacctggcggcagcgcaaaagatg

SEQ ID NO: 94999 - DNA, 103 bp, Artificial Sequence
  Synthetic Polynucleotide
taatacgactcactatagggattcaaacttttcccttgctgggggaagttaacagaggagaaacttcatgcagcaagggaacctggcggcagcgcaaaagatg

SEQ ID NO: 95000 - DNA, 103 bp, Artificial Sequence
  Synthetic Polynucleotide
taatacgactcactatagggcactagggagactgctggggaggttgttggaacagaggagaccaacaatgtccccagcaaacctggcggcagcgcaaaagatg

SEQ ID NO: 95001 - DNA, 103 bp, Artificial Sequence
  Synthetic Polynucleotide
taatacgactcactatagggctggagaaaccactagggagactgctggggaacagaggagaccccagatgtctccctagaacctggcggcagcgcaaaagatg

SEQ ID NO: 95002 - DNA, 103 bp, Artificial Sequence
  Synthetic Polynucleotide
taatacgactcactatagggggggaggctgctggagaaaccactagggagaacagaggagactccctatgggtttctccaacctggcggcagcgcaaaagatg

SEQ ID NO: 95003 - DNA, 103 bp, Artificial Sequence
  Synthetic Polynucleotide
taatacgactcactatagggagagatttctggggaggctgctggagaaacaacagaggagagtttctatggcagcctccaacctggcggcagcgcaaaagatg

SEQ ID NO: 95004 - DNA, 103 bp, Artificial Sequence
  Synthetic Polynucleotide
taatacgactcactatagggaaacttctggagagatttctggggaggctgaacagaggagacagcctatgcagaaatctaacctggcggcagcgcaaaagatg

SEQ ID NO: 95005 - DNA, 103 bp, Artificial Sequence
  Synthetic Polynucleotide
taatacgactcactataggggctgcgggacaaacttctggagagatttctaacagaggagaagaaatatgtccagaagtaacctggcggcagcgcaaaagatg

SEQ ID NO: 95006 - DNA, 103 bp, Artificial Sequence
  Synthetic Polynucleotide
taatacgactcactatagggaactgtagaagctgcgggacaaacttctggaacagaggagaccagaaatgtgtcccgcaaacctggcggcagcgcaaaagatg

SEQ ID NO: 95007 - DNA, 103 bp, Artificial Sequence
  Synthetic Polynucleotide
taatacgactcactatagggctggagagacaactgtagaagctgcgggacaacagaggagagtcccgatgcttctacagaacctggcggcagcgcaaaagatg

SEQ ID NO: 95008 - DNA, 103 bp, Artificial Sequence
  Synthetic Polynucleotide
taatacgactcactataggggagaagactgctggagagacaactgtagaaaacagaggagattctacatgtgtctctccaacctggcggcagcgcaaaagatg

SEQ ID NO: 95009 - DNA, 103 bp, Artificial Sequence
  Synthetic Polynucleotide
taatacgactcactatagggagagaccactgagaagactgctggagagacaacagaggagagtctctatggcagtcttcaacctggcggcagcgcaaaagatg

SEQ ID NO: 95010 - DNA, 103 bp, Artificial Sequence
  Synthetic Polynucleotide
taatacgactcactatagggtcacatccccattcaaacttttcccttgctaacagaggagaagcaagatgaaagtttgaaacctggcggcagcgcaaaagatg

SEQ ID NO: 95011 - DNA, 103 bp, Artificial Sequence
  Synthetic Polynucleotide
taatacgactcactatagggaggaagctggagagaccactgagaagactgaacagaggagacagtctatgcagtggtctaacctggcggcagcgcaaaagatg

SEQ ID NO: 95012 - DNA, 103 bp, Artificial Sequence
  Synthetic Polynucleotide
taatacgactcactatagggaggactgctgaggaagctggagagaccactaacagaggagaagtggtatgtccagcttcaacctggcggcagcgcaaaagatg

SEQ ID NO: 95013 - DNA, 103 bp, Artificial Sequence
  Synthetic Polynucleotide
taatacgactcactataggggactgctgggaggactgctgaggaagctggaacagaggagaccagctatgtcagcagtcaacctggcggcagcgcaaaagatg

SEQ ID NO: 95014 - DNA, 103 bp, Artificial Sequence
  Synthetic Polynucleotide
taatacgactcactatagggcttctaaggagactgctgggaggactgctgaacagaggagacagcagatgtcccagcagaacctggcggcagcgcaaaagatg

SEQ ID NO: 95015 - DNA, 103 bp, Artificial Sequence
  Synthetic Polynucleotide
taatacgactcactataggggtcaacgggacttctaaggagactgctgggaacagaggagacccagcatgctccttagaaacctggcggcagcgcaaaagatg

SEQ ID NO: 95016 - DNA, 103 bp, Artificial Sequence
  Synthetic Polynucleotide
taatacgactcactatagggcactgaagccgtcaacgggacttctaaggaaacagaggagatccttaatggtcccgttgaacctggcggcagcgcaaaagatg

SEQ ID NO: 95017 - DNA, 103 bp, Artificial Sequence
  Synthetic Polynucleotide
taatacgactcactatagggttggggatgtcactgaagccgtcaacgggaaacagaggagatcccgtatgcggcttcagaacctggcggcagcgcaaaagatg

SEQ ID NO: 95018 - DNA, 103 bp, Artificial Sequence
  Synthetic Polynucleotide
taatacgactcactatagggggagaggcttttggggatgtcactgaagccaacagaggagaggcttcatggacatccccaacctggcggcagcgcaaaagatg

SEQ ID NO: 95019 - DNA, 103 bp, Artificial Sequence
  Synthetic Polynucleotide
taatacgactcactatagggggaagttacgggagaggcttttggggatgtaacagaggagaacatccatgaaagcctctaacctggcggcagcgcaaaagatg

SEQ ID NO: 95020 - DNA, 103 bp, Artificial Sequence
  Synthetic Polynucleotide
taatacgactcactatagggcagctgctggggaagttacgggagaggcttaacagaggagaaagcctatgccgtaacttaacctggcggcagcgcaaaagatg

SEQ ID NO: 95021 - DNA, 103 bp, Artificial Sequence
  Synthetic Polynucleotide
taatacgactcactatagggccattaacattcacatccccattcaaacttaacagaggagaaagtttatgtggggatgtaacctggcggcagcgcaaaagatg

SEQ ID NO: 95022 - DNA, 103 bp, Artificial Sequence
  Synthetic Polynucleotide
taatacgactcactataggggttggaaaggcagctgctggggaagttacgaacagaggagacgtaacatgcccagcagcaacctggcggcagcgcaaaagatg

SEQ ID NO: 95023 - DNA, 103 bp, Artificial Sequence
  Synthetic Polynucleotide
taatacgactcactatagggtggggaggctgttggaaaggcagctgctggaacagaggagaccagcaatggcctttccaaacctggcggcagcgcaaaagatg

SEQ ID NO: 95024 - DNA, 103 bp, Artificial Sequence
  Synthetic Polynucleotide
taatacgactcactatagggccttatttgctggggaggctgttggaaaggaacagaggagacctttcatgcagcctcccaacctggcggcagcgcaaaagatg

SEQ ID NO: 95025 - DNA, 103 bp, Artificial Sequence
  Synthetic Polynucleotide
taatacgactcactatagggctgctgacatccttatttgctggggaggctaacagaggagaagcctcatgagcaaataaaacctggcggcagcgcaaaagatg

SEQ ID NO: 95026 - DNA, 103 bp, Artificial Sequence
  Synthetic Polynucleotide
taatacgactcactatagggttctagaaagctgctgacatccttatttgcaacagaggagagcaaatatggatgtcagcaacctggcggcagcgcaaaagatg

SEQ ID NO: 95027 - DNA, 103 bp, Artificial Sequence
  Synthetic Polynucleotide
taatacgactcactatagggcagcagtggtttctagaaagctgctgacataacagaggagaatgtcaatggctttctagaacctggcggcagcgcaaaagatg

SEQ ID NO: 95028 - DNA, 103 bp, Artificial Sequence
  Synthetic Polynucleotide
taatacgactcactatagggtcttccacgtcagcagtggtttctagaaagaacagaggagactttctatgaaccactgcaacctggcggcagcgcaaaagatg

SEQ ID NO: 95029 - DNA, 103 bp, Artificial Sequence
  Synthetic Polynucleotide
taatacgactcactatagggtccagtgatctcttccacgtcagcagtggtaacagaggagaaccactatggacgtggaaaacctggcggcagcgcaaaagatg

SEQ ID NO: 95030 - DNA, 103 bp, Artificial Sequence
  Synthetic Polynucleotide
taatacgactcactatagggtgagtccttctccagtgatctcttccacgtaacagaggagaacgtggatgagatcactgaacctggcggcagcgcaaaagatg

SEQ ID NO: 95031 - DNA, 103 bp, Artificial Sequence
  Synthetic Polynucleotide
taatacgactcactatagggccagaagcagtgagtccttctccagtgatcaacagaggagagatcacatgagaaggactaacctggcggcagcgcaaaagatg

SEQ ID NO: 95032 - DNA, 103 bp, Artificial Sequence
  Synthetic Polynucleotide
taatacgactcactatagggagtagataagccattaacattcacatccccaacagaggagaggggatatgaatgttaataacctggcggcagcgcaaaagatg

SEQ ID NO: 95033 - DNA, 103 bp, Artificial Sequence
  Synthetic Polynucleotide
taatacgactcactatagggatcaccactaccagaagcagtgagtccttcaacagaggagagaaggaatgactgcttctaacctggcggcagcgcaaaagatg

SEQ ID NO: 95034 - DNA, 103 bp, Artificial Sequence
  Synthetic Polynucleotide
taatacgactcactatagggtcctcatgacatcaccactaccagaagcagaacagaggagactgcttatggtagtggtgaacctggcggcagcgcaaaagatg

SEQ ID NO: 95035 - DNA, 103 bp, Artificial Sequence
  Synthetic Polynucleotide
taatacgactcactataggggcaatacgtctcctcatgacatcaccactaaacagaggagatagtggatgtgtcatgagaacctggcggcagcgcaaaagatg

SEQ ID NO: 95036 - DNA, 103 bp, Artificial Sequence
  Synthetic Polynucleotide
taatacgactcactatagggttctggggtagcaatacgtctcctcatgacaacagaggagagtcatgatgagacgtattaacctggcggcagcgcaaaagatg

SEQ ID NO: 95037 - DNA, 103 bp, Artificial Sequence
  Synthetic Polynucleotide
taatacgactcactataggggacgaacttcttctggggtagcaatacgtcaacagaggagagacgtaatgctaccccagaacctggcggcagcgcaaaagatg

SEQ ID NO: 95038 - DNA, 103 bp, Artificial Sequence
  Synthetic Polynucleotide
taatacgactcactatagggtggaggggaagacgaacttcttctggggtaaacagaggagataccccatgagaagttcgaacctggcggcagcgcaaaagatg

SEQ ID NO: 95039 - DNA, 103 bp, Artificial Sequence
  Synthetic Polynucleotide
taatacgactcactatagggccacccatgttggaggggaagacgaacttcaacagaggagagaagttatgcttcccctcaacctggcggcagcgcaaaagatg

SEQ ID NO: 95040 - DNA, 103 bp, Artificial Sequence
  Synthetic Polynucleotide
taatacgactcactatagggcctctctccgccacccatgttggaggggaaaacagaggagattccccatgaacatgggtaacctggcggcagcgcaaaagatg

SEQ ID NO: 95041 - DNA, 103 bp, Artificial Sequence
  Synthetic Polynucleotide
taatacgactcactatagggttgatgcgcacctctctccgccacccatgtaacagaggagaacatggatggcggagagaaacctggcggcagcgcaaaagatg

SEQ ID NO: 95042 - DNA, 103 bp, Artificial Sequence
  Synthetic Polynucleotide
taatacgactcactataggggctgcccttcttgatgcgcacctctctccgaacagaggagacggagaatggtgcgcatcaacctggcggcagcgcaaaagatg

SEQ ID NO: 95043 - DNA, 103 bp, Artificial Sequence
  Synthetic Polynucleotide
taatacgactcactatagggtgtgagatacagtagataagccattaacataacagaggagaatgttaatggcttatctaaacctggcggcagcgcaaaagatg

SEQ ID NO: 95044 - DNA, 103 bp, Artificial Sequence
  Synthetic Polynucleotide
taatacgactcactataggggccatcggtggctgcccttcttgatgcgcaaacagaggagatgcgcaatgagaagggcaaacctggcggcagcgcaaaagatg

SEQ ID NO: 95045 - DNA, 103 bp, Artificial Sequence
  Synthetic Polynucleotide
taatacgactcactataggggtctccccctgccatcggtggctgcccttcaacagaggagagaagggatgccaccgatgaacctggcggcagcgcaaaagatg

SEQ ID NO: 95046 - DNA, 103 bp, Artificial Sequence
  Synthetic Polynucleotide
taatacgactcactatagggataataccaggtctccccctgccatcggtgaacagaggagacaccgaatgcagggggagaacctggcggcagcgcaaaagatg

SEQ ID NO: 95047 - DNA, 103 bp, Artificial Sequence
  Synthetic Polynucleotide
taatacgactcactatagggcacaggggccataataccaggtctccccctaacagaggagaagggggatgcctggtattaacctggcggcagcgcaaaagatg

SEQ ID NO: 95048 - DNA, 103 bp, Artificial Sequence
  Synthetic Polynucleotide
taatacgactcactatagggatcctcttcccacaggggccataataccagaacagaggagactggtaatgtggcccctgaacctggcggcagcgcaaaagatg

SEQ ID NO: 95049 - DNA, 103 bp, Artificial Sequence
  Synthetic Polynucleotide
taatacgactcactatagggaaattgcttcatcctcttcccacaggggccaacagaggagaggccccatggggaagaggaacctggcggcagcgcaaaagatg

SEQ ID NO: 95050 - DNA, 103 bp, Artificial Sequence
  Synthetic Polynucleotide
taatacgactcactatagggtcacttctggaaattgcttcatcctcttccaacagaggagaggaagaatgtgaagcaataacctggcggcagcgcaaaagatg

SEQ ID NO: 95051 - DNA, 103 bp, Artificial Sequence
  Synthetic Polynucleotide
taatacgactcactatagggaggtacttgatcacttctggaaattgcttcaacagaggagagaagcaatgtccagaagtaacctggcggcagcgcaaaagatg

SEQ ID NO: 95052 - DNA, 103 bp, Artificial Sequence
  Synthetic Polynucleotide
taatacgactcactataggggttgcggctcaggtacttgatcacttctggaacagaggagaccagaaatgatcaagtacaacctggcggcagcgcaaaagatg

SEQ ID NO: 95053 - DNA, 103 bp, Artificial Sequence
  Synthetic Polynucleotide
taatacgactcactatagggtgtgtaccacgttgcggctcaggtacttgaaacagaggagatcaagtatgtgagccgcaaacctggcggcagcgcaaaagatg

SEQ ID NO: 95054 - DNA, 103 bp, Artificial Sequence
  Synthetic Polynucleotide
taatacgactcactataggggaagtagtagtgtgagatacagtagataagaacagaggagacttatcatgtgtatctcaaacctggcggcagcgcaaaagatg

SEQ ID NO: 95055 - DNA, 103 bp, Artificial Sequence
  Synthetic Polynucleotide
taatacgactcactatagggcggcggacactgtgtaccacgttgcggctcaacagaggagagagccgatgcgtggtacaaacctggcggcagcgcaaaagatg

SEQ ID NO: 95056 - DNA, 103 bp, Artificial Sequence
  Synthetic Polynucleotide
taatacgactcactataggggaagtgctctcggcggacactgtgtaccacaacagaggagagtggtaatgagtgtccgcaacctggcggcagcgcaaaagatg

SEQ ID NO: 95057 - DNA, 103 bp, Artificial Sequence
  Synthetic Polynucleotide
taatacgactcactataggggactgaagctgaagtgctctcggcggacacaacagaggagagtgtccatggagagcactaacctggcggcagcgcaaaagatg

SEQ ID NO: 95058 - DNA, 103 bp, Artificial Sequence
  Synthetic Polynucleotide
taatacgactcactatagggggcatacggggactgaagctgaagtgctctaacagaggagaagagcaatgcagcttcagaacctggcggcagcgcaaaagatg

SEQ ID NO: 95059 - DNA, 103 bp, Artificial Sequence
  Synthetic Polynucleotide
taatacgactcactatagggatctccaacaggcatacggggactgaagctaacagaggagaagcttcatgccccgtatgaacctggcggcagcgcaaaagatg

SEQ ID NO: 95060 - DNA, 103 bp, Artificial Sequence
  Synthetic Polynucleotide
taatacgactcactatagggcttcaaagaaatctccaacaggcatacgggaacagaggagacccgtaatgctgttggagaacctggcggcagcgcaaaagatg

SEQ ID NO: 95061 - DNA, 103 bp, Artificial Sequence
  Synthetic Polynucleotide
taatacgactcactataggggtgtctctttcttcaaagaaatctccaacaaacagaggagatgttggatgtttctttgaaacctggcggcagcgcaaaagatg

SEQ ID NO: 95062 - DNA, 103 bp, Artificial Sequence
  Synthetic Polynucleotide
taatacgactcactataggggccctctggcgtgtctctttcttcaaagaaaacagaggagattctttatggaaagagacaacctggcggcagcgcaaaagatg

SEQ ID NO: 95063 - DNA, 103 bp, Artificial Sequence
  Synthetic Polynucleotide
taatacgactcactatagggcccactgcaagccctctggcgtgtctctttaacagaggagaaaagagatgcgccagaggaacctggcggcagcgcaaaagatg

SEQ ID NO: 95064 - DNA, 103 bp, Artificial Sequence
  Synthetic Polynucleotide
taatacgactcactataggggagagctgcacccactgcaagccctctggcaacagaggagagccagaatgcttgcagtgaacctggcggcagcgcaaaagatg

SEQ ID NO: 95065 - DNA, 103 bp, Artificial Sequence
  Synthetic Polynucleotide
taatacgactcactatagggcaaaatccctgaagtagtagtgtgagatacaacagaggagagtatctatgactactactaacctggcggcagcgcaaaagatg

SEQ ID NO: 95066 - DNA, 103 bp, Artificial Sequence
  Synthetic Polynucleotide
taatacgactcactatagggctcctctgctgagagctgcacccactgcaaaacagaggagattgcagatggtgcagctcaacctggcggcagcgcaaaagatg

SEQ ID NO: 95067 - DNA, 103 bp, Artificial Sequence
  Synthetic Polynucleotide
taatacgactcactatagggtcgacgggatctcctctgctgagagctgcaaacagaggagatgcagcatgcagcagaggaacctggcggcagcgcaaaagatg

SEQ ID NO: 95068 - DNA, 103 bp, Artificial Sequence
  Synthetic Polynucleotide
taatacgactcactataggggcctgaatcctcgacgggatctcctctgctaacagaggagaagcagaatggatcccgtcaacctggcggcagcgcaaaagatg

SEQ ID NO: 95069 - DNA, 103 bp, Artificial Sequence
  Synthetic Polynucleotide
taatacgactcactataggggccagtaattgcctgaatcctcgacgggataacagaggagaatcccgatgaggattcagaacctggcggcagcgcaaaagatg

SEQ ID NO: 95070 - DNA, 103 bp, Artificial Sequence
  Synthetic Polynucleotide
taatacgactcactataggggaccccgtttgccagtaattgcctgaatccaacagaggagaggattcatgcaattactgaacctggcggcagcgcaaaagatg

SEQ ID NO: 95071 - DNA, 103 bp, Artificial Sequence
  Synthetic Polynucleotide
taatacgactcactatagggtttcgaggtcgaccccgtttgccagtaattaacagaggagaaattacatgcaaacggggaacctggcggcagcgcaaaagatg

SEQ ID NO: 95072 - DNA, 103 bp, Artificial Sequence
  Synthetic Polynucleotide
taatacgactcactatagggcttctcagtgtttcgaggtcgaccccgtttaacagaggagaaaacggatgcgacctcgaaacctggcggcagcgcaaaagatg

SEQ ID NO: 95073 - DNA, 103 bp, Artificial Sequence
  Synthetic Polynucleotide
taatacgactcactatagggtagtcttagccttctcagtgtttcgaggtcaacagaggagagacctcatgacactgagaaacctggcggcagcgcaaaagatg

SEQ ID NO: 95074 - DNA, 103 bp, Artificial Sequence
  Synthetic Polynucleotide
taatacgactcactataggggggacttccttagtcttagccttctcagtgaacagaggagacactgaatgggctaagacaacctggcggcagcgcaaaagatg

SEQ ID NO: 95075 - DNA, 103 bp, Artificial Sequence
  Synthetic Polynucleotide
taatacgactcactatagggtttcaccttggggacttccttagtcttagcaacagaggagagctaagatgaaggaagtcaacctggcggcagcgcaaaagatg

SEQ ID NO: 95076 - DNA, 103 bp, Artificial Sequence
  Synthetic Polynucleotide
taatacgactcactatagggggccagtaaagttaaaatggtcgtttgcctaacagaggagaaggcaaatgaccattttaaacctggcggcagcgcaaaagatg

SEQ ID NO: 95077 - DNA, 103 bp, Artificial Sequence
  Synthetic Polynucleotide
taatacgactcactataggggagcagagttcaaaatccctgaagtagtagaacagaggagactactaatgcagggatttaacctggcggcagcgcaaaagatg

SEQ ID NO: 95078 - DNA, 103 bp, Artificial Sequence
  Synthetic Polynucleotide
taatacgactcactatagggctcgaccccgtttcaccttggggacttcctaacagaggagaaggaagatgccaaggtgaaacctggcggcagcgcaaaagatg

SEQ ID NO: 95079 - DNA, 103 bp, Artificial Sequence
  Synthetic Polynucleotide
taatacgactcactatagggggtggccgacctcgaccccgtttcaccttgaacagaggagacaaggtatgacggggtcgaacctggcggcagcgcaaaagatg

SEQ ID NO: 95080 - DNA, 103 bp, Artificial Sequence
  Synthetic Polynucleotide
taatacgactcactatagggtttgaccttaggtggccgacctcgaccccgaacagaggagacggggtatgggtcggccaaacctggcggcagcgcaaaagatg

SEQ ID NO: 95081 - DNA, 103 bp, Artificial Sequence
  Synthetic Polynucleotide
taatacgactcactataggggctcagtgattttgaccttaggtggccgacaacagaggagagtcggcatgctaaggtcaaacctggcggcagcgcaaaagatg

SEQ ID NO: 95082 - DNA, 103 bp, Artificial Sequence
  Synthetic Polynucleotide
taatacgactcactatagggttgttcaatagctcagtgattttgaccttaaacagaggagataaggtatgaatcactgaaacctggcggcagcgcaaaagatg

SEQ ID NO: 95083 - DNA, 103 bp, Artificial Sequence
  Synthetic Polynucleotide
taatacgactcactataggggttgtctgtcttgttcaatagctcagtgataacagaggagaatcactatgctattgaacaacctggcggcagcgcaaaagatg

SEQ ID NO: 95084 - DNA, 103 bp, Artificial Sequence
  Synthetic Polynucleotide
taatacgactcactatagggttagggggcggttgtctgtcttgttcaataaacagaggagatattgaatgagacagacaaacctggcggcagcgcaaaagatg

SEQ ID NO: 95085 - DNA, 103 bp, Artificial Sequence
  Synthetic Polynucleotide
taatacgactcactatagggtccagtttctttagggggcggttgtctgtcaacagaggagagacagaatgccgccccctaacctggcggcagcgcaaaagatg

SEQ ID NO: 95086 - DNA, 103 bp, Artificial Sequence
  Synthetic Polynucleotide
taatacgactcactatagggttcttgggcctccagtttctttagggggcgaacagaggagacgccccatgaagaaactgaacctggcggcagcgcaaaagatg

SEQ ID NO: 95087 - DNA, 103 bp, Artificial Sequence
  Synthetic Polynucleotide
taatacgactcactatagggcattcaatgtttcttgggcctccagtttctaacagaggagaagaaacatgaggcccaagaacctggcggcagcgcaaaagatg

SEQ ID NO: 95088 - DNA, 103 bp, Artificial Sequence
  Synthetic Polynucleotide
taatacgactcactataggggaggagtggggagcagagttcaaaatccctaacagaggagaagggatatggaactctgcaacctggcggcagcgcaaaagatg

SEQ ID NO: 95089 - DNA, 103 bp, Artificial Sequence
  Synthetic Polynucleotide
taatacgactcactatagggttatcctcctcattcaatgtttcttgggccaacagaggagaggcccaatgaacattgaaaacctggcggcagcgcaaaagatg

SEQ ID NO: 95090 - DNA, 103 bp, Artificial Sequence
  Synthetic Polynucleotide
taatacgactcactatagggaatctttgctttatcctcctcattcaatgtaacagaggagaacattgatggaggaggataacctggcggcagcgcaaaagatg

SEQ ID NO: 95091 - DNA, 103 bp, Artificial Sequence
  Synthetic Polynucleotide
taatacgactcactatagggtgcttttagcaatctttgctttatcctcctaacagaggagaaggaggatgaagcaaagaaacctggcggcagcgcaaaagatg

SEQ ID NO: 95092 - DNA, 103 bp, Artificial Sequence
  Synthetic Polynucleotide
taatacgactcactatagggatcttcttcttgcttttagcaatctttgctaacagaggagaagcaaaatgtgctaaaagaacctggcggcagcgcaaaagatg

SEQ ID NO: 95093 - DNA, 103 bp, Artificial Sequence
  Synthetic Polynucleotide
taatacgactcactatagggcttctgcctcatcttcttcttgcttttagcaacagaggagagctaaaatgaagaagaagaacctggcggcagcgcaaaagatg

SEQ ID NO: 95094 - DNA, 103 bp, Artificial Sequence
  Synthetic Polynucleotide
taatacgactcactatagggcccgttgaaccttctgcctcatcttcttctaacagaggagaagaagaatgtgaggcagaaacctggcggcagcgcaaaagatg

SEQ ID NO: 95095 - DNA, 103 bp, Artificial Sequence
  Synthetic Polynucleotide
taatacgactcactatagggtgacactctccccgttgaaccttctgcctcaacagaggagagaggcaatgggttcaacgaacctggcggcagcgcaaaagatg

SEQ ID NO: 95096 - DNA, 103 bp, Artificial Sequence
  Synthetic Polynucleotide
taatacgactcactataggggatagtagtctgacactctccccgttgaacaacagaggagagttcaaatgggagagtgtaacctggcggcagcgcaaaagatg

SEQ ID NO: 95097 - DNA, 103 bp, Artificial Sequence
  Synthetic Polynucleotide
taatacgactcactatagggcctgcccttggatagtagtctgacactctcaacagaggagagagagtatgagactactaaacctggcggcagcgcaaaagatg

SEQ ID NO: 95098 - DNA, 103 bp, Artificial Sequence
  Synthetic Polynucleotide
taatacgactcactatagggttatttctggcctgcccttggatagtagtcaacagaggagagactacatgccaagggcaaacctggcggcagcgcaaaagatg

SEQ ID NO: 95099 - DNA, 103 bp, Artificial Sequence
  Synthetic Polynucleotide
taatacgactcactatagggtgaggtgctggaggagtggggagcagagttaacagaggagaaactctatgccccactccaacctggcggcagcgcaaaagatg

SEQ ID NO: 95100 - DNA, 103 bp, Artificial Sequence
  Synthetic Polynucleotide
taatacgactcactatagggttgtttccgcttatttctggcctgcccttgaacagaggagacaagggatggccagaaataacctggcggcagcgcaaaagatg

SEQ ID NO: 95101 - DNA, 103 bp, Artificial Sequence
  Synthetic Polynucleotide
taatacgactcactatagggtcttggtctcttgtttccgcttatttctggaacagaggagaccagaaatgagcggaaacaacctggcggcagcgcaaaagatg

SEQ ID NO: 95102 - DNA, 103 bp, Artificial Sequence
  Synthetic Polynucleotide
taatacgactcactatagggtgctttaagctcttggtctcttgtttccgcaacagaggagagcggaaatgagagaccaaaacctggcggcagcgcaaaagatg

SEQ ID NO: 95103 - DNA, 103 bp, Artificial Sequence
  Synthetic Polynucleotide
taatacgactcactatagggagcttccttctgctttaagctcttggtctcaacagaggagagagaccatgagcttaaagaacctggcggcagcgcaaaagatg

SEQ ID NO: 95104 - DNA, 103 bp, Artificial Sequence
  Synthetic Polynucleotide
taatacgactcactatagggatttcttcttagcttccttctgctttaagcaacagaggagagcttaaatgagaaggaagaacctggcggcagcgcaaaagatg

SEQ ID NO: 95105 - DNA, 103 bp, Artificial Sequence
  Synthetic Polynucleotide
taatacgactcactatagggtcagccttggatttcttcttagcttccttcaacagaggagagaaggaatgtaagaagaaaacctggcggcagcgcaaaagatg

SEQ ID NO: 95106 - DNA, 103 bp, Artificial Sequence
  Synthetic Polynucleotide
taatacgactcactatagggtttttctttctcagccttggatttcttcttaacagaggagaaagaagatgtccaaggctaacctggcggcagcgcaaaagatg

SEQ ID NO: 95107 - DNA, 103 bp, Artificial Sequence
  Synthetic Polynucleotide
taatacgactcactatagggttgtctttcctttttctttctcagccttggaacagaggagaccaaggatgagaaagaaaaacctggcggcagcgcaaaagatg

SEQ ID NO: 95108 - DNA, 103 bp, Artificial Sequence
  Synthetic Polynucleotide
taatacgactcactatagggttttcctgctttgtctttcctttttctttcaacagaggagagaaagaatgaggaaagacaacctggcggcagcgcaaaagatg

SEQ ID NO: 95109 - DNA, 103 bp, Artificial Sequence
  Synthetic Polynucleotide
taatacgactcactatagggttccttcagtttttcctgctttgtctttccaacagaggagaggaaagatgaagcaggaaaacctggcggcagcgcaaaagatg

SEQ ID NO: 95110 - DNA, 103 bp, Artificial Sequence
  Synthetic Polynucleotide
taatacgactcactataggggatggaggtgtgaggtgctggaggagtgggaacagaggagacccactatgccagcacctaacctggcggcagcgcaaaagatg

SEQ ID NO: 95111 - DNA, 103 bp, Artificial Sequence
  Synthetic Polynucleotide
taatacgactcactatagggtcttgactttttccttcagtttttcctgctaacagaggagaagcaggatgaactgaaggaacctggcggcagcgcaaaagatg

SEQ ID NO: 95112 - DNA, 103 bp, Artificial Sequence
  Synthetic Polynucleotide
taatacgactcactatagggttcttttccctcttgactttttccttcagtaacagaggagaactgaaatgaaaagtcaaaacctggcggcagcgcaaaagatg

SEQ ID NO: 95113 - DNA, 103 bp, Artificial Sequence
  Synthetic Polynucleotide
taatacgactcactatagggtaccttctccttcttttccctcttgactttaacagaggagaaaagtcatgagggaaaagaacctggcggcagcgcaaaagatg

SEQ ID NO: 95114 - DNA, 103 bp, Artificial Sequence
  Synthetic Polynucleotide
taatacgactcactatagggccttcatttttaccttctccttcttttcccaacagaggagagggaaaatgaggagaaggaacctggcggcagcgcaaaagatg

SEQ ID NO: 95115 - DNA, 103 bp, Artificial Sequence
  Synthetic Polynucleotide
taatacgactcactatagggtcctccttttccttcatttttaccttctccaacagaggagaggagaaatgaaaaatgaaaacctggcggcagcgcaaaagatg

SEQ ID NO: 95116 - DNA, 103 bp, Artificial Sequence
  Synthetic Polynucleotide
taatacgactcactatagggtttggtcacctcctccttttccttcattttaacagaggagaaaaatgatggaaaaggagaacctggcggcagcgcaaaagatg

SEQ ID NO: 95117 - DNA, 103 bp, Artificial Sequence
  Synthetic Polynucleotide
taatacgactcactatagggctggcttggctttggtcacctcctccttttaacagaggagaaaaaggatgaggtgaccaaacctggcggcagcgcaaaagatg

SEQ ID NO: 95118 - DNA, 103 bp, Artificial Sequence
  Synthetic Polynucleotide
taatacgactcactataggggctttacaggctggcttggctttggtcaccaacagaggagaggtgacatgagccaagccaacctggcggcagcgcaaaagatg

SEQ ID NO: 95119 - DNA, 103 bp, Artificial Sequence
  Synthetic Polynucleotide
taatacgactcactatagggggtcttatctgctttacaggctggcttggcaacagaggagagccaagatggcctgtaaaaacctggcggcagcgcaaaagatg

SEQ ID NO: 95120 - DNA, 103 bp, Artificial Sequence
  Synthetic Polynucleotide
taatacgactcactataggggtgtggccagggtcttatctgctttacaggaacagaggagacctgtaatgcagataagaaacctggcggcagcgcaaaagatg

SEQ ID NO: 95121 - DNA, 103 bp, Artificial Sequence
  Synthetic Polynucleotide
taatacgactcactatagggacgctggggtgatggaggtgtgaggtgctgaacagaggagacagcacatgacacctccaaacctggcggcagcgcaaaagatg

SEQ ID NO: 95122 - DNA, 103 bp, Artificial Sequence
  Synthetic Polynucleotide
taatacgactcactatagggaagcgcctctgtgtggccagggtcttatctaacagaggagaagataaatgcctggccacaacctggcggcagcgcaaaagatg

SEQ ID NO: 95123 - DNA, 103 bp, Artificial Sequence
  Synthetic Polynucleotide
taatacgactcactatagggccgttcctccaagcgcctctgtgtggccagaacagaggagactggccatgcagaggcgcaacctggcggcagcgcaaaagatg

SEQ ID NO: 95124 - DNA, 103 bp, Artificial Sequence
  Synthetic Polynucleotide
taatacgactcactataggggctgcctctgccgttcctccaagcgcctctaacagaggagaagaggcatgtggaggaacaacctggcggcagcgcaaaagatg

SEQ ID NO: 95125 - DNA, 103 bp, Artificial Sequence
  Synthetic Polynucleotide
taatacgactcactatagggaagatcatctgctgcctctgccgttcctccaacagaggagaggaggaatggcagaggcaaacctggcggcagcgcaaaagatg

SEQ ID NO: 95126 - DNA, 103 bp, Artificial Sequence
  Synthetic Polynucleotide
taatacgactcactatagggcatttcctccaagatcatctgctgcctctgaacagaggagacagaggatgcagatgatcaacctggcggcagcgcaaaagatg

SEQ ID NO: 95127 - DNA, 103 bp, Artificial Sequence
  Synthetic Polynucleotide
taatacgactcactatagggtcggcttcttcatttcctccaagatcatctaacagaggagaagatgaatgtggaggaaaaacctggcggcagcgcaaaagatg

SEQ ID NO: 95128 - DNA, 103 bp, Artificial Sequence
  Synthetic Polynucleotide
taatacgactcactatagggatatcctctgtcggcttcttcatttcctccaacagaggagaggaggaatggaagaagccaacctggcggcagcgcaaaagatg

SEQ ID NO: 95129 - DNA, 103 bp, Artificial Sequence
  Synthetic Polynucleotide
taatacgactcactatagggagtcagacacatatcctctgtcggcttcttaacagaggagaaagaagatgacagaggataacctggcggcagcgcaaaagatg

SEQ ID NO: 95130 - DNA, 103 bp, Artificial Sequence
  Synthetic Polynucleotide
taatacgactcactataggggctggtggtcagtcagacacatatcctctgaacagaggagacagaggatgtgtgtctgaaacctggcggcagcgcaaaagatg

SEQ ID NO: 95131 - DNA, 103 bp, Artificial Sequence
  Synthetic Polynucleotide
taatacgactcactatagggtcaggcaggggctggtggtcagtcagacacaacagaggagagtgtctatgtgaccaccaaacctggcggcagcgcaaaagatg

SEQ ID NO: 95132 - DNA, 103 bp, Artificial Sequence
  Synthetic Polynucleotide
taatacgactcactataggggtcgtaggccacgctggggtgatggaggtgaacagaggagacacctcatgcaccccagcaacctggcggcagcgcaaaagatg

SEQ ID NO: 95133 - DNA, 103 bp, Artificial Sequence
  Synthetic Polynucleotide
taatacgactcactatagggtcgtgagaagtcaggcaggggctggtggtcaacagaggagagaccacatgcccctgcctaacctggcggcagcgcaaaagatg

SEQ ID NO: 95134 - DNA, 103 bp, Artificial Sequence
  Synthetic Polynucleotide
taatacgactcactataggggaccagggactcgtgagaagtcaggcagggaacagaggagaccctgcatgacttctcacaacctggcggcagcgcaaaagatg

SEQ ID NO: 95135 - DNA, 103 bp, Artificial Sequence
  Synthetic Polynucleotide
taatacgactcactatagggggcaatgtcagaccagggactcgtgagaagaacagaggagacttctcatgagtccctggaacctggcggcagcgcaaaagatg

SEQ ID NO: 95136 - DNA, 103 bp, Artificial Sequence
  Synthetic Polynucleotide
taatacgactcactatagggggctccactgggcaatgtcagaccagggacaacagaggagagtccctatgctgacattgaacctggcggcagcgcaaaagatg

SEQ ID NO: 95137 - DNA, 103 bp, Artificial Sequence
  Synthetic Polynucleotide
taatacgactcactatagggagtctgagaaggctccactgggcaatgtcaaacagaggagatgacatatgccagtggagaacctggcggcagcgcaaaagatg

SEQ ID NO: 95138 - DNA, 103 bp, Artificial Sequence
  Synthetic Polynucleotide
taatacgactcactatagggatggtcaagcagtctgagaaggctccactgaacagaggagacagtggatgcttctcagaaacctggcggcagcgcaaaagatg

SEQ ID NO: 95139 - DNA, 103 bp, Artificial Sequence
  Synthetic Polynucleotide
taatacgactcactataggggaactccacaatggtcaagcagtctgagaaaacagaggagattctcaatgtgcttgaccaacctggcggcagcgcaaaagatg

SEQ ID NO: 95140 - DNA, 103 bp, Artificial Sequence
  Synthetic Polynucleotide
taatacgactcactatagggagctatgcaggaactccacaatggtcaagcaacagaggagagcttgaatgttgtggagtaacctggcggcagcgcaaaagatg

SEQ ID NO: 95141 - DNA, 103 bp, Artificial Sequence
  Synthetic Polynucleotide
taatacgactcactatagggaccttgccaaagctatgcaggaactccacaaacagaggagatgtggaatgcctgcatagaacctggcggcagcgcaaaagatg

SEQ ID NO: 95142 - DNA, 103 bp, Artificial Sequence
  Synthetic Polynucleotide
taatacgactcactatagggaaagcccagcaccttgccaaagctatgcagaacagaggagactgcatatgtttggcaagaacctggcggcagcgcaaaagatg

SEQ ID NO: 95143 - DNA, 103 bp, Artificial Sequence
  Synthetic Polynucleotide
taatacgactcactatagggtccagagacagtcgtaggccacgctggggtaacagaggagaaccccaatgtggcctacgaacctggcggcagcgcaaaagatg

SEQ ID NO: 95144 - DNA, 103 bp, Artificial Sequence
  Synthetic Polynucleotide
taatacgactcactatagggtggcaggatcaaagcccagcaccttgccaaaacagaggagattggcaatgtgctgggctaacctggcggcagcgcaaaagatg

SEQ ID NO: 95145 - DNA, 103 bp, Artificial Sequence
  Synthetic Polynucleotide
taatacgactcactatagggggcacatctttggcaggatcaaagcccagcaacagaggagagctgggatgtgatcctgcaacctggcggcagcgcaaaagatg

SEQ ID NO: 95146 - DNA, 103 bp, Artificial Sequence
  Synthetic Polynucleotide
taatacgactcactatagggccccaggctaggcacatctttggcaggatcaacagaggagagatcctatgaaagatgtgaacctggcggcagcgcaaaagatg

SEQ ID NO: 95147 - DNA, 103 bp, Artificial Sequence
  Synthetic Polynucleotide
taatacgactcactatagggcctgcaggacccccaggctaggcacatcttaacagaggagaaagatgatgctagcctggaacctggcggcagcgcaaaagatg

SEQ ID NO: 95148 - DNA, 103 bp, Artificial Sequence
  Synthetic Polynucleotide
taatacgactcactatagggaggagtccctcctgcaggacccccaggctaaacagaggagatagcctatgggtcctgcaaacctggcggcagcgcaaaagatg

SEQ ID NO: 95149 - DNA, 103 bp, Artificial Sequence
  Synthetic Polynucleotide
taatacgactcactatagggaccttgacacaggagtccctcctgcaggacaacagaggagagtcctgatggagggactcaacctggcggcagcgcaaaagatg

SEQ ID NO: 95150 - DNA, 103 bp, Artificial Sequence
  Synthetic Polynucleotide
taatacgactcactatagggccaagctgtcaccttgacacaggagtccctaacagaggagaagggacatgtgtgtcaagaacctggcggcagcgcaaaagatg

SEQ ID NO: 95151 - DNA, 103 bp, Artificial Sequence
  Synthetic Polynucleotide
taatacgactcactatagggtgcacctcacccaagctgtcaccttgacacaacagaggagagtgtcaatgtgacagcttaacctggcggcagcgcaaaagatg

SEQ ID NO: 95152 - DNA, 103 bp, Artificial Sequence
  Synthetic Polynucleotide
taatacgactcactatagggcagcaggtcttgcacctcacccaagctgtcaacagaggagagacagcatgggtgaggtgaacctggcggcagcgcaaaagatg

SEQ ID NO: 95153 - DNA, 103 bp, Artificial Sequence
  Synthetic Polynucleotide
taatacgactcactataggggcagcctgaccagcaggtcttgcacctcacaacagaggagagtgaggatgaagacctgcaacctggcggcagcgcaaaagatg

SEQ ID NO: 95154 - DNA, 103 bp, Artificial Sequence
  Synthetic Polynucleotide
taatacgactcactatagggtgtgagtagttccagagacagtcgtaggccaacagaggagaggcctaatgctgtctctgaacctggcggcagcgcaaaagatg

SEQ ID NO: 95155 - DNA, 103 bp, Artificial Sequence
  Synthetic Polynucleotide
taatacgactcactataggggcagccttcagcagcctgaccagcaggtctaacagaggagaagacctatgggtcaggctaacctggcggcagcgcaaaagatg

SEQ ID NO: 95156 - DNA, 103 bp, Artificial Sequence
  Synthetic Polynucleotide
taatacgactcactatagggatcatggagtgcagccttcagcagcctgacaacagaggagagtcaggatgctgaaggctaacctggcggcagcgcaaaagatg

SEQ ID NO: 95157 - DNA, 103 bp, Artificial Sequence
  Synthetic Polynucleotide
taatacgactcactataggggaaagccaggatcatggagtgcagccttcaaacagaggagatgaaggatgcactccatgaacctggcggcagcgcaaaagatg

SEQ ID NO: 95158 - DNA, 103 bp, Artificial Sequence
  Synthetic Polynucleotide
taatacgactcactatagggcagtaggagggaaagccaggatcatggagtaacagaggagaactccaatgtcctggcttaacctggcggcagcgcaaaagatg

SEQ ID NO: 95159 - DNA, 103 bp, Artificial Sequence
  Synthetic Polynucleotide
taatacgactcactatagggtagggactgacagtaggagggaaagccaggaacagaggagacctggcatgccctcctacaacctggcggcagcgcaaaagatg

SEQ ID NO: 95160 - DNA, 103 bp, Artificial Sequence
  Synthetic Polynucleotide
taatacgactcactatagggccaagatctttagggactgacagtaggaggaacagaggagacctcctatggtcagtcccaacctggcggcagcgcaaaagatg

SEQ ID NO: 95161 - DNA, 103 bp, Artificial Sequence
  Synthetic Polynucleotide
taatacgactcactatagggaccttctcccccaagatctttagggactgaaacagaggagatcagtcatgaaagatcttaacctggcggcagcgcaaaagatg

SEQ ID NO: 95162 - DNA, 103 bp, Artificial Sequence
  Synthetic Polynucleotide
taatacgactcactataggggatctcagacaccttctcccccaagatcttaacagaggagaaagatcatgggggagaagaacctggcggcagcgcaaaagatg

SEQ ID NO: 95163 - DNA, 103 bp, Artificial Sequence
  Synthetic Polynucleotide
taatacgactcactatagggttgtcagtgggatctcagacaccttctcccaacagaggagagggagaatgtgtctgagaaacctggcggcagcgcaaaagatg

SEQ ID NO: 95164 - DNA, 103 bp, Artificial Sequence
  Synthetic Polynucleotide
taatacgactcactatagggacattgtctcttgtcagtgggatctcagacaacagaggagagtctgaatgcccactgacaacctggcggcagcgcaaaagatg

SEQ ID NO: 95165 - DNA, 103 bp, Artificial Sequence
  Synthetic Polynucleotide
taatacgactcactatagggagatgggtactgtgagtagttccagagacaaacagaggagatgtctcatgaactactcaaacctggcggcagcgcaaaagatg

SEQ ID NO: 95166 - DNA, 103 bp, Artificial Sequence
  Synthetic Polynucleotide
taatacgactcactataggggatctctgacacattgtctcttgtcagtggaacagaggagaccactgatgagagacaataacctggcggcagcgcaaaagatg

SEQ ID NO: 95167 - DNA, 103 bp, Artificial Sequence
  Synthetic Polynucleotide
taatacgactcactatagggagcagcgcaggatctctgacacattgtctcaacagaggagagagacaatgtgtcagagaaacctggcggcagcgcaaaagatg

SEQ ID NO: 95168 - DNA, 103 bp, Artificial Sequence
  Synthetic Polynucleotide
taatacgactcactataggggccataaggaagcagcgcaggatctctgacaacagaggagagtcagaatgcctgcgctgaacctggcggcagcgcaaaagatg

SEQ ID NO: 95169 - DNA, 103 bp, Artificial Sequence
  Synthetic Polynucleotide
taatacgactcactatagggtactccatatgccataaggaagcagcgcagaacagaggagactgcgcatgttccttatgaacctggcggcagcgcaaaagatg

SEQ ID NO: 95170 - DNA, 103 bp, Artificial Sequence
  Synthetic Polynucleotide
taatacgactcactataggggggctggctctactccatatgccataaggaaacagaggagatccttaatgcatatggagaacctggcggcagcgcaaaagatg

SEQ ID NO: 95171 - DNA, 103 bp, Artificial Sequence
  Synthetic Polynucleotide
taatacgactcactatagggcggtcacagagggctggctctactccatataacagaggagaatatggatgagagccagcaacctggcggcagcgcaaaagatg

SEQ ID NO: 95172 - DNA, 103 bp, Artificial Sequence
  Synthetic Polynucleotide
taatacgactcactatagggggtgcgcaggcggtcacagagggctggctcaacagaggagagagccaatgctctgtgacaacctggcggcagcgcaaaagatg

SEQ ID NO: 95173 - DNA, 103 bp, Artificial Sequence
  Synthetic Polynucleotide
taatacgactcactataggggaaaaggctgggtgcgcaggcggtcacagaaacagaggagatctgtgatggcctgcgcaaacctggcggcagcgcaaaagatg

SEQ ID NO: 95174 - DNA, 103 bp, Artificial Sequence
  Synthetic Polynucleotide
taatacgactcactatagggggctgggcctgaaaaggctgggtgcgcaggaacagaggagacctgcgatgccagcctttaacctggcggcagcgcaaaagatg

SEQ ID NO: 95175 - DNA, 103 bp, Artificial Sequence
  Synthetic Polynucleotide
taatacgactcactatagggctgctggggtggctgggcctgaaaaggctgaacagaggagacagcctatgcaggcccagaacctggcggcagcgcaaaagatg

SEQ ID NO: 95176 - DNA, 103 bp, Artificial Sequence
  Synthetic Polynucleotide
taatacgactcactatagggcaggattggcagatgggtactgtgagtagtaacagaggagaactactatgagtacccataacctggcggcagcgcaaaagatg

SEQ ID NO: 95177 - DNA, 103 bp, Artificial Sequence
  Synthetic Polynucleotide
taatacgactcactatagggcagcagccttctgctggggtggctgggcctaacagaggagaaggcccatgcaccccagcaacctggcggcagcgcaaaagatg

SEQ ID NO: 95178 - DNA, 103 bp, Artificial Sequence
  Synthetic Polynucleotide
taatacgactcactatagggaaggccaggacagcagccttctgctggggtaacagaggagaaccccaatggaaggctgcaacctggcggcagcgcaaaagatg

SEQ ID NO: 95179 - DNA, 103 bp, Artificial Sequence
  Synthetic Polynucleotide
taatacgactcactatagggatgcacaaggaaggccaggacagcagccttaacagaggagaaaggctatggtcctggccaacctggcggcagcgcaaaagatg

SEQ ID NO: 95180 - DNA, 103 bp, Artificial Sequence
  Synthetic Polynucleotide
taatacgactcactatagggcattgagctcatgcacaaggaaggccaggaaacagaggagatcctggatgtccttgtgcaacctggcggcagcgcaaaagatg

SEQ ID NO: 95181 - DNA, 103 bp, Artificial Sequence
  Synthetic Polynucleotide
taatacgactcactatagggagggtggagccattgagctcatgcacaaggaacagaggagaccttgtatgtgagctcaaaacctggcggcagcgcaaaagatg

SEQ ID NO: 95182 - DNA, 103 bp, Artificial Sequence
  Synthetic Polynucleotide
taatacgactcactatagggattgatgatgagggtggagccattgagctcaacagaggagagagctcatgggctccaccaacctggcggcagcgcaaaagatg

SEQ ID NO: 95183 - DNA, 103 bp, Artificial Sequence
  Synthetic Polynucleotide
taatacgactcactatagggtgtcaatctcattgatgatgagggtggagcaacagaggagagctccaatgtcatcatcaaacctggcggcagcgcaaaagatg

SEQ ID NO: 95184 - DNA, 103 bp, Artificial Sequence
  Synthetic Polynucleotide
taatacgactcactatagggtccagagtcttgtcaatctcattgatgatgaacagaggagacatcatatgtgagattgaaacctggcggcagcgcaaaagatg

SEQ ID NO: 95185 - DNA, 103 bp, Artificial Sequence
  Synthetic Polynucleotide
taatacgactcactatagggggacatactctccagagtcttgtcaatctcaacagaggagagagattatgaagactctgaacctggcggcagcgcaaaagatg

SEQ ID NO: 95186 - DNA, 103 bp, Artificial Sequence
  Synthetic Polynucleotide
taatacgactcactatagggtcctgtagctggacatactctccagagtctaacagaggagaagactcatgagagtatgtaacctggcggcagcgcaaaagatg

SEQ ID NO: 95187 - DNA, 103 bp, Artificial Sequence
  Synthetic Polynucleotide
taatacgactcactataggggcagggggaaggccagtaaagttaaaatggaacagaggagaccatttatgctttactggaacctggcggcagcgcaaaagatg

SEQ ID NO: 95188 - DNA, 103 bp, Artificial Sequence
  Synthetic Polynucleotide
taatacgactcactatagggaggttgctgccaggattggcagatgggtacaacagaggagagtacccatgtgccaatccaacctggcggcagcgcaaaagatg

SEQ ID NO: 95189 - DNA, 103 bp, Artificial Sequence
  Synthetic Polynucleotide
taatacgactcactatagggcacttgtttttcctgtagctggacatactcaacagaggagagagtatatgcagctacagaacctggcggcagcgcaaaagatg

SEQ ID NO: 95190 - DNA, 103 bp, Artificial Sequence
  Synthetic Polynucleotide
taatacgactcactatagggttcaacaatccacttgtttttcctgtagctaacagaggagaagctacatgaaaaacaagaacctggcggcagcgcaaaagatg

SEQ ID NO: 95191 - DNA, 103 bp, Artificial Sequence
  Synthetic Polynucleotide
taatacgactcactatagggggagccggccttcaacaatccacttgttttaacagaggagaaaaacaatgggattgttgaacctggcggcagcgcaaaagatg

SEQ ID NO: 95192 - DNA, 103 bp, Artificial Sequence
  Synthetic Polynucleotide
taatacgactcactatagggttcagcctccggagccggccttcaacaatcaacagaggagagattgtatgaggccggctaacctggcggcagcgcaaaagatg

SEQ ID NO: 95193 - DNA, 103 bp, Artificial Sequence
  Synthetic Polynucleotide
taatacgactcactatagggcagaacagttttcagcctccggagccggccaacagaggagaggccggatgcggaggctgaacctggcggcagcgcaaaagatg

SEQ ID NO: 95194 - DNA, 103 bp, Artificial Sequence
  Synthetic Polynucleotide
taatacgactcactatagggttcgcttggccagaacagttttcagcctccaacagaggagaggaggcatgaaactgttcaacctggcggcagcgcaaaagatg

SEQ ID NO: 95195 - DNA, 103 bp, Artificial Sequence
  Synthetic Polynucleotide
taatacgactcactataggggaccgcccagttcgcttggccagaacagttaacagaggagaaactgtatgggccaagcgaacctggcggcagcgcaaaagatg

SEQ ID NO: 95196 - DNA, 103 bp, Artificial Sequence
  Synthetic Polynucleotide
taatacgactcactatagggctctacttcagaccgcccagttcgcttggcaacagaggagagccaagatgactgggcggaacctggcggcagcgcaaaagatg

SEQ ID NO: 95197 - DNA, 103 bp, Artificial Sequence
  Synthetic Polynucleotide
taatacgactcactataggggcccttccatctctacttcagaccgcccagaacagaggagactgggcatgctgaagtagaacctggcggcagcgcaaaagatg

SEQ ID NO: 95198 - DNA, 103 bp, Artificial Sequence
  Synthetic Polynucleotide
taatacgactcactatagggcattcctctggcccttccatctctacttcaaacagaggagatgaagtatggatggaaggaacctggcggcagcgcaaaagatg

SEQ ID NO: 95199 - DNA, 103 bp, Artificial Sequence
  Synthetic Polynucleotide
taatacgactcactatagggtgggtccttgaggttgctgccaggattggcaacagaggagagccaatatgggcagcaacaacctggcggcagcgcaaaagatg

SEQ ID NO: 95200 - DNA, 103 bp, Artificial Sequence
  Synthetic Polynucleotide
taatacgactcactatagggccgtcccaggcattcctctggcccttccataacagaggagaatggaaatgccagaggaaaacctggcggcagcgcaaaagatg

SEQ ID NO: 95201 - DNA, 103 bp, Artificial Sequence
  Synthetic Polynucleotide
taatacgactcactatagggaactgcgcctccgtcccaggcattcctctgaacagaggagacagaggatggcctgggacaacctggcggcagcgcaaaagatg

SEQ ID NO: 95202 - DNA, 103 bp, Artificial Sequence
  Synthetic Polynucleotide
taatacgactcactatagggatgatccgagaactgcgcctccgtcccaggaacagaggagacctgggatggaggcgcagaacctggcggcagcgcaaaagatg

SEQ ID NO: 95203 - DNA, 103 bp, Artificial Sequence
  Synthetic Polynucleotide
taatacgactcactatagggggtctcctccatgatccgagaactgcgcctaacagaggagaaggcgcatgtctcggatcaacctggcggcagcgcaaaagatg

SEQ ID NO: 95204 - DNA, 103 bp, Artificial Sequence
  Synthetic Polynucleotide
taatacgactcactatagggccatgccactggtctcctccatgatccgagaacagaggagactcggaatgtggaggagaaacctggcggcagcgcaaaagatg

SEQ ID NO: 95205 - DNA, 103 bp, Artificial Sequence
  Synthetic Polynucleotide
taatacgactcactatagggtcctcttcttccatgccactggtctcctccaacagaggagaggaggaatgcagtggcataacctggcggcagcgcaaaagatg

SEQ ID NO: 95206 - DNA, 103 bp, Artificial Sequence
  Synthetic Polynucleotide
taatacgactcactatagggctcctcttcttcctcttcttccatgccactaacagaggagaagtggcatggaagaagagaacctggcggcagcgcaaaagatg

SEQ ID NO: 95207 - DNA, 103 bp, Artificial Sequence
  Synthetic Polynucleotide
taatacgactcactatagggctgctatagactcctcttcttcctcttcttaacagaggagaaagaagatgaagaagaggaacctggcggcagcgcaaaagatg

SEQ ID NO: 95208 - DNA, 103 bp, Artificial Sequence
  Synthetic Polynucleotide
taatacgactcactatagggccagggacagctgctatagactcctcttctaacagaggagaagaagaatggtctatagcaacctggcggcagcgcaaaagatg

SEQ ID NO: 95209 - DNA, 103 bp, Artificial Sequence
  Synthetic Polynucleotide
taatacgactcactatagggacccctgcggccagggacagctgctatagaaacagaggagatctataatggctgtccctaacctggcggcagcgcaaaagatg

SEQ ID NO: 95210 - DNA, 103 bp, Artificial Sequence
  Synthetic Polynucleotide
taatacgactcactatagggagagaaggggtgggtccttgaggttgctgcaacagaggagagcagcaatgtcaaggaccaacctggcggcagcgcaaaagatg

SEQ ID NO: 95211 - DNA, 103 bp, Artificial Sequence
  Synthetic Polynucleotide
taatacgactcactatagggcatctcttcgacccctgcggccagggacagaacagaggagactgtccatggccgcagggaacctggcggcagcgcaaaagatg

SEQ ID NO: 95212 - DNA, 103 bp, Artificial Sequence
  Synthetic Polynucleotide
taatacgactcactatagggtcaacctctccatctcttcgacccctgcggaacagaggagaccgcagatgtcgaagagaaacctggcggcagcgcaaaagatg

SEQ ID NO: 95213 - DNA, 103 bp, Artificial Sequence
  Synthetic Polynucleotide
taatacgactcactatagggtgctgtggcatcaacctctccatctcttcgaacagaggagacgaagaatgggagaggttaacctggcggcagcgcaaaagatg

SEQ ID NO: 95214 - DNA, 103 bp, Artificial Sequence
  Synthetic Polynucleotide
taatacgactcactatagggggatgctagatgctgtggcatcaacctctcaacagaggagagagaggatgatgccacagaacctggcggcagcgcaaaagatg

SEQ ID NO: 95215 - DNA, 103 bp, Artificial Sequence
  Synthetic Polynucleotide
taatacgactcactatagggtctagctctgggatgctagatgctgtggcaaacagaggagatgccacatgatctagcataacctggcggcagcgcaaaagatg

SEQ ID NO: 95216 - DNA, 103 bp, Artificial Sequence
  Synthetic Polynucleotide
taatacgactcactatagggtatctggcgctctagctctgggatgctagaaacagaggagatctagcatgccagagctaaacctggcggcagcgcaaaagatg

SEQ ID NO: 95217 - DNA, 103 bp, Artificial Sequence
  Synthetic Polynucleotide
taatacgactcactatagggtgagtttttctatctggcgctctagctctgaacagaggagacagagcatgagcgccagaaacctggcggcagcgcaaaagatg

SEQ ID NO: 95218 - DNA, 103 bp, Artificial Sequence
  Synthetic Polynucleotide
taatacgactcactatagggtgacgcttgctgagtttttctatctggcgcaacagaggagagcgccaatgagaaaaactaacctggcggcagcgcaaaagatg

SEQ ID NO: 95219 - DNA, 103 bp, Artificial Sequence
  Synthetic Polynucleotide
taatacgactcactatagggaaagaaaagctgacgcttgctgagtttttcaacagaggagagaaaaaatgagcaagcgtaacctggcggcagcgcaaaagatg

SEQ ID NO: 95220 - DNA, 103 bp, Artificial Sequence
  Synthetic Polynucleotide
taatacgactcactataggggctttttgcgaaagaaaagctgacgcttgcaacagaggagagcaagcatgagcttttctaacctggcggcagcgcaaaagatg

SEQ ID NO: 95221 - DNA, 103 bp, Artificial Sequence
  Synthetic Polynucleotide
taatacgactcactataggggagaactgggagagaaggggtgggtccttgaacagaggagacaaggaatgaccccttctaacctggcggcagcgcaaaagatg

SEQ ID NO: 95222 - DNA, 103 bp, Artificial Sequence
  Synthetic Polynucleotide
taatacgactcactataggggagtgaagcagctttttgcgaaagaaaagcaacagaggagagcttttatgtcgcaaaaaaacctggcggcagcgcaaaagatg

SEQ ID NO: 95223 - DNA, 103 bp, Artificial Sequence
  Synthetic Polynucleotide
taatacgactcactatagggcatctgggatgagtgaagcagctttttgcgaacagaggagacgcaaaatgctgcttcacaacctggcggcagcgcaaaagatg

SEQ ID NO: 95224 - DNA, 103 bp, Artificial Sequence
  Synthetic Polynucleotide
taatacgactcactatagggccgcccgaagcatctgggatgagtgaagcaaacagaggagatgcttcatgcatcccagaaacctggcggcagcgcaaaagatg

SEQ ID NO: 95225 - DNA, 103 bp, Artificial Sequence
  Synthetic Polynucleotide
taatacgactcactatagggcccagggagaccgcccgaagcatctgggataacagaggagaatcccaatggcttcgggcaacctggcggcagcgcaaaagatg

SEQ ID NO: 95226 - DNA, 103 bp, Artificial Sequence
  Synthetic Polynucleotide
taatacgactcactataggggcggtcctgacccagggagaccgcccgaagaacagaggagacttcggatggtctccctgaacctggcggcagcgcaaaagatg

SEQ ID NO: 95227 - DNA, 103 bp, Artificial Sequence
  Synthetic Polynucleotide
taatacgactcactataggggacgtctgtagcggtcctgacccagggagaaacagaggagatctcccatggtcaggaccaacctggcggcagcgcaaaagatg

SEQ ID NO: 95228 - DNA, 103 bp, Artificial Sequence
  Synthetic Polynucleotide
taatacgactcactatagggacccagtagcgacgtctgtagcggtcctgaaacagaggagatcaggaatgctacagacgaacctggcggcagcgcaaaagatg

SEQ ID NO: 95229 - DNA, 103 bp, Artificial Sequence
  Synthetic Polynucleotide
taatacgactcactatagggatacggcaatacccagtagcgacgtctgtaaacagaggagatacagaatgcgctactggaacctggcggcagcgcaaaagatg

SEQ ID NO: 95230 - DNA, 103 bp, Artificial Sequence
  Synthetic Polynucleotide
taatacgactcactatagggtaccagccaaatacggcaatacccagtagcaacagaggagagctactatgtattgccgtaacctggcggcagcgcaaaagatg

SEQ ID NO: 95231 - DNA, 103 bp, Artificial Sequence
  Synthetic Polynucleotide
taatacgactcactatagggtctacaaagataccagccaaatacggcaataacagaggagaattgccatgtttggctggaacctggcggcagcgcaaaagatg

SEQ ID NO: 95232 - DNA, 103 bp, Artificial Sequence
  Synthetic Polynucleotide
taatacgactcactatagggttgtccccccgagaactgggagagaaggggaacagaggagaccccttatgtcccagttcaacctggcggcagcgcaaaagatg

SEQ ID NO: 95233 - DNA, 103 bp, Artificial Sequence
  Synthetic Polynucleotide
taatacgactcactatagggctctgttccttctacaaagataccagccaaaacagaggagattggctatgatctttgtaaacctggcggcagcgcaaaagatg

SEQ ID NO: 95234 - DNA, 103 bp, Artificial Sequence
  Synthetic Polynucleotide
taatacgactcactatagggctaagttcccctctgttccttctacaaagaaacagaggagatctttgatgaaggaacagaacctggcggcagcgcaaaagatg

SEQ ID NO: 95235 - DNA, 103 bp, Artificial Sequence
  Synthetic Polynucleotide
taatacgactcactatagggtcctcaggaactaagttcccctctgttcctaacagaggagaaggaacatgggggaacttaacctggcggcagcgcaaaagatg

SEQ ID NO: 95236 - DNA, 103 bp, Artificial Sequence
  Synthetic Polynucleotide
taatacgactcactatagggctttatcacctcctcaggaactaagttcccaacagaggagagggaacatggttcctgagaacctggcggcagcgcaaaagatg

SEQ ID NO: 95237 - DNA, 103 bp, Artificial Sequence
  Synthetic Polynucleotide
taatacgactcactatagggcagtttccttctttatcacctcctcaggaaaacagaggagattcctgatgaggtgataaaacctggcggcagcgcaaaagatg

SEQ ID NO: 95238 - DNA, 103 bp, Artificial Sequence
  Synthetic Polynucleotide
taatacgactcactatagggtttaaggagtcagtttccttctttatcaccaacagaggagaggtgatatggaaggaaacaacctggcggcagcgcaaaagatg

SEQ ID NO: 95239 - DNA, 103 bp, Artificial Sequence
  Synthetic Polynucleotide
taatacgactcactatagggggctgccacttttaaggagtcagtttccttaacagaggagaaaggaaatggactccttaaacctggcggcagcgcaaaagatg

SEQ ID NO: 95240 - DNA, 103 bp, Artificial Sequence
  Synthetic Polynucleotide
taatacgactcactataggggtgacgcatgggctgccacttttaaggagtaacagaggagaactcctatgaagtggcagaacctggcggcagcgcaaaagatg

SEQ ID NO: 95241 - DNA, 103 bp, Artificial Sequence
  Synthetic Polynucleotide
taatacgactcactataggggcagggttgagtgacgcatgggctgccactaacagaggagaagtggcatgccatgcgtcaacctggcggcagcgcaaaagatg

SEQ ID NO: 95242 - DNA, 103 bp, Artificial Sequence
  Synthetic Polynucleotide
taatacgactcactatagggagagaagagggcagggttgagtgacgcatgaacagaggagacatgcgatgctcaaccctaacctggcggcagcgcaaaagatg

SEQ ID NO: 95243 - DNA, 103 bp, Artificial Sequence
  Synthetic Polynucleotide
taatacgactcactatagggtgagtgggtattgtccccccgagaactgggaacagaggagacccagtatgcggggggacaacctggcggcagcgcaaaagatg

SEQ ID NO: 95244 - DNA, 103 bp, Artificial Sequence
  Synthetic Polynucleotide
taatacgactcactatagggccatcttcatagagaagagggcagggttgaaacagaggagatcaaccatgccctcttctaacctggcggcagcgcaaaagatg

SEQ ID NO: 95245 - DNA, 103 bp, Artificial Sequence
  Synthetic Polynucleotide
taatacgactcactatagggccagctaactccatcttcatagagaagaggaacagaggagacctcttatgtatgaagataacctggcggcagcgcaaaagatg

SEQ ID NO: 95246 - DNA, 103 bp, Artificial Sequence
  Synthetic Polynucleotide
taatacgactcactatagggggtgttggagccagctaactccatcttcataacagaggagaatgaagatggagttagctaacctggcggcagcgcaaaagatg

SEQ ID NO: 95247 - DNA, 103 bp, Artificial Sequence
  Synthetic Polynucleotide
taatacgactcactatagggaactggcagtggtgttggagccagctaactaacagaggagaagttagatggctccaacaaacctggcggcagcgcaaaagatg

SEQ ID NO: 95248 - DNA, 103 bp, Artificial Sequence
  Synthetic Polynucleotide
taatacgactcactatagggcgggcaggagaactggcagtggtgttggagaacagaggagactccaaatgcactgccagaacctggcggcagcgcaaaagatg

SEQ ID NO: 95249 - DNA, 103 bp, Artificial Sequence
  Synthetic Polynucleotide
taatacgactcactataggggcctcgggcccgggcaggagaactggcagtaacagaggagaactgccatgtctcctgccaacctggcggcagcgcaaaagatg

SEQ ID NO: 95250 - DNA, 103 bp, Artificial Sequence
  Synthetic Polynucleotide
taatacgactcactatagggttcgaggtcggcctcgggcccgggcaggagaacagaggagactcctgatggggcccgagaacctggcggcagcgcaaaagatg

SEQ ID NO: 95251 - DNA, 103 bp, Artificial Sequence
  Synthetic Polynucleotide
taatacgactcactatagggggcttagtttttcgaggtcggcctcgggccaacagaggagaggcccgatgccgacctcgaacctggcggcagcgcaaaagatg

SEQ ID NO: 95252 - DNA, 103 bp, Artificial Sequence
  Synthetic Polynucleotide
taatacgactcactatagggcatagacccgggcttagtttttcgaggtcgaacagaggagacgacctatgaaaactaagaacctggcggcagcgcaaaagatg

SEQ ID NO: 95253 - DNA, 103 bp, Artificial Sequence
  Synthetic Polynucleotide
taatacgactcactataggggcctaggttgcatagacccgggcttagtttaacagaggagaaaactaatgccgggtctaaacctggcggcagcgcaaaagatg

SEQ ID NO: 95254 - DNA, 103 bp, Artificial Sequence
  Synthetic Polynucleotide
taatacgactcactatagggaggatgccgttgagtgggtattgtccccccaacagaggagaggggggatgatacccactaacctggcggcagcgcaaaagatg

SEQ ID NO: 95255 - DNA, 103 bp, Artificial Sequence
  Synthetic Polynucleotide
taatacgactcactataggggacttaagatgcctaggttgcatagacccgaacagaggagacgggtcatggcaacctagaacctggcggcagcgcaaaagatg

SEQ ID NO: 95256 - DNA, 103 bp, Artificial Sequence
  Synthetic Polynucleotide
taatacgactcactatagggcctgacaggggacttaagatgcctaggttgaacagaggagacaacctatgcatcttaagaacctggcggcagcgcaaaagatg

SEQ ID NO: 95257 - DNA, 103 bp, Artificial Sequence
  Synthetic Polynucleotide
taatacgactcactatagggaatcctgacccctgacaggggacttaagataacagaggagaatcttaatgcccctgtcaaacctggcggcagcgcaaaagatg

SEQ ID NO: 95258 - DNA, 103 bp, Artificial Sequence
  Synthetic Polynucleotide
taatacgactcactatagggggctgttctgaatcctgacccctgacagggaacagaggagaccctgtatggggtcaggaaacctggcggcagcgcaaaagatg

SEQ ID NO: 95259 - DNA, 103 bp, Artificial Sequence
  Synthetic Polynucleotide
taatacgactcactatagggctgggcctggggctgttctgaatcctgaccaacagaggagaggtcagatgtcagaacagaacctggcggcagcgcaaaagatg

SEQ ID NO: 95260 - DNA, 103 bp, Artificial Sequence
  Synthetic Polynucleotide
taatacgactcactatagggcaggctgaagctgggcctggggctgttctgaacagaggagacagaacatgcccaggcccaacctggcggcagcgcaaaagatg

SEQ ID NO: 95261 - DNA, 103 bp, Artificial Sequence
  Synthetic Polynucleotide
taatacgactcactatagggagctgagcctcaggctgaagctgggcctggaacagaggagaccaggcatggcttcagccaacctggcggcagcgcaaaagatg

SEQ ID NO: 95262 - DNA, 103 bp, Artificial Sequence
  Synthetic Polynucleotide
taatacgactcactatagggaggagcatgaagctgagcctcaggctgaagaacagaggagacttcagatggaggctcagaacctggcggcagcgcaaaagatg

SEQ ID NO: 95263 - DNA, 103 bp, Artificial Sequence
  Synthetic Polynucleotide
taatacgactcactatagggggggctgggcaggagcatgaagctgagcctaacagaggagaaggctcatgttcatgctcaacctggcggcagcgcaaaagatg

SEQ ID NO: 95264 - DNA, 103 bp, Artificial Sequence
  Synthetic Polynucleotide
taatacgactcactatagggagctgaggctggggctgggcaggagcatgaaacagaggagatcatgcatgtgcccagccaacctggcggcagcgcaaaagatg

SEQ ID NO: 95265 - DNA, 103 bp, Artificial Sequence
  Synthetic Polynucleotide
taatacgactcactataggggctgcccccaaggatgccgttgagtgggtaaacagaggagatacccaatgaacggcatcaacctggcggcagcgcaaaagatg

SEQ ID NO: 95266 - DNA, 103 bp, Artificial Sequence
  Synthetic Polynucleotide
taatacgactcactatagggctgaagctgaagctgaggctggggctgggcaacagaggagagcccagatgcagcctcagaacctggcggcagcgcaaaagatg

SEQ ID NO: 95267 - DNA, 103 bp, Artificial Sequence
  Synthetic Polynucleotide
taatacgactcactataggggggactgaagctgaagctgaagctgaggctaacagaggagaagcctcatgttcagcttcaacctggcggcagcgcaaaagatg

SEQ ID NO: 95268 - DNA, 103 bp, Artificial Sequence
  Synthetic Polynucleotide
taatacgactcactatagggaaccccttatgggactgaagctgaagctgaaacagaggagatcagctatggcttcagtcaacctggcggcagcgcaaaagatg

SEQ ID NO: 95269 - DNA, 103 bp, Artificial Sequence
  Synthetic Polynucleotide
taatacgactcactatagggttgctccaggaaccccttatgggactgaagaacagaggagacttcagatgcataaggggaacctggcggcagcgcaaaagatg

SEQ ID NO: 95270 - DNA, 103 bp, Artificial Sequence
  Synthetic Polynucleotide
taatacgactcactataggggggagccttcttgctccaggaaccccttataacagaggagaataaggatgtcctggagcaacctggcggcagcgcaaaagatg

SEQ ID NO: 95271 - DNA, 103 bp, Artificial Sequence
  Synthetic Polynucleotide
taatacgactcactatagggagtgacaaaggggagccttcttgctccaggaacagaggagacctggaatgagaaggctcaacctggcggcagcgcaaaagatg

SEQ ID NO: 95272 - DNA, 103 bp, Artificial Sequence
  Synthetic Polynucleotide
taatacgactcactataggggctctgacccagtgacaaaggggagccttcaacagaggagagaaggcatgcctttgtcaaacctggcggcagcgcaaaagatg

SEQ ID NO: 95273 - DNA, 103 bp, Artificial Sequence
  Synthetic Polynucleotide
taatacgactcactatagggggtcatgctggctctgacccagtgacaaagaacagaggagactttgtatgtgggtcagaaacctggcggcagcgcaaaagatg

SEQ ID NO: 95274 - DNA, 103 bp, Artificial Sequence
  Synthetic Polynucleotide
taatacgactcactataggggactggctgaggtcatgctggctctgacccaacagaggagagggtcaatgccagcatgaaacctggcggcagcgcaaaagatg

SEQ ID NO: 95275 - DNA, 103 bp, Artificial Sequence
  Synthetic Polynucleotide
taatacgactcactatagggcaggaaggctgactggctgaggtcatgctgaacagaggagacagcatatgctcagccagaacctggcggcagcgcaaaagatg

SEQ ID NO: 95276 - DNA, 103 bp, Artificial Sequence
  Synthetic Polynucleotide
taatacgactcactatagggaaggttgccggctgcccccaaggatgccgtaacagaggagaacggcaatgttgggggcaaacctggcggcagcgcaaaagatg

SEQ ID NO: 95277 - DNA, 103 bp, Artificial Sequence
  Synthetic Polynucleotide
taatacgactcactatagggtcagccaagacaggaaggctgactggctgaaacagaggagatcagccatgcagccttccaacctggcggcagcgcaaaagatg

SEQ ID NO: 95278 - DNA, 103 bp, Artificial Sequence
  Synthetic Polynucleotide
taatacgactcactatagggtgagtctggctcagccaagacaggaaggctaacagaggagaagccttatggtcttggctaacctggcggcagcgcaaaagatg

SEQ ID NO: 95279 - DNA, 103 bp, Artificial Sequence
  Synthetic Polynucleotide
taatacgactcactataggggctatggctctgagtctggctcagccaagaaacagaggagatcttggatgagccagactaacctggcggcagcgcaaaagatg

SEQ ID NO: 95280 - DNA, 103 bp, Artificial Sequence
  Synthetic Polynucleotide
taatacgactcactatagggtcaacagggagctatggctctgagtctggcaacagaggagagccagaatgagagccataaacctggcggcagcgcaaaagatg

SEQ ID NO: 95281 - DNA, 103 bp, Artificial Sequence
  Synthetic Polynucleotide
taatacgactcactatagggactgagctgctcaacagggagctatggctcaacagaggagagagccaatgctccctgttaacctggcggcagcgcaaaagatg

SEQ ID NO: 95282 - DNA, 103 bp, Artificial Sequence
  Synthetic Polynucleotide
taatacgactcactatagggaggtgtgaggactgagctgctcaacagggaaacagaggagatccctgatgagcagctcaaacctggcggcagcgcaaaagatg

SEQ ID NO: 95283 - DNA, 103 bp, Artificial Sequence
  Synthetic Polynucleotide
taatacgactcactataggggactgctatcaggtgtgaggactgagctgcaacagaggagagcagctatgtcctcacacaacctggcggcagcgcaaaagatg

SEQ ID NO: 95284 - DNA, 103 bp, Artificial Sequence
  Synthetic Polynucleotide
taatacgactcactatagggagttttcccggactgctatcaggtgtgaggaacagaggagacctcacatgtgatagcagaacctggcggcagcgcaaaagatg

SEQ ID NO: 95285 - DNA, 103 bp, Artificial Sequence
  Synthetic Polynucleotide
taatacgactcactatagggagctgggtctagttttcccggactgctatcaacagaggagagatagcatgccgggaaaaaacctggcggcagcgcaaaagatg

SEQ ID NO: 95286 - DNA, 103 bp, Artificial Sequence
  Synthetic Polynucleotide
taatacgactcactataggggttgtgatggagctgggtctagttttcccgaacagaggagacgggaaatgtagacccagaacctggcggcagcgcaaaagatg

SEQ ID NO: 95287 - DNA, 103 bp, Artificial Sequence
  Synthetic Polynucleotide
taatacgactcactatagggcttggggatgaaggttgccggctgcccccaaacagaggagatgggggatgccggcaaccaacctggcggcagcgcaaaagatg

SEQ ID NO: 95288 - DNA, 103 bp, Artificial Sequence
  Synthetic Polynucleotide
taatacgactcactatagggtcctccgggggttgtgatggagctgggtctaacagaggagaagacccatgtccatcacaaacctggcggcagcgcaaaagatg

SEQ ID NO: 95289 - DNA, 103 bp, Artificial Sequence
  Synthetic Polynucleotide
taatacgactcactatagggaggctctggctcctccgggggttgtgatggaacagaggagaccatcaatgcccccggagaacctggcggcagcgcaaaagatg

SEQ ID NO: 95290 - DNA, 103 bp, Artificial Sequence
  Synthetic Polynucleotide
taatacgactcactatagggctgcctcatcaggctctggctcctccggggaacagaggagaccccggatgagccagagcaacctggcggcagcgcaaaagatg

SEQ ID NO: 95291 - DNA, 103 bp, Artificial Sequence
  Synthetic Polynucleotide
taatacgactcactataggggggctggattctgcctcatcaggctctggcaacagaggagagccagaatgtgatgaggcaacctggcggcagcgcaaaagatg

SEQ ID NO: 95292 - DNA, 103 bp, Artificial Sequence
  Synthetic Polynucleotide
taatacgactcactatagggttgaggatcagggctggattctgcctcatcaacagaggagagatgagatggaatccagcaacctggcggcagcgcaaaagatg

SEQ ID NO: 95293 - DNA, 103 bp, Artificial Sequence
  Synthetic Polynucleotide
taatacgactcactatagggaccagagtgcttgaggatcagggctggattaacagaggagaaatccaatgctgatcctcaacctggcggcagcgcaaaagatg

SEQ ID NO: 95294 - DNA, 103 bp, Artificial Sequence
  Synthetic Polynucleotide
taatacgactcactataggggagatgttaaaccagagtgcttgaggatcaaacagaggagatgatccatgagcactctgaacctggcggcagcgcaaaagatg

SEQ ID NO: 95295 - DNA, 103 bp, Artificial Sequence
  Synthetic Polynucleotide
taatacgactcactatagggcatctgggctgagatgttaaaccagagtgcaacagaggagagcactcatgtttaacatcaacctggcggcagcgcaaaagatg

SEQ ID NO: 95296 - DNA, 103 bp, Artificial Sequence
  Synthetic Polynucleotide
taatacgactcactatagggcattgcagggcatctgggctgagatgttaaaacagaggagattaacaatgcagcccagaaacctggcggcagcgcaaaagatg

SEQ ID NO: 95297 - DNA, 103 bp, Artificial Sequence
  Synthetic Polynucleotide
taatacgactcactataggggtgggggcagcattgcagggcatctgggctaacagaggagaagcccaatggccctgcaaaacctggcggcagcgcaaaagatg

SEQ ID NO: 95298 - DNA, 103 bp, Artificial Sequence
  Synthetic Polynucleotide
taatacgactcactatagggggcagcaggtgcagggggaaggccagtaaaaacagaggagatttactatgcttccccctaacctggcggcagcgcaaaagatg

SEQ ID NO: 95299 - DNA, 103 bp, Artificial Sequence
  Synthetic Polynucleotide
taatacgactcactatagggagtgttatgacttggggatgaaggttgccgaacagaggagacggcaaatgtcatccccaaacctggcggcagcgcaaaagatg

SEQ ID NO: 95300 - DNA, 103 bp, Artificial Sequence
  Synthetic Polynucleotide
taatacgactcactatagggagggggcggtgtgggggcagcattgcagggaacagaggagaccctgcatggctgcccccaacctggcggcagcgcaaaagatg

SEQ ID NO: 95301 - DNA, 103 bp, Artificial Sequence
  Synthetic Polynucleotide
taatacgactcactatagggcagaaactgcagggggcggtgtgggggcagaacagaggagactgcccatgcaccgccccaacctggcggcagcgcaaaagatg

SEQ ID NO: 95302 - DNA, 103 bp, Artificial Sequence
  Synthetic Polynucleotide
taatacgactcactatagggggttggtcctcagaaactgcagggggcggtaacagaggagaaccgccatgtgcagtttcaacctggcggcagcgcaaaagatg

SEQ ID NO: 95303 - DNA, 103 bp, Artificial Sequence
  Synthetic Polynucleotide
taatacgactcactatagggggagggagtgggttggtcctcagaaactgcaacagaggagagcagttatggaggaccaaaacctggcggcagcgcaaaagatg

SEQ ID NO: 95304 - DNA, 103 bp, Artificial Sequence
  Synthetic Polynucleotide
taatacgactcactataggggctgctgaggggagggagtgggttggtcctaacagaggagaaggaccatgccactccctaacctggcggcagcgcaaaagatg

SEQ ID NO: 95305 - DNA, 103 bp, Artificial Sequence
  Synthetic Polynucleotide
taatacgactcactataggggaggaggcaagctgctgaggggagggagtgaacagaggagacactccatgccctcagcaaacctggcggcagcgcaaaagatg

SEQ ID NO: 95306 - DNA, 103 bp, Artificial Sequence
  Synthetic Polynucleotide
taatacgactcactatagggcattggcttggaggaggcaagctgctgaggaacagaggagacctcagatgcttgcctccaacctggcggcagcgcaaaagatg

SEQ ID NO: 95307 - DNA, 103 bp, Artificial Sequence
  Synthetic Polynucleotide
taatacgactcactatagggtaggtctattcattggcttggaggaggcaaaacagaggagattgcctatgccaagccaaaacctggcggcagcgcaaaagatg

SEQ ID NO: 95308 - DNA, 103 bp, Artificial Sequence
  Synthetic Polynucleotide
taatacgactcactatagggttggcagcactaggtctattcattggcttgaacagaggagacaagccatggaatagaccaacctggcggcagcgcaaaagatg

SEQ ID NO: 95309 - DNA, 103 bp, Artificial Sequence
  Synthetic Polynucleotide
taatacgactcactatagggagaacaagggttggcagcactaggtctattaacagaggagaaatagaatgagtgctgccaacctggcggcagcgcaaaagatg

SEQ ID NO: 95310 - DNA, 103 bp, Artificial Sequence
  Synthetic Polynucleotide
taatacgactcactatagggcccgaaggttagtgttatgacttggggatgaacagaggagacatcccatggtcataacaaacctggcggcagcgcaaaagatg

SEQ ID NO: 95311 - DNA, 103 bp, Artificial Sequence
  Synthetic Polynucleotide
taatacgactcactatagggactgcactggagaacaagggttggcagcacaacagaggagagtgctgatgacccttgttaacctggcggcagcgcaaaagatg

SEQ ID NO: 95312 - DNA, 103 bp, Artificial Sequence
  Synthetic Polynucleotide
taatacgactcactataggggtggaagagaactgcactggagaacaagggaacagaggagacccttgatgtccagtgcaaacctggcggcagcgcaaaagatg

SEQ ID NO: 95313 - DNA, 103 bp, Artificial Sequence
  Synthetic Polynucleotide
taatacgactcactatagggagccaagggcgtggaagagaactgcactggaacagaggagaccagtgatgttctcttccaacctggcggcagcgcaaaagatg

SEQ ID NO: 95314 - DNA, 103 bp, Artificial Sequence
  Synthetic Polynucleotide
taatacgactcactataggggggccaacccagccaagggcgtggaagagaaacagaggagatctcttatgcgcccttggaacctggcggcagcgcaaaagatg

SEQ ID NO: 95315 - DNA, 103 bp, Artificial Sequence
  Synthetic Polynucleotide
taatacgactcactatagggcgcctcttaggggccaacccagccaagggcaacagaggagagcccttatgtgggttggcaacctggcggcagcgcaaaagatg

SEQ ID NO: 95316 - DNA, 103 bp, Artificial Sequence
  Synthetic Polynucleotide
taatacgactcactataggggtctcctgctcgcctcttaggggccaacccaacagaggagagggttgatgcctaagaggaacctggcggcagcgcaaaagatg

SEQ ID NO: 95317 - DNA, 103 bp, Artificial Sequence
  Synthetic Polynucleotide
taatacgactcactatagggtttctccagggtctcctgctcgcctcttagaacagaggagactaagaatggagcaggagaacctggcggcagcgcaaaagatg

SEQ ID NO: 95318 - DNA, 103 bp, Artificial Sequence
  Synthetic Polynucleotide
taatacgactcactatagggctctgtggcatttctccagggtctcctgctaacagaggagaagcaggatgccctggagaaacctggcggcagcgcaaaagatg

SEQ ID NO: 95319 - DNA, 103 bp, Artificial Sequence
  Synthetic Polynucleotide
taatacgactcactatagggccctgtgggactctgtggcatttctccaggaacagaggagacctggaatgatgccacagaacctggcggcagcgcaaaagatg

SEQ ID NO: 95320 - DNA, 103 bp, Artificial Sequence
  Synthetic Polynucleotide
taatacgactcactataggggctgtcccagccctgtgggactctgtggcaaacagaggagatgccacatggtcccacagaacctggcggcagcgcaaaagatg

SEQ ID NO: 95321 - DNA, 103 bp, Artificial Sequence
  Synthetic Polynucleotide
taatacgactcactatagggtggctcccagcccgaaggttagtgttatgaaacagaggagatcataaatgtaaccttcgaacctggcggcagcgcaaaagatg

SEQ ID NO: 95322 - DNA, 103 bp, Artificial Sequence
  Synthetic Polynucleotide
taatacgactcactatagggctccgtttgggctgtcccagccctgtgggaaacagaggagatcccacatggctgggacaaacctggcggcagcgcaaaagatg

SEQ ID NO: 95323 - DNA, 103 bp, Artificial Sequence
  Synthetic Polynucleotide
taatacgactcactatagggaggtctccctctccgtttgggctgtcccagaacagaggagactgggaatgcccaaacggaacctggcggcagcgcaaaagatg

SEQ ID NO: 95324 - DNA, 103 bp, Artificial Sequence
  Synthetic Polynucleotide
taatacgactcactatagggacttactgggaggtctccctctccgtttggaacagaggagaccaaacatggagggagacaacctggcggcagcgcaaaagatg

SEQ ID NO: 95325 - DNA, 103 bp, Artificial Sequence
  Synthetic Polynucleotide
taatacgactcactatagggtgtttgaagaacttactgggaggtctccctaacagaggagaagggagatgtcccagtaaaacctggcggcagcgcaaaagatg

SEQ ID NO: 95326 - DNA, 103 bp, Artificial Sequence
  Synthetic Polynucleotide
taatacgactcactatagggctgttccatctgtttgaagaacttactgggaacagaggagacccagtatgttcttcaaaaacctggcggcagcgcaaaagatg

SEQ ID NO: 95327 - DNA, 103 bp, Artificial Sequence
  Synthetic Polynucleotide
taatacgactcactatagggttaggtaacgctgttccatctgtttgaagaaacagaggagatcttcaatgagatggaacaacctggcggcagcgcaaaagatg

SEQ ID NO: 95328 - DNA, 103 bp, Artificial Sequence
  Synthetic Polynucleotide
taatacgactcactataggggtcagctgggttaggtaacgctgttccatcaacagaggagagatggaatggcgttacctaacctggcggcagcgcaaaagatg

SEQ ID NO: 95329 - DNA, 103 bp, Artificial Sequence
  Synthetic Polynucleotide
taatacgactcactatagggaggctgggctgtcagctgggttaggtaacgaacagaggagacgttacatgacccagctgaacctggcggcagcgcaaaagatg

SEQ ID NO: 95330 - DNA, 103 bp, Artificial Sequence
  Synthetic Polynucleotide
taatacgactcactatagggcaggtgggacaggctgggctgtcagctgggaacagaggagacccagcatgcagcccagcaacctggcggcagcgcaaaagatg

SEQ ID NO: 95331 - DNA, 103 bp, Artificial Sequence
  Synthetic Polynucleotide
taatacgactcactataggggagcacatctcaggtgggacaggctgggctaacagaggagaagcccaatgtgtcccaccaacctggcggcagcgcaaaagatg

SEQ ID NO: 95332 - DNA, 103 bp, Artificial Sequence
  Synthetic Polynucleotide
taatacgactcactatagggccagaactcttggctcccagcccgaaggttaacagaggagaaaccttatggctgggagcaacctggcggcagcgcaaaagatg

SEQ ID NO: 95333 - DNA, 103 bp, Artificial Sequence
  Synthetic Polynucleotide
taatacgactcactatagggccaccagcctgagcacatctcaggtgggacaacagaggagagtcccaatggagatgtgcaacctggcggcagcgcaaaagatg

SEQ ID NO: 95334 - DNA, 103 bp, Artificial Sequence
  Synthetic Polynucleotide
taatacgactcactatagggctcgtatccaccaccagcctgagcacatctaacagaggagaagatgtatgcaggctggtaacctggcggcagcgcaaaagatg

SEQ ID NO: 95335 - DNA, 103 bp, Artificial Sequence
  Synthetic Polynucleotide
taatacgactcactatagggatctcaggatctcgtatccaccaccagcctaacagaggagaaggctgatggtggatacgaacctggcggcagcgcaaaagatg

SEQ ID NO: 95336 - DNA, 103 bp, Artificial Sequence
  Synthetic Polynucleotide
taatacgactcactatagggggcatccaacatctcaggatctcgtatccaaacagaggagatggataatggatcctgagaacctggcggcagcgcaaaagatg

SEQ ID NO: 95337 - DNA, 103 bp, Artificial Sequence
  Synthetic Polynucleotide
taatacgactcactatagggccttgagcatggcatccaacatctcaggataacagaggagaatcctgatgtgttggatgaacctggcggcagcgcaaaagatg

SEQ ID NO: 95338 - DNA, 103 bp, Artificial Sequence
  Synthetic Polynucleotide
taatacgactcactataggggggtgtagggccttgagcatggcatccaacaacagaggagagttggaatgcatgctcaaaacctggcggcagcgcaaaagatg

SEQ ID NO: 95339 - DNA, 103 bp, Artificial Sequence
  Synthetic Polynucleotide
taatacgactcactataggggatacctcgggggtgtagggccttgagcataacagaggagaatgctcatggccctacacaacctggcggcagcgcaaaagatg

SEQ ID NO: 95340 - DNA, 103 bp, Artificial Sequence
  Synthetic Polynucleotide
taatacgactcactatagggccttctcccggatacctcgggggtgtagggaacagaggagaccctacatgcccgaggtaaacctggcggcagcgcaaaagatg

SEQ ID NO: 95341 - DNA, 103 bp, Artificial Sequence
  Synthetic Polynucleotide
taatacgactcactatagggttgtgaagtgccttctcccggatacctcggaacagaggagaccgaggatgccgggagaaaacctggcggcagcgcaaaagatg

SEQ ID NO: 95342 - DNA, 103 bp, Artificial Sequence
  Synthetic Polynucleotide
taatacgactcactataggggttaaggtgtttgtgaagtgccttctcccgaacagaggagacgggagatggcacttcacaacctggcggcagcgcaaaagatg

SEQ ID NO: 95343 - DNA, 103 bp, Artificial Sequence
  Synthetic Polynucleotide
taatacgactcactatagggtaccgttggcccagaactcttggctcccagaacagaggagactgggaatgaagagttctaacctggcggcagcgcaaaagatg

SEQ ID NO: 95344 - DNA, 103 bp, Artificial Sequence
  Synthetic Polynucleotide
taatacgactcactatagggccctgtgcttgttaaggtgtttgtgaagtgaacagaggagacacttcatgaacaccttaaacctggcggcagcgcaaaagatg

SEQ ID NO: 95345 - DNA, 103 bp, Artificial Sequence
  Synthetic Polynucleotide
taatacgactcactatagggtgcaagaagtccctgtgcttgttaaggtgtaacagaggagaacacctatgcaagcacagaacctggcggcagcgcaaaagatg

SEQ ID NO: 95346 - DNA, 103 bp, Artificial Sequence
  Synthetic Polynucleotide
taatacgactcactataggggcagacttcctgcaagaagtccctgtgcttaacagaggagaaagcacatggacttcttgaacctggcggcagcgcaaaagatg

SEQ ID NO: 95347 - DNA, 103 bp, Artificial Sequence
  Synthetic Polynucleotide
taatacgactcactatagggagggccgcaggcagacttcctgcaagaagtaacagaggagaacttctatgaggaagtctaacctggcggcagcgcaaaagatg

SEQ ID NO: 95348 - DNA, 103 bp, Artificial Sequence
  Synthetic Polynucleotide
taatacgactcactataggggggtcagctgagggccgcaggcagacttccaacagaggagaggaagtatgcctgcggccaacctggcggcagcgcaaaagatg

SEQ ID NO: 95349 - DNA, 103 bp, Artificial Sequence
  Synthetic Polynucleotide
taatacgactcactatagggctcaaagatggggtcagctgagggccgcagaacagaggagactgcggatgtcagctgacaacctggcggcagcgcaaaagatg

SEQ ID NO: 95350 - DNA, 103 bp, Artificial Sequence
  Synthetic Polynucleotide
taatacgactcactataggggttgcctgggctcaaagatggggtcagctgaacagaggagacagctgatgccatctttgaacctggcggcagcgcaaaagatg

SEQ ID NO: 95351 - DNA, 103 bp, Artificial Sequence
  Synthetic Polynucleotide
taatacgactcactatagggaaggcaggtagttgcctgggctcaaagatgaacagaggagacatcttatggcccaggcaaacctggcggcagcgcaaaagatg

SEQ ID NO: 95352 - DNA, 103 bp, Artificial Sequence
  Synthetic Polynucleotide
taatacgactcactatagggcccttcttgaaaggcaggtagttgcctgggaacagaggagacccaggatgctacctgccaacctggcggcagcgcaaaagatg

SEQ ID NO: 95353 - DNA, 103 bp, Artificial Sequence
  Synthetic Polynucleotide
taatacgactcactatagggagctcataatcccttcttgaaaggcaggtaaacagaggagatacctgatgttcaagaagaacctggcggcagcgcaaaagatg

SEQ ID NO: 95354 - DNA, 103 bp, Artificial Sequence
  Synthetic Polynucleotide
taatacgactcactatagggggactctgggtaccgttggcccagaactctaacagaggagaagagttatgggccaacggaacctggcggcagcgcaaaagatg

SEQ ID NO: 95355 - DNA, 103 bp, Artificial Sequence
  Synthetic Polynucleotide
taatacgactcactatagggttgggggaccagctcataatcccttcttgaaacagaggagatcaagaatggattatgagaacctggcggcagcgcaaaagatg

SEQ ID NO: 95356 - DNA, 103 bp, Artificial Sequence
  Synthetic Polynucleotide
taatacgactcactatagggtgtcttctctttgggggaccagctcataataacagaggagaattatgatgtggtcccccaacctggcggcagcgcaaaagatg

SEQ ID NO: 95357 - DNA, 103 bp, Artificial Sequence
  Synthetic Polynucleotide
taatacgactcactatagggctgtctcgtatgtcttctctttgggggaccaacagaggagaggtcccatgaagagaagaaacctggcggcagcgcaaaagatg

SEQ ID NO: 95358 - DNA, 103 bp, Artificial Sequence
  Synthetic Polynucleotide
taatacgactcactatagggactgctaggtctgtctcgtatgtcttctctaacagaggagaagagaaatgatacgagacaacctggcggcagcgcaaaagatg

SEQ ID NO: 95359 - DNA, 103 bp, Artificial Sequence
  Synthetic Polynucleotide
taatacgactcactatagggccattgaagcactgctaggtctgtctcgtaaacagaggagatacgagatggacctagcaaacctggcggcagcgcaaaagatg

SEQ ID NO: 95360 - DNA, 103 bp, Artificial Sequence
  Synthetic Polynucleotide
taatacgactcactataggggctcctctacccattgaagcactgctaggtaacagaggagaacctagatgtgcttcaataacctggcggcagcgcaaaagatg

SEQ ID NO: 95361 - DNA, 103 bp, Artificial Sequence
  Synthetic Polynucleotide
taatacgactcactatagggcgctgctccagctcctctacccattgaagcaacagaggagagcttcaatgggtagaggaaacctggcggcagcgcaaaagatg

SEQ ID NO: 95362 - DNA, 103 bp, Artificial Sequence
  Synthetic Polynucleotide
taatacgactcactatagggcatgataacccgctgctccagctcctctacaacagaggagagtagagatgctggagcagaacctggcggcagcgcaaaagatg

SEQ ID NO: 95363 - DNA, 103 bp, Artificial Sequence
  Synthetic Polynucleotide
taatacgactcactataggggcagatcagacatgataacccgctgctccaaacagaggagatggagcatggggttatcaaacctggcggcagcgcaaaagatg

SEQ ID NO: 95364 - DNA, 103 bp, Artificial Sequence
  Synthetic Polynucleotide
taatacgactcactatagggccccgaatctgcagatcagacatgataaccaacagaggagaggttatatggtctgatctaacctggcggcagcgcaaaagatg

SEQ ID NO: 95365 - DNA, 103 bp, Artificial Sequence
  Synthetic Polynucleotide
taatacgactcactatagggaagccccatgggactctgggtaccgttggcaacagaggagagccaacatgacccagagtaacctggcggcagcgcaaaagatg

SEQ ID NO: 95366 - DNA, 103 bp, Artificial Sequence
  Synthetic Polynucleotide
taatacgactcactatagggacatgtccagccccgaatctgcagatcagaaacagaggagatctgatatgcagattcggaacctggcggcagcgcaaaagatg

SEQ ID NO: 95367 - DNA, 103 bp, Artificial Sequence
  Synthetic Polynucleotide
taatacgactcactatagggctgggctaggacatgtccagccccgaatctaacagaggagaagattcatggctggacataacctggcggcagcgcaaaagatg

SEQ ID NO: 95368 - DNA, 103 bp, Artificial Sequence
  Synthetic Polynucleotide
taatacgactcactatagggcgggtagagtctgggctaggacatgtccagaacagaggagactggacatgtcctagcccaacctggcggcagcgcaaaagatg

SEQ ID NO: 95369 - DNA, 103 bp, Artificial Sequence
  Synthetic Polynucleotide
taatacgactcactatagggcaagtcttcacgggtagagtctgggctaggaacagaggagacctagcatggactctaccaacctggcggcagcgcaaaagatg

SEQ ID NO: 95370 - DNA, 103 bp, Artificial Sequence
  Synthetic Polynucleotide
taatacgactcactatagggcacagtaggccaagtcttcacgggtagagtaacagaggagaactctaatggtgaagactaacctggcggcagcgcaaaagatg

SEQ ID NO: 95371 - DNA, 103 bp, Artificial Sequence
  Synthetic Polynucleotide
taatacgactcactataggggagaggtgctcacagtaggccaagtcttcaaacagaggagatgaagaatgggcctactgaacctggcggcagcgcaaaagatg

SEQ ID NO: 95372 - DNA, 103 bp, Artificial Sequence
  Synthetic Polynucleotide
taatacgactcactatagggctgggagtcggagaggtgctcacagtaggcaacagaggagagcctacatggagcacctcaacctggcggcagcgcaaaagatg

SEQ ID NO: 95373 - DNA, 103 bp, Artificial Sequence
  Synthetic Polynucleotide
taatacgactcactatagggtgatatcctcctgggagtcggagaggtgctaacagaggagaagcaccatgccgactcccaacctggcggcagcgcaaaagatg

SEQ ID NO: 95374 - DNA, 103 bp, Artificial Sequence
  Synthetic Polynucleotide
taatacgactcactatagggcctcgccaggtgatatcctcctgggagtcgaacagaggagacgactcatgggaggatataacctggcggcagcgcaaaagatg

SEQ ID NO: 95375 - DNA, 103 bp, Artificial Sequence
  Synthetic Polynucleotide
taatacgactcactatagggcctgccccgacctcgccaggtgatatcctcaacagaggagagaggatatgacctggcgaaacctggcggcagcgcaaaagatg

SEQ ID NO: 95376 - DNA, 103 bp, Artificial Sequence
  Synthetic Polynucleotide
taatacgactcactatagggaatcaaagttaagccccatgggactctgggaacagaggagacccagaatgccatggggcaacctggcggcagcgcaaaagatg

SEQ ID NO: 95377 - DNA, 103 bp, Artificial Sequence
  Synthetic Polynucleotide
taatacgactcactatagggccagtccctccctgccccgacctcgccaggaacagaggagacctggcatggtcggggcaaacctggcggcagcgcaaaagatg

SEQ ID NO: 95378 - DNA, 103 bp, Artificial Sequence
  Synthetic Polynucleotide
taatacgactcactatagggcgctgaggtgccagtccctccctgccccgaaacagaggagatcggggatgggagggactaacctggcggcagcgcaaaagatg

SEQ ID NO: 95379 - DNA, 103 bp, Artificial Sequence
  Synthetic Polynucleotide
taatacgactcactatagggggtagttttacgctgaggtgccagtccctcaacagaggagagagggaatggcacctcagaacctggcggcagcgcaaaagatg

SEQ ID NO: 95380 - DNA, 103 bp, Artificial Sequence
  Synthetic Polynucleotide
taatacgactcactatagggccaaagggttggtagttttacgctgaggtgaacagaggagacacctcatggtaaaactaaacctggcggcagcgcaaaagatg

SEQ ID NO: 95381 - DNA, 103 bp, Artificial Sequence
  Synthetic Polynucleotide
taatacgactcactatagggacagccaggtccaaagggttggtagttttaaacagaggagataaaacatgcaaccctttaacctggcggcagcgcaaaagatg

SEQ ID NO: 95382 - DNA, 103 bp, Artificial Sequence
  Synthetic Polynucleotide
taatacgactcactatagggcagccgcatcacagccaggtccaaagggttaacagaggagaaaccctatggacctggctaacctggcggcagcgcaaaagatg

SEQ ID NO: 95383 - DNA, 103 bp, Artificial Sequence
  Synthetic Polynucleotide
taatacgactcactatagggccagggcagccagccgcatcacagccaggtaacagaggagaacctggatgtgatgcggcaacctggcggcagcgcaaaagatg

SEQ ID NO: 95384 - DNA, 103 bp, Artificial Sequence
  Synthetic Polynucleotide
taatacgactcactatagggacattctgttccagggcagccagccgcatcaacagaggagagatgcgatgggctgccctaacctggcggcagcgcaaaagatg

SEQ ID NO: 95385 - DNA, 103 bp, Artificial Sequence
  Synthetic Polynucleotide
taatacgactcactatagggccgccgttctacattctgttccagggcagcaacagaggagagctgccatggaacagaataacctggcggcagcgcaaaagatg

SEQ ID NO: 95386 - DNA, 103 bp, Artificial Sequence
  Synthetic Polynucleotide
taatacgactcactatagggcccgcaggtaccgccgttctacattctgttaacagaggagaaacagaatgtagaacggcaacctggcggcagcgcaaaagatg

SEQ ID NO: 95387 - DNA, 103 bp, Artificial Sequence
  Synthetic Polynucleotide
taatacgactcactatagggagttcttgtgaatcaaagttaagccccatgaacagaggagacatgggatgtaactttgaaacctggcggcagcgcaaaagatg

SEQ ID NO: 95388 - DNA, 103 bp, Artificial Sequence
  Synthetic Polynucleotide
taatacgactcactatagggcagaggggctcccgcaggtaccgccgttctaacagaggagaagaacgatggtacctgcgaacctggcggcagcgcaaaagatg

SEQ ID NO: 95389 - DNA, 103 bp, Artificial Sequence
  Synthetic Polynucleotide
taatacgactcactatagggatgagttggccagaggggctcccgcaggtaaacagaggagatacctgatggagcccctcaacctggcggcagcgcaaaagatg

SEQ ID NO: 95390 - DNA, 103 bp, Artificial Sequence
  Synthetic Polynucleotide
taatacgactcactataggggcacaacctcatgagttggccagaggggctaacagaggagaagccccatgggccaactcaacctggcggcagcgcaaaagatg

SEQ ID NO: 95391 - DNA, 103 bp, Artificial Sequence
  Synthetic Polynucleotide
taatacgactcactataggggccttctccagcacaacctcatgagttggcaacagaggagagccaacatgtgaggttgtaacctggcggcagcgcaaaagatg

SEQ ID NO: 95392 - DNA, 103 bp, Artificial Sequence
  Synthetic Polynucleotide
taatacgactcactataggggctaagcagggccttctccagcacaacctcaacagaggagagaggttatgctggagaagaacctggcggcagcgcaaaagatg

SEQ ID NO: 95393 - DNA, 103 bp, Artificial Sequence
  Synthetic Polynucleotide
taatacgactcactatagggcattaggtgtgctaagcagggccttctccaaacagaggagatggagaatgccctgcttaaacctggcggcagcgcaaaagatg

SEQ ID NO: 95394 - DNA, 103 bp, Artificial Sequence
  Synthetic Polynucleotide
taatacgactcactatagggtcaggggcaccattaggtgtgctaagcaggaacagaggagacctgctatgcacacctaaaacctggcggcagcgcaaaagatg

SEQ ID NO: 95395 - DNA, 103 bp, Artificial Sequence
  Synthetic Polynucleotide
taatacgactcactatagggagtggtgccctcaggggcaccattaggtgtaacagaggagaacacctatgggtgcccctaacctggcggcagcgcaaaagatg

SEQ ID NO: 95396 - DNA, 103 bp, Artificial Sequence
  Synthetic Polynucleotide
taatacgactcactatagggatatctctgtagtggtgccctcaggggcacaacagaggagagtgcccatgagggcaccaaacctggcggcagcgcaaaagatg

SEQ ID NO: 95397 - DNA, 103 bp, Artificial Sequence
  Synthetic Polynucleotide
taatacgactcactatagggatctcatatgatatctctgtagtggtgcccaacagaggagagggcacatgtacagagataacctggcggcagcgcaaaagatg

SEQ ID NO: 95398 - DNA, 103 bp, Artificial Sequence
  Synthetic Polynucleotide
taatacgactcactatagggggaatcatacagttcttgtgaatcaaagttaacagaggagaaactttatgtcacaagaaaacctggcggcagcgcaaaagatg

SEQ ID NO: 95399 - DNA, 103 bp, Artificial Sequence
  Synthetic Polynucleotide
taatacgactcactataggggcgaggggtgatctcatatgatatctctgtaacagaggagaacagagatgtcatatgagaacctggcggcagcgcaaaagatg

SEQ ID NO: 95400 - DNA, 103 bp, Artificial Sequence
  Synthetic Polynucleotide
taatacgactcactatagggagacacgaatgcgaggggtgatctcatatgaacagaggagacatatgatgtcacccctcaacctggcggcagcgcaaaagatg

SEQ ID NO: 95401 - DNA, 103 bp, Artificial Sequence
  Synthetic Polynucleotide
taatacgactcactataggggtctggcgccagacacgaatgcgaggggtgaacagaggagacaccccatgcattcgtgtaacctggcggcagcgcaaaagatg

SEQ ID NO: 95402 - DNA, 103 bp, Artificial Sequence
  Synthetic Polynucleotide
taatacgactcactatagggccgctcgagggtctggcgccagacacgaataacagaggagaattcgtatgtggcgccagaacctggcggcagcgcaaaagatg

SEQ ID NO: 95403 - DNA, 103 bp, Artificial Sequence
  Synthetic Polynucleotide
taatacgactcactatagggcgctccggcaccgctcgagggtctggcgccaacagaggagaggcgccatgccctcgagcaacctggcggcagcgcaaaagatg

SEQ ID NO: 95404 - DNA, 103 bp, Artificial Sequence
  Synthetic Polynucleotide
taatacgactcactatagggacctgggctgcgctccggcaccgctcgaggaacagaggagacctcgaatggtgccggagaacctggcggcagcgcaaaagatg

SEQ ID NO: 95405 - DNA, 103 bp, Artificial Sequence
  Synthetic Polynucleotide
taatacgactcactataggggcacaagcacacctgggctgcgctccggcaaacagaggagatgccggatggcagcccagaacctggcggcagcgcaaaagatg

SEQ ID NO: 95406 - DNA, 103 bp, Artificial Sequence
  Synthetic Polynucleotide
taatacgactcactataggggctggcccaggcacaagcacacctgggctgaacagaggagacagcccatgtgtgcttgtaacctggcggcagcgcaaaagatg

SEQ ID NO: 95407 - DNA, 103 bp, Artificial Sequence
  Synthetic Polynucleotide
taatacgactcactataggggacctctccagctggcccaggcacaagcacaacagaggagagtgcttatgcctgggccaaacctggcggcagcgcaaaagatg

SEQ ID NO: 95408 - DNA, 103 bp, Artificial Sequence
  Synthetic Polynucleotide
taatacgactcactatagggccaggcaatggacctctccagctggcccagaacagaggagactgggcatgctggagaggaacctggcggcagcgcaaaagatg

SEQ ID NO: 95409 - DNA, 103 bp, Artificial Sequence
  Synthetic Polynucleotide
taatacgactcactatagggtcagtcctgaggcagcaggtgcagggggaaaacagaggagattccccatgcacctgctgaacctggcggcagcgcaaaagatg

SEQ ID NO: 95410 - DNA, 103 bp, Artificial Sequence
  Synthetic Polynucleotide
taatacgactcactatagggggtcaggaaaggaatcatacagttcttgtgaacagaggagacacaagatgtgtatgattaacctggcggcagcgcaaaagatg

SEQ ID NO: 95411 - DNA, 103 bp, Artificial Sequence
  Synthetic Polynucleotide
taatacgactcactatagggcagacttctcccaggcaatggacctctccaaacagaggagatggagaatgccattgcctaacctggcggcagcgcaaaagatg

SEQ ID NO: 95412 - DNA, 103 bp, Artificial Sequence
  Synthetic Polynucleotide
taatacgactcactatagggactttgttgacagacttctcccaggcaatgaacagaggagacattgcatgggagaagtcaacctggcggcagcgcaaaagatg

SEQ ID NO: 95413 - DNA, 103 bp, Artificial Sequence
  Synthetic Polynucleotide
taatacgactcactatagggtagacatgtcactttgttgacagacttctcaacagaggagagagaagatggtcaacaaaaacctggcggcagcgcaaaagatg

SEQ ID NO: 95414 - DNA, 103 bp, Artificial Sequence
  Synthetic Polynucleotide
taatacgactcactatagggtccggcagactagacatgtcactttgttgaaacagaggagatcaacaatgtgacatgtcaacctggcggcagcgcaaaagatg

SEQ ID NO: 95415 - DNA, 103 bp, Artificial Sequence
  Synthetic Polynucleotide
taatacgactcactatagggttgtcacccttccggcagactagacatgtcaacagaggagagacatgatgagtctgccgaacctggcggcagcgcaaaagatg

SEQ ID NO: 95416 - DNA, 103 bp, Artificial Sequence
  Synthetic Polynucleotide
taatacgactcactatagggaaactcatcattgtcacccttccggcagacaacagaggagagtctgcatgaagggtgacaacctggcggcagcgcaaaagatg

SEQ ID NO: 95417 - DNA, 103 bp, Artificial Sequence
  Synthetic Polynucleotide
taatacgactcactatagggaaagcagaagaaactcatcattgtcaccctaacagaggagaagggtgatgatgatgagtaacctggcggcagcgcaaaagatg

SEQ ID NO: 95418 - DNA, 103 bp, Artificial Sequence
  Synthetic Polynucleotide
taatacgactcactatagggcacccatcacaaagcagaagaaactcatcaaacagaggagatgatgaatgtcttctgctaacctggcggcagcgcaaaagatg

SEQ ID NO: 95419 - DNA, 103 bp, Artificial Sequence
  Synthetic Polynucleotide
taatacgactcactataggggccacggtcacacccatcacaaagcagaagaacagaggagacttctgatgtgtgatgggaacctggcggcagcgcaaaagatg

SEQ ID NO: 95420 - DNA, 103 bp, Artificial Sequence
  Synthetic Polynucleotide
taatacgactcactatagggaaatgtggcagccacggtcacacccatcacaacagaggagagtgatgatggtgaccgtgaacctggcggcagcgcaaaagatg

SEQ ID NO: 95421 - DNA, 103 bp, Artificial Sequence
  Synthetic Polynucleotide
taatacgactcactatagggtcaaaattctggtcaggaaaggaatcatacaacagaggagagtatgaatgctttcctgaaacctggcggcagcgcaaaagatg

SEQ ID NO: 95422 - DNA, 103 bp, Artificial Sequence
  Synthetic Polynucleotide
taatacgactcactatagggcgatggcagtaaatgtggcagccacggtcaaacagaggagatgaccgatgctgccacataacctggcggcagcgcaaaagatg

SEQ ID NO: 95423 - DNA, 103 bp, Artificial Sequence
  Synthetic Polynucleotide
taatacgactcactatagggcatcttgggacgatggcagtaaatgtggcaaacagaggagatgccacatgtactgccataacctggcggcagcgcaaaagatg

SEQ ID NO: 95424 - DNA, 103 bp, Artificial Sequence
  Synthetic Polynucleotide
taatacgactcactatagggggacagcctccatcttgggacgatggcagtaacagaggagaactgccatggtcccaagaaacctggcggcagcgcaaaagatg

SEQ ID NO: 95425 - DNA, 103 bp, Artificial Sequence
  Synthetic Polynucleotide
taatacgactcactatagggtctccttctgggacagcctccatcttgggaaacagaggagatcccaaatgggaggctgtaacctggcggcagcgcaaaagatg

SEQ ID NO: 95426 - DNA, 103 bp, Artificial Sequence
  Synthetic Polynucleotide
taatacgactcactatagggacagaaccaatctccttctgggacagcctcaacagaggagagaggctatgccagaaggaaacctggcggcagcgcaaaagatg

SEQ ID NO: 95427 - DNA, 103 bp, Artificial Sequence
  Synthetic Polynucleotide
taatacgactcactatagggaacagacagtacagaaccaatctccttctgaacagaggagacagaagatgattggttctaacctggcggcagcgcaaaagatg

SEQ ID NO: 95428 - DNA, 103 bp, Artificial Sequence
  Synthetic Polynucleotide
taatacgactcactatagggtgctgagccaaacagacagtacagaaccaaaacagaggagattggttatgtactgtctgaacctggcggcagcgcaaaagatg

SEQ ID NO: 95429 - DNA, 103 bp, Artificial Sequence
  Synthetic Polynucleotide
taatacgactcactatagggtccctccacctgctgagccaaacagacagtaacagaggagaactgtcatgttggctcagaacctggcggcagcgcaaaagatg

SEQ ID NO: 95430 - DNA, 103 bp, Artificial Sequence
  Synthetic Polynucleotide
taatacgactcactataggggagtgaattctccctccacctgctgagccaaacagaggagatggctcatgaggtggaggaacctggcggcagcgcaaaagatg

SEQ ID NO: 95431 - DNA, 103 bp, Artificial Sequence
  Synthetic Polynucleotide
taatacgactcactatagggccaggcttctgagtgaattctccctccaccaacagaggagaggtggaatgagaattcacaacctggcggcagcgcaaaagatg

SEQ ID NO: 95432 - DNA, 103 bp, Artificial Sequence
  Synthetic Polynucleotide
taatacgactcactataggggggcatcacctcaaaattctggtcaggaaaaacagaggagatttcctatgcagaattttaacctggcggcagcgcaaaagatg

SEQ ID NO: 95433 - DNA, 103 bp, Artificial Sequence
  Synthetic Polynucleotide
taatacgactcactatagggctttgggaaaccaggcttctgagtgaattcaacagaggagagaattcatgcagaagcctaacctggcggcagcgcaaaagatg

SEQ ID NO: 95434 - DNA, 103 bp, Artificial Sequence
  Synthetic Polynucleotide
taatacgactcactatagggtctggccacgctttgggaaaccaggcttctaacagaggagaagaagcatggtttcccaaaacctggcggcagcgcaaaagatg

SEQ ID NO: 95435 - DNA, 103 bp, Artificial Sequence
  Synthetic Polynucleotide
taatacgactcactatagggcttttccgcttctggccacgctttgggaaaaacagaggagatttcccatggcgtggccaaacctggcggcagcgcaaaagatg

SEQ ID NO: 95436 - DNA, 103 bp, Artificial Sequence
  Synthetic Polynucleotide
taatacgactcactatagggcgaataaccacttttccgcttctggccacgaacagaggagacgtggcatgaagcggaaaaacctggcggcagcgcaaaagatg

SEQ ID NO: 95437 - DNA, 103 bp, Artificial Sequence
  Synthetic Polynucleotide
taatacgactcactatagggagaagttcagcgaataaccacttttccgctaacagaggagaagcggaatggtggttattaacctggcggcagcgcaaaagatg

SEQ ID NO: 95438 - DNA, 103 bp, Artificial Sequence
  Synthetic Polynucleotide
taatacgactcactatagggtcaccctctgagaagttcagcgaataaccaaacagaggagatggttaatggctgaacttaacctggcggcagcgcaaaagatg

SEQ ID NO: 95439 - DNA, 103 bp, Artificial Sequence
  Synthetic Polynucleotide
taatacgactcactatagggtcggcggccatcaccctctgagaagttcagaacagaggagactgaacatgtcagagggtaacctggcggcagcgcaaaagatg

SEQ ID NO: 95440 - DNA, 103 bp, Artificial Sequence
  Synthetic Polynucleotide
taatacgactcactataggggtacccggcgtcggcggccatcaccctctgaacagaggagacagaggatgatggccgccaacctggcggcagcgcaaaagatg

SEQ ID NO: 95441 - DNA, 103 bp, Artificial Sequence
  Synthetic Polynucleotide
taatacgactcactatagggcccctcaacagtacccggcgtcggcggccaaacagaggagatggccgatgacgccgggtaacctggcggcagcgcaaaagatg

SEQ ID NO: 95442 - DNA, 103 bp, Artificial Sequence
  Synthetic Polynucleotide
taatacgactcactataggggctttctcggcccctcaacagtacccggcgaacagaggagacgccggatgctgttgaggaacctggcggcagcgcaaaagatg

SEQ ID NO: 95443 - DNA, 103 bp, Artificial Sequence
  Synthetic Polynucleotide
taatacgactcactatagggggggtccattgggcatcacctcaaaattctaacagaggagaagaattatgaggtgatgcaacctggcggcagcgcaaaagatg

SEQ ID NO: 95444 - DNA, 103 bp, Artificial Sequence
  Synthetic Polynucleotide
taatacgactcactatagggctgctgctgggctttctcggcccctcaacaaacagaggagatgttgaatggccgagaaaaacctggcggcagcgcaaaagatg

SEQ ID NO: 95445 - DNA, 103 bp, Artificial Sequence
  Synthetic Polynucleotide
taatacgactcactatagggtaccgaggccctgctgctgggctttctcggaacagaggagaccgagaatgcccagcagcaacctggcggcagcgcaaaagatg

SEQ ID NO: 95446 - DNA, 103 bp, Artificial Sequence
  Synthetic Polynucleotide
taatacgactcactatagggttcttccgagtaccgaggccctgctgctggaacagaggagaccagcaatggggcctcggaacctggcggcagcgcaaaagatg

SEQ ID NO: 95447 - DNA, 103 bp, Artificial Sequence
  Synthetic Polynucleotide
taatacgactcactataggggggagagcccttcttccgagtaccgaggccaacagaggagaggcctcatgactcggaagaacctggcggcagcgcaaaagatg

SEQ ID NO: 95448 - DNA, 103 bp, Artificial Sequence
  Synthetic Polynucleotide
taatacgactcactatagggcgcttggagggggagagcccttcttccgagaacagaggagactcggaatgagggctctcaacctggcggcagcgcaaaagatg

SEQ ID NO: 95449 - DNA, 103 bp, Artificial Sequence
  Synthetic Polynucleotide
taatacgactcactataggggagtcgccgccgcttggagggggagagcccaacagaggagagggctcatgccctccaagaacctggcggcagcgcaaaagatg

SEQ ID NO: 95450 - DNA, 103 bp, Artificial Sequence
  Synthetic Polynucleotide
taatacgactcactatagggtccgcatagagagtcgccgccgcttggaggaacagaggagacctccaatgggcggcgacaacctggcggcagcgcaaaagatg

SEQ ID NO: 95451 - DNA, 103 bp, Artificial Sequence
  Synthetic Polynucleotide
taatacgactcactatagggctgtggtggttccgcatagagagtcgccgcaacagaggagagcggcgatgctctatgcgaacctggcggcagcgcaaaagatg

SEQ ID NO: 95452 - DNA, 103 bp, Artificial Sequence
  Synthetic Polynucleotide
taatacgactcactatagggtgtgagatcactgtggtggttccgcatagaaacagaggagatctatgatgaaccaccacaacctggcggcagcgcaaaagatg

SEQ ID NO: 95453 - DNA, 103 bp, Artificial Sequence
  Synthetic Polynucleotide
taatacgactcactatagggtctcgcaaaatgtgagatcactgtggtggtaacagaggagaaccaccatggtgatctcaaacctggcggcagcgcaaaagatg

SEQ ID NO: 95454 - DNA, 103 bp, Artificial Sequence
  Synthetic Polynucleotide
taatacgactcactatagggaaaaaactagggggtccattgggcatcaccaacagaggagaggtgatatgcaatggaccaacctggcggcagcgcaaaagatg

SEQ ID NO: 95455 - DNA, 103 bp, Artificial Sequence
  Synthetic Polynucleotide
taatacgactcactatagggatcaggataatctcgcaaaatgtgagatcaaacagaggagatgatctatgattttgcgaaacctggcggcagcgcaaaagatg

SEQ ID NO: 95456 - DNA, 103 bp, Artificial Sequence
  Synthetic Polynucleotide
taatacgactcactatagggctccatctccatcaggataatctcgcaaaaaacagaggagattttgcatgattatcctgaacctggcggcagcgcaaaagatg

SEQ ID NO: 95457 - DNA, 103 bp, Artificial Sequence
  Synthetic Polynucleotide
taatacgactcactatagggcatcatgggactccatctccatcaggataaaacagaggagattatccatgtggagatggaacctggcggcagcgcaaaagatg

SEQ ID NO: 95458 - DNA, 103 bp, Artificial Sequence
  Synthetic Polynucleotide
taatacgactcactatagggggccaggctgcatcatgggactccatctccaacagaggagaggagatatggtcccatgaaacctggcggcagcgcaaaagatg

SEQ ID NO: 95459 - DNA, 103 bp, Artificial Sequence
  Synthetic Polynucleotide
taatacgactcactatagggctctaggaaaggccaggctgcatcatgggaaacagaggagatcccatatggcagcctggaacctggcggcagcgcaaaagatg

SEQ ID NO: 95460 - DNA, 103 bp, Artificial Sequence
  Synthetic Polynucleotide
taatacgactcactatagggggttcacaggctctaggaaaggccaggctgaacagaggagacagcctatgctttcctagaacctggcggcagcgcaaaagatg

SEQ ID NO: 95461 - DNA, 103 bp, Artificial Sequence
  Synthetic Polynucleotide
taatacgactcactatagggaccaaacgtgggttcacaggctctaggaaaaacagaggagatttcctatggcctgtgaaaacctggcggcagcgcaaaagatg

SEQ ID NO: 95462 - DNA, 103 bp, Artificial Sequence
  Synthetic Polynucleotide
taatacgactcactataggggtacccactcaccaaacgtgggttcacaggaacagaggagacctgtgatgccacgtttgaacctggcggcagcgcaaaagatg

SEQ ID NO: 95463 - DNA, 103 bp, Artificial Sequence
  Synthetic Polynucleotide
taatacgactcactatagggtgatgcgccggtacccactcaccaaacgtgaacagaggagacacgttatgtgagtgggtaacctggcggcagcgcaaaagatg

SEQ ID NO: 95464 - DNA, 103 bp, Artificial Sequence
  Synthetic Polynucleotide
taatacgactcactatagggggatttttgatgatgcgccggtacccactcaacagaggagagagtggatgccggcgcataacctggcggcagcgcaaaagatg

SEQ ID NO: 95465 - DNA, 103 bp, Artificial Sequence
  Synthetic Polynucleotide
taatacgactcactatagggtggggaggtgaaaaaactagggggtccattaacagaggagaaatggaatgcctagttttaacctggcggcagcgcaaaagatg

SEQ ID NO: 95466 - DNA, 103 bp, Artificial Sequence
  Synthetic Polynucleotide
taatacgactcactatagggaaaatccataggatttttgatgatgcgccgaacagaggagacggcgcatgatcaaaaataacctggcggcagcgcaaaagatg

SEQ ID NO: 95467 - DNA, 103 bp, Artificial Sequence
  Synthetic Polynucleotide
taatacgactcactataggggcatggtggaaaaatccataggatttttgaaacagaggagatcaaaaatgctatggattaacctggcggcagcgcaaaagatg

SEQ ID NO: 95468 - DNA, 103 bp, Artificial Sequence
  Synthetic Polynucleotide
taatacgactcactatagggagccgctcccgcatggtggaaaaatccataaacagaggagatatggaatgttccaccataacctggcggcagcgcaaaagatg

SEQ ID NO: 95469 - DNA, 103 bp, Artificial Sequence
  Synthetic Polynucleotide
taatacgactcactatagggtcccctgagcagccgctcccgcatggtggaaacagaggagatccaccatgcgggagcggaacctggcggcagcgcaaaagatg

SEQ ID NO: 95470 - DNA, 103 bp, Artificial Sequence
  Synthetic Polynucleotide
taatacgactcactatagggtggtgtaccctcccctgagcagccgctcccaacagaggagagggagcatgtgctcagggaacctggcggcagcgcaaaagatg

SEQ ID NO: 95471 - DNA, 103 bp, Artificial Sequence
  Synthetic Polynucleotide
taatacgactcactatagggtcctctgagctggtgtaccctcccctgagcaacagaggagagctcagatgagggtacacaacctggcggcagcgcaaaagatg

SEQ ID NO: 95472 - DNA, 103 bp, Artificial Sequence
  Synthetic Polynucleotide
taatacgactcactatagggagccgcaaactcctctgagctggtgtacccaacagaggagagggtacatgagctcagagaacctggcggcagcgcaaaagatg

SEQ ID NO: 95473 - DNA, 103 bp, Artificial Sequence
  Synthetic Polynucleotide
taatacgactcactatagggggagggcatcagccgcaaactcctctgagcaacagaggagagctcagatgagtttgcggaacctggcggcagcgcaaaagatg

SEQ ID NO: 95474 - DNA, 103 bp, Artificial Sequence
  Synthetic Polynucleotide
taatacgactcactatagggtcaaataccaggagggcatcagccgcaaacaacagaggagagtttgcatgtgatgccctaacctggcggcagcgcaaaagatg

SEQ ID NO: 95475 - DNA, 103 bp, Artificial Sequence
  Synthetic Polynucleotide
taatacgactcactatagggctggcagttgtcaaataccaggagggcatcaacagaggagagatgccatgctggtatttaacctggcggcagcgcaaaagatg

SEQ ID NO: 95476 - DNA, 103 bp, Artificial Sequence
  Synthetic Polynucleotide
taatacgactcactataggggagaagtctgtggggaggtgaaaaaactagaacagaggagactagttatgtcacctcccaacctggcggcagcgcaaaagatg

SEQ ID NO: 95477 - DNA, 103 bp, Artificial Sequence
  Synthetic Polynucleotide
taatacgactcactatagggcgttgaaagtctggcagttgtcaaataccaaacagaggagatggtatatgacaactgccaacctggcggcagcgcaaaagatg

SEQ ID NO: 95478 - DNA, 103 bp, Artificial Sequence
  Synthetic Polynucleotide
taatacgactcactataggggagtcatcctcgttgaaagtctggcagttgaacagaggagacaactgatggactttcaaaacctggcggcagcgcaaaagatg

SEQ ID NO: 95479 - DNA, 103 bp, Artificial Sequence
  Synthetic Polynucleotide
taatacgactcactataggggcctacttcagagtcatcctcgttgaaagtaacagaggagaactttcatggaggatgacaacctggcggcagcgcaaaagatg

SEQ ID NO: 95480 - DNA, 103 bp, Artificial Sequence
  Synthetic Polynucleotide
taatacgactcactataggggcccagccttgcctacttcagagtcatcctaacagaggagaaggatgatgctgaagtagaacctggcggcagcgcaaaagatg

SEQ ID NO: 95481 - DNA, 103 bp, Artificial Sequence
  Synthetic Polynucleotide
taatacgactcactatagggcgcatgatgtgcccagccttgcctacttcaaacagaggagatgaagtatgcaaggctggaacctggcggcagcgcaaaagatg

SEQ ID NO: 95482 - DNA, 103 bp, Artificial Sequence
  Synthetic Polynucleotide
taatacgactcactataggggaagaagcggcgcatgatgtgcccagccttaacagaggagaaaggctatgcacatcatgaacctggcggcagcgcaaaagatg

SEQ ID NO: 95483 - DNA, 103 bp, Artificial Sequence
  Synthetic Polynucleotide
taatacgactcactatagggagcggctctcgaagaagcggcgcatgatgtaacagaggagaacatcaatggccgcttctaacctggcggcagcgcaaaagatg

SEQ ID NO: 95484 - DNA, 103 bp, Artificial Sequence
  Synthetic Polynucleotide
taatacgactcactatagggaactcctcccagcggctctcgaagaagcggaacagaggagaccgcttatgcgagagccgaacctggcggcagcgcaaaagatg

SEQ ID NO: 95485 - DNA, 103 bp, Artificial Sequence
  Synthetic Polynucleotide
taatacgactcactatagggtccctgataaaactcctcccagcggctctcaacagaggagagagagcatgtgggaggagaacctggcggcagcgcaaaagatg

SEQ ID NO: 95486 - DNA, 103 bp, Artificial Sequence
  Synthetic Polynucleotide
taatacgactcactatagggtggcctgttttccctgataaaactcctcccaacagaggagagggaggatgtttatcaggaacctggcggcagcgcaaaagatg

SEQ ID NO: 95487 - DNA, 103 bp, Artificial Sequence
  Synthetic Polynucleotide
taatacgactcactatagggcccaacataggagaagtctgtggggaggtgaacagaggagacacctcatgacagacttcaacctggcggcagcgcaaaagatg

SEQ ID NO: 95488 - DNA, 103 bp, Artificial Sequence
  Synthetic Polynucleotide
taatacgactcactatagggaatgctagatcccaacataggagaagtctgaacagaggagacagactatgcctatgttgaacctggcggcagcgcaaaagatg

SEQ ID NO: 95489 - DNA, 103 bp, Artificial Sequence
  Synthetic Polynucleotide
taatacgactcactatagggcaaaggtttgaatgctagatcccaacatagaacagaggagactatgtatggatctagcaaacctggcggcagcgcaaaagatg

SEQ ID NO: 95490 - DNA, 103 bp, Artificial Sequence
  Synthetic Polynucleotide
taatacgactcactatagggggagagggtttcagtcctgaggcagcaggtaacagaggagaacctgcatgctcaggactaacctggcggcagcgcaaaagatg

SEQ ID NO: 95491 - DNA, 103 bp, Artificial Sequence
  Synthetic Polynucleotide
taatacgactcactatagggtgggagggtgcaaaggtttgaatgctagataacagaggagaatctagatgtcaaaccttaacctggcggcagcgcaaaagatg

SEQ ID NO: 95492 - DNA, 103 bp, Artificial Sequence
  Synthetic Polynucleotide
taatacgactcactataggggcctacctcctgggagggtgcaaaggtttgaacagaggagacaaaccatggcaccctccaacctggcggcagcgcaaaagatg

SEQ ID NO: 95493 - DNA, 103 bp, Artificial Sequence
  Synthetic Polynucleotide
taatacgactcactatagggggataccactgcctacctcctgggagggtgaacagaggagacaccctatgaggaggtagaacctggcggcagcgcaaaagatg

SEQ ID NO: 95494 - DNA, 103 bp, Artificial Sequence
  Synthetic Polynucleotide
taatacgactcactatagggtcatcaggatggataccactgcctacctccaacagaggagaggaggtatgcagtggtataacctggcggcagcgcaaaagatg

SEQ ID NO: 95495 - DNA, 103 bp, Artificial Sequence
  Synthetic Polynucleotide
taatacgactcactatagggttctgctgcctcatcaggatggataccactaacagaggagaagtggtatgcatcctgataacctggcggcagcgcaaaagatg

SEQ ID NO: 95496 - DNA, 103 bp, Artificial Sequence
  Synthetic Polynucleotide
taatacgactcactatagggtcatctccttttctgctgcctcatcaggataacagaggagaatcctgatgaggcagcagaacctggcggcagcgcaaaagatg

SEQ ID NO: 95497 - DNA, 103 bp, Artificial Sequence
  Synthetic Polynucleotide
taatacgactcactatagggacaactgaagtcatctccttttctgctgccaacagaggagaggcagcatgaaaggagataacctggcggcagcgcaaaagatg

SEQ ID NO: 95498 - DNA, 103 bp, Artificial Sequence
  Synthetic Polynucleotide
taatacgactcactatagggattctctgccacaactgaagtcatctccttaacagaggagaaaggagatgacttcagttaacctggcggcagcgcaaaagatg

SEQ ID NO: 95499 - DNA, 103 bp, Artificial Sequence
  Synthetic Polynucleotide
taatacgactcactatagggagccagtgccattctctgccacaactgaagaacagaggagacttcagatgtggcagagaaacctggcggcagcgcaaaagatg

SEQ ID NO: 95500 - DNA, 103 bp, Artificial Sequence
  Synthetic Polynucleotide
taatacgactcactatagggctgcctaccaagccagtgccattctctgccaacagaggagaggcagaatgtggcactggaacctggcggcagcgcaaaagatg

SEQ ID NO: 95501 - DNA, 103 bp, Artificial Sequence
  Synthetic Polynucleotide
taatacgactcactatagggccctgaggaaggagagggtttcagtcctgaaacagaggagatcaggaatgaaaccctctaacctggcggcagcgcaaaagatg

SEQ ID NO: 95502 - DNA, 103 bp, Artificial Sequence
  Synthetic Polynucleotide
taatacgactcactatagggcagctccaagctgcctaccaagccagtgccaacagaggagaggcactatgttggtaggcaacctggcggcagcgcaaaagatg

SEQ ID NO: 95503 - DNA, 103 bp, Artificial Sequence
  Synthetic Polynucleotide
taatacgactcactataggggctcttcttccagctccaagctgcctaccaaacagaggagatggtagatggcttggagcaacctggcggcagcgcaaaagatg

SEQ ID NO: 95504 - DNA, 103 bp, Artificial Sequence
  Synthetic Polynucleotide
taatacgactcactatagggagttctggctgctcttcttccagctccaagaacagaggagacttggaatgggaagaagaaacctggcggcagcgcaaaagatg

SEQ ID NO: 95505 - DNA, 103 bp, Artificial Sequence
  Synthetic Polynucleotide
taatacgactcactatagggacacatcttcagttctggctgctcttcttcaacagaggagagaagaaatgcagccagaaaacctggcggcagcgcaaaagatg

SEQ ID NO: 95506 - DNA, 103 bp, Artificial Sequence
  Synthetic Polynucleotide
taatacgactcactatagggcattgtagccacacatcttcagttctggctaacagaggagaagccagatgtgaagatgtaacctggcggcagcgcaaaagatg

SEQ ID NO: 95507 - DNA, 103 bp, Artificial Sequence
  Synthetic Polynucleotide
taatacgactcactataggggggacagagccattgtagccacacatcttcaacagaggagagaagatatgtggctacaaaacctggcggcagcgcaaaagatg

SEQ ID NO: 95508 - DNA, 103 bp, Artificial Sequence
  Synthetic Polynucleotide
taatacgactcactatagggttccacagaagggacagagccattgtagccaacagaggagaggctacatgggctctgtcaacctggcggcagcgcaaaagatg

SEQ ID NO: 95509 - DNA, 103 bp, Artificial Sequence
  Synthetic Polynucleotide
taatacgactcactatagggggtgtaacgattccacagaagggacagagcaacagaggagagctctgatgcttctgtggaacctggcggcagcgcaaaagatg

SEQ ID NO: 95510 - DNA, 103 bp, Artificial Sequence
  Synthetic Polynucleotide
taatacgactcactataggggagacctcttggtgtaacgattccacagaaaacagaggagattctgtatgatcgttacaaacctggcggcagcgcaaaagatg

SEQ ID NO: 95511 - DNA, 103 bp, Artificial Sequence
  Synthetic Polynucleotide
taatacgactcactataggggaccaggactgagacctcttggtgtaacgaaacagaggagatcgttaatgcaagaggtcaacctggcggcagcgcaaaagatg

SEQ ID NO: 95512 - DNA, 103 bp, Artificial Sequence
  Synthetic Polynucleotide
taatacgactcactatagggagaggccctcccctgaggaaggagagggttaacagaggagaaaccctatgcttcctcagaacctggcggcagcgcaaaagatg

SEQ ID NO: 95513 - DNA, 103 bp, Artificial Sequence
  Synthetic Polynucleotide
taatacgactcactatagggtggggtcagggaccaggactgagacctcttaacagaggagaaagaggatgcagtcctggaacctggcggcagcgcaaaagatg

SEQ ID NO: 95514 - DNA, 103 bp, Artificial Sequence
  Synthetic Polynucleotide
taatacgactcactatagggcagctcactgtggggtcagggaccaggactaacagaggagaagtcctatgccctgacccaacctggcggcagcgcaaaagatg

SEQ ID NO: 95515 - DNA, 103 bp, Artificial Sequence
  Synthetic Polynucleotide
taatacgactcactatagggatcatctaaacagctcactgtggggtcaggaacagaggagacctgacatgacagtgagcaacctggcggcagcgcaaaagatg

SEQ ID NO: 95516 - DNA, 103 bp, Artificial Sequence
  Synthetic Polynucleotide
taatacgactcactataggggatgtgaaggatcatctaaacagctcactgaacagaggagacagtgaatggtttagatgaacctggcggcagcgcaaaagatg

SEQ ID NO: 95517 - DNA, 103 bp, Artificial Sequence
  Synthetic Polynucleotide
taatacgactcactatagggtgatcaggaagatgtgaaggatcatctaaaaacagaggagatttagaatgtccttcacaaacctggcggcagcgcaaaagatg

SEQ ID NO: 95518 - DNA, 103 bp, Artificial Sequence
  Synthetic Polynucleotide
taatacgactcactataggggtcttccagttgatcaggaagatgtgaaggaacagaggagaccttcaatgcttcctgataacctggcggcagcgcaaaagatg

SEQ ID NO: 95519 - DNA, 103 bp, Artificial Sequence
  Synthetic Polynucleotide
taatacgactcactatagggggattggagtgtcttccagttgatcaggaaaacagaggagattcctgatgaactggaagaacctggcggcagcgcaaaagatg

SEQ ID NO: 95520 - DNA, 103 bp, Artificial Sequence
  Synthetic Polynucleotide
taatacgactcactatagggtcttcactgaggattggagtgtcttccagtaacagaggagaactggaatgcactccaataacctggcggcagcgcaaaagatg

SEQ ID NO: 95521 - DNA, 103 bp, Artificial Sequence
  Synthetic Polynucleotide
taatacgactcactatagggctccagagagtcttcactgaggattggagtaacagaggagaactccaatgctcagtgaaaacctggcggcagcgcaaaagatg

SEQ ID NO: 95522 - DNA, 103 bp, Artificial Sequence
  Synthetic Polynucleotide
taatacgactcactatagggagttgaagggctccagagagtcttcactgaaacagaggagatcagtgatgactctctggaacctggcggcagcgcaaaagatg

SEQ ID NO: 95523 - DNA, 103 bp, Artificial Sequence
  Synthetic Polynucleotide
taatacgactcactatagggccgttagtgtagaggccctcccctgaggaaaacagaggagattcctcatgggagggcctaacctggcggcagcgcaaaagatg

SEQ ID NO: 95524 - DNA, 103 bp, Artificial Sequence
  Synthetic Polynucleotide
taatacgactcactatagggggtgccagagagttgaagggctccagagagaacagaggagactctctatggcccttcaaaacctggcggcagcgcaaaagatg

SEQ ID NO: 95525 - DNA, 103 bp, Artificial Sequence
  Synthetic Polynucleotide
taatacgactcactatagggcactggctctggtgccagagagttgaagggaacagaggagacccttcatgtctctggcaaacctggcggcagcgcaaaagatg

SEQ ID NO: 95526 - DNA, 103 bp, Artificial Sequence
  Synthetic Polynucleotide
taatacgactcactataggggtcctccactcactggctctggtgccagagaacagaggagactctggatgcagagccagaacctggcggcagcgcaaaagatg

SEQ ID NO: 95527 - DNA, 103 bp, Artificial Sequence
  Synthetic Polynucleotide
taatacgactcactatagggataccatatagtcctccactcactggctctaacagaggagaagagccatggagtggaggaacctggcggcagcgcaaaagatg

SEQ ID NO: 95528 - DNA, 103 bp, Artificial Sequence
  Synthetic Polynucleotide
taatacgactcactatagggcgtgtcatcaataccatatagtcctccactaacagaggagaagtggaatgctatatggtaacctggcggcagcgcaaaagatg

SEQ ID NO: 95529 - DNA, 103 bp, Artificial Sequence
  Synthetic Polynucleotide
taatacgactcactatagggccatcagctccgtgtcatcaataccatataaacagaggagatatatgatgttgatgacaaacctggcggcagcgcaaaagatg

SEQ ID NO: 95530 - DNA, 103 bp, Artificial Sequence
  Synthetic Polynucleotide
taatacgactcactatagggtcctctgcacccatcagctccgtgtcatcaaacagaggagatgatgaatgggagctgataacctggcggcagcgcaaaagatg

SEQ ID NO: 95531 - DNA, 103 bp, Artificial Sequence
  Synthetic Polynucleotide
taatacgactcactatagggaggcagcttgtcctctgcacccatcagctcaacagaggagagagctgatgggtgcagagaacctggcggcagcgcaaaagatg

SEQ ID NO: 95532 - DNA, 103 bp, Artificial Sequence
  Synthetic Polynucleotide
taatacgactcactatagggtgtcctcaagaggcagcttgtcctctgcacaacagaggagagtgcagatgacaagctgcaacctggcggcagcgcaaaagatg

SEQ ID NO: 95533 - DNA, 103 bp, Artificial Sequence
  Synthetic Polynucleotide
taatacgactcactatagggatcacagggctgtcctcaagaggcagcttgaacagaggagacaagctatgtcttgaggaaacctggcggcagcgcaaaagatg

SEQ ID NO: 95534 - DNA, 103 bp, Artificial Sequence
  Synthetic Polynucleotide
taatacgactcactatagggctggggtttgccttgcttgcggcgagacataacagaggagaatgtctatgcgcaagcaaaacctggcggcagcgcaaaagatg

SEQ ID NO: 95535 - DNA, 103 bp, Artificial Sequence
  Synthetic Polynucleotide
taatacgactcactatagggttctggagctcccaacgggccgtggtctggaacagaggagaccagacatgggcccgttgaacctggcggcagcgcaaaagatg

SEQ ID NO: 95536 - DNA, 103 bp, Artificial Sequence
  Synthetic Polynucleotide
taatacgactcactataggggaccgggggctgggagggaggaggggcggaaacagaggagatccgccatgcctccctccaacctggcggcagcgcaaaagatg

SEQ ID NO: 95537 - DNA, 103 bp, Artificial Sequence
  Synthetic Polynucleotide
taatacgactcactatagggacttggacttgaccgggggctgggagggagaacagaggagactccctatgagcccccggaacctggcggcagcgcaaaagatg

SEQ ID NO: 95538 - DNA, 103 bp, Artificial Sequence
  Synthetic Polynucleotide
taatacgactcactatagggaactcgcatgacttggacttgaccgggggcaacagaggagagcccccatgcaagtccaaaacctggcggcagcgcaaaagatg

SEQ ID NO: 95539 - DNA, 103 bp, Artificial Sequence
  Synthetic Polynucleotide
taatacgactcactatagggcttgccgcagaactcgcatgacttggacttaacagaggagaaagtccatgtcatgcgagaacctggcggcagcgcaaaagatg

SEQ ID NO: 95540 - DNA, 103 bp, Artificial Sequence
  Synthetic Polynucleotide
taatacgactcactatagggatttgaacgtcttgccgcagaactcgcatgaacagaggagacatgcgatgtctgcggcaaacctggcggcagcgcaaaagatg

SEQ ID NO: 95541 - DNA, 103 bp, Artificial Sequence
  Synthetic Polynucleotide
taatacgactcactatagggttgctctgaaatttgaacgtcttgccgcagaacagaggagactgcggatggacgttcaaaacctggcggcagcgcaaaagatg

SEQ ID NO: 95542 - DNA, 103 bp, Artificial Sequence
  Synthetic Polynucleotide
taatacgactcactatagggcaccaccaggttgctctgaaatttgaacgtaacagaggagaacgttcatgtttcagagcaacctggcggcagcgcaaaagatg

SEQ ID NO: 95543 - DNA, 103 bp, Artificial Sequence
  Synthetic Polynucleotide
taatacgactcactatagggtgcgccggtgcaccaccaggttgctctgaaaacagaggagattcagaatgacctggtggaacctggcggcagcgcaaaagatg

SEQ ID NO: 95544 - DNA, 103 bp, Artificial Sequence
  Synthetic Polynucleotide
taatacgactcactatagggcccgtgtggctgcgccggtgcaccaccaggaacagaggagacctggtatggcaccggcgaacctggcggcagcgcaaaagatg

SEQ ID NO: 95545 - DNA, 103 bp, Artificial Sequence
  Synthetic Polynucleotide
taatacgactcactataggggggcttctcgcccgtgtggctgcgccggtgaacagaggagacaccggatgagccacacgaacctggcggcagcgcaaaagatg

SEQ ID NO: 95546 - DNA, 103 bp, Artificial Sequence
  Synthetic Polynucleotide
taatacgactcactatagggcatgatccccttctggagctcccaacgggcaacagaggagagcccgtatggagctccagaacctggcggcagcgcaaaagatg

SEQ ID NO: 95547 - DNA, 103 bp, Artificial Sequence
  Synthetic Polynucleotide
taatacgactcactatagggtgcacttgtagggcttctcgcccgtgtggcaacagaggagagccacaatggcgagaagcaacctggcggcagcgcaaaagatg

SEQ ID NO: 95548 - DNA, 103 bp, Artificial Sequence
  Synthetic Polynucleotide
taatacgactcactatagggtcgcacaggttgcacttgtagggcttctcgaacagaggagacgagaaatgctacaagtgaacctggcggcagcgcaaaagatg

SEQ ID NO: 95549 - DNA, 103 bp, Artificial Sequence
  Synthetic Polynucleotide
taatacgactcactataggggcacgcgtggtcgcacaggttgcacttgtaaacagaggagatacaagatgaacctgtgcaacctggcggcagcgcaaaagatg

SEQ ID NO: 95550 - DNA, 103 bp, Artificial Sequence
  Synthetic Polynucleotide
taatacgactcactatagggtggcctgggtgcacgcgtggtcgcacaggtaacagaggagaacctgtatgaccacgcgtaacctggcggcagcgcaaaagatg

SEQ ID NO: 95551 - DNA, 103 bp, Artificial Sequence
  Synthetic Polynucleotide
taatacgactcactatagggttcagcttgctggcctgggtgcacgcgtggaacagaggagaccacgcatgcacccaggcaacctggcggcagcgcaaaagatg

SEQ ID NO: 95552 - DNA, 103 bp, Artificial Sequence
  Synthetic Polynucleotide
taatacgactcactatagggcatgtggcgcttcagcttgctggcctgggtaacagaggagaacccagatgagcaagctgaacctggcggcagcgcaaaagatg

SEQ ID NO: 95553 - DNA, 103 bp, Artificial Sequence
  Synthetic Polynucleotide
taatacgactcactatagggtgtgcgtcttcatgtggcgcttcagcttgcaacagaggagagcaagcatgagcgccacaaacctggcggcagcgcaaaagatg

SEQ ID NO: 95554 - DNA, 103 bp, Artificial Sequence
  Synthetic Polynucleotide
taatacgactcactataggggatttgtgcatgtgcgtcttcatgtggcgcaacagaggagagcgccaatggaagacgcaaacctggcggcagcgcaaaagatg

SEQ ID NO: 95555 - DNA, 103 bp, Artificial Sequence
  Synthetic Polynucleotide
taatacgactcactatagggcatgggggacgatttgtgcatgtgcgtcttaacagaggagaaagacgatgatgcacaaaaacctggcggcagcgcaaaagatg

SEQ ID NO: 95556 - DNA, 103 bp, Artificial Sequence
  Synthetic Polynucleotide
taatacgactcactatagggacttgaccgtcatgggggacgatttgtgcaaacagaggagatgcacaatgcgtcccccaaacctggcggcagcgcaaaagatg

SEQ ID NO: 95557 - DNA, 103 bp, Artificial Sequence
  Synthetic Polynucleotide
taatacgactcactataggggtgaggaggtcatgatccccttctggagctaacagaggagaagctccatgaggggatcaaacctggcggcagcgcaaaagatg

SEQ ID NO: 95558 - DNA, 103 bp, Artificial Sequence
  Synthetic Polynucleotide
taatacgactcactatagggccgtcgtcggacttgaccgtcatgggggacaacagaggagagtccccatggacggtcaaaacctggcggcagcgcaaaagatg

SEQ ID NO: 95559 - DNA, 103 bp, Artificial Sequence
  Synthetic Polynucleotide
taatacgactcactatagggggtggagagaccgtcgtcggacttgaccgtaacagaggagaacggtcatgtccgacgacaacctggcggcagcgcaaaagatg

SEQ ID NO: 95560 - DNA, 103 bp, Artificial Sequence
  Synthetic Polynucleotide
taatacgactcactataggggggagctggcggtggagagaccgtcgtcggaacagaggagaccgacgatggtctctccaaacctggcggcagcgcaaaagatg

SEQ ID NO: 95561 - DNA, 103 bp, Artificial Sequence
  Synthetic Polynucleotide
taatacgactcactatagggccgggttccggggagctggcggtggagagaaacagaggagatctctcatgcgccagctcaacctggcggcagcgcaaaagatg

SEQ ID NO: 95562 - DNA, 103 bp, Artificial Sequence
  Synthetic Polynucleotide
taatacgactcactataggggtcgctggtgccgggttccggggagctggcaacagaggagagccagcatgccggaacccaacctggcggcagcgcaaaagatg

SEQ ID NO: 95563 - DNA, 103 bp, Artificial Sequence
  Synthetic Polynucleotide
taatacgactcactatagggtgcccaccaagtcgctggtgccgggttccgaacagaggagacggaacatggcaccagcgaacctggcggcagcgcaaaagatg

SEQ ID NO: 95564 - DNA, 103 bp, Artificial Sequence
  Synthetic Polynucleotide
taatacgactcactatagggctgctggcgctgcccaccaagtcgctggtgaacagaggagacaccagatgcttggtgggaacctggcggcagcgcaaaagatg

SEQ ID NO: 95565 - DNA, 103 bp, Artificial Sequence
  Synthetic Polynucleotide
taatacgactcactatagggcttgagcgcgctgctggcgctgcccaccaaaacagaggagattggtgatgagcgccagcaacctggcggcagcgcaaaagatg

SEQ ID NO: 95566 - DNA, 103 bp, Artificial Sequence
  Synthetic Polynucleotide
taatacgactcactatagggccaccacggacttgagcgcgctgctggcgcaacagaggagagcgccaatggcgcgctcaaacctggcggcagcgcaaaagatg

SEQ ID NO: 95567 - DNA, 103 bp, Artificial Sequence
  Synthetic Polynucleotide
taatacgactcactatagggttgaacttggccaccacggacttgagcgcgaacagaggagacgcgctatggtccgtggtaacctggcggcagcgcaaaagatg

SEQ ID NO: 95568 - DNA, 103 bp, Artificial Sequence
  Synthetic Polynucleotide
taatacgactcactatagggctgcccacaggtgaggaggtcatgatccccaacagaggagaggggatatggacctcctcaacctggcggcagcgcaaaagatg

SEQ ID NO: 95569 - DNA, 103 bp, Artificial Sequence
  Synthetic Polynucleotide
taatacgactcactataggggttctcgctcttgaacttggccaccacggaaacagaggagatccgtgatggccaagttcaacctggcggcagcgcaaaagatg

SEQ ID NO: 95570 - DNA, 103 bp, Artificial Sequence
  Synthetic Polynucleotide
taatacgactcactatagggggttggggtcgttctcgctcttgaacttggaacagaggagaccaagtatgagagcgagaaacctggcggcagcgcaaaagatg

SEQ ID NO: 95571 - DNA, 103 bp, Artificial Sequence
  Synthetic Polynucleotide
taatacgactcactatagggtccgggatcaggttggggtcgttctcgctcaacagaggagagagcgaatgcgaccccaaaacctggcggcagcgcaaaagatg

SEQ ID NO: 95572 - DNA, 103 bp, Artificial Sequence
  Synthetic Polynucleotide
taatacgactcactataggggtccccgttctccgggatcaggttggggtcaacagaggagagaccccatgctgatcccgaacctggcggcagcgcaaaagatg

SEQ ID NO: 95573 - DNA, 103 bp, Artificial Sequence
  Synthetic Polynucleotide
taatacgactcactatagggcttcctcctcgtccccgttctccgggatcaaacagaggagatgatccatgagaacggggaacctggcggcagcgcaaaagatg

SEQ ID NO: 95574 - DNA, 103 bp, Artificial Sequence
  Synthetic Polynucleotide
taatacgactcactatagggtcgtcctcctcttcctcctcgtccccgttcaacagaggagagaacggatgcgaggaggaaacctggcggcagcgcaaaagatg

SEQ ID NO: 95575 - DNA, 103 bp, Artificial Sequence
  Synthetic Polynucleotide
taatacgactcactatagggctcttcctcgtcgtcctcctcttcctcctcaacagaggagagaggagatggaggaggacaacctggcggcagcgcaaaagatg

SEQ ID NO: 95576 - DNA, 103 bp, Artificial Sequence
  Synthetic Polynucleotide
taatacgactcactatagggcctcttcttcctcttcctcgtcgtcctcctaacagaggagaaggaggatgacgaggaagaacctggcggcagcgcaaaagatg

SEQ ID NO: 95577 - DNA, 103 bp, Artificial Sequence
  Synthetic Polynucleotide
taatacgactcactatagggtcctcttcctcctcttcttcctcttcctcgaacagaggagacgaggaatgggaagaagaaacctggcggcagcgcaaaagatg

SEQ ID NO: 95578 - DNA, 103 bp, Artificial Sequence
  Synthetic Polynucleotide
taatacgactcactatagggctcctcctcctcctcttcctcctcttcttcaacagaggagagaagaaatggaggaagagaacctggcggcagcgcaaaagatg

SEQ ID NO: 95579 - DNA, 103 bp, Artificial Sequence
  Synthetic Polynucleotide
taatacgactcactatagggtcatctggcactgcccacaggtgaggaggtaacagaggagaacctccatgcctgtgggcaacctggcggcagcgcaaaagatg

SEQ ID NO: 95580 - DNA, 103 bp, Artificial Sequence
  Synthetic Polynucleotide
taatacgactcactatagggtctccgtcagctcctcctcctcctcttcctaacagaggagaaggaagatgaggaggaggaacctggcggcagcgcaaaagatg

SEQ ID NO: 95581 - DNA, 103 bp, Artificial Sequence
  Synthetic Polynucleotide
taatacgactcactatagggaccctctcgctctccgtcagctcctcctccaacagaggagaggaggaatggctgacggaaacctggcggcagcgcaaaagatg

SEQ ID NO: 95582 - DNA, 103 bp, Artificial Sequence
  Synthetic Polynucleotide
taatacgactcactataggggccgtagtccaccctctcgctctccgtcagaacagaggagactgacgatgagcgagaggaacctggcggcagcgcaaaagatg

SEQ ID NO: 95583 - DNA, 103 bp, Artificial Sequence
  Synthetic Polynucleotide
taatacgactcactatagggtcagcccgaagccgtagtccaccctctcgcaacagaggagagcgagaatgtggactacgaacctggcggcagcgcaaaagatg

SEQ ID NO: 95584 - DNA, 103 bp, Artificial Sequence
  Synthetic Polynucleotide
taatacgactcactataggggcctccaggctcagcccgaagccgtagtccaacagaggagaggactaatgcttcgggctaacctggcggcagcgcaaaagatg

SEQ ID NO: 95585 - DNA, 103 bp, Artificial Sequence
  Synthetic Polynucleotide
taatacgactcactataggggtggcgcgccgcctccaggctcagcccgaaaacagaggagattcgggatgagcctggagaacctggcggcagcgcaaaagatg

SEQ ID NO: 95586 - DNA, 103 bp, Artificial Sequence
  Synthetic Polynucleotide
taatacgactcactatagggtgttctcgtggtggcgcgccgcctccaggcaacagaggagagcctggatgcggcgcgccaacctggcggcagcgcaaaagatg

SEQ ID NO: 95587 - DNA, 103 bp, Artificial Sequence
  Synthetic Polynucleotide
taatacgactcactatagggccccgcgagctgttctcgtggtggcgcgccaacagaggagaggcgcgatgccacgagaaaacctggcggcagcgcaaaagatg

SEQ ID NO: 95588 - DNA, 103 bp, Artificial Sequence
  Synthetic Polynucleotide
taatacgactcactatagggcacgaccgcgccccgcgagctgttctcgtgaacagaggagacacgagatgagctcgcggaacctggcggcagcgcaaaagatg

SEQ ID NO: 95589 - DNA, 103 bp, Artificial Sequence
  Synthetic Polynucleotide
taatacgactcactatagggcgcccacgcccacgaccgcgccccgcgagcaacagaggagagctcgcatggcgcggtcgaacctggcggcagcgcaaaagatg

SEQ ID NO: 95590 - DNA, 103 bp, Artificial Sequence
  Synthetic Polynucleotide
taatacgactcactatagggaatgggaagttcatctggcactgcccacagaacagaggagactgtggatggtgccagataacctggcggcagcgcaaaagatg

SEQ ID NO: 95591 - DNA, 103 bp, Artificial Sequence
  Synthetic Polynucleotide
taatacgactcactatagggcggctctcgtcgcccacgcccacgaccgcgaacagaggagacgcggtatggggcgtgggaacctggcggcagcgcaaaagatg

SEQ ID NO: 95592 - DNA, 103 bp, Artificial Sequence
  Synthetic Polynucleotide
taatacgactcactataggggggcagggcgcggctctcgtcgcccacgccaacagaggagaggcgtgatggacgagagcaacctggcggcagcgcaaaagatg

SEQ ID NO: 95593 - DNA, 103 bp, Artificial Sequence
  Synthetic Polynucleotide
taatacgactcactataggggcatgacgtcgggcagggcgcggctctcgtaacagaggagaacgagaatggcgccctgcaacctggcggcagcgcaaaagatg

SEQ ID NO: 95594 - DNA, 103 bp, Artificial Sequence
  Synthetic Polynucleotide
taatacgactcactatagggaccatgccctgcatgacgtcgggcagggcgaacagaggagacgccctatgcgacgtcataacctggcggcagcgcaaaagatg

SEQ ID NO: 95595 - DNA, 103 bp, Artificial Sequence
  Synthetic Polynucleotide
taatacgactcactatagggggagctgagcaccatgccctgcatgacgtcaacagaggagagacgtcatgcagggcatgaacctggcggcagcgcaaaagatg

SEQ ID NO: 95596 - DNA, 103 bp, Artificial Sequence
  Synthetic Polynucleotide
taatacgactcactatagggagtgctgcatggagctgagcaccatgccctaacagaggagaagggcaatgtgctcagctaacctggcggcagcgcaaaagatg

SEQ ID NO: 95597 - DNA, 103 bp, Artificial Sequence
  Synthetic Polynucleotide
taatacgactcactataggggcctcgctgaagtgctgcatggagctgagcaacagaggagagctcagatgcatgcagcaaacctggcggcagcgcaaaagatg

SEQ ID NO: 95598 - DNA, 103 bp, Artificial Sequence
  Synthetic Polynucleotide
taatacgactcactatagggctggtggaaggcctcgctgaagtgctgcataacagaggagaatgcagatgttcagcgagaacctggcggcagcgcaaaagatg

SEQ ID NO: 95599 - DNA, 103 bp, Artificial Sequence
  Synthetic Polynucleotide
taatacgactcactatagggcgcccaggacctggtggaaggcctcgctgaaacagaggagatcagcgatgccttccaccaacctggcggcagcgcaaaagatg

SEQ ID NO: 95600 - DNA, 103 bp, Artificial Sequence
  Synthetic Polynucleotide
taatacgactcactatagggttatgcttctcgcccaggacctggtggaagaacagaggagacttccaatgggtcctgggaacctggcggcagcgcaaaagatg

SEQ ID NO: 95601 - DNA, 103 bp, Artificial Sequence
  Synthetic Polynucleotide
taatacgactcactatagggaatgtcccccaatgggaagttcatctggcaaacagaggagatgccagatgaacttcccaaacctggcggcagcgcaaaagatg

SEQ ID NO: 95602 - DNA, 103 bp, Artificial Sequence
  Synthetic Polynucleotide
taatacgactcactataggggtggccgcgcttatgcttctcgcccaggacaacagaggagagtcctgatggagaagcataacctggcggcagcgcaaaagatg

SEQ ID NO: 95603 - DNA, 103 bp, Artificial Sequence
  Synthetic Polynucleotide
taatacgactcactatagggcctcggccaggtggccgcgcttatgcttctaacagaggagaagaagcatgagcgcggccaacctggcggcagcgcaaaagatg

SEQ ID NO: 95604 - DNA, 103 bp, Artificial Sequence
  Synthetic Polynucleotide
taatacgactcactatagggtggccctcggcctcggccaggtggccgcgcaacagaggagagcgcggatgcctggccgaaacctggcggcagcgcaaaagatg

SEQ ID NO: 95605 - DNA, 103 bp, Artificial Sequence
  Synthetic Polynucleotide
taatacgactcactatagggagtgtccctgtggccctcggcctcggccagaacagaggagactggccatggccgagggcaacctggcggcagcgcaaaagatg

SEQ ID NO: 95606 - DNA, 103 bp, Artificial Sequence
  Synthetic Polynucleotide
taatacgactcactatagggcttcgtcgcaagtgtccctgtggccctcggaacagaggagaccgaggatgacagggacaaacctggcggcagcgcaaaagatg

SEQ ID NO: 95607 - DNA, 103 bp, Artificial Sequence
  Synthetic Polynucleotide
taatacgactcactataggggccaccgagtcttcgtcgcaagtgtccctgaacagaggagacagggaatgttgcgacgaaacctggcggcagcgcaaaagatg

SEQ ID NO: 95608 - DNA, 103 bp, Artificial Sequence
  Synthetic Polynucleotide
taatacgactcactatagggcgactcgccggccaccgagtcttcgtcgcaaacagaggagatgcgacatggactcggtgaacctggcggcagcgcaaaagatg

SEQ ID NO: 95609 - DNA, 103 bp, Artificial Sequence
  Synthetic Polynucleotide
taatacgactcactatagggctatgcggtccgactcgccggccaccgagtaacagaggagaactcggatgccggcgagtaacctggcggcagcgcaaaagatg

SEQ ID NO: 95610 - DNA, 103 bp, Artificial Sequence
  Synthetic Polynucleotide
taatacgactcactataggggtgccatcgtctatgcggtccgactcgccgaacagaggagacggcgaatgggaccgcataacctggcggcagcgcaaaagatg

SEQ ID NO: 95611 - DNA, 103 bp, Artificial Sequence
  Synthetic Polynucleotide
taatacgactcactataggggccattaacagtgccatcgtctatgcggtcaacagaggagagaccgcatggacgatggcaacctggcggcagcgcaaaagatg

SEQ ID NO: 95612 - DNA, 103 bp, Artificial Sequence
  Synthetic Polynucleotide
taatacgactcactatagggtaaaaataagaatgtcccccaatgggaagtaacagaggagaacttccatgtgggggacaaacctggcggcagcgcaaaagatg

SEQ ID NO: 95613 - DNA, 103 bp, Artificial Sequence
  Synthetic Polynucleotide
taatacgactcactatagggagcagccgcggccattaacagtgccatcgtaacagaggagaacgatgatgctgttaatgaacctggcggcagcgcaaaagatg

SEQ ID NO: 95614 - DNA, 103 bp, Artificial Sequence
  Synthetic Polynucleotide
taatacgactcactatagggtcgcccggggagcagccgcggccattaacaaacagaggagatgttaaatgccgcggctgaacctggcggcagcgcaaaagatg

SEQ ID NO: 95615 - DNA, 103 bp, Artificial Sequence
  Synthetic Polynucleotide
taatacgactcactatagggcgaggccgactcgcccggggagcagccgcgaacagaggagacgcggcatgtccccgggcaacctggcggcagcgcaaaagatg

SEQ ID NO: 95616 - DNA, 103 bp, Artificial Sequence
  Synthetic Polynucleotide
taatacgactcactatagggacaggccccccgaggccgactcgcccggggaacagaggagaccccggatgagtcggcctaacctggcggcagcgcaaaagatg

SEQ ID NO: 95617 - DNA, 103 bp, Artificial Sequence
  Synthetic Polynucleotide
taatacgactcactatagggagctttttggacaggccccccgaggccgacaacagaggagagtcggcatgggggggcctaacctggcggcagcgcaaaagatg

SEQ ID NO: 95618 - DNA, 103 bp, Artificial Sequence
  Synthetic Polynucleotide
taatacgactcactataggggcccagcagcagctttttggacaggcccccaacagaggagagggggcatgtccaaaaagaacctggcggcagcgcaaaagatg

SEQ ID NO: 95619 - DNA, 103 bp, Artificial Sequence
  Synthetic Polynucleotide
taatacgactcactatagggagctggggctgcccagcagcagctttttggaacagaggagaccaaaaatgtgctgctggaacctggcggcagcgcaaaagatg

SEQ ID NO: 95620 - DNA, 103 bp, Artificial Sequence
  Synthetic Polynucleotide
taatacgactcactataggggggctcagcgagctggggctgcccagcagcaacagaggagagctgctatgcagccccagaacctggcggcagcgcaaaagatg

SEQ ID NO: 95621 - DNA, 103 bp, Artificial Sequence
  Synthetic Polynucleotide
taatacgactcactatagggcttagagaaggggctcagcgagctggggctaacagaggagaagccccatgtcgctgagcaacctggcggcagcgcaaaagatg

SEQ ID NO: 95622 - DNA, 103 bp, Artificial Sequence
  Synthetic Polynucleotide
taatacgactcactataggggcttgatgcgcttagagaaggggctcagcgaacagaggagacgctgaatgccttctctaaacctggcggcagcgcaaaagatg

SEQ ID NO: 95623 - DNA, 103 bp, Artificial Sequence
  Synthetic Polynucleotide
taatacgactcactatagggttgtgctcgataaaaataagaatgtcccccaacagaggagagggggaatgtcttattttaacctggcggcagcgcaaaagatg

SEQ ID NO: 95624 - DNA, 103 bp, Artificial Sequence
  Synthetic Polynucleotide
taatacgactcactatagggtccttctcgagcttgatgcgcttagagaagaacagaggagacttctcatggcgcatcaaaacctggcggcagcgcaaaagatg

SEQ ID NO: 95625 - DNA, 103 bp, Artificial Sequence
  Synthetic Polynucleotide
taatacgactcactatagggcaggtcgaactccttctcgagcttgatgcgaacagaggagacgcatcatgctcgagaagaacctggcggcagcgcaaaagatg

SEQ ID NO: 95626 - DNA, 103 bp, Artificial Sequence
  Synthetic Polynucleotide
taatacgactcactatagggcggccgggggcaggtcgaactccttctcgaaacagaggagatcgagaatgagttcgaccaacctggcggcagcgcaaaagatg

SEQ ID NO: 95627 - DNA, 103 bp, Artificial Sequence
  Synthetic Polynucleotide
taatacgactcactatagggttgggcatcgcggccgggggcaggtcgaacaacagaggagagttcgaatggcccccggcaacctggcggcagcgcaaaagatg

SEQ ID NO: 95628 - DNA, 103 bp, Artificial Sequence
  Synthetic Polynucleotide
taatacgactcactataggggttctccgtgttgggcatcgcggccgggggaacagaggagacccccgatggcgatgcccaacctggcggcagcgcaaaagatg

SEQ ID NO: 95629 - DNA, 103 bp, Artificial Sequence
  Synthetic Polynucleotide
taatacgactcactataggggcgagtacacgttctccgtgttgggcatcgaacagaggagacgatgcatgacacggagaaacctggcggcagcgcaaaagatg

SEQ ID NO: 95630 - DNA, 103 bp, Artificial Sequence
  Synthetic Polynucleotide
taatacgactcactataggggcgagccactgcgagtacacgttctccgtgaacagaggagacacggaatgcgtgtactcaacctggcggcagcgcaaaagatg

SEQ ID NO: 95631 - DNA, 103 bp, Artificial Sequence
  Synthetic Polynucleotide
taatacgactcactatagggcgcgtagccggcgagccactgcgagtacacaacagaggagagtgtacatgcagtggctcaacctggcggcagcgcaaaagatg

SEQ ID NO: 95632 - DNA, 103 bp, Artificial Sequence
  Synthetic Polynucleotide
taatacgactcactataggggcctggaggccgcgtagccggcgagccactaacagaggagaagtggcatgccggctacgaacctggcggcagcgcaaaagatg

SEQ ID NO: 95633 - DNA, 103 bp, Artificial Sequence
  Synthetic Polynucleotide
taatacgactcactatagggtctttgagctgcctggaggccgcgtagccgaacagaggagacggctaatgggcctccagaacctggcggcagcgcaaaagatg

SEQ ID NO: 95634 - DNA, 103 bp, Artificial Sequence
  Synthetic Polynucleotide
taatacgactcactatagggttgtttccgtttgtgctcgataaaaataagaacagaggagacttattatgatcgagcacaacctggcggcagcgcaaaagatg

SEQ ID NO: 95635 - DNA, 103 bp, Artificial Sequence
  Synthetic Polynucleotide
taatacgactcactatagggaaggaagggatctttgagctgcctggaggcaacagaggagagcctccatgcagctcaaaaacctggcggcagcgcaaaagatg

SEQ ID NO: 95636 - DNA, 103 bp, Artificial Sequence
  Synthetic Polynucleotide
taatacgactcactatagggctccgaagctaaggaagggatctttgagctaacagaggagaagctcaatgatcccttccaacctggcggcagcgcaaaagatg

SEQ ID NO: 95637 - DNA, 103 bp, Artificial Sequence
  Synthetic Polynucleotide
taatacgactcactatagggtgtctggagtctccgaagctaaggaagggaaacagaggagatcccttatgtagcttcggaacctggcggcagcgcaaaagatg

SEQ ID NO: 95638 - DNA, 103 bp, Artificial Sequence
  Synthetic Polynucleotide
taatacgactcactatagggaaaaggcgattgtctggagtctccgaagctaacagaggagaagcttcatggactccagaaacctggcggcagcgcaaaagatg

SEQ ID NO: 95639 - DNA, 103 bp, Artificial Sequence
  Synthetic Polynucleotide
taatacgactcactatagggacgaggaggcaaaaggcgattgtctggagtaacagaggagaactccaatgaatcgccttaacctggcggcagcgcaaaagatg

SEQ ID NO: 95640 - DNA, 103 bp, Artificial Sequence
  Synthetic Polynucleotide
taatacgactcactataggggagtgctccgacgaggaggcaaaaggcgataacagaggagaatcgccatgtgcctcctcaacctggcggcagcgcaaaagatg

SEQ ID NO: 95641 - DNA, 103 bp, Artificial Sequence
  Synthetic Polynucleotide
taatacgactcactataggggttctccgaggagtgctccgacgaggaggcaacagaggagagcctccatgtcggagcacaacctggcggcagcgcaaaagatg

SEQ ID NO: 95642 - DNA, 103 bp, Artificial Sequence
  Synthetic Polynucleotide
taatacgactcactataggggcaaactcccgttctccgaggagtgctccgaacagaggagacggagcatgcctcggagaaacctggcggcagcgcaaaagatg

SEQ ID NO: 95643 - DNA, 103 bp, Artificial Sequence
  Synthetic Polynucleotide
taatacgactcactataggggtggagaagcgcaaactcccgttctccgagaacagaggagactcggaatgcgggagtttaacctggcggcagcgcaaaagatg

SEQ ID NO: 95644 - DNA, 103 bp, Artificial Sequence
  Synthetic Polynucleotide
taatacgactcactatagggcccgggcggtgtggagaagcgcaaactcccaacagaggagagggagtatgcgcttctccaacctggcggcagcgcaaaagatg

SEQ ID NO: 95645 - DNA, 103 bp, Artificial Sequence
  Synthetic Polynucleotide
taatacgactcactatagggtgcttaagtgctggggtttgccttgcttgcaacagaggagagcaagcatggcaaaccccaacctggcggcagcgcaaaagatg

SEQ ID NO: 95646 - DNA, 103 bp, Artificial Sequence
  Synthetic Polynucleotide
taatacgactcactatagggtgccattgcattgtttccgtttgtgctcgaaacagaggagatcgagcatgaacggaaacaacctggcggcagcgcaaaagatg

SEQ ID NO: 95647 - DNA, 103 bp, Artificial Sequence
  Synthetic Polynucleotide
taatacgactcactatagggcgtccagctccccgggcggtgtggagaagcaacagaggagagcttctatgcaccgcccgaacctggcggcagcgcaaaagatg

SEQ ID NO: 95648 - DNA, 103 bp, Artificial Sequence
  Synthetic Polynucleotide
taatacgactcactataggggagatccctccgtccagctccccgggcggtaacagaggagaaccgccatgggagctggaaacctggcggcagcgcaaaagatg

SEQ ID NO: 95649 - DNA, 103 bp, Artificial Sequence
  Synthetic Polynucleotide
taatacgactcactataggggctgcgccccgagatccctccgtccagctcaacagaggagagagctgatgggagggatcaacctggcggcagcgcaaaagatg

SEQ ID NO: 95650 - DNA, 103 bp, Artificial Sequence
  Synthetic Polynucleotide
taatacgactcactatagggttcccgtgccgctgcgccccgagatccctcaacagaggagagagggaatgcggggcgcaaacctggcggcagcgcaaaagatg

SEQ ID NO: 95651 - DNA, 103 bp, Artificial Sequence
  Synthetic Polynucleotide
taatacgactcactatagggctccctccacttcccgtgccgctgcgccccaacagaggagaggggcgatgcggcacgggaacctggcggcagcgcaaaagatg

SEQ ID NO: 95652 - DNA, 103 bp, Artificial Sequence
  Synthetic Polynucleotide
taatacgactcactatagggatggggcgtgctccctccacttcccgtgccaacagaggagaggcacgatgagtggagggaacctggcggcagcgcaaaagatg

SEQ ID NO: 95653 - DNA, 103 bp, Artificial Sequence
  Synthetic Polynucleotide
taatacgactcactataggggaccactaatatggggcgtgctccctccacaacagaggagagtggagatggcacgccccaacctggcggcagcgcaaaagatg

SEQ ID NO: 95654 - DNA, 103 bp, Artificial Sequence
  Synthetic Polynucleotide
taatacgactcactatagggcccgggcccggaccactaatatggggcgtgaacagaggagacacgccatgtattagtggaacctggcggcagcgcaaaagatg

SEQ ID NO: 95655 - DNA, 103 bp, Artificial Sequence
  Synthetic Polynucleotide
taatacgactcactataggggctgggcctgcccgggcccggaccactaataacagaggagaattagtatgccgggcccgaacctggcggcagcgcaaaagatg

SEQ ID NO: 95656 - DNA, 103 bp, Artificial Sequence
  Synthetic Polynucleotide
taatacgactcactatagggcctcttttgagctgggcctgcccgggcccgaacagaggagacgggccatggcaggcccaaacctggcggcagcgcaaaagatg

SEQ ID NO: 95657 - DNA, 103 bp, Artificial Sequence
  Synthetic Polynucleotide
taatacgactcactatagggaagcagaggctgccattgcattgtttccgtaacagaggagaacggaaatgatgcaatggaacctggcggcagcgcaaaagatg

SEQ ID NO: 95658 - DNA, 103 bp, Artificial Sequence
  Synthetic Polynucleotide
taatacgactcactatagggctgcgtctgccctcttttgagctgggcctgaacagaggagacaggccatgctcaaaagaaacctggcggcagcgcaaaagatg

SEQ ID NO: 95659 - DNA, 103 bp, Artificial Sequence
  Synthetic Polynucleotide
taatacgactcactatagggacaagtgtcgctgcgtctgccctcttttgaaacagaggagatcaaaaatgggcagacgcaacctggcggcagcgcaaaagatg

SEQ ID NO: 95660 - DNA, 103 bp, Artificial Sequence
  Synthetic Polynucleotide
taatacgactcactatagggcacagtactcacaagtgtcgctgcgtctgcaacagaggagagcagacatggcgacacttaacctggcggcagcgcaaaagatg

SEQ ID NO: 95661 - DNA, 103 bp, Artificial Sequence
  Synthetic Polynucleotide
taatacgactcactatagggaagactttcccacagtactcacaagtgtcgaacagaggagacgacacatgtgagtactgaacctggcggcagcgcaaaagatg

SEQ ID NO: 95662 - DNA, 103 bp, Artificial Sequence
  Synthetic Polynucleotide
taatacgactcactatagggacagttcttgaagactttcccacagtactcaacagaggagagagtacatggggaaagtcaacctggcggcagcgcaaaagatg

SEQ ID NO: 95663 - DNA, 103 bp, Artificial Sequence
  Synthetic Polynucleotide
taatacgactcactatagggtgagattgctacagttcttgaagactttccaacagaggagaggaaagatgtcaagaactaacctggcggcagcgcaaaagatg

SEQ ID NO: 95664 - DNA, 103 bp, Artificial Sequence
  Synthetic Polynucleotide
taatacgactcactatagggctgtggacagtgagattgctacagttcttgaacagaggagacaagaaatgtagcaatctaacctggcggcagcgcaaaagatg

SEQ ID NO: 95665 - DNA, 103 bp, Artificial Sequence
  Synthetic Polynucleotide
taatacgactcactataggggtggcttctcctgtggacagtgagattgctaacagaggagaagcaatatgactgtccacaacctggcggcagcgcaaaagatg

SEQ ID NO: 95666 - DNA, 103 bp, Artificial Sequence
  Synthetic Polynucleotide
taatacgactcactatagggtttcgcccgtgtggcttctcctgtggacagaacagaggagactgtccatgggagaagccaacctggcggcagcgcaaaagatg

SEQ ID NO: 95667 - DNA, 103 bp, Artificial Sequence
  Synthetic Polynucleotide
taatacgactcactatagggttataaggcctttcgcccgtgtggcttctcaacagaggagagagaagatgcacgggcgaaacctggcggcagcgcaaaagatg

SEQ ID NO: 95668 - DNA, 103 bp, Artificial Sequence
  Synthetic Polynucleotide
taatacgactcactatagggagctttttctaagcagaggctgccattgcaaacagaggagatgcaatatgagcctctgcaacctggcggcagcgcaaaagatg

SEQ ID NO: 95669 - DNA, 103 bp, Artificial Sequence
  Synthetic Polynucleotide
taatacgactcactatagggcagctcgcatttataaggcctttcgcccgtaacagaggagaacgggcatgaggccttataacctggcggcagcgcaaaagatg

SEQ ID NO: 95670 - DNA, 103 bp, Artificial Sequence
  Synthetic Polynucleotide
taatacgactcactatagggcatagttgcacagctcgcatttataaggccaacagaggagaggccttatgaatgcgagcaacctggcggcagcgcaaaagatg

SEQ ID NO: 95671 - DNA, 103 bp, Artificial Sequence
  Synthetic Polynucleotide
taatacgactcactatagggtgggcacaggcatagttgcacagctcgcataacagaggagaatgcgaatggtgcaactaaacctggcggcagcgcaaaagatg

SEQ ID NO: 95672 - DNA, 103 bp, Artificial Sequence
  Synthetic Polynucleotide
taatacgactcactatagggcttgctactctgggcacaggcatagttgcaaacagaggagatgcaacatggcctgtgccaacctggcggcagcgcaaaagatg

SEQ ID NO: 95673 - DNA, 103 bp, Artificial Sequence
  Synthetic Polynucleotide
taatacgactcactataggggcctggtgagcttgctactctgggcacaggaacagaggagacctgtgatgagagtagcaaacctggcggcagcgcaaaagatg

SEQ ID NO: 95674 - DNA, 103 bp, Artificial Sequence
  Synthetic Polynucleotide
taatacgactcactataggggttttcatgtgcctggtgagcttgctactcaacagaggagagagtagatggctcaccagaacctggcggcagcgcaaaagatg

SEQ ID NO: 95675 - DNA, 103 bp, Artificial Sequence
  Synthetic Polynucleotide
taatacgactcactatagggctggccatgcgttttcatgtgcctggtgagaacagaggagactcaccatgcacatgaaaaacctggcggcagcgcaaaagatg

SEQ ID NO: 95676 - DNA, 103 bp, Artificial Sequence
  Synthetic Polynucleotide
taatacgactcactatagggccttccccacctggccatgcgttttcatgtaacagaggagaacatgaatgcgcatggccaacctggcggcagcgcaaaagatg

SEQ ID NO: 95677 - DNA, 103 bp, Artificial Sequence
  Synthetic Polynucleotide
taatacgactcactatagggttgtaaacgtccttccccacctggccatgcaacagaggagagcatggatgggtggggaaaacctggcggcagcgcaaaagatg

SEQ ID NO: 95678 - DNA, 103 bp, Artificial Sequence
  Synthetic Polynucleotide
taatacgactcactatagggaatttcacatttgtaaacgtccttccccacaacagaggagagtggggatggacgtttacaacctggcggcagcgcaaaagatg

SEQ ID NO: 95679 - DNA, 103 bp, Artificial Sequence
  Synthetic Polynucleotide
taatacgactcactataggggcttatccacagctttttctaagcagaggcaacagaggagagcctctatgtagaaaaagaacctggcggcagcgcaaaagatg

SEQ ID NO: 95680 - DNA, 103 bp, Artificial Sequence
  Synthetic Polynucleotide
taatacgactcactataggggcatcttacaaatttcacatttgtaaacgtaacagaggagaacgtttatgaatgtgaaaaacctggcggcagcgcaaaagatg

SEQ ID NO: 95681 - DNA, 103 bp, Artificial Sequence
  Synthetic Polynucleotide
taatacgactcactatagggacgctaaaaggcatcttacaaatttcacataacagaggagaatgtgaatgttgtaagataacctggcggcagcgcaaaagatg

SEQ ID NO: 95682 - DNA, 103 bp, Artificial Sequence
  Synthetic Polynucleotide
taatacgactcactatagggggtactgtacacgctaaaaggcatcttacaaacagaggagatgtaagatgccttttagcaacctggcggcagcgcaaaagatg

SEQ ID NO: 95683 - DNA, 103 bp, Artificial Sequence
  Synthetic Polynucleotide
taatacgactcactataggggtttctccagggtactgtacacgctaaaagaacagaggagacttttaatgtgtacagtaaacctggcggcagcgcaaaagatg

SEQ ID NO: 95684 - DNA, 103 bp, Artificial Sequence
  Synthetic Polynucleotide
taatacgactcactatagggtttttcatgtgtttctccagggtactgtacaacagaggagagtacagatgcctggagaaaacctggcggcagcgcaaaagatg

SEQ ID NO: 95685 - DNA, 103 bp, Artificial Sequence
  Synthetic Polynucleotide
taatacgactcactatagggactgtgccattttttcatgtgtttctccagaacagaggagactggagatgcacatgaaaaacctggcggcagcgcaaaagatg

SEQ ID NO: 95686 - DNA, 103 bp, Artificial Sequence
  Synthetic Polynucleotide
taatacgactcactatagggacactcgatcactgtgccattttttcatgtaacagaggagaacatgaatgaatggcacaaacctggcggcagcgcaaaagatg

SEQ ID NO: 95687 - DNA, 103 bp, Artificial Sequence
  Synthetic Polynucleotide
taatacgactcactatagggtcattattcaacactcgatcactgtgccataacagaggagaatggcaatgtgatcgagtaacctggcggcagcgcaaaagatg

SEQ ID NO: 95688 - DNA, 103 bp, Artificial Sequence
  Synthetic Polynucleotide
taatacgactcactatagggagtttttatatcattattcaacactcgatcaacagaggagagatcgaatgttgaataataacctggcggcagcgcaaaagatg

SEQ ID NO: 95689 - DNA, 103 bp, Artificial Sequence
  Synthetic Polynucleotide
taatacgactcactatagggggggaaggtggcttatccacagctttttctaacagaggagaagaaaaatgtgtggataaaacctggcggcagcgcaaaagatg

SEQ ID NO: 95690 - DNA, 103 bp, Artificial Sequence
  Synthetic Polynucleotide
taatacgactcactataggggattggtgaaggggaaggtggcttatccacaacagaggagagtggatatgccaccttccaacctggcggcagcgcaaaagatg

SEQ ID NO: 95691 - DNA, 103 bp, Artificial Sequence
  Synthetic Polynucleotide
taatacgactcactatagggttttcatctcgattggtgaaggggaaggtgaacagaggagacaccttatgcttcaccaaaacctggcggcagcgcaaaagatg

SEQ ID NO: 95692 - DNA, 103 bp, Artificial Sequence
  Synthetic Polynucleotide
taatacgactcactatagggttggatgcttttttcatctcgattggtgaaaacagaggagattcaccatgcgagatgaaaacctggcggcagcgcaaaagatg

SEQ ID NO: 95693 - DNA, 103 bp, Artificial Sequence
  Synthetic Polynucleotide
taatacgactcactatagggctccacgggattggatgcttttttcatctcaacagaggagagagatgatgaaagcatccaacctggcggcagcgcaaaagatg

SEQ ID NO: 95694 - DNA, 103 bp, Artificial Sequence
  Synthetic Polynucleotide
taatacgactcactatagggggatgccaacctccacgggattggatgcttaacagaggagaaagcatatgatcccgtggaacctggcggcagcgcaaaagatg

SEQ ID NO: 95695 - DNA, 103 bp, Artificial Sequence
  Synthetic Polynucleotide
taatacgactcactatagggaattcccgtttgcttaagtgctggggtttgaacagaggagacaaaccatggcacttaagaacctggcggcagcgcaaaagatg

SEQ ID NO: 95696 - DNA, 103 bp, Artificial Sequence
  Synthetic Polynucleotide
taatacgactcactatagggggcgtgacctggatgccaacctccacgggaaacagaggagatcccgtatgggttggcataacctggcggcagcgcaaaagatg

SEQ ID NO: 95697 - DNA, 103 bp, Artificial Sequence
  Synthetic Polynucleotide
taatacgactcactataggggtcatcctctggcgtgacctggatgccaacaacagaggagagttggcatgcaggtcacgaacctggcggcagcgcaaaagatg

SEQ ID NO: 95698 - DNA, 103 bp, Artificial Sequence
  Synthetic Polynucleotide
taatacgactcactatagggataaacaatcgtcatcctctggcgtgacctaacagaggagaaggtcaatgcagaggatgaacctggcggcagcgcaaaagatg

SEQ ID NO: 95699 - DNA, 103 bp, Artificial Sequence
  Synthetic Polynucleotide
taatacgactcactataggggatgacgttgataaacaatcgtcatcctctaacagaggagaagaggaatgcgattgtttaacctggcggcagcgcaaaagatg

SEQ ID NO: 95700 - DNA, 103 bp, Artificial Sequence
  Synthetic Polynucleotide
taatacgactcactatagggaattcctctagatgacgttgataaacaatcaacagaggagagattgtatgtcaacgtcaaacctggcggcagcgcaaaagatg

SEQ ID NO: 95701 - DNA, 103 bp, Artificial Sequence
  Synthetic Polynucleotide
taatacgactcactataggggtttggggcaaattcctctagatgacgttgaacagaggagacaacgtatgctagaggaaaacctggcggcagcgcaaaagatg

SEQ ID NO: 95702 - DNA, 103 bp, Artificial Sequence
  Synthetic Polynucleotide
taatacgactcactatagggatgtgttcctgtttggggcaaattcctctaaacagaggagatagaggatgttgccccaaaacctggcggcagcgcaaaagatg

SEQ ID NO: 95703 - DNA, 103 bp, Artificial Sequence
  Synthetic Polynucleotide
taatacgactcactatagggtttacctgctatgtgttcctgtttggggcaaacagaggagatgccccatgcaggaacacaacctggcggcagcgcaaaagatg

SEQ ID NO: 95704 - DNA, 103 bp, Artificial Sequence
  Synthetic Polynucleotide
taatacgactcactatagggtgggctcatctttacctgctatgtgttcctaacagaggagaaggaacatgtagcaggtaaacctggcggcagcgcaaaagatg

SEQ ID NO: 95705 - DNA, 103 bp, Artificial Sequence
  Synthetic Polynucleotide
taatacgactcactataggggtgtagctgctgggctcatctttacctgctaacagaggagaagcaggatgagatgagccaacctggcggcagcgcaaaagatg

SEQ ID NO: 95706 - DNA, 103 bp, Artificial Sequence
  Synthetic Polynucleotide
taatacgactcactatagggctcgggcgagaattcccgtttgcttaagtgaacagaggagacacttaatgaaacgggaaaacctggcggcagcgcaaaagatg

SEQ ID NO: 95707 - DNA, 103 bp, Artificial Sequence
  Synthetic Polynucleotide
taatacgactcactatagggagttgtacatgtgtagctgctgggctcatcaacagaggagagatgagatgagcagctacaacctggcggcagcgcaaaagatg

SEQ ID NO: 95708 - DNA, 103 bp, Artificial Sequence
  Synthetic Polynucleotide
taatacgactcactataggggctgtttgcaagttgtacatgtgtagctgcaacagaggagagcagctatgcatgtacaaaacctggcggcagcgcaaaagatg

SEQ ID NO: 95709 - DNA, 103 bp, Artificial Sequence
  Synthetic Polynucleotide
taatacgactcactatagggctggtgaatggctgtttgcaagttgtacataacagaggagaatgtacatgttgcaaacaaacctggcggcagcgcaaaagatg

SEQ ID NO: 95710 - DNA, 103 bp, Artificial Sequence
  Synthetic Polynucleotide
taatacgactcactatagggaaaccatgcactggtgaatggctgtttgcaaacagaggagatgcaaaatgccattcaccaacctggcggcagcgcaaaagatg

SEQ ID NO: 95711 - DNA, 103 bp, Artificial Sequence
  Synthetic Polynucleotide
taatacgactcactataggggttgcaagagaaaccatgcactggtgaatgaacagaggagacattcaatggtgcatggtaacctggcggcagcgcaaaagatg

SEQ ID NO: 95712 - DNA, 103 bp, Artificial Sequence
  Synthetic Polynucleotide
taatacgactcactatagggttctgtgcgtgttgcaagagaaaccatgcaaacagaggagatgcatgatgtctcttgcaaacctggcggcagcgcaaaagatg

SEQ ID NO: 95713 - DNA, 103 bp, Artificial Sequence
  Synthetic Polynucleotide
taatacgactcactatagggtccatgagtgttctgtgcgtgttgcaagagaacagaggagactcttgatgcacgcacagaacctggcggcagcgcaaaagatg

SEQ ID NO: 95714 - DNA, 103 bp, Artificial Sequence
  Synthetic Polynucleotide
taatacgactcactatagggagattcttaatccatgagtgttctgtgcgtaacagaggagaacgcacatgacactcatgaacctggcggcagcgcaaaagatg

SEQ ID NO: 95715 - DNA, 103 bp, Artificial Sequence
  Synthetic Polynucleotide
taatacgactcactatagggctttctaagtagattcttaatccatgagtgaacagaggagacactcaatgattaagaataacctggcggcagcgcaaaagatg

SEQ ID NO: 95716 - DNA, 103 bp, Artificial Sequence
  Synthetic Polynucleotide
taatacgactcactatagggtccgtgttcgctttctaagtagattcttaaaacagaggagattaagaatgtacttagaaaacctggcggcagcgcaaaagatg

SEQ ID NO: 95717 - DNA, 103 bp, Artificial Sequence
  Synthetic Polynucleotide
taatacgactcactatagggcttcaagaggctcgggcgagaattcccgttaacagaggagaaacgggatgtctcgcccgaacctggcggcagcgcaaaagatg

SEQ ID NO: 95718 - DNA, 103 bp, Artificial Sequence
  Synthetic Polynucleotide
taatacgactcactatagggtcaggggacttccgtgttcgctttctaagtaacagaggagaacttagatggcgaacacgaacctggcggcagcgcaaaagatg

SEQ ID NO: 95719 - DNA, 103 bp, Artificial Sequence
  Synthetic Polynucleotide
taatacgactcactatagggacccgcggggtcaggggacttccgtgttcgaacagaggagacgaacaatgaagtcccctaacctggcggcagcgcaaaagatg

SEQ ID NO: 95720 - DNA, 103 bp, Artificial Sequence
  Synthetic Polynucleotide
taatacgactcactatagggagggataccaacccgcggggtcaggggactaacagaggagaagtcccatgaccccgcggaacctggcggcagcgcaaaagatg

SEQ ID NO: 95721 - DNA, 103 bp, Artificial Sequence
  Synthetic Polynucleotide
taatacgactcactatagggctagtcctgaagggataccaacccgcggggaacagaggagaccccgcatgttggtatccaacctggcggcagcgcaaaagatg

SEQ ID NO: 95722 - DNA, 103 bp, Artificial Sequence
  Synthetic Polynucleotide
taatacgactcactatagggcattctgcacctagtcctgaagggataccaaacagaggagatggtatatgttcaggactaacctggcggcagcgcaaaagatg

SEQ ID NO: 95723 - DNA, 103 bp, Artificial Sequence
  Synthetic Polynucleotide
taatacgactcactatagggctgggaaggacattctgcacctagtcctgaaacagaggagatcaggaatgggtgcagaaaacctggcggcagcgcaaaagatg

SEQ ID NO: 95724 - DNA, 103 bp, Artificial Sequence
  Synthetic Polynucleotide
taatacgactcactatagggggagaggtggctgggaaggacattctgcacaacagaggagagtgcagatggtccttcccaacctggcggcagcgcaaaagatg

SEQ ID NO: 95725 - DNA, 103 bp, Artificial Sequence
  Synthetic Polynucleotide
taatacgactcactatagggtgaatcccatggagaggtggctgggaaggaaacagaggagatccttcatggccacctctaacctggcggcagcgcaaaagatg

SEQ ID NO: 95726 - DNA, 103 bp, Artificial Sequence
  Synthetic Polynucleotide
taatacgactcactataggggtctgcaatatgaatcccatggagaggtggaacagaggagaccacctatgcatgggattaacctggcggcagcgcaaaagatg

SEQ ID NO: 95727 - DNA, 103 bp, Artificial Sequence
  Synthetic Polynucleotide
taatacgactcactatagggaggggttattgtctgcaatatgaatcccataacagaggagaatgggaatgatattgcagaacctggcggcagcgcaaaagatg

SEQ ID NO: 95728 - DNA, 103 bp, Artificial Sequence
  Synthetic Polynucleotide
taatacgactcactataggggtaagaatggcttcaagaggctcgggcgagaacagaggagactcgccatggcctcttgaaacctggcggcagcgcaaaagatg

SEQ ID NO: 95729 - DNA, 103 bp, Artificial Sequence
  Synthetic Polynucleotide
taatacgactcactatagggagcaggttaaaggggttattgtctgcaataaacagaggagatattgcatgcaataacccaacctggcggcagcgcaaaagatg

SEQ ID NO: 95730 - DNA, 103 bp, Artificial Sequence
  Synthetic Polynucleotide
taatacgactcactatagggtggtattcttagcaggttaaaggggttattaacagaggagaaataacatgtttaacctgaacctggcggcagcgcaaaagatg

SEQ ID NO: 95731 - DNA, 103 bp, Artificial Sequence
  Synthetic Polynucleotide
taatacgactcactatagggatactgatcctggtattcttagcaggttaaaacagaggagattaaccatgtaagaatacaacctggcggcagcgcaaaagatg

SEQ ID NO: 95732 - DNA, 103 bp, Artificial Sequence
  Synthetic Polynucleotide
taatacgactcactataggggcctctctcgatactgatcctggtattcttaacagaggagaaagaatatgaggatcagtaacctggcggcagcgcaaaagatg

SEQ ID NO: 95733 - DNA, 103 bp, Artificial Sequence
  Synthetic Polynucleotide
taatacgactcactatagggcaggccggaagcctctctcgatactgatccaacagaggagaggatcaatgtcgagagagaacctggcggcagcgcaaaagatg

SEQ ID NO: 95734 - DNA, 103 bp, Artificial Sequence
  Synthetic Polynucleotide
taatacgactcactataggggcccttctgccaggccggaagcctctctcgaacagaggagacgagagatgcttccggccaacctggcggcagcgcaaaagatg

SEQ ID NO: 95735 - DNA, 103 bp, Artificial Sequence
  Synthetic Polynucleotide
taatacgactcactatagggggtggaaagcgcccttctgccaggccggaaaacagaggagattccggatgggcagaaggaacctggcggcagcgcaaaagatg

SEQ ID NO: 95736 - DNA, 103 bp, Artificial Sequence
  Synthetic Polynucleotide
taatacgactcactatagggggggggagtgggtggaaagcgcccttctgcaacagaggagagcagaaatgcgctttccaaacctggcggcagcgcaaaagatg

SEQ ID NO: 95737 - DNA, 103 bp, Artificial Sequence
  Synthetic Polynucleotide
taatacgactcactataggggactaaacagggggggagtgggtggaaagcaacagaggagagctttcatgccactccccaacctggcggcagcgcaaaagatg

SEQ ID NO: 95738 - DNA, 103 bp, Artificial Sequence
  Synthetic Polynucleotide
taatacgactcactatagggctcggtggtggactaaacagggggggagtgaacagaggagacactccatgcctgtttagaacctggcggcagcgcaaaagatg

SEQ ID NO: 95739 - DNA, 103 bp, Artificial Sequence
  Synthetic Polynucleotide
taatacgactcactatagggttcatcatctgtaagaatggcttcaagaggaacagaggagacctcttatggccattcttaacctggcggcagcgcaaaagatg

SEQ ID NO: 95740 - DNA, 103 bp, Artificial Sequence
  Synthetic Polynucleotide
taatacgactcactatagggcaagtgatgtctcggtggtggactaaacagaacagaggagactgtttatgccaccaccgaacctggcggcagcgcaaaagatg

SEQ ID NO: 95741 - DNA, 103 bp, Artificial Sequence
  Synthetic Polynucleotide
taatacgactcactatagggggtgggggtccaagtgatgtctcggtggtgaacagaggagacaccacatggacatcactaacctggcggcagcgcaaaagatg

SEQ ID NO: 95742 - DNA, 103 bp, Artificial Sequence
  Synthetic Polynucleotide
taatacgactcactatagggcgctctatgcggtgggggtccaagtgatgtaacagaggagaacatcaatgggacccccaaacctggcggcagcgcaaaagatg

SEQ ID NO: 95743 - DNA, 103 bp, Artificial Sequence
  Synthetic Polynucleotide
taatacgactcactatagggcgcccccaggcgctctatgcggtgggggtcaacagaggagagaccccatgcgcatagagaacctggcggcagcgcaaaagatg

SEQ ID NO: 95744 - DNA, 103 bp, Artificial Sequence
  Synthetic Polynucleotide
taatacgactcactatagggccatctcttccgcccccaggcgctctatgcaacagaggagagcatagatggcctgggggaacctggcggcagcgcaaaagatg

SEQ ID NO: 95745 - DNA, 103 bp, Artificial Sequence
  Synthetic Polynucleotide
taatacgactcactataggggtggccagggccatctcttccgcccccaggaacagaggagacctgggatgggaagagataacctggcggcagcgcaaaagatg

SEQ ID NO: 95746 - DNA, 103 bp, Artificial Sequence
  Synthetic Polynucleotide
taatacgactcactatagggcgggtgatgggtggccagggccatctcttcaacagaggagagaagagatggccctggccaacctggcggcagcgcaaaagatg

SEQ ID NO: 95747 - DNA, 103 bp, Artificial Sequence
  Synthetic Polynucleotide
taatacgactcactatagggcaaaggcactcgggtgatgggtggccagggaacagaggagaccctggatgcccatcaccaacctggcggcagcgcaaaagatg

SEQ ID NO: 95748 - DNA, 103 bp, Artificial Sequence
  Synthetic Polynucleotide
taatacgactcactatagggagcaccctgtcaaaggcactcgggtgatggaacagaggagaccatcaatggagtgccttaacctggcggcagcgcaaaagatg

SEQ ID NO: 95749 - DNA, 103 bp, Artificial Sequence
  Synthetic Polynucleotide
taatacgactcactatagggattcaaccgcagcaccctgtcaaaggcactaacagaggagaagtgccatggacagggtgaacctggcggcagcgcaaaagatg

SEQ ID NO: 95750 - DNA, 103 bp, Artificial Sequence
  Synthetic Polynucleotide
taatacgactcactatagggcgtggtctggttcatcatctgtaagaatggaacagaggagaccattcatgcagatgatgaacctggcggcagcgcaaaagatg

SEQ ID NO: 95751 - DNA, 103 bp, Artificial Sequence
  Synthetic Polynucleotide
taatacgactcactatagggtagccattggattcaaccgcagcaccctgtaacagaggagaacagggatgtgcggttgaaacctggcggcagcgcaaaagatg

SEQ ID NO: 95752 - DNA, 103 bp, Artificial Sequence
  Synthetic Polynucleotide
taatacgactcactatagggggaggctccatagccattggattcaaccgcaacagaggagagcggttatgtccaatggcaacctggcggcagcgcaaaagatg

SEQ ID NO: 95753 - DNA, 103 bp, Artificial Sequence
  Synthetic Polynucleotide
taatacgactcactatagggatccatggcgggaggctccatagccattggaacagaggagaccaatgatgatggagcctaacctggcggcagcgcaaaagatg

SEQ ID NO: 95754 - DNA, 103 bp, Artificial Sequence
  Synthetic Polynucleotide
taatacgactcactatagggtcctagagaaatccatggcgggaggctccaaacagaggagatggagcatgccgccatggaacctggcggcagcgcaaaagatg

SEQ ID NO: 95755 - DNA, 103 bp, Artificial Sequence
  Synthetic Polynucleotide
taatacgactcactatagggtctctaagtctcctagagaaatccatggcgaacagaggagacgccatatgtttctctagaacctggcggcagcgcaaaagatg

SEQ ID NO: 95756 - DNA, 103 bp, Artificial Sequence
  Synthetic Polynucleotide
taatacgactcactatagggccctgccagctctctaagtctcctagagaaaacagaggagattctctatgagacttagaaacctggcggcagcgcaaaagatg

SEQ ID NO: 95757 - DNA, 103 bp, Artificial Sequence
  Synthetic Polynucleotide
taatacgactcactatagggtagacgtgttccctgccagctctctaagtcaacagaggagagacttaatgagctggcagaacctggcggcagcgcaaaagatg

SEQ ID NO: 95758 - DNA, 103 bp, Artificial Sequence
  Synthetic Polynucleotide
taatacgactcactatagggagcggtgggctagacgtgttccctgccagcaacagaggagagctggcatggaacacgtcaacctggcggcagcgcaaaagatg

SEQ ID NO: 95759 - DNA, 103 bp, Artificial Sequence
  Synthetic Polynucleotide
taatacgactcactataggggcctggggacagcggtgggctagacgtgttaacagaggagaaacacgatgagcccaccgaacctggcggcagcgcaaaagatg

SEQ ID NO: 95760 - DNA, 103 bp, Artificial Sequence
  Synthetic Polynucleotide
taatacgactcactatagggggctgggccggcctggggacagcggtgggcaacagaggagagcccacatgtgtccccagaacctggcggcagcgcaaaagatg

SEQ ID NO: 95761 - DNA, 103 bp, Artificial Sequence
  Synthetic Polynucleotide
taatacgactcactatagggcccaacgggccgtggtctggttcatcatctaacagaggagaagatgaatgaccagaccaaacctggcggcagcgcaaaagatg

SEQ ID NO: 95762 - DNA, 103 bp, Artificial Sequence
  Synthetic Polynucleotide
taatacgactcactatagggctttgcatagggctgggccggcctggggacaacagaggagagtccccatgccggcccagaacctggcggcagcgcaaaagatg

SEQ ID NO: 95763 - DNA, 103 bp, Artificial Sequence
  Synthetic Polynucleotide
taatacgactcactatagggttgcagtaacctttgcatagggctgggccgaacagaggagacggcccatgcctatgcaaaacctggcggcagcgcaaaagatg

SEQ ID NO: 95764 - DNA, 103 bp, Artificial Sequence
  Synthetic Polynucleotide
taatacgactcactataggggctggaatggttgcagtaacctttgcatagaacagaggagactatgcatgggttactgcaacctggcggcagcgcaaaagatg

SEQ ID NO: 95765 - DNA, 103 bp, Artificial Sequence
  Synthetic Polynucleotide
taatacgactcactatagggttgctacctggctggaatggttgcagtaacaacagaggagagttactatgaccattccaaacctggcggcagcgcaaaagatg

SEQ ID NO: 95766 - DNA, 103 bp, Artificial Sequence
  Synthetic Polynucleotide
taatacgactcactataggggaagggcggcttgctacctggctggaatggaacagaggagaccattcatgccaggtagcaacctggcggcagcgcaaaagatg

SEQ ID NO: 95767 - DNA, 103 bp, Artificial Sequence
  Synthetic Polynucleotide
taatacgactcactataggggcgtcgccaggaagggcggcttgctacctgaacagaggagacaggtaatgagccgccctaacctggcggcagcgcaaaagatg

SEQ ID NO: 95768 - DNA, 103 bp, Artificial Sequence
  Synthetic Polynucleotide
taatacgactcactataggggggagggggggcgtcgccaggaagggcggcaacagaggagagccgccatgcctggcgacaacctggcggcagcgcaaaagatg

SEQ ID NO: 95769 - DNA, 103 bp, Artificial Sequence
  Synthetic Polynucleotide
taatacgactcactatagggttgcagaggagggagggggggcgtcgccagaacagaggagactggcgatgccccccctcaacctggcggcagcgcaaaagatg

SEQ ID NO: 95770 - DNA, 103 bp, Artificial Sequence
  Synthetic Polynucleotide
taatacgactcactataggggaggggcggattgcagaggagggaggggggaacagaggagaccccccatgctcctctgcaacctggcggcagcgcaaaagatg

SEQ ID NO: 95771 - DNA, 103 bp, Artificial Sequence
  Synthetic Polynucleotide
taatacgactcactatagggtgggagggaggaggggcggattgcagaggaaacagaggagatcctctatgatccgccccaacctggcggcagcgcaaaagatg

SEQ ID NO: 95772 - DNA, 103 bp, Artificial Sequence
  Synthetic Polynucleotide
taatacgactcactatagggctgcgggttgccctgtttgcggcgggacataacagaggagaatgtccatgcgcaaacagaacctggcggcagcgcaaaagatg

SEQ ID NO: 95773 - DNA, 103 bp, Artificial Sequence
  Synthetic Polynucleotide
taatacgactcactatagggctcctctatctccagaccctcgtcttcttcaacagaggagagaagaaatggagggtctgaacctggcggcagcgcaaaagatg

SEQ ID NO: 95774 - DNA, 103 bp, Artificial Sequence
  Synthetic Polynucleotide
taatacgactcactatagggctgggcgacgagccccatctcctcggcactaacagaggagaagtgccatggagatggggaacctggcggcagcgcaaaagatg

SEQ ID NO: 95775 - DNA, 103 bp, Artificial Sequence
  Synthetic Polynucleotide
taatacgactcactatagggcactggggtgctgggcgacgagccccatctaacagaggagaagatggatgtcgtcgcccaacctggcggcagcgcaaaagatg

SEQ ID NO: 95776 - DNA, 103 bp, Artificial Sequence
  Synthetic Polynucleotide
taatacgactcactatagggcggtcgaaggcactggggtgctgggcgacgaacagaggagacgtcgcatggcaccccagaacctggcggcagcgcaaaagatg

SEQ ID NO: 95777 - DNA, 103 bp, Artificial Sequence
  Synthetic Polynucleotide
taatacgactcactataggggcgcatgactcggtcgaaggcactggggtgaacagaggagacaccccatggccttcgacaacctggcggcagcgcaaaagatg

SEQ ID NO: 95778 - DNA, 103 bp, Artificial Sequence
  Synthetic Polynucleotide
taatacgactcactatagggtggggttcaggcgcatgactcggtcgaaggaacagaggagaccttcgatggagtcatgcaacctggcggcagcgcaaaagatg

SEQ ID NO: 95779 - DNA, 103 bp, Artificial Sequence
  Synthetic Polynucleotide
taatacgactcactatagggtcgatggccatggggttcaggcgcatgactaacagaggagaagtcatatgcctgaacccaacctggcggcagcgcaaaagatg

SEQ ID NO: 95780 - DNA, 103 bp, Artificial Sequence
  Synthetic Polynucleotide
taatacgactcactatagggggcgggcgagtcgatggccatggggttcagaacagaggagactgaacatgatggccatcaacctggcggcagcgcaaaagatg

SEQ ID NO: 95781 - DNA, 103 bp, Artificial Sequence
  Synthetic Polynucleotide
taatacgactcactatagggagaagtccatggcgggcgagtcgatggccaaacagaggagatggccaatgactcgcccgaacctggcggcagcgcaaaagatg

SEQ ID NO: 95782 - DNA, 103 bp, Artificial Sequence
  Synthetic Polynucleotide
taatacgactcactatagggagccgccgcgagaagtccatggcgggcgagaacagaggagactcgccatgcatggacttaacctggcggcagcgcaaaagatg

SEQ ID NO: 95783 - DNA, 103 bp, Artificial Sequence
  Synthetic Polynucleotide
taatacgactcactatagggcagctcgcggagccgccgcgagaagtccataacagaggagaatggacatgtcgcggcggaacctggcggcagcgcaaaagatg

SEQ ID NO: 95784 - DNA, 103 bp, Artificial Sequence
  Synthetic Polynucleotide
taatacgactcactatagggggccacttggctcctctatctccagaccctaacagaggagaagggtcatgagatagaggaacctggcggcagcgcaaaagatg

SEQ ID NO: 95785 - DNA, 103 bp, Artificial Sequence
  Synthetic Polynucleotide
taatacgactcactatagggtgttgcccgccagctcgcggagccgccgcgaacagaggagacgcggcatgtccgcgagcaacctggcggcagcgcaaaagatg

SEQ ID NO: 95786 - DNA, 103 bp, Artificial Sequence
  Synthetic Polynucleotide
taatacgactcactatagggggcgtggagctgttgcccgccagctcgcggaacagaggagaccgcgaatgggcgggcaaaacctggcggcagcgcaaaagatg

SEQ ID NO: 95787 - DNA, 103 bp, Artificial Sequence
  Synthetic Polynucleotide
taatacgactcactatagggcacgggcggcggcgtggagctgttgcccgcaacagaggagagcgggcatgagctccacgaacctggcggcagcgcaaaagatg

SEQ ID NO: 95788 - DNA, 103 bp, Artificial Sequence
  Synthetic Polynucleotide
taatacgactcactatagggggcccggggacacgggcggcggcgtggagcaacagaggagagctccaatgcgccgcccgaacctggcggcagcgcaaaagatg

SEQ ID NO: 95789 - DNA, 103 bp, Artificial Sequence
  Synthetic Polynucleotide
taatacgactcactataggggggttgccgcggcccggggacacgggcggcaacagaggagagccgccatggtccccgggaacctggcggcagcgcaaaagatg

SEQ ID NO: 95790 - DNA, 103 bp, Artificial Sequence
  Synthetic Polynucleotide
taatacgactcactatagggccggtgcatagggttgccgcggcccggggaaacagaggagatccccgatgcgcggcaacaacctggcggcagcgcaaaagatg

SEQ ID NO: 95791 - DNA, 103 bp, Artificial Sequence
  Synthetic Polynucleotide
taatacgactcactatagggggttcaggagccggtgcatagggttgccgcaacagaggagagcggcaatgctatgcaccaacctggcggcagcgcaaaagatg

SEQ ID NO: 95792 - DNA, 103 bp, Artificial Sequence
  Synthetic Polynucleotide
taatacgactcactatagggggctggaaggggttcaggagccggtgcataaacagaggagatatgcaatggctcctgaaaacctggcggcagcgcaaaagatg

SEQ ID NO: 95793 - DNA, 103 bp, Artificial Sequence
  Synthetic Polynucleotide
taatacgactcactatagggcttggggctgggctggaaggggttcaggagaacagaggagactcctgatgcccttccagaacctggcggcagcgcaaaagatg

SEQ ID NO: 95794 - DNA, 103 bp, Artificial Sequence
  Synthetic Polynucleotide
taatacgactcactatagggggaacggggacttggggctgggctggaaggaacagaggagaccttccatgccagccccaaacctggcggcagcgcaaaagatg

SEQ ID NO: 95795 - DNA, 103 bp, Artificial Sequence
  Synthetic Polynucleotide
taatacgactcactatagggatcagccccaggccacttggctcctctatcaacagaggagagatagaatggccaagtggaacctggcggcagcgcaaaagatg

SEQ ID NO: 95796 - DNA, 103 bp, Artificial Sequence
  Synthetic Polynucleotide
taatacgactcactatagggggcgtgctcaggaacggggacttggggctgaacagaggagacagcccatggtccccgttaacctggcggcagcgcaaaagatg

SEQ ID NO: 95797 - DNA, 103 bp, Artificial Sequence
  Synthetic Polynucleotide
taatacgactcactatagggcggcagcggcggcgtgctcaggaacggggaaacagaggagatccccgatgctgagcacgaacctggcggcagcgcaaaagatg

SEQ ID NO: 95798 - DNA, 103 bp, Artificial Sequence
  Synthetic Polynucleotide
taatacgactcactatagggggggcatgggcggcagcggcggcgtgctcaaacagaggagatgagcaatgcgccgctgcaacctggcggcagcgcaaaagatg

SEQ ID NO: 95799 - DNA, 103 bp, Artificial Sequence
  Synthetic Polynucleotide
taatacgactcactataggggtgccgccagggggcatgggcggcagcggcaacagaggagagccgctatggcccatgccaacctggcggcagcgcaaaagatg

SEQ ID NO: 95800 - DNA, 103 bp, Artificial Sequence
  Synthetic Polynucleotide
taatacgactcactatagggcgggggcggcgtgccgccagggggcatgggaacagaggagacccatgatgcctggcggcaacctggcggcagcgcaaaagatg

SEQ ID NO: 95801 - DNA, 103 bp, Artificial Sequence
  Synthetic Polynucleotide
taatacgactcactatagggctggcggctgcgggggcggcgtgccgccagaacagaggagactggcgatgcgccgccccaacctggcggcagcgcaaaagatg

SEQ ID NO: 95802 - DNA, 103 bp, Artificial Sequence
  Synthetic Polynucleotide
taatacgactcactatagggttgctcttggctggcggctgcgggggcggcaacagaggagagccgccatggcagccgccaacctggcggcagcgcaaaagatg

SEQ ID NO: 95803 - DNA, 103 bp, Artificial Sequence
  Synthetic Polynucleotide
taatacgactcactatagggctcgcacgacttgctcttggctggcggctgaacagaggagacagccgatggccaagagcaacctggcggcagcgcaaaagatg

SEQ ID NO: 95804 - DNA, 103 bp, Artificial Sequence
  Synthetic Polynucleotide
taatacgactcactatagggtgccgcagaactcgcacgacttgctcttggaacagaggagaccaagaatgagtcgtgcgaacctggcggcagcgcaaaagatg

SEQ ID NO: 95805 - DNA, 103 bp, Artificial Sequence
  Synthetic Polynucleotide
taatacgactcactatagggttgaaggtcttgccgcagaactcgcacgacaacagaggagagtcgtgatggttctgcggaacctggcggcagcgcaaaagatg

SEQ ID NO: 95806 - DNA, 103 bp, Artificial Sequence
  Synthetic Polynucleotide
taatacgactcactataggggccacccaccatcagccccaggccacttggaacagaggagaccaagtatgctggggctgaacctggcggcagcgcaaaagatg

SEQ ID NO: 95807 - DNA, 103 bp, Artificial Sequence
  Synthetic Polynucleotide
taatacgactcactataggggctctggaacttgaaggtcttgccgcagaaaacagaggagattctgcatgaagaccttcaacctggcggcagcgcaaaagatg

SEQ ID NO: 95808 - DNA, 103 bp, Artificial Sequence
  Synthetic Polynucleotide
taatacgactcactatagggcgatgagattgctctggaacttgaaggtctaacagaggagaagacctatgagttccagaaacctggcggcagcgcaaaagatg

SEQ ID NO: 95809 - DNA, 103 bp, Artificial Sequence
  Synthetic Polynucleotide
taatacgactcactatagggcgccggtgcacgatgagattgctctggaacaacagaggagagttccaatgcaatctcataacctggcggcagcgcaaaagatg

SEQ ID NO: 95810 - DNA, 103 bp, Artificial Sequence
  Synthetic Polynucleotide
taatacgactcactatagggcgtgtgactgcgccggtgcacgatgagattaacagaggagaaatctcatggtgcaccggaacctggcggcagcgcaaaagatg

SEQ ID NO: 95811 - DNA, 103 bp, Artificial Sequence
  Synthetic Polynucleotide
taatacgactcactataggggcttctcgcccgtgtgactgcgccggtgcaaacagaggagatgcaccatggcagtcacaaacctggcggcagcgcaaaagatg

SEQ ID NO: 95812 - DNA, 103 bp, Artificial Sequence
  Synthetic Polynucleotide
taatacgactcactatagggcacttgtagggcttctcgcccgtgtgactgaacagaggagacagtcaatggggcgagaaaacctggcggcagcgcaaaagatg

SEQ ID NO: 95813 - DNA, 103 bp, Artificial Sequence
  Synthetic Polynucleotide
taatacgactcactataggggcacagctggcacttgtagggcttctcgccaacagaggagaggcgagatgccctacaagaacctggcggcagcgcaaaagatg

SEQ ID NO: 95814 - DNA, 103 bp, Artificial Sequence
  Synthetic Polynucleotide
taatacgactcactatagggacgcgtggtcgcacagctggcacttgtaggaacagaggagacctacaatggccagctgtaacctggcggcagcgcaaaagatg

SEQ ID NO: 95815 - DNA, 103 bp, Artificial Sequence
  Synthetic Polynucleotide
taatacgactcactataggggcctgcgagcacgcgtggtcgcacagctggaacagaggagaccagctatgcgaccacgcaacctggcggcagcgcaaaagatg

SEQ ID NO: 95816 - DNA, 103 bp, Artificial Sequence
  Synthetic Polynucleotide
taatacgactcactataggggagcttgctggcctgcgagcacgcgtggtcaacagaggagagaccacatgtgctcgcagaacctggcggcagcgcaaaagatg

SEQ ID NO: 95817 - DNA, 103 bp, Artificial Sequence
  Synthetic Polynucleotide
taatacgactcactatagggcagggtcggggccacccaccatcagccccaaacagaggagatggggcatgtggtgggtgaacctggcggcagcgcaaaagatg

SEQ ID NO: 95818 - DNA, 103 bp, Artificial Sequence
  Synthetic Polynucleotide
taatacgactcactatagggtgtggcgcttgagcttgctggcctgcgagcaacagaggagagctcgcatgccagcaagcaacctggcggcagcgcaaaagatg

SEQ ID NO: 95819 - DNA, 103 bp, Artificial Sequence
  Synthetic Polynucleotide
taatacgactcactatagggtgcgtcttcatgtggcgcttgagcttgctgaacagaggagacagcaaatgcaagcgccaaacctggcggcagcgcaaaagatg

SEQ ID NO: 95820 - DNA, 103 bp, Artificial Sequence
  Synthetic Polynucleotide
taatacgactcactatagggcttgtgcatgtgcgtcttcatgtggcgcttaacagaggagaaagcgcatgatgaagacgaacctggcggcagcgcaaaagatg

SEQ ID NO: 95821 - DNA, 103 bp, Artificial Sequence
  Synthetic Polynucleotide
taatacgactcactataggggcgagccggccttgtgcatgtgcgtcttcaaacagaggagatgaagaatgacatgcacaaacctggcggcagcgcaaaagatg

SEQ ID NO: 95822 - DNA, 103 bp, Artificial Sequence
  Synthetic Polynucleotide
taatacgactcactatagggcggccggccagcgagccggccttgtgcatgaacagaggagacatgcaatgggccggctcaacctggcggcagcgcaaaagatg

SEQ ID NO: 95823 - DNA, 103 bp, Artificial Sequence
  Synthetic Polynucleotide
taatacgactcactataggggtcgtcggagcggccggccagcgagccggcaacagaggagagccggcatgctggccggcaacctggcggcagcgcaaaagatg

SEQ ID NO: 95824 - DNA, 103 bp, Artificial Sequence
  Synthetic Polynucleotide
taatacgactcactatagggccgagagcccgtcgtcggagcggccggccaaacagaggagatggccgatggctccgacgaacctggcggcagcgcaaaagatg

SEQ ID NO: 95825 - DNA, 103 bp, Artificial Sequence
  Synthetic Polynucleotide
taatacgactcactataggggagctggcggccgagagcccgtcgtcggagaacagaggagactccgaatgcgggctctcaacctggcggcagcgcaaaagatg

SEQ ID NO: 95826 - DNA, 103 bp, Artificial Sequence
  Synthetic Polynucleotide
taatacgactcactataggggggctcgggggagctggcggccgagagcccaacagaggagagggctcatggccgccagcaacctggcggcagcgcaaaagatg

SEQ ID NO: 95827 - DNA, 103 bp, Artificial Sequence
  Synthetic Polynucleotide
taatacgactcactatagggcgctggtgccgggctcgggggagctggcggaacagaggagaccgccaatgcccccgagcaacctggcggcagcgcaaaagatg

SEQ ID NO: 95828 - DNA, 103 bp, Artificial Sequence
  Synthetic Polynucleotide
taatacgactcactataggggtgagcaggtcagggtcggggccacccaccaacagaggagaggtgggatgccccgacccaacctggcggcagcgcaaaagatg

SEQ ID NO: 95829 - DNA, 103 bp, Artificial Sequence
  Synthetic Polynucleotide
taatacgactcactatagggcccgccagctcgctggtgccgggctcggggaacagaggagaccccgaatgcggcaccagaacctggcggcagcgcaaaagatg

SEQ ID NO: 95830 - DNA, 103 bp, Artificial Sequence
  Synthetic Polynucleotide
taatacgactcactataggggaggccctcgcccgccagctcgctggtgccaacagaggagaggcaccatggagctggcgaacctggcggcagcgcaaaagatg

SEQ ID NO: 95831 - DNA, 103 bp, Artificial Sequence
  Synthetic Polynucleotide
taatacgactcactatagggcggccgccttgaggccctcgcccgccagctaacagaggagaagctggatggcgagggccaacctggcggcagcgcaaaagatg

SEQ ID NO: 95832 - DNA, 103 bp, Artificial Sequence
  Synthetic Polynucleotide
taatacgactcactatagggaagtcaccgtcggccgccttgaggccctcgaacagaggagacgagggatgcaaggcggcaacctggcggcagcgcaaaagatg

SEQ ID NO: 95833 - DNA, 103 bp, Artificial Sequence
  Synthetic Polynucleotide
taatacgactcactataggggtggtggcggaagtcaccgtcggccgccttaacagaggagaaaggcgatggacggtgacaacctggcggcagcgcaaaagatg

SEQ ID NO: 95834 - DNA, 103 bp, Artificial Sequence
  Synthetic Polynucleotide
taatacgactcactatagggggtcgctctcgtggtggcggaagtcaccgtaacagaggagaacggtgatgtccgccaccaacctggcggcagcgcaaaagatg

SEQ ID NO: 95835 - DNA, 103 bp, Artificial Sequence
  Synthetic Polynucleotide
taatacgactcactatagggcccagcgacgggtcgctctcgtggtggcggaacagaggagaccgccaatgcgagagcgaaacctggcggcagcgcaaaagatg

SEQ ID NO: 95836 - DNA, 103 bp, Artificial Sequence
  Synthetic Polynucleotide
taatacgactcactatagggcggctcgtggcccagcgacgggtcgctctcaacagaggagagagagcatgccgtcgctgaacctggcggcagcgcaaaagatg

SEQ ID NO: 95837 - DNA, 103 bp, Artificial Sequence
  Synthetic Polynucleotide
taatacgactcactatagggcctcctcctccggctcgtggcccagcgacgaacagaggagacgtcgcatggccacgagcaacctggcggcagcgcaaaagatg

SEQ ID NO: 95838 - DNA, 103 bp, Artificial Sequence
  Synthetic Polynucleotide
taatacgactcactatagggtcctcctcgtcctcctcctccggctcgtggaacagaggagaccacgaatgggaggaggaaacctggcggcagcgcaaaagatg

SEQ ID NO: 95839 - DNA, 103 bp, Artificial Sequence
  Synthetic Polynucleotide
taatacgactcactatagggctggccacaggtgagcaggtcagggtcgggaacagaggagacccgacatggacctgctcaacctggcggcagcgcaaaagatg

SEQ ID NO: 95840 - DNA, 103 bp, Artificial Sequence
  Synthetic Polynucleotide
taatacgactcactatagggctcctcctcctcctcctcgtcctcctcctcaacagaggagagaggagatggacgaggagaacctggcggcagcgcaaaagatg

SEQ ID NO: 95841 - DNA, 103 bp, Artificial Sequence
  Synthetic Polynucleotide
taatacgactcactataggggctcctcctcctcctcctcctcctcctcgtaacagaggagaacgaggatgaggaggaggaacctggcggcagcgcaaaagatg

SEQ ID NO: 95842 - DNA, 103 bp, Artificial Sequence
  Synthetic Polynucleotide
taatacgactcactatagggtccagtagcagctcctcctcctcctcctccaacagaggagaggaggaatgggaggaggaaacctggcggcagcgcaaaagatg

SEQ ID NO: 95843 - DNA, 103 bp, Artificial Sequence
  Synthetic Polynucleotide
taatacgactcactataggggctctcgttctccagtagcagctcctcctcaacagaggagagaggagatgctgctactgaacctggcggcagcgcaaaagatg

SEQ ID NO: 95844 - DNA, 103 bp, Artificial Sequence
  Synthetic Polynucleotide
taatacgactcactatagggactcgggccggctctcgttctccagtagcaaacagaggagatgctacatgagaacgagaaacctggcggcagcgcaaaagatg

SEQ ID NO: 95845 - DNA, 103 bp, Artificial Sequence
  Synthetic Polynucleotide
taatacgactcactatagggctgaagctcgactcgggccggctctcgttcaacagaggagagaacgaatgccggcccgaaacctggcggcagcgcaaaagatg

SEQ ID NO: 95846 - DNA, 103 bp, Artificial Sequence
  Synthetic Polynucleotide
taatacgactcactatagggcgagtccatgctgaagctcgactcgggccgaacagaggagacggcccatgtcgagcttcaacctggcggcagcgcaaaagatg

SEQ ID NO: 95847 - DNA, 103 bp, Artificial Sequence
  Synthetic Polynucleotide
taatacgactcactatagggggctcagctccgagtccatgctgaagctcgaacagaggagacgagctatggcatggactaacctggcggcagcgcaaaagatg

SEQ ID NO: 95848 - DNA, 103 bp, Artificial Sequence
  Synthetic Polynucleotide
taatacgactcactatagggtcgcggttgcggctcagctccgagtccatgaacagaggagacatggaatgggagctgagaacctggcggcagcgcaaaagatg

SEQ ID NO: 95849 - DNA, 103 bp, Artificial Sequence
  Synthetic Polynucleotide
taatacgactcactatagggaccgccgttctcgcggttgcggctcagctcaacagaggagagagctgatgcgcaaccgcaacctggcggcagcgcaaaagatg

SEQ ID NO: 95850 - DNA, 103 bp, Artificial Sequence
  Synthetic Polynucleotide
taatacgactcactatagggtcatttgacactggccacaggtgagcaggtaacagaggagaacctgcatgcctgtggccaacctggcggcagcgcaaaagatg

SEQ ID NO: 95851 - DNA, 103 bp, Artificial Sequence
  Synthetic Polynucleotide
taatacgactcactataggggcaccccaccaccgccgttctcgcggttgcaacagaggagagcaaccatgagaacggcgaacctggcggcagcgcaaaagatg

SEQ ID NO: 95852 - DNA, 103 bp, Artificial Sequence
  Synthetic Polynucleotide
taatacgactcactataggggggaccccgggcaccccaccaccgccgttcaacagaggagagaacggatgtggtggggtaacctggcggcagcgcaaaagatg

SEQ ID NO: 95853 - DNA, 103 bp, Artificial Sequence
  Synthetic Polynucleotide
taatacgactcactatagggccccgcgcccgggaccccgggcaccccaccaacagaggagaggtgggatgcccggggtcaacctggcggcagcgcaaaagatg

SEQ ID NO: 95854 - DNA, 103 bp, Artificial Sequence
  Synthetic Polynucleotide
taatacgactcactatagggccgcgccgccccccgcgcccgggaccccggaacagaggagaccggggatgcgggcgcggaacctggcggcagcgcaaaagatg

SEQ ID NO: 95855 - DNA, 103 bp, Artificial Sequence
  Synthetic Polynucleotide
taatacgactcactatagggagcgccttggccgcgccgccccccgcgcccaacagaggagagggcgcatggggcggcgcaacctggcggcagcgcaaaagatg

SEQ ID NO: 95856 - DNA, 103 bp, Artificial Sequence
  Synthetic Polynucleotide
taatacgactcactatagggctcgtcagccagcgccttggccgcgccgccaacagaggagaggcggcatggccaaggcgaacctggcggcagcgcaaaagatg

SEQ ID NO: 95857 - DNA, 103 bp, Artificial Sequence
  Synthetic Polynucleotide
taatacgactcactatagggccagcgccttctcgtcagccagcgccttggaacagaggagaccaaggatgtggctgacgaacctggcggcagcgcaaaagatg

SEQ ID NO: 95858 - DNA, 103 bp, Artificial Sequence
  Synthetic Polynucleotide
taatacgactcactatagggttgcccagcaccagcgccttctcgtcagccaacagaggagaggctgaatggaaggcgctaacctggcggcagcgcaaaagatg

SEQ ID NO: 95859 - DNA, 103 bp, Artificial Sequence
  Synthetic Polynucleotide
taatacgactcactatagggctccatgaccttgcccagcaccagcgccttaacagaggagaaaggcgatggtgctgggcaacctggcggcagcgcaaaagatg

SEQ ID NO: 95860 - DNA, 103 bp, Artificial Sequence
  Synthetic Polynucleotide
taatacgactcactatagggggcccacgttctccatgaccttgcccagcaaacagaggagatgctggatgaggtcatggaacctggcggcagcgcaaaagatg

SEQ ID NO: 95861 - DNA, 103 bp, Artificial Sequence
  Synthetic Polynucleotide
taatacgactcactatagggaaggggaagttcatttgacactggccacagaacagaggagactgtggatggtgtcaaataacctggcggcagcgcaaaagatg

SEQ ID NO: 95862 - DNA, 103 bp, Artificial Sequence
  Synthetic Polynucleotide
taatacgactcactatagggagtgcgcctaggcccacgttctccatgaccaacagaggagaggtcatatggaacgtgggaacctggcggcagcgcaaaagatg

SEQ ID NO: 95863 - DNA, 103 bp, Artificial Sequence
  Synthetic Polynucleotide
taatacgactcactataggggtactgcggcagtgcgcctaggcccacgttaacagaggagaaacgtgatgctaggcgcaaacctggcggcagcgcaaaagatg

SEQ ID NO: 95864 - DNA, 103 bp, Artificial Sequence
  Synthetic Polynucleotide
taatacgactcactatagggggagctcgccgtactgcggcagtgcgcctaaacagaggagataggcgatgtgccgcagtaacctggcggcagcgcaaaagatg

SEQ ID NO: 95865 - DNA, 103 bp, Artificial Sequence
  Synthetic Polynucleotide
taatacgactcactatagggttgtcggccaggagctcgccgtactgcggcaacagaggagagccgcaatgcggcgagctaacctggcggcagcgcaaaagatg

SEQ ID NO: 95866 - DNA, 103 bp, Artificial Sequence
  Synthetic Polynucleotide
taatacgactcactataggggcgcttctgcttgtcggccaggagctcgccaacagaggagaggcgagatgctggccgacaacctggcggcagcgcaaaagatg

SEQ ID NO: 95867 - DNA, 103 bp, Artificial Sequence
  Synthetic Polynucleotide
taatacgactcactatagggggaaggcgccgcgcttctgcttgtcggccaaacagaggagatggccgatgagcagaagcaacctggcggcagcgcaaaagatg

SEQ ID NO: 95868 - DNA, 103 bp, Artificial Sequence
  Synthetic Polynucleotide
taatacgactcactataggggcacgcttcaggaaggcgccgcgcttctgcaacagaggagagcagaaatgcggcgccttaacctggcggcagcgcaaaagatg

SEQ ID NO: 95869 - DNA, 103 bp, Artificial Sequence
  Synthetic Polynucleotide
taatacgactcactataggggccgcccgccgcacgcttcaggaaggcgccaacagaggagaggcgccatgctgaagcgtaacctggcggcagcgcaaaagatg

SEQ ID NO: 95870 - DNA, 103 bp, Artificial Sequence
  Synthetic Polynucleotide
taatacgactcactatagggccgcgtccccgccgcccgccgcacgcttcaaacagaggagatgaagcatgcggcgggcgaacctggcggcagcgcaaaagatg

SEQ ID NO: 95871 - DNA, 103 bp, Artificial Sequence
  Synthetic Polynucleotide
taatacgactcactatagggtcgtcgtcgcccgcgtccccgccgcccgccaacagaggagaggcgggatgcggggacgcaacctggcggcagcgcaaaagatg

SEQ ID NO: 95872 - DNA, 103 bp, Artificial Sequence
  Synthetic Polynucleotide
taatacgactcactataggggatgtcccccaaggggaagttcatttgacaaacagaggagatgtcaaatgaacttccccaacctggcggcagcgcaaaagatg

SEQ ID NO: 95873 - DNA, 103 bp, Artificial Sequence
  Synthetic Polynucleotide
taatacgactcactataggggcccgcgtcgtcgtcgtcgcccgcgtccccaacagaggagaggggacatgggcgacgacaacctggcggcagcgcaaaagatg

SEQ ID NO: 95874 - DNA, 103 bp, Artificial Sequence
  Synthetic Polynucleotide
taatacgactcactatagggccccgcagccgcccgcgtcgtcgtcgtcgcaacagaggagagcgacgatgacgacgcggaacctggcggcagcgcaaaagatg

SEQ ID NO: 95875 - DNA, 103 bp, Artificial Sequence
  Synthetic Polynucleotide
taatacgactcactataggggcgcccgcgtccccgcagccgcccgcgtcgaacagaggagacgacgcatgcggctgcggaacctggcggcagcgcaaaagatg

SEQ ID NO: 95876 - DNA, 103 bp, Artificial Sequence
  Synthetic Polynucleotide
taatacgactcactatagggcgcgccgcccgcgcccgcgtccccgcagccaacagaggagaggctgcatggacgcgggcaacctggcggcagcgcaaaagatg

SEQ ID NO: 95877 - DNA, 103 bp, Artificial Sequence
  Synthetic Polynucleotide
taatacgactcactataggggcccgttgaccgcgccgcccgcgcccgcgtaacagaggagaacgcggatgcgggcggcgaacctggcggcagcgcaaaagatg

SEQ ID NO: 95878 - DNA, 103 bp, Artificial Sequence
  Synthetic Polynucleotide
taatacgactcactatagggccgcccccgcgcccgttgaccgcgccgcccaacagaggagagggcggatgggtcaacggaacctggcggcagcgcaaaagatg

SEQ ID NO: 95879 - DNA, 103 bp, Artificial Sequence
  Synthetic Polynucleotide
taatacgactcactatagggtggcgcgaagccgcccccgcgcccgttgacaacagaggagagtcaacatgcgcgggggcaacctggcggcagcgcaaaagatg

SEQ ID NO: 95880 - DNA, 103 bp, Artificial Sequence
  Synthetic Polynucleotide
taatacgactcactataggggctcggtgcctggcgcgaagccgcccccgcaacagaggagagcggggatggcttcgcgcaacctggcggcagcgcaaaagatg

SEQ ID NO: 95881 - DNA, 103 bp, Artificial Sequence
  Synthetic Polynucleotide
taatacgactcactatagggccggggaagggctcggtgcctggcgcgaagaacagaggagacttcgcatgaggcaccgaaacctggcggcagcgcaaaagatg

SEQ ID NO: 95882 - DNA, 103 bp, Artificial Sequence
  Synthetic Polynucleotide
taatacgactcactatagggcgggaagagcccggggaagggctcggtgccaacagaggagaggcaccatgcccttccccaacctggcggcagcgcaaaagatg

SEQ ID NO: 95883 - DNA, 103 bp, Artificial Sequence
  Synthetic Polynucleotide
taatacgactcactataggggggacaagtgctgcgggttgccctgtttgcaacagaggagagcaaacatggcaacccgcaacctggcggcagcgcaaaagatg

SEQ ID NO: 95884 - DNA, 103 bp, Artificial Sequence
  Synthetic Polynucleotide
taatacgactcactatagggtaaaaaccaggatgtcccccaaggggaagtaacagaggagaacttccatgtgggggacaaacctggcggcagcgcaaaagatg

SEQ ID NO: 95885 - DNA, 103 bp, Artificial Sequence
  Synthetic Polynucleotide
taatacgactcactatagggcgggcttgcgcgggaagagcccggggaaggaacagaggagaccttccatgggctcttccaacctggcggcagcgcaaaagatg

SEQ ID NO: 95886 - DNA, 103 bp, Artificial Sequence
  Synthetic Polynucleotide
taatacgactcactatagggggcagcggcgcgggcttgcgcgggaagagcaacagaggagagctcttatggcgcaagccaacctggcggcagcgcaaaagatg

SEQ ID NO: 95887 - DNA, 103 bp, Artificial Sequence
  Synthetic Polynucleotide
taatacgactcactatagggcccggggctgggcagcggcgcgggcttgcgaacagaggagacgcaagatggcgccgctgaacctggcggcagcgcaaaagatg

SEQ ID NO: 95888 - DNA, 103 bp, Artificial Sequence
  Synthetic Polynucleotide
taatacgactcactatagggcgctgttgagcccggggctgggcagcggcgaacagaggagacgccgcatgccagccccgaacctggcggcagcgcaaaagatg

SEQ ID NO: 95889 - DNA, 103 bp, Artificial Sequence
  Synthetic Polynucleotide
taatacgactcactatagggcgcttggcggcgctgttgagcccggggctgaacagaggagacagcccatggctcaacagaacctggcggcagcgcaaaagatg

SEQ ID NO: 95890 - DNA, 103 bp, Artificial Sequence
  Synthetic Polynucleotide
taatacgactcactatagggcaccttgatgcgcttggcggcgctgttgagaacagaggagactcaacatggccgccaagaacctggcggcagcgcaaaagatg

SEQ ID NO: 95891 - DNA, 103 bp, Artificial Sequence
  Synthetic Polynucleotide
taatacgactcactatagggggtccttctccaccttgatgcgcttggcggaacagaggagaccgccaatggcatcaaggaacctggcggcagcgcaaaagatg

SEQ ID NO: 95892 - DNA, 103 bp, Artificial Sequence
  Synthetic Polynucleotide
taatacgactcactatagggggcagctccaggtccttctccaccttgatgaacagaggagacatcaaatgggagaaggaaacctggcggcagcgcaaaagatg

SEQ ID NO: 95893 - DNA, 103 bp, Artificial Sequence
  Synthetic Polynucleotide
taatacgactcactatagggcgcggcgggcggcagctccaggtccttctcaacagaggagagagaagatgctggagctgaacctggcggcagcgcaaaagatg

SEQ ID NO: 95894 - DNA, 103 bp, Artificial Sequence
  Synthetic Polynucleotide
taatacgactcactatagggacgggatgagcgcggcgggcggcagctccaaacagaggagatggagcatgcgcccgccgaacctggcggcagcgcaaaagatg

SEQ ID NO: 95895 - DNA, 103 bp, Artificial Sequence
  Synthetic Polynucleotide
taatacgactcactatagggttgtgctctataaaaaccaggatgtcccccaacagaggagagggggaatgcctggttttaacctggcggcagcgcaaaagatg

SEQ ID NO: 95896 - DNA, 103 bp, Artificial Sequence
  Synthetic Polynucleotide
taatacgactcactatagggacgttctcggacgggatgagcgcggcgggcaacagaggagagcccgcatggctcatcccaacctggcggcagcgcaaaagatg

SEQ ID NO: 95897 - DNA, 103 bp, Artificial Sequence
  Synthetic Polynucleotide
taatacgactcactatagggctgcgagtacacgttctcggacgggatgagaacagaggagactcatcatgtccgagaacaacctggcggcagcgcaaaagatg

SEQ ID NO: 95898 - DNA, 103 bp, Artificial Sequence
  Synthetic Polynucleotide
taatacgactcactatagggccaccagccactgcgagtacacgttctcggaacagaggagaccgagaatgtgtactcgcaacctggcggcagcgcaaaagatg

SEQ ID NO: 95899 - DNA, 103 bp, Artificial Sequence
  Synthetic Polynucleotide
taatacgactcactataggggccgcgtagcccaccagccactgcgagtacaacagaggagagtactcatggtggctggtaacctggcggcagcgcaaaagatg

SEQ ID NO: 95900 - DNA, 103 bp, Artificial Sequence
  Synthetic Polynucleotide
taatacgactcactataggggtgccgcgacgccgcgtagcccaccagccaaacagaggagatggctgatgggctacgcgaacctggcggcagcgcaaaagatg

SEQ ID NO: 95901 - DNA, 103 bp, Artificial Sequence
  Synthetic Polynucleotide
taatacgactcactatagggccttcatgaagtgccgcgacgccgcgtagcaacagaggagagctacgatgcgtcgcggcaacctggcggcagcgcaaaagatg

SEQ ID NO: 95902 - DNA, 103 bp, Artificial Sequence
  Synthetic Polynucleotide
taatacgactcactatagggaggaaggggtccttcatgaagtgccgcgacaacagaggagagtcgcgatgcttcatgaaaacctggcggcagcgcaaaagatg

SEQ ID NO: 95903 - DNA, 103 bp, Artificial Sequence
  Synthetic Polynucleotide
taatacgactcactatagggcgtgaagcccaggaaggggtccttcatgaaaacagaggagattcatgatggaccccttcaacctggcggcagcgcaaaagatg

SEQ ID NO: 95904 - DNA, 103 bp, Artificial Sequence
  Synthetic Polynucleotide
taatacgactcactataggggtcgtgcgtccgtgaagcccaggaaggggtaacagaggagaacccctatgtgggcttcaaacctggcggcagcgcaaaagatg

SEQ ID NO: 95905 - DNA, 103 bp, Artificial Sequence
  Synthetic Polynucleotide
taatacgactcactatagggaagggcgactgtcgtgcgtccgtgaagcccaacagaggagagggcttatgggacgcacgaacctggcggcagcgcaaaagatg

SEQ ID NO: 95906 - DNA, 103 bp, Artificial Sequence
  Synthetic Polynucleotide
taatacgactcactatagggctgcttccttttgtgctctataaaaaccagaacagaggagactggttatgatagagcacaacctggcggcagcgcaaaagatg

SEQ ID NO: 95907 - DNA, 103 bp, Artificial Sequence
  Synthetic Polynucleotide
taatacgactcactatagggcgacgtggcgaagggcgactgtcgtgcgtcaacagaggagagacgcaatgcagtcgcccaacctggcggcagcgcaaaagatg

SEQ ID NO: 95908 - DNA, 103 bp, Artificial Sequence
  Synthetic Polynucleotide
taatacgactcactatagggagtgctcggacgacgtggcgaagggcgactaacagaggagaagtcgcatgtcgccacgtaacctggcggcagcgcaaaagatg

SEQ ID NO: 95909 - DNA, 103 bp, Artificial Sequence
  Synthetic Polynucleotide
taatacgactcactatagggttctcggacgagtgctcggacgacgtggcgaacagaggagacgccacatggtccgagcaaacctggcggcagcgcaaaagatg

SEQ ID NO: 95910 - DNA, 103 bp, Artificial Sequence
  Synthetic Polynucleotide
taatacgactcactatagggcaggctgccgttctcggacgagtgctcggaaacagaggagatccgagatgtcgtccgagaacctggcggcagcgcaaaagatg

SEQ ID NO: 95911 - DNA, 103 bp, Artificial Sequence
  Synthetic Polynucleotide
taatacgactcactatagggtggagaagcgcaggctgccgttctcggacgaacagaggagacgtccgatgacggcagccaacctggcggcagcgcaaaagatg

SEQ ID NO: 95912 - DNA, 103 bp, Artificial Sequence
  Synthetic Polynucleotide
taatacgactcactatagggccgggcggcgtggagaagcgcaggctgccgaacagaggagacggcagatggcgcttctcaacctggcggcagcgcaaaagatg

SEQ ID NO: 95913 - DNA, 103 bp, Artificial Sequence
  Synthetic Polynucleotide
taatacgactcactatagggcagcaggtccccgggcggcgtggagaagcgaacagaggagacgcttcatgacgccgcccaacctggcggcagcgcaaaagatg

SEQ ID NO: 95914 - DNA, 103 bp, Artificial Sequence
  Synthetic Polynucleotide
taatacgactcactatagggggccgccgtccagcaggtccccgggcggcgaacagaggagacgccgcatggggacctgcaacctggcggcagcgcaaaagatg

SEQ ID NO: 95915 - DNA, 103 bp, Artificial Sequence
  Synthetic Polynucleotide
taatacgactcactatagggcggcccgagaggccgccgtccagcaggtccaacagaggagaggacctatgggacggcggaacctggcggcagcgcaaaagatg

SEQ ID NO: 95916 - DNA, 103 bp, Artificial Sequence
  Synthetic Polynucleotide
taatacgactcactatagggcgtgccgctgcggcccgagaggccgccgtcaacagaggagagacggcatgctctcgggcaacctggcggcagcgcaaaagatg

SEQ ID NO: 95917 - DNA, 103 bp, Artificial Sequence
  Synthetic Polynucleotide
taatacgactcactatagggtgccgccacactgcttccttttgtgctctaaacagaggagatagagcatgaaaggaagcaacctggcggcagcgcaaaagatg

SEQ ID NO: 95918 - DNA, 103 bp, Artificial Sequence
  Synthetic Polynucleotide
taatacgactcactatagggctccgctggccgtgccgctgcggcccgagaaacagaggagatctcggatggcagcggcaaacctggcggcagcgcaaaagatg

SEQ ID NO: 95919 - DNA, 103 bp, Artificial Sequence
  Synthetic Polynucleotide
taatacgactcactatagggggggtgctgcctccgctggccgtgccgctgaacagaggagacagcggatgggccagcggaacctggcggcagcgcaaaagatg

SEQ ID NO: 95920 - DNA, 103 bp, Artificial Sequence
  Synthetic Polynucleotide
taatacgactcactataggggcccaggtgcggggtgctgcctccgctggcaacagaggagagccagcatgggcagcaccaacctggcggcagcgcaaaagatg

SEQ ID NO: 95921 - DNA, 103 bp, Artificial Sequence
  Synthetic Polynucleotide
taatacgactcactatagggggcccgggccgcccaggtgcggggtgctgcaacagaggagagcagcaatgcgcacctggaacctggcggcagcgcaaaagatg

SEQ ID NO: 95922 - DNA, 103 bp, Artificial Sequence
  Synthetic Polynucleotide
taatacgactcactatagggggccgcccggggcccgggccgcccaggtgcaacagaggagagcacctatgcggcccgggaacctggcggcagcgcaaaagatg

SEQ ID NO: 95923 - DNA, 103 bp, Artificial Sequence
  Synthetic Polynucleotide
taatacgactcactatagggcttggagctgggccgcccggggcccgggccaacagaggagaggcccgatgcccgggcggaacctggcggcagcgcaaaagatg

SEQ ID NO: 95924 - DNA, 103 bp, Artificial Sequence
  Synthetic Polynucleotide
taatacgactcactatagggggcggccctccttggagctgggccgcccggaacagaggagaccgggcatgccagctccaaacctggcggcagcgcaaaagatg

SEQ ID NO: 95925 - DNA, 103 bp, Artificial Sequence
  Synthetic Polynucleotide
taatacgactcactataggggtgtcgctgcggcggccctccttggagctgaacagaggagacagctcatgggagggccgaacctggcggcagcgcaaaagatg

SEQ ID NO: 95926 - DNA, 103 bp, Artificial Sequence
  Synthetic Polynucleotide
taatacgactcactataggggtactcgcacgtgtcgctgcggcggccctcaacagaggagagagggcatgcgcagcgacaacctggcggcagcgcaaaagatg

SEQ ID NO: 95927 - DNA, 103 bp, Artificial Sequence
  Synthetic Polynucleotide
taatacgactcactatagggccttgccgcagtactcgcacgtgtcgctgcaacagaggagagcagcgatgcgtgcgagtaacctggcggcagcgcaaaagatg

SEQ ID NO: 95928 - DNA, 103 bp, Artificial Sequence
  Synthetic Polynucleotide
taatacgactcactataggggcacccaagctgccgccacactgcttccttaacagaggagaaaggaaatggtgtggcggaacctggcggcagcgcaaaagatg

SEQ ID NO: 95929 - DNA, 103 bp, Artificial Sequence
  Synthetic Polynucleotide
taatacgactcactatagggttcttgaacaccttgccgcagtactcgcacaacagaggagagtgcgaatgctgcggcaaaacctggcggcagcgcaaaagatg

SEQ ID NO: 95930 - DNA, 103 bp, Artificial Sequence
  Synthetic Polynucleotide
taatacgactcactataggggttgctgcagttcttgaacaccttgccgcaaacagaggagatgcggcatggtgttcaagaacctggcggcagcgcaaaagatg

SEQ ID NO: 95931 - DNA, 103 bp, Artificial Sequence
  Synthetic Polynucleotide
taatacgactcactataggggcaccgtcaagttgctgcagttcttgaacaaacagaggagatgttcaatgactgcagcaaacctggcggcagcgcaaaagatg

SEQ ID NO: 95932 - DNA, 103 bp, Artificial Sequence
  Synthetic Polynucleotide
taatacgactcactatagggctccgccggtgcaccgtcaagttgctgcagaacagaggagactgcagatgcttgacggtaacctggcggcagcgcaaaagatg

SEQ ID NO: 95933 - DNA, 103 bp, Artificial Sequence
  Synthetic Polynucleotide
taatacgactcactataggggccggtgtggctccgccggtgcaccgtcaaaacagaggagattgacgatgcaccggcggaacctggcggcagcgcaaaagatg

SEQ ID NO: 95934 - DNA, 103 bp, Artificial Sequence
  Synthetic Polynucleotide
taatacgactcactatagggaaggccgctcgccggtgtggctccgccggtaacagaggagaaccggcatggccacaccgaacctggcggcagcgcaaaagatg

SEQ ID NO: 95935 - DNA, 103 bp, Artificial Sequence
  Synthetic Polynucleotide
taatacgactcactatagggtcgcacttgtaaggccgctcgccggtgtggaacagaggagaccacacatgcgagcggccaacctggcggcagcgcaaaagatg

SEQ ID NO: 95936 - DNA, 103 bp, Artificial Sequence
  Synthetic Polynucleotide
taatacgactcactataggggttgcacagctcgcacttgtaaggccgctcaacagaggagagagcggatgtacaagtgcaacctggcggcagcgcaaaagatg

SEQ ID NO: 95937 - DNA, 103 bp, Artificial Sequence
  Synthetic Polynucleotide
taatacgactcactatagggcgcacgcgtagttgcacagctcgcacttgtaacagaggagaacaagtatgagctgtgcaaacctggcggcagcgcaaaagatg

SEQ ID NO: 95938 - DNA, 103 bp, Artificial Sequence
  Synthetic Polynucleotide
taatacgactcactatagggctgctctgcgcgcacgcgtagttgcacagcaacagaggagagctgtgatgctacgcgtgaacctggcggcagcgcaaaagatg

SEQ ID NO: 95939 - DNA, 103 bp, Artificial Sequence
  Synthetic Polynucleotide
taatacgactcactataggggtcatagcaggcacccaagctgccgccacaaacagaggagatgtggcatgagcttgggtaacctggcggcagcgcaaaagatg

SEQ ID NO: 95940 - DNA, 103 bp, Artificial Sequence
  Synthetic Polynucleotide
taatacgactcactatagggcgtgagcttgctgctctgcgcgcacgcgtaaacagaggagatacgcgatggcgcagagcaacctggcggcagcgcaaaagatg

SEQ ID NO: 95941 - DNA, 103 bp, Artificial Sequence
  Synthetic Polynucleotide
taatacgactcactatagggtcatgtggcgcgtgagcttgctgctctgcgaacagaggagacgcagaatggcaagctcaaacctggcggcagcgcaaaagatg

SEQ ID NO: 95942 - DNA, 103 bp, Artificial Sequence
  Synthetic Polynucleotide
taatacgactcactatagggccgtgcgtcttcatgtggcgcgtgagcttgaacagaggagacaagctatggcgccacataacctggcggcagcgcaaaagatg

SEQ ID NO: 95943 - DNA, 103 bp, Artificial Sequence
  Synthetic Polynucleotide
taatacgactcactataggggccgatctgcccgtgcgtcttcatgtggcgaacagaggagacgccacatgaagacgcacaacctggcggcagcgcaaaagatg

SEQ ID NO: 95944 - DNA, 103 bp, Artificial Sequence
  Synthetic Polynucleotide
taatacgactcactatagggacacctccttgccgatctgcccgtgcgtctaacagaggagaagacgcatgggcagatcgaacctggcggcagcgcaaaagatg

SEQ ID NO: 95945 - DNA, 103 bp, Artificial Sequence
  Synthetic Polynucleotide
taatacgactcactatagggtcgcagcggtacacctccttgccgatctgcaacagaggagagcagatatgcaaggaggtaacctggcggcagcgcaaaagatg

SEQ ID NO: 95946 - DNA, 103 bp, Artificial Sequence
  Synthetic Polynucleotide
taatacgactcactatagggctggcagatgtcgcagcggtacacctccttaacagaggagaaaggagatgtaccgctgcaacctggcggcagcgcaaaagatg

SEQ ID NO: 95947 - DNA, 103 bp, Artificial Sequence
  Synthetic Polynucleotide
taatacgactcactatagggtgaagggcatctggcagatgtcgcagcggtaacagaggagaaccgctatgacatctgccaacctggcggcagcgcaaaagatg

SEQ ID NO: 95948 - DNA, 103 bp, Artificial Sequence
  Synthetic Polynucleotide
taatacgactcactatagggctgtagacgctgaagggcatctggcagatgaacagaggagacatctgatggatgcccttaacctggcggcagcgcaaaagatg

SEQ ID NO: 95949 - DNA, 103 bp, Artificial Sequence
  Synthetic Polynucleotide
taatacgactcactatagggctccagggtgctgtagacgctgaagggcataacagaggagaatgcccatgagcgtctacaacctggcggcagcgcaaaagatg

SEQ ID NO: 95950 - DNA, 103 bp, Artificial Sequence
  Synthetic Polynucleotide
taatacgactcactatagggccagggccttgtcatagcaggcacccaagcaacagaggagagcttggatgcctgctatgaacctggcggcagcgcaaaagatg

SEQ ID NO: 95951 - DNA, 103 bp, Artificial Sequence
  Synthetic Polynucleotide
taatacgactcactatagggtcatgtgtttctccagggtgctgtagacgcaacagaggagagcgtctatggcaccctggaacctggcggcagcgcaaaagatg

SEQ ID NO: 95952 - DNA, 103 bp, Artificial Sequence
  Synthetic Polynucleotide
taatacgactcactatagggtgccactttttcatgtgtttctccagggtgaacagaggagacaccctatggaaacacataacctggcggcagcgcaaaagatg

SEQ ID NO: 95953 - DNA, 103 bp, Artificial Sequence
  Synthetic Polynucleotide
taatacgactcactataggggtgctcgccgtgccactttttcatgtgtttaacagaggagaaaacacatgaaaaagtggaacctggcggcagcgcaaaagatg

SEQ ID NO: 95954 - DNA, 103 bp, Artificial Sequence
  Synthetic Polynucleotide
taatacgactcactatagggtagtcagcaagtgctcgccgtgccacttttaacagaggagaaaaagtatgacggcgagcaacctggcggcagcgcaaaagatg

SEQ ID NO: 95955 - DNA, 103 bp, Artificial Sequence
  Synthetic Polynucleotide
taatacgactcactatagggttgacgtcgttagtcagcaagtgctcgccgaacagaggagacggcgaatgcttgctgacaacctggcggcagcgcaaaagatg

SEQ ID NO: 95956 - DNA, 103 bp, Artificial Sequence
  Synthetic Polynucleotide
taatacgactcactatagggctgctcgattttgacgtcgttagtcagcaaaacagaggagattgctgatgaacgacgtcaacctggcggcagcgcaaaagatg

SEQ ID NO: 95957 - DNA, 103 bp, Artificial Sequence
  Synthetic Polynucleotide
taatacgactcactatagggtcctctcggcctgctcgattttgacgtcgtaacagaggagaacgacgatgaaatcgagcaacctggcggcagcgcaaaagatg

SEQ ID NO: 95958 - DNA, 103 bp, Artificial Sequence
  Synthetic Polynucleotide
taatacgactcactatagggctgtccttgtccagggccttgtcatagcagaacagaggagactgctaatgcaaggccctaacctggcggcagcgcaaaagatg

SEQ ID NO: 95959 - DNA, 103 bp, Artificial Sequence
  Synthetic Polynucleotide
taatacgactcactataggggggtggcgggctgtccttgtccagggccttaacagaggagaaaggccatggacaaggacaacctggcggcagcgcaaaagatg

SEQ ID NO: 95960 - DNA, 103 bp, Artificial Sequence
  Synthetic Polynucleotide
taatacgactcactatagggagcgtgaggagggtggcgggctgtccttgtaacagaggagaacaaggatggcccgccacaacctggcggcagcgcaaaagatg

SEQ ID NO: 95961 - DNA, 103 bp, Artificial Sequence
  Synthetic Polynucleotide
taatacgactcactatagggagctccctctgggacaagtgctgcgggttgaacagaggagacaacccatggcacttgtcaacctggcggcagcgcaaaagatg

SEQ ID NO: 95962 - DNA, 103 bp, Artificial Sequence
  Synthetic Polynucleotide
taatacgactcactatagggctgagctcggagcgtgaggagggtggcgggaacagaggagacccgccatgctcctcacgaacctggcggcagcgcaaaagatg

SEQ ID NO: 95963 - DNA, 103 bp, Artificial Sequence
  Synthetic Polynucleotide
taatacgactcactatagggggacactttcctgagctcggagcgtgaggaaacagaggagatcctcaatgtccgagctcaacctggcggcagcgcaaaagatg

SEQ ID NO: 95964 - DNA, 103 bp, Artificial Sequence
  Synthetic Polynucleotide
taatacgactcactatagggccaccggctcggacactttcctgagctcggaacagaggagaccgagcatgggaaagtgtaacctggcggcagcgcaaaagatg

SEQ ID NO: 95965 - DNA, 103 bp, Artificial Sequence
  Synthetic Polynucleotide
taatacgactcactatagggatcccgatctccaccggctcggacactttcaacagaggagagaaagtatgcgagccggtaacctggcggcagcgcaaaagatg

SEQ ID NO: 95966 - DNA, 103 bp, Artificial Sequence
  Synthetic Polynucleotide
taatacgactcactatagggggtgacttggatcccgatctccaccggctcaacagaggagagagccgatggagatcgggaacctggcggcagcgcaaaagatg

SEQ ID NO: 95967 - DNA, 103 bp, Artificial Sequence
  Synthetic Polynucleotide
taatacgactcactatagggcttcgtcgggggtgacttggatcccgatctaacagaggagaagatcgatgtccaagtcaaacctggcggcagcgcaaaagatg

SEQ ID NO: 95968 - DNA, 103 bp, Artificial Sequence
  Synthetic Polynucleotide
taatacgactcactatagggaggtggtcatcttcgtcgggggtgacttggaacagaggagaccaagtatgccccgacgaaacctggcggcagcgcaaaagatg

SEQ ID NO: 95969 - DNA, 103 bp, Artificial Sequence
  Synthetic Polynucleotide
taatacgactcactataggggggtgagagcaggtggtcatcttcgtcgggaacagaggagacccgacatggatgaccacaacctggcggcagcgcaaaagatg

SEQ ID NO: 95970 - DNA, 103 bp, Artificial Sequence
  Synthetic Polynucleotide
taatacgactcactatagggtgcctttcgtgggtgagagcaggtggtcataacagaggagaatgaccatgtgctctcacaacctggcggcagcgcaaaagatg

SEQ ID NO: 95971 - DNA, 103 bp, Artificial Sequence
  Synthetic Polynucleotide
taatacgactcactatagggttgggacagatgcctttcgtgggtgagagcaacagaggagagctctcatgcacgaaaggaacctggcggcagcgcaaaagatg

SEQ ID NO: 95972 - DNA, 103 bp, Artificial Sequence
  Synthetic Polynucleotide
taatacgactcactatagggtggggtgatgagctccctctgggacaagtgaacagaggagacacttgatgcagagggagaacctggcggcagcgcaaaagatg

SEQ ID NO: 95973 - DNA, 103 bp, Artificial Sequence
  Synthetic Polynucleotide
taatacgactcactataggggttctcctgcttgggacagatgcctttcgtaacagaggagaacgaaaatgatctgtcccaacctggcggcagcgcaaaagatg

SEQ ID NO: 95974 - DNA, 103 bp, Artificial Sequence
  Synthetic Polynucleotide
taatacgactcactataggggccctgcaatgttctcctgcttgggacagaaacagaggagatctgtcatgagcaggagaaacctggcggcagcgcaaaagatg

SEQ ID NO: 95975 - DNA, 103 bp, Artificial Sequence
  Synthetic Polynucleotide
taatacgactcactatagggggcctgcacggccctgcaatgttctcctgcaacagaggagagcaggaatgcattgcaggaacctggcggcagcgcaaaagatg

SEQ ID NO: 95976 - DNA, 103 bp, Artificial Sequence
  Synthetic Polynucleotide
taatacgactcactatagggcagctgggcaggcctgcacggccctgcaataacagaggagaattgcaatgccgtgcaggaacctggcggcagcgcaaaagatg

SEQ ID NO: 95977 - DNA, 103 bp, Artificial Sequence
  Synthetic Polynucleotide
taatacgactcactatagggccaccgctggcagctgggcaggcctgcacgaacagaggagacgtgcaatgctgcccagcaacctggcggcagcgcaaaagatg

SEQ ID NO: 95978 - DNA, 103 bp, Artificial Sequence
  Synthetic Polynucleotide
taatacgactcactataggggctatgggggccaccgctggcagctgggcaaacagaggagatgcccaatggccagcggtaacctggcggcagcgcaaaagatg

SEQ ID NO: 95979 - DNA, 103 bp, Artificial Sequence
  Synthetic Polynucleotide
taatacgactcactatagggggaggaggcagctatgggggccaccgctggaacagaggagaccagcgatggcccccataaacctggcggcagcgcaaaagatg

SEQ ID NO: 95980 - DNA, 103 bp, Artificial Sequence
  Synthetic Polynucleotide
taatacgactcactatagggagtgagggtgggaggaggcagctatgggggaacagaggagacccccaatgctgcctcctaacctggcggcagcgcaaaagatg

SEQ ID NO: 95981 - DNA, 103 bp, Artificial Sequence
  Synthetic Polynucleotide
taatacgactcactatagggatcacggatgagtgagggtgggaggaggcaaacagaggagatgcctcatgccaccctcaaacctggcggcagcgcaaaagatg

SEQ ID NO: 95982 - DNA, 103 bp, Artificial Sequence
  Synthetic Polynucleotide
taatacgactcactatagggaggtgaagtgatcacggatgagtgagggtgaacagaggagacaccctatgtcatccgtgaacctggcggcagcgcaaaagatg

SEQ ID NO: 95983 - DNA, 103 bp, Artificial Sequence
  Synthetic Polynucleotide
taatacgactcactatagggggtcagcctctggggtgatgagctccctctaacagaggagaagagggatgtcatcacccaacctggcggcagcgcaaaagatg

SEQ ID NO: 95984 - DNA, 103 bp, Artificial Sequence
  Synthetic Polynucleotide
taatacgactcactataggggggcacgcagaggtgaagtgatcacggatgaacagaggagacatccgatgtcacttcacaacctggcggcagcgcaaaagatg

SEQ ID NO: 95985 - DNA, 103 bp, Artificial Sequence
  Synthetic Polynucleotide
taatacgactcactatagggagagcgcccagggcacgcagaggtgaagtgaacagaggagacacttcatgtctgcgtgcaacctggcggcagcgcaaaagatg

SEQ ID NO: 95986 - DNA, 103 bp, Artificial Sequence
  Synthetic Polynucleotide
taatacgactcactataggggcagggcgggagagcgcccagggcacgcagaacagaggagactgcgtatgctgggcgctaacctggcggcagcgcaaaagatg

SEQ ID NO: 95987 - DNA, 103 bp, Artificial Sequence
  Synthetic Polynucleotide
taatacgactcactataggggcagggggaggcagggcgggagagcgcccaaacagaggagatgggcgatgtcccgccctaacctggcggcagcgcaaaagatg

SEQ ID NO: 95988 - DNA, 103 bp, Artificial Sequence
  Synthetic Polynucleotide
taatacgactcactatagggctgcagcacggcagggggaggcagggcgggaacagaggagacccgccatgcctccccctaacctggcggcagcgcaaaagatg

SEQ ID NO: 95989 - DNA, 103 bp, Artificial Sequence
  Synthetic Polynucleotide
taatacgactcactatagggcgggcgcgcgctgcagcacggcagggggagaacagaggagactccccatgccgtgctgcaacctggcggcagcgcaaaagatg

SEQ ID NO: 95990 - DNA, 103 bp, Artificial Sequence
  Synthetic Polynucleotide
taatacgactcactatagggcacccgagaccgggcgcgcgctgcagcacgaacagaggagacgtgctatggcgcgcgccaacctggcggcagcgcaaaagatg

SEQ ID NO: 95991 - DNA, 103 bp, Artificial Sequence
  Synthetic Polynucleotide
taatacgactcactatagggtgagtcccgtcacccgagaccgggcgcgcgaacagaggagacgcgcgatgggtctcgggaacctggcggcagcgcaaaagatg

SEQ ID NO: 95992 - DNA, 103 bp, Artificial Sequence
  Synthetic Polynucleotide
taatacgactcactatagggaccctcaccctgagtcccgtcacccgagacaacagaggagagtctcgatggacgggactaacctggcggcagcgcaaaagatg

SEQ ID NO: 95993 - DNA, 103 bp, Artificial Sequence
  Synthetic Polynucleotide
taatacgactcactatagggcctccgtctgaccctcaccctgagtcccgtaacagaggagaacgggaatgagggtgaggaacctggcggcagcgcaaaagatg

SEQ ID NO: 95994 - DNA, 103 bp, Artificial Sequence
  Synthetic Polynucleotide
taatacgactcactataggggcctccacatggtcagcctctggggtgatgaacagaggagacatcacatgagaggctgaaacctggcggcagcgcaaaagatg

SEQ ID NO: 95995 - DNA, 103 bp, Artificial Sequence
  Synthetic Polynucleotide
taatacgactcactatagggccaaagggagcctccgtctgaccctcacccaacagaggagagggtgaatgtcagacggaaacctggcggcagcgcaaaagatg

SEQ ID NO: 95996 - DNA, 103 bp, Artificial Sequence
  Synthetic Polynucleotide
taatacgactcactatagggacactggcatccaaagggagcctccgtctgaacagaggagacagacgatggctccctttaacctggcggcagcgcaaaagatg

SEQ ID NO: 95997 - DNA, 103 bp, Artificial Sequence
  Synthetic Polynucleotide
taatacgactcactatagggctgacaactgacactggcatccaaagggagaacagaggagactccctatggatgccagtaacctggcggcagcgcaaaagatg

SEQ ID NO: 95998 - DNA, 103 bp, Artificial Sequence
  Synthetic Polynucleotide
taatacgactcactatagggtcatctttacctgacaactgacactggcataacagaggagaatgccaatgtcagttgtcaacctggcggcagcgcaaaagatg

SEQ ID NO: 95999 - DNA, 103 bp, Artificial Sequence
  Synthetic Polynucleotide
taatacgactcactataggggctggaaggctcatctttacctgacaactgaacagaggagacagttgatgggtaaagataacctggcggcagcgcaaaagatg

SEQ ID NO: 96000 - DNA, 103 bp, Artificial Sequence
  Synthetic Polynucleotide
taatacgactcactatagggtgcaaatgtagctggaaggctcatctttacaacagaggagagtaaagatgagccttccaaacctggcggcagcgcaaaagatg

SEQ ID NO: 96001 - DNA, 103 bp, Artificial Sequence
  Synthetic Polynucleotide
taatacgactcactatagggttgcatgttgtgcaaatgtagctggaaggcaacagaggagagccttcatgctacatttgaacctggcggcagcgcaaaagatg

SEQ ID NO: 96002 - DNA, 103 bp, Artificial Sequence
  Synthetic Polynucleotide
taatacgactcactataggggaagggctgcttgcatgttgtgcaaatgtaaacagaggagatacattatgacaacatgcaacctggcggcagcgcaaaagatg

SEQ ID NO: 96003 - DNA, 103 bp, Artificial Sequence
  Synthetic Polynucleotide
taatacgactcactatagggacgcgctgttgaagggctgcttgcatgttgaacagaggagacaacatatgagcagccctaacctggcggcagcgcaaaagatg

SEQ ID NO: 96004 - DNA, 103 bp, Artificial Sequence
  Synthetic Polynucleotide
taatacgactcactatagggagcaggaaccacgcgctgttgaagggctgcaacagaggagagcagccatgcaacagcgcaacctggcggcagcgcaaaagatg

SEQ ID NO: 96005 - DNA, 103 bp, Artificial Sequence
  Synthetic Polynucleotide
taatacgactcactataggggaggatggcggcctccacatggtcagcctcaacagaggagagaggctatgcatgtggagaacctggcggcagcgcaaaagatg

SEQ ID NO: 96006 - DNA, 103 bp, Artificial Sequence
  Synthetic Polynucleotide
taatacgactcactatagggcgcgtgctgcagcaggaaccacgcgctgttaacagaggagaaacagcatgtggttcctgaacctggcggcagcgcaaaagatg

SEQ ID NO: 96007 - DNA, 103 bp, Artificial Sequence
  Synthetic Polynucleotide
taatacgactcactataggggcgtgttctgcgcgtgctgcagcaggaaccaacagaggagaggttccatgtgcagcacgaacctggcggcagcgcaaaagatg

SEQ ID NO: 96008 - DNA, 103 bp, Artificial Sequence
  Synthetic Polynucleotide
taatacgactcactatagggcggaagccgtgcgtgttctgcgcgtgctgcaacagaggagagcagcaatggcagaacacaacctggcggcagcgcaaaagatg

SEQ ID NO: 96009 - DNA, 103 bp, Artificial Sequence
  Synthetic Polynucleotide
taatacgactcactatagggcaggtagatgcggaagccgtgcgtgttctgaacagaggagacagaacatgcacggcttcaacctggcggcagcgcaaaagatg

SEQ ID NO: 96010 - DNA, 103 bp, Artificial Sequence
  Synthetic Polynucleotide
taatacgactcactataggggcccgggctccaggtagatgcggaagccgtaacagaggagaacggctatggcatctaccaacctggcggcagcgcaaaagatg

SEQ ID NO: 96011 - DNA, 103 bp, Artificial Sequence
  Synthetic Polynucleotide
taatacgactcactatagggctgctggccggcccgggctccaggtagatgaacagaggagacatctaatgggagcccggaacctggcggcagcgcaaaagatg

SEQ ID NO: 96012 - DNA, 103 bp, Artificial Sequence
  Synthetic Polynucleotide
taatacgactcactatagggcgtgagcgagctgctggccggcccgggctcaacagaggagagagcccatgccggccagcaacctggcggcagcgcaaaagatg

SEQ ID NO: 96013 - DNA, 103 bp, Artificial Sequence
  Synthetic Polynucleotide
taatacgactcactatagggtgagccgcggcgtgagcgagctgctggccgaacagaggagacggccaatggctcgctcaaacctggcggcagcgcaaaagatg

SEQ ID NO: 96014 - DNA, 103 bp, Artificial Sequence
  Synthetic Polynucleotide
taatacgactcactatagggggcgggatggtgagccgcggcgtgagcgagaacagaggagactcgctatggccgcggctaacctggcggcagcgcaaaagatg

SEQ ID NO: 96015 - DNA, 103 bp, Artificial Sequence
  Synthetic Polynucleotide
taatacgactcactatagggcccgagcggcggcgggatggtgagccgcggaacagaggagaccgcggatgaccatcccgaacctggcggcagcgcaaaagatg

SEQ ID NO: 96016 - DNA, 103 bp, Artificial Sequence
  Synthetic Polynucleotide
taatacgactcactatagggcgtcttcttcgaggatggcggcctccacataacagaggagaatgtggatgccgccatccaacctggcggcagcgcaaaagatg

SEQ ID NO: 96017 - DNA, 103 bp, Artificial Sequence
  Synthetic Polynucleotide
taatacgactcactatagggcggcctccggcccgagcggcggcgggatggaacagaggagaccatccatgcgccgctcgaacctggcggcagcgcaaaagatg

SEQ ID NO: 96018 - DNA, 103 bp, Artificial Sequence
  Synthetic Polynucleotide
taatacgactcactataggggactgcgccacggcctccggcccgagcggcaacagaggagagccgctatggccggaggcaacctggcggcagcgcaaaagatg

SEQ ID NO: 96019 - DNA, 103 bp, Artificial Sequence
  Synthetic Polynucleotide
taatacgactcactatagggcatgagcggggactgcgccacggcctccggaacagaggagaccggagatggtggcgcagaacctggcggcagcgcaaaagatg

SEQ ID NO: 96020 - DNA, 103 bp, Artificial Sequence
  Synthetic Polynucleotide
taatacgactcactatagggccaggaaattcatgagcggggactgcgccaaacagaggagatggcgcatgccccgctcaaacctggcggcagcgcaaaagatg

SEQ ID NO: 96021 - DNA, 103 bp, Artificial Sequence
  Synthetic Polynucleotide
taatacgactcactatagggttgctgtcgcccaggaaattcatgagcgggaacagaggagacccgctatggaatttcctaacctggcggcagcgcaaaagatg

SEQ ID NO: 96022 - DNA, 103 bp, Artificial Sequence
  Synthetic Polynucleotide
taatacgactcactataggggttgaaggggttgctgtcgcccaggaaattaacagaggagaaatttcatgggcgacagcaacctggcggcagcgcaaaagatg

SEQ ID NO: 96023 - DNA, 103 bp, Artificial Sequence
  Synthetic Polynucleotide
taatacgactcactatagggtgcgcagcaggttgaaggggttgctgtcgcaacagaggagagcgacaatgaccccttcaaacctggcggcagcgcaaaagatg

SEQ ID NO: 96024 - DNA, 103 bp, Artificial Sequence
  Synthetic Polynucleotide
taatacgactcactataggggggcccgtcatgcgcagcaggttgaaggggaacagaggagaccccttatgcctgctgcgaacctggcggcagcgcaaaagatg

SEQ ID NO: 96025 - DNA, 103 bp, Artificial Sequence
  Synthetic Polynucleotide
taatacgactcactatagggccgcaggatggggcccgtcatgcgcagcagaacagaggagactgctgatgatgacgggcaacctggcggcagcgcaaaagatg

SEQ ID NO: 96026 - DNA, 103 bp, Artificial Sequence
  Synthetic Polynucleotide
taatacgactcactatagggccgggtggtcccgcaggatggggcccgtcaaacagaggagatgacggatgccatcctgcaacctggcggcagcgcaaaagatg

SEQ ID NO: 96027 - DNA, 103 bp, Artificial Sequence
  Synthetic Polynucleotide
taatacgactcactatagggtccagaccctcgtcttcttcgaggatggcgaacagaggagacgccatatgcgaagaagaaacctggcggcagcgcaaaagatg

SEQ ID NO: 96028 - DNA, 103 bp, Artificial Sequence
  Synthetic Polynucleotide
taatacgactcactatagggtcgccgaagcccgggtggtcccgcaggatgaacagaggagacatcctatgggaccacccaacctggcggcagcgcaaaagatg

SEQ ID NO: 96029 - DNA, 103 bp, Artificial Sequence
  Synthetic Polynucleotide
taatacgactcactatagggcaggcggccctcgccgaagcccgggtggtcaacagaggagagaccacatgggcttcggcaacctggcggcagcgcaaaagatg

SEQ ID NO: 96030 - DNA, 103 bp, Artificial Sequence
  Synthetic Polynucleotide
taatacgactcactataggggcgtgcccggcaggcggccctcgccgaagcaacagaggagagcttcgatgagggccgccaacctggcggcagcgcaaaagatg

SEQ ID NO: 96031 - DNA, 103 bp, Artificial Sequence
  Synthetic Polynucleotide
taatacgactcactatagggaagagaggcggcgtgcccggcaggcggcccaacagaggagagggccgatggccgggcacaacctggcggcagcgcaaaagatg

SEQ ID NO: 96032 - DNA, 103 bp, Artificial Sequence
  Synthetic Polynucleotide
taatacgactcactatagggcgggggactgaagagaggcggcgtgcccggaacagaggagaccgggcatgccgcctctcaacctggcggcagcgcaaaagatg

SEQ ID NO: 96033 - DNA, 103 bp, Artificial Sequence
  Synthetic Polynucleotide
taatacgactcactatagggggtggcgcggcgggggactgaagagaggcgaacagaggagacgcctcatgtcagtccccaacctggcggcagcgcaaaagatg

SEQ ID NO: 96034 - DNA, 103 bp, Artificial Sequence
  Synthetic Polynucleotide
taatacgactcactataggggggtccaggtggtggcgcggcgggggactgaacagaggagacagtccatggccgcgccaaacctggcggcagcgcaaaagatg

SEQ ID NO: 96035 - DNA, 103 bp, Artificial Sequence
  Synthetic Polynucleotide
taatacgactcactataggggaggcggtgcgggtccaggtggtggcgcggaacagaggagaccgcgcatgcacctggacaacctggcggcagcgcaaaagatg

SEQ ID NO: 96036 - DNA, 103 bp, Artificial Sequence
  Synthetic Polynucleotide
taatacgactcactatagggcctcggcactgaggcggtgcgggtccaggtaacagaggagaacctggatgcgcaccgccaacctggcggcagcgcaaaagatg

SEQ ID NO: 96037 - DNA, 103 bp, Artificial Sequence
  Synthetic Polynucleotide
taatacgactcactatagggagccccatctcctcggcactgaggcggtgcaacagaggagagcaccgatgcagtgccgaaacctggcggcagcgcaaaagatg

SEQ ID NO: 96038 - DNA, 103 bp, Artificial Sequence
  Synthetic Polynucleotide
taatacgactcactatagggctggatacagctgtcagccggcgaggccataacagaggagaatggccatgccggctgacaacctggcggcagcgcaaaagatg

SEQ ID NO: 96039 - DNA, 103 bp, Artificial Sequence
  Synthetic Polynucleotide
taatacgactcactatagggacggctcacaacaatgacaacatcagtcaaaacagaggagattgactatggttgtcattaacctggcggcagcgcaaaagatg

SEQ ID NO: 96040 - DNA, 103 bp, Artificial Sequence
  Synthetic Polynucleotide
taatacgactcactatagggctggcagtcagatttctgggggctctgtggaacagaggagaccacagatgccccagaaaaacctggcggcagcgcaaaagatg

SEQ ID NO: 96041 - DNA, 103 bp, Artificial Sequence
  Synthetic Polynucleotide
taatacgactcactataggggcgagttgggctggcagtcagatttctgggaacagaggagacccagaatgctgactgccaacctggcggcagcgcaaaagatg

SEQ ID NO: 96042 - DNA, 103 bp, Artificial Sequence
  Synthetic Polynucleotide
taatacgactcactataggggactctgtgggcgagttgggctggcagtcaaacagaggagatgactgatggcccaactcaacctggcggcagcgcaaaagatg

SEQ ID NO: 96043 - DNA, 103 bp, Artificial Sequence
  Synthetic Polynucleotide
taatacgactcactatagggactgctgcaggactctgtgggcgagttgggaacagaggagacccaacatgcccacagagaacctggcggcagcgcaaaagatg

SEQ ID NO: 96044 - DNA, 103 bp, Artificial Sequence
  Synthetic Polynucleotide
taatacgactcactatagggaggcattcttactgctgcaggactctgtggaacagaggagaccacagatgcctgcagcaaacctggcggcagcgcaaaagatg

SEQ ID NO: 96045 - DNA, 103 bp, Artificial Sequence
  Synthetic Polynucleotide
taatacgactcactatagggtggaggatgcaggcattcttactgctgcagaacagaggagactgcagatgtaagaatgcaacctggcggcagcgcaaaagatg

SEQ ID NO: 96046 - DNA, 103 bp, Artificial Sequence
  Synthetic Polynucleotide
taatacgactcactataggggccagaagcctggaggatgcaggcattcttaacagaggagaaagaatatgtgcatcctcaacctggcggcagcgcaaaagatg

SEQ ID NO: 96047 - DNA, 103 bp, Artificial Sequence
  Synthetic Polynucleotide
taatacgactcactatagggctggaggggagccagaagcctggaggatgcaacagaggagagcatccatgaggcttctgaacctggcggcagcgcaaaagatg

SEQ ID NO: 96048 - DNA, 103 bp, Artificial Sequence
  Synthetic Polynucleotide
taatacgactcactataggggggctcttggctggaggggagccagaagccaacagaggagaggcttcatgctcccctccaacctggcggcagcgcaaaagatg

SEQ ID NO: 96049 - DNA, 103 bp, Artificial Sequence
  Synthetic Polynucleotide
taatacgactcactatagggggggtcagtggggctcttggctggaggggaaacagaggagatcccctatggccaagagcaacctggcggcagcgcaaaagatg

SEQ ID NO: 96050 - DNA, 103 bp, Artificial Sequence
  Synthetic Polynucleotide
taatacgactcactatagggtaaactgctcacggctcacaacaatgacaaaacagaggagattgtcaatgttgtgagccaacctggcggcagcgcaaaagatg

SEQ ID NO: 96051 - DNA, 103 bp, Artificial Sequence
  Synthetic Polynucleotide
taatacgactcactatagggtgcaggctttggggtcagtggggctcttggaacagaggagaccaagaatgccactgaccaacctggcggcagcgcaaaagatg

SEQ ID NO: 96052 - DNA, 103 bp, Artificial Sequence
  Synthetic Polynucleotide
taatacgactcactatagggttcttccagttgcaggctttggggtcagtgaacagaggagacactgaatgcaaagcctgaacctggcggcagcgcaaaagatg

SEQ ID NO: 96053 - DNA, 103 bp, Artificial Sequence
  Synthetic Polynucleotide
taatacgactcactataggggaacttgtatttcttccagttgcaggctttaacagaggagaaaagccatgaactggaagaacctggcggcagcgcaaaagatg

SEQ ID NO: 96054 - DNA, 103 bp, Artificial Sequence
  Synthetic Polynucleotide
taatacgactcactatagggtgagcacgatgaacttgtatttcttccagtaacagaggagaactggaatgaatacaagtaacctggcggcagcgcaaaagatg

SEQ ID NO: 96055 - DNA, 103 bp, Artificial Sequence
  Synthetic Polynucleotide
taatacgactcactatagggttgaggctgttgagcacgatgaacttgtataacagaggagaatacaaatgcatcgtgctaacctggcggcagcgcaaaagatg

SEQ ID NO: 96056 - DNA, 103 bp, Artificial Sequence
  Synthetic Polynucleotide
taatacgactcactatagggggcattctggttgaggctgttgagcacgataacagaggagaatcgtgatgaacagcctcaacctggcggcagcgcaaaagatg

SEQ ID NO: 96057 - DNA, 103 bp, Artificial Sequence
  Synthetic Polynucleotide
taatacgactcactatagggcctctggtttggcattctggttgaggctgtaacagaggagaacagccatgaccagaatgaacctggcggcagcgcaaaagatg

SEQ ID NO: 96058 - DNA, 103 bp, Artificial Sequence
  Synthetic Polynucleotide
taatacgactcactatagggtgctcaggcccctctggtttggcattctggaacagaggagaccagaaatgcaaaccagaaacctggcggcagcgcaaaagatg

SEQ ID NO: 96059 - DNA, 103 bp, Artificial Sequence
  Synthetic Polynucleotide
taatacgactcactatagggcagctcagcctgctcaggcccctctggtttaacagaggagaaaaccaatggggcctgagaacctggcggcagcgcaaaagatg

SEQ ID NO: 96060 - DNA, 103 bp, Artificial Sequence
  Synthetic Polynucleotide
taatacgactcactatagggaaaggcggcccagctcagcctgctcaggccaacagaggagaggcctgatgaggctgagcaacctggcggcagcgcaaaagatg

SEQ ID NO: 96061 - DNA, 103 bp, Artificial Sequence
  Synthetic Polynucleotide
taatacgactcactatagggttatgggctctaaactgctcacggctcacaaacagaggagatgtgagatgtgagcagttaacctggcggcagcgcaaaagatg

SEQ ID NO: 96062 - DNA, 103 bp, Artificial Sequence
  Synthetic Polynucleotide
taatacgactcactataggggctcgtggggaaaggcggcccagctcagccaacagaggagaggctgaatggggccgcctaacctggcggcagcgcaaaagatg

SEQ ID NO: 96063 - DNA, 103 bp, Artificial Sequence
  Synthetic Polynucleotide
taatacgactcactatagggggccgtgtaggctcgtggggaaaggcggccaacagaggagaggccgcatgtccccacgaaacctggcggcagcgcaaaagatg

SEQ ID NO: 96064 - DNA, 103 bp, Artificial Sequence
  Synthetic Polynucleotide
taatacgactcactatagggaggcaggtggggccgtgtaggctcgtggggaacagaggagaccccacatgcctacacggaacctggcggcagcgcaaaagatg

SEQ ID NO: 96065 - DNA, 103 bp, Artificial Sequence
  Synthetic Polynucleotide
taatacgactcactatagggggtggctggcaggcaggtggggccgtgtagaacagaggagactacacatgcccacctgcaacctggcggcagcgcaaaagatg

SEQ ID NO: 96066 - DNA, 103 bp, Artificial Sequence
  Synthetic Polynucleotide
taatacgactcactatagggaggctccatgggtggctggcaggcaggtggaacagaggagaccacctatgtgccagccaaacctggcggcagcgcaaaagatg

SEQ ID NO: 96067 - DNA, 103 bp, Artificial Sequence
  Synthetic Polynucleotide
taatacgactcactatagggcaaggttctcaggctccatgggtggctggcaacagaggagagccagcatgccatggagcaacctggcggcagcgcaaaagatg

SEQ ID NO: 96068 - DNA, 103 bp, Artificial Sequence
  Synthetic Polynucleotide
taatacgactcactataggggactggaggtcaaggttctcaggctccatgaacagaggagacatggaatgtgagaacctaacctggcggcagcgcaaaagatg

SEQ ID NO: 96069 - DNA, 103 bp, Artificial Sequence
  Synthetic Polynucleotide
taatacgactcactatagggcttggttggggactggaggtcaaggttctcaacagaggagagagaacatggacctccagaacctggcggcagcgcaaaagatg

SEQ ID NO: 96070 - DNA, 103 bp, Artificial Sequence
  Synthetic Polynucleotide
taatacgactcactatagggtggcactcagcttggttggggactggaggtaacagaggagaacctccatgccccaaccaaacctggcggcagcgcaaaagatg

SEQ ID NO: 96071 - DNA, 103 bp, Artificial Sequence
  Synthetic Polynucleotide
taatacgactcactatagggtcctccccgctggcactcagcttggttgggaacagaggagacccaacatggctgagtgcaacctggcggcagcgcaaaagatg

SEQ ID NO: 96072 - DNA, 103 bp, Artificial Sequence
  Synthetic Polynucleotide
taatacgactcactataggggaggaccgttttatgggctctaaactgctcaacagaggagagagcagatgagagcccataacctggcggcagcgcaaaagatg

SEQ ID NO: 96073 - DNA, 103 bp, Artificial Sequence
  Synthetic Polynucleotide
taatacgactcactataggggatggtggagtcctccccgctggcactcagaacagaggagactgagtatgagcggggagaacctggcggcagcgcaaaagatg

SEQ ID NO: 96074 - DNA, 103 bp, Artificial Sequence
  Synthetic Polynucleotide
taatacgactcactatagggtggcttgtgggatggtggagtcctccccgcaacagaggagagcggggatgactccaccaaacctggcggcagcgcaaaagatg

SEQ ID NO: 96075 - DNA, 103 bp, Artificial Sequence
  Synthetic Polynucleotide
taatacgactcactatagggttgagccggctggcttgtgggatggtggagaacagaggagactccacatgcccacaagcaacctggcggcagcgcaaaagatg

SEQ ID NO: 96076 - DNA, 103 bp, Artificial Sequence
  Synthetic Polynucleotide
taatacgactcactatagggaacgatgttattgagccggctggcttgtggaacagaggagaccacaaatgagccggctcaacctggcggcagcgcaaaagatg

SEQ ID NO: 96077 - DNA, 103 bp, Artificial Sequence
  Synthetic Polynucleotide
taatacgactcactatagggtggacctgttaacgatgttattgagccggcaacagaggagagccggcatgataacatcgaacctggcggcagcgcaaaagatg

SEQ ID NO: 96078 - DNA, 103 bp, Artificial Sequence
  Synthetic Polynucleotide
taatacgactcactataggggagcccgtcatggacctgttaacgatgttaaacagaggagataacatatgtaacaggtcaacctggcggcagcgcaaaagatg

SEQ ID NO: 96079 - DNA, 103 bp, Artificial Sequence
  Synthetic Polynucleotide
taatacgactcactataggggctgcggggagagcccgtcatggacctgttaacagaggagaaacaggatgatgacgggcaacctggcggcagcgcaaaagatg

SEQ ID NO: 96080 - DNA, 103 bp, Artificial Sequence
  Synthetic Polynucleotide
taatacgactcactatagggtctcgctgctgctgcggggagagcccgtcaaacagaggagatgacggatgctccccgcaaacctggcggcagcgcaaaagatg

SEQ ID NO: 96081 - DNA, 103 bp, Artificial Sequence
  Synthetic Polynucleotide
taatacgactcactatagggggtgagtggctctcgctgctgctgcggggaaacagaggagatccccgatgcagcagcgaaacctggcggcagcgcaaaagatg

SEQ ID NO: 96082 - DNA, 103 bp, Artificial Sequence
  Synthetic Polynucleotide
taatacgactcactatagggcatgtagagtggtgagtggctctcgctgctaacagaggagaagcagcatgagccactcaaacctggcggcagcgcaaaagatg

SEQ ID NO: 96083 - DNA, 103 bp, Artificial Sequence
  Synthetic Polynucleotide
taatacgactcactatagggtgcaggccatgaggaccgttttatgggctcaacagaggagagagcccatgaaacggtccaacctggcggcagcgcaaaagatg

SEQ ID NO: 96084 - DNA, 103 bp, Artificial Sequence
  Synthetic Polynucleotide
taatacgactcactatagggtcggggggtgcatgtagagtggtgagtggcaacagaggagagccactatgcactctacaaacctggcggcagcgcaaaagatg

SEQ ID NO: 96085 - DNA, 103 bp, Artificial Sequence
  Synthetic Polynucleotide
taatacgactcactataggggacgtgcacttcggggggtgcatgtagagtaacagaggagaactctaatggcaccccccaacctggcggcagcgcaaaagatg

SEQ ID NO: 96086 - DNA, 103 bp, Artificial Sequence
  Synthetic Polynucleotide
taatacgactcactatagggagagccgcaggacgtgcacttcggggggtgaacagaggagacaccccatgaagtgcacgaacctggcggcagcgcaaaagatg

SEQ ID NO: 96087 - DNA, 103 bp, Artificial Sequence
  Synthetic Polynucleotide
taatacgactcactataggggtggggactgagagccgcaggacgtgcactaacagaggagaagtgcaatgcctgcggctaacctggcggcagcgcaaaagatg

SEQ ID NO: 96088 - DNA, 103 bp, Artificial Sequence
  Synthetic Polynucleotide
taatacgactcactatagggtctgcatgctgtggggactgagagccgcagaacagaggagactgcggatgtcagtccccaacctggcggcagcgcaaaagatg

SEQ ID NO: 96089 - DNA, 103 bp, Artificial Sequence
  Synthetic Polynucleotide
taatacgactcactataggggaggcacatctctgcatgctgtggggactgaacagaggagacagtccatgcagcatgcaaacctggcggcagcgcaaaagatg

SEQ ID NO: 96090 - DNA, 103 bp, Artificial Sequence
  Synthetic Polynucleotide
taatacgactcactatagggcagcggtgtggaggcacatctctgcatgctaacagaggagaagcatgatgagatgtgccaacctggcggcagcgcaaaagatg

SEQ ID NO: 96091 - DNA, 103 bp, Artificial Sequence
  Synthetic Polynucleotide
taatacgactcactatagggaacgtggggccagcggtgtggaggcacatcaacagaggagagatgtgatgccacaccgcaacctggcggcagcgcaaaagatg

SEQ ID NO: 96092 - DNA, 103 bp, Artificial Sequence
  Synthetic Polynucleotide
taatacgactcactatagggctcctcagggaacgtggggccagcggtgtgaacagaggagacacaccatgggccccacgaacctggcggcagcgcaaaagatg

SEQ ID NO: 96093 - DNA, 103 bp, Artificial Sequence
  Synthetic Polynucleotide
taatacgactcactatagggtctctcccatctcctcagggaacgtggggcaacagaggagagccccaatgtccctgaggaacctggcggcagcgcaaaagatg

SEQ ID NO: 96094 - DNA, 103 bp, Artificial Sequence
  Synthetic Polynucleotide
taatacgactcactatagggaacaggccactgcaggccatgaggaccgttaacagaggagaaacggtatgcatggcctgaacctggcggcagcgcaaaagatg

SEQ ID NO: 96095 - DNA, 103 bp, Artificial Sequence
  Synthetic Polynucleotide
taatacgactcactatagggtcagactgggtctctcccatctcctcagggaacagaggagaccctgaatggatgggagaaacctggcggcagcgcaaaagatg

SEQ ID NO: 96096 - DNA, 103 bp, Artificial Sequence
  Synthetic Polynucleotide
taatacgactcactatagggatctgagtactcagactgggtctctcccataacagaggagaatgggaatgacccagtctaacctggcggcagcgcaaaagatg

SEQ ID NO: 96097 - DNA, 103 bp, Artificial Sequence
  Synthetic Polynucleotide
taatacgactcactatagggcacagctagaatctgagtactcagactgggaacagaggagacccagtatgagtactcagaacctggcggcagcgcaaaagatg

SEQ ID NO: 96098 - DNA, 103 bp, Artificial Sequence
  Synthetic Polynucleotide
taatacgactcactataggggccccgttctcacagctagaatctgagtacaacagaggagagtactcatgttctagctgaacctggcggcagcgcaaaagatg

SEQ ID NO: 96099 - DNA, 103 bp, Artificial Sequence
  Synthetic Polynucleotide
taatacgactcactataggggcagaagaaggccccgttctcacagctagaaacagaggagatctagcatggagaacgggaacctggcggcagcgcaaaagatg

SEQ ID NO: 96100 - DNA, 103 bp, Artificial Sequence
  Synthetic Polynucleotide
taatacgactcactatagggcacactcattgcagaagaaggccccgttctaacagaggagaagaacgatgccttcttctaacctggcggcagcgcaaaagatg

SEQ ID NO: 96101 - DNA, 103 bp, Artificial Sequence
  Synthetic Polynucleotide
taatacgactcactatagggaagcggcagtcacactcattgcagaagaagaacagaggagacttcttatgcaatgagtgaacctggcggcagcgcaaaagatg

SEQ ID NO: 96102 - DNA, 103 bp, Artificial Sequence
  Synthetic Polynucleotide
taatacgactcactatagggctcctcagagaagcggcagtcacactcattaacagaggagaaatgagatggactgccgcaacctggcggcagcgcaaaagatg

SEQ ID NO: 96103 - DNA, 103 bp, Artificial Sequence
  Synthetic Polynucleotide
taatacgactcactatagggtgagtgaggcctcctcagagaagcggcagtaacagaggagaactgccatgtctctgaggaacctggcggcagcgcaaaagatg

SEQ ID NO: 96104 - DNA, 103 bp, Artificial Sequence
  Synthetic Polynucleotide
taatacgactcactataggggtgtgcctcttgagtgaggcctcctcagagaacagaggagactctgaatgggcctcactaacctggcggcagcgcaaaagatg

SEQ ID NO: 96105 - DNA, 103 bp, Artificial Sequence
  Synthetic Polynucleotide
taatacgactcactataggggatgctatagaacaggccactgcaggccataacagaggagaatggccatgagtggcctgaacctggcggcagcgcaaaagatg

SEQ ID NO: 96106 - DNA, 103 bp, Artificial Sequence
  Synthetic Polynucleotide
taatacgactcactatagggggtctgcagcgtgtgcctcttgagtgaggcaacagaggagagcctcaatgaagaggcacaacctggcggcagcgcaaaagatg

SEQ ID NO: 96107 - DNA, 103 bp, Artificial Sequence
  Synthetic Polynucleotide
taatacgactcactatagggtgtcactgtgggtctgcagcgtgtgcctctaacagaggagaagaggcatgcgctgcagaaacctggcggcagcgcaaaagatg

SEQ ID NO: 96108 - DNA, 103 bp, Artificial Sequence
  Synthetic Polynucleotide
taatacgactcactatagggttgtagggtttgtcactgtgggtctgcagcaacagaggagagctgcaatgccacagtgaaacctggcggcagcgcaaaagatg

SEQ ID NO: 96109 - DNA, 103 bp, Artificial Sequence
  Synthetic Polynucleotide
taatacgactcactataggggcggtcacacttgtagggtttgtcactgtgaacagaggagacacagtatgaaaccctacaacctggcggcagcgcaaaagatg

SEQ ID NO: 96110 - DNA, 103 bp, Artificial Sequence
  Synthetic Polynucleotide
taatacgactcactatagggaggcctggcagcggtcacacttgtagggttaacagaggagaaaccctatgagtgtgaccaacctggcggcagcgcaaaagatg

SEQ ID NO: 96111 - DNA, 103 bp, Artificial Sequence
  Synthetic Polynucleotide
taatacgactcactatagggtagcggaaggaggcctggcagcggtcacacaacagaggagagtgtgaatgctgccaggcaacctggcggcagcgcaaaagatg

SEQ ID NO: 96112 - DNA, 103 bp, Artificial Sequence
  Synthetic Polynucleotide
taatacgactcactataggggttgcccttgtagcggaaggaggcctggcaaacagaggagatgccagatgtccttccgcaacctggcggcagcgcaaaagatg

SEQ ID NO: 96113 - DNA, 103 bp, Artificial Sequence
  Synthetic Polynucleotide
taatacgactcactatagggggctggcgaggttgcccttgtagcggaaggaacagaggagaccttccatgacaagggcaaacctggcggcagcgcaaaagatg

SEQ ID NO: 96114 - DNA, 103 bp, Artificial Sequence
  Synthetic Polynucleotide
taatacgactcactatagggacggtcttgtggctggcgaggttgcccttgaacagaggagacaagggatgcctcgccagaacctggcggcagcgcaaaagatg

SEQ ID NO: 96115 - DNA, 103 bp, Artificial Sequence
  Synthetic Polynucleotide
taatacgactcactatagggaccggtatggacggtcttgtggctggcgagaacagaggagactcgccatgcacaagaccaacctggcggcagcgcaaaagatg

SEQ ID NO: 96116 - DNA, 103 bp, Artificial Sequence
  Synthetic Polynucleotide
taatacgactcactatagggggtctgtaaagatgctatagaacaggccacaacagaggagagtggccatgtctatagcaaacctggcggcagcgcaaaagatg

SEQ ID NO: 96117 - DNA, 103 bp, Artificial Sequence
  Synthetic Polynucleotide
taatacgactcactatagggagggtttctcaccggtatggacggtcttgtaacagaggagaacaagaatgtccataccgaacctggcggcagcgcaaaagatg

SEQ ID NO: 96118 - DNA, 103 bp, Artificial Sequence
  Synthetic Polynucleotide
taatacgactcactatagggttgcaacgatagggtttctcaccggtatggaacagaggagaccatacatgtgagaaaccaacctggcggcagcgcaaaagatg

SEQ ID NO: 96119 - DNA, 103 bp, Artificial Sequence
  Synthetic Polynucleotide
taatacgactcactatagggcccacagatgttgcaacgatagggtttctcaacagaggagagagaaaatgtatcgttgcaacctggcggcagcgcaaaagatg

SEQ ID NO: 96120 - DNA, 103 bp, Artificial Sequence
  Synthetic Polynucleotide
taatacgactcactatagggtgaactgggccccacagatgttgcaacgataacagaggagaatcgttatgacatctgtgaacctggcggcagcgcaaaagatg

SEQ ID NO: 96121 - DNA, 103 bp, Artificial Sequence
  Synthetic Polynucleotide
taatacgactcactataggggctggccggttgaactgggccccacagatgaacagaggagacatctgatgggcccagttaacctggcggcagcgcaaaagatg

SEQ ID NO: 96122 - DNA, 103 bp, Artificial Sequence
  Synthetic Polynucleotide
taatacgactcactatagggtttcaggttggctggccggttgaactgggcaacagaggagagcccagatgaaccggccaaacctggcggcagcgcaaaagatg

SEQ ID NO: 96123 - DNA, 103 bp, Artificial Sequence
  Synthetic Polynucleotide
taatacgactcactataggggagtgtgggttttcaggttggctggccggtaacagaggagaaccggcatgccaacctgaaacctggcggcagcgcaaaagatg

SEQ ID NO: 96124 - DNA, 103 bp, Artificial Sequence
  Synthetic Polynucleotide
taatacgactcactataggggagtgaattcgagtgtgggttttcaggttgaacagaggagacaacctatgaacccacacaacctggcggcagcgcaaaagatg

SEQ ID NO: 96125 - DNA, 103 bp, Artificial Sequence
  Synthetic Polynucleotide
taatacgactcactatagggcttctctccagagtgaattcgagtgtgggtaacagaggagaacccacatgcgaattcacaacctggcggcagcgcaaaagatg

SEQ ID NO: 96126 - DNA, 103 bp, Artificial Sequence
  Synthetic Polynucleotide
taatacgactcactatagggatttgtagggcttctctccagagtgaattcaacagaggagagaattcatgctggagagaaacctggcggcagcgcaaaagatg

SEQ ID NO: 96127 - DNA, 103 bp, Artificial Sequence
  Synthetic Polynucleotide
taatacgactcactatagggcatttcaactggtctgtaaagatgctatagaacagaggagactatagatgctttacagaaacctggcggcagcgcaaaagatg

SEQ ID NO: 96128 - DNA, 103 bp, Artificial Sequence
  Synthetic Polynucleotide
taatacgactcactatagggcaggtttcgcatttgtagggcttctctccaaacagaggagatggagaatggccctacaaaacctggcggcagcgcaaaagatg

SEQ ID NO: 96129 - DNA, 103 bp, Artificial Sequence
  Synthetic Polynucleotide
taatacgactcactatagggtctggctccgcaggtttcgcatttgtagggaacagaggagaccctacatgtgcgaaaccaacctggcggcagcgcaaaagatg

SEQ ID NO: 96130 - DNA, 103 bp, Artificial Sequence
  Synthetic Polynucleotide
taatacgactcactatagggcctgtacaaatctggctccgcaggtttcgcaacagaggagagcgaaaatggcggagccaaacctggcggcagcgcaaaagatg

SEQ ID NO: 96131 - DNA, 103 bp, Artificial Sequence
  Synthetic Polynucleotide
taatacgactcactatagggaggtgggccacctgtacaaatctggctccgaacagaggagacggagcatgatttgtacaaacctggcggcagcgcaaaagatg

SEQ ID NO: 96132 - DNA, 103 bp, Artificial Sequence
  Synthetic Polynucleotide
taatacgactcactatagggatgggcacggaggtgggccacctgtacaaaaacagaggagatttgtaatggtggcccacaacctggcggcagcgcaaaagatg

SEQ ID NO: 96133 - DNA, 103 bp, Artificial Sequence
  Synthetic Polynucleotide
taatacgactcactatagggggataagcacatgggcacggaggtgggccaaacagaggagatggcccatgtccgtgcccaacctggcggcagcgcaaaagatg

SEQ ID NO: 96134 - DNA, 103 bp, Artificial Sequence
  Synthetic Polynucleotide
taatacgactcactatagggtcaccagtgtggataagcacatgggcacggaacagaggagaccgtgcatgtgtgcttataacctggcggcagcgcaaaagatg

SEQ ID NO: 96135 - DNA, 103 bp, Artificial Sequence
  Synthetic Polynucleotide
taatacgactcactatagggatagggcttctcaccagtgtggataagcacaacagaggagagtgcttatgcacactggtaacctggcggcagcgcaaaagatg

SEQ ID NO: 96136 - DNA, 103 bp, Artificial Sequence
  Synthetic Polynucleotide
taatacgactcactatagggtttcacagggatagggcttctcaccagtgtaacagaggagaacactgatgagaagccctaacctggcggcagcgcaaaagatg

SEQ ID NO: 96137 - DNA, 103 bp, Artificial Sequence
  Synthetic Polynucleotide
taatacgactcactataggggtgccacagatttcacagggatagggcttcaacagaggagagaagccatgtccctgtgaaacctggcggcagcgcaaaagatg

SEQ ID NO: 96138 - DNA, 103 bp, Artificial Sequence
  Synthetic Polynucleotide
taatacgactcactatagggactaaggttgcatttcaactggtctgtaaaaacagaggagatttacaatgcagttgaaaaacctggcggcagcgcaaaagatg

SEQ ID NO: 96139 - DNA, 103 bp, Artificial Sequence
  Synthetic Polynucleotide
taatacgactcactatagggccggaaacgggtgccacagatttcacagggaacagaggagaccctgtatgatctgtggcaacctggcggcagcgcaaaagatg

SEQ ID NO: 96140 - DNA, 103 bp, Artificial Sequence
  Synthetic Polynucleotide
taatacgactcactatagggtctgaaggtgccggaaacgggtgccacagaaacagaggagatctgtgatgcccgtttccaacctggcggcagcgcaaaagatg

SEQ ID NO: 96141 - DNA, 103 bp, Artificial Sequence
  Synthetic Polynucleotide
taatacgactcactatagggctcttcagagtctgaaggtgccggaaacggaacagaggagaccgtttatggcaccttcaaacctggcggcagcgcaaaagatg

SEQ ID NO: 96142 - DNA, 103 bp, Artificial Sequence
  Synthetic Polynucleotide
taatacgactcactatagggtcgcaggtggctcttcagagtctgaaggtgaacagaggagacaccttatgactctgaagaacctggcggcagcgcaaaagatg

SEQ ID NO: 96143 - DNA, 103 bp, Artificial Sequence
  Synthetic Polynucleotide
taatacgactcactatagggctgtgtggattcgcaggtggctcttcagagaacagaggagactctgaatggccacctgcaacctggcggcagcgcaaaagatg

SEQ ID NO: 96144 - DNA, 103 bp, Artificial Sequence
  Synthetic Polynucleotide
taatacgactcactatagggggtttctctcctgtgtggattcgcaggtggaacagaggagaccacctatgaatccacacaacctggcggcagcgcaaaagatg

SEQ ID NO: 96145 - DNA, 103 bp, Artificial Sequence
  Synthetic Polynucleotide
taatacgactcactatagggacaatggtaaggtttctctcctgtgtggataacagaggagaatccacatgggagagaaaaacctggcggcagcgcaaaagatg

SEQ ID NO: 96146 - DNA, 103 bp, Artificial Sequence
  Synthetic Polynucleotide
taatacgactcactatagggtacacttctcacaatggtaaggtttctctcaacagaggagagagagaatgcttaccattaacctggcggcagcgcaaaagatg

SEQ ID NO: 96147 - DNA, 103 bp, Artificial Sequence
  Synthetic Polynucleotide
taatacgactcactatagggaaatgcaggttacacttctcacaatggtaaaacagaggagattaccaatgtgagaagtgaacctggcggcagcgcaaaagatg

SEQ ID NO: 96148 - DNA, 103 bp, Artificial Sequence
  Synthetic Polynucleotide
taatacgactcactatagggtttgtgacggaaatgcaggttacacttctcaacagaggagagagaagatgaacctgcataacctggcggcagcgcaaaagatg

SEQ ID NO: 96149 - DNA, 103 bp, Artificial Sequence
  Synthetic Polynucleotide
taatacgactcactatagggggcgggtgaactggatacagctgtcagccgaacagaggagacggctgatggctgtatccaacctggcggcagcgcaaaagatg

SEQ ID NO: 96150 - DNA, 103 bp, Artificial Sequence
  Synthetic Polynucleotide
taatacgactcactataggggattgatcacactaaggttgcatttcaactaacagaggagaagttgaatggcaaccttaaacctggcggcagcgcaaaagatg

SEQ ID NO: 96151 - DNA, 103 bp, Artificial Sequence
  Synthetic Polynucleotide
taatacgactcactataggggcagctggcttttgtgacggaaatgcaggtaacagaggagaacctgcatgtccgtcacaaacctggcggcagcgcaaaagatg

SEQ ID NO: 96152 - DNA, 103 bp, Artificial Sequence
  Synthetic Polynucleotide
taatacgactcactatagggaagtgaagtcgcagctggcttttgtgacggaacagaggagaccgtcaatgaagccagctaacctggcggcagcgcaaaagatg

SEQ ID NO: 96153 - DNA, 103 bp, Artificial Sequence
  Synthetic Polynucleotide
taatacgactcactatagggcttctggcgcaagtgaagtcgcagctggctaacagaggagaagccagatgcgacttcacaacctggcggcagcgcaaaagatg

SEQ ID NO: 96154 - DNA, 103 bp, Artificial Sequence
  Synthetic Polynucleotide
taatacgactcactatagggtggcgccatgcttctggcgcaagtgaagtcaacagaggagagacttcatgtgcgccagaaacctggcggcagcgcaaaagatg

SEQ ID NO: 96155 - DNA, 103 bp, Artificial Sequence
  Synthetic Polynucleotide
taatacgactcactataggggtgttggtgatggcgccatgcttctggcgcaacagaggagagcgccaatggcatggcgcaacctggcggcagcgcaaaagatg

SEQ ID NO: 96156 - DNA, 103 bp, Artificial Sequence
  Synthetic Polynucleotide
taatacgactcactatagggttgcaccttggtgttggtgatggcgccatgaacagaggagacatggcatgatcaccaacaacctggcggcagcgcaaaagatg

SEQ ID NO: 96157 - DNA, 103 bp, Artificial Sequence
  Synthetic Polynucleotide
taatacgactcactatagggacacgcggtattgcaccttggtgttggtgaaacagaggagatcaccaatgccaaggtgcaacctggcggcagcgcaaaagatg

SEQ ID NO: 96158 - DNA, 103 bp, Artificial Sequence
  Synthetic Polynucleotide
taatacgactcactatagggtcagtggctgacacgcggtattgcaccttgaacagaggagacaaggtatgataccgcgtaacctggcggcagcgcaaaagatg

SEQ ID NO: 96159 - DNA, 103 bp, Artificial Sequence
  Synthetic Polynucleotide
taatacgactcactatagggcggaggcaggtcagtggctgacacgcggtaaacagaggagataccgcatgtcagccactaacctggcggcagcgcaaaagatg

SEQ ID NO: 96160 - DNA, 103 bp, Artificial Sequence
  Synthetic Polynucleotide
taatacgactcactatagggtggggagctccggaggcaggtcagtggctgaacagaggagacagccaatgacctgcctcaacctggcggcagcgcaaaagatg

SEQ ID NO: 96161 - DNA, 103 bp, Artificial Sequence
  Synthetic Polynucleotide
taatacgactcactatagggtcaggatctagattgatcacactaaggttgaacagaggagacaacctatgtgtgatcaaaacctggcggcagcgcaaaagatg

SEQ ID NO: 96162 - DNA, 103 bp, Artificial Sequence
  Synthetic Polynucleotide
taatacgactcactatagggcagcaggctttggggagctccggaggcaggaacagaggagacctgccatgggagctcccaacctggcggcagcgcaaaagatg

SEQ ID NO: 96163 - DNA, 103 bp, Artificial Sequence
  Synthetic Polynucleotide
taatacgactcactatagggagggttgatctcaggatctagattgatcacaacagaggagagtgatcatgctagatcctaacctggcggcagcgcaaaagatg

SEQ ID NO: 96164 - DNA, 103 bp, Artificial Sequence
  Synthetic Polynucleotide
taatacgactcactatagggagaatccctcagggttgatctcaggatctaaacagaggagatagatcatgagatcaaccaacctggcggcagcgcaaaagatg

SEQ ID NO: 96165 - DNA, 103 bp, Artificial Sequence
  Synthetic Polynucleotide
taatacgactcactatagggaggaggatgcagaatccctcagggttgatcaacagaggagagatcaaatgtgagggattaacctggcggcagcgcaaaagatg

SEQ ID NO: 96166 - DNA, 103 bp, Artificial Sequence
  Synthetic Polynucleotide
taatacgactcactatagggcatgaagtccaggaggatgcagaatccctcaacagaggagagagggaatgtgcatcctcaacctggcggcagcgcaaaagatg

SEQ ID NO: 96167 - DNA, 103 bp, Artificial Sequence
  Synthetic Polynucleotide
taatacgactcactataggggagatgtgtacatgaagtccaggaggatgcaacagaggagagcatccatgtggacttcaaacctggcggcagcgcaaaagatg

SEQ ID NO: 96168 - DNA, 103 bp, Artificial Sequence
  Synthetic Polynucleotide
taatacgactcactatagggaaattgagccgagatgtgtacatgaagtccaacagaggagaggacttatggtacacatcaacctggcggcagcgcaaaagatg

SEQ ID NO: 96169 - DNA, 103 bp, Artificial Sequence
  Synthetic Polynucleotide
taatacgactcactataggggccctcccgcaaattgagccgagatgtgtaaacagaggagatacacaatgcggctcaataacctggcggcagcgcaaaagatg

SEQ ID NO: 96170 - DNA, 103 bp, Artificial Sequence
  Synthetic Polynucleotide
taatacgactcactatagggccatgatgttgccctcccgcaaattgagccaacagaggagaggctcaatgtgcgggaggaacctggcggcagcgcaaaagatg

SEQ ID NO: 96171 - DNA, 103 bp, Artificial Sequence
  Synthetic Polynucleotide
taatacgactcactatagggtcactggcatggcgggtgaactggatacagaacagaggagactgtatatggttcacccgaacctggcggcagcgcaaaagatg

SEQ ID NO: 96172 - DNA, 103 bp, Artificial Sequence
  Synthetic Polynucleotide
taatacgactcactataggggccatcacagccatgatgttgccctcccgcaacagaggagagcgggaatgcaacatcataacctggcggcagcgcaaaagatg

SEQ ID NO: 96173 - DNA, 103 bp, Artificial Sequence
  Synthetic Polynucleotide
taatacgactcactatagggcatagccgtggccatcacagccatgatgttaacagaggagaaacatcatggctgtgatgaacctggcggcagcgcaaaagatg

SEQ ID NO: 96174 - DNA, 103 bp, Artificial Sequence
  Synthetic Polynucleotide
taatacgactcactatagggtctgcaggtacatagccgtggccatcacagaacagaggagactgtgaatgccacggctaaacctggcggcagcgcaaaagatg

SEQ ID NO: 96175 - DNA, 103 bp, Artificial Sequence
  Synthetic Polynucleotide
taatacgactcactatagggacatgctccatctgcaggtacatagccgtgaacagaggagacacggcatggtacctgcaaacctggcggcagcgcaaaagatg

SEQ ID NO: 96176 - DNA, 103 bp, Artificial Sequence
  Synthetic Polynucleotide
taatacgactcactatagggagtgtccacaacatgctccatctgcaggtaaacagaggagatacctgatgatggagcataacctggcggcagcgcaaaagatg

SEQ ID NO: 96177 - DNA, 103 bp, Artificial Sequence
  Synthetic Polynucleotide
taatacgactcactatagggacttccggcaagtgtccacaacatgctccaaacagaggagatggagcatgttgtggacaaacctggcggcagcgcaaaagatg

SEQ ID NO: 96178 - DNA, 103 bp, Artificial Sequence
  Synthetic Polynucleotide
taatacgactcactataggggccttaataaacttccggcaagtgtccacaaacagaggagatgtggaatgttgccggaaaacctggcggcagcgcaaaagatg

SEQ ID NO: 96179 - DNA, 103 bp, Artificial Sequence
  Synthetic Polynucleotide
taatacgactcactatagggtgcttcactggccttaataaacttccggcaaacagaggagatgccggatgtttattaagaacctggcggcagcgcaaaagatg

SEQ ID NO: 96180 - DNA, 103 bp, Artificial Sequence
  Synthetic Polynucleotide
taatacgactcactatagggaaaccatctctgcttcactggccttaataaaacagaggagattattaatgccagtgaagaacctggcggcagcgcaaaagatg

SEQ ID NO: 96181 - DNA, 103 bp, Artificial Sequence
  Synthetic Polynucleotide
taatacgactcactatagggttgatggcagaaaccatctctgcttcactgaacagaggagacagtgaatgagagatggtaacctggcggcagcgcaaaagatg

SEQ ID NO: 96182 - DNA, 103 bp, Artificial Sequence
  Synthetic Polynucleotide
taatacgactcactataggggagaagaacatcactggcatggcgggtgaaaacagaggagattcaccatgcatgccagtaacctggcggcagcgcaaaagatg

SEQ ID NO: 96183 - DNA, 103 bp, Artificial Sequence
  Synthetic Polynucleotide
taatacgactcactatagggacgaggaggcttgatggcagaaaccatctcaacagaggagagagatgatgtctgccatcaacctggcggcagcgcaaaagatg

SEQ ID NO: 96184 - DNA, 103 bp, Artificial Sequence
  Synthetic Polynucleotide
taatacgactcactatagggggaactcttcacgaggaggcttgatggcagaacagaggagactgccaatgagcctcctcaacctggcggcagcgcaaaagatg

SEQ ID NO: 96185 - DNA, 103 bp, Artificial Sequence
  Synthetic Polynucleotide
taatacgactcactatagggcggctgttgaggaactcttcacgaggaggcaacagaggagagcctccatgtgaagagttaacctggcggcagcgcaaaagatg

SEQ ID NO: 96186 - DNA, 103 bp, Artificial Sequence
  Synthetic Polynucleotide
taatacgactcactatagggcatcagcatccggctgttgaggaactcttcaacagaggagagaagagatgctcaacagcaacctggcggcagcgcaaaagatg

SEQ ID NO: 96187 - DNA, 103 bp, Artificial Sequence
  Synthetic Polynucleotide
taatacgactcactatagggtgtcttggggcatcagcatccggctgttgaaacagaggagatcaacaatgggatgctgaaacctggcggcagcgcaaaagatg

SEQ ID NO: 96188 - DNA, 103 bp, Artificial Sequence
  Synthetic Polynucleotide
taatacgactcactatagggtaggccatgatgtcttggggcatcagcatcaacagaggagagatgctatggccccaagaaacctggcggcagcgcaaaagatg

SEQ ID NO: 96189 - DNA, 103 bp, Artificial Sequence
  Synthetic Polynucleotide
taatacgactcactatagggacgaccccgataggccatgatgtcttggggaacagaggagaccccaaatgatcatggccaacctggcggcagcgcaaaagatg

SEQ ID NO: 96190 - DNA, 103 bp, Artificial Sequence
  Synthetic Polynucleotide
taatacgactcactatagggccaccacctcacgaccccgataggccatgaaacagaggagatcatggatgatcggggtcaacctggcggcagcgcaaaagatg

SEQ ID NO: 96191 - DNA, 103 bp, Artificial Sequence
  Synthetic Polynucleotide
taatacgactcactatagggaggttgttctccaccacctcacgaccccgaaacagaggagatcggggatgtgaggtggtaacctggcggcagcgcaaaagatg

SEQ ID NO: 96192 - DNA, 103 bp, Artificial Sequence
  Synthetic Polynucleotide
taatacgactcactatagggcctcagtggcaggttgttctccaccacctcaacagaggagagaggtgatggagaacaacaacctggcggcagcgcaaaagatg

SEQ ID NO: 96193 - DNA, 103 bp, Artificial Sequence
  Synthetic Polynucleotide
taatacgactcactataggggattaaggttgagaagaacatcactggcataacagaggagaatgccaatgatgttcttcaacctggcggcagcgcaaaagatg

SEQ ID NO: 96194 - DNA, 103 bp, Artificial Sequence
  Synthetic Polynucleotide
taatacgactcactatagggcaggggcgctcctcagtggcaggttgttctaacagaggagaagaacaatgtgccactgaaacctggcggcagcgcaaaagatg

SEQ ID NO: 96195 - DNA, 103 bp, Artificial Sequence
  Synthetic Polynucleotide
taatacgactcactatagggctctcacacccaggggcgctcctcagtggcaacagaggagagccactatggagcgccccaacctggcggcagcgcaaaagatg

SEQ ID NO: 96196 - DNA, 103 bp, Artificial Sequence
  Synthetic Polynucleotide
taatacgactcactatagggaaaggctctgctctcacacccaggggcgctaacagaggagaagcgccatggggtgtgagaacctggcggcagcgcaaaagatg

SEQ ID NO: 96197 - DNA, 103 bp, Artificial Sequence
  Synthetic Polynucleotide
taatacgactcactatagggggctgggggcaaaggctctgctctcacaccaacagaggagaggtgtgatggcagagcctaacctggcggcagcgcaaaagatg

SEQ ID NO: 96198 - DNA, 103 bp, Artificial Sequence
  Synthetic Polynucleotide
taatacgactcactatagggccactgtacaggctgggggcaaaggctctgaacagaggagacagagcatgtgcccccagaacctggcggcagcgcaaaagatg

SEQ ID NO: 96199 - DNA, 103 bp, Artificial Sequence
  Synthetic Polynucleotide
taatacgactcactatagggtgtggacaggccactgtacaggctgggggcaacagaggagagcccccatgctgtacagtaacctggcggcagcgcaaaagatg

SEQ ID NO: 96200 - DNA, 103 bp, Artificial Sequence
  Synthetic Polynucleotide
taatacgactcactatagggaggctggcggtgtggacaggccactgtacaaacagaggagatgtacaatggcctgtccaaacctggcggcagcgcaaaagatg

SEQ ID NO: 96201 - DNA, 103 bp, Artificial Sequence
  Synthetic Polynucleotide
taatacgactcactatagggatggaataagaggctggcggtgtggacaggaacagaggagacctgtcatgaccgccagcaacctggcggcagcgcaaaagatg

SEQ ID NO: 96202 - DNA, 103 bp, Artificial Sequence
  Synthetic Polynucleotide
taatacgactcactataggggtggctgtacatggaataagaggctggcggaacagaggagaccgccaatgtcttattccaacctggcggcagcgcaaaagatg

SEQ ID NO: 96203 - DNA, 103 bp, Artificial Sequence
  Synthetic Polynucleotide
taatacgactcactatagggtgacagggaggtggctgtacatggaataagaacagaggagacttattatgtgtacagccaacctggcggcagcgcaaaagatg

SEQ ID NO: 96204 - DNA, 103 bp, Artificial Sequence
  Synthetic Polynucleotide
taatacgactcactatagggctccggagacgattaaggttgagaagaacaaacagaggagatgttctatgcaaccttaaaacctggcggcagcgcaaaagatg

SEQ ID NO: 96205 - DNA, 103 bp, Artificial Sequence
  Synthetic Polynucleotide
taatacgactcactatagggaggaggctgctgacagggaggtggctgtacaacagaggagagtacagatgcctccctgtaacctggcggcagcgcaaaagatg

SEQ ID NO: 96206 - DNA, 103 bp, Artificial Sequence
  Synthetic Polynucleotide
taatacgactcactatagggatcggagaagaggaggctgctgacagggagaacagaggagactccctatgagcagcctcaacctggcggcagcgcaaaagatg

SEQ ID NO: 96207 - DNA, 103 bp, Artificial Sequence
  Synthetic Polynucleotide
taatacgactcactataggggaaactcctcatcggagaagaggaggctgcaacagaggagagcagccatgtcttctccgaacctggcggcagcgcaaaagatg

SEQ ID NO: 96208 - DNA, 103 bp, Artificial Sequence
  Synthetic Polynucleotide
taatacgactcactatagggcggacatcccgaaactcctcatcggagaagaacagaggagacttctcatgtgaggagttaacctggcggcagcgcaaaagatg

SEQ ID NO: 96209 - DNA, 103 bp, Artificial Sequence
  Synthetic Polynucleotide
taatacgactcactatagggcacaggcatccggacatcccgaaactcctcaacagaggagagaggagatgcgggatgtcaacctggcggcagcgcaaaagatg

SEQ ID NO: 96210 - DNA, 103 bp, Artificial Sequence
  Synthetic Polynucleotide
taatacgactcactatagggaggggttggccacaggcatccggacatcccaacagaggagagggatgatgggatgcctgaacctggcggcagcgcaaaagatg

SEQ ID NO: 96211 - DNA, 103 bp, Artificial Sequence
  Synthetic Polynucleotide
taatacgactcactatagggtccttggggaaggggttggccacaggcatcaacagaggagagatgccatgggccaacccaacctggcggcagcgcaaaagatg

SEQ ID NO: 96212 - DNA, 103 bp, Artificial Sequence
  Synthetic Polynucleotide
taatacgactcactataggggagtgcccgctccttggggaaggggttggcaacagaggagagccaacatgttccccaagaacctggcggcagcgcaaaagatg

SEQ ID NO: 96213 - DNA, 103 bp, Artificial Sequence
  Synthetic Polynucleotide
taatacgactcactatagggtatcacatgggagtgcccgctccttggggaaacagaggagatccccaatgagcgggcacaacctggcggcagcgcaaaagatg

SEQ ID NO: 96214 - DNA, 103 bp, Artificial Sequence
  Synthetic Polynucleotide
taatacgactcactatagggggcctggcactatcacatgggagtgcccgcaacagaggagagcgggcatgcccatgtgaaacctggcggcagcgcaaaagatg

SEQ ID NO: 96215 - DNA, 103 bp, Artificial Sequence
  Synthetic Polynucleotide
taatacgactcactataggggatgtctcgactccggagacgattaaggttaacagaggagaaaccttatgcgtctccggaacctggcggcagcgcaaaagatg

SEQ ID NO: 96216 - DNA, 103 bp, Artificial Sequence
  Synthetic Polynucleotide
taatacgactcactatagggaccagggactggcctggcactatcacatggaacagaggagaccatgtatgagtgccaggaacctggcggcagcgcaaaagatg

SEQ ID NO: 96217 - DNA, 103 bp, Artificial Sequence
  Synthetic Polynucleotide
taatacgactcactatagggggctgtactcaccagggactggcctggcacaacagaggagagtgccaatgcagtccctgaacctggcggcagcgcaaaagatg

SEQ ID NO: 96218 - DNA, 103 bp, Artificial Sequence
  Synthetic Polynucleotide
taatacgactcactatagggaaagtcggccggctgtactcaccagggactaacagaggagaagtcccatgtgagtacagaacctggcggcagcgcaaaagatg

SEQ ID NO: 96219 - DNA, 103 bp, Artificial Sequence
  Synthetic Polynucleotide
taatacgactcactatagggggacacctccaaagtcggccggctgtactcaacagaggagagagtacatgcggccgactaacctggcggcagcgcaaaagatg

SEQ ID NO: 96220 - DNA, 103 bp, Artificial Sequence
  Synthetic Polynucleotide
taatacgactcactatagggacacattgggggacacctccaaagtcggccaacagaggagaggccgaatgtggaggtgtaacctggcggcagcgcaaaagatg

SEQ ID NO: 96221 - DNA, 103 bp, Artificial Sequence
  Synthetic Polynucleotide
taatacgactcactatagggttgctgtggcacacattgggggacacctccaacagaggagaggaggtatgccccaatgtaacctggcggcagcgcaaaagatg

SEQ ID NO: 96222 - DNA, 103 bp, Artificial Sequence
  Synthetic Polynucleotide
taatacgactcactatagggtgaatagatattgctgtggcacacattgggaacagaggagacccaatatgtgccacagcaacctggcggcagcgcaaaagatg

SEQ ID NO: 96223 - DNA, 103 bp, Artificial Sequence
  Synthetic Polynucleotide
taatacgactcactatagggtttccttgggtgaatagatattgctgtggcaacagaggagagccacaatgatatctattaacctggcggcagcgcaaaagatg

SEQ ID NO: 96224 - DNA, 103 bp, Artificial Sequence
  Synthetic Polynucleotide
taatacgactcactatagggtctgggattgtttccttgggtgaatagataaacagaggagatatctaatgacccaaggaaacctggcggcagcgcaaaagatg

SEQ ID NO: 96225 - DNA, 103 bp, Artificial Sequence
  Synthetic Polynucleotide
taatacgactcactatagggtcgtgcctcttctgggattgtttccttgggaacagaggagacccaagatgacaatcccaaacctggcggcagcgcaaaagatg

SEQ ID NO: 96226 - DNA, 103 bp, Artificial Sequence
  Synthetic Polynucleotide
taatacgactcactatagggcatcagtcaagatgtctcgactccggagacaacagaggagagtctccatggtcgagacaaacctggcggcagcgcaaaagatg

SEQ ID NO: 96227 - DNA, 103 bp, Artificial Sequence
  Synthetic Polynucleotide
taatacgactcactataggggcatatcacttcgtgcctcttctgggattgaacagaggagacaatccatgaagaggcacaacctggcggcagcgcaaaagatg

SEQ ID NO: 96228 - DNA, 103 bp, Artificial Sequence
  Synthetic Polynucleotide
taatacgactcactatagggacactgtagtgcatatcacttcgtgcctctaacagaggagaagaggcatgaagtgatataacctggcggcagcgcaaaagatg

SEQ ID NO: 96229 - DNA, 103 bp, Artificial Sequence
  Synthetic Polynucleotide
taatacgactcactataggggccctcagccacactgtagtgcatatcactaacagaggagaagtgatatgcactacagtaacctggcggcagcgcaaaagatg

SEQ ID NO: 96230 - DNA, 103 bp, Artificial Sequence
  Synthetic Polynucleotide
taatacgactcactatagggcaggtttgaggccctcagccacactgtagtaacagaggagaactacaatgtggctgaggaacctggcggcagcgcaaaagatg

SEQ ID NO: 96231 - DNA, 103 bp, Artificial Sequence
  Synthetic Polynucleotide
taatacgactcactataggggagggggcagcaggtttgaggccctcagccaacagaggagaggctgaatgcctcaaaccaacctggcggcagcgcaaaagatg

SEQ ID NO: 96232 - DNA, 103 bp, Artificial Sequence
  Synthetic Polynucleotide
taatacgactcactatagggatttcgggctgagggggcagcaggtttgagaacagaggagactcaaaatggctgcccccaacctggcggcagcgcaaaagatg

SEQ ID NO: 96233 - DNA, 103 bp, Artificial Sequence
  Synthetic Polynucleotide
taatacgactcactatagggagtagggggcatttcgggctgagggggcagaacagaggagactgcccatgcagcccgaaaacctggcggcagcgcaaaagatg

SEQ ID NO: 96234 - DNA, 103 bp, Artificial Sequence
  Synthetic Polynucleotide
taatacgactcactatagggtcacaagggaagtagggggcatttcgggctaacagaggagaagcccgatgtgccccctaaacctggcggcagcgcaaaagatg

SEQ ID NO: 96235 - DNA, 103 bp, Artificial Sequence
  Synthetic Polynucleotide
taatacgactcactataggggctggccttgtcacaagggaagtagggggcaacagaggagagcccccatgttcccttgtaacctggcggcagcgcaaaagatg

SEQ ID NO: 96236 - DNA, 103 bp, Artificial Sequence
  Synthetic Polynucleotide
taatacgactcactatagggcttcttctttgctggccttgtcacaagggaaacagaggagatcccttatgacaaggccaaacctggcggcagcgcaaaagatg

SEQ ID NO: 96237 - DNA, 103 bp, Artificial Sequence
  Synthetic Polynucleotide
taatacgactcactatagggacaatgacaacatcagtcaagatgtctcgaaacagaggagatcgagaatgcttgactgaaacctggcggcagcgcaaaagatg

SEQ ID NO: 96238 - DNA, 103 bp, Artificial Sequence
  Synthetic Polynucleotide
taatacgactcactataggggagggtctctcttcttctttgctggccttgaacagaggagacaaggcatgcaaagaagaaacctggcggcagcgcaaaagatg

SEQ ID NO: 96239 - DNA, 103 bp, Artificial Sequence
  Synthetic Polynucleotide
taatacgactcactatagggatcttccgaggagggtctctcttcttctttaacagaggagaaaagaaatggagagacccaacctggcggcagcgcaaaagatg

SEQ ID NO: 96240 - DNA, 103 bp, Artificial Sequence
  Synthetic Polynucleotide
taatacgactcactataggggggcaatctcatcttccgaggagggtctctaacagaggagaagagacatgcctcggaagaacctggcggcagcgcaaaagatg

SEQ ID NO: 96241 - DNA, 103 bp, Artificial Sequence
  Synthetic Polynucleotide
taatacgactcactatagggtcgaaatgcagggcaatctcatcttccgagaacagaggagactcggaatgtgagattgcaacctggcggcagcgcaaaagatg

SEQ ID NO: 96242 - DNA, 103 bp, Artificial Sequence
  Synthetic Polynucleotide
taatacgactcactatagggattggggggctcgaaatgcagggcaatctcaacagaggagagagattatgctgcatttcaacctggcggcagcgcaaaagatg

SEQ ID NO: 96243 - DNA, 103 bp, Artificial Sequence
  Synthetic Polynucleotide
taatacgactcactatagggtcaggggtgcattggggggctcgaaatgcaaacagaggagatgcattatgagccccccaaacctggcggcagcgcaaaagatg

SEQ ID NO: 96244 - DNA, 103 bp, Artificial Sequence
  Synthetic Polynucleotide
taatacgactcactatagggcccttccggttcaggggtgcattggggggcaacagaggagagcccccatgtgcacccctaacctggcggcagcgcaaaagatg

SEQ ID NO: 96245 - DNA, 103 bp, Artificial Sequence
  Synthetic Polynucleotide
taatacgactcactatagggactaaccagacccttccggttcaggggtgcaacagaggagagcacccatgaaccggaagaacctggcggcagcgcaaaagatg

SEQ ID NO: 96246 - DNA, 103 bp, Artificial Sequence
  Synthetic Polynucleotide
taatacgactcactatagggggctctgtggactaaccagacccttccggtaacagaggagaaccggaatggtctggttaaacctggcggcagcgcaaaagatg

SEQ ID NO: 96247 - DNA, 103 bp, Artificial Sequence
  Synthetic Polynucleotide
taatacgactcactataggggatttctgggggctctgtggactaaccagaaacagaggagatctggtatgtccacagagaacctggcggcagcgcaaaagatg

SEQ ID NO: 96248 - DNA, 103 bp, Artificial Sequence
  Synthetic Polynucleotide
taatacgactcactatagggcgctccctccggggcggcgggggaacccataacagaggagaatgggtatgcccgccgccaacctggcggcagcgcaaaagatg

SEQ ID NO: 96249 - DNA, 103 bp, Artificial Sequence
  Synthetic Polynucleotide
taatacgactcactataggggacgtcagtgaggatcccgcgcaggcgcagaacagaggagactgcgcatgcgcgggatcaacctggcggcagcgcaaaagatg

SEQ ID NO: 96250 - DNA, 103 bp, Artificial Sequence
  Synthetic Polynucleotide
taatacgactcactatagggcttgtagcggaacgaagaccggcacagctgaacagaggagacagctgatgcggtcttcgaacctggcggcagcgcaaaagatg

SEQ ID NO: 96251 - DNA, 103 bp, Artificial Sequence
  Synthetic Polynucleotide
taatacgactcactatagggcaaggttgcccttgtagcggaacgaagaccaacagaggagaggtcttatgtccgctacaaacctggcggcagcgcaaaagatg

SEQ ID NO: 96252 - DNA, 103 bp, Artificial Sequence
  Synthetic Polynucleotide
taatacgactcactatagggcgatgactggcaaggttgcccttgtagcggaacagaggagaccgctaatggggcaacctaacctggcggcagcgcaaaagatg

SEQ ID NO: 96253 - DNA, 103 bp, Artificial Sequence
  Synthetic Polynucleotide
taatacgactcactataggggtgcactgtacgatgactggcaaggttgccaacagaggagaggcaacatggccagtcataacctggcggcagcgcaaaagatg

SEQ ID NO: 96254 - DNA, 103 bp, Artificial Sequence
  Synthetic Polynucleotide
taatacgactcactatagggtttcccctgtgtgcactgtacgatgactggaacagaggagaccagtcatggtacagtgcaacctggcggcagcgcaaaagatg

SEQ ID NO: 96255 - DNA, 103 bp, Artificial Sequence
  Synthetic Polynucleotide
taatacgactcactatagggtggtaaggcttttcccctgtgtgcactgtaaacagaggagatacagtatgcacaggggaaacctggcggcagcgcaaaagatg

SEQ ID NO: 96256 - DNA, 103 bp, Artificial Sequence
  Synthetic Polynucleotide
taatacgactcactataggggattgagcagtggtaaggcttttcccctgtaacagaggagaacagggatgaagccttacaacctggcggcagcgcaaaagatg

SEQ ID NO: 96257 - DNA, 103 bp, Artificial Sequence
  Synthetic Polynucleotide
taatacgactcactataggggggctccgcagattgagcagtggtaaggctaacagaggagaagccttatgactgctcaaaacctggcggcagcgcaaaagatg

SEQ ID NO: 96258 - DNA, 103 bp, Artificial Sequence
  Synthetic Polynucleotide
taatacgactcactatagggcggttaaaacgggctccgcagattgagcagaacagaggagactgctcatgctgcggagcaacctggcggcagcgcaaaagatg

SEQ ID NO: 96259 - DNA, 103 bp, Artificial Sequence
  Synthetic Polynucleotide
taatacgactcactataggggtttgctggccggttaaaacgggctccgcaaacagaggagatgcggaatgcgttttaacaacctggcggcagcgcaaaagatg

SEQ ID NO: 96260 - DNA, 103 bp, Artificial Sequence
  Synthetic Polynucleotide
taatacgactcactatagggccagcagcgtgacgtcagtgaggatcccgcaacagaggagagcgggaatgtcactgacgaacctggcggcagcgcaaaagatg

SEQ ID NO: 96261 - DNA, 103 bp, Artificial Sequence
  Synthetic Polynucleotide
taatacgactcactataggggcgttttcaggtttgctggccggttaaaacaacagaggagagttttaatgggccagcaaaacctggcggcagcgcaaaagatg

SEQ ID NO: 96262 - DNA, 103 bp, Artificial Sequence
  Synthetic Polynucleotide
taatacgactcactatagggatgcggctgtgcgttttcaggtttgctggcaacagaggagagccagcatgcctgaaaacaacctggcggcagcgcaaaagatg

SEQ ID NO: 96263 - DNA, 103 bp, Artificial Sequence
  Synthetic Polynucleotide
taatacgactcactatagggtcccgaatggatgcggctgtgcgttttcagaacagaggagactgaaaatgcacagccgcaacctggcggcagcgcaaaagatg

SEQ ID NO: 96264 - DNA, 103 bp, Artificial Sequence
  Synthetic Polynucleotide
taatacgactcactatagggacggcttctctcccgaatggatgcggctgtaacagaggagaacagccatgtccattcggaacctggcggcagcgcaaaagatg

SEQ ID NO: 96265 - DNA, 103 bp, Artificial Sequence
  Synthetic Polynucleotide
taatacgactcactatagggtcacacttatacggcttctctcccgaatggaacagaggagaccattcatgagagaagccaacctggcggcagcgcaaaagatg

SEQ ID NO: 96266 - DNA, 103 bp, Artificial Sequence
  Synthetic Polynucleotide
taatacgactcactataggggccgcacgtctcacacttatacggcttctcaacagaggagagagaagatgtataagtgtaacctggcggcagcgcaaaagatg

SEQ ID NO: 96267 - DNA, 103 bp, Artificial Sequence
  Synthetic Polynucleotide
taatacgactcactatagggcaaagcgcgagccgcacgtctcacacttataacagaggagaataagtatgagacgtgcgaacctggcggcagcgcaaaagatg

SEQ ID NO: 96268 - DNA, 103 bp, Artificial Sequence
  Synthetic Polynucleotide
taatacgactcactataggggccacctgtacaaagcgcgagccgcacgtcaacagaggagagacgtgatgctcgcgcttaacctggcggcagcgcaaaagatg

SEQ ID NO: 96269 - DNA, 103 bp, Artificial Sequence
  Synthetic Polynucleotide
taatacgactcactatagggccgcagatgtgccacctgtacaaagcgcgaaacagaggagatcgcgcatggtacaggtgaacctggcggcagcgcaaaagatg

SEQ ID NO: 96270 - DNA, 103 bp, Artificial Sequence
  Synthetic Polynucleotide
taatacgactcactataggggcacgtgcgcccgcagatgtgccacctgtaaacagaggagatacaggatgcacatctgcaacctggcggcagcgcaaaagatg

SEQ ID NO: 96271 - DNA, 103 bp, Artificial Sequence
  Synthetic Polynucleotide
taatacgactcactatagggtgcccgccaaccagcagcgtgacgtcagtgaacagaggagacactgaatgcacgctgctaacctggcggcagcgcaaaagatg

SEQ ID NO: 96272 - DNA, 103 bp, Artificial Sequence
  Synthetic Polynucleotide
taatacgactcactataggggtgtggatcagcacgtgcgcccgcagatgtaacagaggagaacatctatgggcgcacgtaacctggcggcagcgcaaaagatg

SEQ ID NO: 96273 - DNA, 103 bp, Artificial Sequence
  Synthetic Polynucleotide
taatacgactcactatagggcttctccccggtgtggatcagcacgtgcgcaacagaggagagcgcacatgctgatccacaacctggcggcagcgcaaaagatg

SEQ ID NO: 96274 - DNA, 103 bp, Artificial Sequence
  Synthetic Polynucleotide
taatacgactcactatagggaagggtagggcttctccccggtgtggatcaaacagaggagatgatccatgccggggagaaacctggcggcagcgcaaaagatg

SEQ ID NO: 96275 - DNA, 103 bp, Artificial Sequence
  Synthetic Polynucleotide
taatacgactcactatagggcaggtagggcaagggtagggcttctccccgaacagaggagacggggaatggccctacccaacctggcggcagcgcaaaagatg

SEQ ID NO: 96276 - DNA, 103 bp, Artificial Sequence
  Synthetic Polynucleotide
taatacgactcactataggggcgggttccgcaggtagggcaagggtagggaacagaggagaccctacatgtgccctaccaacctggcggcagcgcaaaagatg

SEQ ID NO: 96277 - DNA, 103 bp, Artificial Sequence
  Synthetic Polynucleotide
taatacgactcactatagggggtggcggaagcgggttccgcaggtagggcaacagaggagagccctaatggcggaacccaacctggcggcagcgcaaaagatg

SEQ ID NO: 96278 - DNA, 103 bp, Artificial Sequence
  Synthetic Polynucleotide
taatacgactcactatagggagggtctgcaggtggcggaagcgggttccgaacagaggagacggaacatgcttccgccaaacctggcggcagcgcaaaagatg

SEQ ID NO: 96279 - DNA, 103 bp, Artificial Sequence
  Synthetic Polynucleotide
taatacgactcactataggggtggctcttgagggtctgcaggtggcggaaaacagaggagattccgcatgctgcagaccaacctggcggcagcgcaaaagatg

SEQ ID NO: 96280 - DNA, 103 bp, Artificial Sequence
  Synthetic Polynucleotide
taatacgactcactatagggggatgcgaacgtggctcttgagggtctgcaaacagaggagatgcagaatgtcaagagccaacctggcggcagcgcaaaagatg

SEQ ID NO: 96281 - DNA, 103 bp, Artificial Sequence
  Synthetic Polynucleotide
taatacgactcactatagggtctccggtgtggatgcgaacgtggctcttgaacagaggagacaagagatgcgttcgcataacctggcggcagcgcaaaagatg

SEQ ID NO: 96282 - DNA, 103 bp, Artificial Sequence
  Synthetic Polynucleotide
taatacgactcactatagggtctgaggggttgcccgccaaccagcagcgtaacagaggagaacgctgatggttggcgggaacctggcggcagcgcaaaagatg

SEQ ID NO: 96283 - DNA, 103 bp, Artificial Sequence
  Synthetic Polynucleotide
taatacgactcactataggggtaaggcttctctccggtgtggatgcgaacaacagaggagagttcgcatgcacaccggaaacctggcggcagcgcaaaagatg

SEQ ID NO: 96284 - DNA, 103 bp, Artificial Sequence
  Synthetic Polynucleotide
taatacgactcactatagggggtcgcagtggtaaggcttctctccggtgtaacagaggagaacaccgatgagaagccttaacctggcggcagcgcaaaagatg

SEQ ID NO: 96285 - DNA, 103 bp, Artificial Sequence
  Synthetic Polynucleotide
taatacgactcactatagggaggccacaggggtcgcagtggtaaggcttcaacagaggagagaagccatgccactgcgaaacctggcggcagcgcaaaagatg

SEQ ID NO: 96286 - DNA, 103 bp, Artificial Sequence
  Synthetic Polynucleotide
taatacgactcactatagggccggaaatgcaggccacaggggtcgcagtgaacagaggagacactgcatgccctgtggcaacctggcggcagcgcaaaagatg

SEQ ID NO: 96287 - DNA, 103 bp, Artificial Sequence
  Synthetic Polynucleotide
taatacgactcactataggggactcttgtgccggaaatgcaggccacaggaacagaggagacctgtgatgtgcatttccaacctggcggcagcgcaaaagatg

SEQ ID NO: 96288 - DNA, 103 bp, Artificial Sequence
  Synthetic Polynucleotide
taatacgactcactatagggagccgcagttgactcttgtgccggaaatgcaacagaggagagcatttatggcacaagagaacctggcggcagcgcaaaagatg

SEQ ID NO: 96289 - DNA, 103 bp, Artificial Sequence
  Synthetic Polynucleotide
taatacgactcactataggggcgcagatgcagccgcagttgactcttgtgaacagaggagacacaagatgcaactgcggaacctggcggcagcgcaaaagatg

SEQ ID NO: 96290 - DNA, 103 bp, Artificial Sequence
  Synthetic Polynucleotide
taatacgactcactatagggcgtgtttctggcgcagatgcagccgcagttaacagaggagaaactgcatgtgcatctgcaacctggcggcagcgcaaaagatg

SEQ ID NO: 96291 - DNA, 103 bp, Artificial Sequence
  Synthetic Polynucleotide
taatacgactcactataggggtagcagctccgtgtttctggcgcagatgcaacagaggagagcatctatgccagaaacaaacctggcggcagcgcaaaagatg

SEQ ID NO: 96292 - DNA, 103 bp, Artificial Sequence
  Synthetic Polynucleotide
taatacgactcactatagggtttggtgttggtagcagctccgtgtttctgaacagaggagacagaaaatgggagctgctaacctggcggcagcgcaaaagatg

SEQ ID NO: 96293 - DNA, 103 bp, Artificial Sequence
  Synthetic Polynucleotide
taatacgactcactatagggccttgtgtgctctgaggggttgcccgccaaaacagaggagattggcgatgaacccctcaaacctggcggcagcgcaaaagatg

SEQ ID NO: 96294 - DNA, 103 bp, Artificial Sequence
  Synthetic Polynucleotide
taatacgactcactatagggggtagtgcactttggtgttggtagcagctcaacagaggagagagctgatgccaacaccaaacctggcggcagcgcaaaagatg

SEQ ID NO: 96295 - DNA, 103 bp, Artificial Sequence
  Synthetic Polynucleotide
taatacgactcactatagggccgagaatgtggtagtgcactttggtgttgaacagaggagacaacacatgagtgcactaaacctggcggcagcgcaaaagatg

SEQ ID NO: 96296 - DNA, 103 bp, Artificial Sequence
  Synthetic Polynucleotide
taatacgactcactatagggctagggccccccgagaatgtggtagtgcacaacagaggagagtgcacatgcacattctcaacctggcggcagcgcaaaagatg

SEQ ID NO: 96297 - DNA, 103 bp, Artificial Sequence
  Synthetic Polynucleotide
taatacgactcactatagggatgagaactgccttgtgtgctctgaggggtaacagaggagaacccctatgagcacacaaaacctggcggcagcgcaaaagatg

SEQ ID NO: 96298 - DNA, 103 bp, Artificial Sequence
  Synthetic Polynucleotide
taatacgactcactatagggactgcaggcgatgagaactgccttgtgtgcaacagaggagagcacacatggcagttctcaacctggcggcagcgcaaaagatg

SEQ ID NO: 96299 - DNA, 103 bp, Artificial Sequence
  Synthetic Polynucleotide
taatacgactcactatagggagaagaagccactgcaggcgatgagaactgaacagaggagacagttcatgtcgcctgcaaacctggcggcagcgcaaaagatg

SEQ ID NO: 96300 - DNA, 103 bp, Artificial Sequence
  Synthetic Polynucleotide
taatacgactcactatagggaaaattgaatagaagaagccactgcaggcgaacagaggagacgcctgatgtggcttcttaacctggcggcagcgcaaaagatg

SEQ ID NO: 96301 - DNA, 103 bp, Artificial Sequence
  Synthetic Polynucleotide
taatacgactcactatagggacggccccggaaaattgaatagaagaagccaacagaggagaggcttcatgtattcaattaacctggcggcagcgcaaaagatg

SEQ ID NO: 96302 - DNA, 103 bp, Artificial Sequence
  Synthetic Polynucleotide
taatacgactcactatagggcgtagcccagcgctccctccggggcggcggaacagaggagaccgccgatgcggagggagaacctggcggcagcgcaaaagatg

SEQ ID NO: 96303 - DNA, 103 bp, Artificial Sequence
  Synthetic Polynucleotide
taatacgactcactatagggcgactcccgcacggccccggaaaattgaataacagaggagaattcaaatgtccggggccaacctggcggcagcgcaaaagatg

SEQ ID NO: 96304 - DNA, 103 bp, Artificial Sequence
  Synthetic Polynucleotide
taatacgactcactatagggacgtccaccccgactcccgcacggccccggaacagaggagaccggggatgtgcgggagtaacctggcggcagcgcaaaagatg

SEQ ID NO: 96305 - DNA, 103 bp, Artificial Sequence
  Synthetic Polynucleotide
taatacgactcactatagggcagagagagcacgtccaccccgactcccgcaacagaggagagcgggaatgggggtggacaacctggcggcagcgcaaaagatg

SEQ ID NO: 96306 - DNA, 103 bp, Artificial Sequence
  Synthetic Polynucleotide
taatacgactcactataggggacccccgggcagagagagcacgtccacccaacagaggagagggtggatgtgctctctcaacctggcggcagcgcaaaagatg

SEQ ID NO: 96307 - DNA, 103 bp, Artificial Sequence
  Synthetic Polynucleotide
taatacgactcactatagggctcgcttcgggacccccgggcagagagagcaacagaggagagctctcatggcccgggggaacctggcggcagcgcaaaagatg

SEQ ID NO: 96308 - DNA, 103 bp, Artificial Sequence
  Synthetic Polynucleotide
taatacgactcactatagggggcgaagcctctcgcttcgggacccccgggaacagaggagacccgggatgcccgaagcgaacctggcggcagcgcaaaagatg

SEQ ID NO: 96309 - DNA, 103 bp, Artificial Sequence
  Synthetic Polynucleotide
taatacgactcactatagggccaatagaggggcgaagcctctcgcttcggaacagaggagaccgaagatggaggcttcgaacctggcggcagcgcaaaagatg

SEQ ID NO: 96310 - DNA, 103 bp, Artificial Sequence
  Synthetic Polynucleotide
taatacgactcactatagggtacatgaagtccaatagaggggcgaagcctaacagaggagaaggcttatgccctctattaacctggcggcagcgcaaaagatg

SEQ ID NO: 96311 - DNA, 103 bp, Artificial Sequence
  Synthetic Polynucleotide
taatacgactcactataggggcgcgaagtgtacatgaagtccaatagaggaacagaggagacctctaatggacttcatgaacctggcggcagcgcaaaagatg

SEQ ID NO: 96312 - DNA, 103 bp, Artificial Sequence
  Synthetic Polynucleotide
taatacgactcactatagggagaggcgcaggcgcgaagtgtacatgaagtaacagaggagaacttcaatgacacttcgcaacctggcggcagcgcaaaagatg

SEQ ID NO: 96313 - DNA, 103 bp, Artificial Sequence
  Synthetic Polynucleotide
taatacgactcactatagggaactcgcggacgtagcccagcgctccctccaacagaggagaggagggatggctgggctaaacctggcggcagcgcaaaagatg

SEQ ID NO: 96314 - DNA, 103 bp, Artificial Sequence
  Synthetic Polynucleotide
taatacgactcactataggggtggctggagagaggcgcaggcgcgaagtgaacagaggagacacttcatgcctgcgcctaacctggcggcagcgcaaaagatg

SEQ ID NO: 96315 - DNA, 103 bp, Artificial Sequence
  Synthetic Polynucleotide
taatacgactcactatagggtgctggtgcagtggctggagagaggcgcagaacagaggagactgcgcatgtctccagccaacctggcggcagcgcaaaagatg

SEQ ID NO: 96316 - DNA, 103 bp, Artificial Sequence
  Synthetic Polynucleotide
taatacgactcactatagggccgctaggactgctggtgcagtggctggagaacagaggagactccagatgctgcaccagaacctggcggcagcgcaaaagatg

SEQ ID NO: 96317 - DNA, 103 bp, Artificial Sequence
  Synthetic Polynucleotide
taatacgactcactatagggtaggtggcggccgctaggactgctggtgcaaacagaggagatgcaccatgagtcctagcaacctggcggcagcgcaaaagatg

SEQ ID NO: 96318 - DNA, 103 bp, Artificial Sequence
  Synthetic Polynucleotide
taatacgactcactatagggcatctgcaaataggtggcggccgctaggacaacagaggagagtcctaatggccgccaccaacctggcggcagcgcaaaagatg

SEQ ID NO: 96319 - DNA, 103 bp, Artificial Sequence
  Synthetic Polynucleotide
taatacgactcactatagggccacgtgctccatctgcaaataggtggcggaacagaggagaccgccaatgatttgcagaaacctggcggcagcgcaaaagatg

SEQ ID NO: 96320 - DNA, 103 bp, Artificial Sequence
  Synthetic Polynucleotide
taatacgactcactatagggcatgcctggaccacgtgctccatctgcaaaaacagaggagatttgcaatgggagcacgtaacctggcggcagcgcaaaagatg

SEQ ID NO: 96321 - DNA, 103 bp, Artificial Sequence
  Synthetic Polynucleotide
taatacgactcactataggggaagcggtggcatgcctggaccacgtgctcaacagaggagagagcacatggtccaggcaaacctggcggcagcgcaaaagatg

SEQ ID NO: 96322 - DNA, 103 bp, Artificial Sequence
  Synthetic Polynucleotide
taatacgactcactatagggtggcctggatgaagcggtggcatgcctggaaacagaggagatccaggatggccaccgctaacctggcggcagcgcaaaagatg

SEQ ID NO: 96323 - DNA, 103 bp, Artificial Sequence
  Synthetic Polynucleotide
taatacgactcactatagggggttcatagctggcctggatgaagcggtggaacagaggagaccaccgatgcatccaggcaacctggcggcagcgcaaaagatg

SEQ ID NO: 96324 - DNA, 103 bp, Artificial Sequence
  Synthetic Polynucleotide
taatacgactcactataggggtggcgagtgaactcgcggacgtagcccagaacagaggagactgggcatggtccgcgagaacctggcggcagcgcaaaagatg

SEQ ID NO: 96325 - DNA, 103 bp, Artificial Sequence
  Synthetic Polynucleotide
taatacgactcactataggggatgcccagaggttcatagctggcctggataacagaggagaatccagatgagctatgaaaacctggcggcagcgcaaaagatg

SEQ ID NO: 96326 - DNA, 103 bp, Artificial Sequence
  Synthetic Polynucleotide
taatacgactcactatagggggcgcagggagatgcccagaggttcatagcaacagaggagagctatgatgctctgggcaaacctggcggcagcgcaaaagatg

SEQ ID NO: 96327 - DNA, 103 bp, Artificial Sequence
  Synthetic Polynucleotide
taatacgactcactataggggcttccagggggcgcagggagatgcccagaaacagaggagatctgggatgctccctgcgaacctggcggcagcgcaaaagatg

SEQ ID NO: 96328 - DNA, 103 bp, Artificial Sequence
  Synthetic Polynucleotide
taatacgactcactatagggtgggggttctgcttccagggggcgcagggaaacagaggagatccctgatgcccctggaaaacctggcggcagcgcaaaagatg

SEQ ID NO: 96329 - DNA, 103 bp, Artificial Sequence
  Synthetic Polynucleotide
taatacgactcactatagggttgggggtgttgggggttctgcttccagggaacagaggagaccctggatgcagaaccccaacctggcggcagcgcaaaagatg

SEQ ID NO: 96330 - DNA, 103 bp, Artificial Sequence
  Synthetic Polynucleotide
taatacgactcactatagggggaggggccgttgggggtgttgggggttctaacagaggagaagaaccatgaacacccccaacctggcggcagcgcaaaagatg

SEQ ID NO: 96331 - DNA, 103 bp, Artificial Sequence
  Synthetic Polynucleotide
taatacgactcactatagggactacctggtggaggggccgttgggggtgtaacagaggagaacacccatgacggcccctaacctggcggcagcgcaaaagatg

SEQ ID NO: 96332 - DNA, 103 bp, Artificial Sequence
  Synthetic Polynucleotide
taatacgactcactatagggagcgcctgggactacctggtggaggggccgaacagaggagacggcccatgcaccaggtaaacctggcggcagcgcaaaagatg

SEQ ID NO: 96333 - DNA, 103 bp, Artificial Sequence
  Synthetic Polynucleotide
taatacgactcactatagggtgtccttcggagcgcctgggactacctggtaacagaggagaaccaggatgtcccaggcgaacctggcggcagcgcaaaagatg

SEQ ID NO: 96334 - DNA, 103 bp, Artificial Sequence
  Synthetic Polynucleotide
taatacgactcactatagggtgggtctgggtgtccttcggagcgcctgggaacagaggagacccaggatgtccgaaggaaacctggcggcagcgcaaaagatg

SEQ ID NO: 96335 - DNA, 103 bp, Artificial Sequence
  Synthetic Polynucleotide
taatacgactcactatagggcgtcggaggagtggcgagtgaactcgcggaaacagaggagatccgcgatgtcactcgccaacctggcggcagcgcaaaagatg

SEQ ID NO: 96336 - DNA, 103 bp, Artificial Sequence
  Synthetic Polynucleotide
taatacgactcactatagggattcagtaggtgggtctgggtgtccttcggaacagaggagaccgaagatgacccagaccaacctggcggcagcgcaaaagatg

SEQ ID NO: 96337 - DNA, 103 bp, Artificial Sequence
  Synthetic Polynucleotide
taatacgactcactatagggcagcttcgagattcagtaggtgggtctgggaacagaggagacccagaatgacctactgaaacctggcggcagcgcaaaagatg

SEQ ID NO: 96338 - DNA, 103 bp, Artificial Sequence
  Synthetic Polynucleotide
taatacgactcactataggggccttgactgcagcttcgagattcagtaggaacagaggagacctactatgtctcgaagcaacctggcggcagcgcaaaagatg

SEQ ID NO: 96339 - DNA, 103 bp, Artificial Sequence
  Synthetic Polynucleotide
taatacgactcactataggggactgggggggccttgactgcagcttcgagaacagaggagactcgaaatggcagtcaagaacctggcggcagcgcaaaagatg

SEQ ID NO: 96340 - DNA, 103 bp, Artificial Sequence
  Synthetic Polynucleotide
taatacgactcactataggggggctggctggactgggggggccttgactgaacagaggagacagtcaatgcccccccagaacctggcggcagcgcaaaagatg

SEQ ID NO: 96341 - DNA, 103 bp, Artificial Sequence
  Synthetic Polynucleotide
taatacgactcactatagggcttggggtcagggctggctggactggggggaacagaggagaccccccatgccagccagcaacctggcggcagcgcaaaagatg

SEQ ID NO: 96342 - DNA, 103 bp, Artificial Sequence
  Synthetic Polynucleotide
taatacgactcactatagggagttgcaggccttggggtcagggctggctgaacagaggagacagccaatgctgaccccaaacctggcggcagcgcaaaagatg

SEQ ID NO: 96343 - DNA, 103 bp, Artificial Sequence
  Synthetic Polynucleotide
taatacgactcactatagggtactttttccagttgcaggccttggggtcaaacagaggagatgacccatgggcctgcaaaacctggcggcagcgcaaaagatg

SEQ ID NO: 96344 - DNA, 103 bp, Artificial Sequence
  Synthetic Polynucleotide
taatacgactcactataggggatgtacttgtactttttccagttgcaggcaacagaggagagcctgcatgtggaaaaagaacctggcggcagcgcaaaagatg

SEQ ID NO: 96345 - DNA, 103 bp, Artificial Sequence
  Synthetic Polynucleotide
taatacgactcactatagggagtttagcacgatgtacttgtactttttccaacagaggagaggaaaaatgacaagtacaaacctggcggcagcgcaaaagatg

SEQ ID NO: 96346 - DNA, 103 bp, Artificial Sequence
  Synthetic Polynucleotide
taatacgactcactatagggttgcccagcacgtcggaggagtggcgagtgaacagaggagacactcgatgctcctccgaaacctggcggcagcgcaaaagatg

SEQ ID NO: 96347 - DNA, 103 bp, Artificial Sequence
  Synthetic Polynucleotide
taatacgactcactataggggaggcctgagagtttagcacgatgtacttgaacagaggagacaagtaatgcgtgctaaaaacctggcggcagcgcaaaagatg

SEQ ID NO: 96348 - DNA, 103 bp, Artificial Sequence
  Synthetic Polynucleotide
taatacgactcactatagggccctgcttgggaggcctgagagtttagcacaacagaggagagtgctaatgtctcaggccaacctggcggcagcgcaaaagatg

SEQ ID NO: 96349 - DNA, 103 bp, Artificial Sequence
  Synthetic Polynucleotide
taatacgactcactatagggcgaccaggctccctgcttgggaggcctgagaacagaggagactcaggatgcccaagcagaacctggcggcagcgcaaaagatg

SEQ ID NO: 96350 - DNA, 103 bp, Artificial Sequence
  Synthetic Polynucleotide
taatacgactcactatagggcttctctccccgaccaggctccctgcttggaacagaggagaccaagcatggagcctggtaacctggcggcagcgcaaaagatg

SEQ ID NO: 96351 - DNA, 103 bp, Artificial Sequence
  Synthetic Polynucleotide
taatacgactcactatagggttgaccagaacttctctccccgaccaggctaacagaggagaagcctgatgggggagagaaacctggcggcagcgcaaaagatg

SEQ ID NO: 96352 - DNA, 103 bp, Artificial Sequence
  Synthetic Polynucleotide
taatacgactcactataggggggggcaaggttgaccagaacttctctcccaacagaggagagggagaatggttctggtcaacctggcggcagcgcaaaagatg

SEQ ID NO: 96353 - DNA, 103 bp, Artificial Sequence
  Synthetic Polynucleotide
taatacgactcactatagggagcctggcttgggggcaaggttgaccagaaaacagaggagattctggatgaccttgcccaacctggcggcagcgcaaaagatg

SEQ ID NO: 96354 - DNA, 103 bp, Artificial Sequence
  Synthetic Polynucleotide
taatacgactcactatagggtccactggggagcctggcttgggggcaaggaacagaggagaccttgcatgcaagccaggaacctggcggcagcgcaaaagatg

SEQ ID NO: 96355 - DNA, 103 bp, Artificial Sequence
  Synthetic Polynucleotide
taatacgactcactatagggaggcctcgtctccactggggagcctggcttaacagaggagaaagccaatgtccccagtgaacctggcggcagcgcaaaagatg

SEQ ID NO: 96356 - DNA, 103 bp, Artificial Sequence
  Synthetic Polynucleotide
taatacgactcactatagggctgctgctggaggcctcgtctccactggggaacagaggagaccccagatgagacgaggcaacctggcggcagcgcaaaagatg

SEQ ID NO: 96357 - DNA, 103 bp, Artificial Sequence
  Synthetic Polynucleotide
taatacgactcactatagggctcgttgaggttgcccagcacgtcggaggaaacagaggagatcctccatggtgctgggcaacctggcggcagcgcaaaagatg

SEQ ID NO: 96358 - DNA, 103 bp, Artificial Sequence
  Synthetic Polynucleotide
taatacgactcactataggggctgctgctgctgctgctggaggcctcgtcaacagaggagagacgagatgtccagcagcaacctggcggcagcgcaaaagatg

SEQ ID NO: 96359 - DNA, 103 bp, Artificial Sequence
  Synthetic Polynucleotide
taatacgactcactatagggtgctgctgctgctgctgctgctgctgctggaacagaggagaccagcaatggcagcagcaaacctggcggcagcgcaaaagatg

SEQ ID NO: 96360 - DNA, 103 bp, Artificial Sequence
  Synthetic Polynucleotide
taatacgactcactatagggccttcttcactgctgctgctgctgctgctgaacagaggagacagcagatgcagcagcagaacctggcggcagcgcaaaagatg

SEQ ID NO: 96361 - DNA, 103 bp, Artificial Sequence
  Synthetic Polynucleotide
taatacgactcactatagggaggaatgggtccttcttcactgctgctgctaacagaggagaagcagcatgagtgaagaaaacctggcggcagcgcaaaagatg

SEQ ID NO: 96362 - DNA, 103 bp, Artificial Sequence
  Synthetic Polynucleotide
taatacgactcactatagggtctggggaccaggaatgggtccttcttcacaacagaggagagtgaagatggacccattcaacctggcggcagcgcaaaagatg

SEQ ID NO: 96363 - DNA, 103 bp, Artificial Sequence
  Synthetic Polynucleotide
taatacgactcactataggggagagcctgctctggggaccaggaatgggtaacagaggagaacccatatgtggtccccaaacctggcggcagcgcaaaagatg

SEQ ID NO: 96364 - DNA, 103 bp, Artificial Sequence
  Synthetic Polynucleotide
taatacgactcactatagggagcagttggagagagcctgctctggggaccaacagaggagaggtcccatgagcaggctcaacctggcggcagcgcaaaagatg

SEQ ID NO: 96365 - DNA, 103 bp, Artificial Sequence
  Synthetic Polynucleotide
taatacgactcactataggggcacagtggcagcagttggagagagcctgcaacagaggagagcaggcatgctccaactgaacctggcggcagcgcaaaagatg

SEQ ID NO: 96366 - DNA, 103 bp, Artificial Sequence
  Synthetic Polynucleotide
taatacgactcactatagggcatttgaactgcacagtggcagcagttggaaacagaggagatccaacatgtgccactgtaacctggcggcagcgcaaaagatg

SEQ ID NO: 96367 - DNA, 103 bp, Artificial Sequence
  Synthetic Polynucleotide
taatacgactcactatagggtggagccccacatttgaactgcacagtggcaacagaggagagccactatgcagttcaaaaacctggcggcagcgcaaaagatg

SEQ ID NO: 96368 - DNA, 103 bp, Artificial Sequence
  Synthetic Polynucleotide
taatacgactcactataggggcaggcgcagctcgttgaggttgcccagcaaacagaggagatgctggatgacctcaacgaacctggcggcagcgcaaaagatg

SEQ ID NO: 96369 - DNA, 103 bp, Artificial Sequence
  Synthetic Polynucleotide
taatacgactcactataggggggtactggctggagccccacatttgaactaacagaggagaagttcaatggtggggctcaacctggcggcagcgcaaaagatg

SEQ ID NO: 96370 - DNA, 103 bp, Artificial Sequence
  Synthetic Polynucleotide
taatacgactcactatagggaggaggtagggggtactggctggagccccaaacagaggagatggggcatgagccagtacaacctggcggcagcgcaaaagatg

SEQ ID NO: 96371 - DNA, 103 bp, Artificial Sequence
  Synthetic Polynucleotide
taatacgactcactatagggctgggatgtgaggaggtagggggtactggcaacagaggagagccagtatgccctacctcaacctggcggcagcgcaaaagatg

SEQ ID NO: 96372 - DNA, 103 bp, Artificial Sequence
  Synthetic Polynucleotide
taatacgactcactatagggtgtcttgagcctgggatgtgaggaggtaggaacagaggagacctaccatgtcacatcccaacctggcggcagcgcaaaagatg

SEQ ID NO: 96373 - DNA, 103 bp, Artificial Sequence
  Synthetic Polynucleotide
taatacgactcactataggggatccagaggtgtcttgagcctgggatgtgaacagaggagacacatcatgggctcaagaaacctggcggcagcgcaaaagatg

SEQ ID NO: 96374 - DNA, 103 bp, Artificial Sequence
  Synthetic Polynucleotide
taatacgactcactatagggttcagagggtgatccagaggtgtcttgagcaacagaggagagctcaaatgacctctggaaacctggcggcagcgcaaaagatg

SEQ ID NO: 96375 - DNA, 103 bp, Artificial Sequence
  Synthetic Polynucleotide
taatacgactcactataggggacgagcccgttcagagggtgatccagaggaacagaggagacctctgatgcaccctctgaacctggcggcagcgcaaaagatg

SEQ ID NO: 96376 - DNA, 103 bp, Artificial Sequence
  Synthetic Polynucleotide
taatacgactcactatagggcccggtagtggacgagcccgttcagagggtaacagaggagaaccctcatgacgggctcgaacctggcggcagcgcaaaagatg

SEQ ID NO: 96377 - DNA, 103 bp, Artificial Sequence
  Synthetic Polynucleotide
taatacgactcactatagggaaattcacttcccggtagtggacgagcccgaacagaggagacgggctatgccactaccgaacctggcggcagcgcaaaagatg

SEQ ID NO: 96378 - DNA, 103 bp, Artificial Sequence
  Synthetic Polynucleotide
taatacgactcactatagggggcagctgaaaaattcacttcccggtagtgaacagaggagacactacatggaagtgaataacctggcggcagcgcaaaagatg

SEQ ID NO: 96379 - DNA, 103 bp, Artificial Sequence
  Synthetic Polynucleotide
taatacgactcactatagggaggatcccgcgcaggcgcagctcgttgaggaacagaggagacctcaaatggctgcgcctaacctggcggcagcgcaaaagatg

SEQ ID NO: 96380 - DNA, 103 bp, Artificial Sequence
  Synthetic Polynucleotide
taatacgactcactatagggtcacagttctggcagctgaaaaattcacttaacagaggagaaagtgaatgtttcagctgaacctggcggcagcgcaaaagatg

SEQ ID NO: 96381 - DNA, 103 bp, Artificial Sequence
  Synthetic Polynucleotide
taatacgactcactatagggtgccacagcctcacagttctggcagctgaaaacagaggagattcagcatgcagaactgtaacctggcggcagcgcaaaagatg

SEQ ID NO: 96382 - DNA, 103 bp, Artificial Sequence
  Synthetic Polynucleotide
taatacgactcactatagggatgagcaccctgccacagcctcacagttctaacagaggagaagaactatgaggctgtggaacctggcggcagcgcaaaagatg

SEQ ID NO: 96383 - DNA, 103 bp, Artificial Sequence
  Synthetic Polynucleotide
taatacgactcactatagggtccagccccgatgagcaccctgccacagccaacagaggagaggctgtatgagggtgctcaacctggcggcagcgcaaaagatg

SEQ ID NO: 96384 - DNA, 103 bp, Artificial Sequence
  Synthetic Polynucleotide
taatacgactcactatagggaaccaaggagtccagccccgatgagcacccaacagaggagagggtgcatgtcggggctgaacctggcggcagcgcaaaagatg

SEQ ID NO: 96385 - DNA, 103 bp, Artificial Sequence
  Synthetic Polynucleotide
taatacgactcactatagggcgtccccaggaaccaaggagtccagccccgaacagaggagacggggcatgactccttggaacctggcggcagcgcaaaagatg

SEQ ID NO: 96386 - DNA, 103 bp, Artificial Sequence
  Synthetic Polynucleotide
taatacgactcactatagggggtttgtcttcgtccccaggaaccaaggagaacagaggagactccttatgtcctggggaaacctggcggcagcgcaaaagatg

SEQ ID NO: 96387 - DNA, 103 bp, Artificial Sequence
  Synthetic Polynucleotide
taatacgactcactatagggacacttatagggtttgtcttcgtccccaggaacagaggagacctgggatggaagacaaaaacctggcggcagcgcaaaagatg

SEQ ID NO: 96388 - DNA, 103 bp, Artificial Sequence
  Synthetic Polynucleotide
taatacgactcactatagggggcacagctgacacttatagggtttgtcttaacagaggagaaagacaatgcctataagtaacctggcggcagcgcaaaagatg

SEQ ID NO: 96389 - DNA, 103 bp, Artificial Sequence
  Synthetic Polynucleotide
taatacgactcactatagggaacgaagaccggcacagctgacacttatagaacagaggagactataaatgtcagctgtgaacctggcggcagcgcaaaagatg

SEQ ID NO: 96390 - DNA, 103 bp, Artificial Sequence
  Synthetic Polynucleotide
taatacgactcactataggggttcccatacaggggggttgctgagagcataacagaggagaatgctcatggcaacccccaacctggcggcagcgcaaaagatg

SEQ ID NO: 96391 - DNA, 103 bp, Artificial Sequence
  Synthetic Polynucleotide
taatacgactcactatagggttttgaagcgtcaccatcatttacaaggataacagaggagaatccttatgaatgatggtaacctggcggcagcgcaaaagatg

SEQ ID NO: 96392 - DNA, 103 bp, Artificial Sequence
  Synthetic Polynucleotide
taatacgactcactatagggtgacggccgaggcgaggggggcaacaggagaacagaggagactcctgatgcccccctcgaacctggcggcagcgcaaaagatg

SEQ ID NO: 96393 - DNA, 103 bp, Artificial Sequence
  Synthetic Polynucleotide
taatacgactcactatagggggactcggggtgacggccgaggcgagggggaacagaggagaccccctatgctcggccgtaacctggcggcagcgcaaaagatg

SEQ ID NO: 96394 - DNA, 103 bp, Artificial Sequence
  Synthetic Polynucleotide
taatacgactcactataggggtgggaaggtggactcggggtgacggccgaaacagaggagatcggccatgaccccgagtaacctggcggcagcgcaaaagatg

SEQ ID NO: 96395 - DNA, 103 bp, Artificial Sequence
  Synthetic Polynucleotide
taatacgactcactatagggagcaggctgggtgggaaggtggactcggggaacagaggagaccccgaatgcaccttcccaacctggcggcagcgcaaaagatg

SEQ ID NO: 96396 - DNA, 103 bp, Artificial Sequence
  Synthetic Polynucleotide
taatacgactcactatagggaggtgtctgcagcaggctgggtgggaaggtaacagaggagaaccttcatgcccagcctgaacctggcggcagcgcaaaagatg

SEQ ID NO: 96397 - DNA, 103 bp, Artificial Sequence
  Synthetic Polynucleotide
taatacgactcactatagggaactccgagtaggtgtctgcagcaggctggaacagaggagaccagccatgtgcagacacaacctggcggcagcgcaaaagatg

SEQ ID NO: 96398 - DNA, 103 bp, Artificial Sequence
  Synthetic Polynucleotide
taatacgactcactataggggtgcttgtggaactccgagtaggtgtctgcaacagaggagagcagacatgtactcggagaacctggcggcagcgcaaaagatg

SEQ ID NO: 96399 - DNA, 103 bp, Artificial Sequence
  Synthetic Polynucleotide
taatacgactcactatagggtcctggcatagtgcttgtggaactccgagtaacagaggagaactcggatgtccacaagcaacctggcggcagcgcaaaagatg

SEQ ID NO: 96400 - DNA, 103 bp, Artificial Sequence
  Synthetic Polynucleotide
taatacgactcactataggggaggtggagatcctggcatagtgcttgtggaacagaggagaccacaaatgctatgccagaacctggcggcagcgcaaaagatg

SEQ ID NO: 96401 - DNA, 103 bp, Artificial Sequence
  Synthetic Polynucleotide
taatacgactcactatagggaactgaaggagaggtggagatcctggcataaacagaggagatatgccatgatctccaccaacctggcggcagcgcaaaagatg

SEQ ID NO: 96402 - DNA, 103 bp, Artificial Sequence
  Synthetic Polynucleotide
taatacgactcactatagggccagtctggcttttgaagcgtcaccatcataacagaggagaatgatgatgacgcttcaaaacctggcggcagcgcaaaagatg

SEQ ID NO: 96403 - DNA, 103 bp, Artificial Sequence
  Synthetic Polynucleotide
taatacgactcactatagggttgacagggcaactgaaggagaggtggagaaacagaggagatctccaatgctccttcagaacctggcggcagcgcaaaagatg

SEQ ID NO: 96404 - DNA, 103 bp, Artificial Sequence
  Synthetic Polynucleotide
taatacgactcactatagggatgtatggctttgacagggcaactgaaggaaacagaggagatccttcatgtgccctgtcaacctggcggcagcgcaaaagatg

SEQ ID NO: 96405 - DNA, 103 bp, Artificial Sequence
  Synthetic Polynucleotide
taatacgactcactataggggctaactgtcatgtatggctttgacagggcaacagaggagagccctgatgaagccatacaacctggcggcagcgcaaaagatg

SEQ ID NO: 96406 - DNA, 103 bp, Artificial Sequence
  Synthetic Polynucleotide
taatacgactcactatagggggaactcgctgctaactgtcatgtatggctaacagaggagaagccatatgtgacagttaaacctggcggcagcgcaaaagatg

SEQ ID NO: 96407 - DNA, 103 bp, Artificial Sequence
  Synthetic Polynucleotide
taatacgactcactatagggctggccgcggggaactcgctgctaactgtcaacagaggagagacagtatgcagcgagttaacctggcggcagcgcaaaagatg

SEQ ID NO: 96408 - DNA, 103 bp, Artificial Sequence
  Synthetic Polynucleotide
taatacgactcactatagggattggagagcctggccgcggggaactcgctaacagaggagaagcgagatgcccgcggccaacctggcggcagcgcaaaagatg

SEQ ID NO: 96409 - DNA, 103 bp, Artificial Sequence
  Synthetic Polynucleotide
taatacgactcactataggggatacttgccattggagagcctggccgcggaacagaggagaccgcggatgggctctccaaacctggcggcagcgcaaaagatg

SEQ ID NO: 96410 - DNA, 103 bp, Artificial Sequence
  Synthetic Polynucleotide
taatacgactcactatagggggagccttgggatacttgccattggagagcaacagaggagagctctcatgtggcaagtaaacctggcggcagcgcaaaagatg

SEQ ID NO: 96411 - DNA, 103 bp, Artificial Sequence
  Synthetic Polynucleotide
taatacgactcactataggggcccccttccggagccttgggatacttgccaacagaggagaggcaagatgcccaaggctaacctggcggcagcgcaaaagatg

SEQ ID NO: 96412 - DNA, 103 bp, Artificial Sequence
  Synthetic Polynucleotide
taatacgactcactataggggggcaccttcgcccccttccggagccttggaacagaggagaccaaggatgcggaaggggaacctggcggcagcgcaaaagatg

SEQ ID NO: 96413 - DNA, 103 bp, Artificial Sequence
  Synthetic Polynucleotide
taatacgactcactatagggtccctcagttccagtctggcttttgaagcgaacagaggagacgcttcatgagccagactaacctggcggcagcgcaaaagatg

SEQ ID NO: 96414 - DNA, 103 bp, Artificial Sequence
  Synthetic Polynucleotide
taatacgactcactatagggggcactggctgggcaccttcgcccccttccaacagaggagaggaaggatgcgaaggtgcaacctggcggcagcgcaaaagatg

SEQ ID NO: 96415 - DNA, 103 bp, Artificial Sequence
  Synthetic Polynucleotide
taatacgactcactatagggggcatgcccgggcactggctgggcaccttcaacagaggagagaaggtatgcagccagtgaacctggcggcagcgcaaaagatg

SEQ ID NO: 96416 - DNA, 103 bp, Artificial Sequence
  Synthetic Polynucleotide
taatacgactcactatagggctgtcttccgggcatgcccgggcactggctaacagaggagaagccagatgccgggcatgaacctggcggcagcgcaaaagatg

SEQ ID NO: 96417 - DNA, 103 bp, Artificial Sequence
  Synthetic Polynucleotide
taatacgactcactatagggtcttgaaccgctgtcttccgggcatgcccgaacagaggagacgggcaatgccggaagacaacctggcggcagcgcaaaagatg

SEQ ID NO: 96418 - DNA, 103 bp, Artificial Sequence
  Synthetic Polynucleotide
taatacgactcactatagggatcttttctgtcttgaaccgctgtcttccgaacagaggagacggaagatggcggttcaaaacctggcggcagcgcaaaagatg

SEQ ID NO: 96419 - DNA, 103 bp, Artificial Sequence
  Synthetic Polynucleotide
taatacgactcactataggggtgagctgccatcttttctgtcttgaaccgaacagaggagacggttcatgacagaaaagaacctggcggcagcgcaaaagatg

SEQ ID NO: 96420 - DNA, 103 bp, Artificial Sequence
  Synthetic Polynucleotide
taatacgactcactatagggaacagaggaggtgagctgccatcttttctgaacagaggagacagaaaatgtggcagctcaacctggcggcagcgcaaaagatg

SEQ ID NO: 96421 - DNA, 103 bp, Artificial Sequence
  Synthetic Polynucleotide
taatacgactcactatagggctgcttctccaacagaggaggtgagctgccaacagaggagaggcagcatgcctcctctgaacctggcggcagcgcaaaagatg

SEQ ID NO: 96422 - DNA, 103 bp, Artificial Sequence
  Synthetic Polynucleotide
taatacgactcactatagggtggtaacggtctgcttctccaacagaggagaacagaggagactcctcatgtggagaagcaacctggcggcagcgcaaaagatg

SEQ ID NO: 96423 - DNA, 103 bp, Artificial Sequence
  Synthetic Polynucleotide
taatacgactcactataggggtgacgtctttggtaacggtctgcttctccaacagaggagaggagaaatggaccgttacaacctggcggcagcgcaaaagatg

SEQ ID NO: 96424 - DNA, 103 bp, Artificial Sequence
  Synthetic Polynucleotide
taatacgactcactataggggggattctcttccctcagttccagtctggcaacagaggagagccagaatggaactgaggaacctggcggcagcgcaaaagatg

SEQ ID NO: 96425 - DNA, 103 bp, Artificial Sequence
  Synthetic Polynucleotide
taatacgactcactatagggtggcttatctgtgacgtctttggtaacggtaacagaggagaaccgttatgaaagacgtcaacctggcggcagcgcaaaagatg

SEQ ID NO: 96426 - DNA, 103 bp, Artificial Sequence
  Synthetic Polynucleotide
taatacgactcactatagggacaagtctagtggcttatctgtgacgtcttaacagaggagaaagacgatgcagataagcaacctggcggcagcgcaaaagatg

SEQ ID NO: 96427 - DNA, 103 bp, Artificial Sequence
  Synthetic Polynucleotide
taatacgactcactatagggactttagaagacaagtctagtggcttatctaacagaggagaagataaatgactagacttaacctggcggcagcgcaaaagatg

SEQ ID NO: 96428 - DNA, 103 bp, Artificial Sequence
  Synthetic Polynucleotide
taatacgactcactatagggtacatccaccactttagaagacaagtctagaacagaggagactagacatgtcttctaaaaacctggcggcagcgcaaaagatg

SEQ ID NO: 96429 - DNA, 103 bp, Artificial Sequence
  Synthetic Polynucleotide
taatacgactcactatagggtggaagcatctacatccaccactttagaagaacagaggagacttctaatgtggtggatgaacctggcggcagcgcaaaagatg

SEQ ID NO: 96430 - DNA, 103 bp, Artificial Sequence
  Synthetic Polynucleotide
taatacgactcactatagggtggtcagctttggaagcatctacatccaccaacagaggagaggtggaatgagatgcttcaacctggcggcagcgcaaaagatg

SEQ ID NO: 96431 - DNA, 103 bp, Artificial Sequence
  Synthetic Polynucleotide
taatacgactcactatagggctttttcatgtggtcagctttggaagcatcaacagaggagagatgctatgaaagctgacaacctggcggcagcgcaaaagatg

SEQ ID NO: 96432 - DNA, 103 bp, Artificial Sequence
  Synthetic Polynucleotide
taatacgactcactatagggtgggagccatctttttcatgtggtcagcttaacagaggagaaagctgatgacatgaaaaaacctggcggcagcgcaaaagatg

SEQ ID NO: 96433 - DNA, 103 bp, Artificial Sequence
  Synthetic Polynucleotide
taatacgactcactatagggaccaggaccgtgggagccatctttttcatgaacagaggagacatgaaatggatggctccaacctggcggcagcgcaaaagatg

SEQ ID NO: 96434 - DNA, 103 bp, Artificial Sequence
  Synthetic Polynucleotide
taatacgactcactatagggcctgctgtgaaccaggaccgtgggagccataacagaggagaatggctatgacggtcctgaacctggcggcagcgcaaaagatg

SEQ ID NO: 96435 - DNA, 103 bp, Artificial Sequence
  Synthetic Polynucleotide
taatacgactcactatagggtgtggttcaagggattctcttccctcagttaacagaggagaaactgaatgaagagaatcaacctggcggcagcgcaaaagatg

SEQ ID NO: 96436 - DNA, 103 bp, Artificial Sequence
  Synthetic Polynucleotide
taatacgactcactatagggcacttccagccctgctgtgaaccaggaccgaacagaggagacggtccatgttcacagcaaacctggcggcagcgcaaaagatg

SEQ ID NO: 96437 - DNA, 103 bp, Artificial Sequence
  Synthetic Polynucleotide
taatacgactcactatagggagcactaagccacttccagccctgctgtgaaacagaggagatcacagatgggctggaagaacctggcggcagcgcaaaagatg

SEQ ID NO: 96438 - DNA, 103 bp, Artificial Sequence
  Synthetic Polynucleotide
taatacgactcactatagggacttccggagagcactaagccacttccagcaacagaggagagctggaatgggcttagtgaacctggcggcagcgcaaaagatg

SEQ ID NO: 96439 - DNA, 103 bp, Artificial Sequence
  Synthetic Polynucleotide
taatacgactcactatagggtcggaatctcacttccggagagcactaagcaacagaggagagcttagatgtctccggaaaacctggcggcagcgcaaaagatg

SEQ ID NO: 96440 - DNA, 103 bp, Artificial Sequence
  Synthetic Polynucleotide
taatacgactcactatagggagtgtttctttcggaatctcacttccggagaacagaggagactccggatgtgagattccaacctggcggcagcgcaaaagatg

SEQ ID NO: 96441 - DNA, 103 bp, Artificial Sequence
  Synthetic Polynucleotide
taatacgactcactatagggtggaggagatagtgtttctttcggaatctcaacagaggagagagattatgaaagaaacaaacctggcggcagcgcaaaagatg

SEQ ID NO: 96442 - DNA, 103 bp, Artificial Sequence
  Synthetic Polynucleotide
taatacgactcactatagggaaccatttcctggaggagatagtgtttcttaacagaggagaaagaaaatgtatctcctcaacctggcggcagcgcaaaagatg

SEQ ID NO: 96443 - DNA, 103 bp, Artificial Sequence
  Synthetic Polynucleotide
taatacgactcactatagggtagatagcacaaccatttcctggaggagataacagaggagaatctccatgaggaaatggaacctggcggcagcgcaaaagatg

SEQ ID NO: 96444 - DNA, 103 bp, Artificial Sequence
  Synthetic Polynucleotide
taatacgactcactatagggttcagatctatagatagcacaaccatttccaacagaggagaggaaatatgtgtgctatcaacctggcggcagcgcaaaagatg

SEQ ID NO: 96445 - DNA, 103 bp, Artificial Sequence
  Synthetic Polynucleotide
taatacgactcactatagggtgctgatgatttcagatctatagatagcacaacagaggagagtgctaatgatagatctgaacctggcggcagcgcaaaagatg

SEQ ID NO: 96446 - DNA, 103 bp, Artificial Sequence
  Synthetic Polynucleotide
taatacgactcactatagggtccaccacgttgtggttcaagggattctctaacagaggagaagagaaatgcttgaaccaaacctggcggcagcgcaaaagatg

SEQ ID NO: 96447 - DNA, 103 bp, Artificial Sequence
  Synthetic Polynucleotide
taatacgactcactataggggagggagcagtgctgatgatttcagatctaaacagaggagatagatcatgaatcatcagaacctggcggcagcgcaaaagatg

SEQ ID NO: 96448 - DNA, 103 bp, Artificial Sequence
  Synthetic Polynucleotide
taatacgactcactatagggcacccaggatgagggagcagtgctgatgataacagaggagaatcatcatgactgctcccaacctggcggcagcgcaaaagatg

SEQ ID NO: 96449 - DNA, 103 bp, Artificial Sequence
  Synthetic Polynucleotide
taatacgactcactataggggcccgggcaccacccaggatgagggagcagaacagaggagactgctcatgcatcctgggaacctggcggcagcgcaaaagatg

SEQ ID NO: 96450 - DNA, 103 bp, Artificial Sequence
  Synthetic Polynucleotide
taatacgactcactatagggttaggacttggcccgggcaccacccaggataacagaggagaatcctgatgggtgcccggaacctggcggcagcgcaaaagatg

SEQ ID NO: 96451 - DNA, 103 bp, Artificial Sequence
  Synthetic Polynucleotide
taatacgactcactataggggttctcttcgttaggacttggcccgggcacaacagaggagagtgcccatgccaagtcctaacctggcggcagcgcaaaagatg

SEQ ID NO: 96452 - DNA, 103 bp, Artificial Sequence
  Synthetic Polynucleotide
taatacgactcactatagggttttgccattgttctcttcgttaggacttgaacagaggagacaagtcatgacgaagagaaacctggcggcagcgcaaaagatg

SEQ ID NO: 96453 - DNA, 103 bp, Artificial Sequence
  Synthetic Polynucleotide
taatacgactcactatagggagcgacatgcttttgccattgttctcttcgaacagaggagacgaagaatgcaatggcaaaacctggcggcagcgcaaaagatg

SEQ ID NO: 96454 - DNA, 103 bp, Artificial Sequence
  Synthetic Polynucleotide
taatacgactcactatagggcttgtttttcagcgacatgcttttgccattaacagaggagaaatggcatgagcatgtcgaacctggcggcagcgcaaaagatg

SEQ ID NO: 96455 - DNA, 103 bp, Artificial Sequence
  Synthetic Polynucleotide
taatacgactcactatagggagtccaatgccttgtttttcagcgacatgcaacagaggagagcatgtatgtgaaaaacaaacctggcggcagcgcaaaagatg

SEQ ID NO: 96456 - DNA, 103 bp, Artificial Sequence
  Synthetic Polynucleotide
taatacgactcactatagggggtatcgcccagtccaatgccttgtttttcaacagaggagagaaaaaatgggcattggaaacctggcggcagcgcaaaagatg

SEQ ID NO: 96457 - DNA, 103 bp, Artificial Sequence
  Synthetic Polynucleotide
taatacgactcactatagggcgtgctcgcatccaccacgttgtggttcaaaacagaggagattgaacatgaacgtggtgaacctggcggcagcgcaaaagatg

SEQ ID NO: 96458 - DNA, 103 bp, Artificial Sequence
  Synthetic Polynucleotide
taatacgactcactatagggccgctgctgtggtatcgcccagtccaatgcaacagaggagagcattgatgtgggcgataaacctggcggcagcgcaaaagatg

SEQ ID NO: 96459 - DNA, 103 bp, Artificial Sequence
  Synthetic Polynucleotide
taatacgactcactatagggatgatgaactccgctgctgtggtatcgcccaacagaggagagggcgaatgcacagcagcaacctggcggcagcgcaaaagatg

SEQ ID NO: 96460 - DNA, 103 bp, Artificial Sequence
  Synthetic Polynucleotide
taatacgactcactatagggatgcgcgggcatgatgaactccgctgctgtaacagaggagaacagcaatggagttcatcaacctggcggcagcgcaaaagatg

SEQ ID NO: 96461 - DNA, 103 bp, Artificial Sequence
  Synthetic Polynucleotide
taatacgactcactatagggggtgccgcccatgcgcgggcatgatgaactaacagaggagaagttcaatgtgcccgcgcaacctggcggcagcgcaaaagatg

SEQ ID NO: 96462 - DNA, 103 bp, Artificial Sequence
  Synthetic Polynucleotide
taatacgactcactatagggtgacagcatcggtgccgcccatgcgcgggcaacagaggagagcccgcatgtgggcggcaaacctggcggcagcgcaaaagatg

SEQ ID NO: 96463 - DNA, 103 bp, Artificial Sequence
  Synthetic Polynucleotide
taatacgactcactatagggacgttagtgatgacagcatcggtgccgcccaacagaggagagggcggatgcgatgctgtaacctggcggcagcgcaaaagatg

SEQ ID NO: 96464 - DNA, 103 bp, Artificial Sequence
  Synthetic Polynucleotide
taatacgactcactatagggtgaccctgaaacgttagtgatgacagcatcaacagaggagagatgctatgatcactaacaacctggcggcagcgcaaaagatg

SEQ ID NO: 96465 - DNA, 103 bp, Artificial Sequence
  Synthetic Polynucleotide
taatacgactcactatagggcactcgacactgaccctgaaacgttagtgaaacagaggagatcactaatgtttcagggtaacctggcggcagcgcaaaagatg

SEQ ID NO: 96466 - DNA, 103 bp, Artificial Sequence
  Synthetic Polynucleotide
taatacgactcactataggggggcggcctgcactcgacactgaccctgaaaacagaggagattcaggatgagtgtcgagaacctggcggcagcgcaaaagatg

SEQ ID NO: 96467 - DNA, 103 bp, Artificial Sequence
  Synthetic Polynucleotide
taatacgactcactatagggtgcggaggctgggcggcctgcactcgacacaacagaggagagtgtcgatggcaggccgcaacctggcggcagcgcaaaagatg

SEQ ID NO: 96468 - DNA, 103 bp, Artificial Sequence
  Synthetic Polynucleotide
taatacgactcactatagggtcctatgggccgtgctcgcatccaccacgtaacagaggagaacgtggatgatgcgagcaaacctggcggcagcgcaaaagatg

SEQ ID NO: 96469 - DNA, 103 bp, Artificial Sequence
  Synthetic Polynucleotide
taatacgactcactataggggggcgggtgatgcggaggctgggcggcctgaacagaggagacaggccatgcagcctccgaacctggcggcagcgcaaaagatg

SEQ ID NO: 96470 - DNA, 103 bp, Artificial Sequence
  Synthetic Polynucleotide
taatacgactcactatagggttggcattgggggcgggtgatgcggaggctaacagaggagaagcctcatgatcacccgcaacctggcggcagcgcaaaagatg

SEQ ID NO: 96471 - DNA, 103 bp, Artificial Sequence
  Synthetic Polynucleotide
taatacgactcactataggggccatctgcattggcattgggggcgggtgaaacagaggagatcacccatgcccaatgccaacctggcggcagcgcaaaagatg

SEQ ID NO: 96472 - DNA, 103 bp, Artificial Sequence
  Synthetic Polynucleotide
taatacgactcactatagggtggttttggtgccatctgcattggcattggaacagaggagaccaatgatgatgcagatgaacctggcggcagcgcaaaagatg

SEQ ID NO: 96473 - DNA, 103 bp, Artificial Sequence
  Synthetic Polynucleotide
taatacgactcactataggggagctcctgctggttttggtgccatctgcaaacagaggagatgcagaatgcaccaaaacaacctggcggcagcgcaaaagatg

SEQ ID NO: 96474 - DNA, 103 bp, Artificial Sequence
  Synthetic Polynucleotide
taatacgactcactatagggggtttctacagagctcctgctggttttggtaacagaggagaaccaaaatgagcaggagcaacctggcggcagcgcaaaagatg

SEQ ID NO: 96475 - DNA, 103 bp, Artificial Sequence
  Synthetic Polynucleotide
taatacgactcactatagggcggatggtgtggtttctacagagctcctgcaacagaggagagcaggaatgctgtagaaaaacctggcggcagcgcaaaagatg

SEQ ID NO: 96476 - DNA, 103 bp, Artificial Sequence
  Synthetic Polynucleotide
taatacgactcactatagggtgctgaataacggatggtgtggtttctacaaacagaggagatgtagaatgcacaccatcaacctggcggcagcgcaaaagatg

SEQ ID NO: 96477 - DNA, 103 bp, Artificial Sequence
  Synthetic Polynucleotide
taatacgactcactatagggctggcccacgtgctgaataacggatggtgtaacagaggagaacaccaatggttattcagaacctggcggcagcgcaaaagatg

SEQ ID NO: 96478 - DNA, 103 bp, Artificial Sequence
  Synthetic Polynucleotide
taatacgactcactatagggtggccgggggctggcccacgtgctgaataaaacagaggagattattcatgacgtgggccaacctggcggcagcgcaaaagatg

SEQ ID NO: 96479 - DNA, 103 bp, Artificial Sequence
  Synthetic Polynucleotide
taatacgactcactatagggaggccatcgatcctatgggccgtgctcgcaaacagaggagatgcgagatgggcccatagaacctggcggcagcgcaaaagatg

SEQ ID NO: 96480 - DNA, 103 bp, Artificial Sequence
  Synthetic Polynucleotide
taatacgactcactatagggttggcaggagtggccgggggctggcccacgaacagaggagacgtgggatggcccccggcaacctggcggcagcgcaaaagatg

SEQ ID NO: 96481 - DNA, 103 bp, Artificial Sequence
  Synthetic Polynucleotide
taatacgactcactataggggctactgtgcttggcaggagtggccgggggaacagaggagacccccgatgactcctgccaacctggcggcagcgcaaaagatg

SEQ ID NO: 96482 - DNA, 103 bp, Artificial Sequence
  Synthetic Polynucleotide
taatacgactcactatagggtgctggtgctgctactgtgcttggcaggagaacagaggagactcctgatgagcacagtaaacctggcggcagcgcaaaagatg

SEQ ID NO: 96483 - DNA, 103 bp, Artificial Sequence
  Synthetic Polynucleotide
taatacgactcactataggggcgcccttgctgctggtgctgctactgtgcaacagaggagagcacagatgcagcaccagaacctggcggcagcgcaaaagatg

SEQ ID NO: 96484 - DNA, 103 bp, Artificial Sequence
  Synthetic Polynucleotide
taatacgactcactataggggctggctttggcgcccttgctgctggtgctaacagaggagaagcaccatgagcaagggcaacctggcggcagcgcaaaagatg

SEQ ID NO: 96485 - DNA, 103 bp, Artificial Sequence
  Synthetic Polynucleotide
taatacgactcactataggggttctgggttgctggctttggcgcccttgcaacagaggagagcaaggatgccaaagccaaacctggcggcagcgcaaaagatg

SEQ ID NO: 96486 - DNA, 103 bp, Artificial Sequence
  Synthetic Polynucleotide
taatacgactcactatagggttgaaactcggttctgggttgctggctttgaacagaggagacaaagcatgcaacccagaaacctggcggcagcgcaaaagatg

SEQ ID NO: 96487 - DNA, 103 bp, Artificial Sequence
  Synthetic Polynucleotide
taatacgactcactatagggctcgtttgctttgaaactcggttctgggttaacagaggagaaacccaatgccgagtttcaacctggcggcagcgcaaaagatg

SEQ ID NO: 96488 - DNA, 103 bp, Artificial Sequence
  Synthetic Polynucleotide
taatacgactcactataggggaaggccgttctcgtttgctttgaaactcgaacagaggagacgagttatgaagcaaacgaacctggcggcagcgcaaaagatg

SEQ ID NO: 96489 - DNA, 103 bp, Artificial Sequence
  Synthetic Polynucleotide
taatacgactcactataggggagcttggtggaaggccgttctcgtttgctaacagaggagaagcaaaatggaacggcctaacctggcggcagcgcaaaagatg

SEQ ID NO: 96490 - DNA, 103 bp, Artificial Sequence
  Synthetic Polynucleotide
taatacgactcactatagggcagtgctgccaggccatcgatcctatgggcaacagaggagagcccatatgatcgatggcaacctggcggcagcgcaaaagatg

SEQ ID NO: 96491 - DNA, 103 bp, Artificial Sequence
  Synthetic Polynucleotide
taatacgactcactatagggcagaaatatagagcttggtggaaggccgttaacagaggagaaacggcatgccaccaagcaacctggcggcagcgcaaaagatg

SEQ ID NO: 96492 - DNA, 103 bp, Artificial Sequence
  Synthetic Polynucleotide
taatacgactcactatagggcatttggagacagaaatatagagcttggtgaacagaggagacaccaaatgctatatttcaacctggcggcagcgcaaaagatg

SEQ ID NO: 96493 - DNA, 103 bp, Artificial Sequence
  Synthetic Polynucleotide
taatacgactcactatagggctgaatgcctcatttggagacagaaatataaacagaggagatatattatggtctccaaaaacctggcggcagcgcaaaagatg

SEQ ID NO: 96494 - DNA, 103 bp, Artificial Sequence
  Synthetic Polynucleotide
taatacgactcactatagggtggtggggacctgaatgcctcatttggagaaacagaggagatctccaatggaggcattcaacctggcggcagcgcaaaagatg

SEQ ID NO: 96495 - DNA, 103 bp, Artificial Sequence
  Synthetic Polynucleotide
taatacgactcactatagggggtagggaattggtggggacctgaatgcctaacagaggagaaggcatatgggtccccacaacctggcggcagcgcaaaagatg

SEQ ID NO: 96496 - DNA, 103 bp, Artificial Sequence
  Synthetic Polynucleotide
taatacgactcactatagggtaactcctggggtagggaattggtggggacaacagaggagagtccccatgaattccctaaacctggcggcagcgcaaaagatg

SEQ ID NO: 96497 - DNA, 103 bp, Artificial Sequence
  Synthetic Polynucleotide
taatacgactcactataggggtaagggaggtaactcctggggtagggaataacagaggagaattcccatgcccaggagtaacctggcggcagcgcaaaagatg

SEQ ID NO: 96498 - DNA, 103 bp, Artificial Sequence
  Synthetic Polynucleotide
taatacgactcactatagggcaggggctgggtaagggaggtaactcctggaacagaggagaccaggaatgacctcccttaacctggcggcagcgcaaaagatg

SEQ ID NO: 96499 - DNA, 103 bp, Artificial Sequence
  Synthetic Polynucleotide
taatacgactcactataggggcaatgccctcaggggctgggtaagggaggaacagaggagacctcccatgcccagccccaacctggcggcagcgcaaaagatg

SEQ ID NO: 96500 - DNA, 103 bp, Artificial Sequence
  Synthetic Polynucleotide
taatacgactcactataggggggacttacagcaatgccctcaggggctggaacagaggagaccagccatggagggcattaacctggcggcagcgcaaaagatg

SEQ ID NO: 96501 - DNA, 103 bp, Artificial Sequence
  Synthetic Polynucleotide
taatacgactcactatagggagctgtgaacgttcccatacaggggggttgaacagaggagacaacccatgtgtatgggaaacctggcggcagcgcaaaagatg

SEQ ID NO: 96502 - DNA, 103 bp, Artificial Sequence
  Synthetic Polynucleotide
taatacgactcactatagggggtccatgctcagtgctgccaggccatcgaaacagaggagatcgatgatgtggcagcacaacctggcggcagcgcaaaagatg

SEQ ID NO: 96503 - DNA, 103 bp, Artificial Sequence
  Synthetic Polynucleotide
taatacgactcactataggggtaaggagaggggacttacagcaatgccctaacagaggagaagggcaatgctgtaagtcaacctggcggcagcgcaaaagatg

SEQ ID NO: 96504 - DNA, 103 bp, Artificial Sequence
  Synthetic Polynucleotide
taatacgactcactatagggcctttgccatgtaaggagaggggacttacaaacagaggagatgtaagatgcctctccttaacctggcggcagcgcaaaagatg

SEQ ID NO: 96505 - DNA, 103 bp, Artificial Sequence
  Synthetic Polynucleotide
taatacgactcactataggggtagacaggtcctttgccatgtaaggagagaacagaggagactctccatgcatggcaaaaacctggcggcagcgcaaaagatg

SEQ ID NO: 96506 - DNA, 103 bp, Artificial Sequence
  Synthetic Polynucleotide
taatacgactcactatagggctgggtgagggtagacaggtcctttgccataacagaggagaatggcaatggacctgtctaacctggcggcagcgcaaaagatg

SEQ ID NO: 96507 - DNA, 103 bp, Artificial Sequence
  Synthetic Polynucleotide
taatacgactcactatagggggtaacaaaactgggtgagggtagacaggtaacagaggagaacctgtatgccctcacccaacctggcggcagcgcaaaagatg

SEQ ID NO: 96508 - DNA, 103 bp, Artificial Sequence
  Synthetic Polynucleotide
taatacgactcactatagggactgccattgggtaacaaaactgggtgaggaacagaggagacctcacatggttttgttaaacctggcggcagcgcaaaagatg

SEQ ID NO: 96509 - DNA, 103 bp, Artificial Sequence
  Synthetic Polynucleotide
taatacgactcactatagggcaggaaacagactgccattgggtaacaaaaaacagaggagattttgtatgccaatggcaaacctggcggcagcgcaaaagatg

SEQ ID NO: 96510 - DNA, 103 bp, Artificial Sequence
  Synthetic Polynucleotide
taatacgactcactataggggcaaggtgcccaggaaacagactgccattgaacagaggagacaatggatgtctgtttccaacctggcggcagcgcaaaagatg

SEQ ID NO: 96511 - DNA, 103 bp, Artificial Sequence
  Synthetic Polynucleotide
taatacgactcactatagggaggctttggggcaaggtgcccaggaaacagaacagaggagactgtttatggggcaccttaacctggcggcagcgcaaaagatg

SEQ ID NO: 96512 - DNA, 103 bp, Artificial Sequence
  Synthetic Polynucleotide
taatacgactcactatagggagggcagcccaggctttggggcaaggtgccaacagaggagaggcaccatgccccaaagcaacctggcggcagcgcaaaagatg

SEQ ID NO: 96513 - DNA, 103 bp, Artificial Sequence
  Synthetic Polynucleotide
taatacgactcactatagggaggccagtgcggtccatgctcagtgctgccaacagaggagaggcagcatggagcatggaaacctggcggcagcgcaaaagatg

SEQ ID NO: 96514 - DNA, 103 bp, Artificial Sequence
  Synthetic Polynucleotide
taatacgactcactatagggggaagcccatagggcagcccaggctttgggaacagaggagacccaaaatgtgggctgccaacctggcggcagcgcaaaagatg

SEQ ID NO: 96515 - DNA, 103 bp, Artificial Sequence
  Synthetic Polynucleotide
taatacgactcactatagggacggccggtgggaagcccatagggcagcccaacagaggagagggctgatgtatgggcttaacctggcggcagcgcaaaagatg

SEQ ID NO: 96516 - DNA, 103 bp, Artificial Sequence
  Synthetic Polynucleotide
taatacgactcactatagggcaaactctggacggccggtgggaagcccataacagaggagaatgggcatgccaccggccaacctggcggcagcgcaaaagatg

SEQ ID NO: 96517 - DNA, 103 bp, Artificial Sequence
  Synthetic Polynucleotide
taatacgactcactatagggtggtaggtcacaaactctggacggccggtgaacagaggagacaccggatgtccagagttaacctggcggcagcgcaaaagatg

SEQ ID NO: 96518 - DNA, 103 bp, Artificial Sequence
  Synthetic Polynucleotide
taatacgactcactatagggcagggcatcttggtaggtcacaaactctggaacagaggagaccagagatggtgacctacaacctggcggcagcgcaaaagatg

SEQ ID NO: 96519 - DNA, 103 bp, Artificial Sequence
  Synthetic Polynucleotide
taatacgactcactatagggtgcccaaccccagggcatcttggtaggtcaaacagaggagatgacctatgaagatgcccaacctggcggcagcgcaaaagatg

SEQ ID NO: 96520 - DNA, 103 bp, Artificial Sequence
  Synthetic Polynucleotide
taatacgactcactatagggggatgcaccatgcccaaccccagggcatctaacagaggagaagatgcatgggggttgggaacctggcggcagcgcaaaagatg

SEQ ID NO: 96521 - DNA, 103 bp, Artificial Sequence
  Synthetic Polynucleotide
taatacgactcactatagggtatcaacatgggatgcaccatgcccaacccaacagaggagagggttgatgatggtgcataacctggcggcagcgcaaaagatg

SEQ ID NO: 96522 - DNA, 103 bp, Artificial Sequence
  Synthetic Polynucleotide
taatacgactcactataggggcgtgtgtggtatcaacatgggatgcaccaaacagaggagatggtgcatgccatgttgaaacctggcggcagcgcaaaagatg

SEQ ID NO: 96523 - DNA, 103 bp, Artificial Sequence
  Synthetic Polynucleotide
taatacgactcactatagggatctctatgggcgtgtgtggtatcaacatgaacagaggagacatgttatgaccacacacaacctggcggcagcgcaaaagatg

SEQ ID NO: 96524 - DNA, 103 bp, Artificial Sequence
  Synthetic Polynucleotide
taatacgactcactatagggttcccggatcaggccagtgcggtccatgctaacagaggagaagcatgatgcgcactggcaacctggcggcagcgcaaaagatg

SEQ ID NO: 96525 - DNA, 103 bp, Artificial Sequence
  Synthetic Polynucleotide
taatacgactcactatagggctctttagtaatctctatgggcgtgtgtggaacagaggagaccacacatgcccatagagaacctggcggcagcgcaaaagatg

SEQ ID NO: 96526 - DNA, 103 bp, Artificial Sequence
  Synthetic Polynucleotide
taatacgactcactatagggctggtttctcctctttagtaatctctatggaacagaggagaccatagatgttactaaagaacctggcggcagcgcaaaagatg

SEQ ID NO: 96527 - DNA, 103 bp, Artificial Sequence
  Synthetic Polynucleotide
taatacgactcactataggggatctcctctctggtttctcctctttagtaaacagaggagatactaaatgggagaaaccaacctggcggcagcgcaaaagatg

SEQ ID NO: 96528 - DNA, 103 bp, Artificial Sequence
  Synthetic Polynucleotide
taatacgactcactatagggatgggaccgggatctcctctctggtttctcaacagaggagagagaaaatggagaggagaaacctggcggcagcgcaaaagatg

SEQ ID NO: 96529 - DNA, 103 bp, Artificial Sequence
  Synthetic Polynucleotide
taatacgactcactataggggggctctctcatgggaccgggatctcctctaacagaggagaagaggaatgcccggtcccaacctggcggcagcgcaaaagatg

SEQ ID NO: 96530 - DNA, 103 bp, Artificial Sequence
  Synthetic Polynucleotide
taatacgactcactatagggtcctcgtaacgggctctctcatgggaccggaacagaggagaccggtcatgtgagagagcaacctggcggcagcgcaaaagatg

SEQ ID NO: 96531 - DNA, 103 bp, Artificial Sequence
  Synthetic Polynucleotide
taatacgactcactataggggagggttgggtcctcgtaacgggctctctcaacagaggagagagagaatgcgttacgagaacctggcggcagcgcaaaagatg

SEQ ID NO: 96532 - DNA, 103 bp, Artificial Sequence
  Synthetic Polynucleotide
taatacgactcactatagggaccgattccggagggttgggtcctcgtaacaacagaggagagttacgatgacccaacccaacctggcggcagcgcaaaagatg

SEQ ID NO: 96533 - DNA, 103 bp, Artificial Sequence
  Synthetic Polynucleotide
taatacgactcactatagggatctcggaaaaccgattccggagggttgggaacagaggagacccaacatgccggaatcgaacctggcggcagcgcaaaagatg

SEQ ID NO: 96534 - DNA, 103 bp, Artificial Sequence
  Synthetic Polynucleotide
taatacgactcactatagggagtttccaaaatctcggaaaaccgattccgaacagaggagacggaatatgttttccgagaacctggcggcagcgcaaaagatg

SEQ ID NO: 96535 - DNA, 103 bp, Artificial Sequence
  Synthetic Polynucleotide
taatacgactcactatagggcccgcagcccttcccggatcaggccagtgcaacagaggagagcactgatgtgatccgggaacctggcggcagcgcaaaagatg

SEQ ID NO: 96536 - DNA, 103 bp, Artificial Sequence
  Synthetic Polynucleotide
taatacgactcactatagggtggtgctgctagtttccaaaatctcggaaaaacagaggagatttccgatgttttggaaaaacctggcggcagcgcaaaagatg

SEQ ID NO: 96537 - DNA, 103 bp, Artificial Sequence
  Synthetic Polynucleotide
taatacgactcactatagggggatgtaacttggtgctgctagtttccaaaaacagaggagatttggaatgtagcagcacaacctggcggcagcgcaaaagatg

SEQ ID NO: 96538 - DNA, 103 bp, Artificial Sequence
  Synthetic Polynucleotide
taatacgactcactatagggggggacatctggatgtaacttggtgctgctaacagaggagaagcagcatgaagttacataacctggcggcagcgcaaaagatg

SEQ ID NO: 96539 - DNA, 103 bp, Artificial Sequence
  Synthetic Polynucleotide
taatacgactcactatagggtcttgtcggtggggacatctggatgtaactaacagaggagaagttacatgcagatgtccaacctggcggcagcgcaaaagatg

SEQ ID NO: 96540 - DNA, 103 bp, Artificial Sequence
  Synthetic Polynucleotide
taatacgactcactatagggggctttaggttcttgtcggtggggacatctaacagaggagaagatgtatgcaccgacaaaacctggcggcagcgcaaaagatg

SEQ ID NO: 96541 - DNA, 103 bp, Artificial Sequence
  Synthetic Polynucleotide
taatacgactcactataggggttggggttcggctttaggttcttgtcggtaacagaggagaaccgacatgaacctaaagaacctggcggcagcgcaaaagatg

SEQ ID NO: 96542 - DNA, 103 bp, Artificial Sequence
  Synthetic Polynucleotide
taatacgactcactatagggcttgattccagttggggttcggctttaggtaacagaggagaacctaaatgcgaaccccaaacctggcggcagcgcaaaagatg

SEQ ID NO: 96543 - DNA, 103 bp, Artificial Sequence
  Synthetic Polynucleotide
taatacgactcactatagggacagtcttcccttgattccagttggggttcaacagaggagagaacccatgctggaatcaaacctggcggcagcgcaaaagatg

SEQ ID NO: 96544 - DNA, 103 bp, Artificial Sequence
  Synthetic Polynucleotide
taatacgactcactataggggcttttgacaacagtcttcccttgattccaaacagaggagatggaatatggggaagactaacctggcggcagcgcaaaagatg

SEQ ID NO: 96545 - DNA, 103 bp, Artificial Sequence
  Synthetic Polynucleotide
taatacgactcactatagggcaagcttgtcgcttttgacaacagtcttccaacagaggagaggaagaatgttgtcaaaaaacctggcggcagcgcaaaagatg

SEQ ID NO: 96546 - DNA, 103 bp, Artificial Sequence
  Synthetic Polynucleotide
taatacgactcactatagggtttcccgggacccgcagcccttcccggatcaacagaggagagatccgatgagggctgcgaacctggcggcagcgcaaaagatg

SEQ ID NO: 96547 - DNA, 103 bp, Artificial Sequence
  Synthetic Polynucleotide
taatacgactcactatagggtctacgtagacaagcttgtcgcttttgacaaacagaggagatgtcaaatgcgacaagctaacctggcggcagcgcaaaagatg

SEQ ID NO: 96548 - DNA, 103 bp, Artificial Sequence
  Synthetic Polynucleotide
taatacgactcactatagggtcggagaaggtctacgtagacaagcttgtcaacagaggagagacaagatggtctacgtaaacctggcggcagcgcaaaagatg

SEQ ID NO: 96549 - DNA, 103 bp, Artificial Sequence
  Synthetic Polynucleotide
taatacgactcactatagggctggttcttctcggagaaggtctacgtagaaacagaggagatctacgatgaccttctccaacctggcggcagcgcaaaagatg

SEQ ID NO: 96550 - DNA, 103 bp, Artificial Sequence
  Synthetic Polynucleotide
taatacgactcactataggggttttagcatctggttcttctcggagaaggaacagaggagaccttctatgagaagaaccaacctggcggcagcgcaaaagatg

SEQ ID NO: 96551 - DNA, 103 bp, Artificial Sequence
  Synthetic Polynucleotide
taatacgactcactataggggtttgtgtcagttttagcatctggttcttcaacagaggagagaagaaatggatgctaaaaacctggcggcagcgcaaaagatg

SEQ ID NO: 96552 - DNA, 103 bp, Artificial Sequence
  Synthetic Polynucleotide
taatacgactcactataggggtttggacacgtttgtgtcagttttagcataacagaggagaatgctaatgctgacacaaaacctggcggcagcgcaaaagatg

SEQ ID NO: 96553 - DNA, 103 bp, Artificial Sequence
  Synthetic Polynucleotide
taatacgactcactataggggcaaagctgggtttggacacgtttgtgtcaaacagaggagatgacacatgcgtgtccaaaacctggcggcagcgcaaaagatg

SEQ ID NO: 96554 - DNA, 103 bp, Artificial Sequence
  Synthetic Polynucleotide
taatacgactcactatagggactctctgctgcaaagctgggtttggacacaacagaggagagtgtccatgcccagctttaacctggcggcagcgcaaaagatg

SEQ ID NO: 96555 - DNA, 103 bp, Artificial Sequence
  Synthetic Polynucleotide
taatacgactcactatagggtctggccaacactctctgctgcaaagctggaacagaggagaccagctatgcagcagagaaacctggcggcagcgcaaaagatg

SEQ ID NO: 96556 - DNA, 103 bp, Artificial Sequence
  Synthetic Polynucleotide
taatacgactcactatagggggctcagcgctctggccaacactctctgctaacagaggagaagcagaatgtgttggccaaacctggcggcagcgcaaaagatg

SEQ ID NO: 96557 - DNA, 103 bp, Artificial Sequence
  Synthetic Polynucleotide
taatacgactcactatagggatagacgatgtttcccgggacccgcagcccaacagaggagagggctgatggtcccgggaaacctggcggcagcgcaaaagatg

SEQ ID NO: 96558 - DNA, 103 bp, Artificial Sequence
  Synthetic Polynucleotide
taatacgactcactataggggggcttggggggctcagcgctctggccaacaacagaggagagttggcatgagcgctgagaacctggcggcagcgcaaaagatg

SEQ ID NO: 96559 - DNA, 103 bp, Artificial Sequence
  Synthetic Polynucleotide
taatacgactcactataggggctcaactgagggcttggggggctcagcgcaacagaggagagcgctgatgcccccaagcaacctggcggcagcgcaaaagatg

SEQ ID NO: 96560 - DNA, 103 bp, Artificial Sequence
  Synthetic Polynucleotide
taatacgactcactatagggtgcagggccggctcaactgagggcttggggaacagaggagaccccaaatgctcagttgaaacctggcggcagcgcaaaagatg

SEQ ID NO: 96561 - DNA, 103 bp, Artificial Sequence
  Synthetic Polynucleotide
taatacgactcactatagggacggtgctgctgcagggccggctcaactgaaacagaggagatcagttatgccggccctgaacctggcggcagcgcaaaagatg

SEQ ID NO: 96562 - DNA, 103 bp, Artificial Sequence
  Synthetic Polynucleotide
taatacgactcactatagggcgatgaaatcacggtgctgctgcagggccgaacagaggagacggcccatgagcagcaccaacctggcggcagcgcaaaagatg

SEQ ID NO: 96563 - DNA, 103 bp, Artificial Sequence
  Synthetic Polynucleotide
taatacgactcactatagggtctctcagggcgatgaaatcacggtgctgcaacagaggagagcagcaatgtgatttcataacctggcggcagcgcaaaagatg

SEQ ID NO: 96564 - DNA, 103 bp, Artificial Sequence
  Synthetic Polynucleotide
taatacgactcactatagggccccaactcctctctcagggcgatgaaatcaacagaggagagatttcatggccctgagaaacctggcggcagcgcaaaagatg

SEQ ID NO: 96565 - DNA, 103 bp, Artificial Sequence
  Synthetic Polynucleotide
taatacgactcactatagggcactgatgcgccccaactcctctctcagggaacagaggagaccctgaatgaggagttggaacctggcggcagcgcaaaagatg

SEQ ID NO: 96566 - DNA, 103 bp, Artificial Sequence
  Synthetic Polynucleotide
taatacgactcactatagggtcgtggaagtcactgatgcgccccaactccaacagaggagaggagttatggcgcatcagaacctggcggcagcgcaaaagatg

SEQ ID NO: 96567 - DNA, 103 bp, Artificial Sequence
  Synthetic Polynucleotide
taatacgactcactatagggagtataagtttcgtggaagtcactgatgcgaacagaggagacgcatcatggacttccacaacctggcggcagcgcaaaagatg

SEQ ID NO: 96568 - DNA, 103 bp, Artificial Sequence
  Synthetic Polynucleotide
taatacgactcactatagggacaagctagaatagacgatgtttcccgggaaacagaggagatcccggatgacatcgtctaacctggcggcagcgcaaaagatg

SEQ ID NO: 96569 - DNA, 103 bp, Artificial Sequence
  Synthetic Polynucleotide
taatacgactcactataggggctgtttgaaagtataagtttcgtggaagtaacagaggagaacttccatgaaacttataaacctggcggcagcgcaaaagatg

SEQ ID NO: 96570 - DNA, 103 bp, Artificial Sequence
  Synthetic Polynucleotide
taatacgactcactataggggtgaagactggctgtttgaaagtataagttaacagaggagaaacttaatgtttcaaacaaacctggcggcagcgcaaaagatg

SEQ ID NO: 96571 - DNA, 103 bp, Artificial Sequence
  Synthetic Polynucleotide
taatacgactcactatagggcttgcttacggtgaagactggctgtttgaaaacagaggagattcaaaatgccagtcttcaacctggcggcagcgcaaaagatg

SEQ ID NO: 96572 - DNA, 103 bp, Artificial Sequence
  Synthetic Polynucleotide
taatacgactcactataggggaacactgtccttgcttacggtgaagactgaacagaggagacagtctatgccgtaagcaaacctggcggcagcgcaaaagatg

SEQ ID NO: 96573 - DNA, 103 bp, Artificial Sequence
  Synthetic Polynucleotide
taatacgactcactataggggtacctgccagaacactgtccttgcttacgaacagaggagacgtaagatgggacagtgtaacctggcggcagcgcaaaagatg

SEQ ID NO: 96574 - DNA, 103 bp, Artificial Sequence
  Synthetic Polynucleotide
taatacgactcactatagggctctttgttggtacctgccagaacactgtcaacagaggagagacagtatgctggcaggtaacctggcggcagcgcaaaagatg

SEQ ID NO: 96575 - DNA, 103 bp, Artificial Sequence
  Synthetic Polynucleotide
taatacgactcactatagggaccctaggttctctttgttggtacctgccaaacagaggagatggcagatgccaacaaagaacctggcggcagcgcaaaagatg

SEQ ID NO: 96576 - DNA, 103 bp, Artificial Sequence
  Synthetic Polynucleotide
taatacgactcactataggggagactggcaaccctaggttctctttgttgaacagaggagacaacaaatggaacctaggaacctggcggcagcgcaaaagatg

SEQ ID NO: 96577 - DNA, 103 bp, Artificial Sequence
  Synthetic Polynucleotide
taatacgactcactataggggaatggagtcgagactggcaaccctaggttaacagaggagaaacctaatgttgccagtcaacctggcggcagcgcaaaagatg

SEQ ID NO: 96578 - DNA, 103 bp, Artificial Sequence
  Synthetic Polynucleotide
taatacgactcactataggggtggctccaggaatggagtcgagactggcaaacagaggagatgccagatgcgactccataacctggcggcagcgcaaaagatg

SEQ ID NO: 96579 - DNA, 103 bp, Artificial Sequence
  Synthetic Polynucleotide
taatacgactcactatagggcccagtccacacaagctagaatagacgatgaacagaggagacatcgtatgttctagcttaacctggcggcagcgcaaaagatg

SEQ ID NO: 96580 - DNA, 103 bp, Artificial Sequence
  Synthetic Polynucleotide
taatacgactcactatagggctccccagaggtggctccaggaatggagtcaacagaggagagactccatgcctggagccaacctggcggcagcgcaaaagatg

SEQ ID NO: 96581 - DNA, 103 bp, Artificial Sequence
  Synthetic Polynucleotide
taatacgactcactatagggagggccatcgctccccagaggtggctccagaacagaggagactggagatgcctctggggaacctggcggcagcgcaaaagatg

SEQ ID NO: 96582 - DNA, 103 bp, Artificial Sequence
  Synthetic Polynucleotide
taatacgactcactatagggaagttacagcagggccatcgctccccagagaacagaggagactctggatggcgatggccaacctggcggcagcgcaaaagatg

SEQ ID NO: 96583 - DNA, 103 bp, Artificial Sequence
  Synthetic Polynucleotide
taatacgactcactataggggttttaccaaaagttacagcagggccatcgaacagaggagacgatggatgtgctgtaacaacctggcggcagcgcaaaagatg

SEQ ID NO: 96584 - DNA, 103 bp, Artificial Sequence
  Synthetic Polynucleotide
taatacgactcactatagggatcctcttgggttttaccaaaagttacagcaacagaggagagctgtaatgtttggtaaaaacctggcggcagcgcaaaagatg

SEQ ID NO: 96585 - DNA, 103 bp, Artificial Sequence
  Synthetic Polynucleotide
taatacgactcactatagggatggtttgggatcctcttgggttttaccaaaacagaggagattggtaatgcccaagaggaacctggcggcagcgcaaaagatg

SEQ ID NO: 96586 - DNA, 103 bp, Artificial Sequence
  Synthetic Polynucleotide
taatacgactcactatagggcccacacaaaatggtttgggatcctcttggaacagaggagaccaagaatgtcccaaaccaacctggcggcagcgcaaaagatg

SEQ ID NO: 96587 - DNA, 103 bp, Artificial Sequence
  Synthetic Polynucleotide
taatacgactcactatagggtggggcactgcccacacaaaatggtttgggaacagaggagacccaaaatgttttgtgtgaacctggcggcagcgcaaaagatg

SEQ ID NO: 96588 - DNA, 103 bp, Artificial Sequence
  Synthetic Polynucleotide
taatacgactcactatagggccacacttggtggggcactgcccacacaaaaacagaggagatttgtgatggcagtgcccaacctggcggcagcgcaaaagatg

SEQ ID NO: 96589 - DNA, 103 bp, Artificial Sequence
  Synthetic Polynucleotide
taatacgactcactatagggggggtcacatccacacttggtggggcactgaacagaggagacagtgcatgaccaagtgtaacctggcggcagcgcaaaagatg

SEQ ID NO: 96590 - DNA, 103 bp, Artificial Sequence
  Synthetic Polynucleotide
taatacgactcactatagggtttctctgagcccagtccacacaagctagaaacagaggagatctagcatgtgtggactgaacctggcggcagcgcaaaagatg

SEQ ID NO: 96591 - DNA, 103 bp, Artificial Sequence
  Synthetic Polynucleotide
taatacgactcactatagggggtataggtgggggtcacatccacacttggaacagaggagaccaagtatggatgtgaccaacctggcggcagcgcaaaagatg

SEQ ID NO: 96592 - DNA, 103 bp, Artificial Sequence
  Synthetic Polynucleotide
taatacgactcactatagggctccatctttggtataggtgggggtcacataacagaggagaatgtgaatgccacctataaacctggcggcagcgcaaaagatg

SEQ ID NO: 96593 - DNA, 103 bp, Artificial Sequence
  Synthetic Polynucleotide
taatacgactcactataggggcctcatcagctccatctttggtataggtgaacagaggagacacctaatgcaaagatggaacctggcggcagcgcaaaagatg

SEQ ID NO: 96594 - DNA, 103 bp, Artificial Sequence
  Synthetic Polynucleotide
taatacgactcactatagggatttgattcagcctcatcagctccatctttaacagaggagaaaagatatggctgatgagaacctggcggcagcgcaaaagatg

SEQ ID NO: 96595 - DNA, 103 bp, Artificial Sequence
  Synthetic Polynucleotide
taatacgactcactatagggctttgccatcatttgattcagcctcatcagaacagaggagactgatgatgctgaatcaaaacctggcggcagcgcaaaagatg

SEQ ID NO: 96596 - DNA, 103 bp, Artificial Sequence
  Synthetic Polynucleotide
taatacgactcactatagggggtttcagaactttgccatcatttgattcaaacagaggagatgaatcatgtgatggcaaaacctggcggcagcgcaaaagatg

SEQ ID NO: 96597 - DNA, 103 bp, Artificial Sequence
  Synthetic Polynucleotide
taatacgactcactatagggagatggcttcggtttcagaactttgccatcaacagaggagagatggcatggttctgaaaaacctggcggcagcgcaaaagatg

SEQ ID NO: 96598 - DNA, 103 bp, Artificial Sequence
  Synthetic Polynucleotide
taatacgactcactatagggttgccagcttagatggcttcggtttcagaaaacagaggagattctgaatgcgaagccataacctggcggcagcgcaaaagatg

SEQ ID NO: 96599 - DNA, 103 bp, Artificial Sequence
  Synthetic Polynucleotide
taatacgactcactataggggcgattctctttgccagcttagatggcttcaacagaggagagaagccatgtaagctggcaacctggcggcagcgcaaaagatg

SEQ ID NO: 96600 - DNA, 103 bp, Artificial Sequence
  Synthetic Polynucleotide
taatacgactcactatagggcgctgagttggcgattctctttgccagcttaacagaggagaaagctgatgaagagaatcaacctggcggcagcgcaaaagatg

SEQ ID NO: 96601 - DNA, 103 bp, Artificial Sequence
  Synthetic Polynucleotide
taatacgactcactatagggcctcccgacctttctctgagcccagtccacaacagaggagagtggacatggctcagagaaacctggcggcagcgcaaaagatg

SEQ ID NO: 96602 - DNA, 103 bp, Artificial Sequence
  Synthetic Polynucleotide
taatacgactcactatagggccacgtaacccgctgagttggcgattctctaacagaggagaagagaaatgccaactcagaacctggcggcagcgcaaaagatg

SEQ ID NO: 96603 - DNA, 103 bp, Artificial Sequence
  Synthetic Polynucleotide
taatacgactcactatagggaatcggtcacccacgtaacccgctgagttgaacagaggagacaactcatggggttacgtaacctggcggcagcgcaaaagatg

SEQ ID NO: 96604 - DNA, 103 bp, Artificial Sequence
  Synthetic Polynucleotide
taatacgactcactataggggacacatttgaatcggtcacccacgtaaccaacagaggagaggttacatgggtgaccgaaacctggcggcagcgcaaaagatg

SEQ ID NO: 96605 - DNA, 103 bp, Artificial Sequence
  Synthetic Polynucleotide
taatacgactcactataggggttcggtagtgacacatttgaatcggtcacaacagaggagagtgaccatgtcaaatgtgaacctggcggcagcgcaaaagatg

SEQ ID NO: 96606 - DNA, 103 bp, Artificial Sequence
  Synthetic Polynucleotide
taatacgactcactatagggtctgcatacagttcggtagtgacacatttgaacagaggagacaaatgatgcactaccgaaacctggcggcagcgcaaaagatg

SEQ ID NO: 96607 - DNA, 103 bp, Artificial Sequence
  Synthetic Polynucleotide
taatacgactcactatagggctgactggaatctgcatacagttcggtagtaacagaggagaactaccatgctgtatgcaaacctggcggcagcgcaaaagatg

SEQ ID NO: 96608 - DNA, 103 bp, Artificial Sequence
  Synthetic Polynucleotide
taatacgactcactatagggcccggctgagctgactggaatctgcatacaaacagaggagatgtatgatgattccagtcaacctggcggcagcgcaaaagatg

SEQ ID NO: 96609 - DNA, 103 bp, Artificial Sequence
  Synthetic Polynucleotide
taatacgactcactataggggcccgttgctcccggctgagctgactggaaaacagaggagattccagatggctcagccgaacctggcggcagcgcaaaagatg

SEQ ID NO: 96610 - DNA, 103 bp, Artificial Sequence
  Synthetic Polynucleotide
taatacgactcactatagggcatctgcaatgcccgttgctcccggctgagaacagaggagactcagcatggagcaacggaacctggcggcagcgcaaaagatg

SEQ ID NO: 96611 - DNA, 103 bp, Artificial Sequence
  Synthetic Polynucleotide
taatacgactcactataggggtaatccttccatctgcaatgcccgttgctaacagaggagaagcaacatgcattgcagaaacctggcggcagcgcaaaagatg

SEQ ID NO: 96612 - DNA, 103 bp, Artificial Sequence
  Synthetic Polynucleotide
taatacgactcactatagggctgttcatccagctgtgaacgttcccatacaacagaggagagtatggatgcgttcacagaacctggcggcagcgcaaaagatg

SEQ ID NO: 96613 - DNA, 103 bp, Artificial Sequence
  Synthetic Polynucleotide
taatacgactcactatagggcttgtggcagcctcccgacctttctctgagaacagaggagactcagaatgaggtcgggaaacctggcggcagcgcaaaagatg

SEQ ID NO: 96614 - DNA, 103 bp, Artificial Sequence
  Synthetic Polynucleotide
taatacgactcactatagggctgtcctcttgtaatccttccatctgcaataacagaggagaattgcaatgggaaggattaacctggcggcagcgcaaaagatg

SEQ ID NO: 96615 - DNA, 103 bp, Artificial Sequence
  Synthetic Polynucleotide
taatacgactcactatagggacataaaatactgtcctcttgtaatccttcaacagaggagagaaggaatgcaagaggacaacctggcggcagcgcaaaagatg

SEQ ID NO: 96616 - DNA, 103 bp, Artificial Sequence
  Synthetic Polynucleotide
taatacgactcactatagggcagcgggtagacataaaatactgtcctcttaacagaggagaaagaggatggtattttataacctggcggcagcgcaaaagatg

SEQ ID NO: 96617 - DNA, 103 bp, Artificial Sequence
  Synthetic Polynucleotide
taatacgactcactatagggtcacagtaagcagcgggtagacataaaataaacagaggagatattttatgtctacccgcaacctggcggcagcgcaaaagatg

SEQ ID NO: 96618 - DNA, 103 bp, Artificial Sequence
  Synthetic Polynucleotide
taatacgactcactatagggcattgcacgctcacagtaagcagcgggtagaacagaggagactacccatggcttactgtaacctggcggcagcgcaaaagatg

SEQ ID NO: 96619 - DNA, 103 bp, Artificial Sequence
  Synthetic Polynucleotide
taatacgactcactatagggagaagcgcatcattgcacgctcacagtaagaacagaggagacttactatgagcgtgcaaaacctggcggcagcgcaaaagatg

SEQ ID NO: 96620 - DNA, 103 bp, Artificial Sequence
  Synthetic Polynucleotide
taatacgactcactatagggtccaactctgagaagcgcatcattgcacgcaacagaggagagcgtgcatggatgcgcttaacctggcggcagcgcaaaagatg

SEQ ID NO: 96621 - DNA, 103 bp, Artificial Sequence
  Synthetic Polynucleotide
taatacgactcactatagggttctttcatctccaactctgagaagcgcataacagaggagaatgcgcatgtcagagttgaacctggcggcagcgcaaaagatg

SEQ ID NO: 96622 - DNA, 103 bp, Artificial Sequence
  Synthetic Polynucleotide
taatacgactcactatagggcaccttctctttctttcatctccaactctgaacagaggagacagagtatgagatgaaagaacctggcggcagcgcaaaagatg

SEQ ID NO: 96623 - DNA, 103 bp, Artificial Sequence
  Synthetic Polynucleotide
taatacgactcactataggggctgggtggccaccttctctttctttcatcaacagaggagagatgaaatgaagagaaggaacctggcggcagcgcaaaagatg

SEQ ID NO: 96624 - DNA, 103 bp, Artificial Sequence
  Synthetic Polynucleotide
taatacgactcactatagggacctagagtgcttgtggcagcctcccgaccaacagaggagaggtcggatggctgccacaaacctggcggcagcgcaaaagatg

SEQ ID NO: 96625 - DNA, 103 bp, Artificial Sequence
  Synthetic Polynucleotide
taatacgactcactataggggtctttggttgctgggtggccaccttctctaacagaggagaagagaaatgggccacccaaacctggcggcagcgcaaaagatg

SEQ ID NO: 96626 - DNA, 103 bp, Artificial Sequence
  Synthetic Polynucleotide
taatacgactcactatagggacatctcggagtctttggttgctgggtggcaacagaggagagccaccatgcaaccaaagaacctggcggcagcgcaaaagatg

SEQ ID NO: 96627 - DNA, 103 bp, Artificial Sequence
  Synthetic Polynucleotide
taatacgactcactatagggctgaatttgcacatctcggagtctttggttaacagaggagaaaccaaatgctccgagataacctggcggcagcgcaaaagatg

SEQ ID NO: 96628 - DNA, 103 bp, Artificial Sequence
  Synthetic Polynucleotide
taatacgactcactataggggtcggctgggctgaatttgcacatctcggaaacagaggagatccgagatgtgcaaattcaacctggcggcagcgcaaaagatg

SEQ ID NO: 96629 - DNA, 103 bp, Artificial Sequence
  Synthetic Polynucleotide
taatacgactcactatagggacctttcccagtcggctgggctgaatttgcaacagaggagagcaaatatggcccagccgaacctggcggcagcgcaaaagatg

SEQ ID NO: 96630 - DNA, 103 bp, Artificial Sequence
  Synthetic Polynucleotide
taatacgactcactatagggtttcctttcaacctttcccagtcggctgggaacagaggagacccagcatgctgggaaagaacctggcggcagcgcaaaagatg

SEQ ID NO: 96631 - DNA, 103 bp, Artificial Sequence
  Synthetic Polynucleotide
taatacgactcactatagggtttgtcctgatttcctttcaacctttcccaaacagaggagatgggaaatgttgaaaggaaacctggcggcagcgcaaaagatg

SEQ ID NO: 96632 - DNA, 103 bp, Artificial Sequence
  Synthetic Polynucleotide
taatacgactcactatagggactttggctttttgtcctgatttcctttcaaacagaggagatgaaagatgatcaggacaaacctggcggcagcgcaaaagatg

SEQ ID NO: 96633 - DNA, 103 bp, Artificial Sequence
  Synthetic Polynucleotide
taatacgactcactatagggagggtgaccgactttggctttttgtcctgaaacagaggagatcaggaatgaaagccaaaaacctggcggcagcgcaaaagatg

SEQ ID NO: 96634 - DNA, 103 bp, Artificial Sequence
  Synthetic Polynucleotide
taatacgactcactatagggggcctcctccagggtgaccgactttggcttaacagaggagaaagccaatgtcggtcaccaacctggcggcagcgcaaaagatg

SEQ ID NO: 96635 - DNA, 103 bp, Artificial Sequence
  Synthetic Polynucleotide
taatacgactcactatagggacccaaggccacctagagtgcttgtggcagaacagaggagactgccaatggcactctagaacctggcggcagcgcaaaagatg

SEQ ID NO: 96636 - DNA, 103 bp, Artificial Sequence
  Synthetic Polynucleotide
taatacgactcactataggggttctgcaatggcctcctccagggtgaccgaacagaggagacggtcaatgtggaggaggaacctggcggcagcgcaaaagatg

SEQ ID NO: 96637 - DNA, 103 bp, Artificial Sequence
  Synthetic Polynucleotide
taatacgactcactatagggctttcgttctgttctgcaatggcctcctccaacagaggagaggaggaatgcattgcagaaacctggcggcagcgcaaaagatg

SEQ ID NO: 96638 - DNA, 103 bp, Artificial Sequence
  Synthetic Polynucleotide
taatacgactcactataggggcatctctcactttcgttctgttctgcaataacagaggagaattgcaatgcagaacgaaaacctggcggcagcgcaaaagatg

SEQ ID NO: 96639 - DNA, 103 bp, Artificial Sequence
  Synthetic Polynucleotide
taatacgactcactatagggcactatactcgcatctctcactttcgttctaacagaggagaagaacgatggtgagagataacctggcggcagcgcaaaagatg

SEQ ID NO: 96640 - DNA, 103 bp, Artificial Sequence
  Synthetic Polynucleotide
taatacgactcactatagggttgtttccaacactatactcgcatctctcaaacagaggagatgagagatgcgagtatagaacctggcggcagcgcaaaagatg

SEQ ID NO: 96641 - DNA, 103 bp, Artificial Sequence
  Synthetic Polynucleotide
taatacgactcactatagggatcacggtgcttgtttccaacactatactcaacagaggagagagtatatggttggaaacaacctggcggcagcgcaaaagatg

SEQ ID NO: 96642 - DNA, 103 bp, Artificial Sequence
  Synthetic Polynucleotide
taatacgactcactatagggcttcaaagggatcacggtgcttgtttccaaaacagaggagattggaaatgagcaccgtgaacctggcggcagcgcaaaagatg

SEQ ID NO: 96643 - DNA, 103 bp, Artificial Sequence
  Synthetic Polynucleotide
taatacgactcactatagggtcctctggggcttcaaagggatcacggtgcaacagaggagagcaccgatgtccctttgaaacctggcggcagcgcaaaagatg

SEQ ID NO: 96644 - DNA, 103 bp, Artificial Sequence
  Synthetic Polynucleotide
taatacgactcactatagggaagatctttgtcctctggggcttcaaagggaacagaggagaccctttatggccccagagaacctggcggcagcgcaaaagatg

SEQ ID NO: 96645 - DNA, 103 bp, Artificial Sequence
  Synthetic Polynucleotide
taatacgactcactatagggtctccacaggaagatctttgtcctctggggaacagaggagaccccagatgacaaagatcaacctggcggcagcgcaaaagatg

SEQ ID NO: 96646 - DNA, 103 bp, Artificial Sequence
  Synthetic Polynucleotide
taatacgactcactatagggtccgaagaaaacccaaggccacctagagtgaacagaggagacactctatgtggccttggaacctggcggcagcgcaaaagatg

SEQ ID NO: 96647 - DNA, 103 bp, Artificial Sequence
  Synthetic Polynucleotide
taatacgactcactatagggacaaagtacttctccacaggaagatctttgaacagaggagacaaagaatgtcctgtggaaacctggcggcagcgcaaaagatg

SEQ ID NO: 96648 - DNA, 103 bp, Artificial Sequence
  Synthetic Polynucleotide
taatacgactcactatagggctgcctctccacaaagtacttctccacaggaacagaggagacctgtgatgaagtactttaacctggcggcagcgcaaaagatg

SEQ ID NO: 96649 - DNA, 103 bp, Artificial Sequence
  Synthetic Polynucleotide
taatacgactcactatagggcgctcacaggctgcctctccacaaagtactaacagaggagaagtactatgtggagaggcaacctggcggcagcgcaaaagatg

SEQ ID NO: 96650 - DNA, 103 bp, Artificial Sequence
  Synthetic Polynucleotide
taatacgactcactataggggcgggaggctcgctcacaggctgcctctccaacagaggagaggagagatggcctgtgagaacctggcggcagcgcaaaagatg

SEQ ID NO: 96651 - DNA, 103 bp, Artificial Sequence
  Synthetic Polynucleotide
taatacgactcactatagggcacctggtctgcgggaggctcgctcacaggaacagaggagacctgtgatggagcctcccaacctggcggcagcgcaaaagatg

SEQ ID NO: 96652 - DNA, 103 bp, Artificial Sequence
  Synthetic Polynucleotide
taatacgactcactatagggtgtccgaggccacctggtctgcgggaggctaacagaggagaagcctcatgcagaccaggaacctggcggcagcgcaaaagatg

SEQ ID NO: 96653 - DNA, 103 bp, Artificial Sequence
  Synthetic Polynucleotide
taatacgactcactatagggctgtgaggcatgtccgaggccacctggtctaacagaggagaagaccaatgggcctcggaaacctggcggcagcgcaaaagatg

SEQ ID NO: 96654 - DNA, 103 bp, Artificial Sequence
  Synthetic Polynucleotide
taatacgactcactataggggagggtggggctgtgaggcatgtccgaggcaacagaggagagcctcgatgatgcctcacaacctggcggcagcgcaaaagatg

SEQ ID NO: 96655 - DNA, 103 bp, Artificial Sequence
  Synthetic Polynucleotide
taatacgactcactatagggtgtccacccggagggtggggctgtgaggcaaacagaggagatgcctcatggccccacccaacctggcggcagcgcaaaagatg

SEQ ID NO: 96656 - DNA, 103 bp, Artificial Sequence
  Synthetic Polynucleotide
taatacgactcactatagggttgcgtttcctgtccacccggagggtggggaacagaggagaccccacatgccgggtggaaacctggcggcagcgcaaaagatg

SEQ ID NO: 96657 - DNA, 103 bp, Artificial Sequence
  Synthetic Polynucleotide
taatacgactcactatagggtggatttctttccgaagaaaacccaaggccaacagaggagaggccttatgttttcttcgaacctggcggcagcgcaaaagatg

SEQ ID NO: 96658 - DNA, 103 bp, Artificial Sequence
  Synthetic Polynucleotide
taatacgactcactatagggacctgagactttgcgtttcctgtccacccgaacagaggagacgggtgatgaggaaacgcaacctggcggcagcgcaaaagatg

SEQ ID NO: 96659 - DNA, 103 bp, Artificial Sequence
  Synthetic Polynucleotide
taatacgactcactatagggggctgctgtcacctgagactttgcgtttccaacagaggagaggaaacatgaagtctcagaacctggcggcagcgcaaaagatg

SEQ ID NO: 96660 - DNA, 103 bp, Artificial Sequence
  Synthetic Polynucleotide
taatacgactcactataggggtctcagtgtggctgctgtcacctgagactaacagaggagaagtctcatgtgacagcagaacctggcggcagcgcaaaagatg

SEQ ID NO: 96661 - DNA, 103 bp, Artificial Sequence
  Synthetic Polynucleotide
taatacgactcactatagggctccgcagtggtctcagtgtggctgctgtcaacagaggagagacagcatgcacactgagaacctggcggcagcgcaaaagatg

SEQ ID NO: 96662 - DNA, 103 bp, Artificial Sequence
  Synthetic Polynucleotide
taatacgactcactatagggctggcacctcctccgcagtggtctcagtgtaacagaggagaacactgatgccactgcggaacctggcggcagcgcaaaagatg

SEQ ID NO: 96663 - DNA, 103 bp, Artificial Sequence
  Synthetic Polynucleotide
taatacgactcactatagggagagggtcctctggcacctcctccgcagtgaacagaggagacactgcatgggaggtgccaacctggcggcagcgcaaaagatg

SEQ ID NO: 96664 - DNA, 103 bp, Artificial Sequence
  Synthetic Polynucleotide
taatacgactcactatagggggctttcagcagagggtcctctggcacctcaacagaggagagaggtgatggaggaccctaacctggcggcagcgcaaaagatg

SEQ ID NO: 96665 - DNA, 103 bp, Artificial Sequence
  Synthetic Polynucleotide
taatacgactcactataggggtcggcgtttggctttcagcagagggtcctaacagaggagaaggaccatgtgctgaaagaacctggcggcagcgcaaaagatg

SEQ ID NO: 96666 - DNA, 103 bp, Artificial Sequence
  Synthetic Polynucleotide
taatacgactcactatagggttagagactcgtcggcgtttggctttcagcaacagaggagagctgaaatgcaaacgccgaacctggcggcagcgcaaaagatg

SEQ ID NO: 96667 - DNA, 103 bp, Artificial Sequence
  Synthetic Polynucleotide
taatacgactcactatagggatggagccctttagagactcgtcggcgtttaacagaggagaaaacgcatgcgagtctctaacctggcggcagcgcaaaagatg

SEQ ID NO: 96668 - DNA, 103 bp, Artificial Sequence
  Synthetic Polynucleotide
taatacgactcactatagggactgcatctctggatttctttccgaagaaaaacagaggagatttcttatgaaagaaatcaacctggcggcagcgcaaaagatg

SEQ ID NO: 96669 - DNA, 103 bp, Artificial Sequence
  Synthetic Polynucleotide
taatacgactcactataggggttttttaggatggagccctttagagactcaacagaggagagagtctatgaagggctccaacctggcggcagcgcaaaagatg

SEQ ID NO: 96670 - DNA, 103 bp, Artificial Sequence
  Synthetic Polynucleotide
taatacgactcactatagggaagtggcgttgttttttaggatggagccctaacagaggagaagggctatgtcctaaaaaaacctggcggcagcgcaaaagatg

SEQ ID NO: 96671 - DNA, 103 bp, Artificial Sequence
  Synthetic Polynucleotide
taatacgactcactatagggaaggtgcagcaagtggcgttgttttttaggaacagaggagacctaaaatgcaacgccacaacctggcggcagcgcaaaagatg

SEQ ID NO: 96672 - DNA, 103 bp, Artificial Sequence
  Synthetic Polynucleotide
taatacgactcactatagggatcgttctctaaggtgcagcaagtggcgttaacagaggagaaacgccatgtgctgcaccaacctggcggcagcgcaaaagatg

SEQ ID NO: 96673 - DNA, 103 bp, Artificial Sequence
  Synthetic Polynucleotide
taatacgactcactatagggtgctgctcccatcgttctctaaggtgcagcaacagaggagagctgcaatgtagagaacgaacctggcggcagcgcaaaagatg

SEQ ID NO: 96674 - DNA, 103 bp, Artificial Sequence
  Synthetic Polynucleotide
taatacgactcactatagggtgccgacacctgctgctcccatcgttctctaacagaggagaagagaaatgtgggagcagaacctggcggcagcgcaaaagatg

SEQ ID NO: 96675 - DNA, 103 bp, Artificial Sequence
  Synthetic Polynucleotide
taatacgactcactatagggtgccatctgctgccgacacctgctgctcccaacagaggagagggagcatgaggtgtcggaacctggcggcagcgcaaaagatg

SEQ ID NO: 96676 - DNA, 103 bp, Artificial Sequence
  Synthetic Polynucleotide
taatacgactcactatagggcggccaggtttgccatctgctgccgacaccaacagaggagaggtgtcatgagcagatggaacctggcggcagcgcaaaagatg

SEQ ID NO: 96677 - DNA, 103 bp, Artificial Sequence
  Synthetic Polynucleotide
taatacgactcactatagggcctgctttgccggccaggtttgccatctgcaacagaggagagcagatatgaaacctggcaacctggcggcagcgcaaaagatg

SEQ ID NO: 96678 - DNA, 103 bp, Artificial Sequence
  Synthetic Polynucleotide
taatacgactcactatagggtcacttccttcctgctttgccggccaggttaacagaggagaaacctgatgggcaaagcaaacctggcggcagcgcaaaagatg

SEQ ID NO: 96679 - DNA, 103 bp, Artificial Sequence
  Synthetic Polynucleotide
taatacgactcactatagggttcggtttgaactgcatctctggatttcttaacagaggagaaagaaaatgagagatgcaaacctggcggcagcgcaaaagatg

SEQ ID NO: 96680 - DNA, 103 bp, Artificial Sequence
  Synthetic Polynucleotide
taatacgactcactataggggtggcctgggtcacttccttcctgctttgcaacagaggagagcaaagatggaaggaagtaacctggcggcagcgcaaaagatg

SEQ ID NO: 96681 - DNA, 103 bp, Artificial Sequence
  Synthetic Polynucleotide
taatacgactcactatagggctcaggctgagtggcctgggtcacttccttaacagaggagaaaggaaatgacccaggccaacctggcggcagcgcaaaagatg

SEQ ID NO: 96682 - DNA, 103 bp, Artificial Sequence
  Synthetic Polynucleotide
taatacgactcactataggggaggaatggcctcaggctgagtggcctgggaacagaggagacccaggatgctcagcctgaacctggcggcagcgcaaaagatg

SEQ ID NO: 96683 - DNA, 103 bp, Artificial Sequence
  Synthetic Polynucleotide
taatacgactcactatagggttagtcccctgaggaatggcctcaggctgaaacagaggagatcagccatgggccattccaacctggcggcagcgcaaaagatg

SEQ ID NO: 96684 - DNA, 103 bp, Artificial Sequence
  Synthetic Polynucleotide
taatacgactcactatagggttcagtgatgttagtcccctgaggaatggcaacagaggagagccattatgcaggggactaacctggcggcagcgcaaaagatg

SEQ ID NO: 96685 - DNA, 103 bp, Artificial Sequence
  Synthetic Polynucleotide
taatacgactcactatagggcaggtttctcttcagtgatgttagtcccctaacagaggagaaggggaatgacatcactgaacctggcggcagcgcaaaagatg

SEQ ID NO: 96686 - DNA, 103 bp, Artificial Sequence
  Synthetic Polynucleotide
taatacgactcactatagggcttttcctgccaggtttctcttcagtgatgaacagaggagacatcacatgagagaaaccaacctggcggcagcgcaaaagatg

SEQ ID NO: 96687 - DNA, 103 bp, Artificial Sequence
  Synthetic Polynucleotide
taatacgactcactatagggggcctctgcccttttcctgccaggtttctcaacagaggagagagaaaatgggcaggaaaaacctggcggcagcgcaaaagatg

SEQ ID NO: 96688 - DNA, 103 bp, Artificial Sequence
  Synthetic Polynucleotide
taatacgactcactatagggtgttgcctttggcctctgcccttttcctgcaacagaggagagcaggaatggggcagaggaacctggcggcagcgcaaaagatg

SEQ ID NO: 96689 - DNA, 103 bp, Artificial Sequence
  Synthetic Polynucleotide
taatacgactcactataggggaccagcttctgttgcctttggcctctgccaacagaggagaggcagaatgcaaaggcaaaacctggcggcagcgcaaaagatg

SEQ ID NO: 96690 - DNA, 103 bp, Artificial Sequence
  Synthetic Polynucleotide
taatacgactcactatagggctcgggtgtattcggtttgaactgcatctcaacagaggagagagatgatgttcaaaccgaacctggcggcagcgcaaaagatg

SEQ ID NO: 96691 - DNA, 103 bp, Artificial Sequence
  Synthetic Polynucleotide
taatacgactcactatagggagactcttccgaccagcttctgttgcctttaacagaggagaaaaggcatgagaagctggaacctggcggcagcgcaaaagatg

SEQ ID NO: 96692 - DNA, 103 bp, Artificial Sequence
  Synthetic Polynucleotide
taatacgactcactatagggtgggtttaagagactcttccgaccagcttcaacagaggagagaagctatgcggaagagtaacctggcggcagcgcaaaagatg

SEQ ID NO: 96693 - DNA, 103 bp, Artificial Sequence
  Synthetic Polynucleotide
taatacgactcactatagggtcattgtcactgggtttaagagactcttccaacagaggagaggaagaatgtcttaaaccaacctggcggcagcgcaaaagatg

SEQ ID NO: 96694 - DNA, 103 bp, Artificial Sequence
  Synthetic Polynucleotide
taatacgactcactatagggcaagccttgttcattgtcactgggtttaagaacagaggagacttaaaatgagtgacaataacctggcggcagcgcaaaagatg

SEQ ID NO: 96695 - DNA, 103 bp, Artificial Sequence
  Synthetic Polynucleotide
taatacgactcactatagggagaacacaggcaagccttgttcattgtcacaacagaggagagtgacaatgaacaaggctaacctggcggcagcgcaaaagatg

SEQ ID NO: 96696 - DNA, 103 bp, Artificial Sequence
  Synthetic Polynucleotide
taatacgactcactatagggggagagccggagaacacaggcaagccttgtaacagaggagaacaaggatggcctgtgttaacctggcggcagcgcaaaagatg

SEQ ID NO: 96697 - DNA, 103 bp, Artificial Sequence
  Synthetic Polynucleotide
taatacgactcactatagggcttcatgggcggagagccggagaacacaggaacagaggagacctgtgatgtccggctctaacctggcggcagcgcaaaagatg

SEQ ID NO: 96698 - DNA, 103 bp, Artificial Sequence
  Synthetic Polynucleotide
taatacgactcactatagggatgaaagactcttcatgggcggagagccggaacagaggagaccggctatgcgcccatgaaacctggcggcagcgcaaaagatg

SEQ ID NO: 96699 - DNA, 103 bp, Artificial Sequence
  Synthetic Polynucleotide
taatacgactcactataggggcactggtggatgaaagactcttcatgggcaacagaggagagcccatatggagtctttcaacctggcggcagcgcaaaagatg

SEQ ID NO: 96700 - DNA, 103 bp, Artificial Sequence
  Synthetic Polynucleotide
taatacgactcactatagggtttgccgcctgcactggtggatgaaagactaacagaggagaagtcttatgtccaccagtaacctggcggcagcgcaaaagatg

SEQ ID NO: 96701 - DNA, 103 bp, Artificial Sequence
  Synthetic Polynucleotide
taatacgactcactatagggcctccactgtctcgggtgtattcggtttgaaacagaggagatcaaacatgatacacccgaacctggcggcagcgcaaaagatg

SEQ ID NO: 96702 - DNA, 103 bp, Artificial Sequence
  Synthetic Polynucleotide
taatacgactcactataggggagcctgctttttgccgcctgcactggtggaacagaggagaccaccaatgcaggcggcaaacctggcggcagcgcaaaagatg

SEQ ID NO: 96703 - DNA, 103 bp, Artificial Sequence
  Synthetic Polynucleotide
taatacgactcactatagggcagcttggctgagcctgctttttgccgcctaacagaggagaaggcggatgaaagcaggcaacctggcggcagcgcaaaagatg

SEQ ID NO: 96704 - DNA, 103 bp, Artificial Sequence
  Synthetic Polynucleotide
taatacgactcactatagggggctggtgcgcagcttggctgagcctgcttaacagaggagaaagcagatgcagccaagcaacctggcggcagcgcaaaagatg

SEQ ID NO: 96705 - DNA, 103 bp, Artificial Sequence
  Synthetic Polynucleotide
taatacgactcactataggggcggcctggaggctggtgcgcagcttggctaacagaggagaagccaaatggcgcaccagaacctggcggcagcgcaaaagatg

SEQ ID NO: 96706 - DNA, 103 bp, Artificial Sequence
  Synthetic Polynucleotide
taatacgactcactatagggtgtttggcaggcggcctggaggctggtgcgaacagaggagacgcaccatgctccaggccaacctggcggcagcgcaaaagatg

SEQ ID NO: 96707 - DNA, 103 bp, Artificial Sequence
  Synthetic Polynucleotide
taatacgactcactatagggaattttctgctgtttggcaggcggcctggaaacagaggagatccaggatgcctgccaaaaacctggcggcagcgcaaaagatg

SEQ ID NO: 96708 - DNA, 103 bp, Artificial Sequence
  Synthetic Polynucleotide
taatacgactcactatagggggttttctttaattttctgctgtttggcagaacagaggagactgccaatgagcagaaaaaacctggcggcagcgcaaaagatg

SEQ ID NO: 96709 - DNA, 103 bp, Artificial Sequence
  Synthetic Polynucleotide
taatacgactcactatagggtctgtcttctggttttctttaattttctgcaacagaggagagcagaaatgtaaagaaaaaacctggcggcagcgcaaaagatg

SEQ ID NO: 96710 - DNA, 103 bp, Artificial Sequence
  Synthetic Polynucleotide
taatacgactcactatagggacacagcacatctgtcttctggttttctttaacagaggagaaaagaaatgcagaagacaaacctggcggcagcgcaaaagatg

SEQ ID NO: 96711 - DNA, 103 bp, Artificial Sequence
  Synthetic Polynucleotide
taatacgactcactatagggcttcgtctgcacacagcacatctgtcttctaacagaggagaagaagaatgatgtgctgtaacctggcggcagcgcaaaagatg

SEQ ID NO: 96712 - DNA, 103 bp, Artificial Sequence
  Synthetic Polynucleotide
taatacgactcactatagggacggcagaagcctccactgtctcgggtgtaaacagaggagatacaccatggacagtggaaacctggcggcagcgcaaaagatg

SEQ ID NO: 96713 - DNA, 103 bp, Artificial Sequence
  Synthetic Polynucleotide
taatacgactcactatagggcaatcctcttcttcgtctgcacacagcacaaacagaggagatgtgctatgtgcagacgaaacctggcggcagcgcaaaagatg

SEQ ID NO: 96714 - DNA, 103 bp, Artificial Sequence
  Synthetic Polynucleotide
taatacgactcactatagggggcagcctggcaatcctcttcttcgtctgcaacagaggagagcagacatggaagaggataacctggcggcagcgcaaaagatg

SEQ ID NO: 96715 - DNA, 103 bp, Artificial Sequence
  Synthetic Polynucleotide
taatacgactcactataggggcagcagggaggcagcctggcaatcctcttaacagaggagaaagaggatggccaggctgaacctggcggcagcgcaaaagatg

SEQ ID NO: 96716 - DNA, 103 bp, Artificial Sequence
  Synthetic Polynucleotide
taatacgactcactataggggtgtatttctgcagcagggaggcagcctggaacagaggagaccaggcatgctccctgctaacctggcggcagcgcaaaagatg

SEQ ID NO: 96717 - DNA, 103 bp, Artificial Sequence
  Synthetic Polynucleotide
taatacgactcactataggggctgttgtcggtgtatttctgcagcagggaaacagaggagatccctgatgcagaaatacaacctggcggcagcgcaaaagatg

SEQ ID NO: 96718 - DNA, 103 bp, Artificial Sequence
  Synthetic Polynucleotide
taatacgactcactatagggatggcttctcgctgttgtcggtgtatttctaacagaggagaagaaatatgccgacaacaaacctggcggcagcgcaaaagatg

SEQ ID NO: 96719 - DNA, 103 bp, Artificial Sequence
  Synthetic Polynucleotide
taatacgactcactatagggctcttcccggatggcttctcgctgttgtcgaacagaggagacgacaaatgcgagaagccaacctggcggcagcgcaaaagatg

SEQ ID NO: 96720 - DNA, 103 bp, Artificial Sequence
  Synthetic Polynucleotide
taatacgactcactatagggtttgcacagtctcttcccggatggcttctcaacagaggagagagaagatgtccgggaagaacctggcggcagcgcaaaagatg

SEQ ID NO: 96721 - DNA, 103 bp, Artificial Sequence
  Synthetic Polynucleotide
taatacgactcactatagggagtgtttggttttgcacagtctcttcccggaacagaggagaccgggaatggactgtgcaaacctggcggcagcgcaaaagatg

SEQ ID NO: 96722 - DNA, 103 bp, Artificial Sequence
  Synthetic Polynucleotide
taatacgactcactatagggtgagggatcaagtgtttggttttgcacagtaacagaggagaactgtgatgaaccaaacaaacctggcggcagcgcaaaagatg

SEQ ID NO: 96723 - DNA, 103 bp, Artificial Sequence
  Synthetic Polynucleotide
taatacgactcactataggggaccctctcgctgttcatccagctgtgaacaacagaggagagttcacatgtggatgaacaacctggcggcagcgcaaaagatg

SEQ ID NO: 96724 - DNA, 103 bp, Artificial Sequence
  Synthetic Polynucleotide
taatacgactcactatagggttttccagagacggcagaagcctccactgtaacagaggagaacagtgatggcttctgccaacctggcggcagcgcaaaagatg

SEQ ID NO: 96725 - DNA, 103 bp, Artificial Sequence
  Synthetic Polynucleotide
taatacgactcactatagggcctggactcctgagggatcaagtgtttggtaacagaggagaaccaaaatgttgatccctaacctggcggcagcgcaaaagatg

SEQ ID NO: 96726 - DNA, 103 bp, Artificial Sequence
  Synthetic Polynucleotide
taatacgactcactataggggcaatccccgcctggactcctgagggatcaaacagaggagatgatccatgaggagtccaaacctggcggcagcgcaaaagatg

SEQ ID NO: 96727 - DNA, 103 bp, Artificial Sequence
  Synthetic Polynucleotide
taatacgactcactatagggcctgtcagtggcaatccccgcctggactccaacagaggagaggagtcatggcggggattaacctggcggcagcgcaaaagatg

SEQ ID NO: 96728 - DNA, 103 bp, Artificial Sequence
  Synthetic Polynucleotide
taatacgactcactataggggtagtattcccctgtcagtggcaatccccgaacagaggagacggggaatgccactgacaaacctggcggcagcgcaaaagatg

SEQ ID NO: 96729 - DNA, 103 bp, Artificial Sequence
  Synthetic Polynucleotide
taatacgactcactatagggcattctccacgtagtattcccctgtcagtgaacagaggagacactgaatggggaatactaacctggcggcagcgcaaaagatg

SEQ ID NO: 96730 - DNA, 103 bp, Artificial Sequence
  Synthetic Polynucleotide
taatacgactcactatagggttgccatcggcattctccacgtagtattccaacagaggagaggaataatgcgtggagaaaacctggcggcagcgcaaaagatg

SEQ ID NO: 96731 - DNA, 103 bp, Artificial Sequence
  Synthetic Polynucleotide
taatacgactcactataggggacagtcaccttgccatcggcattctccacaacagaggagagtggagatggccgatggcaacctggcggcagcgcaaaagatg

SEQ ID NO: 96732 - DNA, 103 bp, Artificial Sequence
  Synthetic Polynucleotide
taatacgactcactatagggtgaatctccggacagtcaccttgccatcggaacagaggagaccgatgatgaggtgactgaacctggcggcagcgcaaaagatg

SEQ ID NO: 96733 - DNA, 103 bp, Artificial Sequence
  Synthetic Polynucleotide
taatacgactcactatagggggccgctttctgaatctccggacagtcaccaacagaggagaggtgacatgccggagattaacctggcggcagcgcaaaagatg

SEQ ID NO: 96734 - DNA, 103 bp, Artificial Sequence
  Synthetic Polynucleotide
taatacgactcactatagggactgggctccggccgctttctgaatctccgaacagaggagacggagaatgagaaagcggaacctggcggcagcgcaaaagatg

SEQ ID NO: 96735 - DNA, 103 bp, Artificial Sequence
  Synthetic Polynucleotide
taatacgactcactatagggcatttgggggttttccagagacggcagaagaacagaggagacttctgatgtctctggaaaacctggcggcagcgcaaaagatg

SEQ ID NO: 96736 - DNA, 103 bp, Artificial Sequence
  Synthetic Polynucleotide
taatacgactcactatagggcatagtccgaactgggctccggccgctttcaacagaggagagaaagcatgcggagcccaaacctggcggcagcgcaaaagatg

SEQ ID NO: 96737 - DNA, 103 bp, Artificial Sequence
  Synthetic Polynucleotide
taatacgactcactatagggggtgacagatcatagtccgaactgggctccaacagaggagaggagccatgttcggactaaacctggcggcagcgcaaaagatg

SEQ ID NO: 96738 - DNA, 103 bp, Artificial Sequence
  Synthetic Polynucleotide
taatacgactcactatagggctgcttggctggtgacagatcatagtccgaaacagaggagatcggacatggatctgtcaaacctggcggcagcgcaaaagatg

SEQ ID NO: 96739 - DNA, 103 bp, Artificial Sequence
  Synthetic Polynucleotide
taatacgactcactataggggctttggctcctgcttggctggtgacagataacagaggagaatctgtatgcagccaagcaacctggcggcagcgcaaaagatg

SEQ ID NO: 96740 - DNA, 103 bp, Artificial Sequence
  Synthetic Polynucleotide
taatacgactcactatagggcggtcgaagggctttggctcctgcttggctaacagaggagaagccaaatgggagccaaaaacctggcggcagcgcaaaagatg

SEQ ID NO: 96741 - DNA, 103 bp, Artificial Sequence
  Synthetic Polynucleotide
taatacgactcactatagggttgctgcaagcggtcgaagggctttggctcaacagaggagagagccaatgcccttcgacaacctggcggcagcgcaaaagatg

SEQ ID NO: 96742 - DNA, 103 bp, Artificial Sequence
  Synthetic Polynucleotide
taatacgactcactatagggctggtagcagttgctgcaagcggtcgaaggaacagaggagaccttcgatggcttgcagcaacctggcggcagcgcaaaagatg

SEQ ID NO: 96743 - DNA, 103 bp, Artificial Sequence
  Synthetic Polynucleotide
taatacgactcactataggggactgggaggctggtagcagttgctgcaagaacagaggagacttgcaatgactgctaccaacctggcggcagcgcaaaagatg

SEQ ID NO: 96744 - DNA, 103 bp, Artificial Sequence
  Synthetic Polynucleotide
taatacgactcactatagggcagctgtgtggactgggaggctggtagcagaacagaggagactgctaatggcctcccagaacctggcggcagcgcaaaagatg

SEQ ID NO: 96745 - DNA, 103 bp, Artificial Sequence
  Synthetic Polynucleotide
taatacgactcactatagggttgagcatggcagctgtgtggactgggaggaacagaggagacctcccatgccacacagcaacctggcggcagcgcaaaagatg

SEQ ID NO: 96746 - DNA, 103 bp, Artificial Sequence
  Synthetic Polynucleotide
taatacgactcactataggggcactgaagccatttgggggttttccagagaacagaggagactctggatgacccccaaaaacctggcggcagcgcaaaagatg

SEQ ID NO: 96747 - DNA, 103 bp, Artificial Sequence
  Synthetic Polynucleotide
taatacgactcactatagggtgaggggaacttgagcatggcagctgtgtgaacagaggagacacacaatggccatgctcaacctggcggcagcgcaaaagatg

SEQ ID NO: 96748 - DNA, 103 bp, Artificial Sequence
  Synthetic Polynucleotide
taatacgactcactatagggggtggtctcctgaggggaacttgagcatggaacagaggagaccatgcatgagttcccctaacctggcggcagcgcaaaagatg

SEQ ID NO: 96749 - DNA, 103 bp, Artificial Sequence
  Synthetic Polynucleotide
taatacgactcactatagggggcgagactgggtggtctcctgaggggaacaacagaggagagttcccatgaggagaccaaacctggcggcagcgcaaaagatg

SEQ ID NO: 96750 - DNA, 103 bp, Artificial Sequence
  Synthetic Polynucleotide
taatacgactcactatagggggcggcatagggcgagactgggtggtctccaacagaggagaggagacatgccagtctcgaacctggcggcagcgcaaaagatg

SEQ ID NO: 96751 - DNA, 103 bp, Artificial Sequence
  Synthetic Polynucleotide
taatacgactcactatagggccgtgcttccggcggcatagggcgagactgaacagaggagacagtctatgcctatgccgaacctggcggcagcgcaaaagatg

SEQ ID NO: 96752 - DNA, 103 bp, Artificial Sequence
  Synthetic Polynucleotide
taatacgactcactatagggcaataagtctccgtgcttccggcggcatagaacagaggagactatgcatgcggaagcacaacctggcggcagcgcaaaagatg

SEQ ID NO: 96753 - DNA, 103 bp, Artificial Sequence
  Synthetic Polynucleotide
taatacgactcactatagggttcttattgacaataagtctccgtgcttccaacagaggagaggaagcatggagacttataacctggcggcagcgcaaaagatg

SEQ ID NO: 96754 - DNA, 103 bp, Artificial Sequence
  Synthetic Polynucleotide
taatacgactcactatagggctcgccagcgttcttattgacaataagtctaacagaggagaagacttatggtcaataagaacctggcggcagcgcaaaagatg

SEQ ID NO: 96755 - DNA, 103 bp, Artificial Sequence
  Synthetic Polynucleotide
taatacgactcactataggggcagaagggtctcgccagcgttcttattgaaacagaggagatcaataatgacgctggcgaacctggcggcagcgcaaaagatg

SEQ ID NO: 96756 - DNA, 103 bp, Artificial Sequence
  Synthetic Polynucleotide
taatacgactcactataggggctgcccgctgcagaagggtctcgccagcgaacagaggagacgctggatggacccttctaacctggcggcagcgcaaaagatg

SEQ ID NO: 96757 - DNA, 103 bp, Artificial Sequence
  Synthetic Polynucleotide
taatacgactcactatagggtttgtatatagcactgaagccatttgggggaacagaggagacccccaatgggcttcagtaacctggcggcagcgcaaaagatg

SEQ ID NO: 96758 - DNA, 103 bp, Artificial Sequence
  Synthetic Polynucleotide
taatacgactcactataggggccaagcctggctgcccgctgcagaagggtaacagaggagaacccttatgcagcgggcaaacctggcggcagcgcaaaagatg

SEQ ID NO: 96759 - DNA, 103 bp, Artificial Sequence
  Synthetic Polynucleotide
taatacgactcactatagggcttcctcatagccaagcctggctgcccgctaacagaggagaagcgggatgccaggcttgaacctggcggcagcgcaaaagatg

SEQ ID NO: 96760 - DNA, 103 bp, Artificial Sequence
  Synthetic Polynucleotide
taatacgactcactatagggtacaggaccacttcctcatagccaagcctgaacagaggagacaggctatgctatgaggaaacctggcggcagcgcaaaagatg

SEQ ID NO: 96761 - DNA, 103 bp, Artificial Sequence
  Synthetic Polynucleotide
taatacgactcactatagggctctaagcagtacaggaccacttcctcataaacagaggagatatgagatggtggtcctgaacctggcggcagcgcaaaagatg

SEQ ID NO: 96762 - DNA, 103 bp, Artificial Sequence
  Synthetic Polynucleotide
taatacgactcactatagggaaatcttgttctctaagcagtacaggaccaaacagaggagatggtccatgactgcttagaacctggcggcagcgcaaaagatg

SEQ ID NO: 96763 - DNA, 103 bp, Artificial Sequence
  Synthetic Polynucleotide
taatacgactcactatagggtttacatcacaaatcttgttctctaagcagaacagaggagactgcttatggaacaagataacctggcggcagcgcaaaagatg

SEQ ID NO: 96764 - DNA, 103 bp, Artificial Sequence
  Synthetic Polynucleotide
taatacgactcactataggggtcccgatgatttacatcacaaatcttgttaacagaggagaaacaagatgtgtgatgtaaacctggcggcagcgcaaaagatg

SEQ ID NO: 96765 - DNA, 103 bp, Artificial Sequence
  Synthetic Polynucleotide
taatacgactcactatagggaacctgcgttgtcccgatgatttacatcacaacagaggagagtgatgatgatcatcgggaacctggcggcagcgcaaaagatg

SEQ ID NO: 96766 - DNA, 103 bp, Artificial Sequence
  Synthetic Polynucleotide
taatacgactcactatagggagggcgcagtaacctgcgttgtcccgatgaaacagaggagatcatcgatgcaacgcaggaacctggcggcagcgcaaaagatg

SEQ ID NO: 96767 - DNA, 103 bp, Artificial Sequence
  Synthetic Polynucleotide
taatacgactcactatagggagcttcatgcagggcgcagtaacctgcgttaacagaggagaaacgcaatgtactgcgccaacctggcggcagcgcaaaagatg

SEQ ID NO: 96768 - DNA, 103 bp, Artificial Sequence
  Synthetic Polynucleotide
taatacgactcactatagggcaggcggtgttttgtatatagcactgaagcaacagaggagagcttcaatgctatatacaaacctggcggcagcgcaaaagatg

SEQ ID NO: 96769 - DNA, 103 bp, Artificial Sequence
  Synthetic Polynucleotide
taatacgactcactatagggccctagcacaagcttcatgcagggcgcagtaacagaggagaactgcgatgtgcatgaagaacctggcggcagcgcaaaagatg

SEQ ID NO: 96770 - DNA, 103 bp, Artificial Sequence
  Synthetic Polynucleotide
taatacgactcactatagggttgagccagcccctagcacaagcttcatgcaacagaggagagcatgaatgttgtgctagaacctggcggcagcgcaaaagatg

SEQ ID NO: 96771 - DNA, 103 bp, Artificial Sequence
  Synthetic Polynucleotide
taatacgactcactatagggtcgcacaatgttgagccagcccctagcacaaacagaggagatgtgctatgggctggctcaacctggcggcagcgcaaaagatg

SEQ ID NO: 96772 - DNA, 103 bp, Artificial Sequence
  Synthetic Polynucleotide
taatacgactcactatagggcaaggaggtgtcgcacaatgttgagccagcaacagaggagagctggcatgacattgtgcaacctggcggcagcgcaaaagatg

SEQ ID NO: 96773 - DNA, 103 bp, Artificial Sequence
  Synthetic Polynucleotide
taatacgactcactataggggcgccatattcaaggaggtgtcgcacaatgaacagaggagacattgtatgacacctcctaacctggcggcagcgcaaaagatg

SEQ ID NO: 96774 - DNA, 103 bp, Artificial Sequence
  Synthetic Polynucleotide
taatacgactcactataggggttgacatcagcgccatattcaaggaggtgaacagaggagacacctcatggaatatggcaacctggcggcagcgcaaaagatg

SEQ ID NO: 96775 - DNA, 103 bp, Artificial Sequence
  Synthetic Polynucleotide
taatacgactcactataggggggcactacagttgacatcagcgccatattaacagaggagaaatatgatgctgatgtcaaacctggcggcagcgcaaaagatg

SEQ ID NO: 96776 - DNA, 103 bp, Artificial Sequence
  Synthetic Polynucleotide
taatacgactcactataggggttccatcctgggcactacagttgacatcaaacagaggagatgatgtatgctgtagtgcaacctggcggcagcgcaaaagatg

SEQ ID NO: 96777 - DNA, 103 bp, Artificial Sequence
  Synthetic Polynucleotide
taatacgactcactatagggcagaggcctggttccatcctgggcactacaaacagaggagatgtagtatgcaggatggaaacctggcggcagcgcaaaagatg

SEQ ID NO: 96778 - DNA, 103 bp, Artificial Sequence
  Synthetic Polynucleotide
taatacgactcactatagggcagcatcgtgcagaggcctggttccatcctaacagaggagaaggatgatgccaggcctcaacctggcggcagcgcaaaagatg

SEQ ID NO: 96779 - DNA, 103 bp, Artificial Sequence
  Synthetic Polynucleotide
taatacgactcactatagggttttgtattccaggcggtgttttgtatataaacagaggagatatataatgaacaccgccaacctggcggcagcgcaaaagatg

SEQ ID NO: 96780 - DNA, 103 bp, Artificial Sequence
  Synthetic Polynucleotide
taatacgactcactatagggtcgttctcaacagcatcgtgcagaggcctgaacagaggagacaggccatggcacgatgcaacctggcggcagcgcaaaagatg

SEQ ID NO: 96781 - DNA, 103 bp, Artificial Sequence
  Synthetic Polynucleotide
taatacgactcactatagggttccaagtgatcgttctcaacagcatcgtgaacagaggagacacgatatggttgagaacaacctggcggcagcgcaaaagatg

SEQ ID NO: 96782 - DNA, 103 bp, Artificial Sequence
  Synthetic Polynucleotide
taatacgactcactataggggtcggacaatttccaagtgatcgttctcaaaacagaggagattgagaatgatcacttggaacctggcggcagcgcaaaagatg

SEQ ID NO: 96783 - DNA, 103 bp, Artificial Sequence
  Synthetic Polynucleotide
taatacgactcactataggggagagaagtagtcggacaatttccaagtgaaacagaggagatcacttatgaattgtccgaacctggcggcagcgcaaaagatg

SEQ ID NO: 96784 - DNA, 103 bp, Artificial Sequence
  Synthetic Polynucleotide
taatacgactcactatagggagcaccataagagagaagtagtcggacaataacagaggagaattgtcatgctacttctcaacctggcggcagcgcaaaagatg

SEQ ID NO: 96785 - DNA, 103 bp, Artificial Sequence
  Synthetic Polynucleotide
taatacgactcactatagggaggtggggtcagcaccataagagagaagtaaacagaggagatacttcatgcttatggtgaacctggcggcagcgcaaaagatg

SEQ ID NO: 96786 - DNA, 103 bp, Artificial Sequence
  Synthetic Polynucleotide
taatacgactcactatagggtacgtagccaaggtggggtcagcaccataaaacagaggagattatggatgtgaccccacaacctggcggcagcgcaaaagatg

SEQ ID NO: 96787 - DNA, 103 bp, Artificial Sequence
  Synthetic Polynucleotide
taatacgactcactatagggtctacctgagtacgtagccaaggtggggtcaacagaggagagaccccatgttggctacgaacctggcggcagcgcaaaagatg

SEQ ID NO: 96788 - DNA, 103 bp, Artificial Sequence
  Synthetic Polynucleotide
taatacgactcactatagggtcatgatggttctacctgagtacgtagccaaacagaggagatggctaatgactcaggtaaacctggcggcagcgcaaaagatg

SEQ ID NO: 96789 - DNA, 103 bp, Artificial Sequence
  Synthetic Polynucleotide
taatacgactcactatagggtgggtcattttcatgatggttctacctgagaacagaggagactcaggatgaaccatcataacctggcggcagcgcaaaagatg

SEQ ID NO: 96790 - DNA, 103 bp, Artificial Sequence
  Synthetic Polynucleotide
taatacgactcactatagggtacagcacttttttgtattccaggcggtgtaacagaggagaacaccgatgggaatacaaaacctggcggcagcgcaaaagatg

SEQ ID NO: 96791 - DNA, 103 bp, Artificial Sequence
  Synthetic Polynucleotide
taatacgactcactatagggaagttcactgtgggtcattttcatgatggtaacagaggagaaccatcatgaaaatgaccaacctggcggcagcgcaaaagatg

SEQ ID NO: 96792 - DNA, 103 bp, Artificial Sequence
  Synthetic Polynucleotide
taatacgactcactatagggacttttccataagttcactgtgggtcatttaacagaggagaaaatgaatgacagtgaacaacctggcggcagcgcaaaagatg

SEQ ID NO: 96793 - DNA, 103 bp, Artificial Sequence
  Synthetic Polynucleotide
taatacgactcactatagggtctgttaagaacttttccataagttcactgaacagaggagacagtgaatgtatggaaaaaacctggcggcagcgcaaaagatg

SEQ ID NO: 96794 - DNA, 103 bp, Artificial Sequence
  Synthetic Polynucleotide
taatacgactcactatagggatttaaataatctgttaagaacttttccataacagaggagaatggaaatgttcttaacaaacctggcggcagcgcaaaagatg

SEQ ID NO: 96795 - DNA, 103 bp, Artificial Sequence
  Synthetic Polynucleotide
taatacgactcactatagggcctggaggtcatttaaataatctgttaagaaacagaggagatcttaaatgattatttaaaacctggcggcagcgcaaaagatg

SEQ ID NO: 96796 - DNA, 103 bp, Artificial Sequence
  Synthetic Polynucleotide
taatacgactcactatagggtcattgcgaccctggaggtcatttaaataaaacagaggagattatttatgtgacctccaaacctggcggcagcgcaaaagatg

SEQ ID NO: 96797 - DNA, 103 bp, Artificial Sequence
  Synthetic Polynucleotide
taatacgactcactatagggggcgtcatcatcattgcgaccctggaggtcaacagaggagagacctcatgggtcgcaataacctggcggcagcgcaaaagatg

SEQ ID NO: 96798 - DNA, 103 bp, Artificial Sequence
  Synthetic Polynucleotide
taatacgactcactatagggaagtgccactggcgtcatcatcattgcgacaacagaggagagtcgcaatgatgatgacgaacctggcggcagcgcaaaagatg

SEQ ID NO: 96799 - DNA, 103 bp, Artificial Sequence
  Synthetic Polynucleotide
taatacgactcactatagggtagaagtcccaagtgccactggcgtcatcaaacagaggagatgatgaatgcagtggcacaacctggcggcagcgcaaaagatg

SEQ ID NO: 96800 - DNA, 103 bp, Artificial Sequence
  Synthetic Polynucleotide
taatacgactcactatagggagagctgccatagaagtcccaagtgccactaacagaggagaagtggcatgtgggacttcaacctggcggcagcgcaaaagatg

SEQ ID NO: 96801 - DNA, 103 bp, Artificial Sequence
  Synthetic Polynucleotide
taatacgactcactatagggctgctgtggctacagcacttttttgtattcaacagaggagagaatacatgaaagtgctgaacctggcggcagcgcaaaagatg

SEQ ID NO: 96802 - DNA, 103 bp, Artificial Sequence
  Synthetic Polynucleotide
taatacgactcactataggggttcacaaacagagctgccatagaagtcccaacagaggagagggactatgatggcagctaacctggcggcagcgcaaaagatg

SEQ ID NO: 96803 - DNA, 103 bp, Artificial Sequence
  Synthetic Polynucleotide
taatacgactcactatagggtcatcatctggttcacaaacagagctgccaaacagaggagatggcagatgtgtttgtgaaacctggcggcagcgcaaaagatg

SEQ ID NO: 96804 - DNA, 103 bp, Artificial Sequence
  Synthetic Polynucleotide
taatacgactcactatagggatagccactttcatcatctggttcacaaacaacagaggagagtttgtatgccagatgataacctggcggcagcgcaaaagatg

SEQ ID NO: 96805 - DNA, 103 bp, Artificial Sequence
  Synthetic Polynucleotide
taatacgactcactatagggctaaaacatcatagccactttcatcatctgaacagaggagacagatgatgaaagtggctaacctggcggcagcgcaaaagatg

SEQ ID NO: 96806 - DNA, 103 bp, Artificial Sequence
  Synthetic Polynucleotide
taatacgactcactatagggggggggttggctaaaacatcatagccacttaacagaggagaaagtggatgtgatgttttaacctggcggcagcgcaaaagatg

SEQ ID NO: 96807 - DNA, 103 bp, Artificial Sequence
  Synthetic Polynucleotide
taatacgactcactatagggttctggtcctggggggttggctaaaacatcaacagaggagagatgttatggccaaccccaacctggcggcagcgcaaaagatg

SEQ ID NO: 96808 - DNA, 103 bp, Artificial Sequence
  Synthetic Polynucleotide
taatacgactcactatagggcatcctggtcttctggtcctggggggttggaacagaggagaccaaccatgcaggaccagaacctggcggcagcgcaaaagatg

SEQ ID NO: 96809 - DNA, 103 bp, Artificial Sequence
  Synthetic Polynucleotide
taatacgactcactatagggtcgtcatcatcatcctggtcttctggtcctaacagaggagaaggaccatgagaccaggaaacctggcggcagcgcaaaagatg

SEQ ID NO: 96810 - DNA, 103 bp, Artificial Sequence
  Synthetic Polynucleotide
taatacgactcactataggggctataggcatcgtcatcatcatcctggtcaacagaggagagaccagatggatgatgacaacctggcggcagcgcaaaagatg

SEQ ID NO: 96811 - DNA, 103 bp, Artificial Sequence
  Synthetic Polynucleotide
taatacgactcactatagggcaaacacatcgctataggcatcgtcatcataacagaggagaatgatgatgatgcctataaacctggcggcagcgcaaaagatg

SEQ ID NO: 96812 - DNA, 103 bp, Artificial Sequence
  Synthetic Polynucleotide
taatacgactcactatagggcccagcgcttctgctgtggctacagcacttaacagaggagaaagtgcatgagccacagcaacctggcggcagcgcaaaagatg

SEQ ID NO: 96813 - DNA, 103 bp, Artificial Sequence
  Synthetic Polynucleotide
taatacgactcactatagggaattcaaattcaaacacatcgctataggcaaacagaggagatgcctaatgcgatgtgttaacctggcggcagcgcaaaagatg

SEQ ID NO: 96814 - DNA, 103 bp, Artificial Sequence
  Synthetic Polynucleotide
taatacgactcactatagggggtctctgaaaattcaaattcaaacacatcaacagaggagagatgtgatggaatttgaaaacctggcggcagcgcaaaagatg

SEQ ID NO: 96815 - DNA, 103 bp, Artificial Sequence
  Synthetic Polynucleotide
taatacgactcactataggggtaagaggggggtctctgaaaattcaaattaacagaggagaaatttgatgtttcagagaaacctggcggcagcgcaaaagatg

SEQ ID NO: 96816 - DNA, 103 bp, Artificial Sequence
  Synthetic Polynucleotide
taatacgactcactatagggttataacacggtaagaggggggtctctgaaaacagaggagattcagaatgccccctcttaacctggcggcagcgcaaaagatg

SEQ ID NO: 96817 - DNA, 103 bp, Artificial Sequence
  Synthetic Polynucleotide
taatacgactcactatagggtacttggatgttataacacggtaagaggggaacagaggagacccctcatgccgtgttataacctggcggcagcgcaaaagatg

SEQ ID NO: 96818 - DNA, 103 bp, Artificial Sequence
  Synthetic Polynucleotide
taatacgactcactataggggagccacagatacttggatgttataacacgaacagaggagacgtgttatgacatccaagaacctggcggcagcgcaaaagatg

SEQ ID NO: 96819 - DNA, 103 bp, Artificial Sequence
  Synthetic Polynucleotide
taatacgactcactatagggcgtggcccctgagccacagatacttggatgaacagaggagacatccaatgatctgtggcaacctggcggcagcgcaaaagatg

SEQ ID NO: 96820 - DNA, 103 bp, Artificial Sequence
  Synthetic Polynucleotide
taatacgactcactatagggtagccagtttcgtggcccctgagccacagaaacagaggagatctgtgatgcaggggccaaacctggcggcagcgcaaaagatg

SEQ ID NO: 96821 - DNA, 103 bp, Artificial Sequence
  Synthetic Polynucleotide
taatacgactcactatagggccgaaagcagtagccagtttcgtggcccctaacagaggagaaggggcatggaaactggcaacctggcggcagcgcaaaagatg

SEQ ID NO: 96822 - DNA, 103 bp, Artificial Sequence
  Synthetic Polynucleotide
taatacgactcactatagggttaaggacatccgaaagcagtagccagtttaacagaggagaaaactgatgactgctttcaacctggcggcagcgcaaaagatg

SEQ ID NO: 96823 - DNA, 103 bp, Artificial Sequence
  Synthetic Polynucleotide
taatacgactcactatagggcctgtccaagcccagcgcttctgctgtggcaacagaggagagccacaatggaagcgctgaacctggcggcagcgcaaaagatg

SEQ ID NO: 96824 - DNA, 103 bp, Artificial Sequence
  Synthetic Polynucleotide
taatacgactcactatagggtttcaatttcttaaggacatccgaaagcagaacagaggagactgcttatggatgtccttaacctggcggcagcgcaaaagatg

SEQ ID NO: 96825 - DNA, 103 bp, Artificial Sequence
  Synthetic Polynucleotide
taatacgactcactataggggggaggacattttcaatttcttaaggacataacagaggagaatgtccatgagaaattgaaacctggcggcagcgcaaaagatg

SEQ ID NO: 96826 - DNA, 103 bp, Artificial Sequence
  Synthetic Polynucleotide
taatacgactcactatagggcgaaatatgcgggaggacattttcaatttcaacagaggagagaaattatgaatgtcctcaacctggcggcagcgcaaaagatg

SEQ ID NO: 96827 - DNA, 103 bp, Artificial Sequence
  Synthetic Polynucleotide
taatacgactcactatagggaaaattgcagcgaaatatgcgggaggacataacagaggagaatgtccatgcgcatatttaacctggcggcagcgcaaaagatg

SEQ ID NO: 96828 - DNA, 103 bp, Artificial Sequence
  Synthetic Polynucleotide
taatacgactcactatagggccacgtttggaaaattgcagcgaaatatgcaacagaggagagcatatatggctgcaattaacctggcggcagcgcaaaagatg

SEQ ID NO: 96829 - DNA, 103 bp, Artificial Sequence
  Synthetic Polynucleotide
taatacgactcactataggggtgacaatttccacgtttggaaaattgcagaacagaggagactgcaaatgtccaaacgtaacctggcggcagcgcaaaagatg

SEQ ID NO: 96830 - DNA, 103 bp, Artificial Sequence
  Synthetic Polynucleotide
taatacgactcactatagggctctgcaatggtgacaatttccacgtttggaacagaggagaccaaacatggaaattgtcaacctggcggcagcgcaaaagatg

SEQ ID NO: 96831 - DNA, 103 bp, Artificial Sequence
  Synthetic Polynucleotide
taatacgactcactatagggaaaattctgcctctgcaatggtgacaatttaacagaggagaaaattgatgccattgcagaacctggcggcagcgcaaaagatg

SEQ ID NO: 96832 - DNA, 103 bp, Artificial Sequence
  Synthetic Polynucleotide
taatacgactcactatagggacctgccgataaaattctgcctctgcaatgaacagaggagacattgcatgggcagaattaacctggcggcagcgcaaaagatg

SEQ ID NO: 96833 - DNA, 103 bp, Artificial Sequence
  Synthetic Polynucleotide
taatacgactcactatagggacttgcagaaacctgccgataaaattctgcaacagaggagagcagaaatgtatcggcagaacctggcggcagcgcaaaagatg

SEQ ID NO: 96834 - DNA, 103 bp, Artificial Sequence
  Synthetic Polynucleotide
taatacgactcactatagggcacacatgcggaccctctcgctgttcatccaacagaggagaggatgaatggcgagagggaacctggcggcagcgcaaaagatg

SEQ ID NO: 96835 - DNA, 103 bp, Artificial Sequence
  Synthetic Polynucleotide
taatacgactcactatagggcgctggcaggcctgtccaagcccagcgcttaacagaggagaaagcgcatggcttggacaaacctggcggcagcgcaaaagatg

SEQ ID NO: 96836 - DNA, 103 bp, Artificial Sequence
  Synthetic Polynucleotide
taatacgactcactatagggagaacaagagacttgcagaaacctgccgataacagaggagaatcggcatgtttctgcaaaacctggcggcagcgcaaaagatg

SEQ ID NO: 96837 - DNA, 103 bp, Artificial Sequence
  Synthetic Polynucleotide
taatacgactcactatagggttggagcaagagaacaagagacttgcagaaaacagaggagattctgcatgtctcttgttaacctggcggcagcgcaaaagatg

SEQ ID NO: 96838 - DNA, 103 bp, Artificial Sequence
  Synthetic Polynucleotide
taatacgactcactatagggttccaggtctttggagcaagagaacaagagaacagaggagactcttgatgtcttgctccaacctggcggcagcgcaaaagatg

SEQ ID NO: 96839 - DNA, 103 bp, Artificial Sequence
  Synthetic Polynucleotide
taatacgactcactatagggggttgaaggcttccaggtctttggagcaagaacagaggagacttgctatgaagacctggaacctggcggcagcgcaaaagatg

SEQ ID NO: 96840 - DNA, 103 bp, Artificial Sequence
  Synthetic Polynucleotide
taatacgactcactatagggttactttcagggttgaaggcttccaggtctaacagaggagaagacctatgagccttcaaaacctggcggcagcgcaaaagatg

SEQ ID NO: 96841 - DNA, 103 bp, Artificial Sequence
  Synthetic Polynucleotide
taatacgactcactatagggtaacagctccttactttcagggttgaaggcaacagaggagagccttcatgcctgaaagtaacctggcggcagcgcaaaagatg

SEQ ID NO: 96842 - DNA, 103 bp, Artificial Sequence
  Synthetic Polynucleotide
taatacgactcactatagggccaccagatctaacagctccttactttcagaacagaggagactgaaaatgaggagctgtaacctggcggcagcgcaaaagatg

SEQ ID NO: 96843 - DNA, 103 bp, Artificial Sequence
  Synthetic Polynucleotide
taatacgactcactatagggttcgtgaattccaccagatctaacagctccaacagaggagaggagctatgagatctggtaacctggcggcagcgcaaaagatg

SEQ ID NO: 96844 - DNA, 103 bp, Artificial Sequence
  Synthetic Polynucleotide
taatacgactcactatagggctgaatttcgttcgtgaattccaccagatcaacagaggagagatctgatggaattcacgaacctggcggcagcgcaaaagatg

SEQ ID NO: 96845 - DNA, 103 bp, Artificial Sequence
  Synthetic Polynucleotide
taatacgactcactatagggccagcagagtctgaatttcgttcgtgaattaacagaggagaaattcaatgacgaaattcaacctggcggcagcgcaaaagatg

SEQ ID NO: 96846 - DNA, 103 bp, Artificial Sequence
  Synthetic Polynucleotide
taatacgactcactatagggctctgtttgtcgctggcaggcctgtccaagaacagaggagacttggaatggcctgccagaacctggcggcagcgcaaaagatg

SEQ ID NO: 96847 - DNA, 103 bp, Artificial Sequence
  Synthetic Polynucleotide
taatacgactcactatagggacagaggagcccagcagagtctgaatttcgaacagaggagacgaaatatggactctgctaacctggcggcagcgcaaaagatg

SEQ ID NO: 96848 - DNA, 103 bp, Artificial Sequence
  Synthetic Polynucleotide
taatacgactcactataggggagccactctacagaggagcccagcagagtaacagaggagaactctgatgggctcctctaacctggcggcagcgcaaaagatg

SEQ ID NO: 96849 - DNA, 103 bp, Artificial Sequence
  Synthetic Polynucleotide
taatacgactcactatagggcactggggtggagccactctacagaggagcaacagaggagagctcctatgtagagtggcaacctggcggcagcgcaaaagatg

SEQ ID NO: 96850 - DNA, 103 bp, Artificial Sequence
  Synthetic Polynucleotide
taatacgactcactataggggaggccagatcactggggtggagccactctaacagaggagaagagtgatgccaccccagaacctggcggcagcgcaaaagatg

SEQ ID NO: 96851 - DNA, 103 bp, Artificial Sequence
  Synthetic Polynucleotide
taatacgactcactataggggtagttgtctgaggccagatcactggggtgaacagaggagacaccccatggatctggccaacctggcggcagcgcaaaagatg

SEQ ID NO: 96852 - DNA, 103 bp, Artificial Sequence
  Synthetic Polynucleotide
taatacgactcactataggggttgagagggctctgtttgtcgctggcaggaacagaggagacctgccatggacaaacagaacctggcggcagcgcaaaagatg

SEQ ID NO: 96853 - DNA, 103 bp, Artificial Sequence
  Synthetic Polynucleotide
taatacgactcactatagggcaccattgatgttgagagggctctgtttgtaacagaggagaacaaacatggccctctcaaacctggcggcagcgcaaaagatg

SEQ ID NO: 96854 - DNA, 103 bp, Artificial Sequence
  Synthetic Polynucleotide
taatacgactcactatagggagataactagcaccattgatgttgagagggaacagaggagaccctctatgcatcaatggaacctggcggcagcgcaaaagatg

SEQ ID NO: 96855 - DNA, 103 bp, Artificial Sequence
  Synthetic Polynucleotide
taatacgactcactataggggggcagccgcagataactagcaccattgataacagaggagaatcaatatggctagttataacctggcggcagcgcaaaagatg

SEQ ID NO: 96856 - DNA, 103 bp, Artificial Sequence
  Synthetic Polynucleotide
taatacgactcactataggggattgacccagggcagccgcagataactagaacagaggagactagttatgtgcggctgcaacctggcggcagcgcaaaagatg

SEQ ID NO: 96857 - DNA, 103 bp, Artificial Sequence
  Synthetic Polynucleotide
taatacgactcactatagggtccatgtaaggattgacccagggcagccgcaacagaggagagcggctatgctgggtcaaaacctggcggcagcgcaaaagatg

SEQ ID NO: 96858 - DNA, 103 bp, Artificial Sequence
  Synthetic Polynucleotide
taatacgactcactatagggcgtggcaccctccatgtaaggattgacccaaacagaggagatgggtcatgccttacatgaacctggcggcagcgcaaaagatg

SEQ ID NO: 96859 - DNA, 103 bp, Artificial Sequence
  Synthetic Polynucleotide
taatacgactcactatagggagatggctggcgtggcaccctccatgtaagaacagaggagacttacaatgagggtgccaaacctggcggcagcgcaaaagatg

SEQ ID NO: 96860 - DNA, 103 bp, Artificial Sequence
  Synthetic Polynucleotide
taatacgactcactatagggtcgctcgccccacacatgcggaccctctcgaacagaggagacgagagatgccgcatgtgaacctggcggcagcgcaaaagatg

SEQ ID NO: 96861 - DNA, 103 bp, Artificial Sequence
  Synthetic Polynucleotide
taatacgactcactatagggaggaaagggtagatggctggcgtggcacccaacagaggagagggtgcatggccagccataacctggcggcagcgcaaaagatg

SEQ ID NO: 96862 - DNA, 103 bp, Artificial Sequence
  Synthetic Polynucleotide
taatacgactcactatagggtggcgagtcgaggaaagggtagatggctggaacagaggagaccagccatgtaccctttcaacctggcggcagcgcaaaagatg

SEQ ID NO: 96863 - DNA, 103 bp, Artificial Sequence
  Synthetic Polynucleotide
taatacgactcactatagggaatacttatttggcgagtcgaggaaagggtaacagaggagaacccttatgtcgactcgcaacctggcggcagcgcaaaagatg

SEQ ID NO: 96864 - DNA, 103 bp, Artificial Sequence
  Synthetic Polynucleotide
taatacgactcactatagggatgttcagtgaatacttatttggcgagtcgaacagaggagacgactcatgaaataagtaaacctggcggcagcgcaaaagatg

SEQ ID NO: 96865 - DNA, 103 bp, Artificial Sequence
  Synthetic Polynucleotide
taatacgactcactatagggggccttgtacatgttcagtgaatacttattaacagaggagaaataagatgtcactgaacaacctggcggcagcgcaaaagatg

SEQ ID NO: 96866 - DNA, 103 bp, Artificial Sequence
  Synthetic Polynucleotide
taatacgactcactataggggaggtagcaaggccttgtacatgttcagtgaacagaggagacactgaatgtgtacaaggaacctggcggcagcgcaaaagatg

SEQ ID NO: 96867 - DNA, 103 bp, Artificial Sequence
  Synthetic Polynucleotide
taatacgactcactatagggtaggactgctgaggtagcaaggccttgtacaacagaggagagtacaaatgcttgctaccaacctggcggcagcgcaaaagatg

SEQ ID NO: 96868 - DNA, 103 bp, Artificial Sequence
  Synthetic Polynucleotide
taatacgactcactatagggggccaagctgtaggactgctgaggtagcaaaacagaggagattgctaatgcagcagtccaacctggcggcagcgcaaaagatg

SEQ ID NO: 96869 - DNA, 103 bp, Artificial Sequence
  Synthetic Polynucleotide
taatacgactcactatagggacagcggctgggccaagctgtaggactgctaacagaggagaagcagtatgacagcttggaacctggcggcagcgcaaaagatg

SEQ ID NO: 96870 - DNA, 103 bp, Artificial Sequence
  Synthetic Polynucleotide
taatacgactcactatagggactggagaatacagcggctgggccaagctgaacagaggagacagcttatgccagccgctaacctggcggcagcgcaaaagatg

SEQ ID NO: 96871 - DNA, 103 bp, Artificial Sequence
  Synthetic Polynucleotide
taatacgactcactatagggtttcctgtcttcgctcgccccacacatgcgaacagaggagacgcatgatgggggcgagcaacctggcggcagcgcaaaagatg

SEQ ID NO: 96872 - DNA, 103 bp, Artificial Sequence
  Synthetic Polynucleotide
taatacgactcactatagggattggtgcagactggagaatacagcggctgaacagaggagacagccgatgtattctccaaacctggcggcagcgcaaaagatg

SEQ ID NO: 96873 - DNA, 103 bp, Artificial Sequence
  Synthetic Polynucleotide
taatacgactcactatagggagcgctccccattggtgcagactggagaataacagaggagaattctcatgtctgcaccaaacctggcggcagcgcaaaagatg

SEQ ID NO: 96874 - DNA, 103 bp, Artificial Sequence
  Synthetic Polynucleotide
taatacgactcactatagggaggtagagaaagcgctccccattggtgcagaacagaggagactgcacatgtggggagcgaacctggcggcagcgcaaaagatg

SEQ ID NO: 96875 - DNA, 103 bp, Artificial Sequence
  Synthetic Polynucleotide
taatacgactcactatagggaggtggcggcaggtagagaaagcgctccccaacagaggagaggggagatgtttctctacaacctggcggcagcgcaaaagatg

SEQ ID NO: 96876 - DNA, 103 bp, Artificial Sequence
  Synthetic Polynucleotide
taatacgactcactatagggcgacgtagtgaggtggcggcaggtagagaaaacagaggagattctctatgtgccgccacaacctggcggcagcgcaaaagatg

SEQ ID NO: 96877 - DNA, 103 bp, Artificial Sequence
  Synthetic Polynucleotide
taatacgactcactatagggatgtggggaccgacgtagtgaggtggcggcaacagaggagagccgccatgtcactacgtaacctggcggcagcgcaaaagatg

SEQ ID NO: 96878 - DNA, 103 bp, Artificial Sequence
  Synthetic Polynucleotide
taatacgactcactatagggggacgatgggatgtggggaccgacgtagtgaacagaggagacactacatgggtccccacaacctggcggcagcgcaaaagatg

SEQ ID NO: 96879 - DNA, 103 bp, Artificial Sequence
  Synthetic Polynucleotide
taatacgactcactataggggtgatgccaaggacgatgggatgtggggacaacagaggagagtccccatgtcccatcgtaacctggcggcagcgcaaaagatg

SEQ ID NO: 96880 - DNA, 103 bp, Artificial Sequence
  Synthetic Polynucleotide
taatacgactcactatagggagcctcatgggtgatgccaaggacgatgggaacagaggagacccatcatgcttggcatcaacctggcggcagcgcaaaagatg

SEQ ID NO: 96881 - DNA, 103 bp, Artificial Sequence
  Synthetic Polynucleotide
taatacgactcactatagggaggtgtcgagagcctcatgggtgatgccaaaacagaggagattggcaatgcccatgaggaacctggcggcagcgcaaaagatg

SEQ ID NO: 96882 - DNA, 103 bp, Artificial Sequence
  Synthetic Polynucleotide
taatacgactcactatagggttacaaggattttcctgtcttcgctcgcccaacagaggagagggcgaatgaagacaggaaacctggcggcagcgcaaaagatg

SEQ ID NO: 96883 - DNA, 103 bp, Artificial Sequence
  Synthetic Polynucleotide
taatacgactcactataggggggaggccgaaggtgtcgagagcctcatggaacagaggagaccatgaatgtctcgacacaacctggcggcagcgcaaaagatg

SEQ ID NO: 96884 - DNA, 103 bp, Artificial Sequence
  Synthetic Polynucleotide
taatacgactcactataggggggatggctggggaggccgaaggtgtcgagaacagaggagactcgacatgttcggcctcaacctggcggcagcgcaaaagatg

SEQ ID NO: 96885 - DNA, 103 bp, Artificial Sequence
  Synthetic Polynucleotide
taatacgactcactataggggacgagaggcgggatggctggggaggccgaaacagaggagatcggccatgccagccatcaacctggcggcagcgcaaaagatg

SEQ ID NO: 96886 - DNA, 103 bp, Artificial Sequence
  Synthetic Polynucleotide
taatacgactcactatagggctgcgcaatggacgagaggcgggatggctgaacagaggagacagccaatgcgcctctcgaacctggcggcagcgcaaaagatg

SEQ ID NO: 96887 - DNA, 103 bp, Artificial Sequence
  Synthetic Polynucleotide
taatacgactcactatagggaggcttttgtctgcgcaatggacgagaggcaacagaggagagcctctatgccattgcgcaacctggcggcagcgcaaaagatg

SEQ ID NO: 96888 - DNA, 103 bp, Artificial Sequence
  Synthetic Polynucleotide
taatacgactcactatagggcttccacgggaggcttttgtctgcgcaatgaacagaggagacattgcatggacaaaagcaacctggcggcagcgcaaaagatg

SEQ ID NO: 96889 - DNA, 103 bp, Artificial Sequence
  Synthetic Polynucleotide
taatacgactcactatagggtgacgcccatcttccacgggaggcttttgtaacagaggagaacaaaaatgtcccgtggaaacctggcggcagcgcaaaagatg

SEQ ID NO: 96890 - DNA, 103 bp, Artificial Sequence
  Synthetic Polynucleotide
taatacgactcactatagggttcccagggctgacgcccatcttccacgggaacagaggagacccgtgatggatgggcgtaacctggcggcagcgcaaaagatg

SEQ ID NO: 96891 - DNA, 103 bp, Artificial Sequence
  Synthetic Polynucleotide
taatacgactcactatagggatcaacaggattcccagggctgacgcccataacagaggagaatgggcatgagccctgggaacctggcggcagcgcaaaagatg

SEQ ID NO: 96892 - DNA, 103 bp, Artificial Sequence
  Synthetic Polynucleotide
taatacgactcactatagggaggcgtgggaatcaacaggattcccagggcaacagaggagagccctgatgatcctgttgaacctggcggcagcgcaaaagatg

SEQ ID NO: 96893 - DNA, 103 bp, Artificial Sequence
  Synthetic Polynucleotide
taatacgactcactatagggtcaccatcatttacaaggattttcctgtctaacagaggagaagacagatgaatccttgtaacctggcggcagcgcaaaagatg

SEQ ID NO: 96894 - DNA, 103 bp, Artificial Sequence
  Synthetic Polynucleotide
taatacgactcactatagggatgtgaggataggcgtgggaatcaacaggaaacagaggagatcctgtatgttcccacgcaacctggcggcagcgcaaaagatg

SEQ ID NO: 96895 - DNA, 103 bp, Artificial Sequence
  Synthetic Polynucleotide
taatacgactcactatagggactgttctggatgtgaggataggcgtgggaaacagaggagatcccacatgtatcctcacaacctggcggcagcgcaaaagatg

SEQ ID NO: 96896 - DNA, 103 bp, Artificial Sequence
  Synthetic Polynucleotide
taatacgactcactatagggtgggctgcttactgttctggatgtgaggataacagaggagaatcctcatgtccagaacaaacctggcggcagcgcaaaagatg

SEQ ID NO: 96897 - DNA, 103 bp, Artificial Sequence
  Synthetic Polynucleotide
taatacgactcactataggggagggaaccctgggctgcttactgttctggaacagaggagaccagaaatgtaagcagccaacctggcggcagcgcaaaagatg

SEQ ID NO: 96898 - DNA, 103 bp, Artificial Sequence
  Synthetic Polynucleotide
taatacgactcactatagggcgccttggcagagggaaccctgggctgcttaacagaggagaaagcagatgagggttcccaacctggcggcagcgcaaaagatg

SEQ ID NO: 96899 - DNA, 103 bp, Artificial Sequence
  Synthetic Polynucleotide
taatacgactcactatagggcactggtgaccgccttggcagagggaacccaacagaggagagggttcatgctgccaaggaacctggcggcagcgcaaaagatg

SEQ ID NO: 96900 - DNA, 103 bp, Artificial Sequence
  Synthetic Polynucleotide
taatacgactcactatagggcccggcaggccactggtgaccgccttggcaaacagaggagatgccaaatgggtcaccagaacctggcggcagcgcaaaagatg

SEQ ID NO: 96901 - DNA, 103 bp, Artificial Sequence
  Synthetic Polynucleotide
taatacgactcactatagggagctgtgtcccccggcaggccactggtgacaacagaggagagtcaccatgggcctgccgaacctggcggcagcgcaaaagatg

SEQ ID NO: 96902 - DNA, 103 bp, Artificial Sequence
  Synthetic Polynucleotide
taatacgactcactataggggcaacaggagagctgtgtcccccggcaggcaacagaggagagcctgcatggggacacagaacctggcggcagcgcaaaagatg

SEQ ID NO: 96903 - DNA, 103 bp, Artificial Sequence
  Synthetic Polynucleotide
taatacgactcactatagggggcgaggggggcaacaggagagctgtgtccaacagaggagaggacacatgtctcctgttaacctggcggcagcgcaaaagatg

SEQ ID NO: 96904 - DNA, 103 bp, Artificial Sequence
  Synthetic Polynucleotide
taatacgactcactataggggcgccgtgggggccggttcttggtcttcataacagaggagaatgaagatgaagaaccggaacctggcggcagcgcaaaagatg

SEQ ID NO: 96905 - DNA, 103 bp, Artificial Sequence
  Synthetic Polynucleotide
taatacgactcactatagggacccttggccggctctggccccgggttcggaacagaggagaccgaacatggggccagagaacctggcggcagcgcaaaagatg

SEQ ID NO: 96906 - DNA, 103 bp, Artificial Sequence
  Synthetic Polynucleotide
taatacgactcactatagggggctccgcagacccttggccggctctggccaacagaggagaggccagatgcggccaaggaacctggcggcagcgcaaaagatg

SEQ ID NO: 96907 - DNA, 103 bp, Artificial Sequence
  Synthetic Polynucleotide
taatacgactcactatagggcgggccggccggctccgcagacccttggccaacagaggagaggccaaatgtctgcggagaacctggcggcagcgcaaaagatg

SEQ ID NO: 96908 - DNA, 103 bp, Artificial Sequence
  Synthetic Polynucleotide
taatacgactcactatagggtgctgcggcccgggccggccggctccgcagaacagaggagactgcggatgcggccggccaacctggcggcagcgcaaaagatg

SEQ ID NO: 96909 - DNA, 103 bp, Artificial Sequence
  Synthetic Polynucleotide
taatacgactcactatagggccggagcccttgctgcggcccgggccggccaacagaggagaggccggatggggccgcagaacctggcggcagcgcaaaagatg

SEQ ID NO: 96910 - DNA, 103 bp, Artificial Sequence
  Synthetic Polynucleotide
taatacgactcactatagggctgccctcgcccggagcccttgctgcggccaacagaggagaggccgcatgaagggctccaacctggcggcagcgcaaaagatg

SEQ ID NO: 96911 - DNA, 103 bp, Artificial Sequence
  Synthetic Polynucleotide
taatacgactcactatagggccgcctgcgcctgccctcgcccggagccctaacagaggagaagggctatgggcgagggcaacctggcggcagcgcaaaagatg

SEQ ID NO: 96912 - DNA, 103 bp, Artificial Sequence
  Synthetic Polynucleotide
taatacgactcactatagggagggtcctggccgcctgcgcctgccctcgcaacagaggagagcgaggatgggcgcaggcaacctggcggcagcgcaaaagatg

SEQ ID NO: 96913 - DNA, 103 bp, Artificial Sequence
  Synthetic Polynucleotide
taatacgactcactatagggccgggcccggagggtcctggccgcctgcgcaacagaggagagcgcagatggccaggaccaacctggcggcagcgcaaaagatg

SEQ ID NO: 96914 - DNA, 103 bp, Artificial Sequence
  Synthetic Polynucleotide
taatacgactcactatagggacgacggccaccgggcccggagggtcctggaacagaggagaccaggaatgtccgggcccaacctggcggcagcgcaaaagatg

SEQ ID NO: 96915 - DNA, 103 bp, Artificial Sequence
  Synthetic Polynucleotide
taatacgactcactatagggccggggcccggcgccgtgggggccggttctaacagaggagaagaaccatgccccacggcaacctggcggcagcgcaaaagatg

SEQ ID NO: 96916 - DNA, 103 bp, Artificial Sequence
  Synthetic Polynucleotide
taatacgactcactatagggtgctgctgtcacgacggccaccgggcccggaacagaggagaccgggcatggtggccgtcaacctggcggcagcgcaaaagatg

SEQ ID NO: 96917 - DNA, 103 bp, Artificial Sequence
  Synthetic Polynucleotide
taatacgactcactatagggcgccgctggatgctgctgtcacgacggccaaacagaggagatggccgatgtgacagcagaacctggcggcagcgcaaaagatg

SEQ ID NO: 96918 - DNA, 103 bp, Artificial Sequence
  Synthetic Polynucleotide
taatacgactcactataggggctctccagccgccgctggatgctgctgtcaacagaggagagacagcatgatccagcggaacctggcggcagcgcaaaagatg

SEQ ID NO: 96919 - DNA, 103 bp, Artificial Sequence
  Synthetic Polynucleotide
taatacgactcactatagggccctctcgttgctctccagccgccgctggaaacagaggagatccagcatgggctggagaaacctggcggcagcgcaaaagatg

SEQ ID NO: 96920 - DNA, 103 bp, Artificial Sequence
  Synthetic Polynucleotide
taatacgactcactatagggcgctgccgctccctctcgttgctctccagcaacagaggagagctggaatgcaacgagagaacctggcggcagcgcaaaagatg

SEQ ID NO: 96921 - DNA, 103 bp, Artificial Sequence
  Synthetic Polynucleotide
taatacgactcactatagggcttgtgcatccgctgccgctccctctcgttaacagaggagaaacgagatggagcggcagaacctggcggcagcgcaaaagatg

SEQ ID NO: 96922 - DNA, 103 bp, Artificial Sequence
  Synthetic Polynucleotide
taatacgactcactatagggcgttatttagcttgtgcatccgctgccgctaacagaggagaagcggcatgggatgcacaaacctggcggcagcgcaaaagatg

SEQ ID NO: 96923 - DNA, 103 bp, Artificial Sequence
  Synthetic Polynucleotide
taatacgactcactataggggcctggaaggcgttatttagcttgtgcatcaacagaggagagatgcaatggctaaataaaacctggcggcagcgcaaaagatg

SEQ ID NO: 96924 - DNA, 103 bp, Artificial Sequence
  Synthetic Polynucleotide
taatacgactcactatagggttcacgcagggcctggaaggcgttatttagaacagaggagactaaatatggccttccagaacctggcggcagcgcaaaagatg

SEQ ID NO: 96925 - DNA, 103 bp, Artificial Sequence
  Synthetic Polynucleotide
taatacgactcactataggggggggatgacttcacgcagggcctggaaggaacagaggagaccttccatgccctgcgtgaacctggcggcagcgcaaaagatg

SEQ ID NO: 96926 - DNA, 103 bp, Artificial Sequence
  Synthetic Polynucleotide
taatacgactcactataggggtgtcctgcaccggggcccggcgccgtgggaacagaggagacccacgatgccgggccccaacctggcggcagcgcaaaagatg

SEQ ID NO: 96927 - DNA, 103 bp, Artificial Sequence
  Synthetic Polynucleotide
taatacgactcactataggggcgcgcacgtgggggatgacttcacgcaggaacagaggagacctgcgatgagtcatcccaacctggcggcagcgcaaaagatg

SEQ ID NO: 96928 - DNA, 103 bp, Artificial Sequence
  Synthetic Polynucleotide
taatacgactcactatagggcttcttgtccgcgcgcacgtgggggatgacaacagaggagagtcatcatgcacgtgcgcaacctggcggcagcgcaaaagatg

SEQ ID NO: 96929 - DNA, 103 bp, Artificial Sequence
  Synthetic Polynucleotide
taatacgactcactatagggtcttggagagcttcttgtccgcgcgcacgtaacagaggagaacgtgcatgcggacaagaaacctggcggcagcgcaaaagatg

SEQ ID NO: 96930 - DNA, 103 bp, Artificial Sequence
  Synthetic Polynucleotide
taatacgactcactatagggagcgtctcgatcttggagagcttcttgtccaacagaggagaggacaaatggctctccaaaacctggcggcagcgcaaaagatg

SEQ ID NO: 96931 - DNA, 103 bp, Artificial Sequence
  Synthetic Polynucleotide
taatacgactcactatagggggccagcgtgagcgtctcgatcttggagagaacagaggagactctccatgatcgagacgaacctggcggcagcgcaaaagatg

SEQ ID NO: 96932 - DNA, 103 bp, Artificial Sequence
  Synthetic Polynucleotide
taatacgactcactatagggtgtagttcttggccagcgtgagcgtctcgaaacagaggagatcgagaatgtcacgctggaacctggcggcagcgcaaaagatg

SEQ ID NO: 96933 - DNA, 103 bp, Artificial Sequence
  Synthetic Polynucleotide
taatacgactcactatagggagcgatttgatgtagttcttggccagcgtgaacagaggagacacgctatgcaagaactaaacctggcggcagcgcaaaagatg

SEQ ID NO: 96934 - DNA, 103 bp, Artificial Sequence
  Synthetic Polynucleotide
taatacgactcactatagggggtggccgtcagcgatttgatgtagttcttaacagaggagaaagaacatgatcaaatcgaacctggcggcagcgcaaaagatg

SEQ ID NO: 96935 - DNA, 103 bp, Artificial Sequence
  Synthetic Polynucleotide
taatacgactcactatagggtggtcaggatggtggccgtcagcgatttgaaacagaggagatcaaatatgtgacggccaaacctggcggcagcgcaaaagatg

SEQ ID NO: 96936 - DNA, 103 bp, Artificial Sequence
  Synthetic Polynucleotide
taatacgactcactatagggctgctggacatggtcaggatggtggccgtcaacagaggagagacggcatgcatcctgacaacctggcggcagcgcaaaagatg

SEQ ID NO: 96937 - DNA, 103 bp, Artificial Sequence
  Synthetic Polynucleotide
taatacgactcactatagggggtggcctctgtgtcctgcaccggggcccgaacagaggagacgggccatggtgcaggacaacctggcggcagcgcaaaagatg

SEQ ID NO: 96938 - DNA, 103 bp, Artificial Sequence
  Synthetic Polynucleotide
taatacgactcactatagggtgggaggcggctgctggacatggtcaggataacagaggagaatcctgatgatgtccagcaacctggcggcagcgcaaaagatg

SEQ ID NO: 96939 - DNA, 103 bp, Artificial Sequence
  Synthetic Polynucleotide
taatacgactcactatagggcctccaggcctgggaggcggctgctggacaaacagaggagatgtccaatggccgcctccaacctggcggcagcgcaaaagatg

SEQ ID NO: 96940 - DNA, 103 bp, Artificial Sequence
  Synthetic Polynucleotide
taatacgactcactataggggggcccggcccctccaggcctgggaggcggaacagaggagaccgcctatgaggcctggaaacctggcggcagcgcaaaagatg

SEQ ID NO: 96941 - DNA, 103 bp, Artificial Sequence
  Synthetic Polynucleotide
taatacgactcactataggggtagagcttggggcccggcccctccaggccaacagaggagaggcctgatggggccgggcaacctggcggcagcgcaaaagatg

SEQ ID NO: 96942 - DNA, 103 bp, Artificial Sequence
  Synthetic Polynucleotide
taatacgactcactatagggggtagtgctggtagagcttggggcccggccaacagaggagaggccggatgccaagctctaacctggcggcagcgcaaaagatg

SEQ ID NO: 96943 - DNA, 103 bp, Artificial Sequence
  Synthetic Polynucleotide
taatacgactcactatagggtgctgctgctggtagtgctggtagagcttgaacagaggagacaagctatgccagcactaaacctggcggcagcgcaaaagatg

SEQ ID NO: 96944 - DNA, 103 bp, Artificial Sequence
  Synthetic Polynucleotide
taatacgactcactatagggagccacctgctgctgctgctggtagtgctgaacagaggagacagcacatgcagcagcagaacctggcggcagcgcaaaagatg

SEQ ID NO: 96945 - DNA, 103 bp, Artificial Sequence
  Synthetic Polynucleotide
taatacgactcactatagggacgcacccccagccacctgctgctgctgctaacagaggagaagcagcatgagcaggtggaacctggcggcagcgcaaaagatg

SEQ ID NO: 96946 - DNA, 103 bp, Artificial Sequence
  Synthetic Polynucleotide
taatacgactcactataggggtggcccccaacgcacccccagccacctgcaacagaggagagcaggtatgtgggggtgcaacctggcggcagcgcaaaagatg

SEQ ID NO: 96947 - DNA, 103 bp, Artificial Sequence
  Synthetic Polynucleotide
taatacgactcactatagggctgggcctccgtggcccccaacgcacccccaacagaggagagggggtatgttgggggccaacctggcggcagcgcaaaagatg

SEQ ID NO: 96948 - DNA, 103 bp, Artificial Sequence
  Synthetic Polynucleotide
taatacgactcactatagggcctccccgggggtggcctctgtgtcctgcaaacagaggagatgcaggatgcagaggccaaacctggcggcagcgcaaaagatg

SEQ ID NO: 96949 - DNA, 103 bp, Artificial Sequence
  Synthetic Polynucleotide
taatacgactcactatagggggccctggggctgggcctccgtggcccccaaacagaggagatgggggatgcggaggcccaacctggcggcagcgcaaaagatg

SEQ ID NO: 96950 - DNA, 103 bp, Artificial Sequence
  Synthetic Polynucleotide
taatacgactcactatagggctctgcaggtggccctggggctgggcctccaacagaggagaggaggcatggccccagggaacctggcggcagcgcaaaagatg

SEQ ID NO: 96951 - DNA, 103 bp, Artificial Sequence
  Synthetic Polynucleotide
taatacgactcactatagggcgtggagtacctctgcaggtggccctggggaacagaggagaccccagatgcacctgcagaacctggcggcagcgcaaaagatg

SEQ ID NO: 96952 - DNA, 103 bp, Artificial Sequence
  Synthetic Polynucleotide
taatacgactcactatagggtgtggatctgcgtggagtacctctgcaggtaacagaggagaacctgcatgggtactccaaacctggcggcagcgcaaaagatg

SEQ ID NO: 96953 - DNA, 103 bp, Artificial Sequence
  Synthetic Polynucleotide
taatacgactcactatagggtctcggaagctgtggatctgcgtggagtacaacagaggagagtactcatggcagatccaaacctggcggcagcgcaaaagatg

SEQ ID NO: 96954 - DNA, 103 bp, Artificial Sequence
  Synthetic Polynucleotide
taatacgactcactatagggctaggtgccctctcggaagctgtggatctgaacagaggagacagatcatgagcttccgaaacctggcggcagcgcaaaagatg

SEQ ID NO: 96955 - DNA, 103 bp, Artificial Sequence
  Synthetic Polynucleotide
taatacgactcactatagggtcgggcgtcccctccccgggggtggcctctaacagaggagaagaggcatgccccggggaaacctggcggcagcgcaaaagatg

SEQ ID NO: 96956 - DNA, 103 bp, Artificial Sequence
  Synthetic Polynucleotide
taatacgactcactatagggcagggacccgtcgggcgtcccctccccgggaacagaggagacccgggatggggacgcccaacctggcggcagcgcaaaagatg

SEQ ID NO: 96957 - DNA, 103 bp, Artificial Sequence
  Synthetic Polynucleotide
taatacgactcactatagggccgggttcggcagggacccgtcgggcgtccaacagaggagaggacgcatgacgggtcccaacctggcggcagcgcaaaagatg

SEQ ID NO: 96958 - DNA, 103 bp, Artificial Sequence
  Synthetic Polynucleotide
taatacgactcactatagggggctctggccccgggttcggcagggacccgaacagaggagacgggtcatggccgaacccaacctggcggcagcgcaaaagatg

SEQ ID NO: 96959 - DNA, 103 bp, Artificial Sequence
  Synthetic Polynucleotide
taatacgactcactataggggggtggttgcgcgctggggatccgctccataacagaggagaatggagatgatccccagcaacctggcggcagcgcaaaagatg

SEQ ID NO: 96960 - DNA, 103 bp, Artificial Sequence
  Synthetic Polynucleotide
taatacgactcactatagggtcttgacttgtacacttggtacatgtgggcaacagaggagagcccacatgtaccaagtgaacctggcggcagcgcaaaagatg

SEQ ID NO: 96961 - DNA, 103 bp, Artificial Sequence
  Synthetic Polynucleotide
taatacgactcactatagggctccagcatgggcaggtaggcagtcgctgaaacagaggagatcagcgatggcctacctgaacctggcggcagcgcaaaagatg

SEQ ID NO: 96962 - DNA, 103 bp, Artificial Sequence
  Synthetic Polynucleotide
taatacgactcactatagggaccagcacttctccagcatgggcaggtaggaacagaggagacctaccatgccatgctggaacctggcggcagcgcaaaagatg

SEQ ID NO: 96963 - DNA, 103 bp, Artificial Sequence
  Synthetic Polynucleotide
taatacgactcactataggggaggtgggataccagcacttctccagcatgaacagaggagacatgctatggaagtgctgaacctggcggcagcgcaaaagatg

SEQ ID NO: 96964 - DNA, 103 bp, Artificial Sequence
  Synthetic Polynucleotide
taatacgactcactatagggcactggcactgaggtgggataccagcacttaacagaggagaaagtgcatgtatcccaccaacctggcggcagcgcaaaagatg

SEQ ID NO: 96965 - DNA, 103 bp, Artificial Sequence
  Synthetic Polynucleotide
taatacgactcactatagggctgggtatagcactggcactgaggtgggataacagaggagaatcccaatgcagtgccagaacctggcggcagcgcaaaagatg

SEQ ID NO: 96966 - DNA, 103 bp, Artificial Sequence
  Synthetic Polynucleotide
taatacgactcactataggggcgttgaggcctgggtatagcactggcactaacagaggagaagtgccatggctatacccaacctggcggcagcgcaaaagatg

SEQ ID NO: 96967 - DNA, 103 bp, Artificial Sequence
  Synthetic Polynucleotide
taatacgactcactatagggtgcggcagaggcgttgaggcctgggtatagaacagaggagactatacatgggcctcaacaacctggcggcagcgcaaaagatg

SEQ ID NO: 96968 - DNA, 103 bp, Artificial Sequence
  Synthetic Polynucleotide
taatacgactcactatagggtagagagggctgcggcagaggcgttgaggcaacagaggagagcctcaatgcctctgccgaacctggcggcagcgcaaaagatg

SEQ ID NO: 96969 - DNA, 103 bp, Artificial Sequence
  Synthetic Polynucleotide
taatacgactcactatagggttcatgaagctagagagggctgcggcagagaacagaggagactctgcatgagccctctcaacctggcggcagcgcaaaagatg

SEQ ID NO: 96970 - DNA, 103 bp, Artificial Sequence
  Synthetic Polynucleotide
taatacgactcactatagggcttgtctgggttcatgaagctagagagggcaacagaggagagccctcatgagcttcatgaacctggcggcagcgcaaaagatg

SEQ ID NO: 96971 - DNA, 103 bp, Artificial Sequence
  Synthetic Polynucleotide
taatacgactcactatagggttattccccgtcttgacttgtacacttggtaacagaggagaaccaagatgacaagtcaaaacctggcggcagcgcaaaagatg

SEQ ID NO: 96972 - DNA, 103 bp, Artificial Sequence
  Synthetic Polynucleotide
taatacgactcactataggggagccgagatcttgtctgggttcatgaagcaacagaggagagcttcaatgacccagacaaacctggcggcagcgcaaaagatg

SEQ ID NO: 96973 - DNA, 103 bp, Artificial Sequence
  Synthetic Polynucleotide
taatacgactcactatagggatgagcaagggagccgagatcttgtctgggaacagaggagacccagaatggatctcggcaacctggcggcagcgcaaaagatg

SEQ ID NO: 96974 - DNA, 103 bp, Artificial Sequence
  Synthetic Polynucleotide
taatacgactcactatagggtctctggggcatgagcaagggagccgagataacagaggagaatctcgatgcccttgctcaacctggcggcagcgcaaaagatg

SEQ ID NO: 96975 - DNA, 103 bp, Artificial Sequence
  Synthetic Polynucleotide
taatacgactcactataggggagaagggagtctctggggcatgagcaaggaacagaggagaccttgcatgtgccccagaaacctggcggcagcgcaaaagatg

SEQ ID NO: 96976 - DNA, 103 bp, Artificial Sequence
  Synthetic Polynucleotide
taatacgactcactataggggctggcaagggagaagggagtctctggggcaacagaggagagccccaatgactcccttcaacctggcggcagcgcaaaagatg

SEQ ID NO: 96977 - DNA, 103 bp, Artificial Sequence
  Synthetic Polynucleotide
taatacgactcactatagggggacggatgagctggcaagggagaagggagaacagaggagactccctatgcccttgccaaacctggcggcagcgcaaaagatg

SEQ ID NO: 96978 - DNA, 103 bp, Artificial Sequence
  Synthetic Polynucleotide
taatacgactcactatagggaagagtcgacggacggatgagctggcaaggaacagaggagaccttgcatgctcatccgtaacctggcggcagcgcaaaagatg

SEQ ID NO: 96979 - DNA, 103 bp, Artificial Sequence
  Synthetic Polynucleotide
taatacgactcactatagggagcaagacagaagagtcgacggacggatgaaacagaggagatcatccatgcgtcgactcaacctggcggcagcgcaaaagatg

SEQ ID NO: 96980 - DNA, 103 bp, Artificial Sequence
  Synthetic Polynucleotide
taatacgactcactatagggcagagcttggagcaagacagaagagtcgacaacagaggagagtcgacatgtctgtcttgaacctggcggcagcgcaaaagatg

SEQ ID NO: 96981 - DNA, 103 bp, Artificial Sequence
  Synthetic Polynucleotide
taatacgactcactatagggggattggcttcagagcttggagcaagacagaacagaggagactgtctatgtccaagctcaacctggcggcagcgcaaaagatg

SEQ ID NO: 96982 - DNA, 103 bp, Artificial Sequence
  Synthetic Polynucleotide
taatacgactcactatagggtcgctccgctttattccccgtcttgacttgaacagaggagacaagtcatgacggggaataacctggcggcagcgcaaaagatg

SEQ ID NO: 96983 - DNA, 103 bp, Artificial Sequence
  Synthetic Polynucleotide
taatacgactcactatagggtttaaaggggggattggcttcagagcttggaacagaggagaccaagcatggaagccaataacctggcggcagcgcaaaagatg

SEQ ID NO: 96984 - DNA, 103 bp, Artificial Sequence
  Synthetic Polynucleotide
taatacgactcactatagggggtttctaagtttaaaggggggattggcttaacagaggagaaagccaatgccccctttaaacctggcggcagcgcaaaagatg

SEQ ID NO: 96985 - DNA, 103 bp, Artificial Sequence
  Synthetic Polynucleotide
taatacgactcactatagggcttgctgtcctcgctccgctttattccccgaacagaggagacggggaatgaagcggagcaacctggcggcagcgcaaaagatg

SEQ ID NO: 96986 - DNA, 103 bp, Artificial Sequence
  Synthetic Polynucleotide
taatacgactcactatagggtgtaggtctccttgctgtcctcgctccgctaacagaggagaagcggaatgaggacagcaaacctggcggcagcgcaaaagatg

SEQ ID NO: 96987 - DNA, 103 bp, Artificial Sequence
  Synthetic Polynucleotide
taatacgactcactatagggtgcggcaatttgtaggtctccttgctgtccaacagaggagaggacagatgggagacctaaacctggcggcagcgcaaaagatg

SEQ ID NO: 96988 - DNA, 103 bp, Artificial Sequence
  Synthetic Polynucleotide
taatacgactcactataggggatgagccggtgcggcaatttgtaggtctcaacagaggagagagaccatgaaattgccgaacctggcggcagcgcaaaagatg

SEQ ID NO: 96989 - DNA, 103 bp, Artificial Sequence
  Synthetic Polynucleotide
taatacgactcactatagggtctttttctcgatgagccggtgcggcaattaacagaggagaaattgcatgaccggctcaaacctggcggcagcgcaaaagatg

SEQ ID NO: 96990 - DNA, 103 bp, Artificial Sequence
  Synthetic Polynucleotide
taatacgactcactatagggcggtcacgtctctttttctcgatgagccggaacagaggagaccggctatgcgagaaaaaaacctggcggcagcgcaaaagatg

SEQ ID NO: 96991 - DNA, 103 bp, Artificial Sequence
  Synthetic Polynucleotide
taatacgactcactatagggctcgttaatccggtcacgtctctttttctcaacagaggagagagaaaatgagacgtgacaacctggcggcagcgcaaaagatg

SEQ ID NO: 96992 - DNA, 103 bp, Artificial Sequence
  Synthetic Polynucleotide
taatacgactcactatagggggcaggcggggggtggttgcgcgctggggaaacagaggagatccccaatgcgcaaccacaacctggcggcagcgcaaaagatg

SEQ ID NO: 96993 - DNA, 103 bp, Artificial Sequence
  Synthetic Polynucleotide
taatacgactcactataggggggcgatgcactcgttaatccggtcacgtcaacagaggagagacgtgatgggattaacgaacctggcggcagcgcaaaagatg

SEQ ID NO: 96994 - DNA, 103 bp, Artificial Sequence
  Synthetic Polynucleotide
taatacgactcactatagggtccttcagctgggcgatgcactcgttaatcaacagaggagagattaaatggtgcatcgcaacctggcggcagcgcaaaagatg

SEQ ID NO: 96995 - DNA, 103 bp, Artificial Sequence
  Synthetic Polynucleotide
taatacgactcactataggggggtaggagatccttcagctgggcgatgcaaacagaggagatgcatcatgcagctgaagaacctggcggcagcgcaaaagatg

SEQ ID NO: 96996 - DNA, 103 bp, Artificial Sequence
  Synthetic Polynucleotide
taatacgactcactatagggtgagatgttcgggtaggagatccttcagctaacagaggagaagctgaatgatctcctacaacctggcggcagcgcaaaagatg

SEQ ID NO: 96997 - DNA, 103 bp, Artificial Sequence
  Synthetic Polynucleotide
taatacgactcactataggggttgtaagtttgagatgttcgggtaggagaaacagaggagatctcctatgcgaacatctaacctggcggcagcgcaaaagatg

SEQ ID NO: 96998 - DNA, 103 bp, Artificial Sequence
  Synthetic Polynucleotide
taatacgactcactataggggtgacccaaagttgtaagtttgagatgttcaacagaggagagaacatatgaaacttacaaacctggcggcagcgcaaaagatg

SEQ ID NO: 96999 - DNA, 103 bp, Artificial Sequence
  Synthetic Polynucleotide
taatacgactcactatagggctttttccaagtgacccaaagttgtaagttaacagaggagaaacttaatgctttgggtcaacctggcggcagcgcaaaagatg

SEQ ID NO: 97000 - DNA, 103 bp, Artificial Sequence
  Synthetic Polynucleotide
taatacgactcactatagggagaaccactgctttttccaagtgacccaaaaacagaggagatttgggatgcttggaaaaaacctggcggcagcgcaaaagatg

SEQ ID NO: 97001 - DNA, 103 bp, Artificial Sequence
  Synthetic Polynucleotide
taatacgactcactatagggggtaagttcaagaaccactgctttttccaaaacagaggagattggaaatggcagtggttaacctggcggcagcgcaaaagatg

SEQ ID NO: 97002 - DNA, 103 bp, Artificial Sequence
  Synthetic Polynucleotide
taatacgactcactatagggcatgcttcaaggtaagttcaagaaccactgaacagaggagacagtggatgttgaacttaaacctggcggcagcgcaaaagatg

SEQ ID NO: 97003 - DNA, 103 bp, Artificial Sequence
  Synthetic Polynucleotide
taatacgactcactataggggctttgggcaggcaggcggggggtggttgcaacagaggagagcaaccatgccccgcctgaacctggcggcagcgcaaaagatg

SEQ ID NO: 97004 - DNA, 103 bp, Artificial Sequence
  Synthetic Polynucleotide
taatacgactcactatagggagtgctttcacatgcttcaaggtaagttcaaacagaggagatgaactatgcttgaagcaaacctggcggcagcgcaaaagatg

SEQ ID NO: 97005 - DNA, 103 bp, Artificial Sequence
  Synthetic Polynucleotide
taatacgactcactatagggtaggtttgttagtgctttcacatgcttcaaaacagaggagattgaagatggtgaaagcaaacctggcggcagcgcaaaagatg

SEQ ID NO: 97006 - DNA, 103 bp, Artificial Sequence
  Synthetic Polynucleotide
taatacgactcactataggggctgatcaattaggtttgttagtgctttcaaacagaggagatgaaagatgtaacaaaccaacctggcggcagcgcaaaagatg

SEQ ID NO: 97007 - DNA, 103 bp, Artificial Sequence
  Synthetic Polynucleotide
taatacgactcactatagggttctgctgctgctgatcaattaggtttgttaacagaggagaaacaaaatgaattgatcaaacctggcggcagcgcaaaagatg

SEQ ID NO: 97008 - DNA, 103 bp, Artificial Sequence
  Synthetic Polynucleotide
taatacgactcactatagggggcaatgattttctgctgctgctgatcaataacagaggagaattgatatgcagcagcagaacctggcggcagcgcaaaagatg

SEQ ID NO: 97009 - DNA, 103 bp, Artificial Sequence
  Synthetic Polynucleotide
taatacgactcactatagggcactctgcagggcaatgattttctgctgctaacagaggagaagcagcatgaaatcattgaacctggcggcagcgcaaaagatg

SEQ ID NO: 97010 - DNA, 103 bp, Artificial Sequence
  Synthetic Polynucleotide
taatacgactcactataggggcttgtaaaccactctgcagggcaatgattaacagaggagaaatcatatgcctgcagagaacctggcggcagcgcaaaagatg

SEQ ID NO: 97011 - DNA, 103 bp, Artificial Sequence
  Synthetic Polynucleotide
taatacgactcactatagggcagctcaccagcttgtaaaccactctgcagaacagaggagactgcagatgggtttacaaaacctggcggcagcgcaaaagatg

SEQ ID NO: 97012 - DNA, 103 bp, Artificial Sequence
  Synthetic Polynucleotide
taatacgactcactatagggttctccctgacagctcaccagcttgtaaacaacagaggagagtttacatgctggtgagcaacctggcggcagcgcaaaagatg

SEQ ID NO: 97013 - DNA, 103 bp, Artificial Sequence
  Synthetic Polynucleotide
taatacgactcactataggggtttcgacatttctccctgacagctcaccaaacagaggagatggtgaatggtcagggagaacctggcggcagcgcaaaagatg

SEQ ID NO: 97014 - DNA, 103 bp, Artificial Sequence
  Synthetic Polynucleotide
taatacgactcactatagggcagtcccggtgctttgggcaggcaggcgggaacagaggagacccgccatgctgcccaaaaacctggcggcagcgcaaaagatg

SEQ ID NO: 97015 - DNA, 103 bp, Artificial Sequence
  Synthetic Polynucleotide
taatacgactcactatagggctcttgacctgtttcgacatttctccctgaaacagaggagatcagggatgaatgtcgaaaacctggcggcagcgcaaaagatg

SEQ ID NO: 97016 - DNA, 103 bp, Artificial Sequence
  Synthetic Polynucleotide
taatacgactcactatagggagcagaacatctcttgacctgtttcgacataacagaggagaatgtcgatgcaggtcaagaacctggcggcagcgcaaaagatg

SEQ ID NO: 97017 - DNA, 103 bp, Artificial Sequence
  Synthetic Polynucleotide
taatacgactcactatagggtggaaacctgagcagaacatctcttgacctaacagaggagaaggtcaatggatgttctgaacctggcggcagcgcaaaagatg

SEQ ID NO: 97018 - DNA, 103 bp, Artificial Sequence
  Synthetic Polynucleotide
taatacgactcactatagggggcacatgtctggaaacctgagcagaacataacagaggagaatgttcatgtcaggtttcaacctggcggcagcgcaaaagatg

SEQ ID NO: 97019 - DNA, 103 bp, Artificial Sequence
  Synthetic Polynucleotide
taatacgactcactataggggcacctcccgggcacatgtctggaaacctgaacagaggagacaggttatgagacatgtgaacctggcggcagcgcaaaagatg

SEQ ID NO: 97020 - DNA, 103 bp, Artificial Sequence
  Synthetic Polynucleotide
taatacgactcactatagggagatactgaagcacctcccgggcacatgtcaacagaggagagacatgatgccgggaggtaacctggcggcagcgcaaaagatg

SEQ ID NO: 97021 - DNA, 103 bp, Artificial Sequence
  Synthetic Polynucleotide
taatacgactcactataggggtgcttggccagatactgaagcacctcccgaacagaggagacgggagatgcttcagtataacctggcggcagcgcaaaagatg

SEQ ID NO: 97022 - DNA, 103 bp, Artificial Sequence
  Synthetic Polynucleotide
taatacgactcactataggggagtgttctcgtgcttggccagatactgaaaacagaggagattcagtatgtggccaagcaacctggcggcagcgcaaaagatg

SEQ ID NO: 97023 - DNA, 103 bp, Artificial Sequence
  Synthetic Polynucleotide
taatacgactcactatagggttcaggtcccgagtgttctcgtgcttggccaacagaggagaggccaaatgcgagaacacaacctggcggcagcgcaaaagatg

SEQ ID NO: 97024 - DNA, 103 bp, Artificial Sequence
  Synthetic Polynucleotide
taatacgactcactatagggctgcgaagacttcaggtcccgagtgttctcaacagaggagagagaacatgcgggacctgaacctggcggcagcgcaaaagatg

SEQ ID NO: 97025 - DNA, 103 bp, Artificial Sequence
  Synthetic Polynucleotide
taatacgactcactatagggctccgtgctccagtcccggtgctttgggcaaacagaggagatgcccaatgcaccgggacaacctggcggcagcgcaaaagatg

SEQ ID NO: 97026 - DNA, 103 bp, Artificial Sequence
  Synthetic Polynucleotide
taatacgactcactataggggggtgacaagctgcgaagacttcaggtcccaacagaggagagggaccatgagtcttcgcaacctggcggcagcgcaaaagatg

SEQ ID NO: 97027 - DNA, 103 bp, Artificial Sequence
  Synthetic Polynucleotide
taatacgactcactatagggcggtggaggtgggtgacaagctgcgaagacaacagaggagagtcttcatggcttgtcacaacctggcggcagcgcaaaagatg

SEQ ID NO: 97028 - DNA, 103 bp, Artificial Sequence
  Synthetic Polynucleotide
taatacgactcactatagggcgagaccacccggtggaggtgggtgacaagaacagaggagacttgtcatgcacctccacaacctggcggcagcgcaaaagatg

SEQ ID NO: 97029 - DNA, 103 bp, Artificial Sequence
  Synthetic Polynucleotide
taatacgactcactataggggcagcagctccgagaccacccggtggaggtaacagaggagaacctccatggggtggtctaacctggcggcagcgcaaaagatg

SEQ ID NO: 97030 - DNA, 103 bp, Artificial Sequence
  Synthetic Polynucleotide
taatacgactcactataggggtaccaccctgcagcagctccgagaccaccaacagaggagaggtggtatgggagctgctaacctggcggcagcgcaaaagatg

SEQ ID NO: 97031 - DNA, 103 bp, Artificial Sequence
  Synthetic Polynucleotide
taatacgactcactatagggcttcctggaggtaccaccctgcagcagctcaacagaggagagagctgatgcagggtggtaacctggcggcagcgcaaaagatg

SEQ ID NO: 97032 - DNA, 103 bp, Artificial Sequence
  Synthetic Polynucleotide
taatacgactcactatagggggtctgatggcttcctggaggtaccaccctaacagaggagaagggtgatgcctccaggaaacctggcggcagcgcaaaagatg

SEQ ID NO: 97033 - DNA, 103 bp, Artificial Sequence
  Synthetic Polynucleotide
taatacgactcactatagggttgggagctgggtctgatggcttcctggagaacagaggagactccagatggccatcagaaacctggcggcagcgcaaaagatg

SEQ ID NO: 97034 - DNA, 103 bp, Artificial Sequence
  Synthetic Polynucleotide
taatacgactcactataggggtccatcactttgggagctgggtctgatggaacagaggagaccatcaatgccagctcccaacctggcggcagcgcaaaagatg

SEQ ID NO: 97035 - DNA, 103 bp, Artificial Sequence
  Synthetic Polynucleotide
taatacgactcactatagggtttccttgaagtccatcactttgggagctgaacagaggagacagctcatgaagtgatggaacctggcggcagcgcaaaagatg

SEQ ID NO: 97036 - DNA, 103 bp, Artificial Sequence
  Synthetic Polynucleotide
taatacgactcactatagggcctggtaggtctccgtgctccagtcccggtaacagaggagaaccgggatgggagcacggaacctggcggcagcgcaaaagatg

SEQ ID NO: 97037 - DNA, 103 bp, Artificial Sequence
  Synthetic Polynucleotide
taatacgactcactataggggagctgggtttttccttgaagtccatcactaacagaggagaagtgatatgcttcaaggaaacctggcggcagcgcaaaagatg

SEQ ID NO: 97038 - DNA, 103 bp, Artificial Sequence
  Synthetic Polynucleotide
taatacgactcactatagggtttggccggagagctgggtttttccttgaaaacagaggagattcaagatgaaacccagcaacctggcggcagcgcaaaagatg

SEQ ID NO: 97039 - DNA, 103 bp, Artificial Sequence
  Synthetic Polynucleotide
taatacgactcactatagggcttccgaacctttggccggagagctgggttaacagaggagaaacccaatgctccggccaaacctggcggcagcgcaaaagatg

SEQ ID NO: 97040 - DNA, 103 bp, Artificial Sequence
  Synthetic Polynucleotide
taatacgactcactatagggttcccaggaccttccgaacctttggccggaaacagaggagatccggcatgaggttcggaaacctggcggcagcgcaaaagatg

SEQ ID NO: 97041 - DNA, 103 bp, Artificial Sequence
  Synthetic Polynucleotide
taatacgactcactatagggcacgcagtttttcccaggaccttccgaaccaacagaggagaggttcgatgggtcctgggaacctggcggcagcgcaaaagatg

SEQ ID NO: 97042 - DNA, 103 bp, Artificial Sequence
  Synthetic Polynucleotide
taatacgactcactatagggggatgactggcacgcagtttttcccaggacaacagaggagagtcctgatgaaaactgcgaacctggcggcagcgcaaaagatg

SEQ ID NO: 97043 - DNA, 103 bp, Artificial Sequence
  Synthetic Polynucleotide
taatacgactcactatagggaaagtccgctggatgactggcacgcagtttaacagaggagaaaactgatggccagtcataacctggcggcagcgcaaaagatg

SEQ ID NO: 97044 - DNA, 103 bp, Artificial Sequence
  Synthetic Polynucleotide
taatacgactcactatagggcgagtgagcgaaagtccgctggatgactggaacagaggagaccagtcatgcagcggactaacctggcggcagcgcaaaagatg

SEQ ID NO: 97045 - DNA, 103 bp, Artificial Sequence
  Synthetic Polynucleotide
taatacgactcactataggggctccccactcgagtgagcgaaagtccgctaacagaggagaagcggaatgtcgctcactaacctggcggcagcgcaaaagatg

SEQ ID NO: 97046 - DNA, 103 bp, Artificial Sequence
  Synthetic Polynucleotide
taatacgactcactatagggctgccgctctgctccccactcgagtgagcgaacagaggagacgctcaatggagtggggaaacctggcggcagcgcaaaagatg

SEQ ID NO: 97047 - DNA, 103 bp, Artificial Sequence
  Synthetic Polynucleotide
taatacgactcactatagggagggtacatccctggtaggtctccgtgctcaacagaggagagagcacatggacctaccaaacctggcggcagcgcaaaagatg

SEQ ID NO: 97048 - DNA, 103 bp, Artificial Sequence
  Synthetic Polynucleotide
taatacgactcactataggggtccgtgtcgctgccgctctgctccccactaacagaggagaagtgggatgcagagcggcaacctggcggcagcgcaaaagatg

SEQ ID NO: 97049 - DNA, 103 bp, Artificial Sequence
  Synthetic Polynucleotide
taatacgactcactatagggcactgtctgtgtccgtgtcgctgccgctctaacagaggagaagagcgatggcgacacggaacctggcggcagcgcaaaagatg

SEQ ID NO: 97050 - DNA, 103 bp, Artificial Sequence
  Synthetic Polynucleotide
taatacgactcactatagggcctccatagccactgtctgtgtccgtgtcgaacagaggagacgacacatgcacagacagaacctggcggcagcgcaaaagatg

SEQ ID NO: 97051 - DNA, 103 bp, Artificial Sequence
  Synthetic Polynucleotide
taatacgactcactatagggctccgattctcctccatagccactgtctgtaacagaggagaacagacatgggctatggaaacctggcggcagcgcaaaagatg

SEQ ID NO: 97052 - DNA, 103 bp, Artificial Sequence
  Synthetic Polynucleotide
taatacgactcactatagggagtcgcccttctccgattctcctccatagcaacagaggagagctatgatggagaatcggaacctggcggcagcgcaaaagatg

SEQ ID NO: 97053 - DNA, 103 bp, Artificial Sequence
  Synthetic Polynucleotide
taatacgactcactatagggtcactgcgcaagtcgcccttctccgattctaacagaggagaagaatcatggaagggcgaaacctggcggcagcgcaaaagatg

SEQ ID NO: 97054 - DNA, 103 bp, Artificial Sequence
  Synthetic Polynucleotide
taatacgactcactataggggcacggctgctcactgcgcaagtcgcccttaacagaggagaaagggcatgttgcgcagtaacctggcggcagcgcaaaagatg

SEQ ID NO: 97055 - DNA, 103 bp, Artificial Sequence
  Synthetic Polynucleotide
taatacgactcactatagggcacttttgaagcacggctgctcactgcgcaaacagaggagatgcgcaatgagcagccgtaacctggcggcagcgcaaaagatg

SEQ ID NO: 97056 - DNA, 103 bp, Artificial Sequence
  Synthetic Polynucleotide
taatacgactcactatagggcgtccgtggtcacttttgaagcacggctgcaacagaggagagcagccatgcttcaaaagaacctggcggcagcgcaaaagatg

SEQ ID NO: 97057 - DNA, 103 bp, Artificial Sequence
  Synthetic Polynucleotide
taatacgactcactatagggcgtgaacctgcgtccgtggtcacttttgaaaacagaggagattcaaaatggaccacggaaacctggcggcagcgcaaaagatg

SEQ ID NO: 97058 - DNA, 103 bp, Artificial Sequence
  Synthetic Polynucleotide
taatacgactcactatagggacatgtgggcagggtacatccctggtaggtaacagaggagaacctacatgggatgtaccaacctggcggcagcgcaaaagatg

SEQ ID NO: 97059 - DNA, 103 bp, Artificial Sequence
  Synthetic Polynucleotide
taatacgactcactatagggtttctcccatcgtgaacctgcgtccgtggtaacagaggagaaccacgatggcaggttcaaacctggcggcagcgcaaaagatg

SEQ ID NO: 97060 - DNA, 103 bp, Artificial Sequence
  Synthetic Polynucleotide
taatacgactcactataggggcgccgatcctttctcccatcgtgaacctgaacagaggagacaggttatggatgggagaaacctggcggcagcgcaaaagatg

SEQ ID NO: 97061 - DNA, 103 bp, Artificial Sequence
  Synthetic Polynucleotide
taatacgactcactatagggttgcttaattgcgccgatcctttctcccataacagaggagaatgggaatgaggatcggcaacctggcggcagcgcaaaagatg

SEQ ID NO: 97062 - DNA, 103 bp, Artificial Sequence
  Synthetic Polynucleotide
taatacgactcactatagggcttcggactcttgcttaattgcgccgatccaacagaggagaggatcgatgcaattaagcaacctggcggcagcgcaaaagatg

SEQ ID NO: 97063 - DNA, 103 bp, Artificial Sequence
  Synthetic Polynucleotide
taatacgactcactataggggtggggggttcttcggactcttgcttaattaacagaggagaaattaaatgagagtccgaaacctggcggcagcgcaaaagatg

SEQ ID NO: 97064 - DNA, 103 bp, Artificial Sequence
  Synthetic Polynucleotide
taatacgactcactataggggttcttttttgtggggggttcttcggactcaacagaggagagagtccatggaaccccccaacctggcggcagcgcaaaagatg

SEQ ID NO: 97065 - DNA, 103 bp, Artificial Sequence
  Synthetic Polynucleotide
taatacgactcactataggggctgcatccggttcttttttgtggggggttaacagaggagaaaccccatgcaaaaaagaaacctggcggcagcgcaaaagatg

SEQ ID NO: 97066 - DNA, 103 bp, Artificial Sequence
  Synthetic Polynucleotide
taatacgactcactatagggtcatccgaaagctgcatccggttcttttttaacagaggagaaaaaaaatgccggatgcaaacctggcggcagcgcaaaagatg

SEQ ID NO: 97067 - DNA, 103 bp, Artificial Sequence
  Synthetic Polynucleotide
taatacgactcactatagggatggccttcatcatccgaaagctgcatccgaacagaggagacggatgatgctttcggataacctggcggcagcgcaaaagatg

SEQ ID NO: 97068 - DNA, 103 bp, Artificial Sequence
  Synthetic Polynucleotide
taatacgactcactatagggtgctagtgaaatggccttcatcatccgaaaaacagaggagatttcggatgatgaaggccaacctggcggcagcgcaaaagatg

SEQ ID NO: 97069 - DNA, 103 bp, Artificial Sequence
  Synthetic Polynucleotide
taatacgactcactatagggtacacttggtacatgtgggcagggtacatcaacagaggagagatgtaatgtgcccacataacctggcggcagcgcaaaagatg

SEQ ID NO: 97070 - DNA, 103 bp, Artificial Sequence
  Synthetic Polynucleotide
taatacgactcactatagggatcaggtcactgctagtgaaatggccttcaaacagaggagatgaaggatgtttcactagaacctggcggcagcgcaaaagatg

SEQ ID NO: 97071 - DNA, 103 bp, Artificial Sequence
  Synthetic Polynucleotide
taatacgactcactatagggcggggagctgatcaggtcactgctagtgaaaacagaggagattcactatgagtgacctgaacctggcggcagcgcaaaagatg

SEQ ID NO: 97072 - DNA, 103 bp, Artificial Sequence
  Synthetic Polynucleotide
taatacgactcactatagggggcccaggaacggggagctgatcaggtcacaacagaggagagtgaccatgtcagctcccaacctggcggcagcgcaaaagatg

SEQ ID NO: 97073 - DNA, 103 bp, Artificial Sequence
  Synthetic Polynucleotide
taatacgactcactatagggtgtgggtgtgggcccaggaacggggagctgaacagaggagacagctcatggttcctgggaacctggcggcagcgcaaaagatg

SEQ ID NO: 97074 - DNA, 103 bp, Artificial Sequence
  Synthetic Polynucleotide
taatacgactcactatagggaggaggctggtgtgggtgtgggcccaggaaaacagaggagattcctgatgccacacccaaacctggcggcagcgcaaaagatg

SEQ ID NO: 97075 - DNA, 103 bp, Artificial Sequence
  Synthetic Polynucleotide
taatacgactcactataggggcaggcagaaaggaggctggtgtgggtgtgaacagaggagacacaccatgaccagcctcaacctggcggcagcgcaaaagatg

SEQ ID NO: 97076 - DNA, 103 bp, Artificial Sequence
  Synthetic Polynucleotide
taatacgactcactatagggaggtagaagggcaggcagaaaggaggctggaacagaggagaccagccatgtttctgcctaacctggcggcagcgcaaaagatg

SEQ ID NO: 97077 - DNA, 103 bp, Artificial Sequence
  Synthetic Polynucleotide
taatacgactcactatagggaggtgggatcaggtagaagggcaggcagaaaacagaggagattctgcatgcccttctacaacctggcggcagcgcaaaagatg

SEQ ID NO: 97078 - DNA, 103 bp, Artificial Sequence
  Synthetic Polynucleotide
taatacgactcactatagggcagtcgctgaaggtgggatcaggtagaaggaacagaggagaccttctatgtgatcccacaacctggcggcagcgcaaaagatg

SEQ ID NO: 97079 - DNA, 103 bp, Artificial Sequence
  Synthetic Polynucleotide
taatacgactcactatagggggcaggtaggcagtcgctgaaggtgggatcaacagaggagagatcccatgttcagcgacaacctggcggcagcgcaaaagatg

SEQ ID NO: 97080 - DNA, 103 bp, Artificial Sequence
  Synthetic Polynucleotide
taatacgactcactatagggctcttgcaaatgaggaattccttcgtccataacagaggagaatggacatgggaattcctaacctggcggcagcgcaaaagatg

SEQ ID NO: 97081 - DNA, 103 bp, Artificial Sequence
  Synthetic Polynucleotide
taatacgactcactataggggtcgtctcgtttcatgctccttttgggtttaacagaggagaaaacccatgaggagcatgaacctggcggcagcgcaaaagatg

SEQ ID NO: 97082 - DNA, 103 bp, Artificial Sequence
  Synthetic Polynucleotide
taatacgactcactataggggggctgcgggaagggcgcgcctccgcctccaacagaggagaggaggcatgggcgcgcccaacctggcggcagcgcaaaagatg

SEQ ID NO: 97083 - DNA, 103 bp, Artificial Sequence
  Synthetic Polynucleotide
taatacgactcactatagggcggcggccgcgggctgcgggaagggcgcgcaacagaggagagcgcgcatgtcccgcagcaacctggcggcagcgcaaaagatg

SEQ ID NO: 97084 - DNA, 103 bp, Artificial Sequence
  Synthetic Polynucleotide
taatacgactcactatagggaagggggccgcggcggccgcgggctgcgggaacagaggagacccgcaatgcgcggccgcaacctggcggcagcgcaaaagatg

SEQ ID NO: 97085 - DNA, 103 bp, Artificial Sequence
  Synthetic Polynucleotide
taatacgactcactataggggggcaggcagaagggggccgcggcggccgcaacagaggagagcggccatggcggcccccaacctggcggcagcgcaaaagatg

SEQ ID NO: 97086 - DNA, 103 bp, Artificial Sequence
  Synthetic Polynucleotide
taatacgactcactatagggggaagcagaagggcaggcagaagggggccgaacagaggagacggcccatgtctgcctgcaacctggcggcagcgcaaaagatg

SEQ ID NO: 97087 - DNA, 103 bp, Artificial Sequence
  Synthetic Polynucleotide
taatacgactcactataggggaaggcgagaggaagcagaagggcaggcagaacagaggagactgcctatgcttctgcttaacctggcggcagcgcaaaagatg

SEQ ID NO: 97088 - DNA, 103 bp, Artificial Sequence
  Synthetic Polynucleotide
taatacgactcactatagggggcagctgcagaaggcgagaggaagcagaaaacagaggagattctgcatgctctcgcctaacctggcggcagcgcaaaagatg

SEQ ID NO: 97089 - DNA, 103 bp, Artificial Sequence
  Synthetic Polynucleotide
taatacgactcactataggggcacgtaggcggcagctgcagaaggcgagaaacagaggagatctcgcatgctgcagctgaacctggcggcagcgcaaaagatg

SEQ ID NO: 97090 - DNA, 103 bp, Artificial Sequence
  Synthetic Polynucleotide
taatacgactcactatagggaggaagggctgcacgtaggcggcagctgcaaacagaggagatgcagcatgcgcctacgtaacctggcggcagcgcaaaagatg

SEQ ID NO: 97091 - DNA, 103 bp, Artificial Sequence
  Synthetic Polynucleotide
taatacgactcactataggggctcttgtccaggaagggctgcacgtaggcaacagaggagagcctacatgcagcccttcaacctggcggcagcgcaaaagatg

SEQ ID NO: 97092 - DNA, 103 bp, Artificial Sequence
  Synthetic Polynucleotide
taatacgactcactatagggtatccttggtgtcgtctcgtttcatgctccaacagaggagaggagcaatgaacgagacgaacctggcggcagcgcaaaagatg

SEQ ID NO: 97093 - DNA, 103 bp, Artificial Sequence
  Synthetic Polynucleotide
taatacgactcactatagggtctccaggccgctcttgtccaggaagggctaacagaggagaagccctatgtggacaagaaacctggcggcagcgcaaaagatg

SEQ ID NO: 97094 - DNA, 103 bp, Artificial Sequence
  Synthetic Polynucleotide
taatacgactcactatagggtacagatacttctccaggccgctcttgtccaacagaggagaggacaaatgcggcctggaaacctggcggcagcgcaaaagatg

SEQ ID NO: 97095 - DNA, 103 bp, Artificial Sequence
  Synthetic Polynucleotide
taatacgactcactatagggcgccgccgggtacagatacttctccaggccaacagaggagaggcctgatgaagtatctgaacctggcggcagcgcaaaagatg

SEQ ID NO: 97096 - DNA, 103 bp, Artificial Sequence
  Synthetic Polynucleotide
taatacgactcactataggggggcggcagccgccgccgggtacagatactaacagaggagaagtatcatgacccggcggaacctggcggcagcgcaaaagatg

SEQ ID NO: 97097 - DNA, 103 bp, Artificial Sequence
  Synthetic Polynucleotide
taatacgactcactatagggagcgggaacggggcggcagccgccgccgggaacagaggagacccggcatgggctgccgcaacctggcggcagcgcaaaagatg

SEQ ID NO: 97098 - DNA, 103 bp, Artificial Sequence
  Synthetic Polynucleotide
taatacgactcactatagggggggtatagcagcgggaacggggcggcagcaacagaggagagctgccatgccgttcccgaacctggcggcagcgcaaaagatg

SEQ ID NO: 97099 - DNA, 103 bp, Artificial Sequence
  Synthetic Polynucleotide
taatacgactcactatagggcggggatgccggggtatagcagcgggaacgaacagaggagacgttccatgtgctataccaacctggcggcagcgcaaaagatg

SEQ ID NO: 97100 - DNA, 103 bp, Artificial Sequence
  Synthetic Polynucleotide
taatacgactcactataggggccgccggggcggggatgccggggtatagcaacagaggagagctataatgcggcatcccaacctggcggcagcgcaaaagatg

SEQ ID NO: 97101 - DNA, 103 bp, Artificial Sequence
  Synthetic Polynucleotide
taatacgactcactatagggtgccgcggctgccgccggggcggggatgccaacagaggagaggcatcatggccccggcgaacctggcggcagcgcaaaagatg

SEQ ID NO: 97102 - DNA, 103 bp, Artificial Sequence
  Synthetic Polynucleotide
taatacgactcactatagggcggcggcggctgccgcggctgccgccggggaacagaggagaccccggatgcagccgcggaacctggcggcagcgcaaaagatg

SEQ ID NO: 97103 - DNA, 103 bp, Artificial Sequence
  Synthetic Polynucleotide
taatacgactcactatagggaatttgtaggtatccttggtgtcgtctcgtaacagaggagaacgagaatgcaccaaggaaacctggcggcagcgcaaaagatg

SEQ ID NO: 97104 - DNA, 103 bp, Artificial Sequence
  Synthetic Polynucleotide
taatacgactcactataggggcggcagcggcggcggcggctgccgcggctaacagaggagaagccgcatgagccgccgcaacctggcggcagcgcaaaagatg

SEQ ID NO: 97105 - DNA, 103 bp, Artificial Sequence
  Synthetic Polynucleotide
taatacgactcactatagggggcggcggcggcggcagcggcggcggcggcaacagaggagagccgccatggccgctgccaacctggcggcagcgcaaaagatg

SEQ ID NO: 97106 - DNA, 103 bp, Artificial Sequence
  Synthetic Polynucleotide
taatacgactcactatagggaggggaacgcggcggcggcggcggcagcggaacagaggagaccgctgatgccgccgccgaacctggcggcagcgcaaaagatg

SEQ ID NO: 97107 - DNA, 103 bp, Artificial Sequence
  Synthetic Polynucleotide
taatacgactcactataggggaggacaggcaggggaacgcggcggcggcgaacagaggagacgccgcatgcgcgttcccaacctggcggcagcgcaaaagatg

SEQ ID NO: 97108 - DNA, 103 bp, Artificial Sequence
  Synthetic Polynucleotide
taatacgactcactatagggcgacaacaccgaggacaggcaggggaacgcaacagaggagagcgttcatgtgcctgtccaacctggcggcagcgcaaaagatg

SEQ ID NO: 97109 - DNA, 103 bp, Artificial Sequence
  Synthetic Polynucleotide
taatacgactcactatagggcgggagggggcgacaacaccgaggacaggcaacagaggagagcctgtatgcggtgttgtaacctggcggcagcgcaaaagatg

SEQ ID NO: 97110 - DNA, 103 bp, Artificial Sequence
  Synthetic Polynucleotide
taatacgactcactatagggcccgccttctcgggagggggcgacaacaccaacagaggagaggtgttatggccccctccaacctggcggcagcgcaaaagatg

SEQ ID NO: 97111 - DNA, 103 bp, Artificial Sequence
  Synthetic Polynucleotide
taatacgactcactatagggggcggcggcgcccgccttctcgggagggggaacagaggagaccccctatggagaaggcgaacctggcggcagcgcaaaagatg

SEQ ID NO: 97112 - DNA, 103 bp, Artificial Sequence
  Synthetic Polynucleotide
taatacgactcactatagggggagggtcgcggcggcggcgcccgccttctaacagaggagaagaaggatggcgccgccgaacctggcggcagcgcaaaagatg

SEQ ID NO: 97113 - DNA, 103 bp, Artificial Sequence
  Synthetic Polynucleotide
taatacgactcactatagggtcgtgcggcaggagggtcgcggcggcggcgaacagaggagacgccgcatgcgcgaccctaacctggcggcagcgcaaaagatg

SEQ ID NO: 97114 - DNA, 103 bp, Artificial Sequence
  Synthetic Polynucleotide
taatacgactcactatagggtctgtgcggtaatttgtaggtatccttggtaacagaggagaaccaagatgacctacaaaaacctggcggcagcgcaaaagatg

SEQ ID NO: 97115 - DNA, 103 bp, Artificial Sequence
  Synthetic Polynucleotide
taatacgactcactataggggggcgccacctcgtgcggcaggagggtcgcaacagaggagagcgaccatgctgccgcacaacctggcggcagcgcaaaagatg

SEQ ID NO: 97116 - DNA, 103 bp, Artificial Sequence
  Synthetic Polynucleotide
taatacgactcactataggggcgccccaaggggcgccacctcgtgcggcaaacagaggagatgccgcatgaggtggcgcaacctggcggcagcgcaaaagatg

SEQ ID NO: 97117 - DNA, 103 bp, Artificial Sequence
  Synthetic Polynucleotide
taatacgactcactatagggtgggggtgcggcgccccaaggggcgccaccaacagaggagaggtggcatgccttggggcaacctggcggcagcgcaaaagatg

SEQ ID NO: 97118 - DNA, 103 bp, Artificial Sequence
  Synthetic Polynucleotide
taatacgactcactataggggtgcgggtgctgggggtgcggcgccccaagaacagaggagacttgggatgccgcaccccaacctggcggcagcgcaaaagatg

SEQ ID NO: 97119 - DNA, 103 bp, Artificial Sequence
  Synthetic Polynucleotide
taatacgactcactataggggggtgcggccgtgcgggtgctgggggtgcgaacagaggagacgcaccatgagcacccgcaacctggcggcagcgcaaaagatg

SEQ ID NO: 97120 - DNA, 103 bp, Artificial Sequence
  Synthetic Polynucleotide
taatacgactcactatagggaagggcaggtgggtgcggccgtgcgggtgcaacagaggagagcacccatgcggccgcacaacctggcggcagcgcaaaagatg

SEQ ID NO: 97121 - DNA, 103 bp, Artificial Sequence
  Synthetic Polynucleotide
taatacgactcactataggggggcccggcgaagggcaggtgggtgcggccaacagaggagaggccgcatgcacctgcccaacctggcggcagcgcaaaagatg

SEQ ID NO: 97122 - DNA, 103 bp, Artificial Sequence
  Synthetic Polynucleotide
taatacgactcactatagggccggctcgcggggcccggcgaagggcaggtaacagaggagaacctgcatgtcgccgggcaacctggcggcagcgcaaaagatg

SEQ ID NO: 97123 - DNA, 103 bp, Artificial Sequence
  Synthetic Polynucleotide
taatacgactcactatagggtccgggttccccggctcgcggggcccggcgaacagaggagacgccggatgccgcgagccaacctggcggcagcgcaaaagatg

SEQ ID NO: 97124 - DNA, 103 bp, Artificial Sequence
  Synthetic Polynucleotide
taatacgactcactatagggagcagagctctccgggttccccggctcgcgaacagaggagacgcgagatggggaacccgaacctggcggcagcgcaaaagatg

SEQ ID NO: 97125 - DNA, 103 bp, Artificial Sequence
  Synthetic Polynucleotide
taatacgactcactatagggtttctattaatctgtgcggtaatttgtaggaacagaggagacctacaatgtaccgcacaaacctggcggcagcgcaaaagatg

SEQ ID NO: 97126 - DNA, 103 bp, Artificial Sequence
  Synthetic Polynucleotide
taatacgactcactataggggatcttcctgagcagagctctccgggttccaacagaggagaggaaccatgagagctctgaacctggcggcagcgcaaaagatg

SEQ ID NO: 97127 - DNA, 103 bp, Artificial Sequence
  Synthetic Polynucleotide
taatacgactcactatagggggctgcgagggatcttcctgagcagagctcaacagaggagagagctcatgtcaggaagaaacctggcggcagcgcaaaagatg

SEQ ID NO: 97128 - DNA, 103 bp, Artificial Sequence
  Synthetic Polynucleotide
taatacgactcactatagggttcctttcctggctgcgagggatcttcctgaacagaggagacaggaaatgccctcgcagaacctggcggcagcgcaaaagatg

SEQ ID NO: 97129 - DNA, 103 bp, Artificial Sequence
  Synthetic Polynucleotide
taatacgactcactatagggcttcttttcttttctattaatctgtgcggtaacagaggagaaccgcaatgattaatagaaacctggcggcagcgcaaaagatg

SEQ ID NO: 97130 - DNA, 103 bp, Artificial Sequence
  Synthetic Polynucleotide
taatacgactcactatagggaattcggtctcttcttttcttttctattaaaacagaggagattaataatgaagaaaagaaacctggcggcagcgcaaaagatg

SEQ ID NO: 97131 - DNA, 103 bp, Artificial Sequence
  Synthetic Polynucleotide
taatacgactcactatagggtgcattcattaattcggtctcttcttttctaacagaggagaagaaaaatggagaccgaaaacctggcggcagcgcaaaagatg

SEQ ID NO: 97132 - DNA, 103 bp, Artificial Sequence
  Synthetic Polynucleotide
taatacgactcactatagggagctgagcaatgcattcattaattcggtctaacagaggagaagaccgatgtaatgaatgaacctggcggcagcgcaaaagatg

SEQ ID NO: 97133 - DNA, 103 bp, Artificial Sequence
  Synthetic Polynucleotide
taatacgactcactatagggtaaatctttcagctgagcaatgcattcattaacagaggagaaatgaaatgattgctcagaacctggcggcagcgcaaaagatg

SEQ ID NO: 97134 - DNA, 103 bp, Artificial Sequence
  Synthetic Polynucleotide
taatacgactcactataggggtaactgtctctcttgcaaatgaggaattcaacagaggagagaattcatgatttgcaagaacctggcggcagcgcaaaagatg

SEQ ID NO: 97135 - DNA, 103 bp, Artificial Sequence
  Synthetic Polynucleotide
taatacgactcactataggggttcaggcagtaaatctttcagctgagcaaaacagaggagattgctcatgtgaaagattaacctggcggcagcgcaaaagatg

SEQ ID NO: 97136 - DNA, 103 bp, Artificial Sequence
  Synthetic Polynucleotide
taatacgactcactatagggaatttcagatgttcaggcagtaaatctttcaacagaggagagaaagaatgactgcctgaaacctggcggcagcgcaaaagatg

SEQ ID NO: 97137 - DNA, 103 bp, Artificial Sequence
  Synthetic Polynucleotide
taatacgactcactatagggcagagttgtcaatttcagatgttcaggcagaacagaggagactgcctatgcatctgaaaaacctggcggcagcgcaaaagatg

SEQ ID NO: 97138 - DNA, 103 bp, Artificial Sequence
  Synthetic Polynucleotide
taatacgactcactatagggccagatgtcccagagttgtcaatttcagataacagaggagaatctgaatgtgacaactcaacctggcggcagcgcaaaagatg

SEQ ID NO: 97139 - DNA, 103 bp, Artificial Sequence
  Synthetic Polynucleotide
taatacgactcactatagggacagctttctccagatgtcccagagttgtcaacagaggagagacaacatggggacatctaacctggcggcagcgcaaaagatg

SEQ ID NO: 97140 - DNA, 103 bp, Artificial Sequence
  Synthetic Polynucleotide
taatacgactcactatagggttccaagactacagctttctccagatgtccaacagaggagaggacatatggagaaagctaacctggcggcagcgcaaaagatg

SEQ ID NO: 97141 - DNA, 103 bp, Artificial Sequence
  Synthetic Polynucleotide
taatacgactcactatagggtcaaagttaattccaagactacagctttctaacagaggagaagaaagatgtagtcttggaacctggcggcagcgcaaaagatg

SEQ ID NO: 97142 - DNA, 103 bp, Artificial Sequence
  Synthetic Polynucleotide
taatacgactcactatagggtttaagtgtttcaaagttaattccaagactaacagaggagaagtcttatgattaactttaacctggcggcagcgcaaaagatg

SEQ ID NO: 97143 - DNA, 103 bp, Artificial Sequence
  Synthetic Polynucleotide
taatacgactcactatagggggttaaagcttttaagtgtttcaaagttaaaacagaggagattaactatgaaacacttaaacctggcggcagcgcaaaagatg

SEQ ID NO: 97144 - DNA, 103 bp, Artificial Sequence
  Synthetic Polynucleotide
taatacgactcactatagggcggttaaggcggttaaagcttttaagtgttaacagaggagaaacactatgaagctttaaaacctggcggcagcgcaaaagatg

SEQ ID NO: 97145 - DNA, 103 bp, Artificial Sequence
  Synthetic Polynucleotide
taatacgactcactatagggctatgttccagtaactgtctctcttgcaaaaacagaggagatttgcaatggagacagttaacctggcggcagcgcaaaagatg

SEQ ID NO: 97146 - DNA, 103 bp, Artificial Sequence
  Synthetic Polynucleotide
taatacgactcactatagggtgctgttgctcggttaaggcggttaaagctaacagaggagaagctttatgcgccttaacaacctggcggcagcgcaaaagatg

SEQ ID NO: 97147 - DNA, 103 bp, Artificial Sequence
  Synthetic Polynucleotide
taatacgactcactatagggtatcttctgatgctgttgctcggttaaggcaacagaggagagccttaatggagcaacagaacctggcggcagcgcaaaagatg

SEQ ID NO: 97148 - DNA, 103 bp, Artificial Sequence
  Synthetic Polynucleotide
taatacgactcactataggggtaaagcaattatcttctgatgctgttgctaacagaggagaagcaacatgatcagaagaaacctggcggcagcgcaaaagatg

SEQ ID NO: 97149 - DNA, 103 bp, Artificial Sequence
  Synthetic Polynucleotide
taatacgactcactatagggtccccattctgtaaagcaattatcttctgaaacagaggagatcagaaatgaattgctttaacctggcggcagcgcaaaagatg

SEQ ID NO: 97150 - DNA, 103 bp, Artificial Sequence
  Synthetic Polynucleotide
taatacgactcactatagggcagagatcgctccccattctgtaaagcaataacagaggagaattgctatgcagaatgggaacctggcggcagcgcaaaagatg

SEQ ID NO: 97151 - DNA, 103 bp, Artificial Sequence
  Synthetic Polynucleotide
taatacgactcactatagggtgggcgatttcagagatcgctccccattctaacagaggagaagaatgatgagcgatctcaacctggcggcagcgcaaaagatg

SEQ ID NO: 97152 - DNA, 103 bp, Artificial Sequence
  Synthetic Polynucleotide
taatacgactcactatagggtcggactgaatgggcgatttcagagatcgcaacagaggagagcgatcatggaaatcgccaacctggcggcagcgcaaaagatg

SEQ ID NO: 97153 - DNA, 103 bp, Artificial Sequence
  Synthetic Polynucleotide
taatacgactcactatagggcgcatccaagtcggactgaatgggcgatttaacagaggagaaaatcgatgattcagtccaacctggcggcagcgcaaaagatg

SEQ ID NO: 97154 - DNA, 103 bp, Artificial Sequence
  Synthetic Polynucleotide
taatacgactcactatagggccgagtggaacgcatccaagtcggactgaaaacagaggagattcagtatgacttggatgaacctggcggcagcgcaaaagatg

SEQ ID NO: 97155 - DNA, 103 bp, Artificial Sequence
  Synthetic Polynucleotide
taatacgactcactataggggtttgaaatcccgagtggaacgcatccaagaacagaggagacttggaatggttccactcaacctggcggcagcgcaaaagatg

SEQ ID NO: 97156 - DNA, 103 bp, Artificial Sequence
  Synthetic Polynucleotide
taatacgactcactatagggtataaaatctctatgttccagtaactgtctaacagaggagaagacagatgctggaacataacctggcggcagcgcaaaagatg

SEQ ID NO: 97157 - DNA, 103 bp, Artificial Sequence
  Synthetic Polynucleotide
taatacgactcactatagggtttggcgcatgtttgaaatcccgagtggaaaacagaggagattccacatgggatttcaaaacctggcggcagcgcaaaagatg

SEQ ID NO: 97158 - DNA, 103 bp, Artificial Sequence
  Synthetic Polynucleotide
taatacgactcactataggggcaagacttctttggcgcatgtttgaaatcaacagaggagagatttcatgcatgcgccaaacctggcggcagcgcaaaagatg

SEQ ID NO: 97159 - DNA, 103 bp, Artificial Sequence
  Synthetic Polynucleotide
taatacgactcactataggggagaggtattgcaagacttctttggcgcataacagaggagaatgcgcatgagaagtcttaacctggcggcagcgcaaaagatg

SEQ ID NO: 97160 - DNA, 103 bp, Artificial Sequence
  Synthetic Polynucleotide
taatacgactcactatagggctcaaaccgggagaggtattgcaagacttcaacagaggagagaagtcatgcaatacctcaacctggcggcagcgcaaaagatg

SEQ ID NO: 97161 - DNA, 103 bp, Artificial Sequence
  Synthetic Polynucleotide
taatacgactcactataggggtgtccagctctcaaaccgggagaggtattaacagaggagaaataccatgcccggtttgaacctggcggcagcgcaaaagatg

SEQ ID NO: 97162 - DNA, 103 bp, Artificial Sequence
  Synthetic Polynucleotide
taatacgactcactatagggggctccctgggtgtccagctctcaaaccggaacagaggagaccggttatggagctggacaacctggcggcagcgcaaaagatg

SEQ ID NO: 97163 - DNA, 103 bp, Artificial Sequence
  Synthetic Polynucleotide
taatacgactcactataggggacacaccgcggctccctgggtgtccagctaacagaggagaagctggatgcccagggagaacctggcggcagcgcaaaagatg

SEQ ID NO: 97164 - DNA, 103 bp, Artificial Sequence
  Synthetic Polynucleotide
taatacgactcactatagggtgatcagctggacacaccgcggctccctggaacagaggagaccagggatgcgcggtgtgaacctggcggcagcgcaaaagatg

SEQ ID NO: 97165 - DNA, 103 bp, Artificial Sequence
  Synthetic Polynucleotide
taatacgactcactatagggtgcaagtggttgatcagctggacacaccgcaacagaggagagcggtgatgccagctgataacctggcggcagcgcaaaagatg

SEQ ID NO: 97166 - DNA, 103 bp, Artificial Sequence
  Synthetic Polynucleotide
taatacgactcactatagggggccacggcgtgcaagtggttgatcagctgaacagaggagacagctgatgaaccacttgaacctggcggcagcgcaaaagatg

SEQ ID NO: 97167 - DNA, 103 bp, Artificial Sequence
  Synthetic Polynucleotide
taatacgactcactatagggagtccagtcctataaaatctctatgttccaaacagaggagatggaacatggagattttaaacctggcggcagcgcaaaagatg

SEQ ID NO: 97168 - DNA, 103 bp, Artificial Sequence
  Synthetic Polynucleotide
taatacgactcactatagggagaactgggtggccacggcgtgcaagtggtaacagaggagaaccactatgacgccgtggaacctggcggcagcgcaaaagatg

SEQ ID NO: 97169 - DNA, 103 bp, Artificial Sequence
  Synthetic Polynucleotide
taatacgactcactatagggggggtgggcaagaactgggtggccacggcgaacagaggagacgccgtatgcacccagttaacctggcggcagcgcaaaagatg

SEQ ID NO: 97170 - DNA, 103 bp, Artificial Sequence
  Synthetic Polynucleotide
taatacgactcactatagggcaacagctgcggggtgggcaagaactgggtaacagaggagaacccagatgttgcccaccaacctggcggcagcgcaaaagatg

SEQ ID NO: 97171 - DNA, 103 bp, Artificial Sequence
  Synthetic Polynucleotide
taatacgactcactatagggcctgttgagtcaacagctgcggggtgggcaaacagaggagatgcccaatgcgcagctgtaacctggcggcagcgcaaaagatg

SEQ ID NO: 97172 - DNA, 103 bp, Artificial Sequence
  Synthetic Polynucleotide
taatacgactcactatagggctcagagggacctgttgagtcaacagctgcaacagaggagagcagctatggactcaacaaacctggcggcagcgcaaaagatg

SEQ ID NO: 97173 - DNA, 103 bp, Artificial Sequence
  Synthetic Polynucleotide
taatacgactcactatagggggtgcctttgctcagagggacctgttgagtaacagaggagaactcaaatggtccctctgaacctggcggcagcgcaaaagatg

SEQ ID NO: 97174 - DNA, 103 bp, Artificial Sequence
  Synthetic Polynucleotide
taatacgactcactatagggagggagcgccggtgcctttgctcagagggaaacagaggagatccctcatggcaaaggcaaacctggcggcagcgcaaaagatg

SEQ ID NO: 97175 - DNA, 103 bp, Artificial Sequence
  Synthetic Polynucleotide
taatacgactcactatagggccggcggccgagggagcgccggtgcctttgaacagaggagacaaaggatgcggcgctccaacctggcggcagcgcaaaagatg

SEQ ID NO: 97176 - DNA, 103 bp, Artificial Sequence
  Synthetic Polynucleotide
taatacgactcactatagggggccgcggacccggcggccgagggagcgccaacagaggagaggcgctatgtcggccgccaacctggcggcagcgcaaaagatg

SEQ ID NO: 97177 - DNA, 103 bp, Artificial Sequence
  Synthetic Polynucleotide
taatacgactcactatagggggcagggggcggccgcggacccggcggccgaacagaggagacggccgatgggtccgcggaacctggcggcagcgcaaaagatg

SEQ ID NO: 97178 - DNA, 103 bp, Artificial Sequence
  Synthetic Polynucleotide
taatacgactcactatagggaaagaggaatagtccagtcctataaaatctaacagaggagaagatttatgaggactggaaacctggcggcagcgcaaaagatg

SEQ ID NO: 97179 - DNA, 103 bp, Artificial Sequence
  Synthetic Polynucleotide
taatacgactcactataggggcgcgctccaggcagggggcggccgcggacaacagaggagagtccgcatgcgccccctgaacctggcggcagcgcaaaagatg

SEQ ID NO: 97180 - DNA, 103 bp, Artificial Sequence
  Synthetic Polynucleotide
taatacgactcactatagggcttctgccccgcgcgctccaggcagggggcaacagaggagagcccccatgctggagcgcaacctggcggcagcgcaaaagatg

SEQ ID NO: 97181 - DNA, 103 bp, Artificial Sequence
  Synthetic Polynucleotide
taatacgactcactatagggggggctccagcttctgccccgcgcgctccaaacagaggagatggagcatgcggggcagaaacctggcggcagcgcaaaagatg

SEQ ID NO: 97182 - DNA, 103 bp, Artificial Sequence
  Synthetic Polynucleotide
taatacgactcactatagggcagtaggcgaggggctccagcttctgccccaacagaggagaggggcaatggctggagccaacctggcggcagcgcaaaagatg

SEQ ID NO: 97183 - DNA, 103 bp, Artificial Sequence
  Synthetic Polynucleotide
taatacgactcactataggggacgggcacgcagtaggcgaggggctccagaacagaggagactggagatgctcgcctacaacctggcggcagcgcaaaagatg

SEQ ID NO: 97184 - DNA, 103 bp, Artificial Sequence
  Synthetic Polynucleotide
taatacgactcactatagggtccgctggatgacgggcacgcagtaggcgaaacagaggagatcgcctatggcgtgcccgaacctggcggcagcgcaaaagatg

SEQ ID NO: 97185 - DNA, 103 bp, Artificial Sequence
  Synthetic Polynucleotide
taatacgactcactatagggctgggctgagtccgctggatgacgggcacgaacagaggagacgtgccatgcatccagcgaacctggcggcagcgcaaaagatg

SEQ ID NO: 97186 - DNA, 103 bp, Artificial Sequence
  Synthetic Polynucleotide
taatacgactcactataggggagctcggcgctgggctgagtccgctggataacagaggagaatccagatgactcagcccaacctggcggcagcgcaaaagatg

SEQ ID NO: 97187 - DNA, 103 bp, Artificial Sequence
  Synthetic Polynucleotide
taatacgactcactatagggtctcggcggcgagctcggcgctgggctgagaacagaggagactcagcatggcgccgagcaacctggcggcagcgcaaaagatg

SEQ ID NO: 97188 - DNA, 103 bp, Artificial Sequence
  Synthetic Polynucleotide
taatacgactcactatagggtccgtgtcgttctcggcggcgagctcggcgaacagaggagacgccgaatgcgccgccgaaacctggcggcagcgcaaaagatg

SEQ ID NO: 97189 - DNA, 103 bp, Artificial Sequence
  Synthetic Polynucleotide
taatacgactcactatagggacacatatacaaagaggaatagtccagtccaacagaggagaggactgatgtattcctctaacctggcggcagcgcaaaagatg

SEQ ID NO: 97190 - DNA, 103 bp, Artificial Sequence
  Synthetic Polynucleotide
taatacgactcactataggggctgtcggtgtccgtgtcgttctcggcggcaacagaggagagccgccatgaacgacacgaacctggcggcagcgcaaaagatg

SEQ ID NO: 97191 - DNA, 103 bp, Artificial Sequence
  Synthetic Polynucleotide
taatacgactcactatagggcgccgtagccgctgtcggtgtccgtgtcgtaacagaggagaacgacaatgacaccgacaaacctggcggcagcgcaaaagatg

SEQ ID NO: 97192 - DNA, 103 bp, Artificial Sequence
  Synthetic Polynucleotide
taatacgactcactatagggtcggcttcgccgccgtagccgctgtcggtgaacagaggagacaccgaatgcggctacggaacctggcggcagcgcaaaagatg

SEQ ID NO: 97193 - DNA, 103 bp, Artificial Sequence
  Synthetic Polynucleotide
taatacgactcactatagggcggccgggcctcggcttcgccgccgtagccaacagaggagaggctacatgggcgaagccaacctggcggcagcgcaaaagatg

SEQ ID NO: 97194 - DNA, 103 bp, Artificial Sequence
  Synthetic Polynucleotide
taatacgactcactatagggtctcgcggtccggccgggcctcggcttcgcaacagaggagagcgaagatgaggcccggcaacctggcggcagcgcaaaagatg

SEQ ID NO: 97195 - DNA, 103 bp, Artificial Sequence
  Synthetic Polynucleotide
taatacgactcactatagggcctttgcctttctcgcggtccggccgggccaacagaggagaggcccgatgggaccgcgaaacctggcggcagcgcaaaagatg

SEQ ID NO: 97196 - DNA, 103 bp, Artificial Sequence
  Synthetic Polynucleotide
taatacgactcactatagggcgcccccgcgcctttgcctttctcgcggtcaacagaggagagaccgcatgaaaggcaaaaacctggcggcagcgcaaaagatg

SEQ ID NO: 97197 - DNA, 103 bp, Artificial Sequence
  Synthetic Polynucleotide
taatacgactcactatagggtgacgcggctcgcccccgcgcctttgccttaacagaggagaaaggcaatggcgcgggggaacctggcggcagcgcaaaagatg

SEQ ID NO: 97198 - DNA, 103 bp, Artificial Sequence
  Synthetic Polynucleotide
taatacgactcactatagggtgcttgatggtgacgcggctcgcccccgcgaacagaggagacgcgggatggagccgcgtaacctggcggcagcgcaaaagatg

SEQ ID NO: 97199 - DNA, 103 bp, Artificial Sequence
  Synthetic Polynucleotide
taatacgactcactataggggggaggctcctgcttgatggtgacgcggctaacagaggagaagccgcatgaccatcaagaacctggcggcagcgcaaaagatg

SEQ ID NO: 97200 - DNA, 103 bp, Artificial Sequence
  Synthetic Polynucleotide
taatacgactcactatagggttttgggtttacacatatacaaagaggaataacagaggagaattcctatgtgtatatgtaacctggcggcagcgcaaaagatg

SEQ ID NO: 97201 - DNA, 103 bp, Artificial Sequence
  Synthetic Polynucleotide
taatacgactcactatagggagtcctccccgggaggctcctgcttgatggaacagaggagaccatcaatgaggagcctcaacctggcggcagcgcaaaagatg

SEQ ID NO: 97202 - DNA, 103 bp, Artificial Sequence
  Synthetic Polynucleotide
taatacgactcactatagggggcgccggcgagtcctccccgggaggctccaacagaggagaggagccatgcggggaggaaacctggcggcagcgcaaaagatg

SEQ ID NO: 97203 - DNA, 103 bp, Artificial Sequence
  Synthetic Polynucleotide
taatacgactcactatagggcatcctcttgggcgccggcgagtcctccccaacagaggagaggggagatgtcgccggcgaacctggcggcagcgcaaaagatg

SEQ ID NO: 97204 - DNA, 103 bp, Artificial Sequence
  Synthetic Polynucleotide
taatacgactcactatagggaatccagcttcatcctcttgggcgccggcgaacagaggagacgccggatgccaagaggaaacctggcggcagcgcaaaagatg

SEQ ID NO: 97205 - DNA, 103 bp, Artificial Sequence
  Synthetic Polynucleotide
taatacgactcactatagggccgccgcgggaatccagcttcatcctcttgaacagaggagacaagagatggaagctggaaacctggcggcagcgcaaaagatg

SEQ ID NO: 97206 - DNA, 103 bp, Artificial Sequence
  Synthetic Polynucleotide
taatacgactcactataggggccgctgccgccgccgcgggaatccagcttaacagaggagaaagctgatgtcccgcggcaacctggcggcagcgcaaaagatg

SEQ ID NO: 97207 - DNA, 103 bp, Artificial Sequence
  Synthetic Polynucleotide
taatacgactcactatagggccgggccgccgccgctgccgccgccgcgggaacagaggagacccgcgatggcggcagcgaacctggcggcagcgcaaaagatg

SEQ ID NO: 97208 - DNA, 103 bp, Artificial Sequence
  Synthetic Polynucleotide
taatacgactcactataggggcgccgccccccgggccgccgccgctgccgaacagaggagacggcagatgcggcggcccaacctggcggcagcgcaaaagatg

SEQ ID NO: 97209 - DNA, 103 bp, Artificial Sequence
  Synthetic Polynucleotide
taatacgactcactatagggcgccgccgccgcgccgccccccgggccgccaacagaggagaggcggcatggggggcggcaacctggcggcagcgcaaaagatg

SEQ ID NO: 97210 - DNA, 103 bp, Artificial Sequence
  Synthetic Polynucleotide
taatacgactcactataggggcgcggctgccgccgccgccgcgccgccccaacagaggagaggggcgatgcggcggcggaacctggcggcagcgcaaaagatg

SEQ ID NO: 97211 - DNA, 103 bp, Artificial Sequence
  Synthetic Polynucleotide
taatacgactcactatagggttcatgctccttttgggtttacacatatacaacagaggagagtatatatgtaaacccaaaacctggcggcagcgcaaaagatg

SEQ ID NO: 97212 - DNA, 103 bp, Artificial Sequence
  Synthetic Polynucleotide
taatacgactcactatagggggccccagaagcgcggctgccgccgccgccaacagaggagaggcggcatgggcagccgcaacctggcggcagcgcaaaagatg

SEQ ID NO: 97213 - DNA, 103 bp, Artificial Sequence
  Synthetic Polynucleotide
taatacgactcactatagggggcagggtcgggccccagaagcgcggctgcaacagaggagagcagccatgcttctggggaacctggcggcagcgcaaaagatg

SEQ ID NO: 97214 - DNA, 103 bp, Artificial Sequence
  Synthetic Polynucleotide
taatacgactcactatagggcggccgcggcggcagggtcgggccccagaaaacagaggagattctggatgccgaccctgaacctggcggcagcgcaaaagatg

SEQ ID NO: 97215 - DNA, 103 bp, Artificial Sequence
  Synthetic Polynucleotide
taatacgactcactatagggctcagcagcgcggccgcggcggcagggtcgaacagaggagacgacccatgcgccgcggcaacctggcggcagcgcaaaagatg

SEQ ID NO: 97216 - DNA, 103 bp, Artificial Sequence
  Synthetic Polynucleotide
taatacgactcactatagggggcgtcgggtctcagcagcgcggccgcggcaacagaggagagccgcgatggcgctgctgaacctggcggcagcgcaaaagatg

SEQ ID NO: 97217 - DNA, 103 bp, Artificial Sequence
  Synthetic Polynucleotide
taatacgactcactatagggtgagcagggcggcgtcgggtctcagcagcgaacagaggagacgctgcatggacccgacgaacctggcggcagcgcaaaagatg

SEQ ID NO: 97218 - DNA, 103 bp, Artificial Sequence
  Synthetic Polynucleotide
taatacgactcactatagggaccagcgagctgagcagggcggcgtcgggtaacagaggagaacccgaatgcgccctgctaacctggcggcagcgcaaaagatg

SEQ ID NO: 97219 - DNA, 103 bp, Artificial Sequence
  Synthetic Polynucleotide
taatacgactcactataggggccgaacgccaccagcgagctgagcagggcaacagaggagagccctgatgagctcgctgaacctggcggcagcgcaaaagatg

SEQ ID NO: 97220 - DNA, 103 bp, Artificial Sequence
  Synthetic Polynucleotide
taatacgactcactatagggctccgcctccgccgaacgccaccagcgagcaacagaggagagctcgcatgtggcgttcgaacctggcggcagcgcaaaagatg

SEQ ID NO: 97221 - DNA, 103 bp, Artificial Sequence
  Synthetic Polynucleotide
taatacgactcactatagggaagggcgcgcctccgcctccgccgaacgccaacagaggagaggcgttatgcggaggcggaacctggcggcagcgcaaaagatg

SEQ ID NO: 97222 - DNA, 103 bp, Artificial Sequence
  Synthetic Polynucleotide
taatacgactcactataggggcgggagatctggatttttttcctccccataacagaggagaatggggatgaaaaaaatcaacctggcggcagcgcaaaagatg

SEQ ID NO: 97223 - DNA, 103 bp, Artificial Sequence
  Synthetic Polynucleotide
taatacgactcactataggggtcacagagcacgctcagctcataggccttaacagaggagaaaggccatggagctgagcaacctggcggcagcgcaaaagatg

SEQ ID NO: 97224 - DNA, 103 bp, Artificial Sequence
  Synthetic Polynucleotide
taatacgactcactatagggtgggctggtgccaccgggtgatctcctaccaacagaggagaggtaggatgtcacccggtaacctggcggcagcgcaaaagatg

SEQ ID NO: 97225 - DNA, 103 bp, Artificial Sequence
  Synthetic Polynucleotide
taatacgactcactataggggcgagcgctctgggctggtgccaccgggtgaacagaggagacacccgatggcaccagccaacctggcggcagcgcaaaagatg

SEQ ID NO: 97226 - DNA, 103 bp, Artificial Sequence
  Synthetic Polynucleotide
taatacgactcactataggggccgtacctggcgagcgctctgggctggtgaacagaggagacaccagatgagagcgctcaacctggcggcagcgcaaaagatg

SEQ ID NO: 97227 - DNA, 103 bp, Artificial Sequence
  Synthetic Polynucleotide
taatacgactcactatagggacgtgccctcgccgtacctggcgagcgctcaacagaggagagagcgcatgccaggtacgaacctggcggcagcgcaaaagatg

SEQ ID NO: 97228 - DNA, 103 bp, Artificial Sequence
  Synthetic Polynucleotide
taatacgactcactatagggtggggtccccacgtgccctcgccgtacctgaacagaggagacaggtaatgcgagggcacaacctggcggcagcgcaaaagatg

SEQ ID NO: 97229 - DNA, 103 bp, Artificial Sequence
  Synthetic Polynucleotide
taatacgactcactatagggtggagggaggtggggtccccacgtgccctcaacagaggagagagggcatgtggggacccaacctggcggcagcgcaaaagatg

SEQ ID NO: 97230 - DNA, 103 bp, Artificial Sequence
  Synthetic Polynucleotide
taatacgactcactatagggtgaagaggcctggagggaggtggggtccccaacagaggagaggggacatgacctccctcaacctggcggcagcgcaaaagatg

SEQ ID NO: 97231 - DNA, 103 bp, Artificial Sequence
  Synthetic Polynucleotide
taatacgactcactataggggggtcttctctgaagaggcctggagggaggaacagaggagacctcccatgaggcctcttaacctggcggcagcgcaaaagatg

SEQ ID NO: 97232 - DNA, 103 bp, Artificial Sequence
  Synthetic Polynucleotide
taatacgactcactatagggctatctcacagtcacagagcacgctcagctaacagaggagaagctgaatgtgctctgtgaacctggcggcagcgcaaaagatg

SEQ ID NO: 97233 - DNA, 103 bp, Artificial Sequence
  Synthetic Polynucleotide
taatacgactcactatagggatgatgagggctatctcacagtcacagagcaacagaggagagctctgatgctgtgagataacctggcggcagcgcaaaagatg

SEQ ID NO: 97234 - DNA, 103 bp, Artificial Sequence
  Synthetic Polynucleotide
taatacgactcactataggggctgttgaagatgatgagggctatctcacaaacagaggagatgtgagatggccctcatcaacctggcggcagcgcaaaagatg

SEQ ID NO: 97235 - DNA, 103 bp, Artificial Sequence
  Synthetic Polynucleotide
taatacgactcactatagggggcggttggcgctgttgaagatgatgagggaacagaggagaccctcaatgtcttcaacaaacctggcggcagcgcaaaagatg

SEQ ID NO: 97236 - DNA, 103 bp, Artificial Sequence
  Synthetic Polynucleotide
taatacgactcactatagggtactggaagaggcggttggcgctgttgaagaacagaggagacttcaaatgcgccaaccgaacctggcggcagcgcaaaagatg

SEQ ID NO: 97237 - DNA, 103 bp, Artificial Sequence
  Synthetic Polynucleotide
taatacgactcactatagggcgtgctggcatactggaagaggcggttggcaacagaggagagccaacatgctcttccagaacctggcggcagcgcaaaagatg

SEQ ID NO: 97238 - DNA, 103 bp, Artificial Sequence
  Synthetic Polynucleotide
taatacgactcactatagggggtccatgtccgtgctggcatactggaagaaacagaggagatcttccatgatgccagcaaacctggcggcagcgcaaaagatg

SEQ ID NO: 97239 - DNA, 103 bp, Artificial Sequence
  Synthetic Polynucleotide
taatacgactcactatagggagcagcacacggtccatgtccgtgctggcaaacagaggagatgccagatgggacatggaaacctggcggcagcgcaaaagatg

SEQ ID NO: 97240 - DNA, 103 bp, Artificial Sequence
  Synthetic Polynucleotide
taatacgactcactatagggtgtgtacttcagcagcacacggtccatgtcaacagaggagagacatgatgcgtgtgctgaacctggcggcagcgcaaaagatg

SEQ ID NO: 97241 - DNA, 103 bp, Artificial Sequence
  Synthetic Polynucleotide
taatacgactcactatagggggtccaggatgcgggagatctggattttttaacagaggagaaaaaaaatgagatctcccaacctggcggcagcgcaaaagatg

SEQ ID NO: 97242 - DNA, 103 bp, Artificial Sequence
  Synthetic Polynucleotide
taatacgactcactatagggcgctgtactctgtgtacttcagcagcacacaacagaggagagtgtgcatgtgaagtacaaacctggcggcagcgcaaaagatg

SEQ ID NO: 97243 - DNA, 103 bp, Artificial Sequence
  Synthetic Polynucleotide
taatacgactcactatagggtcgtggggctcgctgtactctgtgtacttcaacagaggagagaagtaatgagagtacagaacctggcggcagcgcaaaagatg

SEQ ID NO: 97244 - DNA, 103 bp, Artificial Sequence
  Synthetic Polynucleotide
taatacgactcactatagggggtgcggctctcgtggggctcgctgtactcaacagaggagagagtacatggagccccacaacctggcggcagcgcaaaagatg

SEQ ID NO: 97245 - DNA, 103 bp, Artificial Sequence
  Synthetic Polynucleotide
taatacgactcactatagggtgtcagtgttggtgcggctctcgtggggctaacagaggagaagccccatgagagccgcaaacctggcggcagcgcaaaagatg

SEQ ID NO: 97246 - DNA, 103 bp, Artificial Sequence
  Synthetic Polynucleotide
taatacgactcactataggggtctcgaggatgtcagtgttggtgcggctcaacagaggagagagccgatgcaacactgaaacctggcggcagcgcaaaagatg

SEQ ID NO: 97247 - DNA, 103 bp, Artificial Sequence
  Synthetic Polynucleotide
taatacgactcactatagggccgcttcagcgtctcgaggatgtcagtgttaacagaggagaaacactatgatcctcgagaacctggcggcagcgcaaaagatg

SEQ ID NO: 97248 - DNA, 103 bp, Artificial Sequence
  Synthetic Polynucleotide
taatacgactcactatagggcaatgcccctccgcttcagcgtctcgaggaaacagaggagatcctcgatgcgctgaagcaacctggcggcagcgcaaaagatg

SEQ ID NO: 97249 - DNA, 103 bp, Artificial Sequence
  Synthetic Polynucleotide
taatacgactcactatagggccatcgaggccaatgcccctccgcttcagcaacagaggagagctgaaatggaggggcataacctggcggcagcgcaaaagatg

SEQ ID NO: 97250 - DNA, 103 bp, Artificial Sequence
  Synthetic Polynucleotide
taatacgactcactatagggcagctctggcccatcgaggccaatgcccctaacagaggagaaggggcatgggcctcgataacctggcggcagcgcaaaagatg

SEQ ID NO: 97251 - DNA, 103 bp, Artificial Sequence
  Synthetic Polynucleotide
taatacgactcactatagggcatccggctccagctctggcccatcgaggcaacagaggagagcctcgatgggccagagcaacctggcggcagcgcaaaagatg

SEQ ID NO: 97252 - DNA, 103 bp, Artificial Sequence
  Synthetic Polynucleotide
taatacgactcactatagggcgattcctttggtccaggatgcgggagatcaacagaggagagatctcatgcatcctggaaacctggcggcagcgcaaaagatg

SEQ ID NO: 97253 - DNA, 103 bp, Artificial Sequence
  Synthetic Polynucleotide
taatacgactcactatagggtcaggcccttcatccggctccagctctggcaacagaggagagccagaatgggagccggaaacctggcggcagcgcaaaagatg

SEQ ID NO: 97254 - DNA, 103 bp, Artificial Sequence
  Synthetic Polynucleotide
taatacgactcactatagggtcctggctcctcaggcccttcatccggctcaacagaggagagagccgatggaagggcctaacctggcggcagcgcaaaagatg

SEQ ID NO: 97255 - DNA, 103 bp, Artificial Sequence
  Synthetic Polynucleotide
taatacgactcactataggggaaacttctctcctggctcctcaggcccttaacagaggagaaagggcatgaggagccagaacctggcggcagcgcaaaagatg

SEQ ID NO: 97256 - DNA, 103 bp, Artificial Sequence
  Synthetic Polynucleotide
taatacgactcactataggggccagcctccgaaacttctctcctggctccaacagaggagaggagccatgagagaagttaacctggcggcagcgcaaaagatg

SEQ ID NO: 97257 - DNA, 103 bp, Artificial Sequence
  Synthetic Polynucleotide
taatacgactcactatagggcccttcgcctgccagcctccgaaacttctcaacagaggagagagaagatgcggaggctgaacctggcggcagcgcaaaagatg

SEQ ID NO: 97258 - DNA, 103 bp, Artificial Sequence
  Synthetic Polynucleotide
taatacgactcactatagggccggatcacccccttcgcctgccagcctccaacagaggagaggaggcatgcaggcgaagaacctggcggcagcgcaaaagatg

SEQ ID NO: 97259 - DNA, 103 bp, Artificial Sequence
  Synthetic Polynucleotide
taatacgactcactatagggcggggcaaggccggatcacccccttcgcctaacagaggagaaggcgaatggggtgatccaacctggcggcagcgcaaaagatg

SEQ ID NO: 97260 - DNA, 103 bp, Artificial Sequence
  Synthetic Polynucleotide
taatacgactcactatagggcagccggggtcggggcaaggccggatcaccaacagaggagaggtgatatggccttgcccaacctggcggcagcgcaaaagatg

SEQ ID NO: 97261 - DNA, 103 bp, Artificial Sequence
  Synthetic Polynucleotide
taatacgactcactatagggctgcaggatacagccggggtcggggcaaggaacagaggagaccttgcatggaccccggcaacctggcggcagcgcaaaagatg

SEQ ID NO: 97262 - DNA, 103 bp, Artificial Sequence
  Synthetic Polynucleotide
taatacgactcactatagggatagcaggagctgcaggatacagccggggtaacagaggagaaccccgatggtatcctgcaacctggcggcagcgcaaaagatg

SEQ ID NO: 97263 - DNA, 103 bp, Artificial Sequence
  Synthetic Polynucleotide
taatacgactcactatagggcgtcacctgccgattcctttggtccaggataacagaggagaatcctgatgcaaaggaataacctggcggcagcgcaaaagatg

SEQ ID NO: 97264 - DNA, 103 bp, Artificial Sequence
  Synthetic Polynucleotide
taatacgactcactatagggtgggctgggcatagcaggagctgcaggataaacagaggagatatcctatggctcctgctaacctggcggcagcgcaaaagatg

SEQ ID NO: 97265 - DNA, 103 bp, Artificial Sequence
  Synthetic Polynucleotide
taatacgactcactatagggataccacatctgggctgggcatagcaggagaacagaggagactcctgatgtgcccagccaacctggcggcagcgcaaaagatg

SEQ ID NO: 97266 - DNA, 103 bp, Artificial Sequence
  Synthetic Polynucleotide
taatacgactcactatagggaaggccccgtataccacatctgggctgggcaacagaggagagcccagatgagatgtggtaacctggcggcagcgcaaaagatg

SEQ ID NO: 97267 - DNA, 103 bp, Artificial Sequence
  Synthetic Polynucleotide
taatacgactcactatagggtggtggcggtaaggccccgtataccacatcaacagaggagagatgtgatgtacggggccaacctggcggcagcgcaaaagatg

SEQ ID NO: 97268 - DNA, 103 bp, Artificial Sequence
  Synthetic Polynucleotide
taatacgactcactatagggggtcacagcctggtggcggtaaggccccgtaacagaggagaacggggatgtaccgccacaacctggcggcagcgcaaaagatg

SEQ ID NO: 97269 - DNA, 103 bp, Artificial Sequence
  Synthetic Polynucleotide
taatacgactcactatagggagcccactggggtcacagcctggtggcggtaacagaggagaaccgccatgaggctgtgaaacctggcggcagcgcaaaagatg

SEQ ID NO: 97270 - DNA, 103 bp, Artificial Sequence
  Synthetic Polynucleotide
taatacgactcactatagggtgcttccccaagcccactggggtcacagccaacagaggagaggctgtatgcccagtgggaacctggcggcagcgcaaaagatg

SEQ ID NO: 97271 - DNA, 103 bp, Artificial Sequence
  Synthetic Polynucleotide
taatacgactcactataggggggcgggcagtgcttccccaagcccactggaacagaggagaccagtgatgttggggaagaacctggcggcagcgcaaaagatg

SEQ ID NO: 97272 - DNA, 103 bp, Artificial Sequence
  Synthetic Polynucleotide
taatacgactcactataggggggcggctctgggcgggcagtgcttccccaaacagaggagatggggaatgactgcccgcaacctggcggcagcgcaaaagatg

SEQ ID NO: 97273 - DNA, 103 bp, Artificial Sequence
  Synthetic Polynucleotide
taatacgactcactataggggaagggagatgggcggctctgggcgggcagaacagaggagactgcccatgcagagccgcaacctggcggcagcgcaaaagatg

SEQ ID NO: 97274 - DNA, 103 bp, Artificial Sequence
  Synthetic Polynucleotide
taatacgactcactataggggcttggtgaacgtcacctgccgattcctttaacagaggagaaaaggaatgggcaggtgaaacctggcggcagcgcaaaagatg

SEQ ID NO: 97275 - DNA, 103 bp, Artificial Sequence
  Synthetic Polynucleotide
taatacgactcactatagggctgctggtcggaagggagatgggcggctctaacagaggagaagagccatgcatctccctaacctggcggcagcgcaaaagatg

SEQ ID NO: 97276 - DNA, 103 bp, Artificial Sequence
  Synthetic Polynucleotide
taatacgactcactataggggctttgggggctgctggtcggaagggagataacagaggagaatctccatgccgaccagcaacctggcggcagcgcaaaagatg

SEQ ID NO: 97277 - DNA, 103 bp, Artificial Sequence
  Synthetic Polynucleotide
taatacgactcactatagggtgggggcccggctttgggggctgctggtcgaacagaggagacgaccaatggcccccaaaaacctggcggcagcgcaaaagatg

SEQ ID NO: 97278 - DNA, 103 bp, Artificial Sequence
  Synthetic Polynucleotide
taatacgactcactataggggcaccaggcctgggggcccggctttgggggaacagaggagacccccaatgccgggccccaacctggcggcagcgcaaaagatg

SEQ ID NO: 97279 - DNA, 103 bp, Artificial Sequence
  Synthetic Polynucleotide
taatacgactcactatagggaagagagggtgcaccaggcctgggggcccgaacagaggagacgggccatgaggcctggtaacctggcggcagcgcaaaagatg

SEQ ID NO: 97280 - DNA, 103 bp, Artificial Sequence
  Synthetic Polynucleotide
taatacgactcactataggggcttggtgagaagagagggtgcaccaggccaacagaggagaggcctgatgcaccctctcaacctggcggcagcgcaaaagatg

SEQ ID NO: 97281 - DNA, 103 bp, Artificial Sequence
  Synthetic Polynucleotide
taatacgactcactatagggtggtgaggtggcttggtgagaagagagggtaacagaggagaaccctcatgtctcaccaaaacctggcggcagcgcaaaagatg

SEQ ID NO: 97282 - DNA, 103 bp, Artificial Sequence
  Synthetic Polynucleotide
taatacgactcactatagggggtgtcttgctggtgaggtggcttggtgagaacagaggagactcaccatgccacctcacaacctggcggcagcgcaaaagatg

SEQ ID NO: 97283 - DNA, 103 bp, Artificial Sequence
  Synthetic Polynucleotide
taatacgactcactatagggcagtgggggtggtgtcttgctggtgaggtgaacagaggagacacctcatgagcaagacaaacctggcggcagcgcaaaagatg

SEQ ID NO: 97284 - DNA, 103 bp, Artificial Sequence
  Synthetic Polynucleotide
taatacgactcactatagggtcggcaggtacagtgggggtggtgtcttgcaacagaggagagcaagaatgcacccccacaacctggcggcagcgcaaaagatg

SEQ ID NO: 97285 - DNA, 103 bp, Artificial Sequence
  Synthetic Polynucleotide
taatacgactcactatagggccgaacttccgcttggtgaacgtcacctgcaacagaggagagcaggtatggttcaccaaaacctggcggcagcgcaaaagatg

SEQ ID NO: 97286 - DNA, 103 bp, Artificial Sequence
  Synthetic Polynucleotide
taatacgactcactatagggcgcccttccgtcggcaggtacagtgggggtaacagaggagaacccccatggtacctgccaacctggcggcagcgcaaaagatg

SEQ ID NO: 97287 - DNA, 103 bp, Artificial Sequence
  Synthetic Polynucleotide
taatacgactcactataggggtctgacctccgcccttccgtcggcaggtaaacagaggagatacctgatgacggaagggaacctggcggcagcgcaaaagatg

SEQ ID NO: 97288 - DNA, 103 bp, Artificial Sequence
  Synthetic Polynucleotide
taatacgactcactatagggcaccaggcaggtctgacctccgcccttccgaacagaggagacggaagatgggaggtcagaacctggcggcagcgcaaaagatg

SEQ ID NO: 97289 - DNA, 103 bp, Artificial Sequence
  Synthetic Polynucleotide
taatacgactcactatagggccagccaggccaccaggcaggtctgacctcaacagaggagagaggtcatgcctgcctggaacctggcggcagcgcaaaagatg

SEQ ID NO: 97290 - DNA, 103 bp, Artificial Sequence
  Synthetic Polynucleotide
taatacgactcactatagggccctcggggcccagccaggccaccaggcagaacagaggagactgcctatgggcctggctaacctggcggcagcgcaaaagatg

SEQ ID NO: 97291 - DNA, 103 bp, Artificial Sequence
  Synthetic Polynucleotide
taatacgactcactatagggtgtttagtccccctcggggcccagccaggcaacagaggagagcctggatgggccccgagaacctggcggcagcgcaaaagatg

SEQ ID NO: 97292 - DNA, 103 bp, Artificial Sequence
  Synthetic Polynucleotide
taatacgactcactatagggcttctggaggtgtttagtccccctcggggcaacagaggagagccccgatggggactaaaaacctggcggcagcgcaaaagatg

SEQ ID NO: 97293 - DNA, 103 bp, Artificial Sequence
  Synthetic Polynucleotide
taatacgactcactatagggactgtagaggcttctggaggtgtttagtccaacagaggagaggactaatgacctccagaaacctggcggcagcgcaaaagatg

SEQ ID NO: 97294 - DNA, 103 bp, Artificial Sequence
  Synthetic Polynucleotide
taatacgactcactatagggtctgcaggccactgtagaggcttctggaggaacagaggagacctccaatggcctctacaaacctggcggcagcgcaaaagatg

SEQ ID NO: 97295 - DNA, 103 bp, Artificial Sequence
  Synthetic Polynucleotide
taatacgactcactataggggagcaggggttctgcaggccactgtagaggaacagaggagacctctaatgtggcctgcaaacctggcggcagcgcaaaagatg

SEQ ID NO: 97296 - DNA, 103 bp, Artificial Sequence
  Synthetic Polynucleotide
taatacgactcactatagggcttcatcagcccgaacttccgcttggtgaaaacagaggagattcaccatgcggaagttcaacctggcggcagcgcaaaagatg

SEQ ID NO: 97297 - DNA, 103 bp, Artificial Sequence
  Synthetic Polynucleotide
taatacgactcactatagggagttgcagtggagcaggggttctgcaggccaacagaggagaggcctgatgaacccctgcaacctggcggcagcgcaaaagatg

SEQ ID NO: 97298 - DNA, 103 bp, Artificial Sequence
  Synthetic Polynucleotide
taatacgactcactatagggggggtccgggagttgcagtggagcaggggtaacagaggagaacccctatgccactgcaaaacctggcggcagcgcaaaagatg

SEQ ID NO: 97299 - DNA, 103 bp, Artificial Sequence
  Synthetic Polynucleotide
taatacgactcactatagggctccccagtgggggtccgggagttgcagtgaacagaggagacactgcatgtcccggaccaacctggcggcagcgcaaaagatg

SEQ ID NO: 97300 - DNA, 103 bp, Artificial Sequence
  Synthetic Polynucleotide
taatacgactcactataggggaaggggaagctccccagtgggggtccgggaacagaggagacccggaatgccactggggaacctggcggcagcgcaaaagatg

SEQ ID NO: 97301 - DNA, 103 bp, Artificial Sequence
  Synthetic Polynucleotide
taatacgactcactatagggctccggggaggaaggggaagctccccagtgaacagaggagacactggatggcttcccctaacctggcggcagcgcaaaagatg

SEQ ID NO: 97302 - DNA, 103 bp, Artificial Sequence
  Synthetic Polynucleotide
taatacgactcactatagggactggggggcctccggggaggaaggggaagaacagaggagacttcccatgcctccccggaacctggcggcagcgcaaaagatg

SEQ ID NO: 97303 - DNA, 103 bp, Artificial Sequence
  Synthetic Polynucleotide
taatacgactcactatagggttcggcccccactggggggcctccggggagaacagaggagactccccatgggccccccaaacctggcggcagcgcaaaagatg

SEQ ID NO: 97304 - DNA, 103 bp, Artificial Sequence
  Synthetic Polynucleotide
taatacgactcactatagggtcgcccaggcttcggcccccactggggggcaacagaggagagcccccatgtgggggccgaacctggcggcagcgcaaaagatg

SEQ ID NO: 97305 - DNA, 103 bp, Artificial Sequence
  Synthetic Polynucleotide
taatacgactcactataggggggaccctcctcgcccaggcttcggcccccaacagaggagagggggcatgagcctgggcaacctggcggcagcgcaaaagatg

SEQ ID NO: 97306 - DNA, 103 bp, Artificial Sequence
  Synthetic Polynucleotide
taatacgactcactatagggcgcgggttgggggaccctcctcgcccaggcaacagaggagagcctggatgaggagggtcaacctggcggcagcgcaaaagatg

SEQ ID NO: 97307 - DNA, 103 bp, Artificial Sequence
  Synthetic Polynucleotide
taatacgactcactatagggcataggccttcttcatcagcccgaacttccaacagaggagaggaagtatgggctgatgaaacctggcggcagcgcaaaagatg

SEQ ID NO: 97308 - DNA, 103 bp, Artificial Sequence
  Synthetic Polynucleotide
taatacgactcactatagggggggaggcgccgcgggttgggggaccctccaacagaggagaggagggatgcccaacccgaacctggcggcagcgcaaaagatg

SEQ ID NO: 97309 - DNA, 103 bp, Artificial Sequence
  Synthetic Polynucleotide
taatacgactcactataggggggggtcggcggggaggcgccgcgggttggaacagaggagaccaaccatgggcgcctccaacctggcggcagcgcaaaagatg

SEQ ID NO: 97310 - DNA, 103 bp, Artificial Sequence
  Synthetic Polynucleotide
taatacgactcactatagggtgctgactgggggggtcggcggggaggcgcaacagaggagagcgcctatgcgccgacccaacctggcggcagcgcaaaagatg

SEQ ID NO: 97311 - DNA, 103 bp, Artificial Sequence
  Synthetic Polynucleotide
taatacgactcactatagggtcagacttgatgctgactgggggggtcggcaacagaggagagccgacatgcccagtcagaacctggcggcagcgcaaaagatg

SEQ ID NO: 97312 - DNA, 103 bp, Artificial Sequence
  Synthetic Polynucleotide
taatacgactcactatagggagagaggcgctcagacttgatgctgactggaacagaggagaccagtcatgatcaagtctaacctggcggcagcgcaaaagatg

SEQ ID NO: 97313 - DNA, 103 bp, Artificial Sequence
  Synthetic Polynucleotide
taatacgactcactatagggcgggggccggagagaggcgctcagacttgaaacagaggagatcaagtatgagcgcctctaacctggcggcagcgcaaaagatg

SEQ ID NO: 97314 - DNA, 103 bp, Artificial Sequence
  Synthetic Polynucleotide
taatacgactcactatagggccggggcccccgggggccggagagaggcgcaacagaggagagcgcctatgtccggccccaacctggcggcagcgcaaaagatg

SEQ ID NO: 97315 - DNA, 103 bp, Artificial Sequence
  Synthetic Polynucleotide
taatacgactcactatagggaggaaagtcgccggggcccccgggggccggaacagaggagaccggccatggggggccccaacctggcggcagcgcaaaagatg

SEQ ID NO: 97316 - DNA, 103 bp, Artificial Sequence
  Synthetic Polynucleotide
taatacgactcactatagggggaaggtcttaggaaagtcgccggggccccaacagaggagaggggccatggcgactttcaacctggcggcagcgcaaaagatg

SEQ ID NO: 97317 - DNA, 103 bp, Artificial Sequence
  Synthetic Polynucleotide
taatacgactcactatagggaagggataggggaaggtcttaggaaagtcgaacagaggagacgacttatgtaagaccttaacctggcggcagcgcaaaagatg

SEQ ID NO: 97318 - DNA, 103 bp, Artificial Sequence
  Synthetic Polynucleotide
taatacgactcactatagggacgctcagctcataggccttcttcatcagcaacagaggagagctgatatggaaggcctaaacctggcggcagcgcaaaagatg

SEQ ID NO: 97319 - DNA, 103 bp, Artificial Sequence
  Synthetic Polynucleotide
taatacgactcactatagggggcgaggagcaagggataggggaaggtcttaacagaggagaaagaccatgccctatcccaacctggcggcagcgcaaaagatg

SEQ ID NO: 97320 - DNA, 103 bp, Artificial Sequence
  Synthetic Polynucleotide
taatacgactcactatagggccagggaccgggcgaggagcaagggataggaacagaggagacctatcatgtgctcctcgaacctggcggcagcgcaaaagatg

SEQ ID NO: 97321 - DNA, 103 bp, Artificial Sequence
  Synthetic Polynucleotide
taatacgactcactatagggagaggctctgccagggaccgggcgaggagcaacagaggagagctcctatgccggtccctaacctggcggcagcgcaaaagatg

SEQ ID NO: 97322 - DNA, 103 bp, Artificial Sequence
  Synthetic Polynucleotide
taatacgactcactatagggcccaggccgcagaggctctgccagggaccgaacagaggagacggtccatggcagagcctaacctggcggcagcgcaaaagatg

SEQ ID NO: 97323 - DNA, 103 bp, Artificial Sequence
  Synthetic Polynucleotide
taatacgactcactataggggcagggcgggcccaggccgcagaggctctgaacagaggagacagagcatgtgcggcctgaacctggcggcagcgcaaaagatg

SEQ ID NO: 97324 - DNA, 103 bp, Artificial Sequence
  Synthetic Polynucleotide
taatacgactcactatagggggcagccggcgcagggcgggcccaggccgcaacagaggagagcggccatggcccgccctaacctggcggcagcgcaaaagatg

SEQ ID NO: 97325 - DNA, 103 bp, Artificial Sequence
  Synthetic Polynucleotide
taatacgactcactataggggtcggccaagggcagccggcgcagggcgggaacagaggagacccgccatgcgccggctgaacctggcggcagcgcaaaagatg

SEQ ID NO: 97326 - DNA, 103 bp, Artificial Sequence
  Synthetic Polynucleotide
taatacgactcactatagggggggccagccgtcggccaagggcagccggcaacagaggagagccggcatgccttggccgaacctggcggcagcgcaaaagatg

SEQ ID NO: 97327 - DNA, 103 bp, Artificial Sequence
  Synthetic Polynucleotide
taatacgactcactatagggatctcctaccggggccagccgtcggccaagaacagaggagacttggcatgcggctggccaacctggcggcagcgcaaaagatg

SEQ ID NO: 97328 - DNA, 103 bp, Artificial Sequence
  Synthetic Polynucleotide
taatacgactcactatagggccaccgggtgatctcctaccggggccagccaacagaggagaggctggatgcggtaggagaacctggcggcagcgcaaaagatg

SEQ ID NO: 97329 - DNA, 103 bp, Artificial Sequence
  Synthetic Polynucleotide
taatacgactcactatagggttcttcaacgcgaagagcagataaatccataacagaggagaatggatatgtctgctcttaacctggcggcagcgcaaaagatg

SEQ ID NO: 97330 - DNA, 103 bp, Artificial Sequence
  Synthetic Polynucleotide
taatacgactcactataggggtcacactttgtggagacaggttccttgataacagaggagaatcaagatgcctgtctccaacctggcggcagcgcaaaagatg

SEQ ID NO: 97331 - DNA, 103 bp, Artificial Sequence
  Synthetic Polynucleotide
taatacgactcactatagggatctgcagacacctcaaacttgtcagcagaaacagaggagatctgctatgaagtttgagaacctggcggcagcgcaaaagatg

SEQ ID NO: 97332 - DNA, 103 bp, Artificial Sequence
  Synthetic Polynucleotide
taatacgactcactatagggtggtagaactatctgcagacacctcaaactaacagaggagaagtttgatgtgtctgcagaacctggcggcagcgcaaaagatg

SEQ ID NO: 97333 - DNA, 103 bp, Artificial Sequence
  Synthetic Polynucleotide
taatacgactcactatagggttatttttactggtagaactatctgcagacaacagaggagagtctgcatgtagttctacaacctggcggcagcgcaaaagatg

SEQ ID NO: 97334 - DNA, 103 bp, Artificial Sequence
  Synthetic Polynucleotide
taatacgactcactatagggtcctggttctttatttttactggtagaactaacagaggagaagttctatgagtaaaaataacctggcggcagcgcaaaagatg

SEQ ID NO: 97335 - DNA, 103 bp, Artificial Sequence
  Synthetic Polynucleotide
taatacgactcactatagggacctttccactcctggttctttatttttacaacagaggagagtaaaaatgaagaaccagaacctggcggcagcgcaaaagatg

SEQ ID NO: 97336 - DNA, 103 bp, Artificial Sequence
  Synthetic Polynucleotide
taatacgactcactataggggaaggggatgacctttccactcctggttctaacagaggagaagaaccatgagtggaaagaacctggcggcagcgcaaaagatg

SEQ ID NO: 97337 - DNA, 103 bp, Artificial Sequence
  Synthetic Polynucleotide
taatacgactcactatagggtgggcatttagaaggggatgacctttccacaacagaggagagtggaaatgtcatcccctaacctggcggcagcgcaaaagatg

SEQ ID NO: 97338 - DNA, 103 bp, Artificial Sequence
  Synthetic Polynucleotide
taatacgactcactatagggcatctaatgatgggcatttagaaggggatgaacagaggagacatcccatgctaaatgccaacctggcggcagcgcaaaagatg

SEQ ID NO: 97339 - DNA, 103 bp, Artificial Sequence
  Synthetic Polynucleotide
taatacgactcactatagggtaccacctatcatctaatgatgggcatttaaacagaggagataaatgatgatcattagaaacctggcggcagcgcaaaagatg

SEQ ID NO: 97340 - DNA, 103 bp, Artificial Sequence
  Synthetic Polynucleotide
taatacgactcactatagggactgtgcatgtaccacctatcatctaatgaaacagaggagatcattaatggataggtggaacctggcggcagcgcaaaagatg

SEQ ID NO: 97341 - DNA, 103 bp, Artificial Sequence
  Synthetic Polynucleotide
taatacgactcactatagggaaaatatgtggtcacactttgtggagacagaacagaggagactgtctatgcaaagtgtgaacctggcggcagcgcaaaagatg

SEQ ID NO: 97342 - DNA, 103 bp, Artificial Sequence
  Synthetic Polynucleotide
taatacgactcactatagggtcccagagcaactgtgcatgtaccacctataacagaggagaataggtatgacatgcacaaacctggcggcagcgcaaaagatg

SEQ ID NO: 97343 - DNA, 103 bp, Artificial Sequence
  Synthetic Polynucleotide
taatacgactcactatagggttctgaagactcccagagcaactgtgcatgaacagaggagacatgcaatgttgctctggaacctggcggcagcgcaaaagatg

SEQ ID NO: 97344 - DNA, 103 bp, Artificial Sequence
  Synthetic Polynucleotide
taatacgactcactataggggtagtttctattctgaagactcccagagcaaacagaggagatgctctatgagtcttcagaacctggcggcagcgcaaaagatg

SEQ ID NO: 97345 - DNA, 103 bp, Artificial Sequence
  Synthetic Polynucleotide
taatacgactcactatagggcttgagatgggtagtttctattctgaagacaacagaggagagtcttcatgatagaaactaacctggcggcagcgcaaaagatg

SEQ ID NO: 97346 - DNA, 103 bp, Artificial Sequence
  Synthetic Polynucleotide
taatacgactcactatagggatgagctcctcttgagatgggtagtttctaaacagaggagatagaaaatgcccatctcaaacctggcggcagcgcaaaagatg

SEQ ID NO: 97347 - DNA, 103 bp, Artificial Sequence
  Synthetic Polynucleotide
taatacgactcactatagggaacaaccttaatgagctcctcttgagatggaacagaggagaccatctatggaggagctcaacctggcggcagcgcaaaagatg

SEQ ID NO: 97348 - DNA, 103 bp, Artificial Sequence
  Synthetic Polynucleotide
taatacgactcactatagggcctccacatcaacaaccttaatgagctcctaacagaggagaaggagcatgttaaggttgaacctggcggcagcgcaaaagatg

SEQ ID NO: 97349 - DNA, 103 bp, Artificial Sequence
  Synthetic Polynucleotide
taatacgactcactatagggagctgttgctcctccacatcaacaaccttaaacagaggagataaggtatgtgatgtggaaacctggcggcagcgcaaaagatg

SEQ ID NO: 97350 - DNA, 103 bp, Artificial Sequence
  Synthetic Polynucleotide
taatacgactcactatagggagactcttccagctgttgctcctccacatcaacagaggagagatgtgatggagcaacagaacctggcggcagcgcaaaagatg

SEQ ID NO: 97351 - DNA, 103 bp, Artificial Sequence
  Synthetic Polynucleotide
taatacgactcactatagggcgtgtggcccagactcttccagctgttgctaacagaggagaagcaacatgtggaagagtaacctggcggcagcgcaaaagatg

SEQ ID NO: 97352 - DNA, 103 bp, Artificial Sequence
  Synthetic Polynucleotide
taatacgactcactatagggcaaaatttgcaaaatatgtggtcacactttaacagaggagaaaagtgatgccacatattaacctggcggcagcgcaaaagatg

SEQ ID NO: 97353 - DNA, 103 bp, Artificial Sequence
  Synthetic Polynucleotide
taatacgactcactatagggtccgtcaaatcgtgtggcccagactcttccaacagaggagaggaagaatgtgggccacaaacctggcggcagcgcaaaagatg

SEQ ID NO: 97354 - DNA, 103 bp, Artificial Sequence
  Synthetic Polynucleotide
taatacgactcactataggggtaagatgtttccgtcaaatcgtgtggcccaacagaggagagggccaatggatttgacgaacctggcggcagcgcaaaagatg

SEQ ID NO: 97355 - DNA, 103 bp, Artificial Sequence
  Synthetic Polynucleotide
taatacgactcactataggggccttggcaagtaagatgtttccgtcaaataacagaggagaatttgaatgaaacatcttaacctggcggcagcgcaaaagatg

SEQ ID NO: 97356 - DNA, 103 bp, Artificial Sequence
  Synthetic Polynucleotide
taatacgactcactatagggtctagatcttgccttggcaagtaagatgttaacagaggagaaacatcatgcttgccaagaacctggcggcagcgcaaaagatg

SEQ ID NO: 97357 - DNA, 103 bp, Artificial Sequence
  Synthetic Polynucleotide
taatacgactcactatagggaggggttccctctagatcttgccttggcaaaacagaggagattgccaatgcaagatctaaacctggcggcagcgcaaaagatg

SEQ ID NO: 97358 - DNA, 103 bp, Artificial Sequence
  Synthetic Polynucleotide
taatacgactcactatagggattccaggtaaggggttccctctagatcttaacagaggagaaagatcatgagggaacccaacctggcggcagcgcaaaagatg

SEQ ID NO: 97359 - DNA, 103 bp, Artificial Sequence
  Synthetic Polynucleotide
taatacgactcactatagggctgattccagattccaggtaaggggttcccaacagaggagagggaacatgttacctggaaacctggcggcagcgcaaaagatg

SEQ ID NO: 97360 - DNA, 103 bp, Artificial Sequence
  Synthetic Polynucleotide
taatacgactcactatagggagagaagaggctgattccagattccaggtaaacagaggagatacctgatgtctggaatcaacctggcggcagcgcaaaagatg

SEQ ID NO: 97361 - DNA, 103 bp, Artificial Sequence
  Synthetic Polynucleotide
taatacgactcactatagggcagggtcatcagagaagaggctgattccagaacagaggagactggaaatggcctcttctaacctggcggcagcgcaaaagatg

SEQ ID NO: 97362 - DNA, 103 bp, Artificial Sequence
  Synthetic Polynucleotide
taatacgactcactatagggggatcagattcagggtcatcagagaagaggaacagaggagacctcttatgtgatgacccaacctggcggcagcgcaaaagatg

SEQ ID NO: 97363 - DNA, 103 bp, Artificial Sequence
  Synthetic Polynucleotide
taatacgactcactatagggtttcagcatgcaaaatttgcaaaatatgtgaacagaggagacacataatgtgcaaatttaacctggcggcagcgcaaaagatg

SEQ ID NO: 97364 - DNA, 103 bp, Artificial Sequence
  Synthetic Polynucleotide
taatacgactcactataggggtcttcagaaggatcagattcagggtcatcaacagaggagagatgacatggaatctgataacctggcggcagcgcaaaagatg

SEQ ID NO: 97365 - DNA, 103 bp, Artificial Sequence
  Synthetic Polynucleotide
taatacgactcactatagggctggggctctgtcttcagaaggatcagattaacagaggagaaatctgatgcttctgaagaacctggcggcagcgcaaaagatg

SEQ ID NO: 97366 - DNA, 103 bp, Artificial Sequence
  Synthetic Polynucleotide
taatacgactcactatagggcgagctgactctggggctctgtcttcagaaaacagaggagattctgaatgcagagccccaacctggcggcagcgcaaaagatg

SEQ ID NO: 97367 - DNA, 103 bp, Artificial Sequence
  Synthetic Polynucleotide
taatacgactcactataggggttgccaacacgagctgactctggggctctaacagaggagaagagccatggagtcagctaacctggcggcagcgcaaaagatg

SEQ ID NO: 97368 - DNA, 103 bp, Artificial Sequence
  Synthetic Polynucleotide
taatacgactcactatagggaagatggtatgttgccaacacgagctgactaacagaggagaagtcagatggtgttggcaaacctggcggcagcgcaaaagatg

SEQ ID NO: 97369 - DNA, 103 bp, Artificial Sequence
  Synthetic Polynucleotide
taatacgactcactataggggcagaggttgaagatggtatgttgccaacaaacagaggagatgttggatgcataccatcaacctggcggcagcgcaaaagatg

SEQ ID NO: 97370 - DNA, 103 bp, Artificial Sequence
  Synthetic Polynucleotide
taatacgactcactatagggaactttcaatgcagaggttgaagatggtataacagaggagaataccaatgtcaacctctaacctggcggcagcgcaaaagatg

SEQ ID NO: 97371 - DNA, 103 bp, Artificial Sequence
  Synthetic Polynucleotide
taatacgactcactatagggtcaattggggaactttcaatgcagaggttgaacagaggagacaacctatgcattgaaagaacctggcggcagcgcaaaagatg

SEQ ID NO: 97372 - DNA, 103 bp, Artificial Sequence
  Synthetic Polynucleotide
taatacgactcactatagggtctgcaactttcaattggggaactttcaataacagaggagaattgaaatgtccccaattaacctggcggcagcgcaaaagatg

SEQ ID NO: 97373 - DNA, 103 bp, Artificial Sequence
  Synthetic Polynucleotide
taatacgactcactatagggctgggcagattctgcaactttcaattggggaacagaggagaccccaaatgaaagttgcaaacctggcggcagcgcaaaagatg

SEQ ID NO: 97374 - DNA, 103 bp, Artificial Sequence
  Synthetic Polynucleotide
taatacgactcactatagggggttgagaagtttcagcatgcaaaatttgcaacagaggagagcaaatatggcatgctgaaacctggcggcagcgcaaaagatg

SEQ ID NO: 97375 - DNA, 103 bp, Artificial Sequence
  Synthetic Polynucleotide
taatacgactcactatagggcagctggactctgggcagattctgcaacttaacagaggagaaagttgatgaatctgcccaacctggcggcagcgcaaaagatg

SEQ ID NO: 97376 - DNA, 103 bp, Artificial Sequence
  Synthetic Polynucleotide
taatacgactcactataggggtatgagcagcagctggactctgggcagataacagaggagaatctgcatggagtccagcaacctggcggcagcgcaaaagatg

SEQ ID NO: 97377 - DNA, 103 bp, Artificial Sequence
  Synthetic Polynucleotide
taatacgactcactatagggagtatcagtagtatgagcagcagctggactaacagaggagaagtccaatggctgctcataacctggcggcagcgcaaaagatg

SEQ ID NO: 97378 - DNA, 103 bp, Artificial Sequence
  Synthetic Polynucleotide
taatacgactcactatagggtatacccagcagtatcagtagtatgagcagaacagaggagactgctcatgctactgataaacctggcggcagcgcaaaagatg

SEQ ID NO: 97379 - DNA, 103 bp, Artificial Sequence
  Synthetic Polynucleotide
taatacgactcactatagggtccattgcattatacccagcagtatcagtaaacagaggagatactgaatgtgctgggtaaacctggcggcagcgcaaaagatg

SEQ ID NO: 97380 - DNA, 103 bp, Artificial Sequence
  Synthetic Polynucleotide
taatacgactcactatagggcacactttcttccattgcattatacccagcaacagaggagagctgggatgaatgcaatgaacctggcggcagcgcaaaagatg

SEQ ID NO: 97381 - DNA, 103 bp, Artificial Sequence
  Synthetic Polynucleotide
taatacgactcactatagggtctccctgctcacactttcttccattgcataacagaggagaatgcaaatgaagaaagtgaacctggcggcagcgcaaaagatg

SEQ ID NO: 97382 - DNA, 103 bp, Artificial Sequence
  Synthetic Polynucleotide
taatacgactcactatagggaattctggcttctccctgctcacactttctaacagaggagaagaaagatggagcagggaaacctggcggcagcgcaaaagatg

SEQ ID NO: 97383 - DNA, 103 bp, Artificial Sequence
  Synthetic Polynucleotide
taatacgactcactatagggtgaagctgtcaattctggcttctccctgctaacagaggagaagcaggatgaagccagaaaacctggcggcagcgcaaaagatg

SEQ ID NO: 97384 - DNA, 103 bp, Artificial Sequence
  Synthetic Polynucleotide
taatacgactcactatagggccctttctgttgaagctgtcaattctggctaacagaggagaagccagatgtgacagcttaacctggcggcagcgcaaaagatg

SEQ ID NO: 97385 - DNA, 103 bp, Artificial Sequence
  Synthetic Polynucleotide
taatacgactcactatagggcctttcttctggttgagaagtttcagcatgaacagaggagacatgctatgacttctcaaaacctggcggcagcgcaaaagatg

SEQ ID NO: 97386 - DNA, 103 bp, Artificial Sequence
  Synthetic Polynucleotide
taatacgactcactatagggcttttgttgaccctttctgttgaagctgtcaacagaggagagacagcatgaacagaaagaacctggcggcagcgcaaaagatg

SEQ ID NO: 97387 - DNA, 103 bp, Artificial Sequence
  Synthetic Polynucleotide
taatacgactcactatagggcatggacattcttttgttgaccctttctgtaacagaggagaacagaaatggtcaacaaaaacctggcggcagcgcaaaagatg

SEQ ID NO: 97388 - DNA, 103 bp, Artificial Sequence
  Synthetic Polynucleotide
taatacgactcactatagggcagacaccaccatggacattcttttgttgaaacagaggagatcaacaatggaatgtccaaacctggcggcagcgcaaaagatg

SEQ ID NO: 97389 - DNA, 103 bp, Artificial Sequence
  Synthetic Polynucleotide
taatacgactcactatagggggggtcaggccagacaccaccatggacattaacagaggagaaatgtcatgggtggtgtcaacctggcggcagcgcaaaagatg

SEQ ID NO: 97390 - DNA, 103 bp, Artificial Sequence
  Synthetic Polynucleotide
taatacgactcactatagggaaattcttctggggtcaggccagacaccacaacagaggagagtggtgatgggcctgaccaacctggcggcagcgcaaaagatg

SEQ ID NO: 97391 - DNA, 103 bp, Artificial Sequence
  Synthetic Polynucleotide
taatacgactcactatagggacacgagcataaattcttctggggtcaggcaacagaggagagcctgaatgcagaagaataacctggcggcagcgcaaaagatg

SEQ ID NO: 97392 - DNA, 103 bp, Artificial Sequence
  Synthetic Polynucleotide
taatacgactcactataggggcaaacttgtacacgagcataaattcttctaacagaggagaagaagaatgtatgctcgtaacctggcggcagcgcaaaagatg

SEQ ID NO: 97393 - DNA, 103 bp, Artificial Sequence
  Synthetic Polynucleotide
taatacgactcactataggggtgttttctggcaaacttgtacacgagcataacagaggagaatgctcatgtacaagtttaacctggcggcagcgcaaaagatg

SEQ ID NO: 97394 - DNA, 103 bp, Artificial Sequence
  Synthetic Polynucleotide
taatacgactcactatagggaagtgatgtggtgttttctggcaaacttgtaacagaggagaacaagtatgccagaaaacaacctggcggcagcgcaaaagatg

SEQ ID NO: 97395 - DNA, 103 bp, Artificial Sequence
  Synthetic Polynucleotide
taatacgactcactatagggagattagttaaagtgatgtggtgttttctgaacagaggagacagaaaatgccacatcacaacctggcggcagcgcaaaagatg

SEQ ID NO: 97396 - DNA, 103 bp, Artificial Sequence
  Synthetic Polynucleotide
taatacgactcactatagggctgtgaaggccctttcttctggttgagaagaacagaggagacttctcatgcagaagaaaaacctggcggcagcgcaaaagatg

SEQ ID NO: 97397 - DNA, 103 bp, Artificial Sequence
  Synthetic Polynucleotide
taatacgactcactatagggttcagtaattagattagttaaagtgatgtgaacagaggagacacatcatgttaactaataacctggcggcagcgcaaaagatg

SEQ ID NO: 97398 - DNA, 103 bp, Artificial Sequence
  Synthetic Polynucleotide
taatacgactcactataggggagtagtctcttcagtaattagattagttaaacagaggagataactaatgtaattactgaacctggcggcagcgcaaaagatg

SEQ ID NO: 97399 - DNA, 103 bp, Artificial Sequence
  Synthetic Polynucleotide
taatacgactcactatagggataacaacatgagtagtctcttcagtaattaacagaggagaaattacatgagagactacaacctggcggcagcgcaaaagatg

SEQ ID NO: 97400 - DNA, 103 bp, Artificial Sequence
  Synthetic Polynucleotide
taatacgactcactatagggatctgttttcataacaacatgagtagtctcaacagaggagagagactatgcatgttgttaacctggcggcagcgcaaaagatg

SEQ ID NO: 97401 - DNA, 103 bp, Artificial Sequence
  Synthetic Polynucleotide
taatacgactcactatagggcaaactcagcatctgttttcataacaacataacagaggagaatgttgatgtgaaaacagaacctggcggcagcgcaaaagatg

SEQ ID NO: 97402 - DNA, 103 bp, Artificial Sequence
  Synthetic Polynucleotide
taatacgactcactatagggcgttcacacacaaactcagcatctgttttcaacagaggagagaaaacatgtgctgagttaacctggcggcagcgcaaaagatg

SEQ ID NO: 97403 - DNA, 103 bp, Artificial Sequence
  Synthetic Polynucleotide
taatacgactcactatagggtttcagtgtccgttcacacacaaactcagcaacagaggagagctgagatggtgtgtgaaaacctggcggcagcgcaaaagatg

SEQ ID NO: 97404 - DNA, 103 bp, Artificial Sequence
  Synthetic Polynucleotide
taatacgactcactatagggctagaaaatatttcagtgtccgttcacacaaacagaggagatgtgtgatgggacactgaaacctggcggcagcgcaaaagatg

SEQ ID NO: 97405 - DNA, 103 bp, Artificial Sequence
  Synthetic Polynucleotide
taatacgactcactatagggcccgcaattcctagaaaatatttcagtgtcaacagaggagagacactatgatattttctaacctggcggcagcgcaaaagatg

SEQ ID NO: 97406 - DNA, 103 bp, Artificial Sequence
  Synthetic Polynucleotide
taatacgactcactatagggccattttcctcccgcaattcctagaaaataaacagaggagatattttatgggaattgcgaacctggcggcagcgcaaaagatg

SEQ ID NO: 97407 - DNA, 103 bp, Artificial Sequence
  Synthetic Polynucleotide
taatacgactcactatagggataaaggacactgtgaaggccctttcttctaacagaggagaagaagaatgggccttcacaacctggcggcagcgcaaaagatg

SEQ ID NO: 97408 - DNA, 103 bp, Artificial Sequence
  Synthetic Polynucleotide
taatacgactcactatagggagctaactacccattttcctcccgcaattcaacagaggagagaattgatggaggaaaataacctggcggcagcgcaaaagatg

SEQ ID NO: 97409 - DNA, 103 bp, Artificial Sequence
  Synthetic Polynucleotide
taatacgactcactatagggacccagaaatagctaactacccattttcctaacagaggagaaggaaaatgggtagttagaacctggcggcagcgcaaaagatg

SEQ ID NO: 97410 - DNA, 103 bp, Artificial Sequence
  Synthetic Polynucleotide
taatacgactcactatagggagactgggtcacccagaaatagctaactacaacagaggagagtagttatgtatttctggaacctggcggcagcgcaaaagatg

SEQ ID NO: 97411 - DNA, 103 bp, Artificial Sequence
  Synthetic Polynucleotide
taatacgactcactatagggtttctttaatagactgggtcacccagaaataacagaggagaatttctatgtgacccagtaacctggcggcagcgcaaaagatg

SEQ ID NO: 97412 - DNA, 103 bp, Artificial Sequence
  Synthetic Polynucleotide
taatacgactcactatagggagcatttttctttctttaatagactgggtcaacagaggagagacccaatgtattaaagaaacctggcggcagcgcaaaagatg

SEQ ID NO: 97413 - DNA, 103 bp, Artificial Sequence
  Synthetic Polynucleotide
taatacgactcactatagggatgctcattcagcatttttctttctttaataacagaggagaattaaaatgagaaaaatgaacctggcggcagcgcaaaagatg

SEQ ID NO: 97414 - DNA, 103 bp, Artificial Sequence
  Synthetic Polynucleotide
taatacgactcactatagggcttcaaaatcatgctcattcagcatttttcaacagaggagagaaaaaatgtgaatgagcaacctggcggcagcgcaaaagatg

SEQ ID NO: 97415 - DNA, 103 bp, Artificial Sequence
  Synthetic Polynucleotide
taatacgactcactatagggtctcctctgacttcaaaatcatgctcattcaacagaggagagaatgaatgtgattttgaaacctggcggcagcgcaaaagatg

SEQ ID NO: 97416 - DNA, 103 bp, Artificial Sequence
  Synthetic Polynucleotide
taatacgactcactatagggattgaccacatctcctctgacttcaaaatcaacagaggagagattttatggtcagaggaaacctggcggcagcgcaaaagatg

SEQ ID NO: 97417 - DNA, 103 bp, Artificial Sequence
  Synthetic Polynucleotide
taatacgactcactatagggggtttcttccattgaccacatctcctctgaaacagaggagatcagagatgatgtggtcaaacctggcggcagcgcaaaagatg

SEQ ID NO: 97418 - DNA, 103 bp, Artificial Sequence
  Synthetic Polynucleotide
taatacgactcactatagggtcattcttacataaaggacactgtgaaggcaacagaggagagccttcatggtgtcctttaacctggcggcagcgcaaaagatg

SEQ ID NO: 97419 - DNA, 103 bp, Artificial Sequence
  Synthetic Polynucleotide
taatacgactcactatagggggaccttggtggtttcttccattgaccacaaacagaggagatgtggtatgtggaagaaaaacctggcggcagcgcaaaagatg

SEQ ID NO: 97420 - DNA, 103 bp, Artificial Sequence
  Synthetic Polynucleotide
taatacgactcactatagggtgctcgctttggaccttggtggtttcttccaacagaggagaggaagaatgcaccaaggtaacctggcggcagcgcaaaagatg

SEQ ID NO: 97421 - DNA, 103 bp, Artificial Sequence
  Synthetic Polynucleotide
taatacgactcactataggggggattctcttgctcgctttggaccttggtaacagaggagaaccaagatgcaaagcgagaacctggcggcagcgcaaaagatg

SEQ ID NO: 97422 - DNA, 103 bp, Artificial Sequence
  Synthetic Polynucleotide
taatacgactcactatagggtttctgtcctgggattctcttgctcgctttaacagaggagaaaagcgatgaagagaatcaacctggcggcagcgcaaaagatg

SEQ ID NO: 97423 - DNA, 103 bp, Artificial Sequence
  Synthetic Polynucleotide
taatacgactcactatagggcctgaagatctttctgtcctgggattctctaacagaggagaagagaaatgcaggacagaaacctggcggcagcgcaaaagatg

SEQ ID NO: 97424 - DNA, 103 bp, Artificial Sequence
  Synthetic Polynucleotide
taatacgactcactatagggtttctagccccctgaagatctttctgtcctaacagaggagaaggacaatgagatcttcaaacctggcggcagcgcaaaagatg

SEQ ID NO: 97425 - DNA, 103 bp, Artificial Sequence
  Synthetic Polynucleotide
taatacgactcactatagggtagcaacagatttctagccccctgaagatcaacagaggagagatcttatgggggctagaaacctggcggcagcgcaaaagatg

SEQ ID NO: 97426 - DNA, 103 bp, Artificial Sequence
  Synthetic Polynucleotide
taatacgactcactataggggaagggcccatagcaacagatttctagcccaacagaggagagggctaatgatctgttgcaacctggcggcagcgcaaaagatg

SEQ ID NO: 97427 - DNA, 103 bp, Artificial Sequence
  Synthetic Polynucleotide
taatacgactcactataggggcatgttggtgaagggcccatagcaacagaaacagaggagatctgttatgatgggccctaacctggcggcagcgcaaaagatg

SEQ ID NO: 97428 - DNA, 103 bp, Artificial Sequence
  Synthetic Polynucleotide
taatacgactcactatagggtgatctgtgggcatgttggtgaagggcccaaacagaggagatgggccatgcaccaacataacctggcggcagcgcaaaagatg

SEQ ID NO: 97429 - DNA, 103 bp, Artificial Sequence
  Synthetic Polynucleotide
taatacgactcactatagggtttggttatatcattcttacataaaggacaaacagaggagatgtcctatgtgtaagaataacctggcggcagcgcaaaagatg

SEQ ID NO: 97430 - DNA, 103 bp, Artificial Sequence
  Synthetic Polynucleotide
taatacgactcactatagggccattccagttgatctgtgggcatgttggtaacagaggagaaccaacatgcccacagataacctggcggcagcgcaaaagatg

SEQ ID NO: 97431 - DNA, 103 bp, Artificial Sequence
  Synthetic Polynucleotide
taatacgactcactataggggctgtaccatccattccagttgatctgtggaacagaggagaccacagatgaactggaataacctggcggcagcgcaaaagatg

SEQ ID NO: 97432 - DNA, 103 bp, Artificial Sequence
  Synthetic Polynucleotide
taatacgactcactataggggcaccacacagctgtaccatccattccagtaacagaggagaactggaatggatggtacaaacctggcggcagcgcaaaagatg

SEQ ID NO: 97433 - DNA, 103 bp, Artificial Sequence
  Synthetic Polynucleotide
taatacgactcactatagggcaccacagaagcaccacacagctgtaccataacagaggagaatggtaatgctgtgtggtaacctggcggcagcgcaaaagatg

SEQ ID NO: 97434 - DNA, 103 bp, Artificial Sequence
  Synthetic Polynucleotide
taatacgactcactatagggaaagctccttcaccacagaagcaccacacaaacagaggagatgtgtgatgcttctgtggaacctggcggcagcgcaaaagatg

SEQ ID NO: 97435 - DNA, 103 bp, Artificial Sequence
  Synthetic Polynucleotide
taatacgactcactataggggtgaatgatgaaagctccttcaccacagaaaacagaggagattctgtatggaaggagctaacctggcggcagcgcaaaagatg

SEQ ID NO: 97436 - DNA, 103 bp, Artificial Sequence
  Synthetic Polynucleotide
taatacgactcactatagggtgtgccaagggtgaatgatgaaagctccttaacagaggagaaaggagatgtcatcattcaacctggcggcagcgcaaaagatg

SEQ ID NO: 97437 - DNA, 103 bp, Artificial Sequence
  Synthetic Polynucleotide
taatacgactcactatagggggtggacacctgtgccaagggtgaatgatgaacagaggagacatcatatgcccttggcaaacctggcggcagcgcaaaagatg

SEQ ID NO: 97438 - DNA, 103 bp, Artificial Sequence
  Synthetic Polynucleotide
taatacgactcactatagggaccacaattgggtggacacctgtgccaaggaacagaggagaccttggatgaggtgtccaaacctggcggcagcgcaaaagatg

SEQ ID NO: 97439 - DNA, 103 bp, Artificial Sequence
  Synthetic Polynucleotide
taatacgactcactatagggtggctgcacaaccacaattgggtggacaccaacagaggagaggtgtcatgccaattgtgaacctggcggcagcgcaaaagatg

SEQ ID NO: 97440 - DNA, 103 bp, Artificial Sequence
  Synthetic Polynucleotide
taatacgactcactatagggcattttgtacttcttcaacgcgaagagcagaacagaggagactgctcatggcgttgaagaacctggcggcagcgcaaaagatg

SEQ ID NO: 97441 - DNA, 103 bp, Artificial Sequence
  Synthetic Polynucleotide
taatacgactcactataggggtaggctccttttggttatatcattcttacaacagaggagagtaagaatgatataaccaaacctggcggcagcgcaaaagatg

SEQ ID NO: 97442 - DNA, 103 bp, Artificial Sequence
  Synthetic Polynucleotide
taatacgactcactatagggtccaggcatctggctgcacaaccacaattgaacagaggagacaattgatgttgtgcagcaacctggcggcagcgcaaaagatg

SEQ ID NO: 97443 - DNA, 103 bp, Artificial Sequence
  Synthetic Polynucleotide
taatacgactcactatagggttgtcctctgtccaggcatctggctgcacaaacagaggagatgtgcaatgagatgcctgaacctggcggcagcgcaaaagatg

SEQ ID NO: 97444 - DNA, 103 bp, Artificial Sequence
  Synthetic Polynucleotide
taatacgactcactatagggatggaagccattgtcctctgtccaggcatcaacagaggagagatgccatgacagaggacaacctggcggcagcgcaaaagatg

SEQ ID NO: 97445 - DNA, 103 bp, Artificial Sequence
  Synthetic Polynucleotide
taatacgactcactataggggcccaattgcatggaagccattgtcctctgaacagaggagacagaggatgatggcttccaacctggcggcagcgcaaaagatg

SEQ ID NO: 97446 - DNA, 103 bp, Artificial Sequence
  Synthetic Polynucleotide
taatacgactcactatagggtcacacatctgcccaattgcatggaagccaaacagaggagatggcttatgtgcaattggaacctggcggcagcgcaaaagatg

SEQ ID NO: 97447 - DNA, 103 bp, Artificial Sequence
  Synthetic Polynucleotide
taatacgactcactatagggcacaggtgcctcacacatctgcccaattgcaacagaggagagcaattatgcagatgtgtaacctggcggcagcgcaaaagatg

SEQ ID NO: 97448 - DNA, 103 bp, Artificial Sequence
  Synthetic Polynucleotide
taatacgactcactatagggctcgggtcaccacaggtgcctcacacatctaacagaggagaagatgtatgaggcacctgaacctggcggcagcgcaaaagatg

SEQ ID NO: 97449 - DNA, 103 bp, Artificial Sequence
  Synthetic Polynucleotide
taatacgactcactatagggaacacccactctcgggtcaccacaggtgccaacagaggagaggcaccatgggtgacccgaacctggcggcagcgcaaaagatg

SEQ ID NO: 97450 - DNA, 103 bp, Artificial Sequence
  Synthetic Polynucleotide
taatacgactcactatagggtacactgtccaacacccactctcgggtcacaacagaggagagtgaccatggagtgggtgaacctggcggcagcgcaaaagatg

SEQ ID NO: 97451 - DNA, 103 bp, Artificial Sequence
  Synthetic Polynucleotide
taatacgactcactatagggggtagagtgctacactgtccaacacccactaacagaggagaagtgggatgtggacagtgaacctggcggcagcgcaaaagatg

SEQ ID NO: 97452 - DNA, 103 bp, Artificial Sequence
  Synthetic Polynucleotide
taatacgactcactataggggtactttcttgtaggctccttttggttataaacagaggagatataacatgaaggagcctaacctggcggcagcgcaaaagatg

SEQ ID NO: 97453 - DNA, 103 bp, Artificial Sequence
  Synthetic Polynucleotide
taatacgactcactatagggtcctggcactggtagagtgctacactgtccaacagaggagaggacagatgagcactctaaacctggcggcagcgcaaaagatg

SEQ ID NO: 97454 - DNA, 103 bp, Artificial Sequence
  Synthetic Polynucleotide
taatacgactcactatagggggtgtccagctcctggcactggtagagtgcaacagaggagagcactcatgcagtgccagaacctggcggcagcgcaaaagatg

SEQ ID NO: 97455 - DNA, 103 bp, Artificial Sequence
  Synthetic Polynucleotide
taatacgactcactataggggtatcaggtaggtgtccagctcctggcactaacagaggagaagtgccatgagctggacaaacctggcggcagcgcaaaagatg

SEQ ID NO: 97456 - DNA, 103 bp, Artificial Sequence
  Synthetic Polynucleotide
taatacgactcactataggggggatctggggtatcaggtaggtgtccagcaacagaggagagctggaatgctacctgataacctggcggcagcgcaaaagatg

SEQ ID NO: 97457 - DNA, 103 bp, Artificial Sequence
  Synthetic Polynucleotide
taatacgactcactataggggtggctgtgggggatctggggtatcaggtaaacagaggagatacctgatgccccagatcaacctggcggcagcgcaaaagatg

SEQ ID NO: 97458 - DNA, 103 bp, Artificial Sequence
  Synthetic Polynucleotide
taatacgactcactatagggactaaatctcgtactttcttgtaggctcctaacagaggagaaggagcatgcaagaaagtaacctggcggcagcgcaaaagatg

SEQ ID NO: 97459 - DNA, 103 bp, Artificial Sequence
  Synthetic Polynucleotide
taatacgactcactatagggcaacaagttgactaaatctcgtactttcttaacagaggagaaagaaaatgcgagatttaaacctggcggcagcgcaaaagatg

SEQ ID NO: 97460 - DNA, 103 bp, Artificial Sequence
  Synthetic Polynucleotide
taatacgactcactatagggaatagctcttcaacaagttgactaaatctcaacagaggagagagattatgtcaacttgtaacctggcggcagcgcaaaagatg

SEQ ID NO: 97461 - DNA, 103 bp, Artificial Sequence
  Synthetic Polynucleotide
taatacgactcactatagggaatgattttcaatagctcttcaacaagttgaacagaggagacaacttatggaagagctaaacctggcggcagcgcaaaagatg

SEQ ID NO: 97462 - DNA, 103 bp, Artificial Sequence
  Synthetic Polynucleotide
taatacgactcactataggggaaaagcacaaatgattttcaatagctcttaacagaggagaaagagcatgtgaaaatcaaacctggcggcagcgcaaaagatg

SEQ ID NO: 97463 - DNA, 103 bp, Artificial Sequence
  Synthetic Polynucleotide
taatacgactcactataggggtgtcaagctgaaaagcacaaatgattttcaacagaggagagaaaatatgttgtgctttaacctggcggcagcgcaaaagatg

SEQ ID NO: 97464 - DNA, 103 bp, Artificial Sequence
  Synthetic Polynucleotide
taatacgactcactatagggctccaaacctgtgtcaagctgaaaagcacaaacagaggagatgtgctatgcagcttgacaacctggcggcagcgcaaaagatg

SEQ ID NO: 97465 - DNA, 103 bp, Artificial Sequence
  Synthetic Polynucleotide
taatacgactcactatagggtgtttgcatactccaaacctgtgtcaagctaacagaggagaagcttgatgcaggtttggaacctggcggcagcgcaaaagatg

SEQ ID NO: 97466 - DNA, 103 bp, Artificial Sequence
  Synthetic Polynucleotide
taatacgactcactataggggcattaatgacattttgtacttcttcaacgaacagaggagacgttgaatgagtacaaaaaacctggcggcagcgcaaaagatg

SEQ ID NO: 97467 - DNA, 103 bp, Artificial Sequence
  Synthetic Polynucleotide
taatacgactcactatagggaaattatagctgtttgcatactccaaacctaacagaggagaaggtttatggtatgcaaaaacctggcggcagcgcaaaagatg

SEQ ID NO: 97468 - DNA, 103 bp, Artificial Sequence
  Synthetic Polynucleotide
taatacgactcactatagggcttttttgcaaaattatagctgtttgcataaacagaggagatatgcaatgagctataataacctggcggcagcgcaaaagatg

SEQ ID NO: 97469 - DNA, 103 bp, Artificial Sequence
  Synthetic Polynucleotide
taatacgactcactatagggagttattttccttttttgcaaaattatagcaacagaggagagctataatgttgcaaaaaaacctggcggcagcgcaaaagatg

SEQ ID NO: 97470 - DNA, 103 bp, Artificial Sequence
  Synthetic Polynucleotide
taatacgactcactatagggtgttcaggagagttattttccttttttgcaaacagaggagatgcaaaatgggaaaataaaacctggcggcagcgcaaaagatg

SEQ ID NO: 97471 - DNA, 103 bp, Artificial Sequence
  Synthetic Polynucleotide
taatacgactcactatagggatcttttagatgttcaggagagttattttcaacagaggagagaaaatatgtctcctgaaaacctggcggcagcgcaaaagatg

SEQ ID NO: 97472 - DNA, 103 bp, Artificial Sequence
  Synthetic Polynucleotide
taatacgactcactatagggtagaaacttcatcttttagatgttcaggagaacagaggagactcctgatgatctaaaagaacctggcggcagcgcaaaagatg

SEQ ID NO: 97473 - DNA, 103 bp, Artificial Sequence
  Synthetic Polynucleotide
taatacgactcactatagggctttggatgatagaaacttcatcttttagaaacagaggagatctaaaatgtgaagtttcaacctggcggcagcgcaaaagatg

SEQ ID NO: 97474 - DNA, 103 bp, Artificial Sequence
  Synthetic Polynucleotide
taatacgactcactataggggtagcccatactttggatgatagaaacttcaacagaggagagaagttatgatcatccaaaacctggcggcagcgcaaaagatg

SEQ ID NO: 97475 - DNA, 103 bp, Artificial Sequence
  Synthetic Polynucleotide
taatacgactcactatagggcacggtttctgtagcccatactttggatgaaacagaggagatcatccatggtatgggctaacctggcggcagcgcaaaagatg

SEQ ID NO: 97476 - DNA, 103 bp, Artificial Sequence
  Synthetic Polynucleotide
taatacgactcactatagggagtcttttggcacggtttctgtagcccataaacagaggagatatgggatgcagaaaccgaacctggcggcagcgcaaaagatg

SEQ ID NO: 97477 - DNA, 103 bp, Artificial Sequence
  Synthetic Polynucleotide
taatacgactcactatagggtttctgcatagcattaatgacattttgtacaacagaggagagtacaaatggtcattaataacctggcggcagcgcaaaagatg

SEQ ID NO: 97478 - DNA, 103 bp, Artificial Sequence
  Synthetic Polynucleotide
taatacgactcactatagggactctgtagaagtcttttggcacggtttctaacagaggagaagaaacatggccaaaagaaacctggcggcagcgcaaaagatg

SEQ ID NO: 97479 - DNA, 103 bp, Artificial Sequence
  Synthetic Polynucleotide
taatacgactcactatagggtttcgggttcactctgtagaagtcttttggaacagaggagaccaaaaatgttctacagaaacctggcggcagcgcaaaagatg

SEQ ID NO: 97480 - DNA, 103 bp, Artificial Sequence
  Synthetic Polynucleotide
taatacgactcactatagggaaggaaggattttcgggttcactctgtagaaacagaggagatctacaatgtgaacccgaaacctggcggcagcgcaaaagatg

SEQ ID NO: 97481 - DNA, 103 bp, Artificial Sequence
  Synthetic Polynucleotide
taatacgactcactatagggggtttcctgcaaggaaggattttcgggttcaacagaggagagaacccatgaatccttccaacctggcggcagcgcaaaagatg

SEQ ID NO: 97482 - DNA, 103 bp, Artificial Sequence
  Synthetic Polynucleotide
taatacgactcactatagggcactgagactggtttcctgcaaggaaggataacagaggagaatccttatgtgcaggaaaaacctggcggcagcgcaaaagatg

SEQ ID NO: 97483 - DNA, 103 bp, Artificial Sequence
  Synthetic Polynucleotide
taatacgactcactataggggagagttggacactgagactggtttcctgcaacagaggagagcaggaatgcagtctcagaacctggcggcagcgcaaaagatg

SEQ ID NO: 97484 - DNA, 103 bp, Artificial Sequence
  Synthetic Polynucleotide
taatacgactcactatagggtccaaggttagagagttggacactgagactaacagaggagaagtctcatggtccaactcaacctggcggcagcgcaaaagatg

SEQ ID NO: 97485 - DNA, 103 bp, Artificial Sequence
  Synthetic Polynucleotide
taatacgactcactatagggttctcacagttccaaggttagagagttggaaacagaggagatccaacatgctaaccttgaacctggcggcagcgcaaaagatg

SEQ ID NO: 97486 - DNA, 103 bp, Artificial Sequence
  Synthetic Polynucleotide
taatacgactcactataggggtcctcagagttctcacagttccaaggttaaacagaggagataacctatgaactgtgagaacctggcggcagcgcaaaagatg

SEQ ID NO: 97487 - DNA, 103 bp, Artificial Sequence
  Synthetic Polynucleotide
taatacgactcactatagggccgctgctttgtcctcagagttctcacagtaacagaggagaactgtgatgactctgaggaacctggcggcagcgcaaaagatg

SEQ ID NO: 97488 - DNA, 103 bp, Artificial Sequence
  Synthetic Polynucleotide
taatacgactcactatagggactctaagattttctgcatagcattaatgaaacagaggagatcattaatgctatgcagaaacctggcggcagcgcaaaagatg

SEQ ID NO: 97489 - DNA, 103 bp, Artificial Sequence
  Synthetic Polynucleotide
taatacgactcactataggggaggttgtatccgctgctttgtcctcagagaacagaggagactctgaatgcaaagcagcaacctggcggcagcgcaaaagatg

SEQ ID NO: 97490 - DNA, 103 bp, Artificial Sequence
  Synthetic Polynucleotide
taatacgactcactataggggacgtcttttgaggttgtatccgctgctttaacagaggagaaaagcaatggatacaaccaacctggcggcagcgcaaaagatg

SEQ ID NO: 97491 - DNA, 103 bp, Artificial Sequence
  Synthetic Polynucleotide
taatacgactcactatagggaatgtagacagacgtcttttgaggttgtataacagaggagaatacaaatgcaaaagacgaacctggcggcagcgcaaaagatg

SEQ ID NO: 97492 - DNA, 103 bp, Artificial Sequence
  Synthetic Polynucleotide
taatacgactcactatagggatcccaattcaatgtagacagacgtcttttaacagaggagaaaaagaatgctgtctacaaacctggcggcagcgcaaaagatg

SEQ ID NO: 97493 - DNA, 103 bp, Artificial Sequence
  Synthetic Polynucleotide
taatacgactcactataggggaagaatcagatcccaattcaatgtagacaaacagaggagatgtctaatgtgaattgggaacctggcggcagcgcaaaagatg

SEQ ID NO: 97494 - DNA, 103 bp, Artificial Sequence
  Synthetic Polynucleotide
taatacgactcactatagggggtatcttcagaagaatcagatcccaattcaacagaggagagaattgatgtctgattctaacctggcggcagcgcaaaagatg

SEQ ID NO: 97495 - DNA, 103 bp, Artificial Sequence
  Synthetic Polynucleotide
taatacgactcactatagggccttattaacggtatcttcagaagaatcagaacagaggagactgattatgctgaagataaacctggcggcagcgcaaaagatg

SEQ ID NO: 97496 - DNA, 103 bp, Artificial Sequence
  Synthetic Polynucleotide
taatacgactcactatagggcaataagttgccttattaacggtatcttcaaacagaggagatgaagaatgcgttaataaaacctggcggcagcgcaaaagatg

SEQ ID NO: 97497 - DNA, 103 bp, Artificial Sequence
  Synthetic Polynucleotide
taatacgactcactatagggtcccacactgcaataagttgccttattaacaacagaggagagttaatatggcaacttataacctggcggcagcgcaaaagatg

SEQ ID NO: 97498 - DNA, 103 bp, Artificial Sequence
  Synthetic Polynucleotide
taatacgactcactatagggattcttgatctcccacactgcaataagttgaacagaggagacaacttatggcagtgtggaacctggcggcagcgcaaaagatg

SEQ ID NO: 97499 - DNA, 103 bp, Artificial Sequence
  Synthetic Polynucleotide
taatacgactcactatagggcagatgggacactctaagattttctgcataaacagaggagatatgcaatgaatcttagaaacctggcggcagcgcaaaagatg

SEQ ID NO: 97500 - DNA, 103 bp, Artificial Sequence
  Synthetic Polynucleotide
taatacgactcactatagggatttgtaacaattcttgatctcccacactgaacagaggagacagtgtatgagatcaagaaacctggcggcagcgcaaaagatg

SEQ ID NO: 97501 - DNA, 103 bp, Artificial Sequence
  Synthetic Polynucleotide
taatacgactcactatagggttgaggggtgatttgtaacaattcttgatcaacagaggagagatcaaatgttgttacaaaacctggcggcagcgcaaaagatg

SEQ ID NO: 97502 - DNA, 103 bp, Artificial Sequence
  Synthetic Polynucleotide
taatacgactcactatagggccctggttccttgaggggtgatttgtaacaaacagaggagatgttacatgtcacccctcaacctggcggcagcgcaaaagatg

SEQ ID NO: 97503 - DNA, 103 bp, Artificial Sequence
  Synthetic Polynucleotide
taatacgactcactatagggctgatttcatccctggttccttgaggggtgaacagaggagacaccccatgaggaaccagaacctggcggcagcgcaaaagatg

SEQ ID NO: 97504 - DNA, 103 bp, Artificial Sequence
  Synthetic Polynucleotide
taatacgactcactatagggagaatccaaactgatttcatccctggttccaacagaggagaggaaccatggatgaaatcaacctggcggcagcgcaaaagatg

SEQ ID NO: 97505 - DNA, 103 bp, Artificial Sequence
  Synthetic Polynucleotide
taatacgactcactatagggccttttttgcagaatccaaactgatttcataacagaggagaatgaaaatggtttggattaacctggcggcagcgcaaaagatg

SEQ ID NO: 97506 - DNA, 103 bp, Artificial Sequence
  Synthetic Polynucleotide
taatacgactcactataggggctgcttcacccttttttgcagaatccaaaaacagaggagatttggaatgtgcaaaaaaaacctggcggcagcgcaaaagatg

SEQ ID NO: 97507 - DNA, 103 bp, Artificial Sequence
  Synthetic Polynucleotide
taatacgactcactatagggacacccagatgctgcttcacccttttttgcaacagaggagagcaaaaatgggtgaagcaaacctggcggcagcgcaaaagatg

SEQ ID NO: 97508 - DNA, 103 bp, Artificial Sequence
  Synthetic Polynucleotide
taatacgactcactatagggtttcactctcacacccagatgctgcttcacaacagaggagagtgaagatgcatctgggtaacctggcggcagcgcaaaagatg

SEQ ID NO: 97509 - DNA, 103 bp, Artificial Sequence
  Synthetic Polynucleotide
taatacgactcactataggggagacgcttgtttcactctcacacccagataacagaggagaatctggatgtgagagtgaaacctggcggcagcgcaaaagatg

SEQ ID NO: 97510 - DNA, 103 bp, Artificial Sequence
  Synthetic Polynucleotide
taatacgactcactatagggcaactccagacagatgggacactctaagataacagaggagaatcttaatgtgtcccatcaacctggcggcagcgcaaaagatg

SEQ ID NO: 97511 - DNA, 103 bp, Artificial Sequence
  Synthetic Polynucleotide
taatacgactcactataggggcagtcttcagagacgcttgtttcactctcaacagaggagagagagtatgacaagcgtcaacctggcggcagcgcaaaagatg

SEQ ID NO: 97512 - DNA, 103 bp, Artificial Sequence
  Synthetic Polynucleotide
taatacgactcactatagggatagccctgagcagtcttcagagacgcttgaacagaggagacaagcgatgctgaagactaacctggcggcagcgcaaaagatg

SEQ ID NO: 97513 - DNA, 103 bp, Artificial Sequence
  Synthetic Polynucleotide
taatacgactcactatagggctctgagaggatagccctgagcagtcttcaaacagaggagatgaagaatgctcagggctaacctggcggcagcgcaaaagatg

SEQ ID NO: 97514 - DNA, 103 bp, Artificial Sequence
  Synthetic Polynucleotide
taatacgactcactatagggtaaaatgtcactctgagaggatagccctgaaacagaggagatcagggatgtcctctcagaacctggcggcagcgcaaaagatg

SEQ ID NO: 97515 - DNA, 103 bp, Artificial Sequence
  Synthetic Polynucleotide
taatacgactcactataggggctgagtggttaaaatgtcactctgagaggaacagaggagacctctcatggtgacatttaacctggcggcagcgcaaaagatg

SEQ ID NO: 97516 - DNA, 103 bp, Artificial Sequence
  Synthetic Polynucleotide
taatacgactcactataggggtatccctctgctgagtggttaaaatgtcaaacagaggagatgacatatgaaccactcaaacctggcggcagcgcaaaagatg

SEQ ID NO: 97517 - DNA, 103 bp, Artificial Sequence
  Synthetic Polynucleotide
taatacgactcactatagggatgttgcatggtatccctctgctgagtggtaacagaggagaaccactatgcagagggataacctggcggcagcgcaaaagatg

SEQ ID NO: 97518 - DNA, 103 bp, Artificial Sequence
  Synthetic Polynucleotide
taatacgactcactatagggttatcaggttatgttgcatggtatccctctaacagaggagaagagggatgccatgcaacaacctggcggcagcgcaaaagatg

SEQ ID NO: 97519 - DNA, 103 bp, Artificial Sequence
  Synthetic Polynucleotide
taatacgactcactatagggtgctggagctttatcaggttatgttgcatgaacagaggagacatgcaatgtaacctgataacctggcggcagcgcaaaagatg

SEQ ID NO: 97520 - DNA, 103 bp, Artificial Sequence
  Synthetic Polynucleotide
taatacgactcactatagggagccatttcctgctggagctttatcaggttaacagaggagaaacctgatgaagctccagaacctggcggcagcgcaaaagatg

SEQ ID NO: 97521 - DNA, 103 bp, Artificial Sequence
  Synthetic Polynucleotide
taatacgactcactataggggttccttgatcaactccagacagatgggacaacagaggagagtcccaatggtctggagtaacctggcggcagcgcaaaagatg

SEQ ID NO: 97522 - DNA, 103 bp, Artificial Sequence
  Synthetic Polynucleotide
taatacgactcactatagggcttctagttcagccatttcctgctggagctaacagaggagaagctccatgaggaaatggaacctggcggcagcgcaaaagatg

SEQ ID NO: 97523 - DNA, 103 bp, Artificial Sequence
  Synthetic Polynucleotide
taatacgactcactatagggtctaacacagcttctagttcagccatttccaacagaggagaggaaatatgtgaactagaaacctggcggcagcgcaaaagatg

SEQ ID NO: 97524 - DNA, 103 bp, Artificial Sequence
  Synthetic Polynucleotide
taatacgactcactatagggcccatgctgttctaacacagcttctagttcaacagaggagagaactaatggctgtgttaaacctggcggcagcgcaaaagatg

SEQ ID NO: 97525 - DNA, 103 bp, Artificial Sequence
  Synthetic Polynucleotide
taatacgactcactatagggaaggctggctcccatgctgttctaacacagaacagaggagactgtgtatgaacagcatgaacctggcggcagcgcaaaagatg

SEQ ID NO: 97526 - DNA, 103 bp, Artificial Sequence
  Synthetic Polynucleotide
taatacgactcactatagggtagctgttagaaggctggctcccatgctgtaacagaggagaacagcaatggagccagccaacctggcggcagcgcaaaagatg

SEQ ID NO: 97527 - DNA, 103 bp, Artificial Sequence
  Synthetic Polynucleotide
taatacgactcactataggggatggaagggtagctgttagaaggctggctaacagaggagaagccagatgtctaacagcaacctggcggcagcgcaaaagatg

SEQ ID NO: 97528 - DNA, 103 bp, Artificial Sequence
  Synthetic Polynucleotide
taatacgactcactatagggagtcacttatgatggaagggtagctgttagaacagaggagactaacaatgacccttccaaacctggcggcagcgcaaaagatg

SEQ ID NO: 97529 - DNA, 103 bp, Artificial Sequence
  Synthetic Polynucleotide
taatacgactcactatagggagggcagaagagtcacttatgatggaagggaacagaggagacccttcatgcataagtgaaacctggcggcagcgcaaaagatg

SEQ ID NO: 97530 - DNA, 103 bp, Artificial Sequence
  Synthetic Polynucleotide
taatacgactcactatagggcaggtcctcaagggcagaagagtcacttataacagaggagaataagtatgtcttctgccaacctggcggcagcgcaaaagatg

SEQ ID NO: 97531 - DNA, 103 bp, Artificial Sequence
  Synthetic Polynucleotide
taatacgactcactatagggctggatttcgcaggtcctcaagggcagaagaacagaggagacttctgatgttgaggaccaacctggcggcagcgcaaaagatg

SEQ ID NO: 97532 - DNA, 103 bp, Artificial Sequence
  Synthetic Polynucleotide
taatacgactcactataggggtggagacaggttccttgatcaactccagaaacagaggagatctggaatggatcaaggaaacctggcggcagcgcaaaagatg

SEQ ID NO: 97533 - DNA, 103 bp, Artificial Sequence
  Synthetic Polynucleotide
taatacgactcactataggggtgctttgttctggatttcgcaggtcctcaaacagaggagatgaggaatggcgaaatccaacctggcggcagcgcaaaagatg

SEQ ID NO: 97534 - DNA, 103 bp, Artificial Sequence
  Synthetic Polynucleotide
taatacgactcactatagggtttttctgatgtgctttgttctggatttcgaacagaggagacgaaatatggaacaaagcaacctggcggcagcgcaaaagatg

SEQ ID NO: 97535 - DNA, 103 bp, Artificial Sequence
  Synthetic Polynucleotide
taatacgactcactatagggttaatactgctttttctgatgtgctttgttaacagaggagaaacaaaatgcatcagaaaaacctggcggcagcgcaaaagatg

SEQ ID NO: 97536 - DNA, 103 bp, Artificial Sequence
  Synthetic Polynucleotide
taatacgactcactatagggttctgtgaagttaatactgctttttctgataacagaggagaatcagaatgagcagtattaacctggcggcagcgcaaaagatg

SEQ ID NO: 97537 - DNA, 103 bp, Artificial Sequence
  Synthetic Polynucleotide
taatacgactcactatagggttcactacttttctgtgaagttaatactgcaacagaggagagcagtaatgacttcacagaacctggcggcagcgcaaaagatg

SEQ ID NO: 97538 - DNA, 103 bp, Artificial Sequence
  Synthetic Polynucleotide
taatacgactcactatagggttatagggtattcactacttttctgtgaagaacagaggagacttcacatgaaagtagtgaacctggcggcagcgcaaaagatg

SEQ ID NO: 97539 - DNA, 103 bp, Artificial Sequence
  Synthetic Polynucleotide
taatacgactcactatagggggattctggcttatagggtattcactacttaacagaggagaaagtagatgataccctataacctggcggcagcgcaaaagatg

SEQ ID NO: 97540 - DNA, 103 bp, Artificial Sequence
  Synthetic Polynucleotide
taatacgactcactatagggaaggccttctggattctggcttatagggtaaacagaggagataccctatgagccagaataacctggcggcagcgcaaaagatg

SEQ ID NO: 97541 - DNA, 103 bp, Artificial Sequence
  Synthetic Polynucleotide
taatacgactcactatagggtgtcagcagaaaggccttctggattctggcaacagaggagagccagaatgcagaaggccaacctggcggcagcgcaaaagatg

SEQ ID NO: 97542 - DNA, 103 bp, Artificial Sequence
  Synthetic Polynucleotide
taatacgactcactatagggacctcaaacttgtcagcagaaaggccttctaacagaggagaagaaggatgttctgctgaaacctggcggcagcgcaaaagatg

SEQ ID NO: 97543 - DNA, 103 bp, Artificial Sequence
  Synthetic Polynucleotide
taatacgactcactatagggcgacttgtgcttcttgtgcttcttgcccataacagaggagaatgggcatgaagcacaagaacctggcggcagcgcaaaagatg

SEQ ID NO: 97544 - DNA, 103 bp, Artificial Sequence
  Synthetic Polynucleotide
taatacgactcactataggggcccgtggagagttcggtgacttcgttcccaacagaggagagggaacatggtcaccgaaaacctggcggcagcgcaaaagatg

SEQ ID NO: 97545 - DNA, 103 bp, Artificial Sequence
  Synthetic Polynucleotide
taatacgactcactatagggaaattcgcactgactgttcacaagccgcctaacagaggagaaggcggatggtgaacagtaacctggcggcagcgcaaaagatg

SEQ ID NO: 97546 - DNA, 103 bp, Artificial Sequence
  Synthetic Polynucleotide
taatacgactcactatagggttcttctttcaaattcgcactgactgttcaaacagaggagatgaacaatgagtgcgaataacctggcggcagcgcaaaagatg

SEQ ID NO: 97547 - DNA, 103 bp, Artificial Sequence
  Synthetic Polynucleotide
taatacgactcactatagggccatctggttttcttctttcaaattcgcacaacagaggagagtgcgaatgtgaaagaagaacctggcggcagcgcaaaagatg

SEQ ID NO: 97548 - DNA, 103 bp, Artificial Sequence
  Synthetic Polynucleotide
taatacgactcactatagggcgtcgttgttccatctggttttcttctttcaacagaggagagaaagaatgaaaccagataacctggcggcagcgcaaaagatg

SEQ ID NO: 97549 - DNA, 103 bp, Artificial Sequence
  Synthetic Polynucleotide
taatacgactcactataggggaagtcccaacgtcgttgttccatctggttaacagaggagaaaccagatggaacaacgaaacctggcggcagcgcaaaagatg

SEQ ID NO: 97550 - DNA, 103 bp, Artificial Sequence
  Synthetic Polynucleotide
taatacgactcactatagggacaggatggagaagtcccaacgtcgttgttaacagaggagaaacaacatggttgggactaacctggcggcagcgcaaaagatg

SEQ ID NO: 97551 - DNA, 103 bp, Artificial Sequence
  Synthetic Polynucleotide
taatacgactcactatagggaatgggatccacaggatggagaagtcccaaaacagaggagattgggaatgctccatcctaacctggcggcagcgcaaaagatg

SEQ ID NO: 97552 - DNA, 103 bp, Artificial Sequence
  Synthetic Polynucleotide
taatacgactcactataggggctctcctacaatgggatccacaggatggaaacagaggagatccatcatgtggatcccaaacctggcggcagcgcaaaagatg

SEQ ID NO: 97553 - DNA, 103 bp, Artificial Sequence
  Synthetic Polynucleotide
taatacgactcactatagggcagtagcctggctctcctacaatgggatccaacagaggagaggatccatgtgtaggagaaacctggcggcagcgcaaaagatg

SEQ ID NO: 97554 - DNA, 103 bp, Artificial Sequence
  Synthetic Polynucleotide
taatacgactcactatagggtctcacagggcagtagcctggctctcctacaacagaggagagtaggaatgccaggctacaacctggcggcagcgcaaaagatg

SEQ ID NO: 97555 - DNA, 103 bp, Artificial Sequence
  Synthetic Polynucleotide
taatacgactcactataggggccccgagctgcccgtggagagttcggtgaaacagaggagatcaccgatgtctccacggaacctggcggcagcgcaaaagatg

SEQ ID NO: 97556 - DNA, 103 bp, Artificial Sequence
  Synthetic Polynucleotide
taatacgactcactatagggtcattcccagtctcacagggcagtagcctgaacagaggagacaggctatggccctgtgaaacctggcggcagcgcaaaagatg

SEQ ID NO: 97557 - DNA, 103 bp, Artificial Sequence
  Synthetic Polynucleotide
taatacgactcactatagggcttccagttgtcattcccagtctcacagggaacagaggagaccctgtatgactgggaataacctggcggcagcgcaaaagatg

SEQ ID NO: 97558 - DNA, 103 bp, Artificial Sequence
  Synthetic Polynucleotide
taatacgactcactatagggagactgaagtcttccagttgtcattcccagaacagaggagactgggaatgacaactggaaacctggcggcagcgcaaaagatg

SEQ ID NO: 97559 - DNA, 103 bp, Artificial Sequence
  Synthetic Polynucleotide
taatacgactcactatagggtattcactccagactgaagtcttccagttgaacagaggagacaactgatggacttcagtaacctggcggcagcgcaaaagatg

SEQ ID NO: 97560 - DNA, 103 bp, Artificial Sequence
  Synthetic Polynucleotide
taatacgactcactatagggccctgcaaagtattcactccagactgaagtaacagaggagaacttcaatgtggagtgaaaacctggcggcagcgcaaaagatg

SEQ ID NO: 97561 - DNA, 103 bp, Artificial Sequence
  Synthetic Polynucleotide
taatacgactcactatagggctctttgaacccctgcaaagtattcactccaacagaggagaggagtgatgactttgcagaacctggcggcagcgcaaaagatg

SEQ ID NO: 97562 - DNA, 103 bp, Artificial Sequence
  Synthetic Polynucleotide
taatacgactcactatagggtccttttatcctctttgaacccctgcaaagaacagaggagactttgcatgggttcaaagaacctggcggcagcgcaaaagatg

SEQ ID NO: 97563 - DNA, 103 bp, Artificial Sequence
  Synthetic Polynucleotide
taatacgactcactataggggtgactttgttccttttatcctctttgaacaacagaggagagttcaaatgggataaaagaacctggcggcagcgcaaaagatg

SEQ ID NO: 97564 - DNA, 103 bp, Artificial Sequence
  Synthetic Polynucleotide
taatacgactcactatagggtaacactggagtgactttgttccttttatcaacagaggagagataaaatgaacaaagtcaacctggcggcagcgcaaaagatg

SEQ ID NO: 97565 - DNA, 103 bp, Artificial Sequence
  Synthetic Polynucleotide
taatacgactcactatagggaattcaaatataacactggagtgactttgtaacagaggagaacaaagatgctccagtgtaacctggcggcagcgcaaaagatg

SEQ ID NO: 97566 - DNA, 103 bp, Artificial Sequence
  Synthetic Polynucleotide
taatacgactcactatagggctggagtcgtgccccgagctgcccgtggagaacagaggagactccacatgcagctcgggaacctggcggcagcgcaaaagatg

SEQ ID NO: 97567 - DNA, 103 bp, Artificial Sequence
  Synthetic Polynucleotide
taatacgactcactatagggtagggcccataattcaaatataacactggaaacagaggagatccagtatgatatttgaaaacctggcggcagcgcaaaagatg

SEQ ID NO: 97568 - DNA, 103 bp, Artificial Sequence
  Synthetic Polynucleotide
taatacgactcactatagggataagaactgtagggcccataattcaaataaacagaggagatatttgatgtatgggcccaacctggcggcagcgcaaaagatg

SEQ ID NO: 97569 - DNA, 103 bp, Artificial Sequence
  Synthetic Polynucleotide
taatacgactcactatagggaatgcggtgcataagaactgtagggcccataacagaggagaatgggcatgacagttcttaacctggcggcagcgcaaaagatg

SEQ ID NO: 97570 - DNA, 103 bp, Artificial Sequence
  Synthetic Polynucleotide
taatacgactcactataggggtggagtcataatgcggtgcataagaactgaacagaggagacagttcatgtgcaccgcaaacctggcggcagcgcaaaagatg

SEQ ID NO: 97571 - DNA, 103 bp, Artificial Sequence
  Synthetic Polynucleotide
taatacgactcactatagggatttgcaaatgtggagtcataatgcggtgcaacagaggagagcaccgatgtatgactccaacctggcggcagcgcaaaagatg

SEQ ID NO: 97572 - DNA, 103 bp, Artificial Sequence
  Synthetic Polynucleotide
taatacgactcactatagggccttgctgatatttgcaaatgtggagtcataacagaggagaatgactatgcatttgcaaaacctggcggcagcgcaaaagatg

SEQ ID NO: 97573 - DNA, 103 bp, Artificial Sequence
  Synthetic Polynucleotide
taatacgactcactatagggtcagaatcatccttgctgatatttgcaaataacagaggagaatttgcatgtatcagcaaaacctggcggcagcgcaaaagatg

SEQ ID NO: 97574 - DNA, 103 bp, Artificial Sequence
  Synthetic Polynucleotide
taatacgactcactatagggatagattaaatcagaatcatccttgctgataacagaggagaatcagcatggatgattctaacctggcggcagcgcaaaagatg

SEQ ID NO: 97575 - DNA, 103 bp, Artificial Sequence
  Synthetic Polynucleotide
taatacgactcactatagggcataggttgaatagattaaatcagaatcataacagaggagaatgattatgatttaatctaacctggcggcagcgcaaaagatg

SEQ ID NO: 97576 - DNA, 103 bp, Artificial Sequence
  Synthetic Polynucleotide
taatacgactcactataggggagtcttccccataggttgaatagattaaaaacagaggagatttaatatgttcaacctaaacctggcggcagcgcaaaagatg

SEQ ID NO: 97577 - DNA, 103 bp, Artificial Sequence
  Synthetic Polynucleotide
taatacgactcactatagggttcgaagaggctggagtcgtgccccgagctaacagaggagaagctcgatgcacgactccaacctggcggcagcgcaaaagatg

SEQ ID NO: 97578 - DNA, 103 bp, Artificial Sequence
  Synthetic Polynucleotide
taatacgactcactatagggtggaagatcagagtcttccccataggttgaaacagaggagatcaaccatgggggaagacaacctggcggcagcgcaaaagatg

SEQ ID NO: 97579 - DNA, 103 bp, Artificial Sequence
  Synthetic Polynucleotide
taatacgactcactatagggtgaaatcacttggaagatcagagtcttcccaacagaggagagggaagatgctgatcttcaacctggcggcagcgcaaaagatg

SEQ ID NO: 97580 - DNA, 103 bp, Artificial Sequence
  Synthetic Polynucleotide
taatacgactcactatagggtcatggatgctgaaatcacttggaagatcaaacagaggagatgatctatgaagtgatttaacctggcggcagcgcaaaagatg

SEQ ID NO: 97581 - DNA, 103 bp, Artificial Sequence
  Synthetic Polynucleotide
taatacgactcactatagggggccaaaaactcatggatgctgaaatcactaacagaggagaagtgatatgagcatccataacctggcggcagcgcaaaagatg

SEQ ID NO: 97582 - DNA, 103 bp, Artificial Sequence
  Synthetic Polynucleotide
taatacgactcactatagggcttggcacgtggccaaaaactcatggatgcaacagaggagagcatccatgagtttttggaacctggcggcagcgcaaaagatg

SEQ ID NO: 97583 - DNA, 103 bp, Artificial Sequence
  Synthetic Polynucleotide
taatacgactcactatagggtacggataatcttggcacgtggccaaaaacaacagaggagagtttttatgcacgtgccaaacctggcggcagcgcaaaagatg

SEQ ID NO: 97584 - DNA, 103 bp, Artificial Sequence
  Synthetic Polynucleotide
taatacgactcactatagggtgccatgacatacggataatcttggcacgtaacagaggagaacgtgcatggattatccgaacctggcggcagcgcaaaagatg

SEQ ID NO: 97585 - DNA, 103 bp, Artificial Sequence
  Synthetic Polynucleotide
taatacgactcactataggggtaaactatctgccatgacatacggataataacagaggagaattatcatgatgtcatggaacctggcggcagcgcaaaagatg

SEQ ID NO: 97586 - DNA, 103 bp, Artificial Sequence
  Synthetic Polynucleotide
taatacgactcactatagggaaaacatccagtaaactatctgccatgacaaacagaggagatgtcatatgagatagtttaacctggcggcagcgcaaaagatg

SEQ ID NO: 97587 - DNA, 103 bp, Artificial Sequence
  Synthetic Polynucleotide
taatacgactcactatagggtccttttgttaaaacatccagtaaactatcaacagaggagagatagtatgctggatgttaacctggcggcagcgcaaaagatg

SEQ ID NO: 97588 - DNA, 103 bp, Artificial Sequence
  Synthetic Polynucleotide
taatacgactcactatagggcgtttttgtcttcgaagaggctggagtcgtaacagaggagaacgactatggcctcttcgaacctggcggcagcgcaaaagatg

SEQ ID NO: 97589 - DNA, 103 bp, Artificial Sequence
  Synthetic Polynucleotide
taatacgactcactatagggtggaatgccctccttttgttaaaacatccaaacagaggagatggatgatgtaacaaaagaacctggcggcagcgcaaaagatg

SEQ ID NO: 97590 - DNA, 103 bp, Artificial Sequence
  Synthetic Polynucleotide
taatacgactcactatagggtgtagggtcctggaatgccctccttttgttaacagaggagaaacaaaatgagggcattcaacctggcggcagcgcaaaagatg

SEQ ID NO: 97591 - DNA, 103 bp, Artificial Sequence
  Synthetic Polynucleotide
taatacgactcactatagggctccatctcttgtagggtcctggaatgcccaacagaggagagggcatatgaggaccctaaacctggcggcagcgcaaaagatg

SEQ ID NO: 97592 - DNA, 103 bp, Artificial Sequence
  Synthetic Polynucleotide
taatacgactcactataggggcaatgacatctccatctcttgtagggtccaacagaggagaggacccatgaagagatggaacctggcggcagcgcaaaagatg

SEQ ID NO: 97593 - DNA, 103 bp, Artificial Sequence
  Synthetic Polynucleotide
taatacgactcactatagggtcatcttcaggcaatgacatctccatctctaacagaggagaagagatatggatgtcattaacctggcggcagcgcaaaagatg

SEQ ID NO: 97594 - DNA, 103 bp, Artificial Sequence
  Synthetic Polynucleotide
taatacgactcactatagggagtatggccttcatcttcaggcaatgacataacagaggagaatgtcaatgcctgaagataacctggcggcagcgcaaaagatg

SEQ ID NO: 97595 - DNA, 103 bp, Artificial Sequence
  Synthetic Polynucleotide
taatacgactcactatagggcaagtgtcctagtatggccttcatcttcagaacagaggagactgaagatgaaggccataaacctggcggcagcgcaaaagatg

SEQ ID NO: 97596 - DNA, 103 bp, Artificial Sequence
  Synthetic Polynucleotide
taatacgactcactatagggtttgctgtgtcaagtgtcctagtatggcctaacagaggagaaggccaatgtaggacactaacctggcggcagcgcaaaagatg

SEQ ID NO: 97597 - DNA, 103 bp, Artificial Sequence
  Synthetic Polynucleotide
taatacgactcactatagggctccatttcttttgctgtgtcaagtgtcctaacagaggagaaggacaatggacacagcaaacctggcggcagcgcaaaagatg

SEQ ID NO: 97598 - DNA, 103 bp, Artificial Sequence
  Synthetic Polynucleotide
taatacgactcactatagggctgtaatctgctccatttcttttgctgtgtaacagaggagaacacagatgaagaaatggaacctggcggcagcgcaaaagatg

SEQ ID NO: 97599 - DNA, 103 bp, Artificial Sequence
  Synthetic Polynucleotide
taatacgactcactatagggttgtcatgatcgtttttgtcttcgaagaggaacagaggagacctcttatgagacaaaaaaacctggcggcagcgcaaaagatg

SEQ ID NO: 97600 - DNA, 103 bp, Artificial Sequence
  Synthetic Polynucleotide
taatacgactcactatagggggctctacttctgtaatctgctccatttctaacagaggagaagaaatatggcagattacaacctggcggcagcgcaaaagatg

SEQ ID NO: 97601 - DNA, 103 bp, Artificial Sequence
  Synthetic Polynucleotide
taatacgactcactatagggacgccctggtggctctacttctgtaatctgaacagaggagacagattatggaagtagagaacctggcggcagcgcaaaagatg

SEQ ID NO: 97602 - DNA, 103 bp, Artificial Sequence
  Synthetic Polynucleotide
taatacgactcactatagggtggagtccaaacgccctggtggctctacttaacagaggagaaagtagatgcaccagggcaacctggcggcagcgcaaaagatg

SEQ ID NO: 97603 - DNA, 103 bp, Artificial Sequence
  Synthetic Polynucleotide
taatacgactcactatagggtcttgagtactggagtccaaacgccctggtaacagaggagaaccaggatgtttggactcaacctggcggcagcgcaaaagatg

SEQ ID NO: 97604 - DNA, 103 bp, Artificial Sequence
  Synthetic Polynucleotide
taatacgactcactatagggtatgagcctgtcttgagtactggagtccaaaacagaggagattggacatgagtactcaaaacctggcggcagcgcaaaagatg

SEQ ID NO: 97605 - DNA, 103 bp, Artificial Sequence
  Synthetic Polynucleotide
taatacgactcactatagggctttcagcgctatgagcctgtcttgagtacaacagaggagagtactcatgacaggctcaaacctggcggcagcgcaaaagatg

SEQ ID NO: 97606 - DNA, 103 bp, Artificial Sequence
  Synthetic Polynucleotide
taatacgactcactatagggtttgttactgctttcagcgctatgagcctgaacagaggagacaggctatgagcgctgaaaacctggcggcagcgcaaaagatg

SEQ ID NO: 97607 - DNA, 103 bp, Artificial Sequence
  Synthetic Polynucleotide
taatacgactcactatagggaacgccaaaatttgttactgctttcagcgcaacagaggagagcgctgatggcagtaacaaacctggcggcagcgcaaaagatg

SEQ ID NO: 97608 - DNA, 103 bp, Artificial Sequence
  Synthetic Polynucleotide
taatacgactcactatagggcttcaactggaacgccaaaatttgttactgaacagaggagacagtaaatgattttggcgaacctggcggcagcgcaaaagatg

SEQ ID NO: 97609 - DNA, 103 bp, Artificial Sequence
  Synthetic Polynucleotide
taatacgactcactataggggagtcaaaaacttcaactggaacgccaaaaaacagaggagattttggatgtccagttgaaacctggcggcagcgcaaaagatg

SEQ ID NO: 97610 - DNA, 103 bp, Artificial Sequence
  Synthetic Polynucleotide
taatacgactcactataggggtccttgtgtttgtcatgatcgtttttgtcaacagaggagagacaaaatggatcatgacaacctggcggcagcgcaaaagatg

SEQ ID NO: 97611 - DNA, 103 bp, Artificial Sequence
  Synthetic Polynucleotide
taatacgactcactatagggagcttcttcagagtcaaaaacttcaactggaacagaggagaccagttatggtttttgacaacctggcggcagcgcaaaagatg

SEQ ID NO: 97612 - DNA, 103 bp, Artificial Sequence
  Synthetic Polynucleotide
taatacgactcactatagggggaatatttcagcttcttcagagtcaaaaaaacagaggagatttttgatgctgaagaagaacctggcggcagcgcaaaagatg

SEQ ID NO: 97613 - DNA, 103 bp, Artificial Sequence
  Synthetic Polynucleotide
taatacgactcactatagggagtttcttctggaatatttcagcttcttcaaacagaggagatgaagaatgtgaaatattaacctggcggcagcgcaaaagatg

SEQ ID NO: 97614 - DNA, 103 bp, Artificial Sequence
  Synthetic Polynucleotide
taatacgactcactatagggggtctcatcaagtttcttctggaatatttcaacagaggagagaaataatgcagaagaaaaacctggcggcagcgcaaaagatg

SEQ ID NO: 97615 - DNA, 103 bp, Artificial Sequence
  Synthetic Polynucleotide
taatacgactcactataggggcaatctggtggtctcatcaagtttcttctaacagaggagaagaagaatgttgatgagaaacctggcggcagcgcaaaagatg

SEQ ID NO: 97616 - DNA, 103 bp, Artificial Sequence
  Synthetic Polynucleotide
taatacgactcactatagggagttccctgagcaatctggtggtctcatcaaacagaggagatgatgaatgcaccagattaacctggcggcagcgcaaaagatg

SEQ ID NO: 97617 - DNA, 103 bp, Artificial Sequence
  Synthetic Polynucleotide
taatacgactcactatagggggcttcctggagttccctgagcaatctggtaacagaggagaaccagaatgctcagggaaaacctggcggcagcgcaaaagatg

SEQ ID NO: 97618 - DNA, 103 bp, Artificial Sequence
  Synthetic Polynucleotide
taatacgactcactataggggttcattctgggcttcctggagttccctgaaacagaggagatcagggatgtccaggaagaacctggcggcagcgcaaaagatg

SEQ ID NO: 97619 - DNA, 103 bp, Artificial Sequence
  Synthetic Polynucleotide
taatacgactcactataggggtgctcaaacgttcattctgggcttcctggaacagaggagaccaggaatgccagaatgaaacctggcggcagcgcaaaagatg

SEQ ID NO: 97620 - DNA, 103 bp, Artificial Sequence
  Synthetic Polynucleotide
taatacgactcactatagggagggggtctggtgctcaaacgttcattctgaacagaggagacagaatatgcgtttgagcaacctggcggcagcgcaaaagatg

SEQ ID NO: 97621 - DNA, 103 bp, Artificial Sequence
  Synthetic Polynucleotide
taatacgactcactatagggtccgctttctgtccttgtgtttgtcatgataacagaggagaatcatgatgaacacaaggaacctggcggcagcgcaaaagatg

SEQ ID NO: 97622 - DNA, 103 bp, Artificial Sequence
  Synthetic Polynucleotide
taatacgactcactatagggtcatgttcggagggggtctggtgctcaaacaacagaggagagtttgaatgccagaccccaacctggcggcagcgcaaaagatg

SEQ ID NO: 97623 - DNA, 103 bp, Artificial Sequence
  Synthetic Polynucleotide
taatacgactcactatagggaagagacagatcatgttcggagggggtctgaacagaggagacagaccatgtccgaacataacctggcggcagcgcaaaagatg

SEQ ID NO: 97624 - DNA, 103 bp, Artificial Sequence
  Synthetic Polynucleotide
taatacgactcactatagggtgagggacccaagagacagatcatgttcggaacagaggagaccgaacatgatctgtctcaacctggcggcagcgcaaaagatg

SEQ ID NO: 97625 - DNA, 103 bp, Artificial Sequence
  Synthetic Polynucleotide
taatacgactcactatagggtttctctgtatgagggacccaagagacagaaacagaggagatctgtcatgtgggtccctaacctggcggcagcgcaaaagatg

SEQ ID NO: 97626 - DNA, 103 bp, Artificial Sequence
  Synthetic Polynucleotide
taatacgactcactataggggcaagatgcatttctctgtatgagggacccaacagaggagagggtccatgatacagagaaacctggcggcagcgcaaaagatg

SEQ ID NO: 97627 - DNA, 103 bp, Artificial Sequence
  Synthetic Polynucleotide
taatacgactcactatagggcacttgttcagcaagatgcatttctctgtaaacagaggagatacagaatgatgcatcttaacctggcggcagcgcaaaagatg

SEQ ID NO: 97628 - DNA, 103 bp, Artificial Sequence
  Synthetic Polynucleotide
taatacgactcactataggggattattggtcacttgttcagcaagatgcaaacagaggagatgcatcatgctgaacaagaacctggcggcagcgcaaaagatg

SEQ ID NO: 97629 - DNA, 103 bp, Artificial Sequence
  Synthetic Polynucleotide
taatacgactcactatagggagttctttaagattattggtcacttgttcaaacagaggagatgaacaatggaccaataaaacctggcggcagcgcaaaagatg

SEQ ID NO: 97630 - DNA, 103 bp, Artificial Sequence
  Synthetic Polynucleotide
taatacgactcactatagggttgctgtgcaagttctttaagattattggtaacagaggagaaccaatatgcttaaagaaaacctggcggcagcgcaaaagatg

SEQ ID NO: 97631 - DNA, 103 bp, Artificial Sequence
  Synthetic Polynucleotide
taatacgactcactatagggctggagttacttgctgtgcaagttctttaaaacagaggagattaaagatgttgcacagcaacctggcggcagcgcaaaagatg

SEQ ID NO: 97632 - DNA, 103 bp, Artificial Sequence
  Synthetic Polynucleotide
taatacgactcactatagggtttctctttttccgctttctgtccttgtgtaacagaggagaacacaaatgcagaaagcgaacctggcggcagcgcaaaagatg

SEQ ID NO: 97633 - DNA, 103 bp, Artificial Sequence
  Synthetic Polynucleotide
taatacgactcactatagggacgatatcacctggagttacttgctgtgcaaacagaggagatgcacaatgagtaactccaacctggcggcagcgcaaaagatg

SEQ ID NO: 97634 - DNA, 103 bp, Artificial Sequence
  Synthetic Polynucleotide
taatacgactcactatagggatacgtgcttacgatatcacctggagttacaacagaggagagtaactatgggtgatatcaacctggcggcagcgcaaaagatg

SEQ ID NO: 97635 - DNA, 103 bp, Artificial Sequence
  Synthetic Polynucleotide
taatacgactcactatagggttcgaactccatacgtgcttacgatatcacaacagaggagagtgataatgtaagcacgtaacctggcggcagcgcaaaagatg

SEQ ID NO: 97636 - DNA, 103 bp, Artificial Sequence
  Synthetic Polynucleotide
taatacgactcactatagggcccattgcttttcgaactccatacgtgcttaacagaggagaaagcacatgtggagttcgaacctggcggcagcgcaaaagatg

SEQ ID NO: 97637 - DNA, 103 bp, Artificial Sequence
  Synthetic Polynucleotide
taatacgactcactatagggaatggaaatccccattgcttttcgaactccaacagaggagaggagttatgaaagcaatgaacctggcggcagcgcaaaagatg

SEQ ID NO: 97638 - DNA, 103 bp, Artificial Sequence
  Synthetic Polynucleotide
taatacgactcactatagggcgggggaaggaatggaaatccccattgcttaacagaggagaaagcaaatgggatttccaaacctggcggcagcgcaaaagatg

SEQ ID NO: 97639 - DNA, 103 bp, Artificial Sequence
  Synthetic Polynucleotide
taatacgactcactatagggttttccatgacgggggaaggaatggaaatcaacagaggagagatttcatgtccttccccaacctggcggcagcgcaaaagatg

SEQ ID NO: 97640 - DNA, 103 bp, Artificial Sequence
  Synthetic Polynucleotide
taatacgactcactatagggcacaaagttgttttccatgacgggggaaggaacagaggagaccttccatggtcatggaaaacctggcggcagcgcaaaagatg

SEQ ID NO: 97641 - DNA, 103 bp, Artificial Sequence
  Synthetic Polynucleotide
taatacgactcactatagggctgtcaaatccacaaagttgttttccatgaaacagaggagatcatggatgacaactttgaacctggcggcagcgcaaaagatg

SEQ ID NO: 97642 - DNA, 103 bp, Artificial Sequence
  Synthetic Polynucleotide
taatacgactcactatagggtcagtgtcttctgtcaaatccacaaagttgaacagaggagacaacttatgggatttgacaacctggcggcagcgcaaaagatg

SEQ ID NO: 97643 - DNA, 103 bp, Artificial Sequence
  Synthetic Polynucleotide
taatacgactcactatagggctctcctttctttctctttttccgctttctaacagaggagaagaaagatgaaaaagagaaacctggcggcagcgcaaaagatg

SEQ ID NO: 97644 - DNA, 103 bp, Artificial Sequence
  Synthetic Polynucleotide
taatacgactcactatagggtttaggttcttcagtgtcttctgtcaaatcaacagaggagagatttgatggaagacactaacctggcggcagcgcaaaagatg

SEQ ID NO: 97645 - DNA, 103 bp, Artificial Sequence
  Synthetic Polynucleotide
taatacgactcactatagggcatccgtctttttaggttcttcagtgtcttaacagaggagaaagacaatgaagaacctaaacctggcggcagcgcaaaagatg

SEQ ID NO: 97646 - DNA, 103 bp, Artificial Sequence
  Synthetic Polynucleotide
taatacgactcactatagggcactcagcaacatccgtctttttaggttctaacagaggagaagaaccatgaaagacggaaacctggcggcagcgcaaaagatg

SEQ ID NO: 97647 - DNA, 103 bp, Artificial Sequence
  Synthetic Polynucleotide
taatacgactcactatagggaccaggtccacactcagcaacatccgtcttaacagaggagaaagacgatggttgctgagaacctggcggcagcgcaaaagatg

SEQ ID NO: 97648 - DNA, 103 bp, Artificial Sequence
  Synthetic Polynucleotide
taatacgactcactatagggggtgtttgtccgacttgtgcttcttgtgctaacagaggagaagcacaatgagcacaagtaacctggcggcagcgcaaaagatg

SEQ ID NO: 97649 - DNA, 103 bp, Artificial Sequence
  Synthetic Polynucleotide
taatacgactcactataggggaatctgcttctctcctttctttctcttttaacagaggagaaaaagaatgagaaaggagaacctggcggcagcgcaaaagatg

SEQ ID NO: 97650 - DNA, 103 bp, Artificial Sequence
  Synthetic Polynucleotide
taatacgactcactatagggtcttcccctggaatctgcttctctcctttcaacagaggagagaaaggatggaagcagataacctggcggcagcgcaaaagatg

SEQ ID NO: 97651 - DNA, 103 bp, Artificial Sequence
  Synthetic Polynucleotide
taatacgactcactatagggtctccccttttcttcccctggaatctgcttaacagaggagaaagcagatgccaggggaaaacctggcggcagcgcaaaagatg

SEQ ID NO: 97652 - DNA, 103 bp, Artificial Sequence
  Synthetic Polynucleotide
taatacgactcactatagggttctccgttttctccccttttcttcccctgaacagaggagacaggggatgaaaaggggaaacctggcggcagcgcaaaagatg

SEQ ID NO: 97653 - DNA, 103 bp, Artificial Sequence
  Synthetic Polynucleotide
taatacgactcactatagggtccttaactcttctccgttttctcccctttaacagaggagaaaagggatgaaaacggagaacctggcggcagcgcaaaagatg

SEQ ID NO: 97654 - DNA, 103 bp, Artificial Sequence
  Synthetic Polynucleotide
taatacgactcactatagggctttttatcctccttaactcttctccgtttaacagaggagaaaacggatgagagttaagaacctggcggcagcgcaaaagatg

SEQ ID NO: 97655 - DNA, 103 bp, Artificial Sequence
  Synthetic Polynucleotide
taatacgactcactataggggatctcgcttctttttatcctccttaactcaacagaggagagagttaatgaggataaaaaacctggcggcagcgcaaaagatg

SEQ ID NO: 97656 - DNA, 103 bp, Artificial Sequence
  Synthetic Polynucleotide
taatacgactcactatagggacccggtctcgatctcgcttctttttatccaacagaggagaggataaatggaagcgagaaacctggcggcagcgcaaaagatg

SEQ ID NO: 97657 - DNA, 103 bp, Artificial Sequence
  Synthetic Polynucleotide
taatacgactcactatagggctcattctccacccggtctcgatctcgcttaacagaggagaaagcgaatgcgagaccggaacctggcggcagcgcaaaagatg

SEQ ID NO: 97658 - DNA, 103 bp, Artificial Sequence
  Synthetic Polynucleotide
taatacgactcactatagggctttttctgcctcattctccacccggtctcaacagaggagagagaccatgtggagaatgaacctggcggcagcgcaaaagatg

SEQ ID NO: 97659 - DNA, 103 bp, Artificial Sequence
  Synthetic Polynucleotide
taatacgactcactatagggtcctcgtagaggtgtttgtccgacttgtgcaacagaggagagcacaaatgggacaaacaaacctggcggcagcgcaaaagatg

SEQ ID NO: 97660 - DNA, 103 bp, Artificial Sequence
  Synthetic Polynucleotide
taatacgactcactatagggcactggagatctttttctgcctcattctccaacagaggagaggagaaatgggcagaaaaaacctggcggcagcgcaaaagatg

SEQ ID NO: 97661 - DNA, 103 bp, Artificial Sequence
  Synthetic Polynucleotide
taatacgactcactatagggaggggcgtgacactggagatctttttctgcaacagaggagagcagaaatggatctccagaacctggcggcagcgcaaaagatg

SEQ ID NO: 97662 - DNA, 103 bp, Artificial Sequence
  Synthetic Polynucleotide
taatacgactcactatagggctaatctcacaggggcgtgacactggagataacagaggagaatctccatggtcacgcccaacctggcggcagcgcaaaagatg

SEQ ID NO: 97663 - DNA, 103 bp, Artificial Sequence
  Synthetic Polynucleotide
taatacgactcactatagggggaggcaagtctaatctcacaggggcgtgaaacagaggagatcacgcatgtgtgagattaacctggcggcagcgcaaaagatg

SEQ ID NO: 97664 - DNA, 103 bp, Artificial Sequence
  Synthetic Polynucleotide
taatacgactcactatagggaggcttctcaggaggcaagtctaatctcacaacagaggagagtgagaatggacttgcctaacctggcggcagcgcaaaagatg

SEQ ID NO: 97665 - DNA, 103 bp, Artificial Sequence
  Synthetic Polynucleotide
taatacgactcactatagggagcttgtgagaggcttctcaggaggcaagtaacagaggagaacttgcatgctgagaagcaacctggcggcagcgcaaaagatg

SEQ ID NO: 97666 - DNA, 103 bp, Artificial Sequence
  Synthetic Polynucleotide
taatacgactcactatagggttggctaaagagcttgtgagaggcttctcaaacagaggagatgagaaatgtctcacaagaacctggcggcagcgcaaaagatg

SEQ ID NO: 97667 - DNA, 103 bp, Artificial Sequence
  Synthetic Polynucleotide
taatacgactcactatagggttcttcttgtttggctaaagagcttgtgagaacagaggagactcacaatgtctttagccaacctggcggcagcgcaaaagatg

SEQ ID NO: 97668 - DNA, 103 bp, Artificial Sequence
  Synthetic Polynucleotide
taatacgactcactatagggtctgttctacttcttcttgtttggctaaagaacagaggagactttagatgaacaagaagaacctggcggcagcgcaaaagatg

SEQ ID NO: 97669 - DNA, 103 bp, Artificial Sequence
  Synthetic Polynucleotide
taatacgactcactatagggtgaaggggtgtctgttctacttcttcttgtaacagaggagaacaagaatgagtagaacaaacctggcggcagcgcaaaagatg

SEQ ID NO: 97670 - DNA, 103 bp, Artificial Sequence
  Synthetic Polynucleotide
taatacgactcactatagggctctacatactcctcgtagaggtgtttgtcaacagaggagagacaaaatgctctacgagaacctggcggcagcgcaaaagatg

SEQ ID NO: 97671 - DNA, 103 bp, Artificial Sequence
  Synthetic Polynucleotide
taatacgactcactatagggcaaagcttcttgaaggggtgtctgttctacaacagaggagagtagaaatgacaccccttaacctggcggcagcgcaaaagatg

SEQ ID NO: 97672 - DNA, 103 bp, Artificial Sequence
  Synthetic Polynucleotide
taatacgactcactatagggtcagttgattcaaagcttcttgaaggggtgaacagaggagacaccccatgaagaagcttaacctggcggcagcgcaaaagatg

SEQ ID NO: 97673 - DNA, 103 bp, Artificial Sequence
  Synthetic Polynucleotide
taatacgactcactatagggaattgtctcatcagttgattcaaagcttctaacagaggagaagaagcatggaatcaactaacctggcggcagcgcaaaagatg

SEQ ID NO: 97674 - DNA, 103 bp, Artificial Sequence
  Synthetic Polynucleotide
taatacgactcactatagggttttctctgcaattgtctcatcagttgattaacagaggagaaatcaaatgatgagacaaaacctggcggcagcgcaaaagatg

SEQ ID NO: 97675 - DNA, 103 bp, Artificial Sequence
  Synthetic Polynucleotide
taatacgactcactatagggcacttggatcttttctctgcaattgtctcaaacagaggagatgagacatgtgcagagaaaacctggcggcagcgcaaaagatg

SEQ ID NO: 97676 - DNA, 103 bp, Artificial Sequence
  Synthetic Polynucleotide
taatacgactcactataggggaaaagaaagcacttggatcttttctctgcaacagaggagagcagagatgagatccaagaacctggcggcagcgcaaaagatg

SEQ ID NO: 97677 - DNA, 103 bp, Artificial Sequence
  Synthetic Polynucleotide
taatacgactcactatagggcacaggaaatgaaaagaaagcacttggatcaacagaggagagatccaatggctttctttaacctggcggcagcgcaaaagatg

SEQ ID NO: 97678 - DNA, 103 bp, Artificial Sequence
  Synthetic Polynucleotide
taatacgactcactatagggtaaaatcagtcacaggaaatgaaaagaaagaacagaggagactttctatgcatttcctgaacctggcggcagcgcaaaagatg

SEQ ID NO: 97679 - DNA, 103 bp, Artificial Sequence
  Synthetic Polynucleotide
taatacgactcactatagggccaggagcaataaaatcagtcacaggaaataacagaggagaatttccatggactgatttaacctggcggcagcgcaaaagatg

SEQ ID NO: 97680 - DNA, 103 bp, Artificial Sequence
  Synthetic Polynucleotide
taatacgactcactatagggcatggagtagccaggagcaataaaatcagtaacagaggagaactgatatgattgctcctaacctggcggcagcgcaaaagatg

SEQ ID NO: 97681 - DNA, 103 bp, Artificial Sequence
  Synthetic Polynucleotide
taatacgactcactatagggtcaagggcttctctacatactcctcgtagaaacagaggagatctacgatgagtatgtagaacctggcggcagcgcaaaagatg

SEQ ID NO: 97682 - DNA, 103 bp, Artificial Sequence
  Synthetic Polynucleotide
taatacgactcactataggggtttaatgatcatggagtagccaggagcaaaacagaggagattgctcatggctactccaaacctggcggcagcgcaaaagatg

SEQ ID NO: 97683 - DNA, 103 bp, Artificial Sequence
  Synthetic Polynucleotide
taatacgactcactatagggtccattgggtgtttaatgatcatggagtagaacagaggagactactcatggatcattaaaacctggcggcagcgcaaaagatg

SEQ ID NO: 97684 - DNA, 103 bp, Artificial Sequence
  Synthetic Polynucleotide
taatacgactcactatagggggtactaaaatccattgggtgtttaatgataacagaggagaatcattatgcacccaatgaacctggcggcagcgcaaaagatg

SEQ ID NO: 97685 - DNA, 103 bp, Artificial Sequence
  Synthetic Polynucleotide
taatacgactcactatagggtttctttcatggtactaaaatccattgggtaacagaggagaacccaaatgattttagtaaacctggcggcagcgcaaaagatg

SEQ ID NO: 97686 - DNA, 103 bp, Artificial Sequence
  Synthetic Polynucleotide
taatacgactcactatagggttcttgatcttttctttcatggtactaaaaaacagaggagattttagatgcatgaaagaaacctggcggcagcgcaaaagatg

SEQ ID NO: 97687 - DNA, 103 bp, Artificial Sequence
  Synthetic Polynucleotide
taatacgactcactatagggatagtcattgttcttgatcttttctttcataacagaggagaatgaaaatgaagatcaagaacctggcggcagcgcaaaagatg

SEQ ID NO: 97688 - DNA, 103 bp, Artificial Sequence
  Synthetic Polynucleotide
taatacgactcactatagggctatggactgatagtcattgttcttgatctaacagaggagaagatcaatgacaatgactaacctggcggcagcgcaaaagatg

SEQ ID NO: 97689 - DNA, 103 bp, Artificial Sequence
  Synthetic Polynucleotide
taatacgactcactatagggtttagttcttctatggactgatagtcattgaacagaggagacaatgaatgtcagtccataacctggcggcagcgcaaaagatg

SEQ ID NO: 97690 - DNA, 103 bp, Artificial Sequence
  Synthetic Polynucleotide
taatacgactcactataggggaagttatcctttagttcttctatggactgaacagaggagacagtccatggaagaactaaacctggcggcagcgcaaaagatg

SEQ ID NO: 97691 - DNA, 103 bp, Artificial Sequence
  Synthetic Polynucleotide
taatacgactcactatagggacattagtttgaagttatcctttagttcttaacagaggagaaagaacatgaggataactaacctggcggcagcgcaaaagatg

SEQ ID NO: 97692 - DNA, 103 bp, Artificial Sequence
  Synthetic Polynucleotide
taatacgactcactatagggaggaccagcttcaagggcttctctacatacaacagaggagagtatgtatggaagcccttaacctggcggcagcgcaaaagatg

SEQ ID NO: 97693 - DNA, 103 bp, Artificial Sequence
  Synthetic Polynucleotide
taatacgactcactataggggcattagtacacattagtttgaagttatccaacagaggagaggataaatgcaaactaataacctggcggcagcgcaaaagatg

SEQ ID NO: 97694 - DNA, 103 bp, Artificial Sequence
  Synthetic Polynucleotide
taatacgactcactataggggtaaatcatggcattagtacacattagtttaacagaggagaaaactaatgtgtactaataacctggcggcagcgcaaaagatg

SEQ ID NO: 97695 - DNA, 103 bp, Artificial Sequence
  Synthetic Polynucleotide
taatacgactcactatagggctggtttattgtaaatcatggcattagtacaacagaggagagtactaatgccatgatttaacctggcggcagcgcaaaagatg

SEQ ID NO: 97696 - DNA, 103 bp, Artificial Sequence
  Synthetic Polynucleotide
taatacgactcactatagggtaaatggtctctggtttattgtaaatcatgaacagaggagacatgatatgcaataaaccaacctggcggcagcgcaaaagatg

SEQ ID NO: 97697 - DNA, 103 bp, Artificial Sequence
  Synthetic Polynucleotide
taatacgactcactatagggagctttataataaatggtctctggtttattaacagaggagaaataaaatggagaccattaacctggcggcagcgcaaaagatg

SEQ ID NO: 97698 - DNA, 103 bp, Artificial Sequence
  Synthetic Polynucleotide
taatacgactcactataggggcttctttgcagctttataataaatggtctaacagaggagaagaccaatgattataaagaacctggcggcagcgcaaaagatg

SEQ ID NO: 97699 - DNA, 103 bp, Artificial Sequence
  Synthetic Polynucleotide
taatacgactcactataggggagtgcaacagcttctttgcagctttataaaacagaggagattataaatgtgcaaagaaaacctggcggcagcgcaaaagatg

SEQ ID NO: 97700 - DNA, 103 bp, Artificial Sequence
  Synthetic Polynucleotide
taatacgactcactatagggtttcattcctgagtgcaacagcttctttgcaacagaggagagcaaagatgctgttgcacaacctggcggcagcgcaaaagatg

SEQ ID NO: 97701 - DNA, 103 bp, Artificial Sequence
  Synthetic Polynucleotide
taatacgactcactatagggggctaagaattttcattcctgagtgcaacaaacagaggagatgttgcatgcaggaatgaaacctggcggcagcgcaaaagatg

SEQ ID NO: 97702 - DNA, 103 bp, Artificial Sequence
  Synthetic Polynucleotide
taatacgactcactatagggattctttcctggctaagaattttcattcctaacagaggagaaggaatatgaattcttagaacctggcggcagcgcaaaagatg

SEQ ID NO: 97703 - DNA, 103 bp, Artificial Sequence
  Synthetic Polynucleotide
taatacgactcactatagggtcctactttgaggaccagcttcaagggcttaacagaggagaaagcccatgaagctggtcaacctggcggcagcgcaaaagatg

SEQ ID NO: 97704 - DNA, 103 bp, Artificial Sequence
  Synthetic Polynucleotide
taatacgactcactatagggcaggctctgaattctttcctggctaagaataacagaggagaattcttatgcaggaaagaaacctggcggcagcgcaaaagatg

SEQ ID NO: 97705 - DNA, 103 bp, Artificial Sequence
  Synthetic Polynucleotide
taatacgactcactatagggtgctctgcttcaggctctgaattctttcctaacagaggagaaggaaaatgttcagagccaacctggcggcagcgcaaaagatg

SEQ ID NO: 97706 - DNA, 103 bp, Artificial Sequence
  Synthetic Polynucleotide
taatacgactcactatagggatgaagtctatgctctgcttcaggctctgaaacagaggagatcagagatggaagcagagaacctggcggcagcgcaaaagatg

SEQ ID NO: 97707 - DNA, 103 bp, Artificial Sequence
  Synthetic Polynucleotide
taatacgactcactatagggcaagtcagccatgaagtctatgctctgcttaacagaggagaaagcagatgatagacttcaacctggcggcagcgcaaaagatg

SEQ ID NO: 97708 - DNA, 103 bp, Artificial Sequence
  Synthetic Polynucleotide
taatacgactcactataggggagttttctgcaagtcagccatgaagtctaaacagaggagatagactatgtggctgactaacctggcggcagcgcaaaagatg

SEQ ID NO: 97709 - DNA, 103 bp, Artificial Sequence
  Synthetic Polynucleotide
taatacgactcactatagggttctgctttcgagttttctgcaagtcagccaacagaggagaggctgaatggcagaaaacaacctggcggcagcgcaaaagatg

SEQ ID NO: 97710 - DNA, 103 bp, Artificial Sequence
  Synthetic Polynucleotide
taatacgactcactatagggtgttccatctttctgctttcgagttttctgaacagaggagacagaaaatgcgaaagcagaacctggcggcagcgcaaaagatg

SEQ ID NO: 97711 - DNA, 103 bp, Artificial Sequence
  Synthetic Polynucleotide
taatacgactcactataggggtgaggtgtctgttccatctttctgctttcaacagaggagagaaagcatgaagatggaaaacctggcggcagcgcaaaagatg

SEQ ID NO: 97712 - DNA, 103 bp, Artificial Sequence
  Synthetic Polynucleotide
taatacgactcactatagggtccccactctgtgaggtgtctgttccatctaacagaggagaagatggatgagacacctcaacctggcggcagcgcaaaagatg

SEQ ID NO: 97713 - DNA, 103 bp, Artificial Sequence
  Synthetic Polynucleotide
taatacgactcactataggggcctccgtcctccccactctgtgaggtgtcaacagaggagagacaccatgcagagtgggaacctggcggcagcgcaaaagatg

SEQ ID NO: 97714 - DNA, 103 bp, Artificial Sequence
  Synthetic Polynucleotide
taatacgactcactatagggcttcgttccctcctactttgaggaccagctaacagaggagaagctggatgtcaaagtagaacctggcggcagcgcaaaagatg

SEQ ID NO: 97715 - DNA, 103 bp, Artificial Sequence
  Synthetic Polynucleotide
taatacgactcactatagggtctgccagcagcctccgtcctccccactctaacagaggagaagagtgatgaggacggagaacctggcggcagcgcaaaagatg

SEQ ID NO: 97716 - DNA, 103 bp, Artificial Sequence
  Synthetic Polynucleotide
taatacgactcactatagggtctctctctctctgccagcagcctccgtccaacagaggagaggacggatgctgctggcaaacctggcggcagcgcaaaagatg

SEQ ID NO: 97717 - DNA, 103 bp, Artificial Sequence
  Synthetic Polynucleotide
taatacgactcactatagggtccagagtcctctctctctctctgccagcaaacagaggagatgctggatgagagagagaaacctggcggcagcgcaaaagatg

SEQ ID NO: 97718 - DNA, 103 bp, Artificial Sequence
  Synthetic Polynucleotide
taatacgactcactatagggcttcggcatctccagagtcctctctctctcaacagaggagagagagaatgaggactctgaacctggcggcagcgcaaaagatg

SEQ ID NO: 97719 - DNA, 103 bp, Artificial Sequence
  Synthetic Polynucleotide
taatacgactcactatagggaaggcgtgtgcttcggcatctccagagtccaacagaggagaggactcatgagatgccgaaacctggcggcagcgcaaaagatg

SEQ ID NO: 97720 - DNA, 103 bp, Artificial Sequence
  Synthetic Polynucleotide
taatacgactcactataggggggactcttgaaggcgtgtgcttcggcatcaacagaggagagatgccatggcacacgccaacctggcggcagcgcaaaagatg

SEQ ID NO: 97721 - DNA, 103 bp, Artificial Sequence
  Synthetic Polynucleotide
taatacgactcactatagggtttctttgctgggactcttgaaggcgtgtgaacagaggagacacacgatgtcaagagtcaacctggcggcagcgcaaaagatg

SEQ ID NO: 97722 - DNA, 103 bp, Artificial Sequence
  Synthetic Polynucleotide
taatacgactcactatagggttctttttattttctttgctgggactcttgaacagaggagacaagagatgcagcaaagaaacctggcggcagcgcaaaagatg

SEQ ID NO: 97723 - DNA, 103 bp, Artificial Sequence
  Synthetic Polynucleotide
taatacgactcactatagggatctttgtctttctttttattttctttgctaacagaggagaagcaaaatgaataaaaagaacctggcggcagcgcaaaagatg

SEQ ID NO: 97724 - DNA, 103 bp, Artificial Sequence
  Synthetic Polynucleotide
taatacgactcactatagggcttcaagcatatctttgtctttctttttataacagaggagaataaaaatgaagacaaagaacctggcggcagcgcaaaagatg

SEQ ID NO: 97725 - DNA, 103 bp, Artificial Sequence
  Synthetic Polynucleotide
taatacgactcactatagggagttcggtgacttcgttccctcctactttgaacagaggagacaaagtatgagggaacgaaacctggcggcagcgcaaaagatg

SEQ ID NO: 97726 - DNA, 103 bp, Artificial Sequence
  Synthetic Polynucleotide
taatacgactcactatagggttaaacttatcttcaagcatatctttgtctaacagaggagaagacaaatgtatgcttgaaacctggcggcagcgcaaaagatg

SEQ ID NO: 97727 - DNA, 103 bp, Artificial Sequence
  Synthetic Polynucleotide
taatacgactcactatagggattattgcttttaaacttatcttcaagcataacagaggagaatgcttatggataagtttaacctggcggcagcgcaaaagatg

SEQ ID NO: 97728 - DNA, 103 bp, Artificial Sequence
  Synthetic Polynucleotide
taatacgactcactatagggctctctctaaattattgcttttaaacttataacagaggagaataagtatgaaagcaataaacctggcggcagcgcaaaagatg

SEQ ID NO: 97729 - DNA, 103 bp, Artificial Sequence
  Synthetic Polynucleotide
taatacgactcactatagggtgctcctgctctctctctaaattattgcttaacagaggagaaagcaaatgtttagagagaacctggcggcagcgcaaaagatg

SEQ ID NO: 97730 - DNA, 103 bp, Artificial Sequence
  Synthetic Polynucleotide
taatacgactcactataggggcggtcaagctgctcctgctctctctctaaaacagaggagattagagatggagcaggagaacctggcggcagcgcaaaagatg

SEQ ID NO: 97731 - DNA, 103 bp, Artificial Sequence
  Synthetic Polynucleotide
taatacgactcactatagggccttcacgatgcggtcaagctgctcctgctaacagaggagaagcaggatgagcttgaccaacctggcggcagcgcaaaagatg

SEQ ID NO: 97732 - DNA, 103 bp, Artificial Sequence
  Synthetic Polynucleotide
taatacgactcactatagggcctccagattccttcacgatgcggtcaagcaacagaggagagcttgaatgcatcgtgaaaacctggcggcagcgcaaaagatg

SEQ ID NO: 97733 - DNA, 103 bp, Artificial Sequence
  Synthetic Polynucleotide
taatacgactcactatagggggtcagctttcctccagattccttcacgataacagaggagaatcgtgatggaatctggaaacctggcggcagcgcaaaagatg

SEQ ID NO: 97734 - DNA, 103 bp, Artificial Sequence
  Synthetic Polynucleotide
taatacgactcactatagggcaagccgcctggtcagctttcctccagattaacagaggagaaatctgatggaaagctgaaacctggcggcagcgcaaaagatg

SEQ ID NO: 97735 - DNA, 103 bp, Artificial Sequence
  Synthetic Polynucleotide
taatacgactcactatagggtgactgttcacaagccgcctggtcagctttaacagaggagaaaagctatgcaggcggctaacctggcggcagcgcaaaagatg

SEQ ID NO: 97736 - DNA, 103 bp, Artificial Sequence
  Synthetic Polynucleotide
taatacgactcactataggggcagtccgggcagcggcctctgcctggcataacagaggagaatgccaatgagaggccgcaacctggcggcagcgcaaaagatg

SEQ ID NO: 97737 - DNA, 103 bp, Artificial Sequence
  Synthetic Polynucleotide
taatacgactcactatagggaaggaccccctcggtgaccacgcagccgcaaacagaggagatgcggcatggtggtcaccaacctggcggcagcgcaaaagatg

SEQ ID NO: 97738 - DNA, 103 bp, Artificial Sequence
  Synthetic Polynucleotide
taatacgactcactatagggatttcccacctccccttctccttgcccctgaacagaggagacaggggatgggagaagggaacctggcggcagcgcaaaagatg

SEQ ID NO: 97739 - DNA, 103 bp, Artificial Sequence
  Synthetic Polynucleotide
taatacgactcactatagggctaaggaattatttcccacctccccttctcaacagaggagagagaagatgaggtgggaaaacctggcggcagcgcaaaagatg

SEQ ID NO: 97740 - DNA, 103 bp, Artificial Sequence
  Synthetic Polynucleotide
taatacgactcactatagggtggggtaaacctaaggaattatttcccaccaacagaggagaggtgggatgtaattccttaacctggcggcagcgcaaaagatg

SEQ ID NO: 97741 - DNA, 103 bp, Artificial Sequence
  Synthetic Polynucleotide
taatacgactcactatagggccgcttcccctggggtaaacctaaggaattaacagaggagaaattccatgggtttacccaacctggcggcagcgcaaaagatg

SEQ ID NO: 97742 - DNA, 103 bp, Artificial Sequence
  Synthetic Polynucleotide
taatacgactcactataggggactggccggccgcttcccctggggtaaacaacagaggagagtttacatgaggggaagcaacctggcggcagcgcaaaagatg

SEQ ID NO: 97743 - DNA, 103 bp, Artificial Sequence
  Synthetic Polynucleotide
taatacgactcactatagggagaagggcaggactggccggccgcttccccaacagaggagaggggaaatggccggccagaacctggcggcagcgcaaaagatg

SEQ ID NO: 97744 - DNA, 103 bp, Artificial Sequence
  Synthetic Polynucleotide
taatacgactcactataggggggtggcaagagaagggcaggactggccggaacagaggagaccggccatgcctgcccttaacctggcggcagcgcaaaagatg

SEQ ID NO: 97745 - DNA, 103 bp, Artificial Sequence
  Synthetic Polynucleotide
taatacgactcactatagggtcaacatgcagggtggcaagagaagggcagaacagaggagactgcccatgtcttgccacaacctggcggcagcgcaaaagatg

SEQ ID NO: 97746 - DNA, 103 bp, Artificial Sequence
  Synthetic Polynucleotide
taatacgactcactatagggttcggggacttcaacatgcagggtggcaagaacagaggagacttgccatgctgcatgttaacctggcggcagcgcaaaagatg

SEQ ID NO: 97747 - DNA, 103 bp, Artificial Sequence
  Synthetic Polynucleotide
taatacgactcactataggggcagatccgcttcggggacttcaacatgcaaacagaggagatgcatgatgaagtccccgaacctggcggcagcgcaaaagatg

SEQ ID NO: 97748 - DNA, 103 bp, Artificial Sequence
  Synthetic Polynucleotide
taatacgactcactatagggaggtagtggtaaggaccccctcggtgaccaaacagaggagatggtcaatgagggggtccaacctggcggcagcgcaaaagatg

SEQ ID NO: 97749 - DNA, 103 bp, Artificial Sequence
  Synthetic Polynucleotide
taatacgactcactatagggggggtacagggcagatccgcttcggggactaacagaggagaagtcccatgagcggatctaacctggcggcagcgcaaaagatg

SEQ ID NO: 97750 - DNA, 103 bp, Artificial Sequence
  Synthetic Polynucleotide
taatacgactcactataggggtggagacagggggtacagggcagatccgcaacagaggagagcggatatgccctgtaccaacctggcggcagcgcaaaagatg

SEQ ID NO: 97751 - DNA, 103 bp, Artificial Sequence
  Synthetic Polynucleotide
taatacgactcactatagggtccagtgacagtggagacagggggtacaggaacagaggagacctgtaatgcctgtctccaacctggcggcagcgcaaaagatg

SEQ ID NO: 97752 - DNA, 103 bp, Artificial Sequence
  Synthetic Polynucleotide
taatacgactcactatagggtgttctcatctccagtgacagtggagacagaacagaggagactgtctatgctgtcactgaacctggcggcagcgcaaaagatg

SEQ ID NO: 97753 - DNA, 103 bp, Artificial Sequence
  Synthetic Polynucleotide
taatacgactcactatagggctatcagaaatgttctcatctccagtgacaaacagaggagatgtcacatgagatgagaaaacctggcggcagcgcaaaagatg

SEQ ID NO: 97754 - DNA, 103 bp, Artificial Sequence
  Synthetic Polynucleotide
taatacgactcactatagggttctatttcactatcagaaatgttctcatcaacagaggagagatgagatgatttctgataacctggcggcagcgcaaaagatg

SEQ ID NO: 97755 - DNA, 103 bp, Artificial Sequence
  Synthetic Polynucleotide
taatacgactcactataggggcaaatactgttctatttcactatcagaaaaacagaggagatttctgatggtgaaatagaacctggcggcagcgcaaaagatg

SEQ ID NO: 97756 - DNA, 103 bp, Artificial Sequence
  Synthetic Polynucleotide
taatacgactcactatagggtgaggggtacgcaaatactgttctatttcaaacagaggagatgaaatatgacagtatttaacctggcggcagcgcaaaagatg

SEQ ID NO: 97757 - DNA, 103 bp, Artificial Sequence
  Synthetic Polynucleotide
taatacgactcactatagggcctaacttcctgaggggtacgcaaatactgaacagaggagacagtatatgcgtacccctaacctggcggcagcgcaaaagatg

SEQ ID NO: 97758 - DNA, 103 bp, Artificial Sequence
  Synthetic Polynucleotide
taatacgactcactatagggtctgaaagtccctaacttcctgaggggtacaacagaggagagtacccatgaggaagttaaacctggcggcagcgcaaaagatg

SEQ ID NO: 97759 - DNA, 103 bp, Artificial Sequence
  Synthetic Polynucleotide
taatacgactcactatagggtcgtcgctgaaggtagtggtaaggacccccaacagaggagagggggtatgtaccactacaacctggcggcagcgcaaaagatg

SEQ ID NO: 97760 - DNA, 103 bp, Artificial Sequence
  Synthetic Polynucleotide
taatacgactcactataggggcctgggctctctgaaagtccctaacttccaacagaggagaggaagtatgggactttcaaacctggcggcagcgcaaaagatg

SEQ ID NO: 97761 - DNA, 103 bp, Artificial Sequence
  Synthetic Polynucleotide
taatacgactcactatagggctgtctagcagcctgggctctctgaaagtcaacagaggagagactttatgagagcccagaacctggcggcagcgcaaaagatg

SEQ ID NO: 97762 - DNA, 103 bp, Artificial Sequence
  Synthetic Polynucleotide
taatacgactcactatagggtcgtggcagcctgtctagcagcctgggctcaacagaggagagagcccatgctgctagacaacctggcggcagcgcaaaagatg

SEQ ID NO: 97763 - DNA, 103 bp, Artificial Sequence
  Synthetic Polynucleotide
taatacgactcactatagggttagggacactcgtggcagcctgtctagcaaacagaggagatgctagatgggctgccacaacctggcggcagcgcaaaagatg

SEQ ID NO: 97764 - DNA, 103 bp, Artificial Sequence
  Synthetic Polynucleotide
taatacgactcactatagggtcagggagggttagggacactcgtggcagcaacagaggagagctgccatgagtgtccctaacctggcggcagcgcaaaagatg

SEQ ID NO: 97765 - DNA, 103 bp, Artificial Sequence
  Synthetic Polynucleotide
taatacgactcactataggggagattgccctcgtcgctgaaggtagtggtaacagaggagaaccactatgttcagcgacaacctggcggcagcgcaaaagatg

SEQ ID NO: 97766 - DNA, 103 bp, Artificial Sequence
  Synthetic Polynucleotide
taatacgactcactatagggttacctctcggagattgccctcgtcgctgaaacagaggagatcagcgatgagggcaatcaacctggcggcagcgcaaaagatg

SEQ ID NO: 97767 - DNA, 103 bp, Artificial Sequence
  Synthetic Polynucleotide
taatacgactcactatagggcgggaatatgttacctctcggagattgcccaacagaggagagggcaaatgccgagaggtaacctggcggcagcgcaaaagatg

SEQ ID NO: 97768 - DNA, 103 bp, Artificial Sequence
  Synthetic Polynucleotide
taatacgactcactatagggccctgtgcttcgggaatatgttacctctcgaacagaggagacgagagatgacatattccaacctggcggcagcgcaaaagatg

SEQ ID NO: 97769 - DNA, 103 bp, Artificial Sequence
  Synthetic Polynucleotide
taatacgactcactataggggttcgttttcccctgtgcttcgggaatatgaacagaggagacatattatggaagcacagaacctggcggcagcgcaaaagatg

SEQ ID NO: 97770 - DNA, 103 bp, Artificial Sequence
  Synthetic Polynucleotide
taatacgactcactatagggcgactaacttgttcgttttcccctgtgcttaacagaggagaaagcacatgggaaaacgaaacctggcggcagcgcaaaagatg

SEQ ID NO: 97771 - DNA, 103 bp, Artificial Sequence
  Synthetic Polynucleotide
taatacgactcactatagggttgctggctgcgactaacttgttcgttttcaacagaggagagaaaacatgcaagttagtaacctggcggcagcgcaaaagatg

SEQ ID NO: 97772 - DNA, 103 bp, Artificial Sequence
  Synthetic Polynucleotide
taatacgactcactatagggccgtggagccgcagtccgggcagcggcctcaacagaggagagaggccatggcccggactaacctggcggcagcgcaaaagatg

SEQ ID NO: 97773 - DNA, 103 bp, Artificial Sequence
  Synthetic Polynucleotide
taatacgactcactatagggggagacctcgttgctggctgcgactaacttaacagaggagaaagttaatggcagccagcaacctggcggcagcgcaaaagatg

SEQ ID NO: 97774 - DNA, 103 bp, Artificial Sequence
  Synthetic Polynucleotide
taatacgactcactatagggctcactcgccggagacctcgttgctggctgaacagaggagacagccaatgacgaggtctaacctggcggcagcgcaaaagatg

SEQ ID NO: 97775 - DNA, 103 bp, Artificial Sequence
  Synthetic Polynucleotide
taatacgactcactatagggacaaaggtctctcactcgccggagacctcgaacagaggagacgaggtatgcggcgagtgaacctggcggcagcgcaaaagatg

SEQ ID NO: 97776 - DNA, 103 bp, Artificial Sequence
  Synthetic Polynucleotide
taatacgactcactataggggcagaactcgacaaaggtctctcactcgccaacagaggagaggcgagatggagacctttaacctggcggcagcgcaaaagatg

SEQ ID NO: 97777 - DNA, 103 bp, Artificial Sequence
  Synthetic Polynucleotide
taatacgactcactatagggggtggcaactgcagaactcgacaaaggtctaacagaggagaagacctatgtcgagttctaacctggcggcagcgcaaaagatg

SEQ ID NO: 97778 - DNA, 103 bp, Artificial Sequence
  Synthetic Polynucleotide
taatacgactcactatagggctcaaatgttggtggcaactgcagaactcgaacagaggagacgagttatgcagttgccaaacctggcggcagcgcaaaagatg

SEQ ID NO: 97779 - DNA, 103 bp, Artificial Sequence
  Synthetic Polynucleotide
taatacgactcactatagggccgcggtatcctcaaatgttggtggcaactaacagaggagaagttgcatgcaacatttgaacctggcggcagcgcaaaagatg

SEQ ID NO: 97780 - DNA, 103 bp, Artificial Sequence
  Synthetic Polynucleotide
taatacgactcactatagggtagtaggcaaccgcggtatcctcaaatgttaacagaggagaaacattatgggataccgcaacctggcggcagcgcaaaagatg

SEQ ID NO: 97781 - DNA, 103 bp, Artificial Sequence
  Synthetic Polynucleotide
taatacgactcactatagggtgcctgttggtagtaggcaaccgcggtatcaacagaggagagataccatggttgcctacaacctggcggcagcgcaaaagatg

SEQ ID NO: 97782 - DNA, 103 bp, Artificial Sequence
  Synthetic Polynucleotide
taatacgactcactatagggagtgccgatatgcctgttggtagtaggcaaaacagaggagattgcctatgaccaacaggaacctggcggcagcgcaaaagatg

SEQ ID NO: 97783 - DNA, 103 bp, Artificial Sequence
  Synthetic Polynucleotide
taatacgactcactatagggtccaccagctccgtggagccgcagtccgggaacagaggagacccggaatgcggctccacaacctggcggcagcgcaaaagatg

SEQ ID NO: 97784 - DNA, 103 bp, Artificial Sequence
  Synthetic Polynucleotide
taatacgactcactatagggcggatgccagagtgccgatatgcctgttggaacagaggagaccaacaatgatatcggcaaacctggcggcagcgcaaaagatg

SEQ ID NO: 97785 - DNA, 103 bp, Artificial Sequence
  Synthetic Polynucleotide
taatacgactcactatagggcctggccgctcggatgccagagtgccgataaacagaggagatatcggatgtctggcatcaacctggcggcagcgcaaaagatg

SEQ ID NO: 97786 - DNA, 103 bp, Artificial Sequence
  Synthetic Polynucleotide
taatacgactcactatagggtcttttgcagcctggccgctcggatgccagaacagaggagactggcaatggagcggccaaacctggcggcagcgcaaaagatg

SEQ ID NO: 97787 - DNA, 103 bp, Artificial Sequence
  Synthetic Polynucleotide
taatacgactcactatagggaacacctccttcttttgcagcctggccgctaacagaggagaagcggcatggctgcaaaaaacctggcggcagcgcaaaagatg

SEQ ID NO: 97788 - DNA, 103 bp, Artificial Sequence
  Synthetic Polynucleotide
taatacgactcactataggggcacccaaccaacacctccttcttttgcagaacagaggagactgcaaatgaaggaggtgaacctggcggcagcgcaaaagatg

SEQ ID NO: 97789 - DNA, 103 bp, Artificial Sequence
  Synthetic Polynucleotide
taatacgactcactatagggttaagacgcagcacccaaccaacacctcctaacagaggagaaggaggatgtggttgggtaacctggcggcagcgcaaaagatg

SEQ ID NO: 97790 - DNA, 103 bp, Artificial Sequence
  Synthetic Polynucleotide
taatacgactcactatagggcggcaggtgattaagacgcagcacccaaccaacagaggagaggttggatgctgcgtcttaacctggcggcagcgcaaaagatg

SEQ ID NO: 97791 - DNA, 103 bp, Artificial Sequence
  Synthetic Polynucleotide
taatacgactcactataggggttatgctgtcggcaggtgattaagacgcaaacagaggagatgcgtcatgatcacctgcaacctggcggcagcgcaaaagatg

SEQ ID NO: 97792 - DNA, 103 bp, Artificial Sequence
  Synthetic Polynucleotide
taatacgactcactatagggttaggggccagttatgctgtcggcaggtgaaacagaggagatcacctatggacagcataaacctggcggcagcgcaaaagatg

SEQ ID NO: 97793 - DNA, 103 bp, Artificial Sequence
  Synthetic Polynucleotide
taatacgactcactataggggcccccattgttaggggccagttatgctgtaacagaggagaacagcaatgctggcccctaacctggcggcagcgcaaaagatg

SEQ ID NO: 97794 - DNA, 103 bp, Artificial Sequence
  Synthetic Polynucleotide
taatacgactcactataggggtgcgagtcttccaccagctccgtggagccaacagaggagaggctccatggagctggtgaacctggcggcagcgcaaaagatg

SEQ ID NO: 97795 - DNA, 103 bp, Artificial Sequence
  Synthetic Polynucleotide
taatacgactcactatagggcgtgcagatggcccccattgttaggggccaaacagaggagatggcccatgacaatggggaacctggcggcagcgcaaaagatg

SEQ ID NO: 97796 - DNA, 103 bp, Artificial Sequence
  Synthetic Polynucleotide
taatacgactcactatagggcatacaacagcgtgcagatggcccccattgaacagaggagacaatggatgccatctgcaaacctggcggcagcgcaaaagatg

SEQ ID NO: 97797 - DNA, 103 bp, Artificial Sequence
  Synthetic Polynucleotide
taatacgactcactatagggtccaaatctgcatacaacagcgtgcagatgaacagaggagacatctgatggctgttgtaaacctggcggcagcgcaaaagatg

SEQ ID NO: 97798 - DNA, 103 bp, Artificial Sequence
  Synthetic Polynucleotide
taatacgactcactatagggagaaaacacatccaaatctgcatacaacagaacagaggagactgttgatggcagatttgaacctggcggcagcgcaaaagatg

SEQ ID NO: 97799 - DNA, 103 bp, Artificial Sequence
  Synthetic Polynucleotide
taatacgactcactatagggtgtaagtgctagaaaacacatccaaatctgaacagaggagacagattatgatgtgttttaacctggcggcagcgcaaaagatg

SEQ ID NO: 97800 - DNA, 103 bp, Artificial Sequence
  Synthetic Polynucleotide
taatacgactcactatagggactatctgcatgtaagtgctagaaaacacaaacagaggagatgtgttatgtagcacttaaacctggcggcagcgcaaaagatg

SEQ ID NO: 97801 - DNA, 103 bp, Artificial Sequence
  Synthetic Polynucleotide
taatacgactcactatagggcaggagcttcactatctgcatgtaagtgctaacagaggagaagcactatgatgcagataaacctggcggcagcgcaaaagatg

SEQ ID NO: 97802 - DNA, 103 bp, Artificial Sequence
  Synthetic Polynucleotide
taatacgactcactatagggcatccagtcccaggagcttcactatctgcaaacagaggagatgcagaatgtgaagctccaacctggcggcagcgcaaaagatg

SEQ ID NO: 97803 - DNA, 103 bp, Artificial Sequence
  Synthetic Polynucleotide
taatacgactcactatagggagagatggcacatccagtcccaggagcttcaacagaggagagaagctatggggactggaaacctggcggcagcgcaaaagatg

SEQ ID NO: 97804 - DNA, 103 bp, Artificial Sequence
  Synthetic Polynucleotide
taatacgactcactatagggtgccaagcacagagatggcacatccagtccaacagaggagaggactgatggtgccatctaacctggcggcagcgcaaaagatg

SEQ ID NO: 97805 - DNA, 103 bp, Artificial Sequence
  Synthetic Polynucleotide
taatacgactcactatagggtctgcgaatagtgcgagtcttccaccagctaacagaggagaagctggatgaagactcgcaacctggcggcagcgcaaaagatg

SEQ ID NO: 97806 - DNA, 103 bp, Artificial Sequence
  Synthetic Polynucleotide
taatacgactcactatagggtcaccagttctgccaagcacagagatggcaaacagaggagatgccatatgtgtgcttggaacctggcggcagcgcaaaagatg

SEQ ID NO: 97807 - DNA, 103 bp, Artificial Sequence
  Synthetic Polynucleotide
taatacgactcactatagggcaataggtcttcaccagttctgccaagcacaacagaggagagtgcttatgagaactggtaacctggcggcagcgcaaaagatg

SEQ ID NO: 97808 - DNA, 103 bp, Artificial Sequence
  Synthetic Polynucleotide
taatacgactcactataggggaagctgctgcaataggtcttcaccagttcaacagaggagagaactgatgaagacctataacctggcggcagcgcaaaagatg

SEQ ID NO: 97809 - DNA, 103 bp, Artificial Sequence
  Synthetic Polynucleotide
taatacgactcactatagggggaacagtttgaagctgctgcaataggtctaacagaggagaagacctatggcagcagctaacctggcggcagcgcaaaagatg

SEQ ID NO: 97810 - DNA, 103 bp, Artificial Sequence
  Synthetic Polynucleotide
taatacgactcactatagggggtgaagcttggaacagtttgaagctgctgaacagaggagacagcagatgcaaactgttaacctggcggcagcgcaaaagatg

SEQ ID NO: 97811 - DNA, 103 bp, Artificial Sequence
  Synthetic Polynucleotide
taatacgactcactatagggtggcacagaaggtgaagcttggaacagtttaacagaggagaaaactgatgcaagcttcaaacctggcggcagcgcaaaagatg

SEQ ID NO: 97812 - DNA, 103 bp, Artificial Sequence
  Synthetic Polynucleotide
taatacgactcactatagggcgtatttggctggcacagaaggtgaagcttaacagaggagaaagcttatgcttctgtgcaacctggcggcagcgcaaaagatg

SEQ ID NO: 97813 - DNA, 103 bp, Artificial Sequence
  Synthetic Polynucleotide
taatacgactcactatagggttgtcttccacgtatttggctggcacagaaaacagaggagattctgtatgagccaaataaacctggcggcagcgcaaaagatg

SEQ ID NO: 97814 - DNA, 103 bp, Artificial Sequence
  Synthetic Polynucleotide
taatacgactcactatagggcatcttctctttgtcttccacgtatttggcaacagaggagagccaaaatggtggaagacaacctggcggcagcgcaaaagatg

SEQ ID NO: 97815 - DNA, 103 bp, Artificial Sequence
  Synthetic Polynucleotide
taatacgactcactatagggttcgagacagcatcttctctttgtcttccaaacagaggagatggaagatgaagagaagaaacctggcggcagcgcaaaagatg

SEQ ID NO: 97816 - DNA, 103 bp, Artificial Sequence
  Synthetic Polynucleotide
taatacgactcactatagggaccagctggctctgcgaatagtgcgagtctaacagaggagaagactcatgctattcgcaaacctggcggcagcgcaaaagatg

SEQ ID NO: 97817 - DNA, 103 bp, Artificial Sequence
  Synthetic Polynucleotide
taatacgactcactatagggaactgcattgttcgagacagcatcttctctaacagaggagaagagaaatggctgtctcgaacctggcggcagcgcaaaagatg

SEQ ID NO: 97818 - DNA, 103 bp, Artificial Sequence
  Synthetic Polynucleotide
taatacgactcactatagggcagctccaccaactgcattgttcgagacagaacagaggagactgtctatgacaatgcagaacctggcggcagcgcaaaagatg

SEQ ID NO: 97819 - DNA, 103 bp, Artificial Sequence
  Synthetic Polynucleotide
taatacgactcactatagggtctcatttgccagctccaccaactgcattgaacagaggagacaatgcatgtggtggagcaacctggcggcagcgcaaaagatg

SEQ ID NO: 97820 - DNA, 103 bp, Artificial Sequence
  Synthetic Polynucleotide
taatacgactcactatagggaccagccacgtctcatttgccagctccaccaacagaggagaggtggaatgggcaaatgaaacctggcggcagcgcaaaagatg

SEQ ID NO: 97821 - DNA, 103 bp, Artificial Sequence
  Synthetic Polynucleotide
taatacgactcactatagggcctcccggtcaccagccacgtctcatttgcaacagaggagagcaaatatgacgtggctgaacctggcggcagcgcaaaagatg

SEQ ID NO: 97822 - DNA, 103 bp, Artificial Sequence
  Synthetic Polynucleotide
taatacgactcactataggggcaagggatgcctcccggtcaccagccacgaacagaggagacgtggcatgtgaccgggaaacctggcggcagcgcaaaagatg

SEQ ID NO: 97823 - DNA, 103 bp, Artificial Sequence
  Synthetic Polynucleotide
taatacgactcactataggggtgatgacgggcaagggatgcctcccggtcaacagaggagagaccggatggcatcccttaacctggcggcagcgcaaaagatg

SEQ ID NO: 97824 - DNA, 103 bp, Artificial Sequence
  Synthetic Polynucleotide
taatacgactcactatagggagtcgcagcagtgatgacgggcaagggatgaacagaggagacatcccatgcccgtcatcaacctggcggcagcgcaaaagatg

SEQ ID NO: 97825 - DNA, 103 bp, Artificial Sequence
  Synthetic Polynucleotide
taatacgactcactatagggaagccaggaaagtcgcagcagtgatgacggaacagaggagaccgtcaatgctgctgcgaaacctggcggcagcgcaaaagatg

SEQ ID NO: 97826 - DNA, 103 bp, Artificial Sequence
  Synthetic Polynucleotide
taatacgactcactatagggagcgactgccaagccaggaaagtcgcagcaaacagaggagatgctgcatgtttcctggcaacctggcggcagcgcaaaagatg

SEQ ID NO: 97827 - DNA, 103 bp, Artificial Sequence
  Synthetic Polynucleotide
taatacgactcactataggggtcggagcacaccagctggctctgcgaataaacagaggagatattcgatgagccagctgaacctggcggcagcgcaaaagatg

SEQ ID NO: 97828 - DNA, 103 bp, Artificial Sequence
  Synthetic Polynucleotide
taatacgactcactatagggtgcaggctgcagcgactgccaagccaggaaaacagaggagattcctgatgtggcagtcgaacctggcggcagcgcaaaagatg

SEQ ID NO: 97829 - DNA, 103 bp, Artificial Sequence
  Synthetic Polynucleotide
taatacgactcactatagggaaagccgatctgcaggctgcagcgactgccaacagaggagaggcagtatgtgcagcctgaacctggcggcagcgcaaaagatg

SEQ ID NO: 97830 - DNA, 103 bp, Artificial Sequence
  Synthetic Polynucleotide
taatacgactcactatagggagggaacatgaaagccgatctgcaggctgcaacagaggagagcagccatgagatcggctaacctggcggcagcgcaaaagatg

SEQ ID NO: 97831 - DNA, 103 bp, Artificial Sequence
  Synthetic Polynucleotide
taatacgactcactatagggaaatcgggcaagggaacatgaaagccgatcaacagaggagagatcggatgtcatgttccaacctggcggcagcgcaaaagatg

SEQ ID NO: 97832 - DNA, 103 bp, Artificial Sequence
  Synthetic Polynucleotide
taatacgactcactatagggccaatttacaaaatcgggcaagggaacatgaacagaggagacatgttatgttgcccgataacctggcggcagcgcaaaagatg

SEQ ID NO: 97833 - DNA, 103 bp, Artificial Sequence
  Synthetic Polynucleotide
taatacgactcactatagggtccacatttgccaatttacaaaatcgggcaaacagaggagatgcccgatgttgtaaattaacctggcggcagcgcaaaagatg

SEQ ID NO: 97834 - DNA, 103 bp, Artificial Sequence
  Synthetic Polynucleotide
taatacgactcactataggggtagggcaggtccacatttgccaatttacaaacagaggagatgtaaaatggcaaatgtgaacctggcggcagcgcaaaagatg

SEQ ID NO: 97835 - DNA, 103 bp, Artificial Sequence
  Synthetic Polynucleotide
taatacgactcactatagggaggacgccgggtagggcaggtccacatttgaacagaggagacaaatgatgacctgccctaacctggcggcagcgcaaaagatg

SEQ ID NO: 97836 - DNA, 103 bp, Artificial Sequence
  Synthetic Polynucleotide
taatacgactcactatagggtgcaggcgggaggacgccgggtagggcaggaacagaggagacctgccatgcccggcgtcaacctggcggcagcgcaaaagatg

SEQ ID NO: 97837 - DNA, 103 bp, Artificial Sequence
  Synthetic Polynucleotide
taatacgactcactatagggcagcagctcctgcaggcgggaggacgccggaacagaggagaccggcgatgtcccgcctgaacctggcggcagcgcaaaagatg

SEQ ID NO: 97838 - DNA, 103 bp, Artificial Sequence
  Synthetic Polynucleotide
taatacgactcactatagggcgcagccgcagtcggagcacaccagctggcaacagaggagagccagcatgtgtgctccgaacctggcggcagcgcaaaagatg

SEQ ID NO: 97839 - DNA, 103 bp, Artificial Sequence
  Synthetic Polynucleotide
taatacgactcactataggggcagcacagccagcagctcctgcaggcgggaacagaggagacccgccatgaggagctgcaacctggcggcagcgcaaaagatg

SEQ ID NO: 97840 - DNA, 103 bp, Artificial Sequence
  Synthetic Polynucleotide
taatacgactcactataggggccatccgcagcagcacagccagcagctccaacagaggagaggagctatgggctgtgctaacctggcggcagcgcaaaagatg

SEQ ID NO: 97841 - DNA, 103 bp, Artificial Sequence
  Synthetic Polynucleotide
taatacgactcactatagggcagctgctcagccatccgcagcagcacagcaacagaggagagctgtgatgctgcggatgaacctggcggcagcgcaaaagatg

SEQ ID NO: 97842 - DNA, 103 bp, Artificial Sequence
  Synthetic Polynucleotide
taatacgactcactataggggtaaccaggccagctgctcagccatccgcaaacagaggagatgcggaatgctgagcagcaacctggcggcagcgcaaaagatg

SEQ ID NO: 97843 - DNA, 103 bp, Artificial Sequence
  Synthetic Polynucleotide
taatacgactcactatagggctcagaactcgtaaccaggccagctgctcaaacagaggagatgagcaatgggcctggttaacctggcggcagcgcaaaagatg

SEQ ID NO: 97844 - DNA, 103 bp, Artificial Sequence
  Synthetic Polynucleotide
taatacgactcactatagggtttgtcaagtctcagaactcgtaaccaggcaacagaggagagcctggatgcgagttctgaacctggcggcagcgcaaaagatg

SEQ ID NO: 97845 - DNA, 103 bp, Artificial Sequence
  Synthetic Polynucleotide
taatacgactcactatagggccacagaccgtttgtcaagtctcagaactcaacagaggagagagttcatggacttgacaaacctggcggcagcgcaaaagatg

SEQ ID NO: 97846 - DNA, 103 bp, Artificial Sequence
  Synthetic Polynucleotide
taatacgactcactatagggatgtgcttcaccacagaccgtttgtcaagtaacagaggagaacttgaatgacggtctgtaacctggcggcagcgcaaaagatg

SEQ ID NO: 97847 - DNA, 103 bp, Artificial Sequence
  Synthetic Polynucleotide
taatacgactcactatagggaaggtcaccgatgtgcttcaccacagaccgaacagaggagacggtctatggtgaagcacaacctggcggcagcgcaaaagatg

SEQ ID NO: 97848 - DNA, 103 bp, Artificial Sequence
  Synthetic Polynucleotide
taatacgactcactatagggggtgctggagaaggtcaccgatgtgcttcaaacagaggagatgaagcatgtcggtgaccaacctggcggcagcgcaaaagatg

SEQ ID NO: 97849 - DNA, 103 bp, Artificial Sequence
  Synthetic Polynucleotide
taatacgactcactatagggtcggtgaccacgcagccgcagtcggagcacaacagaggagagtgctcatgctgcggctgaacctggcggcagcgcaaaagatg

SEQ ID NO: 97850 - DNA, 103 bp, Artificial Sequence
  Synthetic Polynucleotide
taatacgactcactatagggagtgactggcggtgctggagaaggtcaccgaacagaggagacggtgaatgtctccagcaaacctggcggcagcgcaaaagatg

SEQ ID NO: 97851 - DNA, 103 bp, Artificial Sequence
  Synthetic Polynucleotide
taatacgactcactatagggagagcggaccagtgactggcggtgctggagaacagaggagactccagatgcgccagtcaaacctggcggcagcgcaaaagatg

SEQ ID NO: 97852 - DNA, 103 bp, Artificial Sequence
  Synthetic Polynucleotide
taatacgactcactatagggcccgaaaggcagagcggaccagtgactggcaacagaggagagccagtatgtggtccgctaacctggcggcagcgcaaaagatg

SEQ ID NO: 97853 - DNA, 103 bp, Artificial Sequence
  Synthetic Polynucleotide
taatacgactcactataggggctgtcccatcccgaaaggcagagcggaccaacagaggagaggtccgatgtgcctttcgaacctggcggcagcgcaaaagatg

SEQ ID NO: 97854 - DNA, 103 bp, Artificial Sequence
  Synthetic Polynucleotide
taatacgactcactatagggctccacttctgctgtcccatcccgaaaggcaacagaggagagcctttatggatgggacaaacctggcggcagcgcaaaagatg

SEQ ID NO: 97855 - DNA, 103 bp, Artificial Sequence
  Synthetic Polynucleotide
taatacgactcactatagggtctctcgggtctccacttctgctgtcccataacagaggagaatgggaatgcagaagtggaacctggcggcagcgcaaaagatg

SEQ ID NO: 97856 - DNA, 103 bp, Artificial Sequence
  Synthetic Polynucleotide
taatacgactcactatagggggtggctccttctctcgggtctccacttctaacagaggagaagaagtatggacccgagaaacctggcggcagcgcaaaagatg

SEQ ID NO: 97857 - DNA, 103 bp, Artificial Sequence
  Synthetic Polynucleotide
taatacgactcactatagggtccccaccccggtggctccttctctcgggtaacagaggagaacccgaatgaaggagccaaacctggcggcagcgcaaaagatg

SEQ ID NO: 97858 - DNA, 103 bp, Artificial Sequence
  Synthetic Polynucleotide
taatacgactcactatagggcttgcccctgtccccaccccggtggctcctaacagaggagaaggagcatgcggggtgggaacctggcggcagcgcaaaagatg

SEQ ID NO: 97859 - DNA, 103 bp, Artificial Sequence
  Synthetic Polynucleotide
taatacgactcactatagggtccccttctccttgcccctgtccccaccccaacagaggagaggggtgatgacaggggcaaacctggcggcagcgcaaaagatg

SEQ ID NO: 97860 - DNA, 103 bp, Artificial Sequence
  Synthetic Polynucleotide
taatacgactcactatagggtggtgcccggcttagtggtgattcttccataacagaggagaatggaaatgtcaccactaaacctggcggcagcgcaaaagatg

SEQ ID NO: 97861 - DNA, 103 bp, Artificial Sequence
  Synthetic Polynucleotide
taatacgactcactatagggggtgcctgggggaagggtgtagtgacattcaacagaggagagaatgtatgtacacccttaacctggcggcagcgcaaaagatg

SEQ ID NO: 97862 - DNA, 103 bp, Artificial Sequence
  Synthetic Polynucleotide
taatacgactcactataggggggctccagctcggccacccgctgctgggcaacagaggagagcccagatgcgggtggccaacctggcggcagcgcaaaagatg

SEQ ID NO: 97863 - DNA, 103 bp, Artificial Sequence
  Synthetic Polynucleotide
taatacgactcactataggggctccttcaagggctccagctcggccacccaacagaggagagggtggatgagctggagcaacctggcggcagcgcaaaagatg

SEQ ID NO: 97864 - DNA, 103 bp, Artificial Sequence
  Synthetic Polynucleotide
taatacgactcactatagggcctcgaagctgctccttcaagggctccagcaacagaggagagctggaatgcttgaaggaaacctggcggcagcgcaaaagatg

SEQ ID NO: 97865 - DNA, 103 bp, Artificial Sequence
  Synthetic Polynucleotide
taatacgactcactatagggctcctgggcccctcgaagctgctccttcaaaacagaggagattgaagatgcagcttcgaaacctggcggcagcgcaaaagatg

SEQ ID NO: 97866 - DNA, 103 bp, Artificial Sequence
  Synthetic Polynucleotide
taatacgactcactatagggaggctgcaagctcctgggcccctcgaagctaacagaggagaagcttcatggggcccaggaacctggcggcagcgcaaaagatg

SEQ ID NO: 97867 - DNA, 103 bp, Artificial Sequence
  Synthetic Polynucleotide
taatacgactcactatagggtgctggcttgaggctgcaagctcctgggccaacagaggagaggcccaatggcttgcagcaacctggcggcagcgcaaaagatg

SEQ ID NO: 97868 - DNA, 103 bp, Artificial Sequence
  Synthetic Polynucleotide
taatacgactcactatagggggtggctttctgctggcttgaggctgcaagaacagaggagacttgcaatgtcaagccagaacctggcggcagcgcaaaagatg

SEQ ID NO: 97869 - DNA, 103 bp, Artificial Sequence
  Synthetic Polynucleotide
taatacgactcactatagggccccaagaagggtggctttctgctggcttgaacagaggagacaagccatgagaaagccaaacctggcggcagcgcaaaagatg

SEQ ID NO: 97870 - DNA, 103 bp, Artificial Sequence
  Synthetic Polynucleotide
taatacgactcactataggggccaactcctccccaagaagggtggctttcaacagaggagagaaagcatgccttcttggaacctggcggcagcgcaaaagatg

SEQ ID NO: 97871 - DNA, 103 bp, Artificial Sequence
  Synthetic Polynucleotide
taatacgactcactatagggtgctgcactggccaactcctccccaagaagaacagaggagacttcttatggaggagttgaacctggcggcagcgcaaaagatg

SEQ ID NO: 97872 - DNA, 103 bp, Artificial Sequence
  Synthetic Polynucleotide
taatacgactcactatagggcactgggcatggtgcctgggggaagggtgtaacagaggagaacacccatgccccaggcaaacctggcggcagcgcaaaagatg

SEQ ID NO: 97873 - DNA, 103 bp, Artificial Sequence
  Synthetic Polynucleotide
taatacgactcactatagggccctggctgctgctgcactggccaactcctaacagaggagaaggagtatgccagtgcagaacctggcggcagcgcaaaagatg

SEQ ID NO: 97874 - DNA, 103 bp, Artificial Sequence
  Synthetic Polynucleotide
taatacgactcactatagggatggtgcggtccctggctgctgctgcactgaacagaggagacagtgcatgagcagccagaacctggcggcagcgcaaaagatg

SEQ ID NO: 97875 - DNA, 103 bp, Artificial Sequence
  Synthetic Polynucleotide
taatacgactcactatagggtagttcggctatggtgcggtccctggctgcaacagaggagagcagccatggaccgcaccaacctggcggcagcgcaaaagatg

SEQ ID NO: 97876 - DNA, 103 bp, Artificial Sequence
  Synthetic Polynucleotide
taatacgactcactatagggggctgcggtgtagttcggctatggtgcggtaacagaggagaaccgcaatgtagccgaacaacctggcggcagcgcaaaagatg

SEQ ID NO: 97877 - DNA, 103 bp, Artificial Sequence
  Synthetic Polynucleotide
taatacgactcactatagggacttccaggcggctgcggtgtagttcggctaacagaggagaagccgaatgacaccgcagaacctggcggcagcgcaaaagatg

SEQ ID NO: 97878 - DNA, 103 bp, Artificial Sequence
  Synthetic Polynucleotide
taatacgactcactatagggaacttcagccacttccaggcggctgcggtgaacagaggagacaccgcatgcgcctggaaaacctggcggcagcgcaaaagatg

SEQ ID NO: 97879 - DNA, 103 bp, Artificial Sequence
  Synthetic Polynucleotide
taatacgactcactataggggcctgccgttaacttcagccacttccaggcaacagaggagagcctggatgtggctgaagaacctggcggcagcgcaaaagatg

SEQ ID NO: 97880 - DNA, 103 bp, Artificial Sequence
  Synthetic Polynucleotide
taatacgactcactatagggagctcagccagcctgccgttaacttcagccaacagaggagaggctgaatgtaacggcagaacctggcggcagcgcaaaagatg

SEQ ID NO: 97881 - DNA, 103 bp, Artificial Sequence
  Synthetic Polynucleotide
taatacgactcactataggggtgcaaaccgagctcagccagcctgccgttaacagaggagaaacggcatgctggctgagaacctggcggcagcgcaaaagatg

SEQ ID NO: 97882 - DNA, 103 bp, Artificial Sequence
  Synthetic Polynucleotide
taatacgactcactatagggcttccttcaagtgcaaaccgagctcagccaaacagaggagatggctgatgtcggtttgcaacctggcggcagcgcaaaagatg

SEQ ID NO: 97883 - DNA, 103 bp, Artificial Sequence
  Synthetic Polynucleotide
taatacgactcactatagggcagtcactggcactgggcatggtgcctgggaacagaggagacccaggatgcatgcccagaacctggcggcagcgcaaaagatg

SEQ ID NO: 97884 - DNA, 103 bp, Artificial Sequence
  Synthetic Polynucleotide
taatacgactcactatagggtggcatttttcttccttcaagtgcaaaccgaacagaggagacggtttatgcttgaaggaaacctggcggcagcgcaaaagatg

SEQ ID NO: 97885 - DNA, 103 bp, Artificial Sequence
  Synthetic Polynucleotide
taatacgactcactatagggcttgctccattggcatttttcttccttcaaaacagaggagattgaagatggaaaaatgcaacctggcggcagcgcaaaagatg

SEQ ID NO: 97886 - DNA, 103 bp, Artificial Sequence
  Synthetic Polynucleotide
taatacgactcactatagggctgcccgctccttgctccattggcatttttaacagaggagaaaaaatatgaatggagcaaacctggcggcagcgcaaaagatg

SEQ ID NO: 97887 - DNA, 103 bp, Artificial Sequence
  Synthetic Polynucleotide
taatacgactcactatagggtgcagcagccctgcccgctccttgctccataacagaggagaatggagatgggagcgggcaacctggcggcagcgcaaaagatg

SEQ ID NO: 97888 - DNA, 103 bp, Artificial Sequence
  Synthetic Polynucleotide
taatacgactcactatagggctccacactctgcagcagccctgcccgctcaacagaggagagagcggatggggctgctgaacctggcggcagcgcaaaagatg

SEQ ID NO: 97889 - DNA, 103 bp, Artificial Sequence
  Synthetic Polynucleotide
taatacgactcactatagggccttctctgcctccacactctgcagcagccaacagaggagaggctgcatgagagtgtggaacctggcggcagcgcaaaagatg

SEQ ID NO: 97890 - DNA, 103 bp, Artificial Sequence
  Synthetic Polynucleotide
taatacgactcactatagggaggatcttgtccttctctgcctccacactcaacagaggagagagtgtatgggcagagaaaacctggcggcagcgcaaaagatg

SEQ ID NO: 97891 - DNA, 103 bp, Artificial Sequence
  Synthetic Polynucleotide
taatacgactcactatagggactcagcttcaggatcttgtccttctctgcaacagaggagagcagagatggacaagatcaacctggcggcagcgcaaaagatg

SEQ ID NO: 97892 - DNA, 103 bp, Artificial Sequence
  Synthetic Polynucleotide
taatacgactcactataggggtatctctgcactcagcttcaggatcttgtaacagaggagaacaagaatgtgaagctgaaacctggcggcagcgcaaaagatg

SEQ ID NO: 97893 - DNA, 103 bp, Artificial Sequence
  Synthetic Polynucleotide
taatacgactcactatagggtccaatcgaagtatctctgcactcagcttcaacagaggagagaagctatgtgcagagataacctggcggcagcgcaaaagatg

SEQ ID NO: 97894 - DNA, 103 bp, Artificial Sequence
  Synthetic Polynucleotide
taatacgactcactataggggatgccaatccagtcactggcactgggcataacagaggagaatgcccatggccagtgacaacctggcggcagcgcaaaagatg

SEQ ID NO: 97895 - DNA, 103 bp, Artificial Sequence
  Synthetic Polynucleotide
taatacgactcactatagggaactgccttctccaatcgaagtatctctgcaacagaggagagcagagatgcttcgattgaacctggcggcagcgcaaaagatg

SEQ ID NO: 97896 - DNA, 103 bp, Artificial Sequence
  Synthetic Polynucleotide
taatacgactcactatagggtctcctcctgaactgccttctccaatcgaaaacagaggagattcgatatgagaaggcagaacctggcggcagcgcaaaagatg

SEQ ID NO: 97897 - DNA, 103 bp, Artificial Sequence
  Synthetic Polynucleotide
taatacgactcactatagggttttgggtcctctcctcctgaactgccttcaacagaggagagaaggcatgtcaggaggaaacctggcggcagcgcaaaagatg

SEQ ID NO: 97898 - DNA, 103 bp, Artificial Sequence
  Synthetic Polynucleotide
taatacgactcactataggggaacacttggttttgggtcctctcctcctgaacagaggagacaggagatgaggacccaaaacctggcggcagcgcaaaagatg

SEQ ID NO: 97899 - DNA, 103 bp, Artificial Sequence
  Synthetic Polynucleotide
taatacgactcactataggggctcagtcttgaacacttggttttgggtccaacagaggagaggacccatgaccaagtgtaacctggcggcagcgcaaaagatg

SEQ ID NO: 97900 - DNA, 103 bp, Artificial Sequence
  Synthetic Polynucleotide
taatacgactcactatagggtcccgggccagctcagtcttgaacacttggaacagaggagaccaagtatgcaagactgaaacctggcggcagcgcaaaagatg

SEQ ID NO: 97901 - DNA, 103 bp, Artificial Sequence
  Synthetic Polynucleotide
taatacgactcactatagggagaatccttctcccgggccagctcagtcttaacagaggagaaagactatgctggcccggaacctggcggcagcgcaaaagatg

SEQ ID NO: 97902 - DNA, 103 bp, Artificial Sequence
  Synthetic Polynucleotide
taatacgactcactataggggtaccaggctagaatccttctcccgggccaaacagaggagatggcccatgagaaggattaacctggcggcagcgcaaaagatg

SEQ ID NO: 97903 - DNA, 103 bp, Artificial Sequence
  Synthetic Polynucleotide
taatacgactcactatagggtctgacaactgtaccaggctagaatccttcaacagaggagagaaggaatgtagcctggtaacctggcggcagcgcaaaagatg

SEQ ID NO: 97904 - DNA, 103 bp, Artificial Sequence
  Synthetic Polynucleotide
taatacgactcactatagggccgcttactttctgacaactgtaccaggctaacagaggagaagcctgatgcagttgtcaaacctggcggcagcgcaaaagatg

SEQ ID NO: 97905 - DNA, 103 bp, Artificial Sequence
  Synthetic Polynucleotide
taatacgactcactatagggccaccttgaagatgccaatccagtcactggaacagaggagaccagtgatgggattggcaaacctggcggcagcgcaaaagatg

SEQ ID NO: 97906 - DNA, 103 bp, Artificial Sequence
  Synthetic Polynucleotide
taatacgactcactatagggctgtcagctcccgcttactttctgacaactaacagaggagaagttgtatgaaagtaagcaacctggcggcagcgcaaaagatg

SEQ ID NO: 97907 - DNA, 103 bp, Artificial Sequence
  Synthetic Polynucleotide
taatacgactcactataggggaccgcagctctgtcagctcccgcttacttaacagaggagaaagtaaatgggagctgacaacctggcggcagcgcaaaagatg

SEQ ID NO: 97908 - DNA, 103 bp, Artificial Sequence
  Synthetic Polynucleotide
taatacgactcactatagggacgcagggctgaccgcagctctgtcagctcaacagaggagagagctgatggagctgcggaacctggcggcagcgcaaaagatg

SEQ ID NO: 97909 - DNA, 103 bp, Artificial Sequence
  Synthetic Polynucleotide
taatacgactcactatagggtctggagcacacgcagggctgaccgcagctaacagaggagaagctgcatgcagccctgcaacctggcggcagcgcaaaagatg

SEQ ID NO: 97910 - DNA, 103 bp, Artificial Sequence
  Synthetic Polynucleotide
taatacgactcactatagggtccttttccttctggagcacacgcagggctaacagaggagaagccctatgtgtgctccaaacctggcggcagcgcaaaagatg

SEQ ID NO: 97911 - DNA, 103 bp, Artificial Sequence
  Synthetic Polynucleotide
taatacgactcactatagggctgtaactgctccttttccttctggagcacaacagaggagagtgctcatgaaggaaaagaacctggcggcagcgcaaaagatg

SEQ ID NO: 97912 - DNA, 103 bp, Artificial Sequence
  Synthetic Polynucleotide
taatacgactcactataggggtttctcctcctgtaactgctccttttcctaacagaggagaaggaaaatgagcagttacaacctggcggcagcgcaaaagatg

SEQ ID NO: 97913 - DNA, 103 bp, Artificial Sequence
  Synthetic Polynucleotide
taatacgactcactatagggagcaattcctgtttctcctcctgtaactgcaacagaggagagcagttatgggaggagaaaacctggcggcagcgcaaaagatg

SEQ ID NO: 97914 - DNA, 103 bp, Artificial Sequence
  Synthetic Polynucleotide
taatacgactcactatagggcatgtactctagcaattcctgtttctcctcaacagaggagagaggagatgcaggaattgaacctggcggcagcgcaaaagatg

SEQ ID NO: 97915 - DNA, 103 bp, Artificial Sequence
  Synthetic Polynucleotide
taatacgactcactatagggctagctttctcatgtactctagcaattcctaacagaggagaaggaatatgtagagtacaaacctggcggcagcgcaaaagatg

SEQ ID NO: 97916 - DNA, 103 bp, Artificial Sequence
  Synthetic Polynucleotide
taatacgactcactatagggcaggcagcctccaccttgaagatgccaatcaacagaggagagattggatgcttcaaggtaacctggcggcagcgcaaaagatg

SEQ ID NO: 97917 - DNA, 103 bp, Artificial Sequence
  Synthetic Polynucleotide
taatacgactcactatagggaggcgggcctctagctttctcatgtactctaacagaggagaagagtaatggagaaagctaacctggcggcagcgcaaaagatg

SEQ ID NO: 97918 - DNA, 103 bp, Artificial Sequence
  Synthetic Polynucleotide
taatacgactcactatagggcaccttctccaggcgggcctctagctttctaacagaggagaagaaagatggaggcccgcaacctggcggcagcgcaaaagatg

SEQ ID NO: 97919 - DNA, 103 bp, Artificial Sequence
  Synthetic Polynucleotide
taatacgactcactatagggtctcatctgccaccttctccaggcgggcctaacagaggagaaggcccatgtggagaaggaacctggcggcagcgcaaaagatg

SEQ ID NO: 97920 - DNA, 103 bp, Artificial Sequence
  Synthetic Polynucleotide
taatacgactcactatagggtcattccacttctcatctgccaccttctccaacagaggagaggagaaatgggcagatgaaacctggcggcagcgcaaaagatg

SEQ ID NO: 97921 - DNA, 103 bp, Artificial Sequence
  Synthetic Polynucleotide
taatacgactcactatagggggtggcatcctcattccacttctcatctgcaacagaggagagcagatatgaagtggaataacctggcggcagcgcaaaagatg

SEQ ID NO: 97922 - DNA, 103 bp, Artificial Sequence
  Synthetic Polynucleotide
taatacgactcactatagggcatcctctgtggtggcatcctcattccactaacagaggagaagtggaatgaggatgccaaacctggcggcagcgcaaaagatg

SEQ ID NO: 97923 - DNA, 103 bp, Artificial Sequence
  Synthetic Polynucleotide
taatacgactcactataggggcggcctcctcatcctctgtggtggcatccaacagaggagaggatgcatgcacagaggaaacctggcggcagcgcaaaagatg

SEQ ID NO: 97924 - DNA, 103 bp, Artificial Sequence
  Synthetic Polynucleotide
taatacgactcactatagggcagccccacagcggcctcctcatcctctgtaacagaggagaacagagatggaggaggccaacctggcggcagcgcaaaagatg

SEQ ID NO: 97925 - DNA, 103 bp, Artificial Sequence
  Synthetic Polynucleotide
taatacgactcactatagggccgggcagctcagccccacagcggcctcctaacagaggagaaggaggatgctgtggggcaacctggcggcagcgcaaaagatg

SEQ ID NO: 97926 - DNA, 103 bp, Artificial Sequence
  Synthetic Polynucleotide
taatacgactcactataggggtcagagctgccgggcagctcagccccacaaacagaggagatgtgggatggagctgcccaacctggcggcagcgcaaaagatg

SEQ ID NO: 97927 - DNA, 103 bp, Artificial Sequence
  Synthetic Polynucleotide
taatacgactcactatagggatcccgaacacaggcagcctccaccttgaaaacagaggagattcaagatggaggctgccaacctggcggcagcgcaaaagatg

SEQ ID NO: 97928 - DNA, 103 bp, Artificial Sequence
  Synthetic Polynucleotide
taatacgactcactatagggctctgagtctgtcagagctgccgggcagctaacagaggagaagctgcatggcagctctgaacctggcggcagcgcaaaagatg

SEQ ID NO: 97929 - DNA, 103 bp, Artificial Sequence
  Synthetic Polynucleotide
taatacgactcactataggggggactcgtcctctgagtctgtcagagctgaacagaggagacagctcatgcagactcagaacctggcggcagcgcaaaagatg

SEQ ID NO: 97930 - DNA, 103 bp, Artificial Sequence
  Synthetic Polynucleotide
taatacgactcactatagggatgtcttctggggactcgtcctctgagtctaacagaggagaagactcatgggacgagtcaacctggcggcagcgcaaaagatg

SEQ ID NO: 97931 - DNA, 103 bp, Artificial Sequence
  Synthetic Polynucleotide
taatacgactcactatagggtgggagcctcatgtcttctggggactcgtcaacagaggagagacgagatgccagaagacaacctggcggcagcgcaaaagatg

SEQ ID NO: 97932 - DNA, 103 bp, Artificial Sequence
  Synthetic Polynucleotide
taatacgactcactatagggggccatagggtgggagcctcatgtcttctgaacagaggagacagaagatgtgaggctccaacctggcggcagcgcaaaagatg

SEQ ID NO: 97933 - DNA, 103 bp, Artificial Sequence
  Synthetic Polynucleotide
taatacgactcactatagggcgctcacaaaggccatagggtgggagcctcaacagaggagagaggctatgaccctatggaacctggcggcagcgcaaaagatg

SEQ ID NO: 97934 - DNA, 103 bp, Artificial Sequence
  Synthetic Polynucleotide
taatacgactcactatagggtgggtctccacgctcacaaaggccatagggaacagaggagaccctatatgctttgtgagaacctggcggcagcgcaaaagatg

SEQ ID NO: 97935 - DNA, 103 bp, Artificial Sequence
  Synthetic Polynucleotide
taatacgactcactataggggagaggagcctgggtctccacgctcacaaaaacagaggagatttgtgatggtggagaccaacctggcggcagcgcaaaagatg

SEQ ID NO: 97936 - DNA, 103 bp, Artificial Sequence
  Synthetic Polynucleotide
taatacgactcactatagggggcccagcaggagaggagcctgggtctccaaacagaggagatggagaatgaggctcctcaacctggcggcagcgcaaaagatg

SEQ ID NO: 97937 - DNA, 103 bp, Artificial Sequence
  Synthetic Polynucleotide
taatacgactcactatagggagcctctcgaggcccagcaggagaggagccaacagaggagaggctccatgcctgctgggaacctggcggcagcgcaaaagatg

SEQ ID NO: 97938 - DNA, 103 bp, Artificial Sequence
  Synthetic Polynucleotide
taatacgactcactatagggatgtgtggtaatcccgaacacaggcagcctaacagaggagaaggctgatggtgttcgggaacctggcggcagcgcaaaagatg

SEQ ID NO: 97939 - DNA, 103 bp, Artificial Sequence
  Synthetic Polynucleotide
taatacgactcactatagggcaaggggagaagcctctcgaggcccagcagaacagaggagactgctgatgctcgagaggaacctggcggcagcgcaaaagatg

SEQ ID NO: 97940 - DNA, 103 bp, Artificial Sequence
  Synthetic Polynucleotide
taatacgactcactatagggctgatgacaacaaggggagaagcctctcgaaacagaggagatcgagaatgttctcccctaacctggcggcagcgcaaaagatg

SEQ ID NO: 97941 - DNA, 103 bp, Artificial Sequence
  Synthetic Polynucleotide
taatacgactcactatagggagccggctggctgatgacaacaaggggagaaacagaggagatctcccatggttgtcatcaacctggcggcagcgcaaaagatg

SEQ ID NO: 97942 - DNA, 103 bp, Artificial Sequence
  Synthetic Polynucleotide
taatacgactcactataggggagaaatgggagccggctggctgatgacaaaacagaggagattgtcaatggccagccggaacctggcggcagcgcaaaagatg

SEQ ID NO: 97943 - DNA, 103 bp, Artificial Sequence
  Synthetic Polynucleotide
taatacgactcactataggggagaggtgaggagaaatgggagccggctggaacagaggagaccagccatgtcccatttcaacctggcggcagcgcaaaagatg

SEQ ID NO: 97944 - DNA, 103 bp, Artificial Sequence
  Synthetic Polynucleotide
taatacgactcactatagggagctggcccagagaggtgaggagaaatgggaacagaggagacccattatgcctcacctcaacctggcggcagcgcaaaagatg

SEQ ID NO: 97945 - DNA, 103 bp, Artificial Sequence
  Synthetic Polynucleotide
taatacgactcactatagggtactgtcctcagctggcccagagaggtgagaacagaggagactcaccatgctgggccagaacctggcggcagcgcaaaagatg

SEQ ID NO: 97946 - DNA, 103 bp, Artificial Sequence
  Synthetic Polynucleotide
taatacgactcactataggggagtcagagctactgtcctcagctggcccaaacagaggagatgggccatgtgaggacagaacctggcggcagcgcaaaagatg

SEQ ID NO: 97947 - DNA, 103 bp, Artificial Sequence
  Synthetic Polynucleotide
taatacgactcactatagggatcttcagccgagtcagagctactgtcctcaacagaggagagaggacatgagctctgacaacctggcggcagcgcaaaagatg

SEQ ID NO: 97948 - DNA, 103 bp, Artificial Sequence
  Synthetic Polynucleotide
taatacgactcactatagggctgacttctcatcttcagccgagtcagagcaacagaggagagctctgatgcggctgaagaacctggcggcagcgcaaaagatg

SEQ ID NO: 97949 - DNA, 103 bp, Artificial Sequence
  Synthetic Polynucleotide
taatacgactcactataggggaccacacaaatgtgtggtaatcccgaacaaacagaggagatgttcgatgttaccacacaacctggcggcagcgcaaaagatg

SEQ ID NO: 97950 - DNA, 103 bp, Artificial Sequence
  Synthetic Polynucleotide
taatacgactcactataggggccatcaggactgacttctcatcttcagccaacagaggagaggctgaatgtgagaagtcaacctggcggcagcgcaaaagatg

SEQ ID NO: 97951 - DNA, 103 bp, Artificial Sequence
  Synthetic Polynucleotide
taatacgactcactatagggctgcacagctgccatcaggactgacttctcaacagaggagagagaagatggtcctgatgaacctggcggcagcgcaaaagatg

SEQ ID NO: 97952 - DNA, 103 bp, Artificial Sequence
  Synthetic Polynucleotide
taatacgactcactatagggcacccccactctgcacagctgccatcaggaaacagaggagatcctgaatgcagctgtgcaacctggcggcagcgcaaaagatg

SEQ ID NO: 97953 - DNA, 103 bp, Artificial Sequence
  Synthetic Polynucleotide
taatacgactcactatagggttggcctcctcacccccactctgcacagctaacagaggagaagctgtatggagtgggggaacctggcggcagcgcaaaagatg

SEQ ID NO: 97954 - DNA, 103 bp, Artificial Sequence
  Synthetic Polynucleotide
taatacgactcactatagggaagcagtaagttggcctcctcacccccactaacagaggagaagtgggatggaggaggccaacctggcggcagcgcaaaagatg

SEQ ID NO: 97955 - DNA, 103 bp, Artificial Sequence
  Synthetic Polynucleotide
taatacgactcactatagggccagttcaggaagcagtaagttggcctcctaacagaggagaaggaggatgacttactgcaacctggcggcagcgcaaaagatg

SEQ ID NO: 97956 - DNA, 103 bp, Artificial Sequence
  Synthetic Polynucleotide
taatacgactcactatagggaaggcactgcccagttcaggaagcagtaagaacagaggagacttactatgtcctgaactaacctggcggcagcgcaaaagatg

SEQ ID NO: 97957 - DNA, 103 bp, Artificial Sequence
  Synthetic Polynucleotide
taatacgactcactatagggcatgtcatagaaggcactgcccagttcaggaacagaggagacctgaaatgggcagtgccaacctggcggcagcgcaaaagatg

SEQ ID NO: 97958 - DNA, 103 bp, Artificial Sequence
  Synthetic Polynucleotide
taatacgactcactatagggagccactggccatgtcatagaaggcactgcaacagaggagagcagtgatgtctatgacaaacctggcggcagcgcaaaagatg

SEQ ID NO: 97959 - DNA, 103 bp, Artificial Sequence
  Synthetic Polynucleotide
taatacgactcactatagggcccactgtaaagccactggccatgtcatagaacagaggagactatgaatgggccagtggaacctggcggcagcgcaaaagatg

SEQ ID NO: 97960 - DNA, 103 bp, Artificial Sequence
  Synthetic Polynucleotide
taatacgactcactatagggaggcacggaagaccacacaaatgtgtggtaaacagaggagataccacatgtttgtgtggaacctggcggcagcgcaaaagatg

SEQ ID NO: 97961 - DNA, 103 bp, Artificial Sequence
  Synthetic Polynucleotide
taatacgactcactatagggtgacagggtacccactgtaaagccactggcaacagaggagagccagtatgtttacagtgaacctggcggcagcgcaaaagatg

SEQ ID NO: 97962 - DNA, 103 bp, Artificial Sequence
  Synthetic Polynucleotide
taatacgactcactatagggtgctggtttctgacagggtacccactgtaaaacagaggagattacagatggtaccctgtaacctggcggcagcgcaaaagatg

SEQ ID NO: 97963 - DNA, 103 bp, Artificial Sequence
  Synthetic Polynucleotide
taatacgactcactataggggggcccccagtgctggtttctgacagggtaaacagaggagataccctatgagaaaccagaacctggcggcagcgcaaaagatg

SEQ ID NO: 97964 - DNA, 103 bp, Artificial Sequence
  Synthetic Polynucleotide
taatacgactcactataggggggggtggcagggcccccagtgctggtttcaacagaggagagaaaccatgactgggggcaacctggcggcagcgcaaaagatg

SEQ ID NO: 97965 - DNA, 103 bp, Artificial Sequence
  Synthetic Polynucleotide
taatacgactcactatagggccttccatgtgggggtggcagggcccccagaacagaggagactggggatgctgccacccaacctggcggcagcgcaaaagatg

SEQ ID NO: 97966 - DNA, 103 bp, Artificial Sequence
  Synthetic Polynucleotide
taatacgactcactatagggataggacactccttccatgtgggggtggcaaacagaggagatgccacatgcacatggaaaacctggcggcagcgcaaaagatg

SEQ ID NO: 97967 - DNA, 103 bp, Artificial Sequence
  Synthetic Polynucleotide
taatacgactcactatagggctccttacagataggacactccttccatgtaacagaggagaacatggatggagtgtcctaacctggcggcagcgcaaaagatg

SEQ ID NO: 97968 - DNA, 103 bp, Artificial Sequence
  Synthetic Polynucleotide
taatacgactcactatagggcaggaaagcgctccttacagataggacactaacagaggagaagtgtcatgtctgtaaggaacctggcggcagcgcaaaagatg

SEQ ID NO: 97969 - DNA, 103 bp, Artificial Sequence
  Synthetic Polynucleotide
taatacgactcactatagggtcactctcagcaggaaagcgctccttacagaacagaggagactgtaaatggcgctttccaacctggcggcagcgcaaaagatg

SEQ ID NO: 97970 - DNA, 103 bp, Artificial Sequence
  Synthetic Polynucleotide
taatacgactcactatagggggcatccttgtcactctcagcaggaaagcgaacagaggagacgctttatggctgagagtaacctggcggcagcgcaaaagatg

SEQ ID NO: 97971 - DNA, 103 bp, Artificial Sequence
  Synthetic Polynucleotide
taatacgactcactatagggcaccacgggatggtgcccggcttagtggtgaacagaggagacaccacatggccgggcacaacctggcggcagcgcaaaagatg

SEQ ID NO: 97972 - DNA, 103 bp, Artificial Sequence
  Synthetic Polynucleotide
taatacgactcactatagggttgtactttcaggcacggaagaccacacaaaacagaggagattgtgtatgcttccgtgcaacctggcggcagcgcaaaagatg

SEQ ID NO: 97973 - DNA, 103 bp, Artificial Sequence
  Synthetic Polynucleotide
taatacgactcactatagggggtcctccagggcatccttgtcactctcagaacagaggagactgagaatgacaaggatgaacctggcggcagcgcaaaagatg

SEQ ID NO: 97974 - DNA, 103 bp, Artificial Sequence
  Synthetic Polynucleotide
taatacgactcactatagggccatccatgtggtcctccagggcatccttgaacagaggagacaaggaatgcctggaggaaacctggcggcagcgcaaaagatg

SEQ ID NO: 97975 - DNA, 103 bp, Artificial Sequence
  Synthetic Polynucleotide
taatacgactcactatagggaaagaagtgtccatccatgtggtcctccagaacagaggagactggagatgcacatggataacctggcggcagcgcaaaagatg

SEQ ID NO: 97976 - DNA, 103 bp, Artificial Sequence
  Synthetic Polynucleotide
taatacgactcactataggggggtgctgaaaaagaagtgtccatccatgtaacagaggagaacatggatggacacttctaacctggcggcagcgcaaaagatg

SEQ ID NO: 97977 - DNA, 103 bp, Artificial Sequence
  Synthetic Polynucleotide
taatacgactcactatagggaaggggtcctgggtgctgaaaaagaagtgtaacagaggagaacacttatgtttcagcacaacctggcggcagcgcaaaagatg

SEQ ID NO: 97978 - DNA, 103 bp, Artificial Sequence
  Synthetic Polynucleotide
taatacgactcactatagggctcaaaggtgaaggggtcctgggtgctgaaaacagaggagattcagcatgcaggaccccaacctggcggcagcgcaaaagatg

SEQ ID NO: 97979 - DNA, 103 bp, Artificial Sequence
  Synthetic Polynucleotide
taatacgactcactataggggaaccatcagttgtactttcaggcacggaaaacagaggagattccgtatgtgaaagtacaacctggcggcagcgcaaaagatg

SEQ ID NO: 97980 - DNA, 103 bp, Artificial Sequence
  Synthetic Polynucleotide
taatacgactcactataggggtgaatgggggaaccatcagttgtactttcaacagaggagagaaagtatgactgatggtaacctggcggcagcgcaaaagatg

SEQ ID NO: 97981 - DNA, 103 bp, Artificial Sequence
  Synthetic Polynucleotide
taatacgactcactatagggggacactggtgtgaatgggggaaccatcagaacagaggagactgatgatgcccccattcaacctggcggcagcgcaaaagatg

SEQ ID NO: 97982 - DNA, 103 bp, Artificial Sequence
  Synthetic Polynucleotide
taatacgactcactataggggcttggaactggacactggtgtgaatggggaacagaggagaccccatatgcaccagtgtaacctggcggcagcgcaaaagatg

SEQ ID NO: 97983 - DNA, 103 bp, Artificial Sequence
  Synthetic Polynucleotide
taatacgactcactatagggcaggtagctggcttggaactggacactggtaacagaggagaaccagtatgcagttccaaaacctggcggcagcgcaaaagatg

SEQ ID NO: 97984 - DNA, 103 bp, Artificial Sequence
  Synthetic Polynucleotide
taatacgactcactatagggctggtttgggcaggtagctggcttggaactaacagaggagaagttccatgccagctaccaacctggcggcagcgcaaaagatg

SEQ ID NO: 97985 - DNA, 103 bp, Artificial Sequence
  Synthetic Polynucleotide
taatacgactcactatagggagctgagctcctggtttgggcaggtagctgaacagaggagacagctaatggcccaaaccaacctggcggcagcgcaaaagatg

SEQ ID NO: 97986 - DNA, 103 bp, Artificial Sequence
  Synthetic Polynucleotide
taatacgactcactataggggaactggtagagctgagctcctggtttgggaacagaggagacccaaaatgggagctcagaacctggcggcagcgcaaaagatg

SEQ ID NO: 97987 - DNA, 103 bp, Artificial Sequence
  Synthetic Polynucleotide
taatacgactcactatagggtcacatatcggaactggtagagctgagctcaacagaggagagagctcatgtctaccagtaacctggcggcagcgcaaaagatg

SEQ ID NO: 97988 - DNA, 103 bp, Artificial Sequence
  Synthetic Polynucleotide
taatacgactcactatagggaagttgactccaccacgggatggtgcccggaacagaggagaccgggcatgatcccgtggaacctggcggcagcgcaaaagatg

SEQ ID NO: 97989 - DNA, 103 bp, Artificial Sequence
  Synthetic Polynucleotide
taatacgactcactatagggccctggcggttcacatatcggaactggtagaacagaggagactaccaatgccgatatgtaacctggcggcagcgcaaaagatg

SEQ ID NO: 97990 - DNA, 103 bp, Artificial Sequence
  Synthetic Polynucleotide
taatacgactcactatagggacacacctggccctggcggttcacatatcgaacagaggagacgatatatgaaccgccagaacctggcggcagcgcaaaagatg

SEQ ID NO: 97991 - DNA, 103 bp, Artificial Sequence
  Synthetic Polynucleotide
taatacgactcactatagggggctctgcccacacacctggccctggcggtaacagaggagaaccgccatggccaggtgtaacctggcggcagcgcaaaagatg

SEQ ID NO: 97992 - DNA, 103 bp, Artificial Sequence
  Synthetic Polynucleotide
taatacgactcactatagggtggaaaggggggctctgcccacacacctggaacagaggagaccaggtatgtgggcagagaacctggcggcagcgcaaaagatg

SEQ ID NO: 97993 - DNA, 103 bp, Artificial Sequence
  Synthetic Polynucleotide
taatacgactcactatagggctctcggaactggaaaggggggctctgcccaacagaggagagggcagatgccccctttcaacctggcggcagcgcaaaagatg

SEQ ID NO: 97994 - DNA, 103 bp, Artificial Sequence
  Synthetic Polynucleotide
taatacgactcactatagggtgggccttggctctcggaactggaaaggggaacagaggagaccccttatgagttccgagaacctggcggcagcgcaaaagatg

SEQ ID NO: 97995 - DNA, 103 bp, Artificial Sequence
  Synthetic Polynucleotide
taatacgactcactatagggagttcatccatgggccttggctctcggaacaacagaggagagttccgatggccaaggccaacctggcggcagcgcaaaagatg

SEQ ID NO: 97996 - DNA, 103 bp, Artificial Sequence
  Synthetic Polynucleotide
taatacgactcactatagggcagggtcaccagttcatccatgggccttggaacagaggagaccaaggatgatggatgaaaacctggcggcagcgcaaaagatg

SEQ ID NO: 97997 - DNA, 103 bp, Artificial Sequence
  Synthetic Polynucleotide
taatacgactcactatagggcagcctcctccagggtcaccagttcatccaaacagaggagatggatgatgtggtgacccaacctggcggcagcgcaaaagatg

SEQ ID NO: 97998 - DNA, 103 bp, Artificial Sequence
  Synthetic Polynucleotide
taatacgactcactataggggagcccccatcagcctcctccagggtcaccaacagaggagaggtgacatgggaggaggcaacctggcggcagcgcaaaagatg

SEQ ID NO: 97999 - DNA, 103 bp, Artificial Sequence
  Synthetic Polynucleotide
taatacgactcactatagggtacattgagaaagttgactccaccacgggaaacagaggagatcccgtatgggagtcaacaacctggcggcagcgcaaaagatg

SEQ ID NO: 98000 - DNA, 103 bp, Artificial Sequence
  Synthetic Polynucleotide
taatacgactcactatagggcaggatgtcagagcccccatcagcctcctcaacagaggagagaggagatggatgggggcaacctggcggcagcgcaaaagatg

SEQ ID NO: 98001 - DNA, 103 bp, Artificial Sequence
  Synthetic Polynucleotide
taatacgactcactatagggggacaaccagcaggatgtcagagcccccataacagaggagaatggggatgctgacatccaacctggcggcagcgcaaaagatg

SEQ ID NO: 98002 - DNA, 103 bp, Artificial Sequence
  Synthetic Polynucleotide
taatacgactcactataggggttgccttggggacaaccagcaggatgtcaaacagaggagatgacatatggctggttgtaacctggcggcagcgcaaaagatg

SEQ ID NO: 98003 - DNA, 103 bp, Artificial Sequence
  Synthetic Polynucleotide
taatacgactcactatagggctgtaacacagttgccttggggacaaccagaacagaggagactggttatgcccaaggcaaacctggcggcagcgcaaaagatg

SEQ ID NO: 98004 - DNA, 103 bp, Artificial Sequence
  Synthetic Polynucleotide
taatacgactcactatagggcgagctggttctgtaacacagttgccttggaacagaggagaccaaggatgctgtgttacaacctggcggcagcgcaaaagatg

SEQ ID NO: 98005 - DNA, 103 bp, Artificial Sequence
  Synthetic Polynucleotide
taatacgactcactatagggtggctctcatcgagctggttctgtaacacaaacagaggagatgtgttatggaaccagctaacctggcggcagcgcaaaagatg

SEQ ID NO: 98006 - DNA, 103 bp, Artificial Sequence
  Synthetic Polynucleotide
taatacgactcactatagggccgttcttgctggctctcatcgagctggttaacagaggagaaaccagatggatgagagcaacctggcggcagcgcaaaagatg

SEQ ID NO: 98007 - DNA, 103 bp, Artificial Sequence
  Synthetic Polynucleotide
taatacgactcactatagggtcaggtcattccgttcttgctggctctcataacagaggagaatgagaatgagcaagaacaacctggcggcagcgcaaaagatg

SEQ ID NO: 98008 - DNA, 103 bp, Artificial Sequence
  Synthetic Polynucleotide
taatacgactcactatagggttcagctgcatcaggtcattccgttcttgcaacagaggagagcaagaatggaatgacctaacctggcggcagcgcaaaagatg

SEQ ID NO: 98009 - DNA, 103 bp, Artificial Sequence
  Synthetic Polynucleotide
taatacgactcactatagggcagctgtagcttcagctgcatcaggtcattaacagaggagaaatgacatgatgcagctgaacctggcggcagcgcaaaagatg

SEQ ID NO: 98010 - DNA, 103 bp, Artificial Sequence
  Synthetic Polynucleotide
taatacgactcactatagggaggtccgggctacattgagaaagttgactcaacagaggagagagtcaatgttctcaatgaacctggcggcagcgcaaaagatg

SEQ ID NO: 98011 - DNA, 103 bp, Artificial Sequence
  Synthetic Polynucleotide
taatacgactcactatagggcctgtccctccagctgtagcttcagctgcaaacagaggagatgcagcatgagctacagcaacctggcggcagcgcaaaagatg

SEQ ID NO: 98012 - DNA, 103 bp, Artificial Sequence
  Synthetic Polynucleotide
taatacgactcactatagggagctctgtcacctgtccctccagctgtagcaacagaggagagctacaatgggagggacaaacctggcggcagcgcaaaagatg

SEQ ID NO: 98013 - DNA, 103 bp, Artificial Sequence
  Synthetic Polynucleotide
taatacgactcactatagggtcggctcctcagctctgtcacctgtccctcaacagaggagagagggaatggtgacagagaacctggcggcagcgcaaaagatg

SEQ ID NO: 98014 - DNA, 103 bp, Artificial Sequence
  Synthetic Polynucleotide
taatacgactcactataggggctcctgcactcggctcctcagctctgtcaaacagaggagatgacagatgtgaggagccaacctggcggcagcgcaaaagatg

SEQ ID NO: 98015 - DNA, 103 bp, Artificial Sequence
  Synthetic Polynucleotide
taatacgactcactataggggccctctcgagctcctgcactcggctcctcaacagaggagagaggagatgagtgcaggaaacctggcggcagcgcaaaagatg

SEQ ID NO: 98016 - DNA, 103 bp, Artificial Sequence
  Synthetic Polynucleotide
taatacgactcactatagggagttgccagagccctctcgagctcctgcacaacagaggagagtgcagatgctcgagaggaacctggcggcagcgcaaaagatg

SEQ ID NO: 98017 - DNA, 103 bp, Artificial Sequence
  Synthetic Polynucleotide
taatacgactcactatagggcctgcctggcagttgccagagccctctcgaaacagaggagatcgagaatgctctggcaaaacctggcggcagcgcaaaagatg

SEQ ID NO: 98018 - DNA, 103 bp, Artificial Sequence
  Synthetic Polynucleotide
taatacgactcactatagggtccgtgtgctcctgcctggcagttgccagaaacagaggagatctggcatgtgccaggcaaacctggcggcagcgcaaaagatg

SEQ ID NO: 98019 - DNA, 103 bp, Artificial Sequence
  Synthetic Polynucleotide
taatacgactcactatagggttccatcagctccgtgtgctcctgcctggcaacagaggagagccaggatggagcacacgaacctggcggcagcgcaaaagatg

SEQ ID NO: 98020 - DNA, 103 bp, Artificial Sequence
  Synthetic Polynucleotide
taatacgactcactatagggccttgtactgttccatcagctccgtgtgctaacagaggagaagcacaatgagctgatggaacctggcggcagcgcaaaagatg

SEQ ID NO: 98021 - DNA, 103 bp, Artificial Sequence
  Synthetic Polynucleotide
taatacgactcactatagggttggggatgtaggtccgggctacattgagaaacagaggagatctcaaatgagcccggacaacctggcggcagcgcaaaagatg

SEQ ID NO: 98022 - DNA, 103 bp, Artificial Sequence
  Synthetic Polynucleotide
taatacgactcactatagggcgggaaatccccttgtactgttccatcagcaacagaggagagctgatatgacagtacaaaacctggcggcagcgcaaaagatg

SEQ ID NO: 98023 - DNA, 103 bp, Artificial Sequence
  Synthetic Polynucleotide
taatacgactcactatagggcccatgggaccgggaaatccccttgtactgaacagaggagacagtacatggggatttccaacctggcggcagcgcaaaagatg

SEQ ID NO: 98024 - DNA, 103 bp, Artificial Sequence
  Synthetic Polynucleotide
taatacgactcactatagggctgtgatctccccatgggaccgggaaatccaacagaggagaggatttatgggtcccatgaacctggcggcagcgcaaaagatg

SEQ ID NO: 98025 - DNA, 103 bp, Artificial Sequence
  Synthetic Polynucleotide
taatacgactcactatagggtccctctcttctgtgatctccccatgggacaacagaggagagtcccaatgggagatcacaacctggcggcagcgcaaaagatg

SEQ ID NO: 98026 - DNA, 103 bp, Artificial Sequence
  Synthetic Polynucleotide
taatacgactcactataggggctcaggatgtccctctcttctgtgatctcaacagaggagagagatcatggaagagaggaacctggcggcagcgcaaaagatg

SEQ ID NO: 98027 - DNA, 103 bp, Artificial Sequence
  Synthetic Polynucleotide
taatacgactcactatagggcctgttgccggctcaggatgtccctctcttaacagaggagaaagagaatgacatcctgaaacctggcggcagcgcaaaagatg

SEQ ID NO: 98028 - DNA, 103 bp, Artificial Sequence
  Synthetic Polynucleotide
taatacgactcactatagggacatggtctccctgttgccggctcaggatgaacagaggagacatcctatgccggcaacaaacctggcggcagcgcaaaagatg

SEQ ID NO: 98029 - DNA, 103 bp, Artificial Sequence
  Synthetic Polynucleotide
taatacgactcactataggggatgcgtgccacatggtctccctgttgccgaacagaggagacggcaaatgggagaccataacctggcggcagcgcaaaagatg

SEQ ID NO: 98030 - DNA, 103 bp, Artificial Sequence
  Synthetic Polynucleotide
taatacgactcactatagggctagctccaggatgcgtgccacatggtctcaacagaggagagagaccatgtggcacgcaaacctggcggcagcgcaaaagatg

SEQ ID NO: 98031 - DNA, 103 bp, Artificial Sequence
  Synthetic Polynucleotide
taatacgactcactatagggatgtcatcctctagctccaggatgcgtgccaacagaggagaggcacgatgcctggagctaacctggcggcagcgcaaaagatg

SEQ ID NO: 98032 - DNA, 103 bp, Artificial Sequence
  Synthetic Polynucleotide
taatacgactcactatagggcaccttggtgttggggatgtaggtccgggcaacagaggagagcccggatgtacatccccaacctggcggcagcgcaaaagatg

SEQ ID NO: 98033 - DNA, 103 bp, Artificial Sequence
  Synthetic Polynucleotide
taatacgactcactataggggatggtctggatgtcatcctctagctccagaacagaggagactggagatggaggatgacaacctggcggcagcgcaaaagatg

SEQ ID NO: 98034 - DNA, 103 bp, Artificial Sequence
  Synthetic Polynucleotide
taatacgactcactatagggctttctcactgatggtctggatgtcatcctaacagaggagaaggatgatgtccagaccaaacctggcggcagcgcaaaagatg

SEQ ID NO: 98035 - DNA, 103 bp, Artificial Sequence
  Synthetic Polynucleotide
taatacgactcactatagggttcgtcagcactttctcactgatggtctggaacagaggagaccagacatgcagtgagaaaacctggcggcagcgcaaaagatg

SEQ ID NO: 98036 - DNA, 103 bp, Artificial Sequence
  Synthetic Polynucleotide
taatacgactcactatagggctccacttccttcgtcagcactttctcactaacagaggagaagtgagatggtgctgacgaacctggcggcagcgcaaaagatg

SEQ ID NO: 98037 - DNA, 103 bp, Artificial Sequence
  Synthetic Polynucleotide
taatacgactcactataggggcctgtccagctccacttccttcgtcagcaaacagaggagatgctgaatgaggaagtggaacctggcggcagcgcaaaagatg

SEQ ID NO: 98038 - DNA, 103 bp, Artificial Sequence
  Synthetic Polynucleotide
taatacgactcactataggggtgtctctaagcctgtccagctccacttccaacagaggagaggaagtatggctggacagaacctggcggcagcgcaaaagatg

SEQ ID NO: 98039 - DNA, 103 bp, Artificial Sequence
  Synthetic Polynucleotide
taatacgactcactatagggggccttcactgtgtctctaagcctgtccagaacagaggagactggacatgcttagagacaacctggcggcagcgcaaaagatg

SEQ ID NO: 98040 - DNA, 103 bp, Artificial Sequence
  Synthetic Polynucleotide
taatacgactcactatagggcccgagtcagggccttcactgtgtctctaaaacagaggagattagagatgcagtgaaggaacctggcggcagcgcaaaagatg

SEQ ID NO: 98041 - DNA, 103 bp, Artificial Sequence
  Synthetic Polynucleotide
taatacgactcactatagggttctcttgttcccgagtcagggccttcactaacagaggagaagtgaaatgcctgactcgaacctggcggcagcgcaaaagatg

SEQ ID NO: 98042 - DNA, 103 bp, Artificial Sequence
  Synthetic Polynucleotide
taatacgactcactatagggcccaaggagcttctcttgttcccgagtcagaacagaggagactgactatggaacaagagaacctggcggcagcgcaaaagatg

SEQ ID NO: 98043 - DNA, 103 bp, Artificial Sequence
  Synthetic Polynucleotide
taatacgactcactatagggagtgacattccaccttggtgttggggatgtaacagaggagaacatccatgacaccaaggaacctggcggcagcgcaaaagatg

SEQ ID NO: 98044 - DNA, 103 bp, Artificial Sequence
  Synthetic Polynucleotide
taatacgactcactatagggctttcagttgcccaaggagcttctcttgttaacagaggagaaacaagatgagctccttgaacctggcggcagcgcaaaagatg

SEQ ID NO: 98045 - DNA, 103 bp, Artificial Sequence
  Synthetic Polynucleotide
taatacgactcactataggggcttgtacttctttcagttgcccaaggagcaacagaggagagctcctatggcaactgaaaacctggcggcagcgcaaaagatg

SEQ ID NO: 98046 - DNA, 103 bp, Artificial Sequence
  Synthetic Polynucleotide
taatacgactcactatagggctccttgtctgcttgtacttctttcagttgaacagaggagacaactgatggaagtacaaaacctggcggcagcgcaaaagatg

SEQ ID NO: 98047 - DNA, 103 bp, Artificial Sequence
  Synthetic Polynucleotide
taatacgactcactatagggcctcactttgctccttgtctgcttgtacttaacagaggagaaagtacatgcagacaaggaacctggcggcagcgcaaaagatg

SEQ ID NO: 98048 - DNA, 103 bp, Artificial Sequence
  Synthetic Polynucleotide
taatacgactcactatagggtggagctcagcctcactttgctccttgtctaacagaggagaagacaaatggcaaagtgaaacctggcggcagcgcaaaagatg

SEQ ID NO: 98049 - DNA, 103 bp, Artificial Sequence
  Synthetic Polynucleotide
taatacgactcactatagggttgtgccacttggagctcagcctcactttgaacagaggagacaaagtatggctgagctcaacctggcggcagcgcaaaagatg

SEQ ID NO: 98050 - DNA, 103 bp, Artificial Sequence
  Synthetic Polynucleotide
taatacgactcactatagggggttctcctgttgtgccacttggagctcagaacagaggagactgagcatgaagtggcacaacctggcggcagcgcaaaagatg

SEQ ID NO: 98051 - DNA, 103 bp, Artificial Sequence
  Synthetic Polynucleotide
taatacgactcactatagggtttaagtgatggttctcctgttgtgccactaacagaggagaagtggcatgacaggagaaaacctggcggcagcgcaaaagatg

SEQ ID NO: 98052 - DNA, 103 bp, Artificial Sequence
  Synthetic Polynucleotide
taatacgactcactatagggcaggtccaaatttaagtgatggttctcctgaacagaggagacaggagatgcatcacttaaacctggcggcagcgcaaaagatg

SEQ ID NO: 98053 - DNA, 103 bp, Artificial Sequence
  Synthetic Polynucleotide
taatacgactcactatagggtcgcctccttcaggtccaaatttaagtgataacagaggagaatcactatgatttggaccaacctggcggcagcgcaaaagatg

SEQ ID NO: 98054 - DNA, 103 bp, Artificial Sequence
  Synthetic Polynucleotide
taatacgactcactatagggggaagggtgtagtgacattccaccttggtgaacagaggagacaccaaatgggaatgtcaaacctggcggcagcgcaaaagatg

SEQ ID NO: 98055 - DNA, 103 bp, Artificial Sequence
  Synthetic Polynucleotide
taatacgactcactatagggtgccagctcttcgcctccttcaggtccaaaaacagaggagatttggaatggaaggaggcaacctggcggcagcgcaaaagatg

SEQ ID NO: 98056 - DNA, 103 bp, Artificial Sequence
  Synthetic Polynucleotide
taatacgactcactatagggctgctcctcttgccagctcttcgcctccttaacagaggagaaaggagatgaagagctggaacctggcggcagcgcaaaagatg

SEQ ID NO: 98057 - DNA, 103 bp, Artificial Sequence
  Synthetic Polynucleotide
taatacgactcactatagggcctgagcactctgctcctcttgccagctctaacagaggagaagagctatgaagaggagcaacctggcggcagcgcaaaagatg

SEQ ID NO: 98058 - DNA, 103 bp, Artificial Sequence
  Synthetic Polynucleotide
taatacgactcactatagggagtcgctgagcctgagcactctgctcctctaacagaggagaagaggaatggagtgctcaaacctggcggcagcgcaaaagatg

SEQ ID NO: 98059 - DNA, 103 bp, Artificial Sequence
  Synthetic Polynucleotide
taatacgactcactatagggcttgtctttcagtcgctgagcctgagcactaacagaggagaagtgctatggctcagcgaaacctggcggcagcgcaaaagatg

SEQ ID NO: 98060 - DNA, 103 bp, Artificial Sequence
  Synthetic Polynucleotide
taatacgactcactatagggtctgggccaccttgtctttcagtcgctgagaacagaggagactcagcatgtgaaagacaaacctggcggcagcgcaaaagatg

SEQ ID NO: 98061 - DNA, 103 bp, Artificial Sequence
  Synthetic Polynucleotide
taatacgactcactataggggtgtccttcatctgggccaccttgtctttcaacagaggagagaaagaatgggtggcccaaacctggcggcagcgcaaaagatg

SEQ ID NO: 98062 - DNA, 103 bp, Artificial Sequence
  Synthetic Polynucleotide
taatacgactcactatagggctggcctagggtgtccttcatctgggccacaacagaggagagtggccatgatgaaggacaacctggcggcagcgcaaaagatg

SEQ ID NO: 98063 - DNA, 103 bp, Artificial Sequence
  Synthetic Polynucleotide
taatacgactcactataggggctgctgggcctggcctagggtgtccttcaaacagaggagatgaaggatgccctaggccaacctggcggcagcgcaaaagatg

SEQ ID NO: 98064 - DNA, 103 bp, Artificial Sequence
  Synthetic Polynucleotide
taatacgactcactatagggtcggccacccgctgctgggcctggcctaggaacagaggagacctaggatgggcccagcaaacctggcggcagcgcaaaagatg

SEQ ID NO: 98065 - DNA, 103 bp, Artificial Sequence
  Synthetic Polynucleotide
taatacgactcactataggggactcttaatgaatcattagattgttccataacagaggagaatggaaatgtctaatgataacctggcggcagcgcaaaagatg

SEQ ID NO: 98066 - DNA, 103 bp, Artificial Sequence
  Synthetic Polynucleotide
taatacgactcactatagggttgtccaaaggaagaatccctggagtccataacagaggagaatggacatgagggattctaacctggcggcagcgcaaaagatg

SEQ ID NO: 98067 - DNA, 103 bp, Artificial Sequence
  Synthetic Polynucleotide
taatacgactcactatagggcttgtcaattttggggtctgtaggaactctaacagaggagaagagttatgacagaccccaacctggcggcagcgcaaaagatg

SEQ ID NO: 98068 - DNA, 103 bp, Artificial Sequence
  Synthetic Polynucleotide
taatacgactcactatagggtgataattttcttgtcaattttggggtctgaacagaggagacagaccatgaaattgacaaacctggcggcagcgcaaaagatg

SEQ ID NO: 98069 - DNA, 103 bp, Artificial Sequence
  Synthetic Polynucleotide
taatacgactcactatagggtgctccattctgataattttcttgtcaattaacagaggagaaattgaatggaaaattataacctggcggcagcgcaaaagatg

SEQ ID NO: 98070 - DNA, 103 bp, Artificial Sequence
  Synthetic Polynucleotide
taatacgactcactatagggagctttctcctgctccattctgataattttaacagaggagaaaaattatgagaatggagaacctggcggcagcgcaaaagatg

SEQ ID NO: 98071 - DNA, 103 bp, Artificial Sequence
  Synthetic Polynucleotide
taatacgactcactataggggcatgttaaaagctttctcctgctccattcaacagaggagagaatggatgaggagaaagaacctggcggcagcgcaaaagatg

SEQ ID NO: 98072 - DNA, 103 bp, Artificial Sequence
  Synthetic Polynucleotide
taatacgactcactatagggttcttctttagcatgttaaaagctttctccaacagaggagaggagaaatgttttaacataacctggcggcagcgcaaaagatg

SEQ ID NO: 98073 - DNA, 103 bp, Artificial Sequence
  Synthetic Polynucleotide
taatacgactcactatagggatctaccaagttcttctttagcatgttaaaaacagaggagatttaacatgctaaagaagaacctggcggcagcgcaaaagatg

SEQ ID NO: 98074 - DNA, 103 bp, Artificial Sequence
  Synthetic Polynucleotide
taatacgactcactatagggcaccaccagcatctaccaagttcttctttaaacagaggagataaagaatgacttggtagaacctggcggcagcgcaaaagatg

SEQ ID NO: 98075 - DNA, 103 bp, Artificial Sequence
  Synthetic Polynucleotide
taatacgactcactatagggcacctaagaacaccaccagcatctaccaagaacagaggagacttggtatgtgctggtggaacctggcggcagcgcaaaagatg

SEQ ID NO: 98076 - DNA, 103 bp, Artificial Sequence
  Synthetic Polynucleotide
taatacgactcactatagggctgtacataccacctaagaacaccaccagcaacagaggagagctggtatggttcttaggaacctggcggcagcgcaaaagatg

SEQ ID NO: 98077 - DNA, 103 bp, Artificial Sequence
  Synthetic Polynucleotide
taatacgactcactataggggagaatcattttgtccaaaggaagaatcccaacagaggagagggattatgcctttggacaacctggcggcagcgcaaaagatg

SEQ ID NO: 98078 - DNA, 103 bp, Artificial Sequence
  Synthetic Polynucleotide
taatacgactcactataggggtgtaggtaactgtacataccacctaagaaaacagaggagattcttaatgggtatgtacaacctggcggcagcgcaaaagatg

SEQ ID NO: 98079 - DNA, 103 bp, Artificial Sequence
  Synthetic Polynucleotide
taatacgactcactatagggtgagcttgctgtgtaggtaactgtacatacaacagaggagagtatgtatggttacctacaacctggcggcagcgcaaaagatg

SEQ ID NO: 98080 - DNA, 103 bp, Artificial Sequence
  Synthetic Polynucleotide
taatacgactcactatagggatgatactgatgagcttgctgtgtaggtaaaacagaggagattacctatgcagcaagctaacctggcggcagcgcaaaagatg

SEQ ID NO: 98081 - DNA, 103 bp, Artificial Sequence
  Synthetic Polynucleotide
taatacgactcactatagggtctctaattcatgatactgatgagcttgctaacagaggagaagcaagatgatcagtatcaacctggcggcagcgcaaaagatg

SEQ ID NO: 98082 - DNA, 103 bp, Artificial Sequence
  Synthetic Polynucleotide
taatacgactcactatagggaggcagggagtctctaattcatgatactgaaacagaggagatcagtaatgtgaattagaaacctggcggcagcgcaaaagatg

SEQ ID NO: 98083 - DNA, 103 bp, Artificial Sequence
  Synthetic Polynucleotide
taatacgactcactatagggtgacaaagtgaggcagggagtctctaattcaacagaggagagaattaatgactccctgcaacctggcggcagcgcaaaagatg

SEQ ID NO: 98084 - DNA, 103 bp, Artificial Sequence
  Synthetic Polynucleotide
taatacgactcactatagggaaggagaaggtgacaaagtgaggcagggagaacagaggagactccctatgtcactttgtaacctggcggcagcgcaaaagatg

SEQ ID NO: 98085 - DNA, 103 bp, Artificial Sequence
  Synthetic Polynucleotide
taatacgactcactataggggacacaggaaaaggagaaggtgacaaagtgaacagaggagacactttatgaccttctccaacctggcggcagcgcaaaagatg

SEQ ID NO: 98086 - DNA, 103 bp, Artificial Sequence
  Synthetic Polynucleotide
taatacgactcactatagggttcaagagaagacacaggaaaaggagaaggaacagaggagaccttctatgtttcctgtgaacctggcggcagcgcaaaagatg

SEQ ID NO: 98087 - DNA, 103 bp, Artificial Sequence
  Synthetic Polynucleotide
taatacgactcactatagggtttcctcttcttcaagagaagacacaggaaaacagaggagattcctgatgcttctcttgaacctggcggcagcgcaaaagatg

SEQ ID NO: 98088 - DNA, 103 bp, Artificial Sequence
  Synthetic Polynucleotide
taatacgactcactatagggaaaactgtaggagaatcattttgtccaaagaacagaggagactttggatgaaatgattcaacctggcggcagcgcaaaagatg

SEQ ID NO: 98089 - DNA, 103 bp, Artificial Sequence
  Synthetic Polynucleotide
taatacgactcactatagggctaactgcagtttcctcttcttcaagagaaaacagaggagattctctatgagaagaggaaacctggcggcagcgcaaaagatg

SEQ ID NO: 98090 - DNA, 103 bp, Artificial Sequence
  Synthetic Polynucleotide
taatacgactcactatagggattctcatctctaactgcagtttcctcttcaacagaggagagaagagatgactgcagttaacctggcggcagcgcaaaagatg

SEQ ID NO: 98091 - DNA, 103 bp, Artificial Sequence
  Synthetic Polynucleotide
taatacgactcactataggggtaatgcacaattctcatctctaactgcagaacagaggagactgcagatggagatgagaaacctggcggcagcgcaaaagatg

SEQ ID NO: 98092 - DNA, 103 bp, Artificial Sequence
  Synthetic Polynucleotide
taatacgactcactatagggaaacgtgagggtaatgcacaattctcatctaacagaggagaagatgaatgttgtgcattaacctggcggcagcgcaaaagatg

SEQ ID NO: 98093 - DNA, 103 bp, Artificial Sequence
  Synthetic Polynucleotide
taatacgactcactatagggttgaggatgtaaacgtgagggtaatgcacaaacagaggagatgtgcaatgccctcacgtaacctggcggcagcgcaaaagatg

SEQ ID NO: 98094 - DNA, 103 bp, Artificial Sequence
  Synthetic Polynucleotide
taatacgactcactatagggtatgtgctacttgaggatgtaaacgtgaggaacagaggagacctcacatgtacatcctcaacctggcggcagcgcaaaagatg

SEQ ID NO: 98095 - DNA, 103 bp, Artificial Sequence
  Synthetic Polynucleotide
taatacgactcactatagggtcttgaatcttatgtgctacttgaggatgtaacagaggagaacatccatgagtagcacaaacctggcggcagcgcaaaagatg

SEQ ID NO: 98096 - DNA, 103 bp, Artificial Sequence
  Synthetic Polynucleotide
taatacgactcactatagggtgatactaattcttgaatcttatgtgctacaacagaggagagtagcaatgaagattcaaaacctggcggcagcgcaaaagatg

SEQ ID NO: 98097 - DNA, 103 bp, Artificial Sequence
  Synthetic Polynucleotide
taatacgactcactatagggctattccctgtgatactaattcttgaatctaacagaggagaagattcatgaattagtataacctggcggcagcgcaaaagatg

SEQ ID NO: 98098 - DNA, 103 bp, Artificial Sequence
  Synthetic Polynucleotide
taatacgactcactatagggtacacttgttctattccctgtgatactaataacagaggagaattagtatgacagggaataacctggcggcagcgcaaaagatg

SEQ ID NO: 98099 - DNA, 103 bp, Artificial Sequence
  Synthetic Polynucleotide
taatacgactcactatagggagtgatgggcaaaactgtaggagaatcattaacagaggagaaatgatatgcctacagttaacctggcggcagcgcaaaagatg

SEQ ID NO: 98100 - DNA, 103 bp, Artificial Sequence
  Synthetic Polynucleotide
taatacgactcactatagggccttactgcatacacttgttctattccctgaacagaggagacagggaatggaacaagtgaacctggcggcagcgcaaaagatg

SEQ ID NO: 98101 - DNA, 103 bp, Artificial Sequence
  Synthetic Polynucleotide
taatacgactcactatagggttagctgtttccttactgcatacacttgttaacagaggagaaacaagatgatgcagtaaaacctggcggcagcgcaaaagatg

SEQ ID NO: 98102 - DNA, 103 bp, Artificial Sequence
  Synthetic Polynucleotide
taatacgactcactatagggacaaattttcttagctgtttccttactgcaaacagaggagatgcagtatggaaacagctaacctggcggcagcgcaaaagatg

SEQ ID NO: 98103 - DNA, 103 bp, Artificial Sequence
  Synthetic Polynucleotide
taatacgactcactatagggttccctttccacaaattttcttagctgtttaacagaggagaaaacagatgagaaaatttaacctggcggcagcgcaaaagatg

SEQ ID NO: 98104 - DNA, 103 bp, Artificial Sequence
  Synthetic Polynucleotide
taatacgactcactataggggtttgaacagttccctttccacaaattttcaacagaggagagaaaatatgtggaaagggaacctggcggcagcgcaaaagatg

SEQ ID NO: 98105 - DNA, 103 bp, Artificial Sequence
  Synthetic Polynucleotide
taatacgactcactatagggacctcatcgggtttgaacagttccctttccaacagaggagaggaaagatgactgttcaaaacctggcggcagcgcaaaagatg

SEQ ID NO: 98106 - DNA, 103 bp, Artificial Sequence
  Synthetic Polynucleotide
taatacgactcactatagggtctttcaggtacctcatcgggtttgaacagaacagaggagactgttcatgcccgatgagaacctggcggcagcgcaaaagatg

SEQ ID NO: 98107 - DNA, 103 bp, Artificial Sequence
  Synthetic Polynucleotide
taatacgactcactatagggataaattatgtctttcaggtacctcatcggaacagaggagaccgatgatgtacctgaaaaacctggcggcagcgcaaaagatg

SEQ ID NO: 98108 - DNA, 103 bp, Artificial Sequence
  Synthetic Polynucleotide
taatacgactcactatagggggaaaaaaagataaattatgtctttcaggtaacagaggagaacctgaatgacataatttaacctggcggcagcgcaaaagatg

SEQ ID NO: 98109 - DNA, 103 bp, Artificial Sequence
  Synthetic Polynucleotide
taatacgactcactatagggatttacagttggaaaaaaagataaattatgaacagaggagacataatatgtctttttttaacctggcggcagcgcaaaagatg

SEQ ID NO: 98110 - DNA, 103 bp, Artificial Sequence
  Synthetic Polynucleotide
taatacgactcactatagggcttcacgagtagtgatgggcaaaactgtagaacagaggagactacagatgtgcccatcaaacctggcggcagcgcaaaagatg

SEQ ID NO: 98111 - DNA, 103 bp, Artificial Sequence
  Synthetic Polynucleotide
taatacgactcactatagggtttttatatcatttacagttggaaaaaaagaacagaggagactttttatgcaactgtaaaacctggcggcagcgcaaaagatg

SEQ ID NO: 98112 - DNA, 103 bp, Artificial Sequence
  Synthetic Polynucleotide
taatacgactcactatagggtggatgtgattttttatatcatttacagttaacagaggagaaactgtatgtgatataaaaacctggcggcagcgcaaaagatg

SEQ ID NO: 98113 - DNA, 103 bp, Artificial Sequence
  Synthetic Polynucleotide
taatacgactcactatagggctgtacctcatggatgtgattttttatatcaacagaggagagatataatgaatcacatcaacctggcggcagcgcaaaagatg

SEQ ID NO: 98114 - DNA, 103 bp, Artificial Sequence
  Synthetic Polynucleotide
taatacgactcactatagggtcaaggatttctgtacctcatggatgtgataacagaggagaatcacaatgatgaggtacaacctggcggcagcgcaaaagatg

SEQ ID NO: 98115 - DNA, 103 bp, Artificial Sequence
  Synthetic Polynucleotide
taatacgactcactatagggtctccatttctcaaggatttctgtacctcaaacagaggagatgaggtatggaaatccttaacctggcggcagcgcaaaagatg

SEQ ID NO: 98116 - DNA, 103 bp, Artificial Sequence
  Synthetic Polynucleotide
taatacgactcactatagggatataccgtatctccatttctcaaggatttaacagaggagaaaatccatgagaaatggaaacctggcggcagcgcaaaagatg

SEQ ID NO: 98117 - DNA, 103 bp, Artificial Sequence
  Synthetic Polynucleotide
taatacgactcactatagggtctctgagttatataccgtatctccatttcaacagaggagagaaatgatgatacggtataacctggcggcagcgcaaaagatg

SEQ ID NO: 98118 - DNA, 103 bp, Artificial Sequence
  Synthetic Polynucleotide
taatacgactcactataggggctggaataatctctgagttatataccgtaaacagaggagatacggtatgtaactcagaaacctggcggcagcgcaaaagatg

SEQ ID NO: 98119 - DNA, 103 bp, Artificial Sequence
  Synthetic Polynucleotide
taatacgactcactatagggttgaagcgttgctggaataatctctgagttaacagaggagaaactcaatgattattccaaacctggcggcagcgcaaaagatg

SEQ ID NO: 98120 - DNA, 103 bp, Artificial Sequence
  Synthetic Polynucleotide
taatacgactcactatagggctgtagtccattgaagcgttgctggaataaaacagaggagattattcatgcaacgcttcaacctggcggcagcgcaaaagatg

SEQ ID NO: 98121 - DNA, 103 bp, Artificial Sequence
  Synthetic Polynucleotide
taatacgactcactataggggaattatttgcttcacgagtagtgatgggcaacagaggagagcccatatgtactcgtgaaacctggcggcagcgcaaaagatg

SEQ ID NO: 98122 - DNA, 103 bp, Artificial Sequence
  Synthetic Polynucleotide
taatacgactcactatagggttcccactgtctgtagtccattgaagcgttaacagaggagaaacgctatgatggactacaacctggcggcagcgcaaaagatg

SEQ ID NO: 98123 - DNA, 103 bp, Artificial Sequence
  Synthetic Polynucleotide
taatacgactcactatagggtttgagaatattcccactgtctgtagtccaaacagaggagatggactatggacagtgggaacctggcggcagcgcaaaagatg

SEQ ID NO: 98124 - DNA, 103 bp, Artificial Sequence
  Synthetic Polynucleotide
taatacgactcactatagggtcatggtctctttgagaatattcccactgtaacagaggagaacagtgatgatattctcaaacctggcggcagcgcaaaagatg

SEQ ID NO: 98125 - DNA, 103 bp, Artificial Sequence
  Synthetic Polynucleotide
taatacgactcactatagggaatgtaactgtcatggtctctttgagaataaacagaggagatattctatgagagaccataacctggcggcagcgcaaaagatg

SEQ ID NO: 98126 - DNA, 103 bp, Artificial Sequence
  Synthetic Polynucleotide
taatacgactcactatagggtccttctgcaaatgtaactgtcatggtctcaacagaggagagagaccatgacagttacaaacctggcggcagcgcaaaagatg

SEQ ID NO: 98127 - DNA, 103 bp, Artificial Sequence
  Synthetic Polynucleotide
taatacgactcactatagggctggtgaatttccttctgcaaatgtaactgaacagaggagacagttaatgttgcagaagaacctggcggcagcgcaaaagatg

SEQ ID NO: 98128 - DNA, 103 bp, Artificial Sequence
  Synthetic Polynucleotide
taatacgactcactatagggattgattctcctggtgaatttccttctgcaaacagaggagatgcagaatgaaattcaccaacctggcggcagcgcaaaagatg

SEQ ID NO: 98129 - DNA, 103 bp, Artificial Sequence
  Synthetic Polynucleotide
taatacgactcactatagggtttggtggtaattgattctcctggtgaattaacagaggagaaattcaatgggagaatcaaacctggcggcagcgcaaaagatg

SEQ ID NO: 98130 - DNA, 103 bp, Artificial Sequence
  Synthetic Polynucleotide
taatacgactcactatagggttgtttccactttggtggtaattgattctcaacagaggagagagaatatgttaccaccaaacctggcggcagcgcaaaagatg

SEQ ID NO: 98131 - DNA, 103 bp, Artificial Sequence
  Synthetic Polynucleotide
taatacgactcactatagggctggtctgatttgtttccactttggtggtaaacagaggagataccacatgagtggaaacaacctggcggcagcgcaaaagatg

SEQ ID NO: 98132 - DNA, 103 bp, Artificial Sequence
  Synthetic Polynucleotide
taatacgactcactatagggtgatatgagtgaattatttgcttcacgagtaacagaggagaactcgtatggcaaataataacctggcggcagcgcaaaagatg

SEQ ID NO: 98133 - DNA, 103 bp, Artificial Sequence
  Synthetic Polynucleotide
taatacgactcactatagggcaaagaacccctggtctgatttgtttccacaacagaggagagtggaaatgaatcagaccaacctggcggcagcgcaaaagatg

SEQ ID NO: 98134 - DNA, 103 bp, Artificial Sequence
  Synthetic Polynucleotide
taatacgactcactataggggctcaggagacaaagaacccctggtctgataacagaggagaatcagaatgggggttcttaacctggcggcagcgcaaaagatg

SEQ ID NO: 98135 - DNA, 103 bp, Artificial Sequence
  Synthetic Polynucleotide
taatacgactcactatagggaagtgggttggctcaggagacaaagaacccaacagaggagagggttcatggtctcctgaaacctggcggcagcgcaaaagatg

SEQ ID NO: 98136 - DNA, 103 bp, Artificial Sequence
  Synthetic Polynucleotide
taatacgactcactatagggtgaggagagcaagtgggttggctcaggagaaacagaggagatctcctatgccaacccacaacctggcggcagcgcaaaagatg

SEQ ID NO: 98137 - DNA, 103 bp, Artificial Sequence
  Synthetic Polynucleotide
taatacgactcactatagggatgaggagagtgaggagagcaagtgggttgaacagaggagacaacccatgtgctctcctaacctggcggcagcgcaaaagatg

SEQ ID NO: 98138 - DNA, 103 bp, Artificial Sequence
  Synthetic Polynucleotide
taatacgactcactatagggttgggctgaaatgaggagagtgaggagagcaacagaggagagctctcatgactctcctcaacctggcggcagcgcaaaagatg

SEQ ID NO: 98139 - DNA, 103 bp, Artificial Sequence
  Synthetic Polynucleotide
taatacgactcactatagggtgtaaatattttgggctgaaatgaggagagaacagaggagactctccatgtttcagcccaacctggcggcagcgcaaaagatg

SEQ ID NO: 98140 - DNA, 103 bp, Artificial Sequence
  Synthetic Polynucleotide
taatacgactcactatagggcctgtagttgtgtaaatattttgggctgaaaacagaggagattcagcatgaaatatttaaacctggcggcagcgcaaaagatg

SEQ ID NO: 98141 - DNA, 103 bp, Artificial Sequence
  Synthetic Polynucleotide
taatacgactcactatagggaactgcaaaccctgtagttgtgtaaatattaacagaggagaaatattatgacaactacaaacctggcggcagcgcaaaagatg

SEQ ID NO: 98142 - DNA, 103 bp, Artificial Sequence
  Synthetic Polynucleotide
taatacgactcactatagggccttggttgtaactgcaaaccctgtagttgaacagaggagacaactaatgggtttgcagaacctggcggcagcgcaaaagatg

SEQ ID NO: 98143 - DNA, 103 bp, Artificial Sequence
  Synthetic Polynucleotide
taatacgactcactataggggtatattctgtgatatgagtgaattatttgaacagaggagacaaataatgcactcatataacctggcggcagcgcaaaagatg

SEQ ID NO: 98144 - DNA, 103 bp, Artificial Sequence
  Synthetic Polynucleotide
taatacgactcactataggggagaggtgtaccttggttgtaactgcaaacaacagaggagagtttgcatgtacaaccaaaacctggcggcagcgcaaaagatg

SEQ ID NO: 98145 - DNA, 103 bp, Artificial Sequence
  Synthetic Polynucleotide
taatacgactcactataggggattcatcaggagaggtgtaccttggttgtaacagaggagaacaaccatggtacacctcaacctggcggcagcgcaaaagatg

SEQ ID NO: 98146 - DNA, 103 bp, Artificial Sequence
  Synthetic Polynucleotide
taatacgactcactatagggcacagctggtgattcatcaggagaggtgtaaacagaggagatacaccatgcctgatgaaaacctggcggcagcgcaaaagatg

SEQ ID NO: 98147 - DNA, 103 bp, Artificial Sequence
  Synthetic Polynucleotide
taatacgactcactatagggttactgataccacagctggtgattcatcagaacagaggagactgatgatgcaccagctgaacctggcggcagcgcaaaagatg

SEQ ID NO: 98148 - DNA, 103 bp, Artificial Sequence
  Synthetic Polynucleotide
taatacgactcactatagggggctggttatttactgataccacagctggtaacagaggagaaccagcatgggtatcagtaacctggcggcagcgcaaaagatg

SEQ ID NO: 98149 - DNA, 103 bp, Artificial Sequence
  Synthetic Polynucleotide
taatacgactcactatagggactagaggacggctggttatttactgatacaacagaggagagtatcaatgaataaccagaacctggcggcagcgcaaaagatg

SEQ ID NO: 98150 - DNA, 103 bp, Artificial Sequence
  Synthetic Polynucleotide
taatacgactcactataggggtcctgaaggactagaggacggctggttataacagaggagaataaccatgcgtcctctaaacctggcggcagcgcaaaagatg

SEQ ID NO: 98151 - DNA, 103 bp, Artificial Sequence
  Synthetic Polynucleotide
taatacgactcactataggggtatccagaagtcctgaaggactagaggacaacagaggagagtcctcatgtccttcaggaacctggcggcagcgcaaaagatg

SEQ ID NO: 98152 - DNA, 103 bp, Artificial Sequence
  Synthetic Polynucleotide
taatacgactcactatagggacttcctattgtatccagaagtcctgaaggaacagaggagaccttcaatgcttctggataacctggcggcagcgcaaaagatg

SEQ ID NO: 98153 - DNA, 103 bp, Artificial Sequence
  Synthetic Polynucleotide
taatacgactcactatagggtcattacagcacttcctattgtatccagaaaacagaggagattctggatgcaataggaaaacctggcggcagcgcaaaagatg

SEQ ID NO: 98154 - DNA, 103 bp, Artificial Sequence
  Synthetic Polynucleotide
taatacgactcactatagggaggggccctggtatattctgtgatatgagtaacagaggagaactcatatgacagaatataacctggcggcagcgcaaaagatg

SEQ ID NO: 98155 - DNA, 103 bp, Artificial Sequence
  Synthetic Polynucleotide
taatacgactcactataggggaattattattcattacagcacttcctattaacagaggagaaataggatgtgctgtaataacctggcggcagcgcaaaagatg

SEQ ID NO: 98156 - DNA, 103 bp, Artificial Sequence
  Synthetic Polynucleotide
taatacgactcactatagggaagcagtagagaattattattcattacagcaacagaggagagctgtaatgaataataataacctggcggcagcgcaaaagatg

SEQ ID NO: 98157 - DNA, 103 bp, Artificial Sequence
  Synthetic Polynucleotide
taatacgactcactataggggactttgaccaagcagtagagaattattataacagaggagaataataatgctctactgcaacctggcggcagcgcaaaagatg

SEQ ID NO: 98158 - DNA, 103 bp, Artificial Sequence
  Synthetic Polynucleotide
taatacgactcactatagggtgaaggctatgactttgaccaagcagtagaaacagaggagatctactatgtggtcaaagaacctggcggcagcgcaaaagatg

SEQ ID NO: 98159 - DNA, 103 bp, Artificial Sequence
  Synthetic Polynucleotide
taatacgactcactatagggtgtatctctttgaaggctatgactttgaccaacagaggagaggtcaaatgcatagccttaacctggcggcagcgcaaaagatg

SEQ ID NO: 98160 - DNA, 103 bp, Artificial Sequence
  Synthetic Polynucleotide
taatacgactcactataggggggttaagcatgtatctctttgaaggctataacagaggagaatagccatgaaagagataaacctggcggcagcgcaaaagatg

SEQ ID NO: 98161 - DNA, 103 bp, Artificial Sequence
  Synthetic Polynucleotide
taatacgactcactatagggctattgttttgggttaagcatgtatctcttaacagaggagaaagagaatgatgcttaacaacctggcggcagcgcaaaagatg

SEQ ID NO: 98162 - DNA, 103 bp, Artificial Sequence
  Synthetic Polynucleotide
taatacgactcactatagggggaggcagtactattgttttgggttaagcaaacagaggagatgcttaatgcaaaacaataacctggcggcagcgcaaaagatg

SEQ ID NO: 98163 - DNA, 103 bp, Artificial Sequence
  Synthetic Polynucleotide
taatacgactcactatagggtacccatggtggaggcagtactattgttttaacagaggagaaaaacaatggtactgcctaacctggcggcagcgcaaaagatg

SEQ ID NO: 98164 - DNA, 103 bp, Artificial Sequence
  Synthetic Polynucleotide
taatacgactcactatagggtctggaaggttacccatggtggaggcagtaaacagaggagatactgcatgcaccatgggaacctggcggcagcgcaaaagatg

SEQ ID NO: 98165 - DNA, 103 bp, Artificial Sequence
  Synthetic Polynucleotide
taatacgactcactatagggtgtctgagtcaggggccctggtatattctgaacagaggagacagaatatgccagggcccaacctggcggcagcgcaaaagatg

SEQ ID NO: 98166 - DNA, 103 bp, Artificial Sequence
  Synthetic Polynucleotide
taatacgactcactatagggttgatctggttctggaaggttacccatggtaacagaggagaaccatgatgaaccttccaaacctggcggcagcgcaaaagatg

SEQ ID NO: 98167 - DNA, 103 bp, Artificial Sequence
  Synthetic Polynucleotide
taatacgactcactatagggcaactagattttgatctggttctggaaggtaacagaggagaaccttcatgaaccagatcaacctggcggcagcgcaaaagatg

SEQ ID NO: 98168 - DNA, 103 bp, Artificial Sequence
  Synthetic Polynucleotide
taatacgactcactatagggtcgtccattgcaactagattttgatctggtaacagaggagaaccagaatgaaatctagtaacctggcggcagcgcaaaagatg

SEQ ID NO: 98169 - DNA, 103 bp, Artificial Sequence
  Synthetic Polynucleotide
taatacgactcactatagggttctaccagctcgtccattgcaactagattaacagaggagaaatctaatggcaatggacaacctggcggcagcgcaaaagatg

SEQ ID NO: 98170 - DNA, 103 bp, Artificial Sequence
  Synthetic Polynucleotide
taatacgactcactatagggcatctccaacttctaccagctcgtccattgaacagaggagacaatggatgagctggtagaacctggcggcagcgcaaaagatg

SEQ ID NO: 98171 - DNA, 103 bp, Artificial Sequence
  Synthetic Polynucleotide
taatacgactcactataggggtatcctcaacatctccaacttctaccagcaacagaggagagctggtatgagttggagaaacctggcggcagcgcaaaagatg

SEQ ID NO: 98172 - DNA, 103 bp, Artificial Sequence
  Synthetic Polynucleotide
taatacgactcactatagggcagattccctgtatcctcaacatctccaacaacagaggagagttggaatggttgaggataacctggcggcagcgcaaaagatg

SEQ ID NO: 98173 - DNA, 103 bp, Artificial Sequence
  Synthetic Polynucleotide
taatacgactcactatagggcagttccttccagattccctgtatcctcaaaacagaggagattgaggatgcagggaatcaacctggcggcagcgcaaaagatg

SEQ ID NO: 98174 - DNA, 103 bp, Artificial Sequence
  Synthetic Polynucleotide
taatacgactcactatagggatccgatgaacagttccttccagattccctaacagaggagaagggaaatgggaaggaacaacctggcggcagcgcaaaagatg

SEQ ID NO: 98175 - DNA, 103 bp, Artificial Sequence
  Synthetic Polynucleotide
taatacgactcactatagggtcccaacagaatccgatgaacagttccttcaacagaggagagaaggaatggttcatcggaacctggcggcagcgcaaaagatg

SEQ ID NO: 98176 - DNA, 103 bp, Artificial Sequence
  Synthetic Polynucleotide
taatacgactcactatagggcattatggttgactcttaatgaatcattagaacagaggagactaatgatgcattaagagaacctggcggcagcgcaaaagatg

SEQ ID NO: 98177 - DNA, 103 bp, Artificial Sequence
  Synthetic Polynucleotide
taatacgactcactatagggaaagagtctgtgtctgagtcaggggccctgaacagaggagacagggcatgtgactcagaaacctggcggcagcgcaaaagatg

SEQ ID NO: 98178 - DNA, 103 bp, Artificial Sequence
  Synthetic Polynucleotide
taatacgactcactatagggtctgcacatctcccaacagaatccgatgaaaacagaggagattcatcatgttctgttggaacctggcggcagcgcaaaagatg

SEQ ID NO: 98179 - DNA, 103 bp, Artificial Sequence
  Synthetic Polynucleotide
taatacgactcactatagggattggaatagtctgcacatctcccaacagaaacagaggagatctgttatgagatgtgcaaacctggcggcagcgcaaaagatg

SEQ ID NO: 98180 - DNA, 103 bp, Artificial Sequence
  Synthetic Polynucleotide
taatacgactcactatagggtataatctgtattggaatagtctgcacatcaacagaggagagatgtgatgactattccaaacctggcggcagcgcaaaagatg

SEQ ID NO: 98181 - DNA, 103 bp, Artificial Sequence
  Synthetic Polynucleotide
taatacgactcactatagggagtggttgtctataatctgtattggaatagaacagaggagactattcatgtacagattaaacctggcggcagcgcaaaagatg

SEQ ID NO: 98182 - DNA, 103 bp, Artificial Sequence
  Synthetic Polynucleotide
taatacgactcactatagggataagagctgagtggttgtctataatctgtaacagaggagaacagatatgagacaaccaaacctggcggcagcgcaaaagatg

SEQ ID NO: 98183 - DNA, 103 bp, Artificial Sequence
  Synthetic Polynucleotide
taatacgactcactatagggattttcttcaataagagctgagtggttgtcaacagaggagagacaacatgtcagctcttaacctggcggcagcgcaaaagatg

SEQ ID NO: 98184 - DNA, 103 bp, Artificial Sequence
  Synthetic Polynucleotide
taatacgactcactatagggtactttctggattttcttcaataagagctgaacagaggagacagctcatgttgaagaaaaacctggcggcagcgcaaaagatg

SEQ ID NO: 98185 - DNA, 103 bp, Artificial Sequence
  Synthetic Polynucleotide
taatacgactcactatagggacagaaatggtactttctggattttcttcaaacagaggagatgaagaatgtccagaaagaacctggcggcagcgcaaaagatg

SEQ ID NO: 98186 - DNA, 103 bp, Artificial Sequence
  Synthetic Polynucleotide
taatacgactcactatagggaacttggctcacagaaatggtactttctggaacagaggagaccagaaatgaccatttctaacctggcggcagcgcaaaagatg

SEQ ID NO: 98187 - DNA, 103 bp, Artificial Sequence
  Synthetic Polynucleotide
taatacgactcactataggggttcttgtttaacttggctcacagaaatggaacagaggagaccatttatgtgagccaagaacctggcggcagcgcaaaagatg

SEQ ID NO: 98188 - DNA, 103 bp, Artificial Sequence
  Synthetic Polynucleotide
taatacgactcactatagggtgctctgcagaaagagtctgtgtctgagtcaacagaggagagactcaatgacagactctaacctggcggcagcgcaaaagatg

SEQ ID NO: 98189 - DNA, 103 bp, Artificial Sequence
  Synthetic Polynucleotide
taatacgactcactatagggggttctttgggttcttgtttaacttggctcaacagaggagagagccaatgtaaacaagaaacctggcggcagcgcaaaagatg

SEQ ID NO: 98190 - DNA, 103 bp, Artificial Sequence
  Synthetic Polynucleotide
taatacgactcactatagggagacaatgctggttctttgggttcttgtttaacagaggagaaaacaaatgcccaaagaaaacctggcggcagcgcaaaagatg

SEQ ID NO: 98191 - DNA, 103 bp, Artificial Sequence
  Synthetic Polynucleotide
taatacgactcactatagggttgcttccatagacaatgctggttctttggaacagaggagaccaaagatgcagcattgtaacctggcggcagcgcaaaagatg

SEQ ID NO: 98192 - DNA, 103 bp, Artificial Sequence
  Synthetic Polynucleotide
taatacgactcactatagggacagttttttttgcttccatagacaatgctaacagaggagaagcattatgtatggaagcaacctggcggcagcgcaaaagatg

SEQ ID NO: 98193 - DNA, 103 bp, Artificial Sequence
  Synthetic Polynucleotide
taatacgactcactatagggcttatagtccacagttttttttgcttccataacagaggagaatggaaatgaaaaaaactaacctggcggcagcgcaaaagatg

SEQ ID NO: 98194 - DNA, 103 bp, Artificial Sequence
  Synthetic Polynucleotide
taatacgactcactatagggcagataatttcttatagtccacagttttttaacagaggagaaaaaaaatgtggactataaacctggcggcagcgcaaaagatg

SEQ ID NO: 98195 - DNA, 103 bp, Artificial Sequence
  Synthetic Polynucleotide
taatacgactcactatagggtagatggaattgctctgcagaaagagtctgaacagaggagacagactatgtctgcagagaacctggcggcagcgcaaaagatg

SEQ ID NO: 98196 - DNA, 103 bp, Artificial Sequence
  Synthetic Polynucleotide
taatacgactcactatagggtttggtccactagatggaattgctctgcagaacagaggagactgcagatgaattccatcaacctggcggcagcgcaaaagatg

SEQ ID NO: 98197 - DNA, 103 bp, Artificial Sequence
  Synthetic Polynucleotide
taatacgactcactataggggcctgcccattttggtccactagatggaataacagaggagaattccaatgagtggaccaaacctggcggcagcgcaaaagatg

SEQ ID NO: 98198 - DNA, 103 bp, Artificial Sequence
  Synthetic Polynucleotide
taatacgactcactatagggatattgaatagcctgcccattttggtccacaacagaggagagtggacatgaatgggcagaacctggcggcagcgcaaaagatg

SEQ ID NO: 98199 - DNA, 103 bp, Artificial Sequence
  Synthetic Polynucleotide
taatacgactcactatagggactgaagttcatattgaatagcctgcccataacagaggagaatgggcatgctattcaataacctggcggcagcgcaaaagatg

SEQ ID NO: 98200 - DNA, 103 bp, Artificial Sequence
  Synthetic Polynucleotide
taatacgactcactatagggtcccccaatgactgaagttcatattgaataaacagaggagatattcaatgtgaacttcaaacctggcggcagcgcaaaagatg

SEQ ID NO: 98201 - DNA, 103 bp, Artificial Sequence
  Synthetic Polynucleotide
taatacgactcactatagggtgcattggattcccccaatgactgaagttcaacagaggagagaacttatgtcattggggaacctggcggcagcgcaaaagatg

SEQ ID NO: 98202 - DNA, 103 bp, Artificial Sequence
  Synthetic Polynucleotide
taatacgactcactatagggtcatcatttgtgcattggattcccccaatgaacagaggagacattggatgaatccaatgaacctggcggcagcgcaaaagatg

SEQ ID NO: 98203 - DNA, 103 bp, Artificial Sequence
  Synthetic Polynucleotide
taatacgactcactatagggtcttcaccgtcattatggttgactcttaataacagaggagaattaagatgcaaccataaaacctggcggcagcgcaaaagatg

SEQ ID NO: 98204 - DNA, 103 bp, Artificial Sequence
  Synthetic Polynucleotide
taatacgactcactatagggctggcaacgatcatcatttgtgcattggataacagaggagaatccaaatgacaaatgataacctggcggcagcgcaaaagatg

SEQ ID NO: 98205 - DNA, 103 bp, Artificial Sequence
  Synthetic Polynucleotide
taatacgactcactatagggttctgttgggctggcaacgatcatcatttgaacagaggagacaaatgatgatcgttgccaacctggcggcagcgcaaaagatg

SEQ ID NO: 98206 - DNA, 103 bp, Artificial Sequence
  Synthetic Polynucleotide
taatacgactcactatagggcctgtccattttctgttgggctggcaacgaaacagaggagatcgttgatggcccaacagaacctggcggcagcgcaaaagatg

SEQ ID NO: 98207 - DNA, 103 bp, Artificial Sequence
  Synthetic Polynucleotide
taatacgactcactatagggacacgaagtacctgtccattttctgttgggaacagaggagacccaacatgaaatggacaaacctggcggcagcgcaaaagatg

SEQ ID NO: 98208 - DNA, 103 bp, Artificial Sequence
  Synthetic Polynucleotide
taatacgactcactatagggaggtggaattacacgaagtacctgtccattaacagaggagaaatggaatggtacttcgtaacctggcggcagcgcaaaagatg

SEQ ID NO: 98209 - DNA, 103 bp, Artificial Sequence
  Synthetic Polynucleotide
taatacgactcactatagggctgtctgggtaggtggaattacacgaagtaaacagaggagatacttcatgtaattccacaacctggcggcagcgcaaaagatg

SEQ ID NO: 98210 - DNA, 103 bp, Artificial Sequence
  Synthetic Polynucleotide
taatacgactcactatagggtgtgccattcctgtctgggtaggtggaattaacagaggagaaattccatgtacccagacaacctggcggcagcgcaaaagatg

SEQ ID NO: 98211 - DNA, 103 bp, Artificial Sequence
  Synthetic Polynucleotide
taatacgactcactatagggtataatcacttgtgccattcctgtctgggtaacagaggagaacccagatgggaatggcaaacctggcggcagcgcaaaagatg

SEQ ID NO: 98212 - DNA, 103 bp, Artificial Sequence
  Synthetic Polynucleotide
taatacgactcactataggggcccctgaggtataatcacttgtgccattcaacagaggagagaatggatgaagtgattaaacctggcggcagcgcaaaagatg

SEQ ID NO: 98213 - DNA, 103 bp, Artificial Sequence
  Synthetic Polynucleotide
taatacgactcactatagggtccacaagttgcccctgaggtataatcactaacagaggagaagtgatatgacctcagggaacctggcggcagcgcaaaagatg

SEQ ID NO: 98214 - DNA, 103 bp, Artificial Sequence
  Synthetic Polynucleotide
taatacgactcactatagggggtttttgactcttcaccgtcattatggttaacagaggagaaaccatatggacggtgaaaacctggcggcagcgcaaaagatg

SEQ ID NO: 98215 - DNA, 103 bp, Artificial Sequence
  Synthetic Polynucleotide
taatacgactcactatagggactattcacatccacaagttgcccctgaggaacagaggagacctcagatgcaacttgtgaacctggcggcagcgcaaaagatg

SEQ ID NO: 98216 - DNA, 103 bp, Artificial Sequence
  Synthetic Polynucleotide
taatacgactcactatagggcatcccgaggactattcacatccacaagttaacagaggagaaacttgatgatgtgaataaacctggcggcagcgcaaaagatg

SEQ ID NO: 98217 - DNA, 103 bp, Artificial Sequence
  Synthetic Polynucleotide
taatacgactcactatagggtcttcagggacatcccgaggactattcacaaacagaggagatgtgaaatgtcctcgggaaacctggcggcagcgcaaaagatg

SEQ ID NO: 98218 - DNA, 103 bp, Artificial Sequence
  Synthetic Polynucleotide
taatacgactcactatagggactgggtttctcttcagggacatcccgaggaacagaggagacctcggatggtccctgaaaacctggcggcagcgcaaaagatg

SEQ ID NO: 98219 - DNA, 103 bp, Artificial Sequence
  Synthetic Polynucleotide
taatacgactcactatagggagtttctgttactgggtttctcttcagggaaacagaggagatccctgatgagaaacccaaacctggcggcagcgcaaaagatg

SEQ ID NO: 98220 - DNA, 103 bp, Artificial Sequence
  Synthetic Polynucleotide
taatacgactcactatagggacagttggtaagtttctgttactgggtttcaacagaggagagaaaccatgtaacagaaaaacctggcggcagcgcaaaagatg

SEQ ID NO: 98221 - DNA, 103 bp, Artificial Sequence
  Synthetic Polynucleotide
taatacgactcactatagggatccactcttacagttggtaagtttctgttaacagaggagaaacagaatgttaccaactaacctggcggcagcgcaaaagatg

SEQ ID NO: 98222 - DNA, 103 bp, Artificial Sequence
  Synthetic Polynucleotide
taatacgactcactatagggctgctagagtatccactcttacagttggtaaacagaggagataccaaatgtaagagtggaacctggcggcagcgcaaaagatg

SEQ ID NO: 98223 - DNA, 103 bp, Artificial Sequence
  Synthetic Polynucleotide
taatacgactcactatagggctggtattgtctgctagagtatccactcttaacagaggagaaagagtatgtactctagcaacctggcggcagcgcaaaagatg

SEQ ID NO: 98224 - DNA, 103 bp, Artificial Sequence
  Synthetic Polynucleotide
taatacgactcactatagggaatgtaattgctggtattgtctgctagagtaacagaggagaactctaatggacaataccaacctggcggcagcgcaaaagatg

SEQ ID NO: 98225 - DNA, 103 bp, Artificial Sequence
  Synthetic Polynucleotide
taatacgactcactatagggcttgagcactggtttttgactcttcaccgtaacagaggagaacggtgatgagtcaaaaaaacctggcggcagcgcaaaagatg

SEQ ID NO: 98226 - DNA, 103 bp, Artificial Sequence
  Synthetic Polynucleotide
taatacgactcactataggggaggatgaagaatgtaattgctggtattgtaacagaggagaacaataatggcaattacaaacctggcggcagcgcaaaagatg

SEQ ID NO: 98227 - DNA, 103 bp, Artificial Sequence
  Synthetic Polynucleotide
taatacgactcactatagggaaggatgtttgaggatgaagaatgtaattgaacagaggagacaattaatgtcttcatccaacctggcggcagcgcaaaagatg

SEQ ID NO: 98228 - DNA, 103 bp, Artificial Sequence
  Synthetic Polynucleotide
taatacgactcactataggggggcaatgggaaggatgtttgaggatgaagaacagaggagacttcatatgcaaacatccaacctggcggcagcgcaaaagatg

SEQ ID NO: 98229 - DNA, 103 bp, Artificial Sequence
  Synthetic Polynucleotide
taatacgactcactatagggctgactttttgggcaatgggaaggatgtttaacagaggagaaaacatatgtcccattgcaacctggcggcagcgcaaaagatg

SEQ ID NO: 98230 - DNA, 103 bp, Artificial Sequence
  Synthetic Polynucleotide
taatacgactcactatagggattccggtcactgactttttgggcaatgggaacagaggagacccattatgcaaaaagtcaacctggcggcagcgcaaaagatg

SEQ ID NO: 98231 - DNA, 103 bp, Artificial Sequence
  Synthetic Polynucleotide
taatacgactcactatagggttcttccagcattccggtcactgactttttaacagaggagaaaaaagatggtgaccggaaacctggcggcagcgcaaaagatg

SEQ ID NO: 98232 - DNA, 103 bp, Artificial Sequence
  Synthetic Polynucleotide
taatacgactcactatagggccagaaggggttcttccagcattccggtcaaacagaggagatgaccgatgtgctggaagaacctggcggcagcgcaaaagatg

SEQ ID NO: 98233 - DNA, 103 bp, Artificial Sequence
  Synthetic Polynucleotide
taatacgactcactatagggtgaagaggccccagaaggggttcttccagcaacagaggagagctggaatgaccccttctaacctggcggcagcgcaaaagatg

SEQ ID NO: 98234 - DNA, 103 bp, Artificial Sequence
  Synthetic Polynucleotide
taatacgactcactatagggagaaagtggctgaagaggccccagaaggggaacagaggagaccccttatggggcctcttaacctggcggcagcgcaaaagatg

SEQ ID NO: 98235 - DNA, 103 bp, Artificial Sequence
  Synthetic Polynucleotide
taatacgactcactataggggtgtattagaagaaagtggctgaagaggccaacagaggagaggcctcatgagccactttaacctggcggcagcgcaaaagatg

SEQ ID NO: 98236 - DNA, 103 bp, Artificial Sequence
  Synthetic Polynucleotide
taatacgactcactatagggtgctcaaatacttgagcactggtttttgacaacagaggagagtcaaaatgcagtgctcaaacctggcggcagcgcaaaagatg

SEQ ID NO: 98237 - DNA, 103 bp, Artificial Sequence
  Synthetic Polynucleotide
taatacgactcactataggggcccatataggtgtattagaagaaagtggcaacagaggagagccactatgttctaatacaacctggcggcagcgcaaaagatg

SEQ ID NO: 98238 - DNA, 103 bp, Artificial Sequence
  Synthetic Polynucleotide
taatacgactcactatagggaagacggcaggcccatataggtgtattagaaacagaggagatctaatatgcctatatggaacctggcggcagcgcaaaagatg

SEQ ID NO: 98239 - DNA, 103 bp, Artificial Sequence
  Synthetic Polynucleotide
taatacgactcactatagggcacagctcctaagacggcaggcccatatagaacagaggagactatatatgcctgccgtcaacctggcggcagcgcaaaagatg

SEQ ID NO: 98240 - DNA, 103 bp, Artificial Sequence
  Synthetic Polynucleotide
taatacgactcactatagggccaattttctcacagctcctaagacggcagaacagaggagactgccgatgtaggagctgaacctggcggcagcgcaaaagatg

SEQ ID NO: 98241 - DNA, 103 bp, Artificial Sequence
  Synthetic Polynucleotide
taatacgactcactataggggtatgaatctccaattttctcacagctcctaacagaggagaaggagcatggagaaaattaacctggcggcagcgcaaaagatg

SEQ ID NO: 98242 - DNA, 103 bp, Artificial Sequence
  Synthetic Polynucleotide
taatacgactcactatagggagtagccacggtatgaatctccaattttctaacagaggagaagaaaaatggagattcataacctggcggcagcgcaaaagatg

SEQ ID NO: 98243 - DNA, 103 bp, Artificial Sequence
  Synthetic Polynucleotide
taatacgactcactatagggtcacttacacagtagccacggtatgaatctaacagaggagaagattcatgccgtggctaaacctggcggcagcgcaaaagatg

SEQ ID NO: 98244 - DNA, 103 bp, Artificial Sequence
  Synthetic Polynucleotide
taatacgactcactatagggtaattcagtctcacttacacagtagccacgaacagaggagacgtggcatgtgtgtaagtaacctggcggcagcgcaaaagatg

SEQ ID NO: 98245 - DNA, 103 bp, Artificial Sequence
  Synthetic Polynucleotide
taatacgactcactatagggggacactttctaattcagtctcacttacacaacagaggagagtgtaaatgagactgaataacctggcggcagcgcaaaagatg

SEQ ID NO: 98246 - DNA, 103 bp, Artificial Sequence
  Synthetic Polynucleotide
taatacgactcactatagggtgaaatgttaggacactttctaattcagtcaacagaggagagactgaatgagaaagtgtaacctggcggcagcgcaaaagatg

SEQ ID NO: 98247 - DNA, 103 bp, Artificial Sequence
  Synthetic Polynucleotide
taatacgactcactatagggacagattagatgctcaaatacttgagcactaacagaggagaagtgctatggtatttgagaacctggcggcagcgcaaaagatg

SEQ ID NO: 98248 - DNA, 103 bp, Artificial Sequence
  Synthetic Polynucleotide
taatacgactcactatagggttgctgcttgtgaaatgttaggacactttcaacagaggagagaaagtatgctaacatttaacctggcggcagcgcaaaagatg

SEQ ID NO: 98249 - DNA, 103 bp, Artificial Sequence
  Synthetic Polynucleotide
taatacgactcactatagggcactctgtgtttgctgcttgtgaaatgttaaacagaggagataacatatgacaagcagcaacctggcggcagcgcaaaagatg

SEQ ID NO: 98250 - DNA, 103 bp, Artificial Sequence
  Synthetic Polynucleotide
taatacgactcactataggggtcccccaaacactctgtgtttgctgcttgaacagaggagacaagcaatgaacacagagaacctggcggcagcgcaaaagatg

SEQ ID NO: 98251 - DNA, 103 bp, Artificial Sequence
  Synthetic Polynucleotide
taatacgactcactatagggagactgacgggtcccccaaacactctgtgtaacagaggagaacacagatggtttgggggaacctggcggcagcgcaaaagatg

SEQ ID NO: 98252 - DNA, 103 bp, Artificial Sequence
  Synthetic Polynucleotide
taatacgactcactatagggctgggcttggagactgacgggtcccccaaaaacagaggagatttgggatgcccgtcagtaacctggcggcagcgcaaaagatg

SEQ ID NO: 98253 - DNA, 103 bp, Artificial Sequence
  Synthetic Polynucleotide
taatacgactcactataggggcaggcttggctgggcttggagactgacggaacagaggagaccgtcaatgtccaagcccaacctggcggcagcgcaaaagatg

SEQ ID NO: 98254 - DNA, 103 bp, Artificial Sequence
  Synthetic Polynucleotide
taatacgactcactatagggcaagcgtgtagcaggcttggctgggcttggaacagaggagaccaagcatggccaagcctaacctggcggcagcgcaaaagatg

SEQ ID NO: 98255 - DNA, 103 bp, Artificial Sequence
  Synthetic Polynucleotide
taatacgactcactatagggatttccacatcaagcgtgtagcaggcttggaacagaggagaccaagcatgctacacgctaacctggcggcagcgcaaaagatg

SEQ ID NO: 98256 - DNA, 103 bp, Artificial Sequence
  Synthetic Polynucleotide
taatacgactcactatagggacatactgggatttccacatcaagcgtgtaaacagaggagatacacgatggatgtggaaaacctggcggcagcgcaaaagatg

SEQ ID NO: 98257 - DNA, 103 bp, Artificial Sequence
  Synthetic Polynucleotide
taatacgactcactatagggatcatatggaacatactgggatttccacataacagaggagaatgtggatgtcccagtataacctggcggcagcgcaaaagatg

SEQ ID NO: 98258 - DNA, 103 bp, Artificial Sequence
  Synthetic Polynucleotide
taatacgactcactatagggtggagtccatacagattagatgctcaaataaacagaggagatatttgatgatctaatctaacctggcggcagcgcaaaagatg

SEQ ID NO: 98259 - DNA, 103 bp, Artificial Sequence
  Synthetic Polynucleotide
taatacgactcactatagggatgggattccatcatatggaacatactgggaacagaggagacccagtatgttccatatgaacctggcggcagcgcaaaagatg

SEQ ID NO: 98260 - DNA, 103 bp, Artificial Sequence
  Synthetic Polynucleotide
taatacgactcactataggggcattaacaaatgggattccatcatatggaaacagaggagatccataatgtggaatcccaacctggcggcagcgcaaaagatg

SEQ ID NO: 98261 - DNA, 103 bp, Artificial Sequence
  Synthetic Polynucleotide
taatacgactcactatagggtctactccctgcattaacaaatgggattccaacagaggagaggaatcatgtttgttaataacctggcggcagcgcaaaagatg

SEQ ID NO: 98262 - DNA, 103 bp, Artificial Sequence
  Synthetic Polynucleotide
taatacgactcactatagggttaccacagctctactccctgcattaacaaaacagaggagattgttaatgcagggagtaaacctggcggcagcgcaaaagatg

SEQ ID NO: 98263 - DNA, 103 bp, Artificial Sequence
  Synthetic Polynucleotide
taatacgactcactatagggtgacactccattaccacagctctactccctaacagaggagaagggagatgagctgtggtaacctggcggcagcgcaaaagatg

SEQ ID NO: 98264 - DNA, 103 bp, Artificial Sequence
  Synthetic Polynucleotide
taatacgactcactatagggtggcccatactgacactccattaccacagcaacagaggagagctgtgatgatggagtgtaacctggcggcagcgcaaaagatg

SEQ ID NO: 98265 - DNA, 103 bp, Artificial Sequence
  Synthetic Polynucleotide
taatacgactcactatagggcttttcttcttggcccatactgacactccaaacagaggagatggagtatgagtatgggcaacctggcggcagcgcaaaagatg

SEQ ID NO: 98266 - DNA, 103 bp, Artificial Sequence
  Synthetic Polynucleotide
taatacgactcactatagggaactggaaaccttttcttcttggcccatacaacagaggagagtatggatgaagaagaaaaacctggcggcagcgcaaaagatg

SEQ ID NO: 98267 - DNA, 103 bp, Artificial Sequence
  Synthetic Polynucleotide
taatacgactcactataggggactttttttaactggaaaccttttcttctaacagaggagaagaagaatgggtttccagaacctggcggcagcgcaaaagatg

SEQ ID NO: 98268 - DNA, 103 bp, Artificial Sequence
  Synthetic Polynucleotide
taatacgactcactatagggcctgctcactgactttttttaactggaaacaacagaggagagtttccatgtaaaaaaagaacctggcggcagcgcaaaagatg

SEQ ID NO: 98269 - DNA, 103 bp, Artificial Sequence
  Synthetic Polynucleotide
taatacgactcactataggggaagaatccctggagtccatacagattagaaacagaggagatctaatatgtatggactcaacctggcggcagcgcaaaagatg

SEQ ID NO: 98270 - DNA, 103 bp, Artificial Sequence
  Synthetic Polynucleotide
taatacgactcactataggggacctgctttcctgctcactgactttttttaacagaggagaaaaaaaatgcagtgagcaaacctggcggcagcgcaaaagatg

SEQ ID NO: 98271 - DNA, 103 bp, Artificial Sequence
  Synthetic Polynucleotide
taatacgactcactataggggagctgacaagacctgctttcctgctcactaacagaggagaagtgagatggaaagcaggaacctggcggcagcgcaaaagatg

SEQ ID NO: 98272 - DNA, 103 bp, Artificial Sequence
  Synthetic Polynucleotide
taatacgactcactatagggtggctttgtagagctgacaagacctgctttaacagaggagaaaagcaatgcttgtcagcaacctggcggcagcgcaaaagatg

SEQ ID NO: 98273 - DNA, 103 bp, Artificial Sequence
  Synthetic Polynucleotide
taatacgactcactataggggctggacaagtggctttgtagagctgacaaaacagaggagattgtcaatgctacaaagcaacctggcggcagcgcaaaagatg

SEQ ID NO: 98274 - DNA, 103 bp, Artificial Sequence
  Synthetic Polynucleotide
taatacgactcactataggggtaaatccgagctggacaagtggctttgtaaacagaggagatacaaaatgacttgtccaaacctggcggcagcgcaaaagatg

SEQ ID NO: 98275 - DNA, 103 bp, Artificial Sequence
  Synthetic Polynucleotide
taatacgactcactatagggcctttttaatgtaaatccgagctggacaagaacagaggagacttgtcatgctcggatttaacctggcggcagcgcaaaagatg

SEQ ID NO: 98276 - DNA, 103 bp, Artificial Sequence
  Synthetic Polynucleotide
taatacgactcactatagggaacttctgtacctttttaatgtaaatccgaaacagaggagatcggatatgcattaaaaaaacctggcggcagcgcaaaagatg

SEQ ID NO: 98277 - DNA, 103 bp, Artificial Sequence
  Synthetic Polynucleotide
taatacgactcactatagggatattcaggaaacttctgtacctttttaataacagaggagaattaaaatggtacagaagaacctggcggcagcgcaaaagatg

SEQ ID NO: 98278 - DNA, 103 bp, Artificial Sequence
  Synthetic Polynucleotide
taatacgactcactatagggtaggaactctatattcaggaaacttctgtaaacagaggagatacagaatgttcctgaataacctggcggcagcgcaaaagatg

SEQ ID NO: 98279 - DNA, 103 bp, Artificial Sequence
  Synthetic Polynucleotide
taatacgactcactatagggttggggtctgtaggaactctatattcaggaaacagaggagatcctgaatgtagagttccaacctggcggcagcgcaaaagatg

SEQ ID NO: 98280 - DNA, 103 bp, Artificial Sequence
  Synthetic Polynucleotide
taatacgactcactatagggcggccccaccgccgccgccgccgctgccataacagaggagaatggcaatggcggcggcgaacctggcggcagcgcaaaagatg

SEQ ID NO: 98281 - DNA, 103 bp, Artificial Sequence
  Synthetic Polynucleotide
taatacgactcactataggggatggtgaggaggcgggcgccggggaacacaacagaggagagtgttcatgggcgcccgcaacctggcggcagcgcaaaagatg

SEQ ID NO: 98282 - DNA, 103 bp, Artificial Sequence
  Synthetic Polynucleotide
taatacgactcactatagggcaccacaggctgccggaaatactcatccacaacagaggagagtggatatgtatttccggaacctggcggcagcgcaaaagatg

SEQ ID NO: 98283 - DNA, 103 bp, Artificial Sequence
  Synthetic Polynucleotide
taatacgactcactatagggcaaatgtgtccaccacaggctgccggaaataacagaggagaatttccatgagcctgtggaacctggcggcagcgcaaaagatg

SEQ ID NO: 98284 - DNA, 103 bp, Artificial Sequence
  Synthetic Polynucleotide
taatacgactcactatagggatccggatgtcaaatgtgtccaccacaggcaacagaggagagcctgtatgggacacattaacctggcggcagcgcaaaagatg

SEQ ID NO: 98285 - DNA, 103 bp, Artificial Sequence
  Synthetic Polynucleotide
taatacgactcactatagggggccatcaggatccggatgtcaaatgtgtcaacagaggagagacacaatggacatccggaacctggcggcagcgcaaaagatg

SEQ ID NO: 98286 - DNA, 103 bp, Artificial Sequence
  Synthetic Polynucleotide
taatacgactcactatagggtgacagacttggccatcaggatccggatgtaacagaggagaacatccatgtcctgatggaacctggcggcagcgcaaaagatg

SEQ ID NO: 98287 - DNA, 103 bp, Artificial Sequence
  Synthetic Polynucleotide
taatacgactcactatagggaccgtgtacttgacagacttggccatcaggaacagaggagacctgatatgcaagtctgtaacctggcggcagcgcaaaagatg

SEQ ID NO: 98288 - DNA, 103 bp, Artificial Sequence
  Synthetic Polynucleotide
taatacgactcactatagggtaagaagttcaccgtgtacttgacagacttaacagaggagaaagtctatgaagtacacgaacctggcggcagcgcaaaagatg

SEQ ID NO: 98289 - DNA, 103 bp, Artificial Sequence
  Synthetic Polynucleotide
taatacgactcactatagggctttggcttctaagaagttcaccgtgtactaacagaggagaagtacaatgtgaacttctaacctggcggcagcgcaaaagatg

SEQ ID NO: 98290 - DNA, 103 bp, Artificial Sequence
  Synthetic Polynucleotide
taatacgactcactatagggaaatctccttctttggcttctaagaagttcaacagaggagagaacttatgagaagccaaaacctggcggcagcgcaaaagatg

SEQ ID NO: 98291 - DNA, 103 bp, Artificial Sequence
  Synthetic Polynucleotide
taatacgactcactatagggtatcctgtgcaaatctccttctttggcttcaacagaggagagaagccatggaaggagataacctggcggcagcgcaaaagatg

SEQ ID NO: 98292 - DNA, 103 bp, Artificial Sequence
  Synthetic Polynucleotide
taatacgactcactatagggtcgcgtcgccgatggtgaggaggcgggcgcaacagaggagagcgcccatgtcctcaccaaacctggcggcagcgcaaaagatg

SEQ ID NO: 98293 - DNA, 103 bp, Artificial Sequence
  Synthetic Polynucleotide
taatacgactcactatagggatgggatttctatcctgtgcaaatctccttaacagaggagaaaggagatgtgcacaggaaacctggcggcagcgcaaaagatg

SEQ ID NO: 98294 - DNA, 103 bp, Artificial Sequence
  Synthetic Polynucleotide
taatacgactcactatagggtggaatttgaatgggatttctatcctgtgcaacagaggagagcacagatgagaaatcccaacctggcggcagcgcaaaagatg

SEQ ID NO: 98295 - DNA, 103 bp, Artificial Sequence
  Synthetic Polynucleotide
taatacgactcactatagggatgcagcatgtggaatttgaatgggatttcaacagaggagagaaatcatgttcaaattcaacctggcggcagcgcaaaagatg

SEQ ID NO: 98296 - DNA, 103 bp, Artificial Sequence
  Synthetic Polynucleotide
taatacgactcactatagggccagccctgaatgcagcatgtggaatttgaaacagaggagatcaaatatgacatgctgcaacctggcggcagcgcaaaagatg

SEQ ID NO: 98297 - DNA, 103 bp, Artificial Sequence
  Synthetic Polynucleotide
taatacgactcactatagggaggccgtggaccagccctgaatgcagcatgaacagaggagacatgctatgttcagggctaacctggcggcagcgcaaaagatg

SEQ ID NO: 98298 - DNA, 103 bp, Artificial Sequence
  Synthetic Polynucleotide
taatacgactcactatagggccagaaagccaggccgtggaccagccctgaaacagaggagatcagggatggtccacggcaacctggcggcagcgcaaaagatg

SEQ ID NO: 98299 - DNA, 103 bp, Artificial Sequence
  Synthetic Polynucleotide
taatacgactcactatagggcaacgtcaaaccagaaagccaggccgtggaaacagaggagatccacgatgtggctttctaacctggcggcagcgcaaaagatg

SEQ ID NO: 98300 - DNA, 103 bp, Artificial Sequence
  Synthetic Polynucleotide
taatacgactcactatagggccgatgaaagcaacgtcaaaccagaaagccaacagaggagaggctttatggtttgacgtaacctggcggcagcgcaaaagatg

SEQ ID NO: 98301 - DNA, 103 bp, Artificial Sequence
  Synthetic Polynucleotide
taatacgactcactatagggcattatggagccgatgaaagcaacgtcaaaaacagaggagatttgacatggctttcatcaacctggcggcagcgcaaaagatg

SEQ ID NO: 98302 - DNA, 103 bp, Artificial Sequence
  Synthetic Polynucleotide
taatacgactcactataggggccacacggtcattatggagccgatgaaagaacagaggagactttcaatggctccataaaacctggcggcagcgcaaaagatg

SEQ ID NO: 98303 - DNA, 103 bp, Artificial Sequence
  Synthetic Polynucleotide
taatacgactcactatagggatctcgccgttcgcgtcgccgatggtgaggaacagaggagacctcacatgcggcgacgcaacctggcggcagcgcaaaagatg

SEQ ID NO: 98304 - DNA, 103 bp, Artificial Sequence
  Synthetic Polynucleotide
taatacgactcactataggggctgtggacagccacacggtcattatggagaacagaggagactccatatggaccgtgtgaacctggcggcagcgcaaaagatg

SEQ ID NO: 98305 - DNA, 103 bp, Artificial Sequence
  Synthetic Polynucleotide
taatacgactcactatagggctctgtcggggctgtggacagccacacggtaacagaggagaaccgtgatgctgtccacaaacctggcggcagcgcaaaagatg

SEQ ID NO: 98306 - DNA, 103 bp, Artificial Sequence
  Synthetic Polynucleotide
taatacgactcactataggggggtcaggggctctgtcggggctgtggacaaacagaggagatgtccaatgccccgacagaacctggcggcagcgcaaaagatg

SEQ ID NO: 98307 - DNA, 103 bp, Artificial Sequence
  Synthetic Polynucleotide
taatacgactcactatagggtggtaccagtgggtcaggggctctgtcgggaacagaggagacccgacatggcccctgacaacctggcggcagcgcaaaagatg

SEQ ID NO: 98308 - DNA, 103 bp, Artificial Sequence
  Synthetic Polynucleotide
taatacgactcactataggggcaccgcacctggtaccagtgggtcaggggaacagaggagacccctgatgcactggtacaacctggcggcagcgcaaaagatg

SEQ ID NO: 98309 - DNA, 103 bp, Artificial Sequence
  Synthetic Polynucleotide
taatacgactcactatagggactggaacaggcaccgcacctggtaccagtaacagaggagaactggtatgaggtgcggtaacctggcggcagcgcaaaagatg

SEQ ID NO: 98310 - DNA, 103 bp, Artificial Sequence
  Synthetic Polynucleotide
taatacgactcactatagggaacagtggtgactggaacaggcaccgcaccaacagaggagaggtgcgatgcctgttccaaacctggcggcagcgcaaaagatg

SEQ ID NO: 98311 - DNA, 103 bp, Artificial Sequence
  Synthetic Polynucleotide
taatacgactcactatagggtgccttggcgaacagtggtgactggaacagaacagaggagactgttcatgtcaccactgaacctggcggcagcgcaaaagatg

SEQ ID NO: 98312 - DNA, 103 bp, Artificial Sequence
  Synthetic Polynucleotide
taatacgactcactataggggcgtgtcccctgccttggcgaacagtggtgaacagaggagacaccacatgtcgccaaggaacctggcggcagcgcaaaagatg

SEQ ID NO: 98313 - DNA, 103 bp, Artificial Sequence
  Synthetic Polynucleotide
taatacgactcactataggggtccctgagagcgtgtcccctgccttggcgaacagaggagacgccaaatgaggggacacaacctggcggcagcgcaaaagatg

SEQ ID NO: 98314 - DNA, 103 bp, Artificial Sequence
  Synthetic Polynucleotide
taatacgactcactataggggtgccgctggatctcgccgttcgcgtcgccaacagaggagaggcgacatgaacggcgagaacctggcggcagcgcaaaagatg

SEQ ID NO: 98315 - DNA, 103 bp, Artificial Sequence
  Synthetic Polynucleotide
taatacgactcactatagggaagcagacatgtccctgagagcgtgtccccaacagaggagaggggacatgctctcagggaacctggcggcagcgcaaaagatg

SEQ ID NO: 98316 - DNA, 103 bp, Artificial Sequence
  Synthetic Polynucleotide
taatacgactcactatagggtgttggcaataagcagacatgtccctgagaaacagaggagatctcagatgcatgtctgcaacctggcggcagcgcaaaagatg

SEQ ID NO: 98317 - DNA, 103 bp, Artificial Sequence
  Synthetic Polynucleotide
taatacgactcactatagggctctgtcttttgttggcaataagcagacataacagaggagaatgtctatgtattgccaaaacctggcggcagcgcaaaagatg

SEQ ID NO: 98318 - DNA, 103 bp, Artificial Sequence
  Synthetic Polynucleotide
taatacgactcactataggggatgtcgtagctctgtcttttgttggcaataacagaggagaattgccatgaaaagacagaacctggcggcagcgcaaaagatg

SEQ ID NO: 98319 - DNA, 103 bp, Artificial Sequence
  Synthetic Polynucleotide
taatacgactcactatagggccacaatactgatgtcgtagctctgtctttaacagaggagaaaagacatggctacgacaaacctggcggcagcgcaaaagatg

SEQ ID NO: 98320 - DNA, 103 bp, Artificial Sequence
  Synthetic Polynucleotide
taatacgactcactatagggtccacctgggccacaatactgatgtcgtagaacagaggagactacgaatgcagtattgtaacctggcggcagcgcaaaagatg

SEQ ID NO: 98321 - DNA, 103 bp, Artificial Sequence
  Synthetic Polynucleotide
taatacgactcactataggggccggtctggtccacctgggccacaatactaacagaggagaagtattatggcccaggtgaacctggcggcagcgcaaaagatg

SEQ ID NO: 98322 - DNA, 103 bp, Artificial Sequence
  Synthetic Polynucleotide
taatacgactcactatagggtggacttggagccggtctggtccacctgggaacagaggagacccaggatgaccagaccgaacctggcggcagcgcaaaagatg

SEQ ID NO: 98323 - DNA, 103 bp, Artificial Sequence
  Synthetic Polynucleotide
taatacgactcactatagggaggaggttactggacttggagccggtctggaacagaggagaccagacatgctccaagtcaacctggcggcagcgcaaaagatg

SEQ ID NO: 98324 - DNA, 103 bp, Artificial Sequence
  Synthetic Polynucleotide
taatacgactcactatagggtttcagatccaggaggttactggacttggaaacagaggagatccaagatgagtaacctcaacctggcggcagcgcaaaagatg

SEQ ID NO: 98325 - DNA, 103 bp, Artificial Sequence
  Synthetic Polynucleotide
taatacgactcactataggggctgctccgcgtgccgctggatctcgccgtaacagaggagaacggcgatgtccagcggcaacctggcggcagcgcaaaagatg

SEQ ID NO: 98326 - DNA, 103 bp, Artificial Sequence
  Synthetic Polynucleotide
taatacgactcactatagggagaaggggtttttcagatccaggaggttacaacagaggagagtaaccatgtggatctgaaacctggcggcagcgcaaaagatg

SEQ ID NO: 98327 - DNA, 103 bp, Artificial Sequence
  Synthetic Polynucleotide
taatacgactcactataggggtgtatctaaagaaggggtttttcagatccaacagaggagaggatctatgaaaccccttaacctggcggcagcgcaaaagatg

SEQ ID NO: 98328 - DNA, 103 bp, Artificial Sequence
  Synthetic Polynucleotide
taatacgactcactatagggcgttgtgcccgtgtatctaaagaaggggttaacagaggagaaaccccatgtttagatacaacctggcggcagcgcaaaagatg

SEQ ID NO: 98329 - DNA, 103 bp, Artificial Sequence
  Synthetic Polynucleotide
taatacgactcactatagggggggtgagggcgttgtgcccgtgtatctaaaacagaggagattagatatgcgggcacaaaacctggcggcagcgcaaaagatg

SEQ ID NO: 98330 - DNA, 103 bp, Artificial Sequence
  Synthetic Polynucleotide
taatacgactcactataggggagccgggtgggggtgagggcgttgtgcccaacagaggagagggcacatggccctcaccaacctggcggcagcgcaaaagatg

SEQ ID NO: 98331 - DNA, 103 bp, Artificial Sequence
  Synthetic Polynucleotide
taatacgactcactatagggtgtgtagtgggagccgggtgggggtgagggaacagaggagaccctcaatgccacccggcaacctggcggcagcgcaaaagatg

SEQ ID NO: 98332 - DNA, 103 bp, Artificial Sequence
  Synthetic Polynucleotide
taatacgactcactatagggccgagggagatgtgtagtgggagccgggtgaacagaggagacacccgatgcccactacaaacctggcggcagcgcaaaagatg

SEQ ID NO: 98333 - DNA, 103 bp, Artificial Sequence
  Synthetic Polynucleotide
taatacgactcactatagggcacatgttttccgagggagatgtgtagtggaacagaggagaccactaatgatctccctcaacctggcggcagcgcaaaagatg

SEQ ID NO: 98334 - DNA, 103 bp, Artificial Sequence
  Synthetic Polynucleotide
taatacgactcactataggggcccgtgttccacatgttttccgagggagaaacagaggagatctcccatggaaaacatgaacctggcggcagcgcaaaagatg

SEQ ID NO: 98335 - DNA, 103 bp, Artificial Sequence
  Synthetic Polynucleotide
taatacgactcactatagggtgtaggtgctgcccgtgttccacatgttttaacagaggagaaaaacaatgggaacacggaacctggcggcagcgcaaaagatg

SEQ ID NO: 98336 - DNA, 103 bp, Artificial Sequence
  Synthetic Polynucleotide
taatacgactcactatagggcgcagcgcctgctgctccgcgtgccgctggaacagaggagaccagcgatgcgcggagcaaacctggcggcagcgcaaaagatg

SEQ ID NO: 98337 - DNA, 103 bp, Artificial Sequence
  Synthetic Polynucleotide
taatacgactcactatagggctgctgaggttgtaggtgctgcccgtgttcaacagaggagagaacacatgcagcacctaaacctggcggcagcgcaaaagatg

SEQ ID NO: 98338 - DNA, 103 bp, Artificial Sequence
  Synthetic Polynucleotide
taatacgactcactatagggggccatcccgctgctgaggttgtaggtgctaacagaggagaagcaccatgaacctcagcaacctggcggcagcgcaaaagatg

SEQ ID NO: 98339 - DNA, 103 bp, Artificial Sequence
  Synthetic Polynucleotide
taatacgactcactatagggtccctgccacggccatcccgctgctgaggtaacagaggagaacctcaatggcgggatggaacctggcggcagcgcaaaagatg

SEQ ID NO: 98340 - DNA, 103 bp, Artificial Sequence
  Synthetic Polynucleotide
taatacgactcactataggggcggtcggcatccctgccacggccatcccgaacagaggagacgggatatgcgtggcaggaacctggcggcagcgcaaaagatg

SEQ ID NO: 98341 - DNA, 103 bp, Artificial Sequence
  Synthetic Polynucleotide
taatacgactcactatagggcaagtcataggcggtcggcatccctgccacaacagaggagagtggcaatgatgccgaccaacctggcggcagcgcaaaagatg

SEQ ID NO: 98342 - DNA, 103 bp, Artificial Sequence
  Synthetic Polynucleotide
taatacgactcactatagggtaacactgctcaagtcataggcggtcggcaaacagaggagatgccgaatgcctatgactaacctggcggcagcgcaaaagatg

SEQ ID NO: 98343 - DNA, 103 bp, Artificial Sequence
  Synthetic Polynucleotide
taatacgactcactatagggccactggcaataacactgctcaagtcatagaacagaggagactatgaatggagcagtgtaacctggcggcagcgcaaaagatg

SEQ ID NO: 98344 - DNA, 103 bp, Artificial Sequence
  Synthetic Polynucleotide
taatacgactcactatagggcacgctggagccactggcaataacactgctaacagaggagaagcagtatgattgccagtaacctggcggcagcgcaaaagatg

SEQ ID NO: 98345 - DNA, 103 bp, Artificial Sequence
  Synthetic Polynucleotide
taatacgactcactatagggtgttgtggcccacgctggagccactggcaaaacagaggagattgccaatggctccagcgaacctggcggcagcgcaaaagatg

SEQ ID NO: 98346 - DNA, 103 bp, Artificial Sequence
  Synthetic Polynucleotide
taatacgactcactatagggggaatcaggttgttgtggcccacgctggagaacagaggagactccagatggggccacaaaacctggcggcagcgcaaaagatg

SEQ ID NO: 98347 - DNA, 103 bp, Artificial Sequence
  Synthetic Polynucleotide
taatacgactcactatagggcacctcgaggcgcagcgcctgctgctccgcaacagaggagagcggagatgcaggcgctgaacctggcggcagcgcaaaagatg

SEQ ID NO: 98348 - DNA, 103 bp, Artificial Sequence
  Synthetic Polynucleotide
taatacgactcactataggggttggctaaaggaatcaggttgttgtggccaacagaggagaggccacatgaacctgattaacctggcggcagcgcaaaagatg

SEQ ID NO: 98349 - DNA, 103 bp, Artificial Sequence
  Synthetic Polynucleotide
taatacgactcactatagggcaatccccgtgttggctaaaggaatcaggtaacagaggagaacctgaatgctttagccaaacctggcggcagcgcaaaagatg

SEQ ID NO: 98350 - DNA, 103 bp, Artificial Sequence
  Synthetic Polynucleotide
taatacgactcactataggggtgtgattgacaatccccgtgttggctaaaaacagaggagatttagcatgcacggggataacctggcggcagcgcaaaagatg

SEQ ID NO: 98351 - DNA, 103 bp, Artificial Sequence
  Synthetic Polynucleotide
taatacgactcactatagggccgggagtgggtgtgattgacaatccccgtaacagaggagaacggggatggtcaatcacaacctggcggcagcgcaaaagatg

SEQ ID NO: 98352 - DNA, 103 bp, Artificial Sequence
  Synthetic Polynucleotide
taatacgactcactatagggtggagcccatccgggagtgggtgtgattgaaacagaggagatcaatcatgcccactcccaacctggcggcagcgcaaaagatg

SEQ ID NO: 98353 - DNA, 103 bp, Artificial Sequence
  Synthetic Polynucleotide
taatacgactcactataggggtgctcattatggagcccatccgggagtggaacagaggagaccactcatggatgggctcaacctggcggcagcgcaaaagatg

SEQ ID NO: 98354 - DNA, 103 bp, Artificial Sequence
  Synthetic Polynucleotide
taatacgactcactataggggacaatccccgtgctcattatggagcccataacagaggagaatgggcatgataatgagcaacctggcggcagcgcaaaagatg

SEQ ID NO: 98355 - DNA, 103 bp, Artificial Sequence
  Synthetic Polynucleotide
taatacgactcactatagggaggacccttggacaatccccgtgctcattaaacagaggagataatgaatgcggggattgaacctggcggcagcgcaaaagatg

SEQ ID NO: 98356 - DNA, 103 bp, Artificial Sequence
  Synthetic Polynucleotide
taatacgactcactatagggtgggcgccggaggacccttggacaatccccaacagaggagaggggatatgccaagggtcaacctggcggcagcgcaaaagatg

SEQ ID NO: 98357 - DNA, 103 bp, Artificial Sequence
  Synthetic Polynucleotide
taatacgactcactatagggaccactgccctgggcgccggaggacccttgaacagaggagacaagggatgtccggcgccaacctggcggcagcgcaaaagatg

SEQ ID NO: 98358 - DNA, 103 bp, Artificial Sequence
  Synthetic Polynucleotide
taatacgactcactatagggggccggcgcgcacctcgaggcgcagcgcctaacagaggagaaggcgcatggcctcgaggaacctggcggcagcgcaaaagatg

SEQ ID NO: 98359 - DNA, 103 bp, Artificial Sequence
  Synthetic Polynucleotide
taatacgactcactatagggtgctgccaccaccactgccctgggcgccggaacagaggagaccggcgatgagggcagtgaacctggcggcagcgcaaaagatg

SEQ ID NO: 98360 - DNA, 103 bp, Artificial Sequence
  Synthetic Polynucleotide
taatacgactcactatagggtgggcactcgtgctgccaccaccactgcccaacagaggagagggcagatgtggtggcagaacctggcggcagcgcaaaagatg

SEQ ID NO: 98361 - DNA, 103 bp, Artificial Sequence
  Synthetic Polynucleotide
taatacgactcactataggggactgcatagtgggcactcgtgctgccaccaacagaggagaggtggcatgacgagtgccaacctggcggcagcgcaaaagatg

SEQ ID NO: 98362 - DNA, 103 bp, Artificial Sequence
  Synthetic Polynucleotide
taatacgactcactatagggactggctgttgactgcatagtgggcactcgaacagaggagacgagtgatgactatgcagaacctggcggcagcgcaaaagatg

SEQ ID NO: 98363 - DNA, 103 bp, Artificial Sequence
  Synthetic Polynucleotide
taatacgactcactatagggcccatggtgaactggctgttgactgcatagaacagaggagactatgcatgcaacagccaaacctggcggcagcgcaaaagatg

SEQ ID NO: 98364 - DNA, 103 bp, Artificial Sequence
  Synthetic Polynucleotide
taatacgactcactatagggggcggggccgcccatggtgaactggctgttaacagaggagaaacagcatgttcaccatgaacctggcggcagcgcaaaagatg

SEQ ID NO: 98365 - DNA, 103 bp, Artificial Sequence
  Synthetic Polynucleotide
taatacgactcactatagggccatggagatggcggggccgcccatggtgaaacagaggagatcaccaatggcggccccgaacctggcggcagcgcaaaagatg

SEQ ID NO: 98366 - DNA, 103 bp, Artificial Sequence
  Synthetic Polynucleotide
taatacgactcactatagggatgggcgacgccatggagatggcggggccgaacagaggagacggcccatgcatctccataacctggcggcagcgcaaaagatg

SEQ ID NO: 98367 - DNA, 103 bp, Artificial Sequence
  Synthetic Polynucleotide
taatacgactcactatagggcgggatggacatgggcgacgccatggagataacagaggagaatctccatggcgtcgcccaacctggcggcagcgcaaaagatg

SEQ ID NO: 98368 - DNA, 103 bp, Artificial Sequence
  Synthetic Polynucleotide
taatacgactcactatagggtggtgttggtcgggatggacatgggcgacgaacagaggagacgtcgcatgtgtccatccaacctggcggcagcgcaaaagatg

SEQ ID NO: 98369 - DNA, 103 bp, Artificial Sequence
  Synthetic Polynucleotide
taatacgactcactataggggccgagtccgggccggcgcgcacctcgaggaacagaggagacctcgaatggcgcgccggaacctggcggcagcgcaaaagatg

SEQ ID NO: 98370 - DNA, 103 bp, Artificial Sequence
  Synthetic Polynucleotide
taatacgactcactatagggccgtagtgcatggtgttggtcgggatggacaacagaggagagtccatatggaccaacacaacctggcggcagcgcaaaagatg

SEQ ID NO: 98371 - DNA, 103 bp, Artificial Sequence
  Synthetic Polynucleotide
taatacgactcactatagggggcgatgcccgccgagtccgggccggcgcgaacagaggagacgcgccatgccggactcgaacctggcggcagcgcaaaagatg

SEQ ID NO: 98372 - DNA, 103 bp, Artificial Sequence
  Synthetic Polynucleotide
taatacgactcactatagggcgcccgcgcccggccccaccgccgccgccgaacagaggagacggcggatgcggtggggcaacctggcggcagcgcaaaagatg

SEQ ID NO: 98373 - DNA, 103 bp, Artificial Sequence
  Synthetic Polynucleotide
taatacgactcactatagggggctgtagagggcgatgcccgccgagtccgaacagaggagacggactatgcgggcatcgaacctggcggcagcgcaaaagatg

SEQ ID NO: 98374 - DNA, 103 bp, Artificial Sequence
  Synthetic Polynucleotide
taatacgactcactatagggacatcttcatggctgtagagggcgatgcccaacagaggagagggcatatgcctctacagaacctggcggcagcgcaaaagatg

SEQ ID NO: 98375 - DNA, 103 bp, Artificial Sequence
  Synthetic Polynucleotide
taatacgactcactatagggaaagacacacacatcttcatggctgtagagaacagaggagactctacatgcatgaagataacctggcggcagcgcaaaagatg

SEQ ID NO: 98376 - DNA, 103 bp, Artificial Sequence
  Synthetic Polynucleotide
taatacgactcactatagggctgagcacttaaagacacacacatcttcataacagaggagaatgaagatgtgtgtgtctaacctggcggcagcgcaaaagatg

SEQ ID NO: 98377 - DNA, 103 bp, Artificial Sequence
  Synthetic Polynucleotide
taatacgactcactatagggtctcgggacactgagcacttaaagacacacaacagaggagagtgtgtatgtaagtgctcaacctggcggcagcgcaaaagatg

SEQ ID NO: 98378 - DNA, 103 bp, Artificial Sequence
  Synthetic Polynucleotide
taatacgactcactataggggcactctgtctctcgggacactgagcacttaacagaggagaaagtgcatggtgtcccgaaacctggcggcagcgcaaaagatg

SEQ ID NO: 98379 - DNA, 103 bp, Artificial Sequence
  Synthetic Polynucleotide
taatacgactcactatagggccacacggctgcactctgtctctcgggacaaacagaggagatgtcccatgagacagagtaacctggcggcagcgcaaaagatg

SEQ ID NO: 98380 - DNA, 103 bp, Artificial Sequence
  Synthetic Polynucleotide
taatacgactcactataggggactgcttgcccacacggctgcactctgtcaacagaggagagacagaatgcagccgtgtaacctggcggcagcgcaaaagatg

SEQ ID NO: 98381 - DNA, 103 bp, Artificial Sequence
  Synthetic Polynucleotide
taatacgactcactataggggatgatgaaggactgcttgcccacacggctaacagaggagaagccgtatgggcaagcagaacctggcggcagcgcaaaagatg

SEQ ID NO: 98382 - DNA, 103 bp, Artificial Sequence
  Synthetic Polynucleotide
taatacgactcactatagggagcccagggtgatgatgaaggactgcttgcaacagaggagagcaagcatgccttcatcaaacctggcggcagcgcaaaagatg

SEQ ID NO: 98383 - DNA, 103 bp, Artificial Sequence
  Synthetic Polynucleotide
taatacgactcactataggggaccccgcgccgcccgcgcccggccccaccaacagaggagaggtgggatggggcgcgggaacctggcggcagcgcaaaagatg

SEQ ID NO: 98384 - DNA, 103 bp, Artificial Sequence
  Synthetic Polynucleotide
taatacgactcactatagggacgctgttgcagcccagggtgatgatgaagaacagaggagacttcatatgcaccctgggaacctggcggcagcgcaaaagatg

SEQ ID NO: 98385 - DNA, 103 bp, Artificial Sequence
  Synthetic Polynucleotide
taatacgactcactatagggctggatgaggacgctgttgcagcccagggtaacagaggagaaccctgatgtgcaacagcaacctggcggcagcgcaaaagatg

SEQ ID NO: 98386 - DNA, 103 bp, Artificial Sequence
  Synthetic Polynucleotide
taatacgactcactataggggtgtggcgaactggatgaggacgctgttgcaacagaggagagcaacaatgtcctcatccaacctggcggcagcgcaaaagatg

SEQ ID NO: 98387 - DNA, 103 bp, Artificial Sequence
  Synthetic Polynucleotide
taatacgactcactatagggaaatcgttgggtgtggcgaactggatgaggaacagaggagacctcatatggttcgccacaacctggcggcagcgcaaaagatg

SEQ ID NO: 98388 - DNA, 103 bp, Artificial Sequence
  Synthetic Polynucleotide
taatacgactcactataggggaaggaacagaaatcgttgggtgtggcgaaaacagaggagattcgccatgcccaacgataacctggcggcagcgcaaaagatg

SEQ ID NO: 98389 - DNA, 103 bp, Artificial Sequence
  Synthetic Polynucleotide
taatacgactcactatagggggatgttgtagaaggaacagaaatcgttggaacagaggagaccaacgatgtctgttcctaacctggcggcagcgcaaaagatg

SEQ ID NO: 98390 - DNA, 103 bp, Artificial Sequence
  Synthetic Polynucleotide
taatacgactcactatagggcaggttttcaggatgttgtagaaggaacagaacagaggagactgttcatgctacaacataacctggcggcagcgcaaaagatg

SEQ ID NO: 98391 - DNA, 103 bp, Artificial Sequence
  Synthetic Polynucleotide
taatacgactcactataggggtggccccggcaggttttcaggatgttgtaaacagaggagatacaacatgctgaaaaccaacctggcggcagcgcaaaagatg

SEQ ID NO: 98392 - DNA, 103 bp, Artificial Sequence
  Synthetic Polynucleotide
taatacgactcactataggggctccagggtgtggccccggcaggttttcaaacagaggagatgaaaaatggccggggccaacctggcggcagcgcaaaagatg

SEQ ID NO: 98393 - DNA, 103 bp, Artificial Sequence
  Synthetic Polynucleotide
taatacgactcactatagggaacacagaccgctccagggtgtggccccggaacagaggagaccggggatgcaccctggaaacctggcggcagcgcaaaagatg

SEQ ID NO: 98394 - DNA, 103 bp, Artificial Sequence
  Synthetic Polynucleotide
taatacgactcactatagggcgggaccgccgaccccgcgccgcccgcgccaacagaggagaggcgcgatgggcgcggggaacctggcggcagcgcaaaagatg

SEQ ID NO: 98395 - DNA, 103 bp, Artificial Sequence
  Synthetic Polynucleotide
taatacgactcactatagggccgctcgctgaacacagaccgctccagggtaacagaggagaaccctgatgcggtctgtgaacctggcggcagcgcaaaagatg

SEQ ID NO: 98396 - DNA, 103 bp, Artificial Sequence
  Synthetic Polynucleotide
taatacgactcactatagggactcctccgtccgctcgctgaacacagaccaacagaggagaggtctgatgtcagcgagcaacctggcggcagcgcaaaagatg

SEQ ID NO: 98397 - DNA, 103 bp, Artificial Sequence
  Synthetic Polynucleotide
taatacgactcactatagggacggcagaagactcctccgtccgctcgctgaacagaggagacagcgaatggacggaggaaacctggcggcagcgcaaaagatg

SEQ ID NO: 98398 - DNA, 103 bp, Artificial Sequence
  Synthetic Polynucleotide
taatacgactcactataggggaagtactgcacggcagaagactcctccgtaacagaggagaacggagatgtcttctgccaacctggcggcagcgcaaaagatg

SEQ ID NO: 98399 - DNA, 103 bp, Artificial Sequence
  Synthetic Polynucleotide
taatacgactcactatagggcataaaactggaagtactgcacggcagaagaacagaggagacttctgatgtgcagtactaacctggcggcagcgcaaaagatg

SEQ ID NO: 98400 - DNA, 103 bp, Artificial Sequence
  Synthetic Polynucleotide
taatacgactcactataggggacaggtagccataaaactggaagtactgcaacagaggagagcagtaatgccagttttaaacctggcggcagcgcaaaagatg

SEQ ID NO: 98401 - DNA, 103 bp, Artificial Sequence
  Synthetic Polynucleotide
taatacgactcactatagggctgctgctgggacaggtagccataaaactgaacagaggagacagtttatgggctacctgaacctggcggcagcgcaaaagatg

SEQ ID NO: 98402 - DNA, 103 bp, Artificial Sequence
  Synthetic Polynucleotide
taatacgactcactataggggcatcatgttctgctgctgggacaggtagcaacagaggagagctaccatgcccagcagcaacctggcggcagcgcaaaagatg

SEQ ID NO: 98403 - DNA, 103 bp, Artificial Sequence
  Synthetic Polynucleotide
taatacgactcactatagggacgtagtcctgcatcatgttctgctgctggaacagaggagaccagcaatggaacatgataacctggcggcagcgcaaaagatg

SEQ ID NO: 98404 - DNA, 103 bp, Artificial Sequence
  Synthetic Polynucleotide
taatacgactcactataggggcctgtccgcacgtagtcctgcatcatgttaacagaggagaaacatgatgcaggactacaacctggcggcagcgcaaaagatg

SEQ ID NO: 98405 - DNA, 103 bp, Artificial Sequence
  Synthetic Polynucleotide
taatacgactcactatagggccgcgccgcccgggaccgccgaccccgcgcaacagaggagagcgcggatgcggcggtccaacctggcggcagcgcaaaagatg

SEQ ID NO: 98406 - DNA, 103 bp, Artificial Sequence
  Synthetic Polynucleotide
taatacgactcactataggggctggtaggtgcctgtccgcacgtagtcctaacagaggagaaggactatgtgcggacagaacctggcggcagcgcaaaagatg

SEQ ID NO: 98407 - DNA, 103 bp, Artificial Sequence
  Synthetic Polynucleotide
taatacgactcactatagggaggatggcgcgctggtaggtgcctgtccgcaacagaggagagcggacatgcacctaccaaacctggcggcagcgcaaaagatg

SEQ ID NO: 98408 - DNA, 103 bp, Artificial Sequence
  Synthetic Polynucleotide
taatacgactcactataggggtggttttgcaggatggcgcgctggtaggtaacagaggagaacctacatgcgcgccatcaacctggcggcagcgcaaaagatg

SEQ ID NO: 98409 - DNA, 103 bp, Artificial Sequence
  Synthetic Polynucleotide
taatacgactcactatagggtgaagtcggtgtggttttgcaggatggcgcaacagaggagagcgccaatgtgcaaaaccaacctggcggcagcgcaaaagatg

SEQ ID NO: 98410 - DNA, 103 bp, Artificial Sequence
  Synthetic Polynucleotide
taatacgactcactatagggatcttgtccttgaagtcggtgtggttttgcaacagaggagagcaaaaatgcaccgacttaacctggcggcagcgcaaaagatg

SEQ ID NO: 98411 - DNA, 103 bp, Artificial Sequence
  Synthetic Polynucleotide
taatacgactcactatagggatcaagaacgatcttgtccttgaagtcggtaacagaggagaaccgacatgaaggacaagaacctggcggcagcgcaaaagatg

SEQ ID NO: 98412 - DNA, 103 bp, Artificial Sequence
  Synthetic Polynucleotide
taatacgactcactatagggcacagccaacatcaagaacgatcttgtcctaacagaggagaaggacaatgtcgttcttgaacctggcggcagcgcaaaagatg

SEQ ID NO: 98413 - DNA, 103 bp, Artificial Sequence
  Synthetic Polynucleotide
taatacgactcactatagggatcccagagccacagccaacatcaagaacgaacagaggagacgttctatgtgttggctgaacctggcggcagcgcaaaagatg

SEQ ID NO: 98414 - DNA, 103 bp, Artificial Sequence
  Synthetic Polynucleotide
taatacgactcactatagggaaacgacaggatcccagagccacagccaacaacagaggagagttggcatgggctctgggaacctggcggcagcgcaaaagatg

SEQ ID NO: 98415 - DNA, 103 bp, Artificial Sequence
  Synthetic Polynucleotide
taatacgactcactataggggggcggcaaaaaacgacaggatcccagagcaacagaggagagctctgatgtcctgtcgtaacctggcggcagcgcaaaagatg

SEQ ID NO: 98416 - DNA, 103 bp, Artificial Sequence
  Synthetic Polynucleotide
taatacgactcactataggggcgcagggccccgcgccgcccgggaccgccaacagaggagaggcggtatggggcggcgcaacctggcggcagcgcaaaagatg

SEQ ID NO: 98417 - DNA, 103 bp, Artificial Sequence
  Synthetic Polynucleotide
taatacgactcactataggggctccagcttgggcggcaaaaaacgacaggaacagaggagacctgtcatgttttgccgcaacctggcggcagcgcaaaagatg

SEQ ID NO: 98418 - DNA, 103 bp, Artificial Sequence
  Synthetic Polynucleotide
taatacgactcactataggggattttccgtgctccagcttgggcggcaaaaacagaggagatttgccatgcaagctggaaacctggcggcagcgcaaaagatg

SEQ ID NO: 98419 - DNA, 103 bp, Artificial Sequence
  Synthetic Polynucleotide
taatacgactcactatagggccaccgcgtagattttccgtgctccagcttaacagaggagaaagctgatgcacggaaaaaacctggcggcagcgcaaaagatg

SEQ ID NO: 98420 - DNA, 103 bp, Artificial Sequence
  Synthetic Polynucleotide
taatacgactcactataggggtgctggcctccaccgcgtagattttccgtaacagaggagaacggaaatgctacgcggtaacctggcggcagcgcaaaagatg

SEQ ID NO: 98421 - DNA, 103 bp, Artificial Sequence
  Synthetic Polynucleotide
taatacgactcactatagggctgggccatggtgctggcctccaccgcgtaaacagaggagatacgcgatggaggccagcaacctggcggcagcgcaaaagatg

SEQ ID NO: 98422 - DNA, 103 bp, Artificial Sequence
  Synthetic Polynucleotide
taatacgactcactatagggcctcagcgtgctgggccatggtgctggcctaacagaggagaaggccaatgccatggcccaacctggcggcagcgcaaaagatg

SEQ ID NO: 98423 - DNA, 103 bp, Artificial Sequence
  Synthetic Polynucleotide
taatacgactcactatagggttcaccaagacctcagcgtgctgggccatgaacagaggagacatggcatggcacgctgaaacctggcggcagcgcaaaagatg

SEQ ID NO: 98424 - DNA, 103 bp, Artificial Sequence
  Synthetic Polynucleotide
taatacgactcactataggggttgttactcttcaccaagacctcagcgtgaacagaggagacacgctatggtcttggtgaacctggcggcagcgcaaaagatg

SEQ ID NO: 98425 - DNA, 103 bp, Artificial Sequence
  Synthetic Polynucleotide
taatacgactcactatagggggtccgtcaggttgttactcttcaccaagaaacagaggagatcttggatgagagtaacaaacctggcggcagcgcaaaagatg

SEQ ID NO: 98426 - DNA, 103 bp, Artificial Sequence
  Synthetic Polynucleotide
taatacgactcactatagggaccacgatgcggtccgtcaggttgttactcaacagaggagagagtaaatgcctgacggaaacctggcggcagcgcaaaagatg

SEQ ID NO: 98427 - DNA, 103 bp, Artificial Sequence
  Synthetic Polynucleotide
taatacgactcactatagggcgacacggtagcgcagggccccgcgccgccaacagaggagaggcggcatggggccctgcaacctggcggcagcgcaaaagatg

SEQ ID NO: 98428 - DNA, 103 bp, Artificial Sequence
  Synthetic Polynucleotide
taatacgactcactataggggcccgggatgaccacgatgcggtccgtcagaacagaggagactgacgatgcgcatcgtgaacctggcggcagcgcaaaagatg

SEQ ID NO: 98429 - DNA, 103 bp, Artificial Sequence
  Synthetic Polynucleotide
taatacgactcactatagggcctccaccttgcccgggatgaccacgatgcaacagaggagagcatcgatgtcatcccggaacctggcggcagcgcaaaagatg

SEQ ID NO: 98430 - DNA, 103 bp, Artificial Sequence
  Synthetic Polynucleotide
taatacgactcactatagggagtgacacctcctccaccttgcccgggatgaacagaggagacatcccatgcaaggtggaaacctggcggcagcgcaaaagatg

SEQ ID NO: 98431 - DNA, 103 bp, Artificial Sequence
  Synthetic Polynucleotide
taatacgactcactatagggctgctcggggagtgacacctcctccaccttaacagaggagaaaggtgatggaggtgtcaaacctggcggcagcgcaaaagatg

SEQ ID NO: 98432 - DNA, 103 bp, Artificial Sequence
  Synthetic Polynucleotide
taatacgactcactatagggtgatgtccacctgctcggggagtgacacctaacagaggagaaggtgtatgtccccgagcaacctggcggcagcgcaaaagatg

SEQ ID NO: 98433 - DNA, 103 bp, Artificial Sequence
  Synthetic Polynucleotide
taatacgactcactatagggtccgagatgatgatgtccacctgctcggggaacagaggagaccccgaatgggtggacataacctggcggcagcgcaaaagatg

SEQ ID NO: 98434 - DNA, 103 bp, Artificial Sequence
  Synthetic Polynucleotide
taatacgactcactataggggcccatgggctccgagatgatgatgtccacaacagaggagagtggacatgatcatctcgaacctggcggcagcgcaaaagatg

SEQ ID NO: 98435 - DNA, 103 bp, Artificial Sequence
  Synthetic Polynucleotide
taatacgactcactatagggagagcatgtagcccatgggctccgagatgaaacagaggagatcatctatgagcccatggaacctggcggcagcgcaaaagatg

SEQ ID NO: 98436 - DNA, 103 bp, Artificial Sequence
  Synthetic Polynucleotide
taatacgactcactatagggcgctcgttgaagagcatgtagcccatgggcaacagaggagagcccatatgctacatgctaacctggcggcagcgcaaaagatg

SEQ ID NO: 98437 - DNA, 103 bp, Artificial Sequence
  Synthetic Polynucleotide
taatacgactcactatagggctccagcatgcgctcgttgaagagcatgtaaacagaggagatacatgatgttcaacgagaacctggcggcagcgcaaaagatg

SEQ ID NO: 98438 - DNA, 103 bp, Artificial Sequence
  Synthetic Polynucleotide
taatacgactcactatagggcggggaacaccgacacggtagcgcagggccaacagaggagaggccctatgctaccgtgtaacctggcggcagcgcaaaagatg

SEQ ID NO: 98439 - DNA, 103 bp, Artificial Sequence
  Synthetic Polynucleotide
taatacgactcactatagggggaggtagctctccagcatgcgctcgttgaaacagaggagatcaacgatggcatgctggaacctggcggcagcgcaaaagatg

SEQ ID NO: 98440 - DNA, 103 bp, Artificial Sequence
  Synthetic Polynucleotide
taatacgactcactatagggttcttggcgtggaggtagctctccagcatgaacagaggagacatgctatggagctacctaacctggcggcagcgcaaaagatg

SEQ ID NO: 98441 - DNA, 103 bp, Artificial Sequence
  Synthetic Polynucleotide
taatacgactcactatagggcttcaggtacttcttggcgtggaggtagctaacagaggagaagctacatgcacgccaagaacctggcggcagcgcaaaagatg

SEQ ID NO: 98442 - DNA, 103 bp, Artificial Sequence
  Synthetic Polynucleotide
taatacgactcactatagggttccgctgggcttcaggtacttcttggcgtaacagaggagaacgccaatgagtacctgaaacctggcggcagcgcaaaagatg

SEQ ID NO: 98443 - DNA, 103 bp, Artificial Sequence
  Synthetic Polynucleotide
taatacgactcactatagggggaaacatgtttccgctgggcttcaggtacaacagaggagagtacctatggcccagcggaacctggcggcagcgcaaaagatg

SEQ ID NO: 98444 - DNA, 103 bp, Artificial Sequence
  Synthetic Polynucleotide
taatacgactcactatagggaccaatggtaggaaacatgtttccgctgggaacagaggagacccagcatgaacatgtttaacctggcggcagcgcaaaagatg

SEQ ID NO: 98445 - DNA, 103 bp, Artificial Sequence
  Synthetic Polynucleotide
taatacgactcactatagggggtggacgtcaccaatggtaggaaacatgtaacagaggagaacatgtatgctaccattgaacctggcggcagcgcaaaagatg

SEQ ID NO: 98446 - DNA, 103 bp, Artificial Sequence
  Synthetic Polynucleotide
taatacgactcactatagggaagggtgcaaggtggacgtcaccaatggtaaacagaggagataccatatgtgacgtccaaacctggcggcagcgcaaaagatg

SEQ ID NO: 98447 - DNA, 103 bp, Artificial Sequence
  Synthetic Polynucleotide
taatacgactcactatagggttcatccgtgaagggtgcaaggtggacgtcaacagaggagagacgtcatgcttgcacccaacctggcggcagcgcaaaagatg

SEQ ID NO: 98448 - DNA, 103 bp, Artificial Sequence
  Synthetic Polynucleotide
taatacgactcactatagggtgtagagctgttcatccgtgaagggtgcaaaacagaggagattgcacatgtcacggatgaacctggcggcagcgcaaaagatg

SEQ ID NO: 98449 - DNA, 103 bp, Artificial Sequence
  Synthetic Polynucleotide
taatacgactcactatagggaggcgggcgccggggaacaccgacacggtaaacagaggagataccgtatgggtgttcccaacctggcggcagcgcaaaagatg

SEQ ID NO: 98450 - DNA, 103 bp, Artificial Sequence
  Synthetic Polynucleotide
taatacgactcactatagggaactgctccatgtagagctgttcatccgtgaacagaggagacacggaatgacagctctaaacctggcggcagcgcaaaagatg

SEQ ID NO: 98451 - DNA, 103 bp, Artificial Sequence
  Synthetic Polynucleotide
taatacgactcactatagggggccttggtgaactgctccatgtagagctgaacagaggagacagctcatgatggagcagaacctggcggcagcgcaaaagatg

SEQ ID NO: 98452 - DNA, 103 bp, Artificial Sequence
  Synthetic Polynucleotide
taatacgactcactatagggaccagaagttggccttggtgaactgctccaaacagaggagatggagcatgtcaccaaggaacctggcggcagcgcaaaagatg

SEQ ID NO: 98453 - DNA, 103 bp, Artificial Sequence
  Synthetic Polynucleotide
taatacgactcactataggggatggctggtaccagaagttggccttggtgaacagaggagacaccaaatgcaacttctgaacctggcggcagcgcaaaagatg

SEQ ID NO: 98454 - DNA, 103 bp, Artificial Sequence
  Synthetic Polynucleotide
taatacgactcactatagggtccatggaaagatggctggtaccagaagttaacagaggagaaacttcatgtaccagccaaacctggcggcagcgcaaaagatg

SEQ ID NO: 98455 - DNA, 103 bp, Artificial Sequence
  Synthetic Polynucleotide
taatacgactcactatagggacaggtccactccatggaaagatggctggtaacagaggagaaccagcatgctttccatgaacctggcggcagcgcaaaagatg

SEQ ID NO: 98456 - DNA, 103 bp, Artificial Sequence
  Synthetic Polynucleotide
taatacgactcactatagggcggagggccgacaggtccactccatggaaaaacagaggagatttccaatgagtggacctaacctggcggcagcgcaaaagatg

SEQ ID NO: 98457 - DNA, 103 bp, Artificial Sequence
  Synthetic Polynucleotide
taatacgactcactatagggcgcggcacctcggagggccgacaggtccacaacagaggagagtggacatgtcggccctcaacctggcggcagcgcaaaagatg

SEQ ID NO: 98458 - DNA, 103 bp, Artificial Sequence
  Synthetic Polynucleotide
taatacgactcactatagggactcatccaccgcggcacctcggagggccgaacagaggagacggcccatggaggtgccgaacctggcggcagcgcaaaagatg

SEQ ID NO: 98459 - DNA, 103 bp, Artificial Sequence
  Synthetic Polynucleotide
taatacgactcactatagggtgccggaaatactcatccaccgcggcacctaacagaggagaaggtgcatgggtggatgaaacctggcggcagcgcaaaagatg

SEQ ID NO: 98460 - DNA, 103 bp, Artificial Sequence
  Synthetic Polynucleotide
taatacgactcactataggggacgtgctcgccaacagctggcagctccataacagaggagaatggagatgccagctgttaacctggcggcagcgcaaaagatg

SEQ ID NO: 98461 - DNA, 103 bp, Artificial Sequence
  Synthetic Polynucleotide
taatacgactcactataggggttatatttgggcgaccagcctctccatttaacagaggagaaaatggatgggctggtcgaacctggcggcagcgcaaaagatg

SEQ ID NO: 98462 - DNA, 103 bp, Artificial Sequence
  Synthetic Polynucleotide
taatacgactcactataggggggctgcggatcgctaaccccggacacctcaacagaggagagaggtgatgggggttagcaacctggcggcagcgcaaaagatg

SEQ ID NO: 98463 - DNA, 103 bp, Artificial Sequence
  Synthetic Polynucleotide
taatacgactcactatagggcggcatcctggggctgcggatcgctaacccaacagaggagagggttaatgatccgcagcaacctggcggcagcgcaaaagatg

SEQ ID NO: 98464 - DNA, 103 bp, Artificial Sequence
  Synthetic Polynucleotide
taatacgactcactatagggttgcgggagccggcatcctggggctgcggaaacagaggagatccgcaatgccaggatgcaacctggcggcagcgcaaaagatg

SEQ ID NO: 98465 - DNA, 103 bp, Artificial Sequence
  Synthetic Polynucleotide
taatacgactcactatagggcggggacagcttgcgggagccggcatcctgaacagaggagacaggatatgggctcccgcaacctggcggcagcgcaaaagatg

SEQ ID NO: 98466 - DNA, 103 bp, Artificial Sequence
  Synthetic Polynucleotide
taatacgactcactatagggcctccttggtcggggacagcttgcgggagcaacagaggagagctcccatgagctgtcccaacctggcggcagcgcaaaagatg

SEQ ID NO: 98467 - DNA, 103 bp, Artificial Sequence
  Synthetic Polynucleotide
taatacgactcactatagggtctccaaaggcctccttggtcggggacagcaacagaggagagctgtcatggaccaaggaaacctggcggcagcgcaaaagatg

SEQ ID NO: 98468 - DNA, 103 bp, Artificial Sequence
  Synthetic Polynucleotide
taatacgactcactatagggcaggggctgctctccaaaggcctccttggtaacagaggagaaccaagatggcctttggaaacctggcggcagcgcaaaagatg

SEQ ID NO: 98469 - DNA, 103 bp, Artificial Sequence
  Synthetic Polynucleotide
taatacgactcactatagggtggtgagctgcaggggctgctctccaaaggaacagaggagacctttgatgagcagccccaacctggcggcagcgcaaaagatg

SEQ ID NO: 98470 - DNA, 103 bp, Artificial Sequence
  Synthetic Polynucleotide
taatacgactcactatagggtcgggcttggtggtgagctgcaggggctgcaacagaggagagcagccatggcagctcacaacctggcggcagcgcaaaagatg

SEQ ID NO: 98471 - DNA, 103 bp, Artificial Sequence
  Synthetic Polynucleotide
taatacgactcactatagggggcaagcaggtcgggcttggtggtgagctgaacagaggagacagctcatgaccaagcccaacctggcggcagcgcaaaagatg

SEQ ID NO: 98472 - DNA, 103 bp, Artificial Sequence
  Synthetic Polynucleotide
taatacgactcactataggggttcccacgtgttatatttgggcgaccagcaacagaggagagctggtatgccaaatataaacctggcggcagcgcaaaagatg

SEQ ID NO: 98473 - DNA, 103 bp, Artificial Sequence
  Synthetic Polynucleotide
taatacgactcactatagggccgggtcccaggcaagcaggtcgggcttggaacagaggagaccaagcatgacctgcttgaacctggcggcagcgcaaaagatg

SEQ ID NO: 98474 - DNA, 103 bp, Artificial Sequence
  Synthetic Polynucleotide
taatacgactcactataggggtgttccgggccgggtcccaggcaagcaggaacagaggagacctgctatgctgggacccaacctggcggcagcgcaaaagatg

SEQ ID NO: 98475 - DNA, 103 bp, Artificial Sequence
  Synthetic Polynucleotide
taatacgactcactataggggggcgggtgcgtgttccgggccgggtcccaaacagaggagatgggacatggcccggaacaacctggcggcagcgcaaaagatg

SEQ ID NO: 98476 - DNA, 103 bp, Artificial Sequence
  Synthetic Polynucleotide
taatacgactcactatagggggtggtgtgagggcgggtgcgtgttccgggaacagaggagacccggaatgcgcacccgcaacctggcggcagcgcaaaagatg

SEQ ID NO: 98477 - DNA, 103 bp, Artificial Sequence
  Synthetic Polynucleotide
taatacgactcactatagggtgcgggtgcgggtggtgtgagggcgggtgcaacagaggagagcacccatgctcacaccaaacctggcggcagcgcaaaagatg

SEQ ID NO: 98478 - DNA, 103 bp, Artificial Sequence
  Synthetic Polynucleotide
taatacgactcactataggggtgatgggggtgcgggtgcgggtggtgtgaaacagaggagatcacacatgccgcacccgaacctggcggcagcgcaaaagatg

SEQ ID NO: 98479 - DNA, 103 bp, Artificial Sequence
  Synthetic Polynucleotide
taatacgactcactatagggggtggtggtggtgatgggggtgcgggtgcgaacagaggagacgcaccatgacccccatcaacctggcggcagcgcaaaagatg

SEQ ID NO: 98480 - DNA, 103 bp, Artificial Sequence
  Synthetic Polynucleotide
taatacgactcactatagggtggtggtggtggtggtggtggtgatgggggaacagaggagacccccaatgccaccaccaaacctggcggcagcgcaaaagatg

SEQ ID NO: 98481 - DNA, 103 bp, Artificial Sequence
  Synthetic Polynucleotide
taatacgactcactataggggtggtggtggtggtggtggtggtggtggtgaacagaggagacaccacatgcaccaccacaacctggcggcagcgcaaaagatg

SEQ ID NO: 98482 - DNA, 103 bp, Artificial Sequence
  Synthetic Polynucleotide
taatacgactcactatagggggccgacggcgtggtggtggtggtggtggtaacagaggagaaccaccatgaccaccaccaacctggcggcagcgcaaaagatg

SEQ ID NO: 98483 - DNA, 103 bp, Artificial Sequence
  Synthetic Polynucleotide
taatacgactcactatagggttctcctccggttcccacgtgttatatttgaacagaggagacaaataatgcacgtgggaaacctggcggcagcgcaaaagatg

SEQ ID NO: 98484 - DNA, 103 bp, Artificial Sequence
  Synthetic Polynucleotide
taatacgactcactataggggagagattcaggccgacggcgtggtggtggaacagaggagaccaccaatgcgccgtcggaacctggcggcagcgcaaaagatg

SEQ ID NO: 98485 - DNA, 103 bp, Artificial Sequence
  Synthetic Polynucleotide
taatacgactcactataggggcgcacgtgggagagattcaggccgacggcaacagaggagagccgtcatgctgaatctcaacctggcggcagcgcaaaagatg

SEQ ID NO: 98486 - DNA, 103 bp, Artificial Sequence
  Synthetic Polynucleotide
taatacgactcactatagggggcagcgcttgcgcacgtgggagagattcaaacagaggagatgaatcatgcccacgtgcaacctggcggcagcgcaaaagatg

SEQ ID NO: 98487 - DNA, 103 bp, Artificial Sequence
  Synthetic Polynucleotide
taatacgactcactataggggtctcggagaggcagcgcttgcgcacgtggaacagaggagaccacgtatgcaagcgctgaacctggcggcagcgcaaaagatg

SEQ ID NO: 98488 - DNA, 103 bp, Artificial Sequence
  Synthetic Polynucleotide
taatacgactcactatagggctcgccgtgggtctcggagaggcagcgcttaacagaggagaaagcgcatgctctccgagaacctggcggcagcgcaaaagatg

SEQ ID NO: 98489 - DNA, 103 bp, Artificial Sequence
  Synthetic Polynucleotide
taatacgactcactatagggagggctcgcgctcgccgtgggtctcggagaaacagaggagatctccgatgcccacggcgaacctggcggcagcgcaaaagatg

SEQ ID NO: 98490 - DNA, 103 bp, Artificial Sequence
  Synthetic Polynucleotide
taatacgactcactatagggcgcttcttgcagggctcgcgctcgccgtggaacagaggagaccacggatggcgcgagccaacctggcggcagcgcaaaagatg

SEQ ID NO: 98491 - DNA, 103 bp, Artificial Sequence
  Synthetic Polynucleotide
taatacgactcactatagggcgcagtcagccgcttcttgcagggctcgcgaacagaggagacgcgagatgtgcaagaagaacctggcggcagcgcaaaagatg

SEQ ID NO: 98492 - DNA, 103 bp, Artificial Sequence
  Synthetic Polynucleotide
taatacgactcactatagggtgatgctgcgcgcagtcagccgcttcttgcaacagaggagagcaagaatgggctgactgaacctggcggcagcgcaaaagatg

SEQ ID NO: 98493 - DNA, 103 bp, Artificial Sequence
  Synthetic Polynucleotide
taatacgactcactataggggtgggggtgctgatgctgcgcgcagtcagcaacagaggagagctgacatggcgcagcataacctggcggcagcgcaaaagatg

SEQ ID NO: 98494 - DNA, 103 bp, Artificial Sequence
  Synthetic Polynucleotide
taatacgactcactataggggtccaggatgttctcctccggttcccacgtaacagaggagaacgtggatgccggaggagaacctggcggcagcgcaaaagatg

SEQ ID NO: 98495 - DNA, 103 bp, Artificial Sequence
  Synthetic Polynucleotide
taatacgactcactatagggccccaggcaggtgggggtgctgatgctgcgaacagaggagacgcagcatgagcacccccaacctggcggcagcgcaaaagatg

SEQ ID NO: 98496 - DNA, 103 bp, Artificial Sequence
  Synthetic Polynucleotide
taatacgactcactatagggctgggctgccccccaggcaggtgggggtgcaacagaggagagcacccatgcctgcctggaacctggcggcagcgcaaaagatg

SEQ ID NO: 98497 - DNA, 103 bp, Artificial Sequence
  Synthetic Polynucleotide
taatacgactcactatagggcgctcagcggctgggctgccccccaggcagaacagaggagactgcctatggggcagcccaacctggcggcagcgcaaaagatg

SEQ ID NO: 98498 - DNA, 103 bp, Artificial Sequence
  Synthetic Polynucleotide
taatacgactcactataggggtcggccgggcgctcagcggctgggctgccaacagaggagaggcagcatggccgctgagaacctggcggcagcgcaaaagatg

SEQ ID NO: 98499 - DNA, 103 bp, Artificial Sequence
  Synthetic Polynucleotide
taatacgactcactatagggctggtggcaggtcggccgggcgctcagcggaacagaggagaccgctgatggcccggccgaacctggcggcagcgcaaaagatg

SEQ ID NO: 98500 - DNA, 103 bp, Artificial Sequence
  Synthetic Polynucleotide
taatacgactcactatagggagggcggcggctggtggcaggtcggccgggaacagaggagacccggcatgcctgccaccaacctggcggcagcgcaaaagatg

SEQ ID NO: 98501 - DNA, 103 bp, Artificial Sequence
  Synthetic Polynucleotide
taatacgactcactataggggggctgcgggagggcggcggctggtggcagaacagaggagactgccaatggccgccgccaacctggcggcagcgcaaaagatg

SEQ ID NO: 98502 - DNA, 103 bp, Artificial Sequence
  Synthetic Polynucleotide
taatacgactcactatagggggatgacctcgggctgcgggagggcggcggaacagaggagaccgccgatgtcccgcagcaacctggcggcagcgcaaaagatg

SEQ ID NO: 98503 - DNA, 103 bp, Artificial Sequence
  Synthetic Polynucleotide
taatacgactcactataggggagtctagcaggatgacctcgggctgcgggaacagaggagacccgcaatgcgaggtcataacctggcggcagcgcaaaagatg

SEQ ID NO: 98504 - DNA, 103 bp, Artificial Sequence
  Synthetic Polynucleotide
taatacgactcactatagggatccaggtctgagtctagcaggatgacctcaacagaggagagaggtcatgctgctagacaacctggcggcagcgcaaaagatg

SEQ ID NO: 98505 - DNA, 103 bp, Artificial Sequence
  Synthetic Polynucleotide
taatacgactcactataggggcagcctggggtccaggatgttctcctccgaacagaggagacggaggatgacatcctggaacctggcggcagcgcaaaagatg

SEQ ID NO: 98506 - DNA, 103 bp, Artificial Sequence
  Synthetic Polynucleotide
taatacgactcactatagggctatgggttcatccaggtctgagtctagcaaacagaggagatgctagatgcagacctggaacctggcggcagcgcaaaagatg

SEQ ID NO: 98507 - DNA, 103 bp, Artificial Sequence
  Synthetic Polynucleotide
taatacgactcactatagggcagcgcaagtctatgggttcatccaggtctaacagaggagaagacctatgtgaacccataacctggcggcagcgcaaaagatg

SEQ ID NO: 98508 - DNA, 103 bp, Artificial Sequence
  Synthetic Polynucleotide
taatacgactcactatagggcgtcttgacgcagcgcaagtctatgggttcaacagaggagagaacccatggacttgcgcaacctggcggcagcgcaaaagatg

SEQ ID NO: 98509 - DNA, 103 bp, Artificial Sequence
  Synthetic Polynucleotide
taatacgactcactatagggcctcgctgcgcgtcttgacgcagcgcaagtaacagaggagaacttgcatggcgtcaagaaacctggcggcagcgcaaaagatg

SEQ ID NO: 98510 - DNA, 103 bp, Artificial Sequence
  Synthetic Polynucleotide
taatacgactcactatagggggctccccggcctcgctgcgcgtcttgacgaacagaggagacgtcaaatggcgcagcgaaacctggcggcagcgcaaaagatg

SEQ ID NO: 98511 - DNA, 103 bp, Artificial Sequence
  Synthetic Polynucleotide
taatacgactcactatagggggagctgggcggctccccggcctcgctgcgaacagaggagacgcagcatggccggggagaacctggcggcagcgcaaaagatg

SEQ ID NO: 98512 - DNA, 103 bp, Artificial Sequence
  Synthetic Polynucleotide
taatacgactcactatagggtcacctggagggagctgggcggctccccggaacagaggagaccggggatgcgcccagctaacctggcggcagcgcaaaagatg

SEQ ID NO: 98513 - DNA, 103 bp, Artificial Sequence
  Synthetic Polynucleotide
taatacgactcactataggggtctcgggcttcacctggagggagctgggcaacagaggagagcccagatgcctccaggtaacctggcggcagcgcaaaagatg

SEQ ID NO: 98514 - DNA, 103 bp, Artificial Sequence
  Synthetic Polynucleotide
taatacgactcactatagggcgacgccggtgtctcgggcttcacctggagaacagaggagactccagatgaagcccgagaacctggcggcagcgcaaaagatg

SEQ ID NO: 98515 - DNA, 103 bp, Artificial Sequence
  Synthetic Polynucleotide
taatacgactcactatagggccaccgccgccgacgccggtgtctcgggctaacagaggagaagcccgatgcaccggcgtaacctggcggcagcgcaaaagatg

SEQ ID NO: 98516 - DNA, 103 bp, Artificial Sequence
  Synthetic Polynucleotide
taatacgactcactatagggaaggcgatcagcagcctggggtccaggatgaacagaggagacatcctatgccccaggctaacctggcggcagcgcaaaagatg

SEQ ID NO: 98517 - DNA, 103 bp, Artificial Sequence
  Synthetic Polynucleotide
taatacgactcactataggggccgccaccgccaccgccgccgacgccggtaacagaggagaaccggcatgggcggcggtaacctggcggcagcgcaaaagatg

SEQ ID NO: 98518 - DNA, 103 bp, Artificial Sequence
  Synthetic Polynucleotide
taatacgactcactatagggtgccgctgccgccgccaccgccaccgccgcaacagaggagagcggcgatggcggtggcgaacctggcggcagcgcaaaagatg

SEQ ID NO: 98519 - DNA, 103 bp, Artificial Sequence
  Synthetic Polynucleotide
taatacgactcactatagggtcgtggtgggtgccgctgccgccgccaccgaacagaggagacggtggatgcggcagcggaacctggcggcagcgcaaaagatg

SEQ ID NO: 98520 - DNA, 103 bp, Artificial Sequence
  Synthetic Polynucleotide
taatacgactcactatagggttctccgccgtcgtggtgggtgccgctgccaacagaggagaggcagcatgacccaccacaacctggcggcagcgcaaaagatg

SEQ ID NO: 98521 - DNA, 103 bp, Artificial Sequence
  Synthetic Polynucleotide
taatacgactcactatagggggctggaggcttctccgccgtcgtggtgggaacagaggagacccaccatgacggcggagaacctggcggcagcgcaaaagatg

SEQ ID NO: 98522 - DNA, 103 bp, Artificial Sequence
  Synthetic Polynucleotide
taatacgactcactatagggcctgggcctcggctggaggcttctccgccgaacagaggagacggcggatgagcctccagaacctggcggcagcgcaaaagatg

SEQ ID NO: 98523 - DNA, 103 bp, Artificial Sequence
  Synthetic Polynucleotide
taatacgactcactataggggcaggttcgtcctgggcctcggctggaggcaacagaggagagcctccatgcgaggcccaaacctggcggcagcgcaaaagatg

SEQ ID NO: 98524 - DNA, 103 bp, Artificial Sequence
  Synthetic Polynucleotide
taatacgactcactatagggcagcgactctgcaggttcgtcctgggcctcaacagaggagagaggccatggacgaacctaacctggcggcagcgcaaaagatg

SEQ ID NO: 98525 - DNA, 103 bp, Artificial Sequence
  Synthetic Polynucleotide
taatacgactcactatagggtgaactcgctcagcgactctgcaggttcgtaacagaggagaacgaacatgcagagtcgcaacctggcggcagcgcaaaagatg

SEQ ID NO: 98526 - DNA, 103 bp, Artificial Sequence
  Synthetic Polynucleotide
taatacgactcactatagggaagaagggcttgaactcgctcagcgactctaacagaggagaagagtcatggagcgagttaacctggcggcagcgcaaaagatg

SEQ ID NO: 98527 - DNA, 103 bp, Artificial Sequence
  Synthetic Polynucleotide
taatacgactcactatagggcctgttctggaaggcgatcagcagcctgggaacagaggagacccaggatgctgatcgccaacctggcggcagcgcaaaagatg

SEQ ID NO: 98528 - DNA, 103 bp, Artificial Sequence
  Synthetic Polynucleotide
taatacgactcactatagggtatattcccaaagaagggcttgaactcgctaacagaggagaagcgagatgaagcccttcaacctggcggcagcgcaaaagatg

SEQ ID NO: 98529 - DNA, 103 bp, Artificial Sequence
  Synthetic Polynucleotide
taatacgactcactatagggcggtgataattatattcccaaagaagggctaacagaggagaagccctatgttgggaataaacctggcggcagcgcaaaagatg

SEQ ID NO: 98530 - DNA, 103 bp, Artificial Sequence
  Synthetic Polynucleotide
taatacgactcactataggggcggtgacgtcggtgataattatattcccaaacagaggagatgggaaatgaattatcacaacctggcggcagcgcaaaagatg

SEQ ID NO: 98531 - DNA, 103 bp, Artificial Sequence
  Synthetic Polynucleotide
taatacgactcactataggggaggcagttcgcggtgacgtcggtgataataacagaggagaattatcatggacgtcaccaacctggcggcagcgcaaaagatg

SEQ ID NO: 98532 - DNA, 103 bp, Artificial Sequence
  Synthetic Polynucleotide
taatacgactcactatagggaagtaacggtgaggcagttcgcggtgacgtaacagaggagaacgtcaatgcgaactgccaacctggcggcagcgcaaaagatg

SEQ ID NO: 98533 - DNA, 103 bp, Artificial Sequence
  Synthetic Polynucleotide
taatacgactcactatagggtactccttgaaagtaacggtgaggcagttcaacagaggagagaactgatgcaccgttacaacctggcggcagcgcaaaagatg

SEQ ID NO: 98534 - DNA, 103 bp, Artificial Sequence
  Synthetic Polynucleotide
taatacgactcactatagggcaccgtcacgtactccttgaaagtaacggtaacagaggagaaccgttatgttcaaggagaacctggcggcagcgcaaaagatg

SEQ ID NO: 98535 - DNA, 103 bp, Artificial Sequence
  Synthetic Polynucleotide
taatacgactcactatagggcctgccgttccctgttctggaaggcgatcaaacagaggagatgatcgatgtccagaacaaacctggcggcagcgcaaaagatg

SEQ ID NO: 98536 - DNA, 103 bp, Artificial Sequence
  Synthetic Polynucleotide
taatacgactcactatagggatcagctgctcctgccgttccctgttctggaacagaggagaccagaaatgggaacggcaaacctggcggcagcgcaaaagatg

SEQ ID NO: 98537 - DNA, 103 bp, Artificial Sequence
  Synthetic Polynucleotide
taatacgactcactatagggccgatatcccatcagctgctcctgccgttcaacagaggagagaacggatggagcagctgaacctggcggcagcgcaaaagatg

SEQ ID NO: 98538 - DNA, 103 bp, Artificial Sequence
  Synthetic Polynucleotide
taatacgactcactatagggccaccgcgaagacgtgctcgccaacagctgaacagaggagacagctgatggcgagcacgaacctggcggcagcgcaaaagatg

SEQ ID NO: 98539 - DNA, 103 bp, Artificial Sequence
  Synthetic Polynucleotide
taatacgactcactataggggccctctcttccgatatcccatcagctgctaacagaggagaagcagcatgtgggatatcaacctggcggcagcgcaaaagatg

SEQ ID NO: 98540 - DNA, 103 bp, Artificial Sequence
  Synthetic Polynucleotide
taatacgactcactatagggttgggcttcggccctctcttccgatatcccaacagaggagagggataatggaagagaggaacctggcggcagcgcaaaagatg

SEQ ID NO: 98541 - DNA, 103 bp, Artificial Sequence
  Synthetic Polynucleotide
taatacgactcactatagggcactagcggtttgggcttcggccctctcttaacagaggagaaagagaatgccgaagcccaacctggcggcagcgcaaaagatg

SEQ ID NO: 98542 - DNA, 103 bp, Artificial Sequence
  Synthetic Polynucleotide
taatacgactcactataggggcacctgcaccactagcggtttgggcttcgaacagaggagacgaagcatgaaccgctagaacctggcggcagcgcaaaagatg

SEQ ID NO: 98543 - DNA, 103 bp, Artificial Sequence
  Synthetic Polynucleotide
taatacgactcactataggggcaaaggtaggcacctgcaccactagcggtaacagaggagaaccgctatgggtgcaggtaacctggcggcagcgcaaaagatg

SEQ ID NO: 98544 - DNA, 103 bp, Artificial Sequence
  Synthetic Polynucleotide
taatacgactcactatagggggaacgacgggcaaaggtaggcacctgcacaacagaggagagtgcagatgcctacctttaacctggcggcagcgcaaaagatg

SEQ ID NO: 98545 - DNA, 103 bp, Artificial Sequence
  Synthetic Polynucleotide
taatacgactcactatagggtcaggacattggaacgacgggcaaaggtagaacagaggagactacctatgcccgtcgttaacctggcggcagcgcaaaagatg

SEQ ID NO: 98546 - DNA, 103 bp, Artificial Sequence
  Synthetic Polynucleotide
taatacgactcactatagggtggaggccggtcaggacattggaacgacggaacagaggagaccgtcgatgcaatgtcctaacctggcggcagcgcaaaagatg

SEQ ID NO: 98547 - DNA, 103 bp, Artificial Sequence
  Synthetic Polynucleotide
taatacgactcactatagggggaggagtcctggaggccggtcaggacattaacagaggagaaatgtcatgaccggcctcaacctggcggcagcgcaaaagatg

SEQ ID NO: 98548 - DNA, 103 bp, Artificial Sequence
  Synthetic Polynucleotide
taatacgactcactatagggggttgtcagtggaggagtcctggaggccggaacagaggagaccggccatgaggactcctaacctggcggcagcgcaaaagatg

SEQ ID NO: 98549 - DNA, 103 bp, Artificial Sequence
  Synthetic Polynucleotide
taatacgactcactatagggtcgatgctctccaccgcgaagacgtgctcgaacagaggagacgagcaatgcttcgcggtaacctggcggcagcgcaaaagatg

SEQ ID NO: 98550 - DNA, 103 bp, Artificial Sequence
  Synthetic Polynucleotide
taatacgactcactatagggagcttggcacggttgtcagtggaggagtccaacagaggagaggactcatgcactgacaaaacctggcggcagcgcaaaagatg

SEQ ID NO: 98551 - DNA, 103 bp, Artificial Sequence
  Synthetic Polynucleotide
taatacgactcactataggggcccaaatccagcttggcacggttgtcagtaacagaggagaactgacatgcgtgccaagaacctggcggcagcgcaaaagatg

SEQ ID NO: 98552 - DNA, 103 bp, Artificial Sequence
  Synthetic Polynucleotide
taatacgactcactatagggtcccctgcgcgcccaaatccagcttggcacaacagaggagagtgccaatgtggatttggaacctggcggcagcgcaaaagatg

SEQ ID NO: 98553 - DNA, 103 bp, Artificial Sequence
  Synthetic Polynucleotide
taatacgactcactatagggccctggcccttcccctgcgcgcccaaatccaacagaggagaggatttatgcgcgcagggaacctggcggcagcgcaaaagatg

SEQ ID NO: 98554 - DNA, 103 bp, Artificial Sequence
  Synthetic Polynucleotide
taatacgactcactataggggtactgatgcccctggcccttcccctgcgcaacagaggagagcgcagatgaagggccagaacctggcggcagcgcaaaagatg

SEQ ID NO: 98555 - DNA, 103 bp, Artificial Sequence
  Synthetic Polynucleotide
taatacgactcactatagggtgttgagctcgtactgatgcccctggccctaacagaggagaagggccatgggcatcagtaacctggcggcagcgcaaaagatg

SEQ ID NO: 98556 - DNA, 103 bp, Artificial Sequence
  Synthetic Polynucleotide
taatacgactcactatagggtgcttcttgctgttgagctcgtactgatgcaacagaggagagcatcaatgcgagctcaaaacctggcggcagcgcaaaagatg

SEQ ID NO: 98557 - DNA, 103 bp, Artificial Sequence
  Synthetic Polynucleotide
taatacgactcactataggggtactggtggtgcttcttgctgttgagctcaacagaggagagagctcatgagcaagaagaacctggcggcagcgcaaaagatg

SEQ ID NO: 98558 - DNA, 103 bp, Artificial Sequence
  Synthetic Polynucleotide
taatacgactcactatagggtgtgcggctggtactggtggtgcttcttgcaacagaggagagcaagaatgaccaccagtaacctggcggcagcgcaaaagatg

SEQ ID NO: 98559 - DNA, 103 bp, Artificial Sequence
  Synthetic Polynucleotide
taatacgactcactatagggcgctccttgctgtgcggctggtactggtggaacagaggagaccaccaatgccagccgcaaacctggcggcagcgcaaaagatg

SEQ ID NO: 98560 - DNA, 103 bp, Artificial Sequence
  Synthetic Polynucleotide
taatacgactcactatagggccgcttcttctcgatgctctccaccgcgaaaacagaggagattcgcgatggagagcatcaacctggcggcagcgcaaaagatg

SEQ ID NO: 98561 - DNA, 103 bp, Artificial Sequence
  Synthetic Polynucleotide
taatacgactcactatagggcttgcccgcccgctccttgctgtgcggctgaacagaggagacagccgatgagcaaggagaacctggcggcagcgcaaaagatg

SEQ ID NO: 98562 - DNA, 103 bp, Artificial Sequence
  Synthetic Polynucleotide
taatacgactcactataggggcggcgggggcttgcccgcccgctccttgcaacagaggagagcaaggatggggcgggcaaacctggcggcagcgcaaaagatg

SEQ ID NO: 98563 - DNA, 103 bp, Artificial Sequence
  Synthetic Polynucleotide
taatacgactcactatagggctcttgcccggcggcgggggcttgcccgccaacagaggagaggcgggatggcccccgccaacctggcggcagcgcaaaagatg

SEQ ID NO: 98564 - DNA, 103 bp, Artificial Sequence
  Synthetic Polynucleotide
taatacgactcactataggggtacttgccgctcttgcccggcggcgggggaacagaggagacccccgatgccgggcaagaacctggcggcagcgcaaaagatg

SEQ ID NO: 98565 - DNA, 103 bp, Artificial Sequence
  Synthetic Polynucleotide
taatacgactcactataggggctggtagtagtacttgccgctcttgcccgaacagaggagacgggcaatggcggcaagtaacctggcggcagcgcaaaagatg

SEQ ID NO: 98566 - DNA, 103 bp, Artificial Sequence
  Synthetic Polynucleotide
taatacgactcactatagggttgctgttgagctggtagtagtacttgccgaacagaggagacggcaaatgctactaccaaacctggcggcagcgcaaaagatg

SEQ ID NO: 98567 - DNA, 103 bp, Artificial Sequence
  Synthetic Polynucleotide
taatacgactcactataggggtggtgcttcttgctgttgagctggtagtaaacagaggagatactacatgctcaacagcaacctggcggcagcgcaaaagatg

SEQ ID NO: 98568 - DNA, 103 bp, Artificial Sequence
  Synthetic Polynucleotide
taatacgactcactataggggctggtaggggtggtgcttcttgctgttgaaacagaggagatcaacaatgagaagcaccaacctggcggcagcgcaaaagatg

SEQ ID NO: 98569 - DNA, 103 bp, Artificial Sequence
  Synthetic Polynucleotide
taatacgactcactatagggttggggtcgggctggtaggggtggtgcttcaacagaggagagaagcaatgcccctaccaaacctggcggcagcgcaaaagatg

SEQ ID NO: 98570 - DNA, 103 bp, Artificial Sequence
  Synthetic Polynucleotide
taatacgactcactataggggtcgtacattttggggtcgggctggtagggaacagaggagaccctacatgcccgaccccaacctggcggcagcgcaaaagatg

SEQ ID NO: 98571 - DNA, 103 bp, Artificial Sequence
  Synthetic Polynucleotide
taatacgactcactatagggccttgcggatccgcttcttctcgatgctctaacagaggagaagagcaatgagaagaagcaacctggcggcagcgcaaaagatg

SEQ ID NO: 98572 - DNA, 103 bp, Artificial Sequence
  Synthetic Polynucleotide
taatacgactcactatagggggtactgcaggtcgtacattttggggtcggaacagaggagaccgaccatgaaatgtacgaacctggcggcagcgcaaaagatg

SEQ ID NO: 98573 - DNA, 103 bp, Artificial Sequence
  Synthetic Polynucleotide
taatacgactcactatagggtggccgccctggtactgcaggtcgtacattaacagaggagaaatgtaatgcctgcagtaaacctggcggcagcgcaaaagatg

SEQ ID NO: 98574 - DNA, 103 bp, Artificial Sequence
  Synthetic Polynucleotide
taatacgactcactatagggcgcctccttgtggccgccctggtactgcagaacagaggagactgcagatgcagggcggcaacctggcggcagcgcaaaagatg

SEQ ID NO: 98575 - DNA, 103 bp, Artificial Sequence
  Synthetic Polynucleotide
taatacgactcactatagggtggggctgggcgcctccttgtggccgccctaacagaggagaagggcgatgacaaggaggaacctggcggcagcgcaaaagatg

SEQ ID NO: 98576 - DNA, 103 bp, Artificial Sequence
  Synthetic Polynucleotide
taatacgactcactatagggtccgggcaggtggggctgggcgcctccttgaacagaggagacaaggaatggcccagcccaacctggcggcagcgcaaaagatg

SEQ ID NO: 98577 - DNA, 103 bp, Artificial Sequence
  Synthetic Polynucleotide
taatacgactcactatagggggcccccaggtccgggcaggtggggctgggaacagaggagacccagcatgacctgcccgaacctggcggcagcgcaaaagatg

SEQ ID NO: 98578 - DNA, 103 bp, Artificial Sequence
  Synthetic Polynucleotide
taatacgactcactatagggggtggctcttggcccccaggtccgggcaggaacagaggagacctgccatgacctgggggaacctggcggcagcgcaaaagatg

SEQ ID NO: 98579 - DNA, 103 bp, Artificial Sequence
  Synthetic Polynucleotide
taatacgactcactatagggttgtcgggcgggtggctcttggcccccaggaacagaggagacctgggatgcaagagccaaacctggcggcagcgcaaaagatg

SEQ ID NO: 98580 - DNA, 103 bp, Artificial Sequence
  Synthetic Polynucleotide
taatacgactcactatagggttgcgcccacttgtcgggcgggtggctcttaacagaggagaaagagcatgccgcccgacaacctggcggcagcgcaaaagatg

SEQ ID NO: 98581 - DNA, 103 bp, Artificial Sequence
  Synthetic Polynucleotide
taatacgactcactatagggcccccgcaccttgcgcccacttgtcgggcgaacagaggagacgcccgatgagtgggcgcaacctggcggcagcgcaaaagatg

SEQ ID NO: 98582 - DNA, 103 bp, Artificial Sequence
  Synthetic Polynucleotide
taatacgactcactatagggtccactctgcccttgcggatccgcttcttcaacagaggagagaagaaatggatccgcaaaacctggcggcagcgcaaaagatg

SEQ ID NO: 98583 - DNA, 103 bp, Artificial Sequence
  Synthetic Polynucleotide
taatacgactcactatagggtagcctttggcccccgcaccttgcgcccacaacagaggagagtgggcatgaggtgcgggaacctggcggcagcgcaaaagatg

SEQ ID NO: 98584 - DNA, 103 bp, Artificial Sequence
  Synthetic Polynucleotide
taatacgactcactatagggcgcccccaggtagcctttggcccccgcaccaacagaggagaggtgcgatggccaaaggcaacctggcggcagcgcaaaagatg

SEQ ID NO: 98585 - DNA, 103 bp, Artificial Sequence
  Synthetic Polynucleotide
taatacgactcactatagggggggcttcaccgcccccaggtagcctttggaacagaggagaccaaagatgacctgggggaacctggcggcagcgcaaaagatg

SEQ ID NO: 98586 - DNA, 103 bp, Artificial Sequence
  Synthetic Polynucleotide
taatacgactcactataggggcaccggccaggggcttcaccgcccccaggaacagaggagacctgggatgggtgaagccaacctggcggcagcgcaaaagatg

SEQ ID NO: 98587 - DNA, 103 bp, Artificial Sequence
  Synthetic Polynucleotide
taatacgactcactatagggagcacccgccgcaccggccaggggcttcacaacagaggagagtgaagatgctggccggtaacctggcggcagcgcaaaagatg

SEQ ID NO: 98588 - DNA, 103 bp, Artificial Sequence
  Synthetic Polynucleotide
taatacgactcactatagggctttgcctggagcacccgccgcaccggccaaacagaggagatggccgatgcggcgggtgaacctggcggcagcgcaaaagatg

SEQ ID NO: 98589 - DNA, 103 bp, Artificial Sequence
  Synthetic Polynucleotide
taatacgactcactatagggttctcggagcctttgcctggagcacccgccaacagaggagaggcgggatgtccaggcaaaacctggcggcagcgcaaaagatg

SEQ ID NO: 98590 - DNA, 103 bp, Artificial Sequence
  Synthetic Polynucleotide
taatacgactcactataggggggggggcccttctcggagcctttgcctggaacagaggagaccaggcatgggctccgagaacctggcggcagcgcaaaagatg

SEQ ID NO: 98591 - DNA, 103 bp, Artificial Sequence
  Synthetic Polynucleotide
taatacgactcactatagggtcattccgttgggggggcccttctcggagcaacagaggagagctccgatgagggcccccaacctggcggcagcgcaaaagatg

SEQ ID NO: 98592 - DNA, 103 bp, Artificial Sequence
  Synthetic Polynucleotide
taatacgactcactatagggggggccggcatcattccgttgggggggcccaacagaggagagggcccatgcaacggaataacctggcggcagcgcaaaagatg

SEQ ID NO: 98593 - DNA, 103 bp, Artificial Sequence
  Synthetic Polynucleotide
taatacgactcactatagggcaccagatactccactctgcccttgcggataacagaggagaatccgcatgggcagagtgaacctggcggcagcgcaaaagatg

SEQ ID NO: 98594 - DNA, 103 bp, Artificial Sequence
  Synthetic Polynucleotide
taatacgactcactatagggagcctctttgggggccggcatcattccgttaacagaggagaaacggaatgatgccggccaacctggcggcagcgcaaaagatg

SEQ ID NO: 98595 - DNA, 103 bp, Artificial Sequence
  Synthetic Polynucleotide
taatacgactcactatagggtgcccgtcacagcctctttgggggccggcaaacagaggagatgccggatgccaaagaggaacctggcggcagcgcaaaagatg

SEQ ID NO: 98596 - DNA, 103 bp, Artificial Sequence
  Synthetic Polynucleotide
taatacgactcactatagggccaatcccgttgcccgtcacagcctctttgaacagaggagacaaagaatgtgtgacgggaacctggcggcagcgcaaaagatg

SEQ ID NO: 98597 - DNA, 103 bp, Artificial Sequence
  Synthetic Polynucleotide
taatacgactcactatagggcatcttgcccccaatcccgttgcccgtcacaacagaggagagtgacgatgaacgggattaacctggcggcagcgcaaaagatg

SEQ ID NO: 98598 - DNA, 103 bp, Artificial Sequence
  Synthetic Polynucleotide
taatacgactcactatagggtgactatcttcatcttgcccccaatcccgtaacagaggagaacgggaatgggggcaagaaacctggcggcagcgcaaaagatg

SEQ ID NO: 98599 - DNA, 103 bp, Artificial Sequence
  Synthetic Polynucleotide
taatacgactcactatagggttcttgttcttgactatcttcatcttgcccaacagaggagagggcaaatggaagatagtaacctggcggcagcgcaaaagatg

SEQ ID NO: 98600 - DNA, 103 bp, Artificial Sequence
  Synthetic Polynucleotide
taatacgactcactatagggtccgttcttgttcttgttcttgactatcttaacagaggagaaagataatgaagaacaagaacctggcggcagcgcaaaagatg

SEQ ID NO: 98601 - DNA, 103 bp, Artificial Sequence
  Synthetic Polynucleotide
taatacgactcactatagggtcacgatgcgtccgttcttgttcttgttctaacagaggagaagaacaatgacaagaacgaacctggcggcagcgcaaaagatg

SEQ ID NO: 98602 - DNA, 103 bp, Artificial Sequence
  Synthetic Polynucleotide
taatacgactcactatagggctcatcacgatcacgatgcgtccgttcttgaacagaggagacaagaaatgacgcatcgtaacctggcggcagcgcaaaagatg

SEQ ID NO: 98603 - DNA, 103 bp, Artificial Sequence
  Synthetic Polynucleotide
taatacgactcactatagggcatgtatttgctcatcacgatcacgatgcgaacagaggagacgcatcatgatcgtgatgaacctggcggcagcgcaaaagatg

SEQ ID NO: 98604 - DNA, 103 bp, Artificial Sequence
  Synthetic Polynucleotide
taatacgactcactatagggctctccatttcaccagatactccactctgcaacagaggagagcagagatgagtatctggaacctggcggcagcgcaaaagatg

SEQ ID NO: 98605 - DNA, 103 bp, Artificial Sequence
  Synthetic Polynucleotide
taatacgactcactatagggtgccgttctccatgtatttgctcatcacgaaacagaggagatcgtgaatggcaaatacaaacctggcggcagcgcaaaagatg

SEQ ID NO: 98606 - DNA, 103 bp, Artificial Sequence
  Synthetic Polynucleotide
taatacgactcactatagggaccgcctgcatgccgttctccatgtatttgaacagaggagacaaataatgggagaacggaacctggcggcagcgcaaaagatg

SEQ ID NO: 98607 - DNA, 103 bp, Artificial Sequence
  Synthetic Polynucleotide
taatacgactcactatagggcttgatcttcaccgcctgcatgccgttctcaacagaggagagagaacatgatgcaggcgaacctggcggcagcgcaaaagatg

SEQ ID NO: 98608 - DNA, 103 bp, Artificial Sequence
  Synthetic Polynucleotide
taatacgactcactatagggcctcgccggacttgatcttcaccgcctgcaaacagaggagatgcaggatgtgaagatcaaacctggcggcagcgcaaaagatg

SEQ ID NO: 98609 - DNA, 103 bp, Artificial Sequence
  Synthetic Polynucleotide
taatacgactcactatagggccctctgccacctcgccggacttgatcttcaacagaggagagaagatatggtccggcgaaacctggcggcagcgcaaaagatg

SEQ ID NO: 98610 - DNA, 103 bp, Artificial Sequence
  Synthetic Polynucleotide
taatacgactcactataggggcgagcctccccctctgccacctcgccggaaacagaggagatccggcatggtggcagagaacctggcggcagcgcaaaagatg

SEQ ID NO: 98611 - DNA, 103 bp, Artificial Sequence
  Synthetic Polynucleotide
taatacgactcactatagggggctgggggagcgagcctccccctctgccaaacagaggagatggcagatggggaggctcaacctggcggcagcgcaaaagatg

SEQ ID NO: 98612 - DNA, 103 bp, Artificial Sequence
  Synthetic Polynucleotide
taatacgactcactatagggcgcttcttgtggctgggggagcgagcctccaacagaggagaggaggcatgctcccccagaacctggcggcagcgcaaaagatg

SEQ ID NO: 98613 - DNA, 103 bp, Artificial Sequence
  Synthetic Polynucleotide
taatacgactcactataggggtcggctgcccgcttcttgtggctgggggaaacagaggagatcccccatgcacaagaagaacctggcggcagcgcaaaagatg

SEQ ID NO: 98614 - DNA, 103 bp, Artificial Sequence
  Synthetic Polynucleotide
taatacgactcactatagggggtggcgctcgtcggctgcccgcttcttgtaacagaggagaacaagaatggggcagccgaacctggcggcagcgcaaaagatg

SEQ ID NO: 98615 - DNA, 103 bp, Artificial Sequence
  Synthetic Polynucleotide
taatacgactcactatagggggcgaccagcctctccatttcaccagatacaacagaggagagtatctatggaaatggagaacctggcggcagcgcaaaagatg

SEQ ID NO: 98616 - DNA, 103 bp, Artificial Sequence
  Synthetic Polynucleotide
taatacgactcactatagggtcggcaggagggtggcgctcgtcggctgccaacagaggagaggcagcatgcgagcgccaaacctggcggcagcgcaaaagatg

SEQ ID NO: 98617 - DNA, 103 bp, Artificial Sequence
  Synthetic Polynucleotide
taatacgactcactatagggaaaagtcctgtcggcaggagggtggcgctcaacagaggagagagcgcatgcctcctgccaacctggcggcagcgcaaaagatg

SEQ ID NO: 98618 - DNA, 103 bp, Artificial Sequence
  Synthetic Polynucleotide
taatacgactcactatagggccgcctttttaaaagtcctgtcggcaggagaacagaggagactcctgatgacaggacttaacctggcggcagcgcaaaagatg

SEQ ID NO: 98619 - DNA, 103 bp, Artificial Sequence
  Synthetic Polynucleotide
taatacgactcactatagggtctgcgcccgccgcctttttaaaagtcctgaacagaggagacaggacatgtaaaaaggcaacctggcggcagcgcaaaagatg

SEQ ID NO: 98620 - DNA, 103 bp, Artificial Sequence
  Synthetic Polynucleotide
taatacgactcactatagggcttcttctcctctgcgcccgccgcctttttaacagaggagaaaaaagatggcgggcgcaaacctggcggcagcgcaaaagatg

SEQ ID NO: 98621 - DNA, 103 bp, Artificial Sequence
  Synthetic Polynucleotide
taatacgactcactataggggcgcctccaccttcttctcctctgcgcccgaacagaggagacgggcgatgaggagaagaaacctggcggcagcgcaaaagatg

SEQ ID NO: 98622 - DNA, 103 bp, Artificial Sequence
  Synthetic Polynucleotide
taatacgactcactatagggctcttgggcggcgcctccaccttcttctccaacagaggagaggagaaatgggtggaggcaacctggcggcagcgcaaaagatg

SEQ ID NO: 98623 - DNA, 103 bp, Artificial Sequence
  Synthetic Polynucleotide
taatacgactcactatagggctcctccctcctcttgggcggcgcctccacaacagaggagagtggagatgccgcccaagaacctggcggcagcgcaaaagatg

SEQ ID NO: 98624 - DNA, 103 bp, Artificial Sequence
  Synthetic Polynucleotide
taatacgactcactatagggcggacacctcctcctccctcctcttgggcgaacagaggagacgcccaatgggagggaggaacctggcggcagcgcaaaagatg

SEQ ID NO: 98625 - DNA, 103 bp, Artificial Sequence
  Synthetic Polynucleotide
taatacgactcactatagggtcgctaaccccggacacctcctcctccctcaacagaggagagagggaatgggaggtgtcaacctggcggcagcgcaaaagatg

SEQ ID NO: 98626 - DNA, 103 bp, Artificial Sequence
  Synthetic Polynucleotide
taatacgactcactataggggggtcccgggggtcctttcctcttgtgcataacagaggagaatgcacatgaggaaaggaaacctggcggcagcgcaaaagatg

SEQ ID NO: 98627 - DNA, 103 bp, Artificial Sequence
  Synthetic Polynucleotide
taatacgactcactataggggttagccccgtcctcagggatcatcaggccaacagaggagaggcctgatgatccctgagaacctggcggcagcgcaaaagatg

SEQ ID NO: 98628 - DNA, 103 bp, Artificial Sequence
  Synthetic Polynucleotide
taatacgactcactatagggctctgttgtggagggcgccgtagcgggggtaacagaggagaacccccatgacggcgcccaacctggcggcagcgcaaaagatg

SEQ ID NO: 98629 - DNA, 103 bp, Artificial Sequence
  Synthetic Polynucleotide
taatacgactcactataggggtgggggcacctctgttgtggagggcgccgaacagaggagacggcgcatgccacaacagaacctggcggcagcgcaaaagatg

SEQ ID NO: 98630 - DNA, 103 bp, Artificial Sequence
  Synthetic Polynucleotide
taatacgactcactataggggtcctcgggggtgggggcacctctgttgtgaacagaggagacacaacatgggtgcccccaacctggcggcagcgcaaaagatg

SEQ ID NO: 98631 - DNA, 103 bp, Artificial Sequence
  Synthetic Polynucleotide
taatacgactcactatagggctccagcagggtcctcgggggtgggggcacaacagaggagagtgcccatgcccccgaggaacctggcggcagcgcaaaagatg

SEQ ID NO: 98632 - DNA, 103 bp, Artificial Sequence
  Synthetic Polynucleotide
taatacgactcactataggggctccagcgcctccagcagggtcctcggggaacagaggagaccccgaatgccctgctggaacctggcggcagcgcaaaagatg

SEQ ID NO: 98633 - DNA, 103 bp, Artificial Sequence
  Synthetic Polynucleotide
taatacgactcactatagggtccatccgctgctccagcgcctccagcaggaacagaggagacctgctatgggcgctggaaacctggcggcagcgcaaaagatg

SEQ ID NO: 98634 - DNA, 103 bp, Artificial Sequence
  Synthetic Polynucleotide
taatacgactcactatagggctggtaccgctccatccgctgctccagcgcaacagaggagagcgctgatgcagcggatgaacctggcggcagcgcaaaagatg

SEQ ID NO: 98635 - DNA, 103 bp, Artificial Sequence
  Synthetic Polynucleotide
taatacgactcactatagggctgcggccacctggtaccgctccatccgctaacagaggagaagcggaatgagcggtaccaacctggcggcagcgcaaaagatg

SEQ ID NO: 98636 - DNA, 103 bp, Artificial Sequence
  Synthetic Polynucleotide
taatacgactcactatagggttggcctgggctgcggccacctggtaccgcaacagaggagagcggtaatgggtggccgcaacctggcggcagcgcaaaagatg

SEQ ID NO: 98637 - DNA, 103 bp, Artificial Sequence
  Synthetic Polynucleotide
taatacgactcactatagggccccttgctcttggcctgggctgcggccacaacagaggagagtggccatggcccaggccaacctggcggcagcgcaaaagatg

SEQ ID NO: 98638 - DNA, 103 bp, Artificial Sequence
  Synthetic Polynucleotide
taatacgactcactataggggttcttcatcgttagccccgtcctcagggaaacagaggagatccctgatgacggggctaaacctggcggcagcgcaaaagatg

SEQ ID NO: 98639 - DNA, 103 bp, Artificial Sequence
  Synthetic Polynucleotide
taatacgactcactatagggtccgctggtcccccttgctcttggcctgggaacagaggagacccaggatgagagcaaggaacctggcggcagcgcaaaagatg

SEQ ID NO: 98640 - DNA, 103 bp, Artificial Sequence
  Synthetic Polynucleotide
taatacgactcactatagggattcgagctttccgctggtcccccttgctcaacagaggagagagcaaatgggaccagcgaacctggcggcagcgcaaaagatg

SEQ ID NO: 98641 - DNA, 103 bp, Artificial Sequence
  Synthetic Polynucleotide
taatacgactcactataggggcgctcgtgcattcgagctttccgctggtcaacagaggagagaccagatgaaagctcgaaacctggcggcagcgcaaaagatg

SEQ ID NO: 98642 - DNA, 103 bp, Artificial Sequence
  Synthetic Polynucleotide
taatacgactcactataggggcttgacgatgcgctcgtgcattcgagcttaacagaggagaaagctcatgtgcacgagcaacctggcggcagcgcaaaagatg

SEQ ID NO: 98643 - DNA, 103 bp, Artificial Sequence
  Synthetic Polynucleotide
taatacgactcactatagggtcttggtattgcttgacgatgcgctcgtgcaacagaggagagcacgaatgcatcgtcaaaacctggcggcagcgcaaaagatg

SEQ ID NO: 98644 - DNA, 103 bp, Artificial Sequence
  Synthetic Polynucleotide
taatacgactcactatagggtcggatggcatcttggtattgcttgacgataacagaggagaatcgtcatgcaataccaaaacctggcggcagcgcaaaagatg

SEQ ID NO: 98645 - DNA, 103 bp, Artificial Sequence
  Synthetic Polynucleotide
taatacgactcactatagggccttgtgggctcggatggcatcttggtattaacagaggagaaataccatgatgccatccaacctggcggcagcgcaaaagatg

SEQ ID NO: 98646 - DNA, 103 bp, Artificial Sequence
  Synthetic Polynucleotide
taatacgactcactataggggctcggccagccttgtgggctcggatggcaaacagaggagatgccatatgagcccacaaaacctggcggcagcgcaaaagatg

SEQ ID NO: 98647 - DNA, 103 bp, Artificial Sequence
  Synthetic Polynucleotide
taatacgactcactataggggacatccacggctcggccagccttgtgggcaacagaggagagcccacatggctggccgaaacctggcggcagcgcaaaagatg

SEQ ID NO: 98648 - DNA, 103 bp, Artificial Sequence
  Synthetic Polynucleotide
taatacgactcactataggggcaattcagcgacatccacggctcggccagaacagaggagactggccatgccgtggatgaacctggcggcagcgcaaaagatg

SEQ ID NO: 98649 - DNA, 103 bp, Artificial Sequence
  Synthetic Polynucleotide
taatacgactcactatagggtcagcctccagttcttcatcgttagccccgaacagaggagacggggcatgcgatgaagaaacctggcggcagcgcaaaagatg

SEQ ID NO: 98650 - DNA, 103 bp, Artificial Sequence
  Synthetic Polynucleotide
taatacgactcactataggggggggcacgggcaattcagcgacatccacgaacagaggagacgtggaatgcgctgaattaacctggcggcagcgcaaaagatg

SEQ ID NO: 98651 - DNA, 103 bp, Artificial Sequence
  Synthetic Polynucleotide
taatacgactcactatagggggggaagcctgggggcacgggcaattcagcaacagaggagagctgaaatgcccgtgcccaacctggcggcagcgcaaaagatg

SEQ ID NO: 98652 - DNA, 103 bp, Artificial Sequence
  Synthetic Polynucleotide
taatacgactcactatagggcctggattggggggaagcctgggggcacggaacagaggagaccgtgcatgcaggcttccaacctggcggcagcgcaaaagatg

SEQ ID NO: 98653 - DNA, 103 bp, Artificial Sequence
  Synthetic Polynucleotide
taatacgactcactataggggcctccaggccctggattggggggaagcctaacagaggagaaggcttatgcccaatccaaacctggcggcagcgcaaaagatg

SEQ ID NO: 98654 - DNA, 103 bp, Artificial Sequence
  Synthetic Polynucleotide
taatacgactcactataggggggcttggtggcctccaggccctggattggaacagaggagaccaatcatgggcctggagaacctggcggcagcgcaaaagatg

SEQ ID NO: 98655 - DNA, 103 bp, Artificial Sequence
  Synthetic Polynucleotide
taatacgactcactatagggtctgctgggtgggcttggtggcctccaggcaacagaggagagcctggatgccaccaagcaacctggcggcagcgcaaaagatg

SEQ ID NO: 98656 - DNA, 103 bp, Artificial Sequence
  Synthetic Polynucleotide
taatacgactcactatagggcccaccagactctgctgggtgggcttggtgaacagaggagacaccaaatgcacccagcaaacctggcggcagcgcaaaagatg

SEQ ID NO: 98657 - DNA, 103 bp, Artificial Sequence
  Synthetic Polynucleotide
taatacgactcactatagggctccaggacacccaccagactctgctgggtaacagaggagaacccagatgagtctggtgaacctggcggcagcgcaaaagatg

SEQ ID NO: 98658 - DNA, 103 bp, Artificial Sequence
  Synthetic Polynucleotide
taatacgactcactatagggtcatggcagtctccaggacacccaccagacaacagaggagagtctggatggtgtcctggaacctggcggcagcgcaaaagatg

SEQ ID NO: 98659 - DNA, 103 bp, Artificial Sequence
  Synthetic Polynucleotide
taatacgactcactatagggttggccagcttcatggcagtctccaggacaaacagaggagatgtcctatggactgccataacctggcggcagcgcaaaagatg

SEQ ID NO: 98660 - DNA, 103 bp, Artificial Sequence
  Synthetic Polynucleotide
taatacgactcactatagggagccaagaactcagcctccagttcttcatcaacagaggagagatgaaatgctggaggctaacctggcggcagcgcaaaagatg

SEQ ID NO: 98661 - DNA, 103 bp, Artificial Sequence
  Synthetic Polynucleotide
taatacgactcactatagggttcatcctggttggccagcttcatggcagtaacagaggagaactgccatgaagctggccaacctggcggcagcgcaaaagatg

SEQ ID NO: 98662 - DNA, 103 bp, Artificial Sequence
  Synthetic Polynucleotide
taatacgactcactatagggcctctgggccttcatcctggttggccagctaacagaggagaagctggatgaccaggatgaacctggcggcagcgcaaaagatg

SEQ ID NO: 98663 - DNA, 103 bp, Artificial Sequence
  Synthetic Polynucleotide
taatacgactcactatagggtcctcttcatcctctgggccttcatcctggaacagaggagaccaggaatgaggcccagaaacctggcggcagcgcaaaagatg

SEQ ID NO: 98664 - DNA, 103 bp, Artificial Sequence
  Synthetic Polynucleotide
taatacgactcactatagggaggcacctcatcctcttcatcctctgggccaacagaggagaggcccaatggatgaagagaacctggcggcagcgcaaaagatg

SEQ ID NO: 98665 - DNA, 103 bp, Artificial Sequence
  Synthetic Polynucleotide
taatacgactcactatagggtctgcttcttaggcacctcatcctcttcataacagaggagaatgaagatgatgaggtgcaacctggcggcagcgcaaaagatg

SEQ ID NO: 98666 - DNA, 103 bp, Artificial Sequence
  Synthetic Polynucleotide
taatacgactcactatagggacagggctgttctgcttcttaggcacctcaaacagaggagatgaggtatgtaagaagcaaacctggcggcagcgcaaaagatg

SEQ ID NO: 98667 - DNA, 103 bp, Artificial Sequence
  Synthetic Polynucleotide
taatacgactcactatagggtgtgggggccacagggctgttctgcttcttaacagaggagaaagaagatgaacagccctaacctggcggcagcgcaaaagatg

SEQ ID NO: 98668 - DNA, 103 bp, Artificial Sequence
  Synthetic Polynucleotide
taatacgactcactatagggtgggctgggctgtgggggccacagggctgtaacagaggagaacagccatgtggcccccaaacctggcggcagcgcaaaagatg

SEQ ID NO: 98669 - DNA, 103 bp, Artificial Sequence
  Synthetic Polynucleotide
taatacgactcactatagggggtggggctttgggctgggctgtgggggccaacagaggagaggccccatgagcccagccaacctggcggcagcgcaaaagatg

SEQ ID NO: 98670 - DNA, 103 bp, Artificial Sequence
  Synthetic Polynucleotide
taatacgactcactatagggagttcttgagggtggggctttgggctgggcaacagaggagagcccagatgaaagccccaaacctggcggcagcgcaaaagatg

SEQ ID NO: 98671 - DNA, 103 bp, Artificial Sequence
  Synthetic Polynucleotide
taatacgactcactatagggccccgaccaaagccaagaactcagcctccaaacagaggagatggaggatgagttcttggaacctggcggcagcgcaaaagatg

SEQ ID NO: 98672 - DNA, 103 bp, Artificial Sequence
  Synthetic Polynucleotide
taatacgactcactatagggccgactggggagttcttgagggtggggcttaacagaggagaaagcccatgcctcaagaaaacctggcggcagcgcaaaagatg

SEQ ID NO: 98673 - DNA, 103 bp, Artificial Sequence
  Synthetic Polynucleotide
taatacgactcactatagggggggctgatcccgactggggagttcttgagaacagaggagactcaagatgtccccagtcaacctggcggcagcgcaaaagatg

SEQ ID NO: 98674 - DNA, 103 bp, Artificial Sequence
  Synthetic Polynucleotide
taatacgactcactatagggtttggctgttggggctgatcccgactggggaacagaggagaccccagatgggatcagccaacctggcggcagcgcaaaagatg

SEQ ID NO: 98675 - DNA, 103 bp, Artificial Sequence
  Synthetic Polynucleotide
taatacgactcactatagggtggggggcgctttggctgttggggctgatcaacagaggagagatcagatgcaacagccaaacctggcggcagcgcaaaagatg

SEQ ID NO: 98676 - DNA, 103 bp, Artificial Sequence
  Synthetic Polynucleotide
taatacgactcactataggggatgtggctttggggggcgctttggctgttaacagaggagaaacagcatgagcgcccccaacctggcggcagcgcaaaagatg

SEQ ID NO: 98677 - DNA, 103 bp, Artificial Sequence
  Synthetic Polynucleotide
taatacgactcactatagggggctctggtggatgtggctttggggggcgcaacagaggagagcgcccatgaaagccacaaacctggcggcagcgcaaaagatg

SEQ ID NO: 98678 - DNA, 103 bp, Artificial Sequence
  Synthetic Polynucleotide
taatacgactcactataggggctgctgctgggctctggtggatgtggcttaacagaggagaaagccaatgccaccagagaacctggcggcagcgcaaaagatg

SEQ ID NO: 98679 - DNA, 103 bp, Artificial Sequence
  Synthetic Polynucleotide
taatacgactcactatagggaggaaggccagctgctgctgggctctggtgaacagaggagacaccagatgccagcagcaaacctggcggcagcgcaaaagatg

SEQ ID NO: 98680 - DNA, 103 bp, Artificial Sequence
  Synthetic Polynucleotide
taatacgactcactataggggcggccctctaggaaggccagctgctgctgaacagaggagacagcagatgctggccttcaacctggcggcagcgcaaaagatg

SEQ ID NO: 98681 - DNA, 103 bp, Artificial Sequence
  Synthetic Polynucleotide
taatacgactcactataggggctgcttcttgcggccctctaggaaggccaaacagaggagatggcctatgtagagggccaacctggcggcagcgcaaaagatg

SEQ ID NO: 98682 - DNA, 103 bp, Artificial Sequence
  Synthetic Polynucleotide
taatacgactcactataggggggggctggcccccgaccaaagccaagaacaacagaggagagttcttatgtttggtcggaacctggcggcagcgcaaaagatg

SEQ ID NO: 98683 - DNA, 103 bp, Artificial Sequence
  Synthetic Polynucleotide
taatacgactcactataggggcctgcaggagctgcttcttgcggccctctaacagaggagaagagggatgcaagaagcaaacctggcggcagcgcaaaagatg

SEQ ID NO: 98684 - DNA, 103 bp, Artificial Sequence
  Synthetic Polynucleotide
taatacgactcactatagggtcgcagtgcggcctgcaggagctgcttcttaacagaggagaaagaagatgctcctgcagaacctggcggcagcgcaaaagatg

SEQ ID NO: 98685 - DNA, 103 bp, Artificial Sequence
  Synthetic Polynucleotide
taatacgactcactatagggtctgcttggctcgcagtgcggcctgcaggaaacagaggagatcctgcatgccgcactgcaacctggcggcagcgcaaaagatg

SEQ ID NO: 98686 - DNA, 103 bp, Artificial Sequence
  Synthetic Polynucleotide
taatacgactcactatagggacgtcgtttttctgcttggctcgcagtgcgaacagaggagacgcactatgagccaagcaaacctggcggcagcgcaaaagatg

SEQ ID NO: 98687 - DNA, 103 bp, Artificial Sequence
  Synthetic Polynucleotide
taatacgactcactatagggggcaccctccacgtcgtttttctgcttggcaacagaggagagccaagatgaaaaacgacaacctggcggcagcgcaaaagatg

SEQ ID NO: 98688 - DNA, 103 bp, Artificial Sequence
  Synthetic Polynucleotide
taatacgactcactatagggggtgcatcttggcaccctccacgtcgttttaacagaggagaaaaacgatgtggagggtgaacctggcggcagcgcaaaagatg

SEQ ID NO: 98689 - DNA, 103 bp, Artificial Sequence
  Synthetic Polynucleotide
taatacgactcactataggggcttggcgcaggtgcatcttggcaccctccaacagaggagaggagggatgcaagatgcaaacctggcggcagcgcaaaagatg

SEQ ID NO: 98690 - DNA, 103 bp, Artificial Sequence
  Synthetic Polynucleotide
taatacgactcactatagggcagtcccttggcttggcgcaggtgcatcttaacagaggagaaagatgatgctgcgccaaaacctggcggcagcgcaaaagatg

SEQ ID NO: 98691 - DNA, 103 bp, Artificial Sequence
  Synthetic Polynucleotide
taatacgactcactataggggcataggctccagtcccttggcttggcgcaaacagaggagatgcgccatgccaagggacaacctggcggcagcgcaaaagatg

SEQ ID NO: 98692 - DNA, 103 bp, Artificial Sequence
  Synthetic Polynucleotide
taatacgactcactataggggaggcctccagcataggctccagtcccttgaacagaggagacaagggatgggagcctataacctggcggcagcgcaaaagatg

SEQ ID NO: 98693 - DNA, 103 bp, Artificial Sequence
  Synthetic Polynucleotide
taatacgactcactatagggctccagggctgggggctggcccccgaccaaaacagaggagattggtcatgggccagcccaacctggcggcagcgcaaaagatg

SEQ ID NO: 98694 - DNA, 103 bp, Artificial Sequence
  Synthetic Polynucleotide
taatacgactcactatagggcccattgcgcgaggcctccagcataggctcaacagaggagagagcctatgctggaggccaacctggcggcagcgcaaaagatg

SEQ ID NO: 98695 - DNA, 103 bp, Artificial Sequence
  Synthetic Polynucleotide
taatacgactcactatagggccacaggcagcccattgcgcgaggcctccaaacagaggagatggaggatgcgcgcaatgaacctggcggcagcgcaaaagatg

SEQ ID NO: 98696 - DNA, 103 bp, Artificial Sequence
  Synthetic Polynucleotide
taatacgactcactatagggttggtgatgtccacaggcagcccattgcgcaacagaggagagcgcaaatggctgcctgtaacctggcggcagcgcaaaagatg

SEQ ID NO: 98697 - DNA, 103 bp, Artificial Sequence
  Synthetic Polynucleotide
taatacgactcactatagggaggcggcaccttggtgatgtccacaggcagaacagaggagactgcctatggacatcaccaacctggcggcagcgcaaaagatg

SEQ ID NO: 98698 - DNA, 103 bp, Artificial Sequence
  Synthetic Polynucleotide
taatacgactcactatagggtgacaggggcaggcggcaccttggtgatgtaacagaggagaacatcaatgaggtgccgcaacctggcggcagcgcaaaagatg

SEQ ID NO: 98699 - DNA, 103 bp, Artificial Sequence
  Synthetic Polynucleotide
taatacgactcactatagggtcgtccttgttgacaggggcaggcggcaccaacagaggagaggtgccatgtgcccctgtaacctggcggcagcgcaaaagatg

SEQ ID NO: 98700 - DNA, 103 bp, Artificial Sequence
  Synthetic Polynucleotide
taatacgactcactatagggcagggcaaagtcgtccttgttgacaggggcaacagaggagagcccctatgaacaaggacaacctggcggcagcgcaaaagatg

SEQ ID NO: 98701 - DNA, 103 bp, Artificial Sequence
  Synthetic Polynucleotide
taatacgactcactataggggccgctggaccagggcaaagtcgtccttgtaacagaggagaacaaggatgactttgcccaacctggcggcagcgcaaaagatg

SEQ ID NO: 98702 - DNA, 103 bp, Artificial Sequence
  Synthetic Polynucleotide
taatacgactcactatagggcccgggccaggccgctggaccagggcaaagaacagaggagactttgcatgggtccagcgaacctggcggcagcgcaaaagatg

SEQ ID NO: 98703 - DNA, 103 bp, Artificial Sequence
  Synthetic Polynucleotide
taatacgactcactatagggctgagacagacccgggccaggccgctggacaacagaggagagtccagatgcctggcccgaacctggcggcagcgcaaaagatg

SEQ ID NO: 98704 - DNA, 103 bp, Artificial Sequence
  Synthetic Polynucleotide
taatacgactcactatagggctttgagcttctccagggctgggggctggcaacagaggagagccagcatgcagccctggaacctggcggcagcgcaaaagatg

SEQ ID NO: 98705 - DNA, 103 bp, Artificial Sequence
  Synthetic Polynucleotide
taatacgactcactataggggggcggcctcctgagacagacccgggccagaacagaggagactggccatggtctgtctcaacctggcggcagcgcaaaagatg

SEQ ID NO: 98706 - DNA, 103 bp, Artificial Sequence
  Synthetic Polynucleotide
taatacgactcactatagggccatagcgccgggcggcctcctgagacagaaacagaggagatctgtcatgggaggccgcaacctggcggcagcgcaaaagatg

SEQ ID NO: 98707 - DNA, 103 bp, Artificial Sequence
  Synthetic Polynucleotide
taatacgactcactatagggggtgagttcaccatagcgccgggcggcctcaacagaggagagaggccatgcggcgctataacctggcggcagcgcaaaagatg

SEQ ID NO: 98708 - DNA, 103 bp, Artificial Sequence
  Synthetic Polynucleotide
taatacgactcactataggggtatgagcttggtgagttcaccatagcgccaacagaggagaggcgctatggtgaactcaaacctggcggcagcgcaaaagatg

SEQ ID NO: 98709 - DNA, 103 bp, Artificial Sequence
  Synthetic Polynucleotide
taatacgactcactatagggtgctgctgccgtatgagcttggtgagttcaaacagaggagatgaactatgcaagctcataacctggcggcagcgcaaaagatg

SEQ ID NO: 98710 - DNA, 103 bp, Artificial Sequence
  Synthetic Polynucleotide
taatacgactcactataggggcacatctcgtgctgctgccgtatgagcttaacagaggagaaagctcatgcggcagcagaacctggcggcagcgcaaaagatg

SEQ ID NO: 98711 - DNA, 103 bp, Artificial Sequence
  Synthetic Polynucleotide
taatacgactcactatagggagtggttcaggcacatctcgtgctgctgccaacagaggagaggcagcatgacgagatgtaacctggcggcagcgcaaaagatg

SEQ ID NO: 98712 - DNA, 103 bp, Artificial Sequence
  Synthetic Polynucleotide
taatacgactcactatagggaattggtttgagtggttcaggcacatctcgaacagaggagacgagatatgcctgaaccaaacctggcggcagcgcaaaagatg

SEQ ID NO: 98713 - DNA, 103 bp, Artificial Sequence
  Synthetic Polynucleotide
taatacgactcactatagggcagctgggtgaattggtttgagtggttcagaacagaggagactgaacatgtcaaaccaaaacctggcggcagcgcaaaagatg

SEQ ID NO: 98714 - DNA, 103 bp, Artificial Sequence
  Synthetic Polynucleotide
taatacgactcactatagggtgatgttgcccagctgggtgaattggtttgaacagaggagacaaaccatgtcacccagcaacctggcggcagcgcaaaagatg

SEQ ID NO: 98715 - DNA, 103 bp, Artificial Sequence
  Synthetic Polynucleotide
taatacgactcactatagggggacctttgcctttgagcttctccagggctaacagaggagaagccctatggaagctcaaaacctggcggcagcgcaaaagatg

SEQ ID NO: 98716 - DNA, 103 bp, Artificial Sequence
  Synthetic Polynucleotide
taatacgactcactataggggtggtttcagtgatgttgcccagctgggtgaacagaggagacacccaatggggcaacataacctggcggcagcgcaaaagatg

SEQ ID NO: 98717 - DNA, 103 bp, Artificial Sequence
  Synthetic Polynucleotide
taatacgactcactatagggttcaaacttggtggtttcagtgatgttgccaacagaggagaggcaacatgactgaaaccaacctggcggcagcgcaaaagatg

SEQ ID NO: 98718 - DNA, 103 bp, Artificial Sequence
  Synthetic Polynucleotide
taatacgactcactatagggccgccaacttttcaaacttggtggtttcagaacagaggagactgaaaatgccaagtttgaacctggcggcagcgcaaaagatg

SEQ ID NO: 98719 - DNA, 103 bp, Artificial Sequence
  Synthetic Polynucleotide
taatacgactcactatagggttacagtcctccgccaacttttcaaacttgaacagaggagacaagttatgaaagttggcaacctggcggcagcgcaaaagatg

SEQ ID NO: 98720 - DNA, 103 bp, Artificial Sequence
  Synthetic Polynucleotide
taatacgactcactatagggcatgctccgcttacagtcctccgccaacttaacagaggagaaagttgatggaggactgtaacctggcggcagcgcaaaagatg

SEQ ID NO: 98721 - DNA, 103 bp, Artificial Sequence
  Synthetic Polynucleotide
taatacgactcactatagggtcagaatgtccatgctccgcttacagtcctaacagaggagaaggactatgagcggagcaaacctggcggcagcgcaaaagatg

SEQ ID NO: 98722 - DNA, 103 bp, Artificial Sequence
  Synthetic Polynucleotide
taatacgactcactatagggaaggcttgcttcagaatgtccatgctccgcaacagaggagagcggagatgggacattctaacctggcggcagcgcaaaagatg

SEQ ID NO: 98723 - DNA, 103 bp, Artificial Sequence
  Synthetic Polynucleotide
taatacgactcactatagggaccccggacgaaggcttgcttcagaatgtcaacagaggagagacattatgaagcaagccaacctggcggcagcgcaaaagatg

SEQ ID NO: 98724 - DNA, 103 bp, Artificial Sequence
  Synthetic Polynucleotide
taatacgactcactataggggcgtggggagaccccggacgaaggcttgctaacagaggagaagcaagatgtcgtccgggaacctggcggcagcgcaaaagatg

SEQ ID NO: 98725 - DNA, 103 bp, Artificial Sequence
  Synthetic Polynucleotide
taatacgactcactatagggcgggcggtgggcgtggggagaccccggacgaacagaggagacgtccgatgtctccccacaacctggcggcagcgcaaaagatg

SEQ ID NO: 98726 - DNA, 103 bp, Artificial Sequence
  Synthetic Polynucleotide
taatacgactcactatagggcatcggcaagggacctttgcctttgagcttaacagaggagaaagctcatgggcaaaggtaacctggcggcagcgcaaaagatg

SEQ ID NO: 98727 - DNA, 103 bp, Artificial Sequence
  Synthetic Polynucleotide
taatacgactcactatagggttgctcaaagcgggcggtgggcgtggggagaacagaggagactccccatgcccaccgccaacctggcggcagcgcaaaagatg

SEQ ID NO: 98728 - DNA, 103 bp, Artificial Sequence
  Synthetic Polynucleotide
taatacgactcactatagggtgaaggtcctttgctcaaagcgggcggtggaacagaggagaccaccgatggctttgagcaacctggcggcagcgcaaaagatg

SEQ ID NO: 98729 - DNA, 103 bp, Artificial Sequence
  Synthetic Polynucleotide
taatacgactcactatagggttgatgacgctgaaggtcctttgctcaaagaacagaggagactttgaatgaaggaccttaacctggcggcagcgcaaaagatg

SEQ ID NO: 98730 - DNA, 103 bp, Artificial Sequence
  Synthetic Polynucleotide
taatacgactcactatagggagggaagatcttgatgacgctgaaggtcctaacagaggagaaggaccatgagcgtcatcaacctggcggcagcgcaaaagatg

SEQ ID NO: 98731 - DNA, 103 bp, Artificial Sequence
  Synthetic Polynucleotide
taatacgactcactatagggtgctgaggtcagggaagatcttgatgacgcaacagaggagagcgtcaatgagatcttccaacctggcggcagcgcaaaagatg

SEQ ID NO: 98732 - DNA, 103 bp, Artificial Sequence
  Synthetic Polynucleotide
taatacgactcactatagggatgtcgttgctgctgaggtcagggaagatcaacagaggagagatcttatgtgacctcagaacctggcggcagcgcaaaagatg

SEQ ID NO: 98733 - DNA, 103 bp, Artificial Sequence
  Synthetic Polynucleotide
taatacgactcactataggggaagaggagcatgtcgttgctgctgaggtcaacagaggagagacctcatgagcaacgacaacctggcggcagcgcaaaagatg

SEQ ID NO: 98734 - DNA, 103 bp, Artificial Sequence
  Synthetic Polynucleotide
taatacgactcactatagggccttcacgatgaagaggagcatgtcgttgcaacagaggagagcaacgatgtgctcctctaacctggcggcagcgcaaaagatg

SEQ ID NO: 98735 - DNA, 103 bp, Artificial Sequence
  Synthetic Polynucleotide
taatacgactcactatagggaagttgatgcccttcacgatgaagaggagcaacagaggagagctcctatgcatcgtgaaaacctggcggcagcgcaaaagatg

SEQ ID NO: 98736 - DNA, 103 bp, Artificial Sequence
  Synthetic Polynucleotide
taatacgactcactataggggggtgtgggcaagttgatgcccttcacgataacagaggagaatcgtgatgggcatcaacaacctggcggcagcgcaaaagatg

SEQ ID NO: 98737 - DNA, 103 bp, Artificial Sequence
  Synthetic Polynucleotide
taatacgactcactatagggctctgcccgggggtcccgggggtcctttccaacagaggagaggaaagatgccccgggacaacctggcggcagcgcaaaagatg

SEQ ID NO: 98738 - DNA, 103 bp, Artificial Sequence
  Synthetic Polynucleotide
taatacgactcactatagggcaatggcctccatcggcaagggacctttgcaacagaggagagcaaagatgccttgccgaaacctggcggcagcgcaaaagatg

SEQ ID NO: 98739 - DNA, 103 bp, Artificial Sequence
  Synthetic Polynucleotide
taatacgactcactatagggacagtcctgggggtgtgggcaagttgatgcaacagaggagagcatcaatgtgcccacacaacctggcggcagcgcaaaagatg

SEQ ID NO: 98740 - DNA, 103 bp, Artificial Sequence
  Synthetic Polynucleotide
taatacgactcactatagggtcgccaggggacagtcctgggggtgtgggcaacagaggagagcccacatgcccaggactaacctggcggcagcgcaaaagatg

SEQ ID NO: 98741 - DNA, 103 bp, Artificial Sequence
  Synthetic Polynucleotide
taatacgactcactataggggacatccagatcgccaggggacagtcctggaacagaggagaccaggaatgtcccctggcaacctggcggcagcgcaaaagatg

SEQ ID NO: 98742 - DNA, 103 bp, Artificial Sequence
  Synthetic Polynucleotide
taatacgactcactatagggaccgaacaaagacatccagatcgccaggggaacagaggagacccctgatgatctggatgaacctggcggcagcgcaaaagatg

SEQ ID NO: 98743 - DNA, 103 bp, Artificial Sequence
  Synthetic Polynucleotide
taatacgactcactataggggggaagtcaaaccgaacaaagacatccagaaacagaggagatctggaatgctttgttcgaacctggcggcagcgcaaaagatg

SEQ ID NO: 98744 - DNA, 103 bp, Artificial Sequence
  Synthetic Polynucleotide
taatacgactcactataggggttgggataggggaagtcaaaccgaacaaaaacagaggagatttgttatgtttgacttcaacctggcggcagcgcaaaagatg

SEQ ID NO: 98745 - DNA, 103 bp, Artificial Sequence
  Synthetic Polynucleotide
taatacgactcactatagggcttcttccacgttgggataggggaagtcaaaacagaggagattgactatgcctatcccaaacctggcggcagcgcaaaagatg

SEQ ID NO: 98746 - DNA, 103 bp, Artificial Sequence
  Synthetic Polynucleotide
taatacgactcactatagggtctttctgagcttcttccacgttgggatagaacagaggagactatccatgcgtggaagaaacctggcggcagcgcaaaagatg

SEQ ID NO: 98747 - DNA, 103 bp, Artificial Sequence
  Synthetic Polynucleotide
taatacgactcactatagggactggtcttgtctttctgagcttcttccacaacagaggagagtggaaatggctcagaaaaacctggcggcagcgcaaaagatg

SEQ ID NO: 98748 - DNA, 103 bp, Artificial Sequence
  Synthetic Polynucleotide
taatacgactcactatagggtcttgatcacactggtcttgtctttctgagaacagaggagactcagaatgacaagaccaaacctggcggcagcgcaaaagatg

SEQ ID NO: 98749 - DNA, 103 bp, Artificial Sequence
  Synthetic Polynucleotide
taatacgactcactataggggccatcttctcaatggcctccatcggcaagaacagaggagacttgccatgggaggccataacctggcggcagcgcaaaagatg

SEQ ID NO: 98750 - DNA, 103 bp, Artificial Sequence
  Synthetic Polynucleotide
taatacgactcactataggggagtctgtgttcttgatcacactggtcttgaacagaggagacaagacatgtgtgatcaaaacctggcggcagcgcaaaagatg

SEQ ID NO: 98751 - DNA, 103 bp, Artificial Sequence
  Synthetic Polynucleotide
taatacgactcactataggggaactcaggggagtctgtgttcttgatcacaacagaggagagtgatcatgaacacagacaacctggcggcagcgcaaaagatg

SEQ ID NO: 98752 - DNA, 103 bp, Artificial Sequence
  Synthetic Polynucleotide
taatacgactcactatagggactgctccttgaactcaggggagtctgtgtaacagaggagaacacagatgcccctgagtaacctggcggcagcgcaaaagatg

SEQ ID NO: 98753 - DNA, 103 bp, Artificial Sequence
  Synthetic Polynucleotide
taatacgactcactatagggcagagtttgaactgctccttgaactcagggaacagaggagaccctgaatgcaaggagcaaacctggcggcagcgcaaaagatg

SEQ ID NO: 98754 - DNA, 103 bp, Artificial Sequence
  Synthetic Polynucleotide
taatacgactcactataggggcggttgatgcagagtttgaactgctccttaacagaggagaaaggagatgttcaaactcaacctggcggcagcgcaaaagatg

SEQ ID NO: 98755 - DNA, 103 bp, Artificial Sequence
  Synthetic Polynucleotide
taatacgactcactatagggcacggtggctgcggttgatgcagagtttgaaacagaggagatcaaacatggcatcaaccaacctggcggcagcgcaaaagatg

SEQ ID NO: 98756 - DNA, 103 bp, Artificial Sequence
  Synthetic Polynucleotide
taatacgactcactatagggcttcggaagccacggtggctgcggttgatgaacagaggagacatcaaatgcagccaccgaacctggcggcagcgcaaaagatg

SEQ ID NO: 98757 - DNA, 103 bp, Artificial Sequence
  Synthetic Polynucleotide
taatacgactcactatagggctggatggcccttcggaagccacggtggctaacagaggagaagccacatgggcttccgaaacctggcggcagcgcaaaagatg

SEQ ID NO: 98758 - DNA, 103 bp, Artificial Sequence
  Synthetic Polynucleotide
taatacgactcactatagggtgcccttggtctggatggcccttcggaagcaacagaggagagcttccatggggccatccaacctggcggcagcgcaaaagatg

SEQ ID NO: 98759 - DNA, 103 bp, Artificial Sequence
  Synthetic Polynucleotide
taatacgactcactatagggtcgaacttgatgcccttggtctggatggccaacagaggagaggccatatggaccaagggaacctggcggcagcgcaaaagatg

SEQ ID NO: 98760 - DNA, 103 bp, Artificial Sequence
  Synthetic Polynucleotide
taatacgactcactataggggcacaggctggccatcttctcaatggcctcaacagaggagagaggccatggagaagatgaacctggcggcagcgcaaaagatg

SEQ ID NO: 98761 - DNA, 103 bp, Artificial Sequence
  Synthetic Polynucleotide
taatacgactcactataggggtgaaccacttcgaacttgatgcccttggtaacagaggagaaccaagatgatcaagttcaacctggcggcagcgcaaaagatg

SEQ ID NO: 98762 - DNA, 103 bp, Artificial Sequence
  Synthetic Polynucleotide
taatacgactcactataggggcccccccttgtgaaccacttcgaacttgaaacagaggagatcaagtatgaagtggttcaacctggcggcagcgcaaaagatg

SEQ ID NO: 98763 - DNA, 103 bp, Artificial Sequence
  Synthetic Polynucleotide
taatacgactcactataggggtcttgaacagcccccccttgtgaaccactaacagaggagaagtggtatgcaaggggggaacctggcggcagcgcaaaagatg

SEQ ID NO: 98764 - DNA, 103 bp, Artificial Sequence
  Synthetic Polynucleotide
taatacgactcactatagggcacccggtcagtcttgaacagcccccccttaacagaggagaaaggggatgctgttcaagaacctggcggcagcgcaaaagatg

SEQ ID NO: 98765 - DNA, 103 bp, Artificial Sequence
  Synthetic Polynucleotide
taatacgactcactatagggctgtccccagcacccggtcagtcttgaacaaacagaggagatgttcaatgctgaccgggaacctggcggcagcgcaaaagatg

SEQ ID NO: 98766 - DNA, 103 bp, Artificial Sequence
  Synthetic Polynucleotide
taatacgactcactatagggttcagctgggctgtccccagcacccggtcaaacagaggagatgaccgatggctggggacaacctggcggcagcgcaaaagatg

SEQ ID NO: 98767 - DNA, 103 bp, Artificial Sequence
  Synthetic Polynucleotide
taatacgactcactatagggtgcatccagcttcagctgggctgtccccagaacagaggagactggggatggcccagctgaacctggcggcagcgcaaaagatg

SEQ ID NO: 98768 - DNA, 103 bp, Artificial Sequence
  Synthetic Polynucleotide
taatacgactcactatagggctatctccagtgcatccagcttcagctgggaacagaggagacccagcatgagctggatgaacctggcggcagcgcaaaagatg

SEQ ID NO: 98769 - DNA, 103 bp, Artificial Sequence
  Synthetic Polynucleotide
taatacgactcactatagggacctcacatgctatctccagtgcatccagcaacagaggagagctggaatgactggagataacctggcggcagcgcaaaagatg

SEQ ID NO: 98770 - DNA, 103 bp, Artificial Sequence
  Synthetic Polynucleotide
taatacgactcactataggggatctcccggacctcacatgctatctccagaacagaggagactggagatggcatgtgagaacctggcggcagcgcaaaagatg

SEQ ID NO: 98771 - DNA, 103 bp, Artificial Sequence
  Synthetic Polynucleotide
taatacgactcactatagggggtctctcatgcacaggctggccatcttctaacagaggagaagaagaatgccagcctgtaacctggcggcagcgcaaaagatg

SEQ ID NO: 98772 - DNA, 103 bp, Artificial Sequence
  Synthetic Polynucleotide
taatacgactcactatagggggacctcaaggatctcccggacctcacatgaacagaggagacatgtgatgtccgggagaaacctggcggcagcgcaaaagatg

SEQ ID NO: 98773 - DNA, 103 bp, Artificial Sequence
  Synthetic Polynucleotide
taatacgactcactatagggcgaccatccaggacctcaaggatctcccggaacagaggagaccgggaatgccttgaggtaacctggcggcagcgcaaaagatg

SEQ ID NO: 98774 - DNA, 103 bp, Artificial Sequence
  Synthetic Polynucleotide
taatacgactcactatagggtgtgggccggcgaccatccaggacctcaagaacagaggagacttgagatgctggatggtaacctggcggcagcgcaaaagatg

SEQ ID NO: 98775 - DNA, 103 bp, Artificial Sequence
  Synthetic Polynucleotide
taatacgactcactataggggtcgcccccctgtgggccggcgaccatccaaacagaggagatggatgatggccggcccaaacctggcggcagcgcaaaagatg

SEQ ID NO: 98776 - DNA, 103 bp, Artificial Sequence
  Synthetic Polynucleotide
taatacgactcactatagggattacctccagtcgcccccctgtgggccggaacagaggagaccggccatgaggggggcgaacctggcggcagcgcaaaagatg

SEQ ID NO: 98777 - DNA, 103 bp, Artificial Sequence
  Synthetic Polynucleotide
taatacgactcactatagggaatccggaccattacctccagtcgccccccaacagaggagaggggggatgctggaggtaaacctggcggcagcgcaaaagatg

SEQ ID NO: 98778 - DNA, 103 bp, Artificial Sequence
  Synthetic Polynucleotide
taatacgactcactataggggtggctcccgaatccggaccattacctccaaacagaggagatggaggatgtggtccggaaacctggcggcagcgcaaaagatg

SEQ ID NO: 98779 - DNA, 103 bp, Artificial Sequence
  Synthetic Polynucleotide
taatacgactcactatagggtgggctgtcagtggctcccgaatccggaccaacagaggagaggtccgatgtcgggagccaacctggcggcagcgcaaaagatg

SEQ ID NO: 98780 - DNA, 103 bp, Artificial Sequence
  Synthetic Polynucleotide
taatacgactcactatagggctccaactgctgggctgtcagtggctcccgaacagaggagacgggagatgctgacagccaacctggcggcagcgcaaaagatg

SEQ ID NO: 98781 - DNA, 103 bp, Artificial Sequence
  Synthetic Polynucleotide
taatacgactcactatagggctgtcgtcgtctccaactgctgggctgtcaaacagaggagatgacagatgagcagttggaacctggcggcagcgcaaaagatg

SEQ ID NO: 98782 - DNA, 103 bp, Artificial Sequence
  Synthetic Polynucleotide
taatacgactcactatagggtcctcatccgggtctctcatgcacaggctgaacagaggagacagcctatgcatgagagaaacctggcggcagcgcaaaagatg

SEQ ID NO: 98783 - DNA, 103 bp, Artificial Sequence
  Synthetic Polynucleotide
taatacgactcactatagggagccacctctctgtcgtcgtctccaactgcaacagaggagagcagttatggacgacgacaacctggcggcagcgcaaaagatg

SEQ ID NO: 98784 - DNA, 103 bp, Artificial Sequence
  Synthetic Polynucleotide
taatacgactcactataggggtcaatgaccagccacctctctgtcgtcgtaacagaggagaacgacgatggagaggtggaacctggcggcagcgcaaaagatg

SEQ ID NO: 98785 - DNA, 103 bp, Artificial Sequence
  Synthetic Polynucleotide
taatacgactcactatagggccggcacagggtcaatgaccagccacctctaacagaggagaagaggtatgtggtcattgaacctggcggcagcgcaaaagatg

SEQ ID NO: 98786 - DNA, 103 bp, Artificial Sequence
  Synthetic Polynucleotide
taatacgactcactatagggggcacagctgccggcacagggtcaatgaccaacagaggagaggtcatatgccctgtgccaacctggcggcagcgcaaaagatg

SEQ ID NO: 98787 - DNA, 103 bp, Artificial Sequence
  Synthetic Polynucleotide
taatacgactcactatagggaacctgtgtgggcacagctgccggcacaggaacagaggagacctgtgatggcagctgtgaacctggcggcagcgcaaaagatg

SEQ ID NO: 98788 - DNA, 103 bp, Artificial Sequence
  Synthetic Polynucleotide
taatacgactcactatagggtgggcccagcaacctgtgtgggcacagctgaacagaggagacagctgatgccacacaggaacctggcggcagcgcaaaagatg

SEQ ID NO: 98789 - DNA, 103 bp, Artificial Sequence
  Synthetic Polynucleotide
taatacgactcactataggggccttccctttgggcccagcaacctgtgtgaacagaggagacacacaatgtgctgggccaacctggcggcagcgcaaaagatg

SEQ ID NO: 98790 - DNA, 103 bp, Artificial Sequence
  Synthetic Polynucleotide
taatacgactcactatagggcacaggaggggccttccctttgggcccagcaacagaggagagctgggatgaaagggaagaacctggcggcagcgcaaaagatg

SEQ ID NO: 98791 - DNA, 103 bp, Artificial Sequence
  Synthetic Polynucleotide
taatacgactcactatagggcaggggcaggcacaggaggggccttcccttaacagaggagaaagggaatgcccctcctgaacctggcggcagcgcaaaagatg

SEQ ID NO: 98792 - DNA, 103 bp, Artificial Sequence
  Synthetic Polynucleotide
taatacgactcactataggggactcccttgcaggggcaggcacaggagggaacagaggagaccctccatggcctgccccaacctggcggcagcgcaaaagatg

SEQ ID NO: 98793 - DNA, 103 bp, Artificial Sequence
  Synthetic Polynucleotide
taatacgactcactatagggctcctcctcatcctcatccgggtctctcataacagaggagaatgagaatgccggatgagaacctggcggcagcgcaaaagatg

SEQ ID NO: 98794 - DNA, 103 bp, Artificial Sequence
  Synthetic Polynucleotide
taatacgactcactatagggtctgttccctgactcccttgcaggggcaggaacagaggagacctgccatggcaagggagaacctggcggcagcgcaaaagatg

SEQ ID NO: 98795 - DNA, 103 bp, Artificial Sequence
  Synthetic Polynucleotide
taatacgactcactataggggccgggctgatctgttccctgactcccttgaacagaggagacaagggatgcagggaacaaacctggcggcagcgcaaaagatg

SEQ ID NO: 98796 - DNA, 103 bp, Artificial Sequence
  Synthetic Polynucleotide
taatacgactcactatagggctatgcaggggccgggctgatctgttccctaacagaggagaagggaaatgatcagcccgaacctggcggcagcgcaaaagatg

SEQ ID NO: 98797 - DNA, 103 bp, Artificial Sequence
  Synthetic Polynucleotide
taatacgactcactatagggcacactgaggctatgcaggggccgggctgaaacagaggagatcagccatgcccctgcataacctggcggcagcgcaaaagatg

SEQ ID NO: 98798 - DNA, 103 bp, Artificial Sequence
  Synthetic Polynucleotide
taatacgactcactatagggcaaacgccagcacactgaggctatgcagggaacagaggagaccctgcatggcctcagtgaacctggcggcagcgcaaaagatg

SEQ ID NO: 98799 - DNA, 103 bp, Artificial Sequence
  Synthetic Polynucleotide
taatacgactcactatagggcgctcttggtcaaacgccagcacactgaggaacagaggagacctcagatggctggcgttaacctggcggcagcgcaaaagatg

SEQ ID NO: 98800 - DNA, 103 bp, Artificial Sequence
  Synthetic Polynucleotide
taatacgactcactatagggccgctccagacgctcttggtcaaacgccagaacagaggagactggcgatggaccaagagaacctggcggcagcgcaaaagatg

SEQ ID NO: 98801 - DNA, 103 bp, Artificial Sequence
  Synthetic Polynucleotide
taatacgactcactatagggccaggatcttccgctccagacgctcttggtaacagaggagaaccaagatggtctggagcaacctggcggcagcgcaaaagatg

SEQ ID NO: 98802 - DNA, 103 bp, Artificial Sequence
  Synthetic Polynucleotide
taatacgactcactatagggtgcctgagggccaggatcttccgctccagaaacagaggagatctggaatggaagatcctaacctggcggcagcgcaaaagatg

SEQ ID NO: 98803 - DNA, 103 bp, Artificial Sequence
  Synthetic Polynucleotide
taatacgactcactatagggccgccgcgcctgcctgagggccaggatcttaacagaggagaaagatcatggccctcaggaacctggcggcagcgcaaaagatg

SEQ ID NO: 98804 - DNA, 103 bp, Artificial Sequence
  Synthetic Polynucleotide
taatacgactcactatagggcatccgtcccctcctcctcatcctcatccgaacagaggagacggatgatgatgaggaggaacctggcggcagcgcaaaagatg

SEQ ID NO: 98805 - DNA, 103 bp, Artificial Sequence
  Synthetic Polynucleotide
taatacgactcactatagggggggcaccggccgccgcgcctgcctgagggaacagaggagaccctcaatgaggcgcggcaacctggcggcagcgcaaaagatg

SEQ ID NO: 98806 - DNA, 103 bp, Artificial Sequence
  Synthetic Polynucleotide
taatacgactcactataggggccacttctgggggcaccggccgccgcgccaacagaggagaggcgcgatggccggtgccaacctggcggcagcgcaaaagatg

SEQ ID NO: 98807 - DNA, 103 bp, Artificial Sequence
  Synthetic Polynucleotide
taatacgactcactataggggtactgctgggccacttctgggggcaccggaacagaggagaccggtgatgccagaagtgaacctggcggcagcgcaaaagatg

SEQ ID NO: 98808 - DNA, 103 bp, Artificial Sequence
  Synthetic Polynucleotide
taatacgactcactatagggtgatgtcctggtactgctgggccacttctgaacagaggagacagaagatgcccagcagtaacctggcggcagcgcaaaagatg

SEQ ID NO: 98809 - DNA, 103 bp, Artificial Sequence
  Synthetic Polynucleotide
taatacgactcactatagggctgcgttgcatgatgtcctggtactgctggaacagaggagaccagcaatgccaggacataacctggcggcagcgcaaaagatg

SEQ ID NO: 98810 - DNA, 103 bp, Artificial Sequence
  Synthetic Polynucleotide
taatacgactcactatagggctgccactggctgcgttgcatgatgtcctgaacagaggagacaggacatgatgcaacgcaacctggcggcagcgcaaaagatg

SEQ ID NO: 98811 - DNA, 103 bp, Artificial Sequence
  Synthetic Polynucleotide
taatacgactcactataggggctgtgccctctgccactggctgcgttgcaaacagaggagatgcaacatggccagtggcaacctggcggcagcgcaaaagatg

SEQ ID NO: 98812 - DNA, 103 bp, Artificial Sequence
  Synthetic Polynucleotide
taatacgactcactatagggccctgctccagctgtgccctctgccactggaacagaggagaccagtgatggagggcacaaacctggcggcagcgcaaaagatg

SEQ ID NO: 98813 - DNA, 103 bp, Artificial Sequence
  Synthetic Polynucleotide
taatacgactcactataggggcccacacccccctgctccagctgtgccctaacagaggagaagggcaatgctggagcagaacctggcggcagcgcaaaagatg

SEQ ID NO: 98814 - DNA, 103 bp, Artificial Sequence
  Synthetic Polynucleotide
taatacgactcactatagggcccgtcggatgcccacacccccctgctccaaacagaggagatggagcatgggggtgtggaacctggcggcagcgcaaaagatg

SEQ ID NO: 98815 - DNA, 103 bp, Artificial Sequence
  Synthetic Polynucleotide
taatacgactcactatagggaagtcgtcctcatccgtcccctcctcctcaaacagaggagatgaggaatgggggacggaaacctggcggcagcgcaaaagatg

SEQ ID NO: 98816 - DNA, 103 bp, Artificial Sequence
  Synthetic Polynucleotide
taatacgactcactataggggctgcgtattcccgtcggatgcccacacccaacagaggagagggtgtatgcatccgacgaacctggcggcagcgcaaaagatg

SEQ ID NO: 98817 - DNA, 103 bp, Artificial Sequence
  Synthetic Polynucleotide
taatacgactcactatagggctccagctgggctgcgtattcccgtcggataacagaggagaatccgaatggaatacgcaaacctggcggcagcgcaaaagatg

SEQ ID NO: 98818 - DNA, 103 bp, Artificial Sequence
  Synthetic Polynucleotide
taatacgactcactataggggcagctgccgctccagctgggctgcgtattaacagaggagaaatacgatgcccagctggaacctggcggcagcgcaaaagatg

SEQ ID NO: 98819 - DNA, 103 bp, Artificial Sequence
  Synthetic Polynucleotide
taatacgactcactataggggtgtagaactgcagctgccgctccagctggaacagaggagaccagctatggcggcagctaacctggcggcagcgcaaaagatg

SEQ ID NO: 98820 - DNA, 103 bp, Artificial Sequence
  Synthetic Polynucleotide
taatacgactcactatagggggcagcctccgtgtagaactgcagctgccgaacagaggagacggcagatgcagttctacaacctggcggcagcgcaaaagatg

SEQ ID NO: 98821 - DNA, 103 bp, Artificial Sequence
  Synthetic Polynucleotide
taatacgactcactatagggccaggcgccgggcagcctccgtgtagaactaacagaggagaagttctatgcggaggctgaacctggcggcagcgcaaaagatg

SEQ ID NO: 98822 - DNA, 103 bp, Artificial Sequence
  Synthetic Polynucleotide
taatacgactcactatagggccatcgttgcccaggcgccgggcagcctccaacagaggagaggaggcatgccggcgcctaacctggcggcagcgcaaaagatg

SEQ ID NO: 98823 - DNA, 103 bp, Artificial Sequence
  Synthetic Polynucleotide
taatacgactcactatagggatccctgctgccatcgttgcccaggcgccgaacagaggagacggcgcatgggcaacgataacctggcggcagcgcaaaagatg

SEQ ID NO: 98824 - DNA, 103 bp, Artificial Sequence
  Synthetic Polynucleotide
taatacgactcactatagggcctttgcagcatccctgctgccatcgttgcaacagaggagagcaacgatggcagcagggaacctggcggcagcgcaaaagatg

SEQ ID NO: 98825 - DNA, 103 bp, Artificial Sequence
  Synthetic Polynucleotide
taatacgactcactatagggtagagcgcctcctttgcagcatccctgctgaacagaggagacagcagatgtgctgcaaaaacctggcggcagcgcaaaagatg

SEQ ID NO: 98826 - DNA, 103 bp, Artificial Sequence
  Synthetic Polynucleotide
taatacgactcactatagggatcagcctccaagtcgtcctcatccgtcccaacagaggagagggacgatggaggacgacaacctggcggcagcgcaaaagatg

SEQ ID NO: 98827 - DNA, 103 bp, Artificial Sequence
  Synthetic Polynucleotide
taatacgactcactatagggattccgcctatagagcgcctcctttgcagcaacagaggagagctgcaatggaggcgctcaacctggcggcagcgcaaaagatg

SEQ ID NO: 98828 - DNA, 103 bp, Artificial Sequence
  Synthetic Polynucleotide
taatacgactcactatagggtctctaccagattccgcctatagagcgcctaacagaggagaaggcgcatgataggcggaaacctggcggcagcgcaaaagatg

SEQ ID NO: 98829 - DNA, 103 bp, Artificial Sequence
  Synthetic Polynucleotide
taatacgactcactatagggtgcagctcactctctaccagattccgcctaaacagaggagataggcgatgtctggtagaaacctggcggcagcgcaaaagatg

SEQ ID NO: 98830 - DNA, 103 bp, Artificial Sequence
  Synthetic Polynucleotide
taatacgactcactataggggcggagccgctgcagctcactctctaccagaacagaggagactggtaatgagtgagctgaacctggcggcagcgcaaaagatg

SEQ ID NO: 98831 - DNA, 103 bp, Artificial Sequence
  Synthetic Polynucleotide
taatacgactcactataggggcaggtcatcatcagcctccaagtcgtcctaacagaggagaaggacgatgtggaggctgaacctggcggcagcgcaaaagatg

SEQ ID NO: 98832 - DNA, 103 bp, Artificial Sequence
  Synthetic Polynucleotide
taatacgactcactataggggccgcggcgcctctgcccgggggtcccgggaacagaggagacccgggatgcccgggcagaacctggcggcagcgcaaaagatg

SEQ ID NO: 98833 - DNA, 103 bp, Artificial Sequence
  Synthetic Polynucleotide
taatacgactcactatagggagctccgccagcaggtcatcatcagcctccaacagaggagaggaggcatgtgatgacctaacctggcggcagcgcaaaagatg

SEQ ID NO: 98834 - DNA, 103 bp, Artificial Sequence
  Synthetic Polynucleotide
taatacgactcactataggggacctcatttagctccgccagcaggtcatcaacagaggagagatgacatgctggcggagaacctggcggcagcgcaaaagatg

SEQ ID NO: 98835 - DNA, 103 bp, Artificial Sequence
  Synthetic Polynucleotide
taatacgactcactatagggcctctccaaggacctcatttagctccgccaaacagaggagatggcggatgtaaatgaggaacctggcggcagcgcaaaagatg

SEQ ID NO: 98836 - DNA, 103 bp, Artificial Sequence
  Synthetic Polynucleotide
taatacgactcactataggggccttctgctcctctccaaggacctcatttaacagaggagaaaatgaatgccttggagaaacctggcggcagcgcaaaagatg

SEQ ID NO: 98837 - DNA, 103 bp, Artificial Sequence
  Synthetic Polynucleotide
taatacgactcactatagggggtctctgaagccttctgctcctctccaagaacagaggagacttggaatggagcagaagaacctggcggcagcgcaaaagatg

SEQ ID NO: 98838 - DNA, 103 bp, Artificial Sequence
  Synthetic Polynucleotide
taatacgactcactatagggcaggaggtggggtctctgaagccttctgctaacagaggagaagcagaatgcttcagagaaacctggcggcagcgcaaaagatg

SEQ ID NO: 98839 - DNA, 103 bp, Artificial Sequence
  Synthetic Polynucleotide
taatacgactcactatagggggctgggccacaggaggtggggtctctgaaaacagaggagattcagaatgcccacctccaacctggcggcagcgcaaaagatg

SEQ ID NO: 98840 - DNA, 103 bp, Artificial Sequence
  Synthetic Polynucleotide
taatacgactcactatagggctcaggcttcggctgggccacaggaggtggaacagaggagaccacctatggtggcccagaacctggcggcagcgcaaaagatg

SEQ ID NO: 98841 - DNA, 103 bp, Artificial Sequence
  Synthetic Polynucleotide
taatacgactcactataggggatgaggggcctcaggcttcggctgggccaaacagaggagatggcccatgcgaagcctgaacctggcggcagcgcaaaagatg

SEQ ID NO: 98842 - DNA, 103 bp, Artificial Sequence
  Synthetic Polynucleotide
taatacgactcactatagggtccagccccggatgaggggcctcaggcttcaacagaggagagaagccatgggcccctcaaacctggcggcagcgcaaaagatg

SEQ ID NO: 98843 - DNA, 103 bp, Artificial Sequence
  Synthetic Polynucleotide
taatacgactcactatagggctggcgggcggccgcggcgcctctgcccggaacagaggagaccgggcatgggcgccgcgaacctggcggcagcgcaaaagatg

SEQ ID NO: 98844 - DNA, 103 bp, Artificial Sequence
  Synthetic Polynucleotide
taatacgactcactatagggcaaggtggtctccagccccggatgaggggcaacagaggagagcccctatgccggggctgaacctggcggcagcgcaaaagatg

SEQ ID NO: 98845 - DNA, 103 bp, Artificial Sequence
  Synthetic Polynucleotide
taatacgactcactataggggcctctcctgcaaggtggtctccagccccgaacagaggagacggggcatgagaccacctaacctggcggcagcgcaaaagatg

SEQ ID NO: 98846 - DNA, 103 bp, Artificial Sequence
  Synthetic Polynucleotide
taatacgactcactatagggtagagcgccagcctctcctgcaaggtggtcaacagaggagagaccacatggcaggagagaacctggcggcagcgcaaaagatg

SEQ ID NO: 98847 - DNA, 103 bp, Artificial Sequence
  Synthetic Polynucleotide
taatacgactcactatagggtgctgtctgatagagcgccagcctctcctgaacagaggagacaggagatgctggcgctcaacctggcggcagcgcaaaagatg

SEQ ID NO: 98848 - DNA, 103 bp, Artificial Sequence
  Synthetic Polynucleotide
taatacgactcactatagggcgctttcaattgctgtctgatagagcgccaaacagaggagatggcgcatgatcagacagaacctggcggcagcgcaaaagatg

SEQ ID NO: 98849 - DNA, 103 bp, Artificial Sequence
  Synthetic Polynucleotide
taatacgactcactataggggcttgtctggcgctttcaattgctgtctgaaacagaggagatcagacatgaattgaaagaacctggcggcagcgcaaaagatg

SEQ ID NO: 98850 - DNA, 103 bp, Artificial Sequence
  Synthetic Polynucleotide
taatacgactcactataggggctgtctccagcttgtctggcgctttcaataacagaggagaattgaaatggccagacaaaacctggcggcagcgcaaaagatg

SEQ ID NO: 98851 - DNA, 103 bp, Artificial Sequence
  Synthetic Polynucleotide
taatacgactcactataggggcatcttggcgctgtctccagcttgtctggaacagaggagaccagacatgctggagacaaacctggcggcagcgcaaaagatg

SEQ ID NO: 98852 - DNA, 103 bp, Artificial Sequence
  Synthetic Polynucleotide
taatacgactcactatagggtcgtagcgccgcatcttggcgctgtctccaaacagaggagatggagaatgcgccaagataacctggcggcagcgcaaaagatg

SEQ ID NO: 98853 - DNA, 103 bp, Artificial Sequence
  Synthetic Polynucleotide
taatacgactcactatagggaagcccccgatcgtagcgccgcatcttggcaacagaggagagccaagatgcggcgctacaacctggcggcagcgcaaaagatg

SEQ ID NO: 98854 - DNA, 103 bp, Artificial Sequence
  Synthetic Polynucleotide
taatacgactcactataggggcaggcccagctggcgggcggccgcggcgcaacagaggagagcgccgatgccgcccgccaacctggcggcagcgcaaaagatg

SEQ ID NO: 98855 - DNA, 103 bp, Artificial Sequence
  Synthetic Polynucleotide
taatacgactcactatagggccagtgttttaagcccccgatcgtagcgccaacagaggagaggcgctatgatcgggggcaacctggcggcagcgcaaaagatg

SEQ ID NO: 98856 - DNA, 103 bp, Artificial Sequence
  Synthetic Polynucleotide
taatacgactcactatagggagcaggttttccagtgttttaagcccccgaaacagaggagatcggggatgtaaaacactaacctggcggcagcgcaaaagatg

SEQ ID NO: 98857 - DNA, 103 bp, Artificial Sequence
  Synthetic Polynucleotide
taatacgactcactataggggatggaggcgagcaggttttccagtgttttaacagaggagaaaaacaatggaaaacctgaacctggcggcagcgcaaaagatg

SEQ ID NO: 98858 - DNA, 103 bp, Artificial Sequence
  Synthetic Polynucleotide
taatacgactcactatagggtgcccttacggatggaggcgagcaggttttaacagaggagaaaaaccatgtcgcctccaaacctggcggcagcgcaaaagatg

SEQ ID NO: 98859 - DNA, 103 bp, Artificial Sequence
  Synthetic Polynucleotide
taatacgactcactatagggtcaatggcattgcccttacggatggaggcgaacagaggagacgcctcatgccgtaagggaacctggcggcagcgcaaaagatg

SEQ ID NO: 98860 - DNA, 103 bp, Artificial Sequence
  Synthetic Polynucleotide
taatacgactcactataggggtccgcttcgtcaatggcattgcccttacgaacagaggagacgtaagatgaatgccattaacctggcggcagcgcaaaagatg

SEQ ID NO: 98861 - DNA, 103 bp, Artificial Sequence
  Synthetic Polynucleotide
taatacgactcactataggggcggcgggatgtccgcttcgtcaatggcataacagaggagaatgccaatgacgaagcggaacctggcggcagcgcaaaagatg

SEQ ID NO: 98862 - DNA, 103 bp, Artificial Sequence
  Synthetic Polynucleotide
taatacgactcactatagggatggccactggcggcgggatgtccgcttcgaacagaggagacgaagcatgcatcccgccaacctggcggcagcgcaaaagatg

SEQ ID NO: 98863 - DNA, 103 bp, Artificial Sequence
  Synthetic Polynucleotide
taatacgactcactataggggccttttcctatggccactggcggcgggataacagaggagaatcccgatgccagtggccaacctggcggcagcgcaaaagatg

SEQ ID NO: 98864 - DNA, 103 bp, Artificial Sequence
  Synthetic Polynucleotide
taatacgactcactatagggtggacgccgggccttttcctatggccactgaacagaggagacagtggatgtaggaaaagaacctggcggcagcgcaaaagatg

SEQ ID NO: 98865 - DNA, 103 bp, Artificial Sequence
  Synthetic Polynucleotide
taatacgactcactatagggaggtcaaccagcaggcccagctggcgggcgaacagaggagacgcccgatggctgggcctaacctggcggcagcgcaaaagatg

SEQ ID NO: 98866 - DNA, 103 bp, Artificial Sequence
  Synthetic Polynucleotide
taatacgactcactatagggtaggtaggcgtggacgccgggccttttcctaacagaggagaaggaaaatgcccggcgtcaacctggcggcagcgcaaaagatg

SEQ ID NO: 98867 - DNA, 103 bp, Artificial Sequence
  Synthetic Polynucleotide
taatacgactcactatagggtgcagggctgtaggtaggcgtggacgccggaacagaggagaccggcgatgacgcctaccaacctggcggcagcgcaaaagatg

SEQ ID NO: 98868 - DNA, 103 bp, Artificial Sequence
  Synthetic Polynucleotide
taatacgactcactataggggctgggtgggtgcagggctgtaggtaggcgaacagaggagacgcctaatgacagccctgaacctggcggcagcgcaaaagatg

SEQ ID NO: 98869 - DNA, 103 bp, Artificial Sequence
  Synthetic Polynucleotide
taatacgactcactatagggctaggggccggctgggtgggtgcagggctgaacagaggagacagcccatgacccacccaaacctggcggcagcgcaaaagatg

SEQ ID NO: 98870 - DNA, 103 bp, Artificial Sequence
  Synthetic Polynucleotide
taatacgactcactatagggtgacgcgattctaggggccggctgggtgggaacagaggagacccaccatgccggcccctaacctggcggcagcgcaaaagatg

SEQ ID NO: 98871 - DNA, 103 bp, Artificial Sequence
  Synthetic Polynucleotide
taatacgactcactataggggctctggggctgacgcgattctaggggccgaacagaggagacggcccatggaatcgcgtaacctggcggcagcgcaaaagatg

SEQ ID NO: 98872 - DNA, 103 bp, Artificial Sequence
  Synthetic Polynucleotide
taatacgactcactataggggtgaccctgggctctggggctgacgcgattaacagaggagaaatcgcatgagccccagaaacctggcggcagcgcaaaagatg

SEQ ID NO: 98873 - DNA, 103 bp, Artificial Sequence
  Synthetic Polynucleotide
taatacgactcactatagggtccctccagggtgaccctgggctctggggcaacagaggagagccccaatgcccagggtcaacctggcggcagcgcaaaagatg

SEQ ID NO: 98874 - DNA, 103 bp, Artificial Sequence
  Synthetic Polynucleotide
taatacgactcactatagggtggcagaaggtccctccagggtgaccctggaacagaggagaccagggatgccctggaggaacctggcggcagcgcaaaagatg

SEQ ID NO: 98875 - DNA, 103 bp, Artificial Sequence
  Synthetic Polynucleotide
taatacgactcactataggggctggggcggtggcagaaggtccctccaggaacagaggagacctggaatgaccttctgcaacctggcggcagcgcaaaagatg

SEQ ID NO: 98876 - DNA, 103 bp, Artificial Sequence
  Synthetic Polynucleotide
taatacgactcactatagggatctggggagaggtcaaccagcaggcccagaacagaggagactgggcatgctggttgacaacctggcggcagcgcaaaagatg

SEQ ID NO: 98877 - DNA, 103 bp, Artificial Sequence
  Synthetic Polynucleotide
taatacgactcactatagggtggagatgaggctggggcggtggcagaaggaacagaggagaccttctatgaccgccccaaacctggcggcagcgcaaaagatg

SEQ ID NO: 98878 - DNA, 103 bp, Artificial Sequence
  Synthetic Polynucleotide
taatacgactcactatagggtagccaagcctggagatgaggctggggcggaacagaggagaccgcccatgcctcatctcaacctggcggcagcgcaaaagatg

SEQ ID NO: 98879 - DNA, 103 bp, Artificial Sequence
  Synthetic Polynucleotide
taatacgactcactatagggatctggggcttagccaagcctggagatgagaacagaggagactcatcatgaggcttggcaacctggcggcagcgcaaaagatg

SEQ ID NO: 98880 - DNA, 103 bp, Artificial Sequence
  Synthetic Polynucleotide
taatacgactcactatagggacctgggggcatctggggcttagccaagccaacagaggagaggcttgatgaagccccagaacctggcggcagcgcaaaagatg

SEQ ID NO: 98881 - DNA, 103 bp, Artificial Sequence
  Synthetic Polynucleotide
taatacgactcactatagggggctgcagggacctgggggcatctggggctaacagaggagaagccccatgtgcccccagaacctggcggcagcgcaaaagatg

SEQ ID NO: 98882 - DNA, 103 bp, Artificial Sequence
  Synthetic Polynucleotide
taatacgactcactatagggagagggccagggctgcagggacctgggggcaacagaggagagcccccatgtccctgcagaacctggcggcagcgcaaaagatg

SEQ ID NO: 98883 - DNA, 103 bp, Artificial Sequence
  Synthetic Polynucleotide
taatacgactcactatagggcaactgggccagagggccagggctgcagggaacagaggagaccctgcatgcctggccctaacctggcggcagcgcaaaagatg

SEQ ID NO: 98884 - DNA, 103 bp, Artificial Sequence
  Synthetic Polynucleotide
taatacgactcactatagggggcggctctgcaactgggccagagggccagaacagaggagactggccatgtggcccagtaacctggcggcagcgcaaaagatg

SEQ ID NO: 98885 - DNA, 103 bp, Artificial Sequence
  Synthetic Polynucleotide
taatacgactcactatagggtagtcgcgctggcggctctgcaactgggccaacagaggagaggcccaatggcagagccgaacctggcggcagcgcaaaagatg

SEQ ID NO: 98886 - DNA, 103 bp, Artificial Sequence
  Synthetic Polynucleotide
taatacgactcactatagggagccagcttgtagtcgcgctggcggctctgaacagaggagacagagcatgcagcgcgacaacctggcggcagcgcaaaagatg

SEQ ID NO: 98887 - DNA, 103 bp, Artificial Sequence
  Synthetic Polynucleotide
taatacgactcactatagggtcatcaggccatctggggagaggtcaaccaaacagaggagatggttgatgtctccccagaacctggcggcagcgcaaaagatg

SEQ ID NO: 98888 - DNA, 103 bp, Artificial Sequence
  Synthetic Polynucleotide
taatacgactcactatagggcgtggagggcagccagcttgtagtcgcgctaacagaggagaagcgcgatgacaagctggaacctggcggcagcgcaaaagatg

SEQ ID NO: 98889 - DNA, 103 bp, Artificial Sequence
  Synthetic Polynucleotide
taatacgactcactatagggtgctgcttggcgtggagggcagccagcttgaacagaggagacaagctatgtgccctccaaacctggcggcagcgcaaaagatg

SEQ ID NO: 98890 - DNA, 103 bp, Artificial Sequence
  Synthetic Polynucleotide
taatacgactcactatagggggtatctccctgctgcttggcgtggagggcaacagaggagagccctcatggccaagcagaacctggcggcagcgcaaaagatg

SEQ ID NO: 98891 - DNA, 103 bp, Artificial Sequence
  Synthetic Polynucleotide
taatacgactcactatagggcggcagcagtggtatctccctgctgcttggaacagaggagaccaagcatgagggagataaacctggcggcagcgcaaaagatg

SEQ ID NO: 98892 - DNA, 103 bp, Artificial Sequence
  Synthetic Polynucleotide
taatacgactcactatagggaagtgtctagcggcagcagtggtatctcccaacagaggagagggagaatgcactgctgcaacctggcggcagcgcaaaagatg

SEQ ID NO: 98893 - DNA, 103 bp, Artificial Sequence
  Synthetic Polynucleotide
taatacgactcactatagggagccacgcggaagtgtctagcggcagcagtaacagaggagaactgctatggctagacacaacctggcggcagcgcaaaagatg

SEQ ID NO: 98894 - DNA, 103 bp, Artificial Sequence
  Synthetic Polynucleotide
taatacgactcactatagggcaaagctcttagccacgcggaagtgtctagaacagaggagactagacatgtccgcgtggaacctggcggcagcgcaaaagatg

SEQ ID NO: 98895 - DNA, 103 bp, Artificial Sequence
  Synthetic Polynucleotide
taatacgactcactatagggaagacagcatcaaagctcttagccacgcggaacagaggagaccgcgtatgtaagagcttaacctggcggcagcgcaaaagatg

SEQ ID NO: 98896 - DNA, 103 bp, Artificial Sequence
  Synthetic Polynucleotide
taatacgactcactatagggcagggcctccaagacagcatcaaagctcttaacagaggagaaagagcatggatgctgtcaacctggcggcagcgcaaaagatg

SEQ ID NO: 98897 - DNA, 103 bp, Artificial Sequence
  Synthetic Polynucleotide
taatacgactcactatagggcaccccggctcagggcctccaagacagcataacagaggagaatgctgatgtggaggcccaacctggcggcagcgcaaaagatg

SEQ ID NO: 98898 - DNA, 103 bp, Artificial Sequence
  Synthetic Polynucleotide
taatacgactcactatagggtcctcagggatcatcaggccatctggggagaacagaggagactccccatgtggcctgataacctggcggcagcgcaaaagatg

SEQ ID NO: 98899 - DNA, 103 bp, Artificial Sequence
  Synthetic Polynucleotide
taatacgactcactatagggtccacgggctcaccccggctcagggcctccaacagaggagaggaggcatggagccggggaacctggcggcagcgcaaaagatg

SEQ ID NO: 98900 - DNA, 103 bp, Artificial Sequence
  Synthetic Polynucleotide
taatacgactcactataggggcaggagaggtccacgggctcaccccggctaacagaggagaagccggatggagcccgtgaacctggcggcagcgcaaaagatg

SEQ ID NO: 98901 - DNA, 103 bp, Artificial Sequence
  Synthetic Polynucleotide
taatacgactcactataggggagggggcaggcaggagaggtccacgggctaacagaggagaagcccgatgacctctcctaacctggcggcagcgcaaaagatg

SEQ ID NO: 98902 - DNA, 103 bp, Artificial Sequence
  Synthetic Polynucleotide
taatacgactcactatagggtggtcgggtggagggggcaggcaggagaggaacagaggagacctctcatgcctgcccccaacctggcggcagcgcaaaagatg

SEQ ID NO: 98903 - DNA, 103 bp, Artificial Sequence
  Synthetic Polynucleotide
taatacgactcactatagggtgggggcagctggtcgggtggagggggcagaacagaggagactgcccatgccacccgacaacctggcggcagcgcaaaagatg

SEQ ID NO: 98904 - DNA, 103 bp, Artificial Sequence
  Synthetic Polynucleotide
taatacgactcactatagggacggtgggtctgggggcagctggtcgggtgaacagaggagacacccgatgagctgccccaacctggcggcagcgcaaaagatg

SEQ ID NO: 98905 - DNA, 103 bp, Artificial Sequence
  Synthetic Polynucleotide
taatacgactcactataggggacggtggtgacggtgggtctgggggcagcaacagaggagagctgccatgagacccaccaacctggcggcagcgcaaaagatg

SEQ ID NO: 98906 - DNA, 103 bp, Artificial Sequence
  Synthetic Polynucleotide
taatacgactcactatagggcggaggctgcgacggtggtgacggtgggtcaacagaggagagacccaatgtcaccaccgaacctggcggcagcgcaaaagatg

SEQ ID NO: 98907 - DNA, 103 bp, Artificial Sequence
  Synthetic Polynucleotide
taatacgactcactatagggtagcgggggtcggaggctgcgacggtggtgaacagaggagacaccacatgcgcagcctcaacctggcggcagcgcaaaagatg

SEQ ID NO: 98908 - DNA, 103 bp, Artificial Sequence
  Synthetic Polynucleotide
taatacgactcactataggggagggcgccgtagcgggggtcggaggctgcaacagaggagagcagccatggacccccgcaacctggcggcagcgcaaaagatg

SEQ ID NO: 98909 - DNA, 103 bp, Artificial Sequence
  Synthetic Polynucleotide
taatacgactcactataggggcccttccgaggtcttggccctggcatcataacagaggagaatgatgatggggccaagaaacctggcggcagcgcaaaagatg

SEQ ID NO: 98910 - DNA, 103 bp, Artificial Sequence
  Synthetic Polynucleotide
taatacgactcactatagggatccatgcccagcagcatgtcctcagggccaacagaggagaggccctatggacatgctgaacctggcggcagcgcaaaagatg

SEQ ID NO: 98911 - DNA, 103 bp, Artificial Sequence
  Synthetic Polynucleotide
taatacgactcactatagggatcctcaggtgccgggggcatggcactcagaacagaggagactgagtatgatgcccccgaacctggcggcagcgcaaaagatg

SEQ ID NO: 98912 - DNA, 103 bp, Artificial Sequence
  Synthetic Polynucleotide
taatacgactcactatagggggggcttcagatcctcaggtgccgggggcaaacagaggagatgccccatgcacctgaggaacctggcggcagcgcaaaagatg

SEQ ID NO: 98913 - DNA, 103 bp, Artificial Sequence
  Synthetic Polynucleotide
taatacgactcactataggggaagcctgctggggcttcagatcctcaggtaacagaggagaacctgaatgtctgaagccaacctggcggcagcgcaaaagatg

SEQ ID NO: 98914 - DNA, 103 bp, Artificial Sequence
  Synthetic Polynucleotide
taatacgactcactataggggggagcctgagaagcctgctggggcttcagaacagaggagactgaagatgcagcaggctaacctggcggcagcgcaaaagatg

SEQ ID NO: 98915 - DNA, 103 bp, Artificial Sequence
  Synthetic Polynucleotide
taatacgactcactatagggagggtgctgtgggagcctgagaagcctgctaacagaggagaagcaggatgctcaggctcaacctggcggcagcgcaaaagatg

SEQ ID NO: 98916 - DNA, 103 bp, Artificial Sequence
  Synthetic Polynucleotide
taatacgactcactatagggggaatgactgagggtgctgtgggagcctgaaacagaggagatcaggcatgcacagcaccaacctggcggcagcgcaaaagatg

SEQ ID NO: 98917 - DNA, 103 bp, Artificial Sequence
  Synthetic Polynucleotide
taatacgactcactatagggcacggctgggggaatgactgagggtgctgtaacagaggagaacagcaatgtcagtcattaacctggcggcagcgcaaaagatg

SEQ ID NO: 98918 - DNA, 103 bp, Artificial Sequence
  Synthetic Polynucleotide
taatacgactcactataggggcactcgctccacggctgggggaatgactgaacagaggagacagtcaatgccccagccgaacctggcggcagcgcaaaagatg

SEQ ID NO: 98919 - DNA, 103 bp, Artificial Sequence
  Synthetic Polynucleotide
taatacgactcactatagggatcactggctgcactcgctccacggctgggaacagaggagacccagcatgggagcgagtaacctggcggcagcgcaaaagatg

SEQ ID NO: 98920 - DNA, 103 bp, Artificial Sequence
  Synthetic Polynucleotide
taatacgactcactataggggtcaggggccatcactggctgcactcgctcaacagaggagagagcgaatgcagccagtgaacctggcggcagcgcaaaagatg

SEQ ID NO: 98921 - DNA, 103 bp, Artificial Sequence
  Synthetic Polynucleotide
taatacgactcactatagggcttcagcctcatccatgcccagcagcatgtaacagaggagaacatgcatgtgggcatggaacctggcggcagcgcaaaagatg

SEQ ID NO: 98922 - DNA, 103 bp, Artificial Sequence
  Synthetic Polynucleotide
taatacgactcactatagggttgctgggacgtcaggggccatcactggctaacagaggagaagccagatgtggcccctgaacctggcggcagcgcaaaagatg

SEQ ID NO: 98923 - DNA, 103 bp, Artificial Sequence
  Synthetic Polynucleotide
taatacgactcactataggggccactggggttgctgggacgtcaggggccaacagaggagaggccccatgcgtcccagcaacctggcggcagcgcaaaagatg

SEQ ID NO: 98924 - DNA, 103 bp, Artificial Sequence
  Synthetic Polynucleotide
taatacgactcactatagggctctgtaggggccactggggttgctgggacaacagaggagagtcccaatgaccccagtgaacctggcggcagcgcaaaagatg

SEQ ID NO: 98925 - DNA, 103 bp, Artificial Sequence
  Synthetic Polynucleotide
taatacgactcactatagggctgtctgtgactctgtaggggccactggggaacagaggagaccccagatgcccctacagaacctggcggcagcgcaaaagatg

SEQ ID NO: 98926 - DNA, 103 bp, Artificial Sequence
  Synthetic Polynucleotide
taatacgactcactataggggcatccagcactgtctgtgactctgtagggaacagaggagaccctacatggtcacagacaacctggcggcagcgcaaaagatg

SEQ ID NO: 98927 - DNA, 103 bp, Artificial Sequence
  Synthetic Polynucleotide
taatacgactcactatagggctgctgcagggcatccagcactgtctgtgaaacagaggagatcacagatggtgctggataacctggcggcagcgcaaaagatg

SEQ ID NO: 98928 - DNA, 103 bp, Artificial Sequence
  Synthetic Polynucleotide
taatacgactcactatagggtgttcagcctctgctgcagggcatccagcaaacagaggagatgctggatgccctgcagcaacctggcggcagcgcaaaagatg

SEQ ID NO: 98929 - DNA, 103 bp, Artificial Sequence
  Synthetic Polynucleotide
taatacgactcactatagggtcgcggtacttgttcagcctctgctgcaggaacagaggagacctgcaatggaggctgaaaacctggcggcagcgcaaaagatg

SEQ ID NO: 98930 - DNA, 103 bp, Artificial Sequence
  Synthetic Polynucleotide
taatacgactcactataggggatgcccgcctcgcggtacttgttcagcctaacagaggagaaggctgatgaagtaccgcaacctggcggcagcgcaaaagatg

SEQ ID NO: 98931 - DNA, 103 bp, Artificial Sequence
  Synthetic Polynucleotide
taatacgactcactatagggtccgggcctggatgcccgcctcgcggtactaacagaggagaagtaccatgaggcgggcaaacctggcggcagcgcaaaagatg

SEQ ID NO: 98932 - DNA, 103 bp, Artificial Sequence
  Synthetic Polynucleotide
taatacgactcactatagggtcctcatcatcttcagcctcatccatgcccaacagaggagagggcatatgtgaggctgaaacctggcggcagcgcaaaagatg

SEQ ID NO: 98933 - DNA, 103 bp, Artificial Sequence
  Synthetic Polynucleotide
taatacgactcactatagggtccccaccactccgggcctggatgcccgccaacagaggagaggcgggatgccaggcccgaacctggcggcagcgcaaaagatg

SEQ ID NO: 98934 - DNA, 103 bp, Artificial Sequence
  Synthetic Polynucleotide
taatacgactcactatagggcttgcgctcgtccccaccactccgggcctgaacagaggagacaggccatgagtggtgggaacctggcggcagcgcaaaagatg

SEQ ID NO: 98935 - DNA, 103 bp, Artificial Sequence
  Synthetic Polynucleotide
taatacgactcactataggggcatccgagccttgcgctcgtccccaccacaacagaggagagtggtgatgacgagcgcaaacctggcggcagcgcaaaagatg

SEQ ID NO: 98936 - DNA, 103 bp, Artificial Sequence
  Synthetic Polynucleotide
taatacgactcactatagggatgcgctcatgcatccgagccttgcgctcgaacagaggagacgagcgatgggctcggataacctggcggcagcgcaaaagatg

SEQ ID NO: 98937 - DNA, 103 bp, Artificial Sequence
  Synthetic Polynucleotide
taatacgactcactatagggttgcttggcaatgcgctcatgcatccgagcaacagaggagagctcggatgcatgagcgcaacctggcggcagcgcaaaagatg

SEQ ID NO: 98938 - DNA, 103 bp, Artificial Sequence
  Synthetic Polynucleotide
taatacgactcactatagggcatcttgatattgcttggcaatgcgctcataacagaggagaatgagcatgttgccaagcaacctggcggcagcgcaaaagatg

SEQ ID NO: 98939 - DNA, 103 bp, Artificial Sequence
  Synthetic Polynucleotide
taatacgactcactataggggctcgaatagcatcttgatattgcttggcaaacagaggagatgccaaatgatatcaagaaacctggcggcagcgcaaaagatg

SEQ ID NO: 98940 - DNA, 103 bp, Artificial Sequence
  Synthetic Polynucleotide
taatacgactcactatagggtgctcggtgtgctcgaatagcatcttgataaacagaggagatatcaaatggctattcgaaacctggcggcagcgcaaaagatg

SEQ ID NO: 98941 - DNA, 103 bp, Artificial Sequence
  Synthetic Polynucleotide
taatacgactcactatagggctttccgtcctgctcggtgtgctcgaatagaacagaggagactattcatgcacaccgagaacctggcggcagcgcaaaagatg

SEQ ID NO: 98942 - DNA, 103 bp, Artificial Sequence
  Synthetic Polynucleotide
taatacgactcactataggggcaaagttgactttccgtcctgctcggtgtaacagaggagaacaccgatgaggacggaaaacctggcggcagcgcaaaagatg

SEQ ID NO: 98943 - DNA, 103 bp, Artificial Sequence
  Synthetic Polynucleotide
taatacgactcactatagggagcctccaggtcctcatcatcttcagcctcaacagaggagagaggctatggatgatgagaacctggcggcagcgcaaaagatg

SEQ ID NO: 98944 - DNA, 103 bp, Artificial Sequence
  Synthetic Polynucleotide
taatacgactcactatagggaggcaattcagcaaagttgactttccgtccaacagaggagaggacggatggtcaactttaacctggcggcagcgcaaaagatg

SEQ ID NO: 98945 - DNA, 103 bp, Artificial Sequence
  Synthetic Polynucleotide
taatacgactcactatagggctggaggaacaggcaattcagcaaagttgaaacagaggagatcaactatgctgaattgcaacctggcggcagcgcaaaagatg

SEQ ID NO: 98946 - DNA, 103 bp, Artificial Sequence
  Synthetic Polynucleotide
taatacgactcactataggggggggaaatcctggaggaacaggcaattcaaacagaggagatgaattatgtgttcctccaacctggcggcagcgcaaaagatg

SEQ ID NO: 98947 - DNA, 103 bp, Artificial Sequence
  Synthetic Polynucleotide
taatacgactcactataggggccagggatggggggaaatcctggaggaacaacagaggagagttcctatgggatttcccaacctggcggcagcgcaaaagatg

SEQ ID NO: 98948 - DNA, 103 bp, Artificial Sequence
  Synthetic Polynucleotide
taatacgactcactatagggtggactccaggccagggatggggggaaatcaacagaggagagatttcatgccatccctgaacctggcggcagcgcaaaagatg

SEQ ID NO: 98949 - DNA, 103 bp, Artificial Sequence
  Synthetic Polynucleotide
taatacgactcactatagggacacccatagtggactccaggccagggatgaacagaggagacatcccatgcctggagtcaacctggcggcagcgcaaaagatg

SEQ ID NO: 98950 - DNA, 103 bp, Artificial Sequence
  Synthetic Polynucleotide
taatacgactcactataggggtcctcctcaacacccatagtggactccagaacagaggagactggagatgactatgggtaacctggcggcagcgcaaaagatg

SEQ ID NO: 98951 - DNA, 103 bp, Artificial Sequence
  Synthetic Polynucleotide
taatacgactcactatagggctgccactgcgtcctcctcaacacccatagaacagaggagactatggatgttgaggaggaacctggcggcagcgcaaaagatg

SEQ ID NO: 98952 - DNA, 103 bp, Artificial Sequence
  Synthetic Polynucleotide
taatacgactcactataggggccaatgtcgctgccactgcgtcctcctcaaacagaggagatgaggaatgcgcagtggcaacctggcggcagcgcaaaagatg

SEQ ID NO: 98953 - DNA, 103 bp, Artificial Sequence
  Synthetic Polynucleotide
taatacgactcactatagggctctgcagctgccaatgtcgctgccactgcaacagaggagagcagtgatggcgacattgaacctggcggcagcgcaaaagatg

SEQ ID NO: 98954 - DNA, 103 bp, Artificial Sequence
  Synthetic Polynucleotide
taatacgactcactatagggccagcagctcagcctccaggtcctcatcataacagaggagaatgatgatgacctggaggaacctggcggcagcgcaaaagatg

SEQ ID NO: 98955 - DNA, 103 bp, Artificial Sequence
  Synthetic Polynucleotide
taatacgactcactatagggaggccagtttctctgcagctgccaatgtcgaacagaggagacgacatatgcagctgcagaacctggcggcagcgcaaaagatg

SEQ ID NO: 98956 - DNA, 103 bp, Artificial Sequence
  Synthetic Polynucleotide
taatacgactcactatagggtcctctgcagaggccagtttctctgcagctaacagaggagaagctgcatggaaactggcaacctggcggcagcgcaaaagatg

SEQ ID NO: 98957 - DNA, 103 bp, Artificial Sequence
  Synthetic Polynucleotide
taatacgactcactatagggcggggctgaatcctctgcagaggccagtttaacagaggagaaaactgatgtctgcagagaacctggcggcagcgcaaaagatg

SEQ ID NO: 98958 - DNA, 103 bp, Artificial Sequence
  Synthetic Polynucleotide
taatacgactcactatagggctttatcagccggggctgaatcctctgcagaacagaggagactgcagatgattcagcccaacctggcggcagcgcaaaagatg

SEQ ID NO: 98959 - DNA, 103 bp, Artificial Sequence
  Synthetic Polynucleotide
taatacgactcactatagggtcgtcctcgtctttatcagccggggctgaaaacagaggagattcagcatgggctgataaaacctggcggcagcgcaaaagatg

SEQ ID NO: 98960 - DNA, 103 bp, Artificial Sequence
  Synthetic Polynucleotide
taatacgactcactatagggcccaggaggctcgtcctcgtctttatcagcaacagaggagagctgatatggacgaggacaacctggcggcagcgcaaaagatg

SEQ ID NO: 98961 - DNA, 103 bp, Artificial Sequence
  Synthetic Polynucleotide
taatacgactcactatagggcctgcaggtgcccaggaggctcgtcctcgtaacagaggagaacgaggatgagcctcctgaacctggcggcagcgcaaaagatg

SEQ ID NO: 98962 - DNA, 103 bp, Artificial Sequence
  Synthetic Polynucleotide
taatacgactcactataggggggggctcaccctgcaggtgcccaggaggcaacagaggagagcctccatggcacctgcaaacctggcggcagcgcaaaagatg

SEQ ID NO: 98963 - DNA, 103 bp, Artificial Sequence
  Synthetic Polynucleotide
taatacgactcactatagggggcctgtgctgggggctcaccctgcaggtgaacagaggagacacctgatgggtgagcccaacctggcggcagcgcaaaagatg

SEQ ID NO: 98964 - DNA, 103 bp, Artificial Sequence
  Synthetic Polynucleotide
taatacgactcactatagggtggccactggggcctgtgctgggggctcacaacagaggagagtgagcatgcagcacaggaacctggcggcagcgcaaaagatg

SEQ ID NO: 98965 - DNA, 103 bp, Artificial Sequence
  Synthetic Polynucleotide
taatacgactcactatagggcctgtgagagccagcagctcagcctccaggaacagaggagacctggaatgtgagctgctaacctggcggcagcgcaaaagatg

SEQ ID NO: 98966 - DNA, 103 bp, Artificial Sequence
  Synthetic Polynucleotide
taatacgactcactataggggcaggtttcttggccactggggcctgtgctaacagaggagaagcacaatgcccagtggcaacctggcggcagcgcaaaagatg

SEQ ID NO: 98967 - DNA, 103 bp, Artificial Sequence
  Synthetic Polynucleotide
taatacgactcactatagggtgtgggccgtgcaggtttcttggccactggaacagaggagaccagtgatgaagaaacctaacctggcggcagcgcaaaagatg

SEQ ID NO: 98968 - DNA, 103 bp, Artificial Sequence
  Synthetic Polynucleotide
taatacgactcactatagggatgaagggactgtgggccgtgcaggtttctaacagaggagaagaaacatgcacggcccaaacctggcggcagcgcaaaagatg

SEQ ID NO: 98969 - DNA, 103 bp, Artificial Sequence
  Synthetic Polynucleotide
taatacgactcactatagggaggcgctgggatgaagggactgtgggccgtaacagaggagaacggccatgagtcccttcaacctggcggcagcgcaaaagatg

SEQ ID NO: 98970 - DNA, 103 bp, Artificial Sequence
  Synthetic Polynucleotide
taatacgactcactataggggggctcaggcaggcgctgggatgaagggacaacagaggagagtccctatgtcccagcgcaacctggcggcagcgcaaaagatg

SEQ ID NO: 98971 - DNA, 103 bp, Artificial Sequence
  Synthetic Polynucleotide
taatacgactcactatagggttgaggccctgggctcaggcaggcgctgggaacagaggagacccagcatgtgcctgagcaacctggcggcagcgcaaaagatg

SEQ ID NO: 98972 - DNA, 103 bp, Artificial Sequence
  Synthetic Polynucleotide
taatacgactcactatagggtccttagaacttgaggccctgggctcaggcaacagaggagagcctgaatgcagggcctcaacctggcggcagcgcaaaagatg

SEQ ID NO: 98973 - DNA, 103 bp, Artificial Sequence
  Synthetic Polynucleotide
taatacgactcactatagggactcggtgactccttagaacttgaggccctaacagaggagaagggccatgagttctaagaacctggcggcagcgcaaaagatg

SEQ ID NO: 98974 - DNA, 103 bp, Artificial Sequence
  Synthetic Polynucleotide
taatacgactcactataggggcacagatggactcggtgactccttagaacaacagaggagagttctaatgagtcaccgaaacctggcggcagcgcaaaagatg

SEQ ID NO: 98975 - DNA, 103 bp, Artificial Sequence
  Synthetic Polynucleotide
taatacgactcactatagggagctgctcccgcacagatggactcggtgacaacagaggagagtcaccatgtccatctgtaacctggcggcagcgcaaaagatg

SEQ ID NO: 98976 - DNA, 103 bp, Artificial Sequence
  Synthetic Polynucleotide
taatacgactcactatagggttgtgcttcccctgtgagagccagcagctcaacagaggagagagctgatggctctcacaaacctggcggcagcgcaaaagatg

SEQ ID NO: 98977 - DNA, 103 bp, Artificial Sequence
  Synthetic Polynucleotide
taatacgactcactatagggcagcagtgccagctgctcccgcacagatggaacagaggagaccatctatgcgggagcagaacctggcggcagcgcaaaagatg

SEQ ID NO: 98978 - DNA, 103 bp, Artificial Sequence
  Synthetic Polynucleotide
taatacgactcactatagggtccgtgcctccagcagtgccagctgctcccaacagaggagagggagcatgtggcactgcaacctggcggcagcgcaaaagatg

SEQ ID NO: 98979 - DNA, 103 bp, Artificial Sequence
  Synthetic Polynucleotide
taatacgactcactatagggtactgcagtttccgtgcctccagcagtgccaacagaggagaggcactatgggaggcacgaacctggcggcagcgcaaaagatg

SEQ ID NO: 98980 - DNA, 103 bp, Artificial Sequence
  Synthetic Polynucleotide
taatacgactcactatagggtgcccgctgatactgcagtttccgtgcctcaacagaggagagaggcaatgaaactgcagaacctggcggcagcgcaaaagatg

SEQ ID NO: 98981 - DNA, 103 bp, Artificial Sequence
  Synthetic Polynucleotide
taatacgactcactatagggcctgcagggctgcccgctgatactgcagttaacagaggagaaactgcatgatcagcgggaacctggcggcagcgcaaaagatg

SEQ ID NO: 98982 - DNA, 103 bp, Artificial Sequence
  Synthetic Polynucleotide
taatacgactcactatagggctgcgcttggcctgcagggctgcccgctgaaacagaggagatcagcgatgagccctgcaaacctggcggcagcgcaaaagatg

SEQ ID NO: 98983 - DNA, 103 bp, Artificial Sequence
  Synthetic Polynucleotide
taatacgactcactatagggcaggtcctggctgcgcttggcctgcagggcaacagaggagagccctgatggccaagcgcaacctggcggcagcgcaaaagatg

SEQ ID NO: 98984 - DNA, 103 bp, Artificial Sequence
  Synthetic Polynucleotide
taatacgactcactatagggtggcctgctccaggtcctggctgcgcttggaacagaggagaccaagcatggccaggaccaacctggcggcagcgcaaaagatg

SEQ ID NO: 98985 - DNA, 103 bp, Artificial Sequence
  Synthetic Polynucleotide
taatacgactcactatagggagataggctttggcctgctccaggtcctggaacagaggagaccaggaatgggagcaggcaacctggcggcagcgcaaaagatg

SEQ ID NO: 98986 - DNA, 103 bp, Artificial Sequence
  Synthetic Polynucleotide
taatacgactcactatagggggctacccgcagataggctttggcctgctcaacagaggagagagcagatgaaagcctataacctggcggcagcgcaaaagatg

SEQ ID NO: 98987 - DNA, 103 bp, Artificial Sequence
  Synthetic Polynucleotide
taatacgactcactatagggtgcctgtggtttgtgcttcccctgtgagagaacagaggagactctcaatggggaagcacaacctggcggcagcgcaaaagatg

SEQ ID NO: 98988 - DNA, 103 bp, Artificial Sequence
  Synthetic Polynucleotide
taatacgactcactatagggcaagccatttggctacccgcagataggcttaacagaggagaaagcctatgtgcgggtagaacctggcggcagcgcaaaagatg

SEQ ID NO: 98989 - DNA, 103 bp, Artificial Sequence
  Synthetic Polynucleotide
taatacgactcactatagggatctgagcctcaagccatttggctacccgcaacagaggagagcgggtatgcaaatggctaacctggcggcagcgcaaaagatg

SEQ ID NO: 98990 - DNA, 103 bp, Artificial Sequence
  Synthetic Polynucleotide
taatacgactcactatagggggcctggatgatctgagcctcaagccatttaacagaggagaaaatggatggaggctcagaacctggcggcagcgcaaaagatg

SEQ ID NO: 98991 - DNA, 103 bp, Artificial Sequence
  Synthetic Polynucleotide
taatacgactcactatagggtgccagatcgggcctggatgatctgagcctaacagaggagaaggctcatgtcatccaggaacctggcggcagcgcaaaagatg

SEQ ID NO: 98992 - DNA, 103 bp, Artificial Sequence
  Synthetic Polynucleotide
taatacgactcactatagggtcaacaggtctgccagatcgggcctggatgaacagaggagacatccaatgccgatctggaacctggcggcagcgcaaaagatg

SEQ ID NO: 98993 - DNA, 103 bp, Artificial Sequence
  Synthetic Polynucleotide
taatacgactcactatagggcttggacagatcaacaggtctgccagatcgaacagaggagacgatctatgagacctgttaacctggcggcagcgcaaaagatg

SEQ ID NO: 98994 - DNA, 103 bp, Artificial Sequence
  Synthetic Polynucleotide
taatacgactcactataggggcgaaggcaccttggacagatcaacaggtcaacagaggagagacctgatgatctgtccaaacctggcggcagcgcaaaagatg

SEQ ID NO: 98995 - DNA, 103 bp, Artificial Sequence
  Synthetic Polynucleotide
taatacgactcactatagggtccgtcaagggcgaaggcaccttggacagaaacagaggagatctgtcatgggtgccttcaacctggcggcagcgcaaaagatg

SEQ ID NO: 98996 - DNA, 103 bp, Artificial Sequence
  Synthetic Polynucleotide
taatacgactcactatagggaccctcctcatccgtcaagggcgaaggcacaacagaggagagtgcctatgcccttgacgaacctggcggcagcgcaaaagatg

SEQ ID NO: 98997 - DNA, 103 bp, Artificial Sequence
  Synthetic Polynucleotide
taatacgactcactatagggggatgaagtcaccctcctcatccgtcaaggaacagaggagaccttgaatgatgaggaggaacctggcggcagcgcaaaagatg

SEQ ID NO: 98998 - DNA, 103 bp, Artificial Sequence
  Synthetic Polynucleotide
taatacgactcactataggggctggcttcttgcctgtggtttgtgcttccaacagaggagaggaagcatgaaccacaggaacctggcggcagcgcaaaagatg

SEQ ID NO: 98999 - DNA, 103 bp, Artificial Sequence
  Synthetic Polynucleotide
taatacgactcactatagggtggtggatgaggatgaagtcaccctcctcaaacagaggagatgaggaatgtgacttcataacctggcggcagcgcaaaagatg

SEQ ID NO: 99000 - DNA, 103 bp, Artificial Sequence
  Synthetic Polynucleotide
taatacgactcactatagggcaggtcctcatggtggatgaggatgaagtcaacagaggagagacttcatgctcatccacaacctggcggcagcgcaaaagatg

SEQ ID NO: 99001 - DNA, 103 bp, Artificial Sequence
  Synthetic Polynucleotide
taatacgactcactataggggggagagtcgcaggtcctcatggtggatgaaacagaggagatcatccatgatgaggaccaacctggcggcagcgcaaaagatg

SEQ ID NO: 99002 - DNA, 103 bp, Artificial Sequence
  Synthetic Polynucleotide
taatacgactcactatagggtccgccttctgggagagtcgcaggtcctcaaacagaggagatgaggaatggcgactctcaacctggcggcagcgcaaaagatg

SEQ ID NO: 99003 - DNA, 103 bp, Artificial Sequence
  Synthetic Polynucleotide
taatacgactcactatagggatacacctcctccgccttctgggagagtcgaacagaggagacgactcatgcagaaggcgaacctggcggcagcgcaaaagatg

SEQ ID NO: 99004 - DNA, 103 bp, Artificial Sequence
  Synthetic Polynucleotide
taatacgactcactataggggcagctgggcatacacctcctccgccttctaacagaggagaagaaggatgaggaggtgtaacctggcggcagcgcaaaagatg

SEQ ID NO: 99005 - DNA, 103 bp, Artificial Sequence
  Synthetic Polynucleotide
taatacgactcactatagggagcattttttgcagctgggcatacacctccaacagaggagaggaggtatgtgcccagctaacctggcggcagcgcaaaagatg

SEQ ID NO: 99006 - DNA, 103 bp, Artificial Sequence
  Synthetic Polynucleotide
taatacgactcactatagggttgctccagaagcattttttgcagctgggcaacagaggagagcccagatgcaaaaaatgaacctggcggcagcgcaaaagatg

SEQ ID NO: 99007 - DNA, 103 bp, Artificial Sequence
  Synthetic Polynucleotide
taatacgactcactatagggacttctcttgttgctccagaagcattttttaacagaggagaaaaaaaatgttctggagcaacctggcggcagcgcaaaagatg

SEQ ID NO: 99008 - DNA, 103 bp, Artificial Sequence
  Synthetic Polynucleotide
taatacgactcactatagggaacagcaggcacttctcttgttgctccagaaacagaggagatctggaatgacaagagaaaacctggcggcagcgcaaaagatg

SEQ ID NO: 99009 - DNA, 103 bp, Artificial Sequence
  Synthetic Polynucleotide
taatacgactcactatagggccccttgggtgctggcttcttgcctgtggtaacagaggagaaccacaatgaagaagccaaacctggcggcagcgcaaaagatg

SEQ ID NO: 99010 - DNA, 103 bp, Artificial Sequence
  Synthetic Polynucleotide
taatacgactcactatagggctgcttggagaacagcaggcacttctcttgaacagaggagacaagagatgtgcctgctgaacctggcggcagcgcaaaagatg

SEQ ID NO: 99011 - DNA, 103 bp, Artificial Sequence
  Synthetic Polynucleotide
taatacgactcactatagggggtgcatgaactgcttggagaacagcaggcaacagaggagagcctgcatgtctccaagcaacctggcggcagcgcaaaagatg

SEQ ID NO: 99012 - DNA, 103 bp, Artificial Sequence
  Synthetic Polynucleotide
taatacgactcactatagggacgttgccctggtgcatgaactgcttggagaacagaggagactccaaatggttcatgcaaacctggcggcagcgcaaaagatg

SEQ ID NO: 99013 - DNA, 103 bp, Artificial Sequence
  Synthetic Polynucleotide
taatacgactcactatagggggtctcagccacgttgccctggtgcatgaaaacagaggagattcatgatgcagggcaacaacctggcggcagcgcaaaagatg

SEQ ID NO: 99014 - DNA, 103 bp, Artificial Sequence
  Synthetic Polynucleotide
taatacgactcactatagggcaaatcgggtggtctcagccacgttgccctaacagaggagaagggcaatgtggctgagaaacctggcggcagcgcaaaagatg

SEQ ID NO: 99015 - DNA, 103 bp, Artificial Sequence
  Synthetic Polynucleotide
taatacgactcactataggggcaagcttctcaaatcgggtggtctcagccaacagaggagaggctgaatgcacccgattaacctggcggcagcgcaaaagatg

SEQ ID NO: 99016 - DNA, 103 bp, Artificial Sequence
  Synthetic Polynucleotide
taatacgactcactataggggcggtcctgagcaagcttctcaaatcgggtaacagaggagaacccgaatggagaagcttaacctggcggcagcgcaaaagatg

SEQ ID NO: 99017 - DNA, 103 bp, Artificial Sequence
  Synthetic Polynucleotide
taatacgactcactataggggctgtttcttgcggtcctgagcaagcttctaacagaggagaagaagcatgctcaggaccaacctggcggcagcgcaaaagatg

SEQ ID NO: 99018 - DNA, 103 bp, Artificial Sequence
  Synthetic Polynucleotide
taatacgactcactatagggaggatctccagctgtttcttgcggtcctgaaacagaggagatcaggaatgcaagaaacaaacctggcggcagcgcaaaagatg

SEQ ID NO: 99019 - DNA, 103 bp, Artificial Sequence
  Synthetic Polynucleotide
taatacgactcactatagggggccagctgcaggatctccagctgtttcttaacagaggagaaagaaaatgctggagatcaacctggcggcagcgcaaaagatg

SEQ ID NO: 99020 - DNA, 103 bp, Artificial Sequence
  Synthetic Polynucleotide
taatacgactcactatagggtggcctgagggcccttccgaggtcttggccaacagaggagaggccaaatgctcggaaggaacctggcggcagcgcaaaagatg

SEQ ID NO: 99021 - DNA, 103 bp, Artificial Sequence
  Synthetic Polynucleotide
taatacgactcactatagggggggggcctgccccttgggtgctggcttctaacagaggagaagaagcatgcacccaaggaacctggcggcagcgcaaaagatg

SEQ ID NO: 99022 - DNA, 103 bp, Artificial Sequence
  Synthetic Polynucleotide
taatacgactcactatagggcctgagcctgggccagctgcaggatctccaaacagaggagatggagaatgtgcagctggaacctggcggcagcgcaaaagatg

SEQ ID NO: 99023 - DNA, 103 bp, Artificial Sequence
  Synthetic Polynucleotide
taatacgactcactataggggggtcgaggccctgagcctgggccagctgcaacagaggagagcagctatgccaggctcaaacctggcggcagcgcaaaagatg

SEQ ID NO: 99024 - DNA, 103 bp, Artificial Sequence
  Synthetic Polynucleotide
taatacgactcactataggggtgggtgggagggtcgaggccctgagcctgaacagaggagacaggctatgggcctcgacaacctggcggcagcgcaaaagatg

SEQ ID NO: 99025 - DNA, 103 bp, Artificial Sequence
  Synthetic Polynucleotide
taatacgactcactatagggactcaaagtggtgggtgggagggtcgaggcaacagaggagagcctcgatgctcccacccaacctggcggcagcgcaaaagatg

SEQ ID NO: 99026 - DNA, 103 bp, Artificial Sequence
  Synthetic Polynucleotide
taatacgactcactatagggaatgtcttcaactcaaagtggtgggtgggaaacagaggagatcccacatgccactttgaaacctggcggcagcgcaaaagatg

SEQ ID NO: 99027 - DNA, 103 bp, Artificial Sequence
  Synthetic Polynucleotide
taatacgactcactatagggcacagtctggaatgtcttcaactcaaagtgaacagaggagacactttatgttgaagacaaacctggcggcagcgcaaaagatg

SEQ ID NO: 99028 - DNA, 103 bp, Artificial Sequence
  Synthetic Polynucleotide
taatacgactcactatagggagaagatcctcacagtctggaatgtcttcaaacagaggagatgaagaatgtccagactgaacctggcggcagcgcaaaagatg

SEQ ID NO: 99029 - DNA, 103 bp, Artificial Sequence
  Synthetic Polynucleotide
taatacgactcactatagggttgagttctgagaagatcctcacagtctggaacagaggagaccagacatggaggatcttaacctggcggcagcgcaaaagatg

SEQ ID NO: 99030 - DNA, 103 bp, Artificial Sequence
  Synthetic Polynucleotide
taatacgactcactatagggttctgtgctgttgagttctgagaagatcctaacagaggagaaggatcatgtcagaactcaacctggcggcagcgcaaaagatg

SEQ ID NO: 99031 - DNA, 103 bp, Artificial Sequence
  Synthetic Polynucleotide
taatacgactcactatagggtcagatgcatttctgtgctgttgagttctgaacagaggagacagaacatgacagcacagaacctggcggcagcgcaaaagatg

SEQ ID NO: 99032 - DNA, 103 bp, Artificial Sequence
  Synthetic Polynucleotide
taatacgactcactataggggccatgggcaggggggcctgccccttgggtaacagaggagaacccaaatggcaggccccaacctggcggcagcgcaaaagatg

SEQ ID NO: 99033 - DNA, 103 bp, Artificial Sequence
  Synthetic Polynucleotide
taatacgactcactatagggcggacaatgatcagatgcatttctgtgctgaacagaggagacagcacatgaatgcatctaacctggcggcagcgcaaaagatg

SEQ ID NO: 99034 - DNA, 103 bp, Artificial Sequence
  Synthetic Polynucleotide
taatacgactcactataggggttcattccccggacaatgatcagatgcataacagaggagaatgcatatgatcattgtcaacctggcggcagcgcaaaagatg

SEQ ID NO: 99035 - DNA, 103 bp, Artificial Sequence
  Synthetic Polynucleotide
taatacgactcactataggggggctgggaggttcattccccggacaatgaaacagaggagatcattgatgggggaatgaaacctggcggcagcgcaaaagatg

SEQ ID NO: 99036 - DNA, 103 bp, Artificial Sequence
  Synthetic Polynucleotide
taatacgactcactatagggacccctggaggggctgggaggttcattcccaacagaggagagggaatatgcctcccagcaacctggcggcagcgcaaaagatg

SEQ ID NO: 99037 - DNA, 103 bp, Artificial Sequence
  Synthetic Polynucleotide
taatacgactcactatagggatcgggagtcacccctggaggggctgggagaacagaggagactcccaatgcctccagggaacctggcggcagcgcaaaagatg

SEQ ID NO: 99038 - DNA, 103 bp, Artificial Sequence
  Synthetic Polynucleotide
taatacgactcactatagggcatccaggtcatcgggagtcacccctggagaacagaggagactccagatgtgactcccgaacctggcggcagcgcaaaagatg

SEQ ID NO: 99039 - DNA, 103 bp, Artificial Sequence
  Synthetic Polynucleotide
taatacgactcactatagggcgcacaaaagcatccaggtcatcgggagtcaacagaggagagactccatgtgacctggaaacctggcggcagcgcaaaagatg

SEQ ID NO: 99040 - DNA, 103 bp, Artificial Sequence
  Synthetic Polynucleotide
taatacgactcactatagggaaactcaaaccgcacaaaagcatccaggtcaacagaggagagacctgatggcttttgtgaacctggcggcagcgcaaaagatg

SEQ ID NO: 99041 - DNA, 103 bp, Artificial Sequence
  Synthetic Polynucleotide
taatacgactcactatagggtagggtagtgaaactcaaaccgcacaaaagaacagaggagacttttgatgggtttgagtaacctggcggcagcgcaaaagatg

SEQ ID NO: 99042 - DNA, 103 bp, Artificial Sequence
  Synthetic Polynucleotide
taatacgactcactatagggtggtccgagttagggtagtgaaactcaaacaacagaggagagtttgaatgtcactacccaacctggcggcagcgcaaaagatg

SEQ ID NO: 99043 - DNA, 103 bp, Artificial Sequence
  Synthetic Polynucleotide
taatacgactcactatagggctcgatgtgggccatgggcaggggggcctgaacagaggagacaggccatgctgcccatgaacctggcggcagcgcaaaagatg

SEQ ID NO: 99044 - DNA, 103 bp, Artificial Sequence
  Synthetic Polynucleotide
taatacgactcactatagggtttttgagcctggtccgagttagggtagtgaacagaggagacactacatgaactcggacaacctggcggcagcgcaaaagatg

SEQ ID NO: 99045 - DNA, 103 bp, Artificial Sequence
  Synthetic Polynucleotide
taatacgactcactatagggctgttttgcttttttgagcctggtccgagtaacagaggagaactcggatgaggctcaaaaacctggcggcagcgcaaaagatg

SEQ ID NO: 99046 - DNA, 103 bp, Artificial Sequence
  Synthetic Polynucleotide
taatacgactcactatagggttcaccacagctgttttgcttttttgagccaacagaggagaggctcaatgaagcaaaacaacctggcggcagcgcaaaagatg

SEQ ID NO: 99047 - DNA, 103 bp, Artificial Sequence
  Synthetic Polynucleotide
taatacgactcactataggggtttgtgttcttcaccacagctgttttgctaacagaggagaagcaaaatggctgtggtgaacctggcggcagcgcaaaagatg

SEQ ID NO: 99048 - DNA, 103 bp, Artificial Sequence
  Synthetic Polynucleotide
taatacgactcactatagggattctggagagtttgtgttcttcaccacagaacagaggagactgtggatgagaacacaaaacctggcggcagcgcaaaagatg

SEQ ID NO: 99049 - DNA, 103 bp, Artificial Sequence
  Synthetic Polynucleotide
taatacgactcactatagggagttgatcaaattctggagagtttgtgttcaacagaggagagaacacatgctctccagaaacctggcggcagcgcaaaagatg

SEQ ID NO: 99050 - DNA, 103 bp, Artificial Sequence
  Synthetic Polynucleotide
taatacgactcactatagggtagtttgaagagttgatcaaattctggagaaacagaggagatctccaatgtttgatcaaaacctggcggcagcgcaaaagatg

SEQ ID NO: 99051 - DNA, 103 bp, Artificial Sequence
  Synthetic Polynucleotide
taatacgactcactatagggggttgatgtttagtttgaagagttgatcaaaacagaggagattgatcatgtcttcaaacaacctggcggcagcgcaaaagatg

SEQ ID NO: 99052 - DNA, 103 bp, Artificial Sequence
  Synthetic Polynucleotide
taatacgactcactatagggcggtggtttcggttgatgtttagtttgaagaacagaggagacttcaaatgaaacatcaaaacctggcggcagcgcaaaagatg

SEQ ID NO: 99053 - DNA, 103 bp, Artificial Sequence
  Synthetic Polynucleotide
taatacgactcactatagggcttgaagccccggtggtttcggttgatgttaacagaggagaaacatcatgcgaaaccacaacctggcggcagcgcaaaagatg

SEQ ID NO: 99054 - DNA, 103 bp, Artificial Sequence
  Synthetic Polynucleotide
taatacgactcactatagggccgccaacttctcgatgtgggccatgggcaaacagaggagatgcccaatgcccacatcgaacctggcggcagcgcaaaagatg

SEQ ID NO: 99055 - DNA, 103 bp, Artificial Sequence
  Synthetic Polynucleotide
taatacgactcactatagggggatcaccctcttgaagccccggtggtttcaacagaggagagaaaccatgggggcttcaaacctggcggcagcgcaaaagatg

SEQ ID NO: 99056 - DNA, 103 bp, Artificial Sequence
  Synthetic Polynucleotide
taatacgactcactatagggcctttgctctggatcaccctcttgaagcccaacagaggagagggcttatggagggtgataacctggcggcagcgcaaaagatg

SEQ ID NO: 99057 - DNA, 103 bp, Artificial Sequence
  Synthetic Polynucleotide
taatacgactcactatagggaaacttgatgcctttgctctggatcaccctaacagaggagaagggtgatgcagagcaaaaacctggcggcagcgcaaaagatg

SEQ ID NO: 99058 - DNA, 103 bp, Artificial Sequence
  Synthetic Polynucleotide
taatacgactcactatagggggaagatctcaaacttgatgcctttgctctaacagaggagaagagcaatggcatcaagtaacctggcggcagcgcaaaagatg

SEQ ID NO: 99059 - DNA, 103 bp, Artificial Sequence
  Synthetic Polynucleotide
taatacgactcactataggggaccctttgtggaagatctcaaacttgatgaacagaggagacatcaaatgtgagatcttaacctggcggcagcgcaaaagatg

SEQ ID NO: 99060 - DNA, 103 bp, Artificial Sequence
  Synthetic Polynucleotide
taatacgactcactatagggtctgaagaaggaccctttgtggaagatctcaacagaggagagagatcatgcacaaagggaacctggcggcagcgcaaaagatg

SEQ ID NO: 99061 - DNA, 103 bp, Artificial Sequence
  Synthetic Polynucleotide
taatacgactcactataggggcttgtcgcttctgaagaaggaccctttgtaacagaggagaacaaagatgccttcttcaaacctggcggcagcgcaaaagatg

SEQ ID NO: 99062 - DNA, 103 bp, Artificial Sequence
  Synthetic Polynucleotide
taatacgactcactataggggtgccaaccagcttgtcgcttctgaagaagaacagaggagacttcttatgaagcgacaaaacctggcggcagcgcaaaagatg

SEQ ID NO: 99063 - DNA, 103 bp, Artificial Sequence
  Synthetic Polynucleotide
taatacgactcactatagggcaggtgtgctgtgccaaccagcttgtcgctaacagaggagaagcgacatgctggttggcaacctggcggcagcgcaaaagatg

SEQ ID NO: 99064 - DNA, 103 bp, Artificial Sequence
  Synthetic Polynucleotide
taatacgactcactataggggctccagtttcaggtgtgctgtgccaaccaaacagaggagatggttgatgcagcacaccaacctggcggcagcgcaaaagatg

SEQ ID NO: 99065 - DNA, 103 bp, Artificial Sequence
  Synthetic Polynucleotide
taatacgactcactatagggatacagtctgccgccaacttctcgatgtggaacagaggagaccacatatggaagttggcaacctggcggcagcgcaaaagatg

SEQ ID NO: 99066 - DNA, 103 bp, Artificial Sequence
  Synthetic Polynucleotide
taatacgactcactatagggttctccagccgctccagtttcaggtgtgctaacagaggagaagcacaatggaaactggaaacctggcggcagcgcaaaagatg

SEQ ID NO: 99067 - DNA, 103 bp, Artificial Sequence
  Synthetic Polynucleotide
taatacgactcactatagggctcacactcattctccagccgctccagtttaacagaggagaaaactgatgcggctggagaacctggcggcagcgcaaaagatg

SEQ ID NO: 99068 - DNA, 103 bp, Artificial Sequence
  Synthetic Polynucleotide
taatacgactcactatagggtttctctgatctcacactcattctccagccaacagaggagaggctggatgatgagtgtgaacctggcggcagcgcaaaagatg

SEQ ID NO: 99069 - DNA, 103 bp, Artificial Sequence
  Synthetic Polynucleotide
taatacgactcactatagggacctccacaatttctctgatctcacactcaaacagaggagatgagtgatggatcagagaaacctggcggcagcgcaaaagatg

SEQ ID NO: 99070 - DNA, 103 bp, Artificial Sequence
  Synthetic Polynucleotide
taatacgactcactatagggtccatccaggacctccacaatttctctgataacagaggagaatcagaatgattgtggagaacctggcggcagcgcaaaagatg

SEQ ID NO: 99071 - DNA, 103 bp, Artificial Sequence
  Synthetic Polynucleotide
taatacgactcactatagggtgggcttccttccatccaggacctccacaaaacagaggagattgtggatgtcctggatgaacctggcggcagcgcaaaagatg

SEQ ID NO: 99072 - DNA, 103 bp, Artificial Sequence
  Synthetic Polynucleotide
taatacgactcactatagggttccccccggtgggcttccttccatccaggaacagaggagacctggaatgaaggaagccaacctggcggcagcgcaaaagatg

SEQ ID NO: 99073 - DNA, 103 bp, Artificial Sequence
  Synthetic Polynucleotide
taatacgactcactatagggcacctccagcttccccccggtgggcttcctaacagaggagaaggaagatgaccggggggaacctggcggcagcgcaaaagatg

SEQ ID NO: 99074 - DNA, 103 bp, Artificial Sequence
  Synthetic Polynucleotide
taatacgactcactataggggcctcaccttcacctccagcttccccccggaacagaggagaccggggatgagctggaggaacctggcggcagcgcaaaagatg

SEQ ID NO: 99075 - DNA, 103 bp, Artificial Sequence
  Synthetic Polynucleotide
taatacgactcactatagggggctcccgcagcctcaccttcacctccagcaacagaggagagctggaatggaaggtgagaacctggcggcagcgcaaaagatg

SEQ ID NO: 99076 - DNA, 103 bp, Artificial Sequence
  Synthetic Polynucleotide
taatacgactcactatagggcacatcccgcatacagtctgccgccaacttaacagaggagaaagttgatggcagactgtaacctggcggcagcgcaaaagatg

SEQ ID NO: 99077 - DNA, 103 bp, Artificial Sequence
  Synthetic Polynucleotide
taatacgactcactataggggccactcagaggctcccgcagcctcaccttaacagaggagaaaggtgatgctgcgggagaacctggcggcagcgcaaaagatg

SEQ ID NO: 99078 - DNA, 103 bp, Artificial Sequence
  Synthetic Polynucleotide
taatacgactcactataggggcacatcctggccactcagaggctcccgcaaacagaggagatgcgggatgctctgagtgaacctggcggcagcgcaaaagatg

SEQ ID NO: 99079 - DNA, 103 bp, Artificial Sequence
  Synthetic Polynucleotide
taatacgactcactataggggtgaccatctgcacatcctggccactcagaaacagaggagatctgagatgccaggatgtaacctggcggcagcgcaaaagatg

SEQ ID NO: 99080 - DNA, 103 bp, Artificial Sequence
  Synthetic Polynucleotide
taatacgactcactatagggccagttctcagtgaccatctgcacatcctgaacagaggagacaggatatgcagatggtcaacctggcggcagcgcaaaagatg

SEQ ID NO: 99081 - DNA, 103 bp, Artificial Sequence
  Synthetic Polynucleotide
taatacgactcactatagggccagaaccagccagttctcagtgaccatctaacagaggagaagatggatgctgagaactaacctggcggcagcgcaaaagatg

SEQ ID NO: 99082 - DNA, 103 bp, Artificial Sequence
  Synthetic Polynucleotide
taatacgactcactatagggcccctgggctccagaaccagccagttctcaaacagaggagatgagaaatggctggttctaacctggcggcagcgcaaaagatg

SEQ ID NO: 99083 - DNA, 103 bp, Artificial Sequence
  Synthetic Polynucleotide
taatacgactcactatagggcctcctcctccacatcccgcatacagtctgaacagaggagacagactatgtgcgggatgaacctggcggcagcgcaaaagatg

SEQ ID NO: 99084 - DNA, 103 bp, Artificial Sequence
  Synthetic Polynucleotide
taatacgactcactatagggtcctcctcctcctcctcctccacatcccgcaacagaggagagcgggaatgggaggaggaaacctggcggcagcgcaaaagatg

SEQ ID NO: 99085 - DNA, 103 bp, Artificial Sequence
  Synthetic Polynucleotide
taatacgactcactatagggctccagcccttcctcctcctcctcctcctcaacagaggagagaggagatggaggaggagaacctggcggcagcgcaaaagatg

SEQ ID NO: 99086 - DNA, 103 bp, Artificial Sequence
  Synthetic Polynucleotide
taatacgactcactatagggctgcatcttcctccagcccttcctcctcctaacagaggagaaggaggatgaagggctggaacctggcggcagcgcaaaagatg

SEQ ID NO: 99087 - DNA, 103 bp, Artificial Sequence
  Synthetic Polynucleotide
taatacgactcactatagggccttggcctctggcctgagggcccttccgaaacagaggagatcggaaatgccctcaggcaacctggcggcagcgcaaaagatg

SEQ ID NO: 99088 - DNA, 103 bp, Artificial Sequence
  Synthetic Polynucleotide
taatacgactcactataggggtcagcagctctgcatcttcctccagccctaacagaggagaagggctatgggaagatgcaacctggcggcagcgcaaaagatg

SEQ ID NO: 99089 - DNA, 103 bp, Artificial Sequence
  Synthetic Polynucleotide
taatacgactcactatagggctgcagctccgtcagcagctctgcatcttcaacagaggagagaagatatggagctgctgaacctggcggcagcgcaaaagatg

SEQ ID NO: 99090 - DNA, 103 bp, Artificial Sequence
  Synthetic Polynucleotide
taatacgactcactatagggctaagacctcctgcagctccgtcagcagctaacagaggagaagctgcatgcggagctgcaacctggcggcagcgcaaaagatg

SEQ ID NO: 99091 - DNA, 103 bp, Artificial Sequence
  Synthetic Polynucleotide
taatacgactcactatagggtcgtccacacctaagacctcctgcagctccaacagaggagaggagctatgggaggtcttaacctggcggcagcgcaaaagatg

SEQ ID NO: 99092 - DNA, 103 bp, Artificial Sequence
  Synthetic Polynucleotide
taatacgactcactatagggctcagtctcctcgtccacacctaagacctcaacagaggagagaggtcatgggtgtggacaacctggcggcagcgcaaaagatg

SEQ ID NO: 99093 - DNA, 103 bp, Artificial Sequence
  Synthetic Polynucleotide
taatacgactcactatagggcatccaggggctcagtctcctcgtccacacaacagaggagagtgtggatgaggagactgaacctggcggcagcgcaaaagatg

SEQ ID NO: 99094 - DNA, 103 bp, Artificial Sequence
  Synthetic Polynucleotide
taatacgactcactatagggacctcatcaccatccaggggctcagtctccaacagaggagaggagacatggcccctggaaacctggcggcagcgcaaaagatg

SEQ ID NO: 99095 - DNA, 103 bp, Artificial Sequence
  Synthetic Polynucleotide
taatacgactcactatagggtgggtcagctacctcatcaccatccaggggaacagaggagacccctgatgggtgatgagaacctggcggcagcgcaaaagatg

SEQ ID NO: 99096 - DNA, 103 bp, Artificial Sequence
  Synthetic Polynucleotide
taatacgactcactatagggcagagccgcctgggtcagctacctcatcacaacagaggagagtgatgatgtagctgaccaacctggcggcagcgcaaaagatg

SEQ ID NO: 99097 - DNA, 103 bp, Artificial Sequence
  Synthetic Polynucleotide
taatacgactcactatagggttctcctcctcagagccgcctgggtcagctaacagaggagaagctgaatgaggcggctcaacctggcggcagcgcaaaagatg

SEQ ID NO: 99098 - DNA, 103 bp, Artificial Sequence
  Synthetic Polynucleotide
taatacgactcactatagggagcggccaccccttggcctctggcctgaggaacagaggagacctcagatgagaggccaaaacctggcggcagcgcaaaagatg

SEQ ID NO: 99099 - DNA, 103 bp, Artificial Sequence
  Synthetic Polynucleotide
taatacgactcactatagggttctaggccgttctcctcctcagagccgccaacagaggagaggcggcatggaggaggagaacctggcggcagcgcaaaagatg

SEQ ID NO: 99100 - DNA, 103 bp, Artificial Sequence
  Synthetic Polynucleotide
taatacgactcactataggggttcagtgtcttctaggccgttctcctcctaacagaggagaaggaggatgacggcctagaacctggcggcagcgcaaaagatg

SEQ ID NO: 99101 - DNA, 103 bp, Artificial Sequence
  Synthetic Polynucleotide
taatacgactcactatagggtgcactggaggttcagtgtcttctaggccgaacagaggagacggcctatgagacactgaaacctggcggcagcgcaaaagatg

SEQ ID NO: 99102 - DNA, 103 bp, Artificial Sequence
  Synthetic Polynucleotide
taatacgactcactataggggacggctgtctgcactggaggttcagtgtcaacagaggagagacactatgcctccagtgaacctggcggcagcgcaaaagatg

SEQ ID NO: 99103 - DNA, 103 bp, Artificial Sequence
  Synthetic Polynucleotide
taatacgactcactatagggaagctgtcaggacggctgtctgcactggagaacagaggagactccagatgagacagccgaacctggcggcagcgcaaaagatg

SEQ ID NO: 99104 - DNA, 103 bp, Artificial Sequence
  Synthetic Polynucleotide
taatacgactcactataggggctggggctgaagctgtcaggacggctgtcaacagaggagagacagcatgcctgacagcaacctggcggcagcgcaaaagatg

SEQ ID NO: 99105 - DNA, 103 bp, Artificial Sequence
  Synthetic Polynucleotide
taatacgactcactatagggggcctgagctgctggggctgaagctgtcagaacagaggagactgacaatgtcagccccaaacctggcggcagcgcaaaagatg

SEQ ID NO: 99106 - DNA, 103 bp, Artificial Sequence
  Synthetic Polynucleotide
taatacgactcactataggggagatgctccggcctgagctgctggggctgaacagaggagacagcccatgcagctcaggaacctggcggcagcgcaaaagatg

SEQ ID NO: 99107 - DNA, 103 bp, Artificial Sequence
  Synthetic Polynucleotide
taatacgactcactatagggtgtagcccctgagatgctccggcctgagctaacagaggagaagctcaatgcggagcatcaacctggcggcagcgcaaaagatg

SEQ ID NO: 99108 - DNA, 103 bp, Artificial Sequence
  Synthetic Polynucleotide
taatacgactcactatagggcagcaaagcgtgtagcccctgagatgctccaacagaggagaggagcaatgcaggggctaaacctggcggcagcgcaaaagatg

SEQ ID NO: 99109 - DNA, 103 bp, Artificial Sequence
  Synthetic Polynucleotide
taatacgactcactatagggtctgcttggcagcggccaccccttggcctcaacagaggagagaggccatggggtggccgaacctggcggcagcgcaaaagatg

SEQ ID NO: 99110 - DNA, 103 bp, Artificial Sequence
  Synthetic Polynucleotide
taatacgactcactatagggtccgttcctccagcaaagcgtgtagcccctaacagaggagaaggggcatgacgctttgcaacctggcggcagcgcaaaagatg

SEQ ID NO: 99111 - DNA, 103 bp, Artificial Sequence
  Synthetic Polynucleotide
taatacgactcactatagggtagttgtgaatccgttcctccagcaaagcgaacagaggagacgctttatgggaggaacgaacctggcggcagcgcaaaagatg

SEQ ID NO: 99112 - DNA, 103 bp, Artificial Sequence
  Synthetic Polynucleotide
taatacgactcactatagggagcctctcggtagttgtgaatccgttcctcaacagaggagagaggaaatgattcacaacaacctggcggcagcgcaaaagatg

SEQ ID NO: 99113 - DNA, 103 bp, Artificial Sequence
  Synthetic Polynucleotide
taatacgactcactatagggcactggccgcagcctctcggtagttgtgaaaacagaggagattcacaatgaccgagaggaacctggcggcagcgcaaaagatg

SEQ ID NO: 99114 - DNA, 103 bp, Artificial Sequence
  Synthetic Polynucleotide
taatacgactcactataggggcctccttggcactggccgcagcctctcggaacagaggagaccgagaatgtgcggccagaacctggcggcagcgcaaaagatg

SEQ ID NO: 99115 - DNA, 103 bp, Artificial Sequence
  Synthetic Polynucleotide
taatacgactcactatagggtgcttcgcctgcctccttggcactggccgcaacagaggagagcggccatggccaaggagaacctggcggcagcgcaaaagatg

SEQ ID NO: 99116 - DNA, 103 bp, Artificial Sequence
  Synthetic Polynucleotide
taatacgactcactatagggtggctttggctgcttcgcctgcctccttggaacagaggagaccaaggatgcaggcgaagaacctggcggcagcgcaaaagatg

SEQ ID NO: 99117 - DNA, 103 bp, Artificial Sequence
  Synthetic Polynucleotide
taatacgactcactatagggtcgcagcgcctggctttggctgcttcgcctaacagaggagaaggcgaatgagccaaagcaacctggcggcagcgcaaaagatg

SEQ ID NO: 99118 - DNA, 103 bp, Artificial Sequence
  Synthetic Polynucleotide
taatacgactcactatagggcaggccgcgctcgcagcgcctggctttggcaacagaggagagccaaaatgaggcgctgcaacctggcggcagcgcaaaagatg

SEQ ID NO: 99119 - DNA, 103 bp, Artificial Sequence
  Synthetic Polynucleotide
taatacgactcactatagggccaaggtcttcaggccgcgctcgcagcgccaacagaggagaggcgctatgagcgcggccaacctggcggcagcgcaaaagatg

SEQ ID NO: 99120 - DNA, 103 bp, Artificial Sequence
  Synthetic Polynucleotide
taatacgactcactatagggaagagccccatctgcttggcagcggccaccaacagaggagaggtggcatgtgccaagcaaacctggcggcagcgcaaaagatg

SEQ ID NO: 99121 - DNA, 103 bp, Artificial Sequence
  Synthetic Polynucleotide
taatacgactcactatagggagctgcgactccaaggtcttcaggccgcgcaacagaggagagcgcggatggaagaccttaacctggcggcagcgcaaaagatg

SEQ ID NO: 99122 - DNA, 103 bp, Artificial Sequence
  Synthetic Polynucleotide
taatacgactcactatagggcacagaggctagctgcgactccaaggtcttaacagaggagaaagaccatggagtcgcagaacctggcggcagcgcaaaagatg

SEQ ID NO: 99123 - DNA, 103 bp, Artificial Sequence
  Synthetic Polynucleotide
taatacgactcactatagggtgcctctcctcacagaggctagctgcgactaacagaggagaagtcgcatgtagcctctgaacctggcggcagcgcaaaagatg

SEQ ID NO: 99124 - DNA, 103 bp, Artificial Sequence
  Synthetic Polynucleotide
taatacgactcactatagggttgatctttctgcctctcctcacagaggctaacagaggagaagcctcatggaggagaggaacctggcggcagcgcaaaagatg

SEQ ID NO: 99125 - DNA, 103 bp, Artificial Sequence
  Synthetic Polynucleotide
taatacgactcactatagggctcatcctcattgatctttctgcctctcctaacagaggagaaggagaatgagaaagatcaacctggcggcagcgcaaaagatg

SEQ ID NO: 99126 - DNA, 103 bp, Artificial Sequence
  Synthetic Polynucleotide
taatacgactcactataggggaggtgggatctcatcctcattgatctttcaacagaggagagaaagaatgatgaggatgaacctggcggcagcgcaaaagatg

SEQ ID NO: 99127 - DNA, 103 bp, Artificial Sequence
  Synthetic Polynucleotide
taatacgactcactatagggaaggccactggaggtgggatctcatcctcaaacagaggagatgaggaatggatcccaccaacctggcggcagcgcaaaagatg

SEQ ID NO: 99128 - DNA, 103 bp, Artificial Sequence
  Synthetic Polynucleotide
taatacgactcactatagggccgctttcctaaggccactggaggtgggataacagaggagaatcccaatgccagtggccaacctggcggcagcgcaaaagatg

SEQ ID NO: 99129 - DNA, 103 bp, Artificial Sequence
  Synthetic Polynucleotide
taatacgactcactataggggggccaggggccgctttcctaaggccactgaacagaggagacagtggatgtaggaaagcaacctggcggcagcgcaaaagatg

SEQ ID NO: 99130 - DNA, 103 bp, Artificial Sequence
  Synthetic Polynucleotide
taatacgactcactatagggggttcctggggggccaggggccgctttcctaacagaggagaaggaaaatggcccctggcaacctggcggcagcgcaaaagatg

SEQ ID NO: 99131 - DNA, 103 bp, Artificial Sequence
  Synthetic Polynucleotide
taatacgactcactatagggaaactccataaagagccccatctgcttggcaacagaggagagccaagatgatggggctcaacctggcggcagcgcaaaagatg

SEQ ID NO: 99132 - DNA, 103 bp, Artificial Sequence
  Synthetic Polynucleotide
taatacgactcactatagggcctgttggctggttcctggggggccaggggaacagaggagacccctgatgccccaggaaaacctggcggcagcgcaaaagatg

SEQ ID NO: 99133 - DNA, 103 bp, Artificial Sequence
  Synthetic Polynucleotide
taatacgactcactatagggtctcagggctcctgttggctggttcctgggaacagaggagacccaggatgcagccaacaaacctggcggcagcgcaaaagatg

SEQ ID NO: 99134 - DNA, 103 bp, Artificial Sequence
  Synthetic Polynucleotide
taatacgactcactatagggggagggtctgtctcagggctcctgttggctaacagaggagaagccaaatggagccctgaaacctggcggcagcgcaaaagatg

SEQ ID NO: 99135 - DNA, 103 bp, Artificial Sequence
  Synthetic Polynucleotide
taatacgactcactatagggagggggagctggagggtctgtctcagggctaacagaggagaagccctatgacagaccctaacctggcggcagcgcaaaagatg

SEQ ID NO: 99136 - DNA, 103 bp, Artificial Sequence
  Synthetic Polynucleotide
taatacgactcactatagggactccaaggcagggggagctggagggtctgaacagaggagacagaccatgcagctccccaacctggcggcagcgcaaaagatg

SEQ ID NO: 99137 - DNA, 103 bp, Artificial Sequence
  Synthetic Polynucleotide
taatacgactcactataggggggttgtctgactccaaggcagggggagctaacagaggagaagctccatgtgccttggaaacctggcggcagcgcaaaagatg

SEQ ID NO: 99138 - DNA, 103 bp, Artificial Sequence
  Synthetic Polynucleotide
taatacgactcactatagggaggttgggaggggttgtctgactccaaggcaacagaggagagccttgatgtcagacaacaacctggcggcagcgcaaaagatg

SEQ ID NO: 99139 - DNA, 103 bp, Artificial Sequence
  Synthetic Polynucleotide
taatacgactcactatagggggctggtctcaggttgggaggggttgtctgaacagaggagacagacaatgcctcccaacaacctggcggcagcgcaaaagatg

SEQ ID NO: 99140 - DNA, 103 bp, Artificial Sequence
  Synthetic Polynucleotide
taatacgactcactatagggatgccagggaggctggtctcaggttgggagaacagaggagactcccaatgtgagaccagaacctggcggcagcgcaaaagatg

SEQ ID NO: 99141 - DNA, 103 bp, Artificial Sequence
  Synthetic Polynucleotide
taatacgactcactatagggctgggcagaaatgccagggaggctggtctcaacagaggagagagaccatgctccctggcaacctggcggcagcgcaaaagatg

SEQ ID NO: 99142 - DNA, 103 bp, Artificial Sequence
  Synthetic Polynucleotide
taatacgactcactatagggcctcagggccaaactccataaagagccccaaacagaggagatggggcatgttatggagtaacctggcggcagcgcaaaagatg

SEQ ID NO: 99143 - DNA, 103 bp, Artificial Sequence
  Synthetic Polynucleotide
taatacgactcactatagggctgaaacgggctgggcagaaatgccagggaaacagaggagatccctgatgtttctgcccaacctggcggcagcgcaaaagatg

SEQ ID NO: 99144 - DNA, 103 bp, Artificial Sequence
  Synthetic Polynucleotide
taatacgactcactataggggggtctaagtctgaaacgggctgggcagaaaacagaggagattctgcatggcccgtttcaacctggcggcagcgcaaaagatg

SEQ ID NO: 99145 - DNA, 103 bp, Artificial Sequence
  Synthetic Polynucleotide
taatacgactcactatagggccgcgggtctgggtctaagtctgaaacgggaacagaggagacccgttatggacttagacaacctggcggcagcgcaaaagatg

SEQ ID NO: 99146 - DNA, 103 bp, Artificial Sequence
  Synthetic Polynucleotide
taatacgactcactatagggacagcagggcccgcgggtctgggtctaagtaacagaggagaacttagatgcagacccgcaacctggcggcagcgcaaaagatg

SEQ ID NO: 99147 - DNA, 103 bp, Artificial Sequence
  Synthetic Polynucleotide
taatacgactcactatagggtgtcgggatgacagcagggcccgcgggtctaacagaggagaagacccatgggccctgctaacctggcggcagcgcaaaagatg

SEQ ID NO: 99148 - DNA, 103 bp, Artificial Sequence
  Synthetic Polynucleotide
taatacgactcactataggggtactctctctgtcgggatgacagcagggcaacagaggagagccctgatgtcatcccgaaacctggcggcagcgcaaaagatg

SEQ ID NO: 99149 - DNA, 103 bp, Artificial Sequence
  Synthetic Polynucleotide
taatacgactcactatagggcagccactttgtactctctctgtcgggatgaacagaggagacatcccatgagagagagtaacctggcggcagcgcaaaagatg

SEQ ID NO: 99150 - DNA, 103 bp, Artificial Sequence
  Synthetic Polynucleotide
taatacgactcactataggggcactgagggcagccactttgtactctctcaacagaggagagagagaatgcaaagtggcaacctggcggcagcgcaaaagatg

SEQ ID NO: 99151 - DNA, 103 bp, Artificial Sequence
  Synthetic Polynucleotide
taatacgactcactatagggagcccgcttggcactgagggcagccactttaacagaggagaaaagtgatggccctcagtaacctggcggcagcgcaaaagatg

SEQ ID NO: 99152 - DNA, 103 bp, Artificial Sequence
  Synthetic Polynucleotide
taatacgactcactatagggctagctctccagcccgcttggcactgagggaacagaggagaccctcaatgccaagcgggaacctggcggcagcgcaaaagatg

SEQ ID NO: 99153 - DNA, 103 bp, Artificial Sequence
  Synthetic Polynucleotide
taatacgactcactatagggagcagcatgtcctcagggccaaactccataaacagaggagatatggaatgtggccctgaaacctggcggcagcgcaaaagatg

SEQ ID NO: 99154 - DNA, 103 bp, Artificial Sequence
  Synthetic Polynucleotide
taatacgactcactatagggcgggcacggtctagctctccagcccgcttgaacagaggagacaagcgatgtggagagctaacctggcggcagcgcaaaagatg

SEQ ID NO: 99155 - DNA, 103 bp, Artificial Sequence
  Synthetic Polynucleotide
taatacgactcactatagggcatgagctctcgggcacggtctagctctccaacagaggagaggagagatggaccgtgccaacctggcggcagcgcaaaagatg

SEQ ID NO: 99156 - DNA, 103 bp, Artificial Sequence
  Synthetic Polynucleotide
taatacgactcactatagggtcccaatcctcatgagctctcgggcacggtaacagaggagaaccgtgatggagagctcaaacctggcggcagcgcaaaagatg

SEQ ID NO: 99157 - DNA, 103 bp, Artificial Sequence
  Synthetic Polynucleotide
taatacgactcactatagggccgaatctcttcccaatcctcatgagctctaacagaggagaagagctatggaggattggaacctggcggcagcgcaaaagatg

SEQ ID NO: 99158 - DNA, 103 bp, Artificial Sequence
  Synthetic Polynucleotide
taatacgactcactatagggcaggacagcaccgaatctcttcccaatcctaacagaggagaaggattatgaagagattcaacctggcggcagcgcaaaagatg

SEQ ID NO: 99159 - DNA, 103 bp, Artificial Sequence
  Synthetic Polynucleotide
taatacgactcactatagggccagggcctccaggacagcaccgaatctctaacagaggagaagagatatggtgctgtccaacctggcggcagcgcaaaagatg

SEQ ID NO: 99160 - DNA, 103 bp, Artificial Sequence
  Synthetic Polynucleotide
taatacgactcactatagggtgccccttctccagggcctccaggacagcaaacagaggagatgctgtatgggaggccctaacctggcggcagcgcaaaagatg

SEQ ID NO: 99161 - DNA, 103 bp, Artificial Sequence
  Synthetic Polynucleotide
taatacgactcactatagggatccacgggctgccccttctccagggcctcaacagaggagagaggccatggagaaggggaacctggcggcagcgcaaaagatg

SEQ ID NO: 99162 - DNA, 103 bp, Artificial Sequence
  Synthetic Polynucleotide
taatacgactcactatagggtggcactcagatccacgggctgccccttctaacagaggagaagaaggatgagcccgtggaacctggcggcagcgcaaaagatg

SEQ ID NO: 99163 - DNA, 103 bp, Artificial Sequence
  Synthetic Polynucleotide
taatacgactcactataggggccgggggcatggcactcagatccacgggcaacagaggagagcccgtatgtctgagtgcaacctggcggcagcgcaaaagatg

SEQ ID NO: 99164 - DNA, 103 bp, Artificial Sequence
  Synthetic Polynucleotide
taatacgactcactatagggcggattcttctgtcctccaaattgagccataacagaggagaatggctatgtttggaggaaacctggcggcagcgcaaaagatg

SEQ ID NO: 99165 - DNA, 103 bp, Artificial Sequence
  Synthetic Polynucleotide
taatacgactcactatagggggtaggagatgctccaaggagtgatggctgaacagaggagacagccaatgctccttggaaacctggcggcagcgcaaaagatg

SEQ ID NO: 99166 - DNA, 103 bp, Artificial Sequence
  Synthetic Polynucleotide
taatacgactcactatagggccgggaacgtttcctctgaggtgatctttcaacagaggagagaaagaatgcctcagaggaacctggcggcagcgcaaaagatg

SEQ ID NO: 99167 - DNA, 103 bp, Artificial Sequence
  Synthetic Polynucleotide
taatacgactcactataggggagatctttcccgggaacgtttcctctgagaacagaggagactcagaatgaacgttcccaacctggcggcagcgcaaaagatg

SEQ ID NO: 99168 - DNA, 103 bp, Artificial Sequence
  Synthetic Polynucleotide
taatacgactcactatagggtctcttcgtggagatctttcccgggaacgtaacagaggagaacgttcatgggaaagatcaacctggcggcagcgcaaaagatg

SEQ ID NO: 99169 - DNA, 103 bp, Artificial Sequence
  Synthetic Polynucleotide
taatacgactcactatagggtcgctctcgctctcttcgtggagatctttcaacagaggagagaaagaatgccacgaagaaacctggcggcagcgcaaaagatg

SEQ ID NO: 99170 - DNA, 103 bp, Artificial Sequence
  Synthetic Polynucleotide
taatacgactcactatagggtccgaggtgatcgctctcgctctcttcgtgaacagaggagacacgaaatgagcgagagcaacctggcggcagcgcaaaagatg

SEQ ID NO: 99171 - DNA, 103 bp, Artificial Sequence
  Synthetic Polynucleotide
taatacgactcactatagggcgtcgaactctccgaggtgatcgctctcgcaacagaggagagcgagaatgatcacctcgaacctggcggcagcgcaaaagatg

SEQ ID NO: 99172 - DNA, 103 bp, Artificial Sequence
  Synthetic Polynucleotide
taatacgactcactatagggtggaacaacacgtcgaactctccgaggtgaaacagaggagatcacctatgagagttcgaaacctggcggcagcgcaaaagatg

SEQ ID NO: 99173 - DNA, 103 bp, Artificial Sequence
  Synthetic Polynucleotide
taatacgactcactatagggctgtgtaacgtggaacaacacgtcgaactcaacagaggagagagttcatggtgttgttcaacctggcggcagcgcaaaagatg

SEQ ID NO: 99174 - DNA, 103 bp, Artificial Sequence
  Synthetic Polynucleotide
taatacgactcactataggggaaaactgaactgtgtaacgtggaacaacaaacagaggagatgttgtatgacgttacacaacctggcggcagcgcaaaagatg

SEQ ID NO: 99175 - DNA, 103 bp, Artificial Sequence
  Synthetic Polynucleotide
taatacgactcactatagggagaaaactttgaaaactgaactgtgtaacgaacagaggagacgttacatggttcagtttaacctggcggcagcgcaaaagatg

SEQ ID NO: 99176 - DNA, 103 bp, Artificial Sequence
  Synthetic Polynucleotide
taatacgactcactataggggtgtataaatggtaggagatgctccaaggaaacagaggagatccttgatgcatctcctaaacctggcggcagcgcaaaagatg

SEQ ID NO: 99177 - DNA, 103 bp, Artificial Sequence
  Synthetic Polynucleotide
taatacgactcactataggggacaatctaaagaaaactttgaaaactgaaaacagaggagattcagtatgcaaagttttaacctggcggcagcgcaaaagatg

SEQ ID NO: 99178 - DNA, 103 bp, Artificial Sequence
  Synthetic Polynucleotide
taatacgactcactatagggtcacaactgggacaatctaaagaaaactttaacagaggagaaaagttatgtttagattgaacctggcggcagcgcaaaagatg

SEQ ID NO: 99179 - DNA, 103 bp, Artificial Sequence
  Synthetic Polynucleotide
taatacgactcactatagggttccatcatgtcacaactgggacaatctaaaacagaggagattagatatgcccagttgtaacctggcggcagcgcaaaagatg

SEQ ID NO: 99180 - DNA, 103 bp, Artificial Sequence
  Synthetic Polynucleotide
taatacgactcactatagggggcgccttagttccatcatgtcacaactggaacagaggagaccagttatgacatgatggaacctggcggcagcgcaaaagatg

SEQ ID NO: 99181 - DNA, 103 bp, Artificial Sequence
  Synthetic Polynucleotide
taatacgactcactatagggttttgataacggcgccttagttccatcatgaacagaggagacatgatatgactaaggcgaacctggcggcagcgcaaaagatg

SEQ ID NO: 99182 - DNA, 103 bp, Artificial Sequence
  Synthetic Polynucleotide
taatacgactcactatagggtatatacaaattttgataacggcgccttagaacagaggagactaaggatgcgttatcaaaacctggcggcagcgcaaaagatg

SEQ ID NO: 99183 - DNA, 103 bp, Artificial Sequence
  Synthetic Polynucleotide
taatacgactcactatagggagtcactaggtatatacaaattttgataacaacagaggagagttatcatgatttgtataaacctggcggcagcgcaaaagatg

SEQ ID NO: 99184 - DNA, 103 bp, Artificial Sequence
  Synthetic Polynucleotide
taatacgactcactataggggcatcaaaaaagtcactaggtatatacaaaaacagaggagatttgtaatgacctagtgaaacctggcggcagcgcaaaagatg

SEQ ID NO: 99185 - DNA, 103 bp, Artificial Sequence
  Synthetic Polynucleotide
taatacgactcactatagggtgtaaattgagcatcaaaaaagtcactaggaacagaggagacctagtatgttttttgataacctggcggcagcgcaaaagatg

SEQ ID NO: 99186 - DNA, 103 bp, Artificial Sequence
  Synthetic Polynucleotide
taatacgactcactatagggcatccacccatgtaaattgagcatcaaaaaaacagaggagatttttgatgctcaatttaaacctggcggcagcgcaaaagatg

SEQ ID NO: 99187 - DNA, 103 bp, Artificial Sequence
  Synthetic Polynucleotide
taatacgactcactataggggcagtttgctgtgtataaatggtaggagataacagaggagaatctccatgcatttatacaacctggcggcagcgcaaaagatg

SEQ ID NO: 99188 - DNA, 103 bp, Artificial Sequence
  Synthetic Polynucleotide
taatacgactcactatagggaaagggaaagcatccacccatgtaaattgaaacagaggagatcaattatgatgggtggaaacctggcggcagcgcaaaagatg

SEQ ID NO: 99189 - DNA, 103 bp, Artificial Sequence
  Synthetic Polynucleotide
taatacgactcactatagggtggtcttgacaaagggaaagcatccacccaaacagaggagatgggtgatggctttccctaacctggcggcagcgcaaaagatg

SEQ ID NO: 99190 - DNA, 103 bp, Artificial Sequence
  Synthetic Polynucleotide
taatacgactcactatagggccagctgaaatggtcttgacaaagggaaagaacagaggagactttccatgtgtcaagacaacctggcggcagcgcaaaagatg

SEQ ID NO: 99191 - DNA, 103 bp, Artificial Sequence
  Synthetic Polynucleotide
taatacgactcactatagggcagtaatttcccagctgaaatggtcttgacaacagaggagagtcaagatgatttcagctaacctggcggcagcgcaaaagatg

SEQ ID NO: 99192 - DNA, 103 bp, Artificial Sequence
  Synthetic Polynucleotide
taatacgactcactatagggataaaaattgcagtaatttcccagctgaaaaacagaggagatttcagatgggaaattacaacctggcggcagcgcaaaagatg

SEQ ID NO: 99193 - DNA, 103 bp, Artificial Sequence
  Synthetic Polynucleotide
taatacgactcactatagggtgtgcattacataaaaattgcagtaatttcaacagaggagagaaattatggcaatttttaacctggcggcagcgcaaaagatg

SEQ ID NO: 99194 - DNA, 103 bp, Artificial Sequence
  Synthetic Polynucleotide
taatacgactcactatagggtctacttctctgtgcattacataaaaattgaacagaggagacaatttatgtgtaatgcaaacctggcggcagcgcaaaagatg

SEQ ID NO: 99195 - DNA, 103 bp, Artificial Sequence
  Synthetic Polynucleotide
taatacgactcactatagggttctaaggactctacttctctgtgcattacaacagaggagagtaatgatgagagaagtaaacctggcggcagcgcaaaagatg

SEQ ID NO: 99196 - DNA, 103 bp, Artificial Sequence
  Synthetic Polynucleotide
taatacgactcactatagggccatatttttttctaaggactctacttctcaacagaggagagagaagatgagtccttagaacctggcggcagcgcaaaagatg

SEQ ID NO: 99197 - DNA, 103 bp, Artificial Sequence
  Synthetic Polynucleotide
taatacgactcactatagggtcaagaatggccatatttttttctaaggacaacagaggagagtccttatgaaaaaatataacctggcggcagcgcaaaagatg

SEQ ID NO: 99198 - DNA, 103 bp, Artificial Sequence
  Synthetic Polynucleotide
taatacgactcactatagggtgctgccaatgcagtttgctgtgtataaataacagaggagaatttatatgcagcaaactaacctggcggcagcgcaaaagatg

SEQ ID NO: 99199 - DNA, 103 bp, Artificial Sequence
  Synthetic Polynucleotide
taatacgactcactatagggatctggtggatcaagaatggccatatttttaacagaggagaaaaaatatggccattcttaacctggcggcagcgcaaaagatg

SEQ ID NO: 99200 - DNA, 103 bp, Artificial Sequence
  Synthetic Polynucleotide
taatacgactcactatagggagtggtcagcatctggtggatcaagaatggaacagaggagaccattcatgatccaccagaacctggcggcagcgcaaaagatg

SEQ ID NO: 99201 - DNA, 103 bp, Artificial Sequence
  Synthetic Polynucleotide
taatacgactcactataggggcactgtataagtggtcagcatctggtggaaacagaggagatccaccatgtgctgaccaaacctggcggcagcgcaaaagatg

SEQ ID NO: 99202 - DNA, 103 bp, Artificial Sequence
  Synthetic Polynucleotide
taatacgactcactatagggcattacctttgcactgtataagtggtcagcaacagaggagagctgacatgttatacagtaacctggcggcagcgcaaaagatg

SEQ ID NO: 99203 - DNA, 103 bp, Artificial Sequence
  Synthetic Polynucleotide
taatacgactcactatagggtagccatcagcattacctttgcactgtataaacagaggagatatacaatgcaaaggtaaaacctggcggcagcgcaaaagatg

SEQ ID NO: 99204 - DNA, 103 bp, Artificial Sequence
  Synthetic Polynucleotide
taatacgactcactatagggatactagggctagccatcagcattacctttaacagaggagaaaaggtatggctgatggcaacctggcggcagcgcaaaagatg

SEQ ID NO: 99205 - DNA, 103 bp, Artificial Sequence
  Synthetic Polynucleotide
taatacgactcactatagggtaaatcttccatactagggctagccatcagaacagaggagactgatgatgagccctagtaacctggcggcagcgcaaaagatg

SEQ ID NO: 99206 - DNA, 103 bp, Artificial Sequence
  Synthetic Polynucleotide
taatacgactcactatagggacttatgatataaatcttccatactagggcaacagaggagagccctaatgtggaagattaacctggcggcagcgcaaaagatg

SEQ ID NO: 99207 - DNA, 103 bp, Artificial Sequence
  Synthetic Polynucleotide
taatacgactcactatagggagagcacatgacttatgatataaatcttccaacagaggagaggaagaatgatatcataaaacctggcggcagcgcaaaagatg

SEQ ID NO: 99208 - DNA, 103 bp, Artificial Sequence
  Synthetic Polynucleotide
taatacgactcactataggggtcctcagcaagagcacatgacttatgataaacagaggagatatcatatgtcatgtgctaacctggcggcagcgcaaaagatg

SEQ ID NO: 99209 - DNA, 103 bp, Artificial Sequence
  Synthetic Polynucleotide
taatacgactcactatagggtaaggcctgctgctgccaatgcagtttgctaacagaggagaagcaaaatgcattggcagaacctggcggcagcgcaaaagatg

SEQ ID NO: 99210 - DNA, 103 bp, Artificial Sequence
  Synthetic Polynucleotide
taatacgactcactataggggttcttgtgggtcctcagcaagagcacatgaacagaggagacatgtgatgttgctgaggaacctggcggcagcgcaaaagatg

SEQ ID NO: 99211 - DNA, 103 bp, Artificial Sequence
  Synthetic Polynucleotide
taatacgactcactatagggccatctcgaagttcttgtgggtcctcagcaaacagaggagatgctgaatgcccacaagaaacctggcggcagcgcaaaagatg

SEQ ID NO: 99212 - DNA, 103 bp, Artificial Sequence
  Synthetic Polynucleotide
taatacgactcactatagggatgttggaatccatctcgaagttcttgtggaacagaggagaccacaaatgcttcgagataacctggcggcagcgcaaaagatg

SEQ ID NO: 99213 - DNA, 103 bp, Artificial Sequence
  Synthetic Polynucleotide
taatacgactcactataggggtctagcaggatgttggaatccatctcgaaaacagaggagattcgagatggattccaacaacctggcggcagcgcaaaagatg

SEQ ID NO: 99214 - DNA, 103 bp, Artificial Sequence
  Synthetic Polynucleotide
taatacgactcactatagggaacttaacaagtctagcaggatgttggaataacagaggagaattccaatgtcctgctagaacctggcggcagcgcaaaagatg

SEQ ID NO: 99215 - DNA, 103 bp, Artificial Sequence
  Synthetic Polynucleotide
taatacgactcactataggggcccactaaaaacttaacaagtctagcaggaacagaggagacctgctatgcttgttaagaacctggcggcagcgcaaaagatg

SEQ ID NO: 99216 - DNA, 103 bp, Artificial Sequence
  Synthetic Polynucleotide
taatacgactcactatagggtgcctttcatgcccactaaaaacttaacaaaacagaggagattgttaatgttttagtggaacctggcggcagcgcaaaagatg

SEQ ID NO: 99217 - DNA, 103 bp, Artificial Sequence
  Synthetic Polynucleotide
taatacgactcactataggggcttcatccttgcctttcatgcccactaaaaacagaggagatttagtatgcatgaaaggaacctggcggcagcgcaaaagatg

SEQ ID NO: 99218 - DNA, 103 bp, Artificial Sequence
  Synthetic Polynucleotide
taatacgactcactatagggaatggccatagcttcatccttgcctttcataacagaggagaatgaaaatgaaggatgaaaacctggcggcagcgcaaaagatg

SEQ ID NO: 99219 - DNA, 103 bp, Artificial Sequence
  Synthetic Polynucleotide
taatacgactcactatagggagtggcctccaatggccatagcttcatcctaacagaggagaaggatgatgctatggccaaacctggcggcagcgcaaaagatg

SEQ ID NO: 99220 - DNA, 103 bp, Artificial Sequence
  Synthetic Polynucleotide
taatacgactcactataggggtttgtgtggtaaggcctgctgctgccaataacagaggagaattggcatgagcaggcctaacctggcggcagcgcaaaagatg

SEQ ID NO: 99221 - DNA, 103 bp, Artificial Sequence
  Synthetic Polynucleotide
taatacgactcactataggggaaggagaccagtggcctccaatggccataaacagaggagatatggcatgtggaggccaaacctggcggcagcgcaaaagatg

SEQ ID NO: 99222 - DNA, 103 bp, Artificial Sequence
  Synthetic Polynucleotide
taatacgactcactatagggtccatccaacgaaggagaccagtggcctccaacagaggagaggaggcatgtggtctcctaacctggcggcagcgcaaaagatg

SEQ ID NO: 99223 - DNA, 103 bp, Artificial Sequence
  Synthetic Polynucleotide
taatacgactcactatagggctgggtctggtccatccaacgaaggagaccaacagaggagaggtctcatgcgttggatgaacctggcggcagcgcaaaagatg

SEQ ID NO: 99224 - DNA, 103 bp, Artificial Sequence
  Synthetic Polynucleotide
taatacgactcactatagggggatctttttctgggtctggtccatccaacaacagaggagagttggaatgaccagacccaacctggcggcagcgcaaaagatg

SEQ ID NO: 99225 - DNA, 103 bp, Artificial Sequence
  Synthetic Polynucleotide
taatacgactcactatagggcaacacagagggatctttttctgggtctggaacagaggagaccagacatggaaaaagataacctggcggcagcgcaaaagatg

SEQ ID NO: 99226 - DNA, 103 bp, Artificial Sequence
  Synthetic Polynucleotide
taatacgactcactatagggcagtcttaatcaacacagagggatctttttaacagaggagaaaaaagatgcctctgtgtaacctggcggcagcgcaaaagatg

SEQ ID NO: 99227 - DNA, 103 bp, Artificial Sequence
  Synthetic Polynucleotide
taatacgactcactatagggcaacgaatagcagtcttaatcaacacagagaacagaggagactctgtatggattaagacaacctggcggcagcgcaaaagatg

SEQ ID NO: 99228 - DNA, 103 bp, Artificial Sequence
  Synthetic Polynucleotide
taatacgactcactatagggagccttacaacaacgaatagcagtcttaataacagaggagaattaagatggctattcgtaacctggcggcagcgcaaaagatg

SEQ ID NO: 99229 - DNA, 103 bp, Artificial Sequence
  Synthetic Polynucleotide
taatacgactcactatagggtgcctgtcagagccttacaacaacgaatagaacagaggagactattcatggttgtaaggaacctggcggcagcgcaaaagatg

SEQ ID NO: 99230 - DNA, 103 bp, Artificial Sequence
  Synthetic Polynucleotide
taatacgactcactatagggcttagatcaatgcctgtcagagccttacaaaacagaggagattgtaaatgtctgacaggaacctggcggcagcgcaaaagatg

SEQ ID NO: 99231 - DNA, 103 bp, Artificial Sequence
  Synthetic Polynucleotide
taatacgactcactataggggtttgctggagtttgtgtggtaaggcctgcaacagaggagagcaggcatgaccacacaaaacctggcggcagcgcaaaagatg

SEQ ID NO: 99232 - DNA, 103 bp, Artificial Sequence
  Synthetic Polynucleotide
taatacgactcactatagggtgtgcacacacttagatcaatgcctgtcagaacagaggagactgacaatgattgatctaaacctggcggcagcgcaaaagatg

SEQ ID NO: 99233 - DNA, 103 bp, Artificial Sequence
  Synthetic Polynucleotide
taatacgactcactatagggggtaccattgtgtgcacacacttagatcaaaacagaggagattgatcatggtgtgtgcaaacctggcggcagcgcaaaagatg

SEQ ID NO: 99234 - DNA, 103 bp, Artificial Sequence
  Synthetic Polynucleotide
taatacgactcactatagggtctgcaaaacggtaccattgtgtgcacacaaacagaggagatgtgtgatgacaatggtaaacctggcggcagcgcaaaagatg

SEQ ID NO: 99235 - DNA, 103 bp, Artificial Sequence
  Synthetic Polynucleotide
taatacgactcactataggggtagcgaatctctgcaaaacggtaccattgaacagaggagacaatggatgcgttttgcaaacctggcggcagcgcaaaagatg

SEQ ID NO: 99236 - DNA, 103 bp, Artificial Sequence
  Synthetic Polynucleotide
taatacgactcactatagggcagggcgatggtagcgaatctctgcaaaacaacagaggagagttttgatgagattcgctaacctggcggcagcgcaaaagatg

SEQ ID NO: 99237 - DNA, 103 bp, Artificial Sequence
  Synthetic Polynucleotide
taatacgactcactatagggtgggtctcctcagggcgatggtagcgaatcaacagaggagagattcgatgccatcgcccaacctggcggcagcgcaaaagatg

SEQ ID NO: 99238 - DNA, 103 bp, Artificial Sequence
  Synthetic Polynucleotide
taatacgactcactatagggacgccccttgtgggtctcctcagggcgatgaacagaggagacatcgcatggaggagaccaacctggcggcagcgcaaaagatg

SEQ ID NO: 99239 - DNA, 103 bp, Artificial Sequence
  Synthetic Polynucleotide
taatacgactcactatagggctggaactgtacgccccttgtgggtctcctaacagaggagaaggagaatgacaaggggcaacctggcggcagcgcaaaagatg

SEQ ID NO: 99240 - DNA, 103 bp, Artificial Sequence
  Synthetic Polynucleotide
taatacgactcactatagggtccacatgagctggaactgtacgccccttgaacagaggagacaagggatgtacagttccaacctggcggcagcgcaaaagatg

SEQ ID NO: 99241 - DNA, 103 bp, Artificial Sequence
  Synthetic Polynucleotide
taatacgactcactatagggaaccactgtctccacatgagctggaactgtaacagaggagaacagttatggctcatgtgaacctggcggcagcgcaaaagatg

SEQ ID NO: 99242 - DNA, 103 bp, Artificial Sequence
  Synthetic Polynucleotide
taatacgactcactatagggttaactgatagtttgctggagtttgtgtggaacagaggagaccacacatgctccagcaaaacctggcggcagcgcaaaagatg

SEQ ID NO: 99243 - DNA, 103 bp, Artificial Sequence
  Synthetic Polynucleotide
taatacgactcactatagggggaaaaataaaaccactgtctccacatgagaacagaggagactcatgatgagacagtggaacctggcggcagcgcaaaagatg

SEQ ID NO: 99244 - DNA, 103 bp, Artificial Sequence
  Synthetic Polynucleotide
taatacgactcactatagggcaaacatccgggaaaaataaaaccactgtcaacagaggagagacagtatgtttatttttaacctggcggcagcgcaaaagatg

SEQ ID NO: 99245 - DNA, 103 bp, Artificial Sequence
  Synthetic Polynucleotide
taatacgactcactatagggaaggcaatgccaaacatccgggaaaaataaaacagaggagattatttatgccggatgttaacctggcggcagcgcaaaagatg

SEQ ID NO: 99246 - DNA, 103 bp, Artificial Sequence
  Synthetic Polynucleotide
taatacgactcactatagggagcgggtgggaaggcaatgccaaacatccgaacagaggagacggatgatgggcattgccaacctggcggcagcgcaaaagatg

SEQ ID NO: 99247 - DNA, 103 bp, Artificial Sequence
  Synthetic Polynucleotide
taatacgactcactatagggtcccactctgagcgggtgggaaggcaatgcaacagaggagagcattgatgtcccacccgaacctggcggcagcgcaaaagatg

SEQ ID NO: 99248 - DNA, 103 bp, Artificial Sequence
  Synthetic Polynucleotide
taatacgactcactatagggggagagggtttcccactctgagcgggtgggaacagaggagacccaccatgtcagagtggaacctggcggcagcgcaaaagatg

SEQ ID NO: 99249 - DNA, 103 bp, Artificial Sequence
  Synthetic Polynucleotide
taatacgactcactatagggtgtatcctcgggagagggtttcccactctgaacagaggagacagagtatgaaaccctctaacctggcggcagcgcaaaagatg

SEQ ID NO: 99250 - DNA, 103 bp, Artificial Sequence
  Synthetic Polynucleotide
taatacgactcactatagggagctgctgcttgtatcctcgggagagggttaacagaggagaaaccctatgccgaggataaacctggcggcagcgcaaaagatg

SEQ ID NO: 99251 - DNA, 103 bp, Artificial Sequence
  Synthetic Polynucleotide
taatacgactcactatagggcttctcgaccagctgctgcttgtatcctcgaacagaggagacgaggaatgaagcagcagaacctggcggcagcgcaaaagatg

SEQ ID NO: 99252 - DNA, 103 bp, Artificial Sequence
  Synthetic Polynucleotide
taatacgactcactatagggcaccctgaagcttctcgaccagctgctgctaacagaggagaagcagcatgtggtcgagaaacctggcggcagcgcaaaagatg

SEQ ID NO: 99253 - DNA, 103 bp, Artificial Sequence
  Synthetic Polynucleotide
taatacgactcactataggggcagtttgtgttaactgatagtttgctggaaacagaggagatccagcatgctatcagttaacctggcggcagcgcaaaagatg

SEQ ID NO: 99254 - DNA, 103 bp, Artificial Sequence
  Synthetic Polynucleotide
taatacgactcactatagggtccttgcgttcaccctgaagcttctcgaccaacagaggagaggtcgaatggcttcagggaacctggcggcagcgcaaaagatg

SEQ ID NO: 99255 - DNA, 103 bp, Artificial Sequence
  Synthetic Polynucleotide
taatacgactcactatagggtccatcagcctccttgcgttcaccctgaagaacagaggagacttcagatggaacgcaagaacctggcggcagcgcaaaagatg

SEQ ID NO: 99256 - DNA, 103 bp, Artificial Sequence
  Synthetic Polynucleotide
taatacgactcactatagggcatcctgttctccatcagcctccttgcgttaacagaggagaaacgcaatgaggctgatgaacctggcggcagcgcaaaagatg

SEQ ID NO: 99257 - DNA, 103 bp, Artificial Sequence
  Synthetic Polynucleotide
taatacgactcactatagggttctcttcttcatcctgttctccatcagccaacagaggagaggctgaatgagaacaggaaacctggcggcagcgcaaaagatg

SEQ ID NO: 99258 - DNA, 103 bp, Artificial Sequence
  Synthetic Polynucleotide
taatacgactcactatagggaccatcatccttctcttcttcatcctgttcaacagaggagagaacagatggaagaagagaacctggcggcagcgcaaaagatg

SEQ ID NO: 99259 - DNA, 103 bp, Artificial Sequence
  Synthetic Polynucleotide
taatacgactcactatagggctttagcttcaccatcatccttctcttcttaacagaggagaaagaagatgaggatgatgaacctggcggcagcgcaaaagatg

SEQ ID NO: 99260 - DNA, 103 bp, Artificial Sequence
  Synthetic Polynucleotide
taatacgactcactataggggtagaaatttctttagcttcaccatcatccaacagaggagaggatgaatgtgaagctaaaacctggcggcagcgcaaaagatg

SEQ ID NO: 99261 - DNA, 103 bp, Artificial Sequence
  Synthetic Polynucleotide
taatacgactcactatagggatgggtaggtgtagaaatttctttagcttcaacagaggagagaagctatggaaatttctaacctggcggcagcgcaaaagatg

SEQ ID NO: 99262 - DNA, 103 bp, Artificial Sequence
  Synthetic Polynucleotide
taatacgactcactataggggtttagaccaatgggtaggtgtagaaatttaacagaggagaaaatttatgcacctacccaacctggcggcagcgcaaaagatg

SEQ ID NO: 99263 - DNA, 103 bp, Artificial Sequence
  Synthetic Polynucleotide
taatacgactcactatagggtttggatcaagtttagaccaatgggtaggtaacagaggagaacctacatgttggtctaaaacctggcggcagcgcaaaagatg

SEQ ID NO: 99264 - DNA, 103 bp, Artificial Sequence
  Synthetic Polynucleotide
taatacgactcactatagggctgcaatgcagcagtttgtgttaactgataaacagaggagatatcagatgacacaaactaacctggcggcagcgcaaaagatg

SEQ ID NO: 99265 - DNA, 103 bp, Artificial Sequence
  Synthetic Polynucleotide
taatacgactcactatagggcttcattgtctttggatcaagtttagaccaaacagaggagatggtctatgcttgatccaaacctggcggcagcgcaaaagatg

SEQ ID NO: 99266 - DNA, 103 bp, Artificial Sequence
  Synthetic Polynucleotide
taatacgactcactatagggggtcatttaccttcattgtctttggatcaaaacagaggagattgatcatgagacaatgaaacctggcggcagcgcaaaagatg

SEQ ID NO: 99267 - DNA, 103 bp, Artificial Sequence
  Synthetic Polynucleotide
taatacgactcactatagggtcttttcggaggtcatttaccttcattgtcaacagaggagagacaatatgggtaaatgaaacctggcggcagcgcaaaagatg

SEQ ID NO: 99268 - DNA, 103 bp, Artificial Sequence
  Synthetic Polynucleotide
taatacgactcactatagggactttctaattcttttcggaggtcatttacaacagaggagagtaaatatgctccgaaaaaacctggcggcagcgcaaaagatg

SEQ ID NO: 99269 - DNA, 103 bp, Artificial Sequence
  Synthetic Polynucleotide
taatacgactcactatagggtaagagctcgactttctaattcttttcggaaacagaggagatccgaaatgaattagaaaaacctggcggcagcgcaaaagatg

SEQ ID NO: 99270 - DNA, 103 bp, Artificial Sequence
  Synthetic Polynucleotide
taatacgactcactatagggcctttggaactaagagctcgactttctaataacagaggagaattagaatgtcgagctctaacctggcggcagcgcaaaagatg

SEQ ID NO: 99271 - DNA, 103 bp, Artificial Sequence
  Synthetic Polynucleotide
taatacgactcactatagggggattttaatcctttggaactaagagctcgaacagaggagacgagctatgagttccaaaaacctggcggcagcgcaaaagatg

SEQ ID NO: 99272 - DNA, 103 bp, Artificial Sequence
  Synthetic Polynucleotide
taatacgactcactatagggctattaactgggattttaatcctttggaacaacagaggagagttccaatggattaaaataacctggcggcagcgcaaaagatg

SEQ ID NO: 99273 - DNA, 103 bp, Artificial Sequence
  Synthetic Polynucleotide
taatacgactcactataggggtcaatcgggctattaactgggattttaataacagaggagaattaaaatgccagttaataacctggcggcagcgcaaaagatg

SEQ ID NO: 99274 - DNA, 103 bp, Artificial Sequence
  Synthetic Polynucleotide
taatacgactcactatagggaagctgttttgtcaatcgggctattaactgaacagaggagacagttaatggcccgattgaacctggcggcagcgcaaaagatg

SEQ ID NO: 99275 - DNA, 103 bp, Artificial Sequence
  Synthetic Polynucleotide
taatacgactcactatagggtagcccatggcggattcttctgtcctccaaaacagaggagattggagatgagaagaatcaacctggcggcagcgcaaaagatg

SEQ ID NO: 99276 - DNA, 103 bp, Artificial Sequence
  Synthetic Polynucleotide
taatacgactcactatagggcggcttgttgctgcaatgcagcagtttgtgaacagaggagacacaaaatgctgcattgcaacctggcggcagcgcaaaagatg

SEQ ID NO: 99277 - DNA, 103 bp, Artificial Sequence
  Synthetic Polynucleotide
taatacgactcactatagggcctctactttaagctgttttgtcaatcgggaacagaggagacccgatatgcaaaacagcaacctggcggcagcgcaaaagatg

SEQ ID NO: 99278 - DNA, 103 bp, Artificial Sequence
  Synthetic Polynucleotide
taatacgactcactatagggtctttttgttcctctactttaagctgttttaacagaggagaaaaacaatgtaaagtagaaacctggcggcagcgcaaaagatg

SEQ ID NO: 99279 - DNA, 103 bp, Artificial Sequence
  Synthetic Polynucleotide
taatacgactcactatagggcttctgttcttctttttgttcctctactttaacagaggagaaaagtaatggaacaaaaaaacctggcggcagcgcaaaagatg

SEQ ID NO: 99280 - DNA, 103 bp, Artificial Sequence
  Synthetic Polynucleotide
taatacgactcactatagggtctctaactccttctgttcttctttttgttaacagaggagaaacaaaatgaagaacagaaacctggcggcagcgcaaaagatg

SEQ ID NO: 99281 - DNA, 103 bp, Artificial Sequence
  Synthetic Polynucleotide
taatacgactcactatagggttttcagatttctctaactccttctgttctaacagaggagaagaacaatgggagttagaaacctggcggcagcgcaaaagatg

SEQ ID NO: 99282 - DNA, 103 bp, Artificial Sequence
  Synthetic Polynucleotide
taatacgactcactatagggatcctcttctttttcagatttctctaactcaacagaggagagagttaatgaaatctgaaaacctggcggcagcgcaaaagatg

SEQ ID NO: 99283 - DNA, 103 bp, Artificial Sequence
  Synthetic Polynucleotide
taatacgactcactatagggcatcatcctcatcctcttctttttcagattaacagaggagaaatctgatgaagaagaggaacctggcggcagcgcaaaagatg

SEQ ID NO: 99284 - DNA, 103 bp, Artificial Sequence
  Synthetic Polynucleotide
taatacgactcactataggggatttcctatcatcatcctcatcctcttctaacagaggagaagaagaatgtgaggatgaaacctggcggcagcgcaaaagatg

SEQ ID NO: 99285 - DNA, 103 bp, Artificial Sequence
  Synthetic Polynucleotide
taatacgactcactatagggatcgtcttcagatttcctatcatcatcctcaacagaggagagaggatatggataggaaaaacctggcggcagcgcaaaagatg

SEQ ID NO: 99286 - DNA, 103 bp, Artificial Sequence
  Synthetic Polynucleotide
taatacgactcactatagggcttcctctttatcgtcttcagatttcctataacagaggagaataggaatgctgaagacgaacctggcggcagcgcaaaagatg

SEQ ID NO: 99287 - DNA, 103 bp, Artificial Sequence
  Synthetic Polynucleotide
taatacgactcactataggggctgcagctgcggcttgttgctgcaatgcaaacagaggagatgcattatggcaacaagcaacctggcggcagcgcaaaagatg

SEQ ID NO: 99288 - DNA, 103 bp, Artificial Sequence
  Synthetic Polynucleotide
taatacgactcactatagggttcctttcttcttcctctttatcgtcttcaaacagaggagatgaagaatgtaaagaggaaacctggcggcagcgcaaaagatg

SEQ ID NO: 99289 - DNA, 103 bp, Artificial Sequence
  Synthetic Polynucleotide
taatacgactcactatagggctcttgacgtttcctttcttcttcctctttaacagaggagaaaagagatggaagaaaggaacctggcggcagcgcaaaagatg

SEQ ID NO: 99290 - DNA, 103 bp, Artificial Sequence
  Synthetic Polynucleotide
taatacgactcactataggggttctatttcctcttgacgtttcctttcttaacagaggagaaagaaaatgaacgtcaagaacctggcggcagcgcaaaagatg

SEQ ID NO: 99291 - DNA, 103 bp, Artificial Sequence
  Synthetic Polynucleotide
taatacgactcactatagggcgacgctggcgttctatttcctcttgacgtaacagaggagaacgtcaatgggaaatagaaacctggcggcagcgcaaaagatg

SEQ ID NO: 99292 - DNA, 103 bp, Artificial Sequence
  Synthetic Polynucleotide
taatacgactcactatagggtcttctttctcgacgctggcgttctatttcaacagaggagagaaataatgcgccagcgtaacctggcggcagcgcaaaagatg

SEQ ID NO: 99293 - DNA, 103 bp, Artificial Sequence
  Synthetic Polynucleotide
taatacgactcactataggggcaaaatatatcttctttctcgacgctggcaacagaggagagccagcatggagaaagaaaacctggcggcagcgcaaaagatg

SEQ ID NO: 99294 - DNA, 103 bp, Artificial Sequence
  Synthetic Polynucleotide
taatacgactcactatagggggttcatcaggcaaaatatatcttctttctaacagaggagaagaaagatgatatattttaacctggcggcagcgcaaaagatg

SEQ ID NO: 99295 - DNA, 103 bp, Artificial Sequence
  Synthetic Polynucleotide
taatacgactcactatagggaatgatggccggttcatcaggcaaaatataaacagaggagatatattatgcctgatgaaaacctggcggcagcgcaaaagatg

SEQ ID NO: 99296 - DNA, 103 bp, Artificial Sequence
  Synthetic Polynucleotide
taatacgactcactatagggttggatgtacaatgatggccggttcatcagaacagaggagactgatgatgcggccatcaaacctggcggcagcgcaaaagatg

SEQ ID NO: 99297 - DNA, 103 bp, Artificial Sequence
  Synthetic Polynucleotide
taatacgactcactataggggcagcccaatttggatgtacaatgatggccaacagaggagaggccatatgtgtacatccaacctggcggcagcgcaaaagatg

SEQ ID NO: 99298 - DNA, 103 bp, Artificial Sequence
  Synthetic Polynucleotide
taatacgactcactatagggtaatgcagctgctgcagctgcggcttgttgaacagaggagacaacaaatggcagctgcaaacctggcggcagcgcaaaagatg

SEQ ID NO: 99299 - DNA, 103 bp, Artificial Sequence
  Synthetic Polynucleotide
taatacgactcactataggggccactttttgcagcccaatttggatgtacaacagaggagagtacatatgaattgggctaacctggcggcagcgcaaaagatg

SEQ ID NO: 99300 - DNA, 103 bp, Artificial Sequence
  Synthetic Polynucleotide
taatacgactcactatagggaatcaaacttgccactttttgcagcccaataacagaggagaattgggatgcaaaaagtgaacctggcggcagcgcaaaagatg

SEQ ID NO: 99301 - DNA, 103 bp, Artificial Sequence
  Synthetic Polynucleotide
taatacgactcactatagggatgatgctacaatcaaacttgccactttttaacagaggagaaaaaagatgcaagtttgaaacctggcggcagcgcaaaagatg

SEQ ID NO: 99302 - DNA, 103 bp, Artificial Sequence
  Synthetic Polynucleotide
taatacgactcactatagggactcaaagacatgatgctacaatcaaacttaacagaggagaaagtttatgtgtagcatcaacctggcggcagcgcaaaagatg

SEQ ID NO: 99303 - DNA, 103 bp, Artificial Sequence
  Synthetic Polynucleotide
taatacgactcactatagggccaataggacactcaaagacatgatgctacaacagaggagagtagcaatgtgtctttgaaacctggcggcagcgcaaaagatg

SEQ ID NO: 99304 - DNA, 103 bp, Artificial Sequence
  Synthetic Polynucleotide
taatacgactcactatagggaatctgtagtccaataggacactcaaagacaacagaggagagtctttatgtgtcctattaacctggcggcagcgcaaaagatg

SEQ ID NO: 99305 - DNA, 103 bp, Artificial Sequence
  Synthetic Polynucleotide
taatacgactcactatagggattatcctctaatctgtagtccaataggacaacagaggagagtcctaatggactacagaaacctggcggcagcgcaaaagatg

SEQ ID NO: 99306 - DNA, 103 bp, Artificial Sequence
  Synthetic Polynucleotide
taatacgactcactatagggaatgttctttattatcctctaatctgtagtaacagaggagaactacaatgtagaggataaacctggcggcagcgcaaaagatg

SEQ ID NO: 99307 - DNA, 103 bp, Artificial Sequence
  Synthetic Polynucleotide
taatacgactcactatagggacctcaaatgaatgttctttattatcctctaacagaggagaagaggaatgtaaagaacaaacctggcggcagcgcaaaagatg

SEQ ID NO: 99308 - DNA, 103 bp, Artificial Sequence
  Synthetic Polynucleotide
taatacgactcactatagggaaacaatgaaacctcaaatgaatgttctttaacagaggagaaaagaaatgtcatttgagaacctggcggcagcgcaaaagatg

SEQ ID NO: 99309 - DNA, 103 bp, Artificial Sequence
  Synthetic Polynucleotide
taatacgactcactatagggattgctgttgtaatgcagctgctgcagctgaacagaggagacagctgatgcagctgcataacctggcggcagcgcaaaagatg

SEQ ID NO: 99310 - DNA, 103 bp, Artificial Sequence
  Synthetic Polynucleotide
taatacgactcactatagggaaagttccgcaaacaatgaaacctcaaatgaacagaggagacatttgatgtttcattgtaacctggcggcagcgcaaaagatg

SEQ ID NO: 99311 - DNA, 103 bp, Artificial Sequence
  Synthetic Polynucleotide
taatacgactcactatagggatttcgttgaaaagttccgcaaacaatgaaaacagaggagattcattatgtgcggaactaacctggcggcagcgcaaaagatg

SEQ ID NO: 99312 - DNA, 103 bp, Artificial Sequence
  Synthetic Polynucleotide
taatacgactcactatagggtctttgaagcatttcgttgaaaagttccgcaacagaggagagcggaaatgttcaacgaaaacctggcggcagcgcaaaagatg

SEQ ID NO: 99313 - DNA, 103 bp, Artificial Sequence
  Synthetic Polynucleotide
taatacgactcactatagggcaccaaaatctctttgaagcatttcgttgaaacagaggagatcaacgatgtgcttcaaaaacctggcggcagcgcaaaagatg

SEQ ID NO: 99314 - DNA, 103 bp, Artificial Sequence
  Synthetic Polynucleotide
taatacgactcactatagggtatatacggacaccaaaatctctttgaagcaacagaggagagcttcaatgagattttggaacctggcggcagcgcaaaagatg

SEQ ID NO: 99315 - DNA, 103 bp, Artificial Sequence
  Synthetic Polynucleotide
taatacgactcactatagggtaatgatttgtatatacggacaccaaaatcaacagaggagagattttatggtccgtataaacctggcggcagcgcaaaagatg

SEQ ID NO: 99316 - DNA, 103 bp, Artificial Sequence
  Synthetic Polynucleotide
taatacgactcactataggggaagagacagtaatgatttgtatatacggaaacagaggagatccgtaatgacaaatcataacctggcggcagcgcaaaagatg

SEQ ID NO: 99317 - DNA, 103 bp, Artificial Sequence
  Synthetic Polynucleotide
taatacgactcactatagggtctttctcaggaagagacagtaatgatttgaacagaggagacaaatcatgactgtctctaacctggcggcagcgcaaaagatg

SEQ ID NO: 99318 - DNA, 103 bp, Artificial Sequence
  Synthetic Polynucleotide
taatacgactcactatagggttttttgtcctctttctcaggaagagacagaacagaggagactgtctatgcctgagaaaaacctggcggcagcgcaaaagatg

SEQ ID NO: 99319 - DNA, 103 bp, Artificial Sequence
  Synthetic Polynucleotide
taatacgactcactatagggtatccttttcttttttgtcctctttctcagaacagaggagactgagaatgaggacaaaaaacctggcggcagcgcaaaagatg

SEQ ID NO: 99320 - DNA, 103 bp, Artificial Sequence
  Synthetic Polynucleotide
taatacgactcactatagggggttgtgaatattgctgttgtaatgcagctaacagaggagaagctgcatgacaacagcaaacctggcggcagcgcaaaagatg

SEQ ID NO: 99321 - DNA, 103 bp, Artificial Sequence
  Synthetic Polynucleotide
taatacgactcactatagggttgctttttttatccttttcttttttgtccaacagaggagaggacaaatgagaaaaggaaacctggcggcagcgcaaaagatg

SEQ ID NO: 99322 - DNA, 103 bp, Artificial Sequence
  Synthetic Polynucleotide
taatacgactcactatagggctcatcttttttgctttttttatccttttcaacagaggagagaaaagatgaaaaaaagcaacctggcggcagcgcaaaagatg

SEQ ID NO: 99323 - DNA, 103 bp, Artificial Sequence
  Synthetic Polynucleotide
taatacgactcactatagggtatcttttctctcatcttttttgcttttttaacagaggagaaaaaaaatgaaaaagatgaacctggcggcagcgcaaaagatg

SEQ ID NO: 99324 - DNA, 103 bp, Artificial Sequence
  Synthetic Polynucleotide
taatacgactcactatagggtcttcttttttatcttttctctcatcttttaacagaggagaaaaagaatggagaaaagaaacctggcggcagcgcaaaagatg

SEQ ID NO: 99325 - DNA, 103 bp, Artificial Sequence
  Synthetic Polynucleotide
taatacgactcactatagggatcatctctttcttcttttttatcttttctaacagaggagaagaaaaatgaaaaaagaaaacctggcggcagcgcaaaagatg

SEQ ID NO: 99326 - DNA, 103 bp, Artificial Sequence
  Synthetic Polynucleotide
taatacgactcactatagggcatcagtttcatcatctctttcttctttttaacagaggagaaaaaagatgaaagagatgaacctggcggcagcgcaaaagatg

SEQ ID NO: 99327 - DNA, 103 bp, Artificial Sequence
  Synthetic Polynucleotide
taatacgactcactatagggggttttggttcatcagtttcatcatctcttaacagaggagaaagagaatgtgaaactgaaacctggcggcagcgcaaaagatg

SEQ ID NO: 99328 - DNA, 103 bp, Artificial Sequence
  Synthetic Polynucleotide
taatacgactcactatagggtctccgtttgggttttggttcatcagtttcaacagaggagagaaactatggaaccaaaaaacctggcggcagcgcaaaagatg

SEQ ID NO: 99329 - DNA, 103 bp, Artificial Sequence
  Synthetic Polynucleotide
taatacgactcactatagggcgcctgattttctccgtttgggttttggttaacagaggagaaaccaaatgccaaacggaaacctggcggcagcgcaaaagatg

SEQ ID NO: 99330 - DNA, 103 bp, Artificial Sequence
  Synthetic Polynucleotide
taatacgactcactatagggtctttatcatcgcctgattttctccgtttgaacagaggagacaaacgatgaaaatcaggaacctggcggcagcgcaaaagatg

SEQ ID NO: 99331 - DNA, 103 bp, Artificial Sequence
  Synthetic Polynucleotide
taatacgactcactatagggggcctgctgaggttgtgaatattgctgttgaacagaggagacaacagatgtattcacaaaacctggcggcagcgcaaaagatg

SEQ ID NO: 99332 - DNA, 103 bp, Artificial Sequence
  Synthetic Polynucleotide
taatacgactcactatagggttcttttttatctttatcatcgcctgatttaacagaggagaaaatcaatggatgataaaaacctggcggcagcgcaaaagatg

SEQ ID NO: 99333 - DNA, 103 bp, Artificial Sequence
  Synthetic Polynucleotide
taatacgactcactatagggcatctctatcttcttttttatctttatcataacagaggagaatgataatgataaaaaagaacctggcggcagcgcaaaagatg

SEQ ID NO: 99334 - DNA, 103 bp, Artificial Sequence
  Synthetic Polynucleotide
taatacgactcactatagggttcttcctttcatctctatcttcttttttaaacagaggagataaaaaatgagatagagaaacctggcggcagcgcaaaagatg

SEQ ID NO: 99335 - DNA, 103 bp, Artificial Sequence
  Synthetic Polynucleotide
taatacgactcactatagggtttatcttctttcttcctttcatctctatcaacagaggagagatagaatggaaaggaagaacctggcggcagcgcaaaagatg

SEQ ID NO: 99336 - DNA, 103 bp, Artificial Sequence
  Synthetic Polynucleotide
taatacgactcactatagggcatcttttcttttatcttctttcttcctttaacagaggagaaaaggaatgaagaagataaacctggcggcagcgcaaaagatg

SEQ ID NO: 99337 - DNA, 103 bp, Artificial Sequence
  Synthetic Polynucleotide
taatacgactcactatagggtctttagaatcatcttttcttttatcttctaacagaggagaagaagaatgaagaaaagaaacctggcggcagcgcaaaagatg

SEQ ID NO: 99338 - DNA, 103 bp, Artificial Sequence
  Synthetic Polynucleotide
taatacgactcactatagggttcatcatcatctttagaatcatcttttctaacagaggagaagaaaaatggattctaaaaacctggcggcagcgcaaaagatg

SEQ ID NO: 99339 - DNA, 103 bp, Artificial Sequence
  Synthetic Polynucleotide
taatacgactcactatagggcttcttcagtttcatcatcatctttagaataacagaggagaattctaatgatgatgatgaacctggcggcagcgcaaaagatg

SEQ ID NO: 99340 - DNA, 103 bp, Artificial Sequence
  Synthetic Polynucleotide
taatacgactcactatagggtgattgttatcttcttcagtttcatcatcaaacagaggagatgatgaatgaactgaagaaacctggcggcagcgcaaaagatg

SEQ ID NO: 99341 - DNA, 103 bp, Artificial Sequence
  Synthetic Polynucleotide
taatacgactcactatagggatattcatcttgattgttatcttcttcagtaacagaggagaactgaaatggataacaataacctggcggcagcgcaaaagatg

SEQ ID NO: 99342 - DNA, 103 bp, Artificial Sequence
  Synthetic Polynucleotide
taatacgactcactatagggcactatacagggcctgctgaggttgtgaataacagaggagaattcacatgctcagcaggaacctggcggcagcgcaaaagatg

SEQ ID NO: 99343 - DNA, 103 bp, Artificial Sequence
  Synthetic Polynucleotide
taatacgactcactatagggccatagggtcatattcatcttgattgttataacagaggagaataacaatgaagatgaataacctggcggcagcgcaaaagatg

SEQ ID NO: 99344 - DNA, 103 bp, Artificial Sequence
  Synthetic Polynucleotide
taatacgactcactatagggtcttctgcttccatagggtcatattcatctaacagaggagaagatgaatgtgaccctataacctggcggcagcgcaaaagatg

SEQ ID NO: 99345 - DNA, 103 bp, Artificial Sequence
  Synthetic Polynucleotide
taatacgactcactatagggatcctcagcttcttctgcttccatagggtcaacagaggagagaccctatggaagcagaaaacctggcggcagcgcaaaagatg

SEQ ID NO: 99346 - DNA, 103 bp, Artificial Sequence
  Synthetic Polynucleotide
taatacgactcactatagggcatcttcttcatcctcagcttcttctgcttaacagaggagaaagcagatgaagctgaggaacctggcggcagcgcaaaagatg

SEQ ID NO: 99347 - DNA, 103 bp, Artificial Sequence
  Synthetic Polynucleotide
taatacgactcactatagggtcatccctatcatcttcttcatcctcagctaacagaggagaagctgaatgtgaagaagaaacctggcggcagcgcaaaagatg

SEQ ID NO: 99348 - DNA, 103 bp, Artificial Sequence
  Synthetic Polynucleotide
taatacgactcactatagggcatttcttcctcatccctatcatcttcttcaacagaggagagaagaaatggatagggataacctggcggcagcgcaaaagatg

SEQ ID NO: 99349 - DNA, 103 bp, Artificial Sequence
  Synthetic Polynucleotide
taatacgactcactatagggctcgtttggtcatttcttcctcatccctataacagaggagaatagggatgaggaagaaaaacctggcggcagcgcaaaagatg

SEQ ID NO: 99350 - DNA, 103 bp, Artificial Sequence
  Synthetic Polynucleotide
taatacgactcactatagggcttttgtcatctcgtttggtcatttcttccaacagaggagaggaagaatggaccaaacgaacctggcggcagcgcaaaagatg

SEQ ID NO: 99351 - DNA, 103 bp, Artificial Sequence
  Synthetic Polynucleotide
taatacgactcactataggggttgatatctcttttgtcatctcgtttggtaacagaggagaaccaaaatggatgacaaaaacctggcggcagcgcaaaagatg

SEQ ID NO: 99352 - DNA, 103 bp, Artificial Sequence
  Synthetic Polynucleotide
taatacgactcactatagggtgcagtatctgttgatatctcttttgtcataacagaggagaatgacaatggagatatcaaacctggcggcagcgcaaaagatg

SEQ ID NO: 99353 - DNA, 103 bp, Artificial Sequence
  Synthetic Polynucleotide
taatacgactcactatagggtgttgttgcacactatacagggcctgctgaaacagaggagatcagcaatgcctgtatagaacctggcggcagcgcaaaagatg

SEQ ID NO: 99354 - DNA, 103 bp, Artificial Sequence
  Synthetic Polynucleotide
taatacgactcactatagggggcctctccttgcagtatctgttgatatctaacagaggagaagatatatgcagatactgaacctggcggcagcgcaaaagatg

SEQ ID NO: 99355 - DNA, 103 bp, Artificial Sequence
  Synthetic Polynucleotide
taatacgactcactatagggatctttagagggcctctccttgcagtatctaacagaggagaagatacatgaaggagaggaacctggcggcagcgcaaaagatg

SEQ ID NO: 99356 - DNA, 103 bp, Artificial Sequence
  Synthetic Polynucleotide
taatacgactcactatagggctttttccttatctttagagggcctctcctaacagaggagaaggagaatgcctctaaagaacctggcggcagcgcaaaagatg

SEQ ID NO: 99357 - DNA, 103 bp, Artificial Sequence
  Synthetic Polynucleotide
taatacgactcactatagggtgagtcttttctttttccttatctttagagaacagaggagactctaaatgtaaggaaaaaacctggcggcagcgcaaaagatg

SEQ ID NO: 99358 - DNA, 103 bp, Artificial Sequence
  Synthetic Polynucleotide
taatacgactcactatagggtgtgatcatttgagtcttttctttttccttaacagaggagaaaggaaatggaaaagactaacctggcggcagcgcaaaagatg

SEQ ID NO: 99359 - DNA, 103 bp, Artificial Sequence
  Synthetic Polynucleotide
taatacgactcactatagggctctgttaattgtgatcatttgagtcttttaacagaggagaaaaagaatgaaatgatcaaacctggcggcagcgcaaaagatg

SEQ ID NO: 99360 - DNA, 103 bp, Artificial Sequence
  Synthetic Polynucleotide
taatacgactcactatagggattaacagatctctgttaattgtgatcattaacagaggagaaatgatatgaattaacagaacctggcggcagcgcaaaagatg

SEQ ID NO: 99361 - DNA, 103 bp, Artificial Sequence
  Synthetic Polynucleotide
taatacgactcactatagggaacaaaagccattaacagatctctgttaataacagaggagaattaacatggatctgttaaacctggcggcagcgcaaaagatg

SEQ ID NO: 99362 - DNA, 103 bp, Artificial Sequence
  Synthetic Polynucleotide
taatacgactcactataggggatcaaaataaacaaaagccattaacagataacagaggagaatctgtatgtggcttttgaacctggcggcagcgcaaaagatg

SEQ ID NO: 99363 - DNA, 103 bp, Artificial Sequence
  Synthetic Polynucleotide
taatacgactcactatagggcaatgactttgatcaaaataaacaaaagccaacagaggagaggctttatgttattttgaaacctggcggcagcgcaaaagatg

SEQ ID NO: 99364 - DNA, 103 bp, Artificial Sequence
  Synthetic Polynucleotide
taatacgactcactatagggttgctgtaactgttgttgcacactatacagaacagaggagactgtatatggtgcaacaaaacctggcggcagcgcaaaagatg

SEQ ID NO: 99365 - DNA, 103 bp, Artificial Sequence
  Synthetic Polynucleotide
taatacgactcactatagggaaggtaaccacaatgactttgatcaaaataaacagaggagatattttatgcaaagtcataacctggcggcagcgcaaaagatg

SEQ ID NO: 99366 - DNA, 103 bp, Artificial Sequence
  Synthetic Polynucleotide
taatacgactcactatagggccttttcaagaaggtaaccacaatgactttaacagaggagaaaagtcatggtggttaccaacctggcggcagcgcaaaagatg

SEQ ID NO: 99367 - DNA, 103 bp, Artificial Sequence
  Synthetic Polynucleotide
taatacgactcactatagggtcttccaaatccttttcaagaaggtaaccaaacagaggagatggttaatgtcttgaaaaaacctggcggcagcgcaaaagatg

SEQ ID NO: 99368 - DNA, 103 bp, Artificial Sequence
  Synthetic Polynucleotide
taatacgactcactatagggataaagtatttcttccaaatccttttcaagaacagaggagacttgaaatggatttggaaaacctggcggcagcgcaaaagatg

SEQ ID NO: 99369 - DNA, 103 bp, Artificial Sequence
  Synthetic Polynucleotide
taatacgactcactataggggtccaagagtataaagtatttcttccaaataacagaggagaatttggatgaaatactttaacctggcggcagcgcaaaagatg

SEQ ID NO: 99370 - DNA, 103 bp, Artificial Sequence
  Synthetic Polynucleotide
taatacgactcactataggggaaagatgtagtccaagagtataaagtattaacagaggagaaatactatgtactcttggaacctggcggcagcgcaaaagatg

SEQ ID NO: 99371 - DNA, 103 bp, Artificial Sequence
  Synthetic Polynucleotide
taatacgactcactatagggctgagcccgagaaagatgtagtccaagagtaacagaggagaactcttatgctacatcttaacctggcggcagcgcaaaagatg

SEQ ID NO: 99372 - DNA, 103 bp, Artificial Sequence
  Synthetic Polynucleotide
taatacgactcactataggggcttctttacctgagcccgagaaagatgtaaacagaggagatacatcatgctcgggctcaacctggcggcagcgcaaaagatg

SEQ ID NO: 99373 - DNA, 103 bp, Artificial Sequence
  Synthetic Polynucleotide
taatacgactcactatagggttattaagaagcttctttacctgagcccgaaacagaggagatcgggcatgggtaaagaaaacctggcggcagcgcaaaagatg

SEQ ID NO: 99374 - DNA, 103 bp, Artificial Sequence
  Synthetic Polynucleotide
taatacgactcactataggggagcactactttattaagaagcttctttacaacagaggagagtaaagatgcttcttaataacctggcggcagcgcaaaagatg

SEQ ID NO: 99375 - DNA, 103 bp, Artificial Sequence
  Synthetic Polynucleotide
taatacgactcactatagggtttgctggggttgctgtaactgttgttgcaaacagaggagatgcaacatgagttacagcaacctggcggcagcgcaaaagatg

SEQ ID NO: 99376 - DNA, 103 bp, Artificial Sequence
  Synthetic Polynucleotide
taatacgactcactatagggaagattcacggagcactactttattaagaaaacagaggagattcttaatgaagtagtgcaacctggcggcagcgcaaaagatg

SEQ ID NO: 99377 - DNA, 103 bp, Artificial Sequence
  Synthetic Polynucleotide
taatacgactcactatagggcggtaaaagcaagattcacggagcactactaacagaggagaagtagtatgccgtgaatcaacctggcggcagcgcaaaagatg

SEQ ID NO: 99378 - DNA, 103 bp, Artificial Sequence
  Synthetic Polynucleotide
taatacgactcactatagggtgttaatttccggtaaaagcaagattcacgaacagaggagacgtgaaatgtgcttttacaacctggcggcagcgcaaaagatg

SEQ ID NO: 99379 - DNA, 103 bp, Artificial Sequence
  Synthetic Polynucleotide
taatacgactcactatagggttgaggtgtctgttaatttccggtaaaagcaacagaggagagcttttatgggaaattaaaacctggcggcagcgcaaaagatg

SEQ ID NO: 99380 - DNA, 103 bp, Artificial Sequence
  Synthetic Polynucleotide
taatacgactcactatagggtcttcatcttttgaggtgtctgttaatttcaacagaggagagaaattatgagacacctcaacctggcggcagcgcaaaagatg

SEQ ID NO: 99381 - DNA, 103 bp, Artificial Sequence
  Synthetic Polynucleotide
taatacgactcactatagggttcatggttctcttcatcttttgaggtgtcaacagaggagagacaccatgaaagatgaaaacctggcggcagcgcaaaagatg

SEQ ID NO: 99382 - DNA, 103 bp, Artificial Sequence
  Synthetic Polynucleotide
taatacgactcactatagggactcagactcttcatggttctcttcatcttaacagaggagaaagatgatgagaaccatgaacctggcggcagcgcaaaagatg

SEQ ID NO: 99383 - DNA, 103 bp, Artificial Sequence
  Synthetic Polynucleotide
taatacgactcactatagggtcctgcaatgactcagactcttcatggttcaacagaggagagaaccaatgagagtctgaaacctggcggcagcgcaaaagatg

SEQ ID NO: 99384 - DNA, 103 bp, Artificial Sequence
  Synthetic Polynucleotide
taatacgactcactatagggtagcatatcttcctgcaatgactcagactcaacagaggagagagtctatgtcattgcagaacctggcggcagcgcaaaagatg

SEQ ID NO: 99385 - DNA, 103 bp, Artificial Sequence
  Synthetic Polynucleotide
taatacgactcactatagggatctgtttcctagcatatcttcctgcaatgaacagaggagacattgcatgaagatatgcaacctggcggcagcgcaaaagatg

SEQ ID NO: 99386 - DNA, 103 bp, Artificial Sequence
  Synthetic Polynucleotide
taatacgactcactataggggtaaactgagtagcccatggcggattcttcaacagaggagagaagaaatggccatgggcaacctggcggcagcgcaaaagatg

SEQ ID NO: 99387 - DNA, 103 bp, Artificial Sequence
  Synthetic Polynucleotide
taatacgactcactataggggttaagagggtttgctggggttgctgtaacaacagaggagagttacaatgaccccagcaaacctggcggcagcgcaaaagatg

SEQ ID NO: 99388 - DNA, 103 bp, Artificial Sequence
  Synthetic Polynucleotide
taatacgactcactatagggggaagtaataatctgtttcctagcatatctaacagaggagaagatatatgaggaaacagaacctggcggcagcgcaaaagatg

SEQ ID NO: 99389 - DNA, 103 bp, Artificial Sequence
  Synthetic Polynucleotide
taatacgactcactatagggtgttggtgttggaagtaataatctgtttccaacagaggagaggaaacatgttattacttaacctggcggcagcgcaaaagatg

SEQ ID NO: 99390 - DNA, 103 bp, Artificial Sequence
  Synthetic Polynucleotide
taatacgactcactatagggcctgctttactgttggtgttggaagtaataaacagaggagatattacatgcaacaccaaaacctggcggcagcgcaaaagatg

SEQ ID NO: 99391 - DNA, 103 bp, Artificial Sequence
  Synthetic Polynucleotide
taatacgactcactatagggtcctttgattcctgctttactgttggtgttaacagaggagaaacaccatgagtaaagcaaacctggcggcagcgcaaaagatg

SEQ ID NO: 99392 - DNA, 103 bp, Artificial Sequence
  Synthetic Polynucleotide
taatacgactcactatagggttcttccacatcctttgattcctgctttacaacagaggagagtaaagatggaatcaaagaacctggcggcagcgcaaaagatg

SEQ ID NO: 99393 - DNA, 103 bp, Artificial Sequence
  Synthetic Polynucleotide
taatacgactcactatagggggccaacattttcttccacatcctttgattaacagaggagaaatcaaatgatgtggaagaacctggcggcagcgcaaaagatg

SEQ ID NO: 99394 - DNA, 103 bp, Artificial Sequence
  Synthetic Polynucleotide
taatacgactcactatagggtacacaatgaggccaacattttcttccacaaacagaggagatgtggaatgaaatgttggaacctggcggcagcgcaaaagatg

SEQ ID NO: 99395 - DNA, 103 bp, Artificial Sequence
  Synthetic Polynucleotide
taatacgactcactatagggtgcaccattgtacacaatgaggccaacattaacagaggagaaatgttatgctcattgtgaacctggcggcagcgcaaaagatg

SEQ ID NO: 99396 - DNA, 103 bp, Artificial Sequence
  Synthetic Polynucleotide
taatacgactcactatagggcatctaccattgcaccattgtacacaatgaaacagaggagatcattgatgacaatggtgaacctggcggcagcgcaaaagatg

SEQ ID NO: 99397 - DNA, 103 bp, Artificial Sequence
  Synthetic Polynucleotide
taatacgactcactatagggaggcttcctacatctaccattgcaccattgaacagaggagacaatggatgaatggtagaaacctggcggcagcgcaaaagatg

SEQ ID NO: 99398 - DNA, 103 bp, Artificial Sequence
  Synthetic Polynucleotide
taatacgactcactatagggagctggctgtgttaagagggtttgctggggaacagaggagaccccagatgaccctcttaaacctggcggcagcgcaaaagatg

SEQ ID NO: 99399 - DNA, 103 bp, Artificial Sequence
  Synthetic Polynucleotide
taatacgactcactatagggtttttgcaagaggcttcctacatctaccataacagaggagaatggtaatggtaggaagcaacctggcggcagcgcaaaagatg

SEQ ID NO: 99400 - DNA, 103 bp, Artificial Sequence
  Synthetic Polynucleotide
taatacgactcactatagggtcttttccaatttttgcaagaggcttcctaaacagaggagataggaaatgtcttgcaaaaacctggcggcagcgcaaaagatg

SEQ ID NO: 99401 - DNA, 103 bp, Artificial Sequence
  Synthetic Polynucleotide
taatacgactcactatagggactttttcgctcttttccaatttttgcaagaacagaggagacttgcaatgattggaaaaaacctggcggcagcgcaaaagatg

SEQ ID NO: 99402 - DNA, 103 bp, Artificial Sequence
  Synthetic Polynucleotide
taatacgactcactatagggctcagctcttactttttcgctcttttccaaaacagaggagattggaaatgagcgaaaaaaacctggcggcagcgcaaaagatg

SEQ ID NO: 99403 - DNA, 103 bp, Artificial Sequence
  Synthetic Polynucleotide
taatacgactcactatagggtctgttctacctcagctcttactttttcgcaacagaggagagcgaaaatgtaagagctgaacctggcggcagcgcaaaagatg

SEQ ID NO: 99404 - DNA, 103 bp, Artificial Sequence
  Synthetic Polynucleotide
taatacgactcactatagggaactgcagcttctgttctacctcagctcttaacagaggagaaagagcatgggtagaacaaacctggcggcagcgcaaaagatg

SEQ ID NO: 99405 - DNA, 103 bp, Artificial Sequence
  Synthetic Polynucleotide
taatacgactcactatagggttcttctagtaactgcagcttctgttctacaacagaggagagtagaaatgaagctgcagaacctggcggcagcgcaaaagatg

SEQ ID NO: 99406 - DNA, 103 bp, Artificial Sequence
  Synthetic Polynucleotide
taatacgactcactatagggcatctgttttttcttctagtaactgcagctaacagaggagaagctgcatgtactagaagaacctggcggcagcgcaaaagatg

SEQ ID NO: 99407 - DNA, 103 bp, Artificial Sequence
  Synthetic Polynucleotide
taatacgactcactatagggttttcatcttcatctgttttttcttctagtaacagaggagaactagaatgaaaaacagaaacctggcggcagcgcaaaagatg

SEQ ID NO: 99408 - DNA, 103 bp, Artificial Sequence
  Synthetic Polynucleotide
taatacgactcactatagggtaatatggttttttcatcttcatctgttttaacagaggagaaaaacaatggaagatgaaaacctggcggcagcgcaaaagatg

SEQ ID NO: 99409 - DNA, 103 bp, Artificial Sequence
  Synthetic Polynucleotide
taatacgactcactataggggcagtgcaacagctggctgtgttaagagggaacagaggagaccctctatgcacagccagaacctggcggcagcgcaaaagatg

SEQ ID NO: 99410 - DNA, 103 bp, Artificial Sequence
  Synthetic Polynucleotide
taatacgactcactatagggtctccaaatttaatatggttttttcatcttaacagaggagaaagatgatgaaaccatataacctggcggcagcgcaaaagatg

SEQ ID NO: 99411 - DNA, 103 bp, Artificial Sequence
  Synthetic Polynucleotide
taatacgactcactatagggttgttggaattctccaaatttaatatggttaacagaggagaaaccatatgaaatttggaaacctggcggcagcgcaaaagatg

SEQ ID NO: 99412 - DNA, 103 bp, Artificial Sequence
  Synthetic Polynucleotide
taatacgactcactatagggagagaggcttttgttggaattctccaaattaacagaggagaaatttgatgaattccaacaacctggcggcagcgcaaaagatg

SEQ ID NO: 99413 - DNA, 103 bp, Artificial Sequence
  Synthetic Polynucleotide
taatacgactcactatagggtgagttcaccagagaggcttttgttggaataacagaggagaattccaatgaaagcctctaacctggcggcagcgcaaaagatg

SEQ ID NO: 99414 - DNA, 103 bp, Artificial Sequence
  Synthetic Polynucleotide
taatacgactcactatagggttaacttctctgagttcaccagagaggcttaacagaggagaaagcctatgtggtgaactaacctggcggcagcgcaaaagatg

SEQ ID NO: 99415 - DNA, 103 bp, Artificial Sequence
  Synthetic Polynucleotide
taatacgactcactatagggaaggtcctttttaacttctctgagttcaccaacagaggagaggtgaaatgagagaagttaacctggcggcagcgcaaaagatg

SEQ ID NO: 99416 - DNA, 103 bp, Artificial Sequence
  Synthetic Polynucleotide
taatacgactcactataggggtaactgactaaggtcctttttaacttctcaacagaggagagagaagatgaaaaggaccaacctggcggcagcgcaaaagatg

SEQ ID NO: 99417 - DNA, 103 bp, Artificial Sequence
  Synthetic Polynucleotide
taatacgactcactatagggaagttttcttgtaactgactaaggtcctttaacagaggagaaaaggaatgtagtcagttaacctggcggcagcgcaaaagatg

SEQ ID NO: 99418 - DNA, 103 bp, Artificial Sequence
  Synthetic Polynucleotide
taatacgactcactatagggcgaaatctttaagttttcttgtaactgactaacagaggagaagtcagatgcaagaaaacaacctggcggcagcgcaaaagatg

SEQ ID NO: 99419 - DNA, 103 bp, Artificial Sequence
  Synthetic Polynucleotide
taatacgactcactatagggtcatgttttccgaaatctttaagttttcttaacagaggagaaagaaaatgtaaagatttaacctggcggcagcgcaaaagatg

SEQ ID NO: 99420 - DNA, 103 bp, Artificial Sequence
  Synthetic Polynucleotide
taatacgactcactatagggaggcttgtaggcagtgcaacagctggctgtaacagaggagaacagccatgtgttgcactaacctggcggcagcgcaaaagatg

SEQ ID NO: 99421 - DNA, 103 bp, Artificial Sequence
  Synthetic Polynucleotide
taatacgactcactatagggaattgtaaattcatgttttccgaaatctttaacagaggagaaaagatatgggaaaacataacctggcggcagcgcaaaagatg

SEQ ID NO: 99422 - DNA, 103 bp, Artificial Sequence
  Synthetic Polynucleotide
taatacgactcactatagggttggttttcaaattgtaaattcatgttttcaacagaggagagaaaacatgaatttacaaaacctggcggcagcgcaaaagatg

SEQ ID NO: 99423 - DNA, 103 bp, Artificial Sequence
  Synthetic Polynucleotide
taatacgactcactatagggtcttattcatttggttttcaaattgtaaataacagaggagaatttacatgttgaaaaccaacctggcggcagcgcaaaagatg

SEQ ID NO: 99424 - DNA, 103 bp, Artificial Sequence
  Synthetic Polynucleotide
taatacgactcactatagggtttctgattgtcttattcatttggttttcaaacagaggagatgaaaaatgaatgaataaaacctggcggcagcgcaaaagatg

SEQ ID NO: 99425 - DNA, 103 bp, Artificial Sequence
  Synthetic Polynucleotide
taatacgactcactatagggcgtagataagtttctgattgtcttattcataacagaggagaatgaatatgacaatcagaaacctggcggcagcgcaaaagatg

SEQ ID NO: 99426 - DNA, 103 bp, Artificial Sequence
  Synthetic Polynucleotide
taatacgactcactatagggcatccattaccgtagataagtttctgattgaacagaggagacaatcaatgacttatctaaacctggcggcagcgcaaaagatg

SEQ ID NO: 99427 - DNA, 103 bp, Artificial Sequence
  Synthetic Polynucleotide
taatacgactcactataggggtgtggatttcatccattaccgtagataagaacagaggagacttatcatgggtaatggaaacctggcggcagcgcaaaagatg

SEQ ID NO: 99428 - DNA, 103 bp, Artificial Sequence
  Synthetic Polynucleotide
taatacgactcactatagggcttgagaacagtgtggatttcatccattacaacagaggagagtaatgatggaaatccacaacctggcggcagcgcaaaagatg

SEQ ID NO: 99429 - DNA, 103 bp, Artificial Sequence
  Synthetic Polynucleotide
taatacgactcactatagggcattatccttcttgagaacagtgtggatttaacagaggagaaaatccatgctgttctcaaacctggcggcagcgcaaaagatg

SEQ ID NO: 99430 - DNA, 103 bp, Artificial Sequence
  Synthetic Polynucleotide
taatacgactcactatagggtcattctttacattatccttcttgagaacaaacagaggagatgttctatggaaggataaaacctggcggcagcgcaaaagatg

SEQ ID NO: 99431 - DNA, 103 bp, Artificial Sequence
  Synthetic Polynucleotide
taatacgactcactatagggagacaggctaaggcttgtaggcagtgcaacaacagaggagagttgcaatgcctacaagcaacctggcggcagcgcaaaagatg

SEQ ID NO: 99432 - DNA, 103 bp, Artificial Sequence
  Synthetic Polynucleotide
taatacgactcactatagggatctttgtcttcattctttacattatccttaacagaggagaaaggatatggtaaagaataacctggcggcagcgcaaaagatg

SEQ ID NO: 99433 - DNA, 103 bp, Artificial Sequence
  Synthetic Polynucleotide
taatacgactcactatagggtggatttttgatctttgtcttcattctttaaacagaggagataaagaatgaagacaaagaacctggcggcagcgcaaaagatg

SEQ ID NO: 99434 - DNA, 103 bp, Artificial Sequence
  Synthetic Polynucleotide
taatacgactcactatagggccattctccttggatttttgatctttgtctaacagaggagaagacaaatgtcaaaaatcaacctggcggcagcgcaaaagatg

SEQ ID NO: 99435 - DNA, 103 bp, Artificial Sequence
  Synthetic Polynucleotide
taatacgactcactatagggtacactggcaccattctccttggatttttgaacagaggagacaaaaaatgaaggagaataacctggcggcagcgcaaaagatg

SEQ ID NO: 99436 - DNA, 103 bp, Artificial Sequence
  Synthetic Polynucleotide
taatacgactcactataggggctgaggagtagacaggctaaggcttgtagaacagaggagactacaaatgttagcctgtaacctggcggcagcgcaaaagatg

SEQ ID NO: 99437 - DNA, 103 bp, Artificial Sequence
  Synthetic Polynucleotide
taatacgactcactatagggtgtgctgttggctgaggagtagacaggctaaacagaggagatagcctatgtactcctcaaacctggcggcagcgcaaaagatg

SEQ ID NO: 99438 - DNA, 103 bp, Artificial Sequence
  Synthetic Polynucleotide
taatacgactcactatagggtacagttatttgtgctgttggctgaggagtaacagaggagaactcctatgccaacagcaaacctggcggcagcgcaaaagatg

SEQ ID NO: 99439 - DNA, 103 bp, Artificial Sequence
  Synthetic Polynucleotide
taatacgactcactatagggttggatatgatacagttatttgtgctgttgaacagaggagacaacagatgaaataactgaacctggcggcagcgcaaaagatg

SEQ ID NO: 99440 - DNA, 103 bp, Artificial Sequence
  Synthetic Polynucleotide
taatacgactcactataggggaccttggtgttggatatgatacagttattaacagaggagaaataacatgatcatatccaacctggcggcagcgcaaaagatg

SEQ ID NO: 99441 - DNA, 103 bp, Artificial Sequence
  Synthetic Polynucleotide
taatacgactcactatagggtgcagtggctgtaaactgagtagcccatggaacagaggagaccatggatgactcagtttaacctggcggcagcgcaaaagatg

SEQ ID NO: 99442 - DNA, 103 bp, Artificial Sequence
  Synthetic Polynucleotide
taatacgactcactatagggctgttgactggaccttggtgttggatatgaaacagaggagatcatatatgacaccaaggaacctggcggcagcgcaaaagatg

SEQ ID NO: 99443 - DNA, 103 bp, Artificial Sequence
  Synthetic Polynucleotide
taatacgactcactataggggctgggtttgctgttgactggaccttggtgaacagaggagacaccaaatgccagtcaacaacctggcggcagcgcaaaagatg

SEQ ID NO: 99444 - DNA, 103 bp, Artificial Sequence
  Synthetic Polynucleotide
taatacgactcactatagggtgcttctgaggctgggtttgctgttgactgaacagaggagacagtcaatggcaaacccaaacctggcggcagcgcaaaagatg

SEQ ID NO: 99445 - DNA, 103 bp, Artificial Sequence
  Synthetic Polynucleotide
taatacgactcactataggggaaaacacgctgcttctgaggctgggtttgaacagaggagacaaaccatgcctcagaagaacctggcggcagcgcaaaagatg

SEQ ID NO: 99446 - DNA, 103 bp, Artificial Sequence
  Synthetic Polynucleotide
taatacgactcactatagggccacccctgtgaaaacacgctgcttctgagaacagaggagactcagaatgagcgtgtttaacctggcggcagcgcaaaagatg

SEQ ID NO: 99447 - DNA, 103 bp, Artificial Sequence
  Synthetic Polynucleotide
taatacgactcactatagggagttttgtaaccacccctgtgaaaacacgcaacagaggagagcgtgtatgcacaggggtaacctggcggcagcgcaaaagatg

SEQ ID NO: 99448 - DNA, 103 bp, Artificial Sequence
  Synthetic Polynucleotide
taatacgactcactatagggcgtatcatgtagttttgtaaccacccctgtaacagaggagaacagggatggttacaaaaaacctggcggcagcgcaaaagatg

SEQ ID NO: 99449 - DNA, 103 bp, Artificial Sequence
  Synthetic Polynucleotide
taatacgactcactatagggcaaatccaaacgtatcatgtagttttgtaaaacagaggagattacaaatgtacatgataaacctggcggcagcgcaaaagatg

SEQ ID NO: 99450 - DNA, 103 bp, Artificial Sequence
  Synthetic Polynucleotide
taatacgactcactatagggtcttcatccacaaatccaaacgtatcatgtaacagaggagaacatgaatggtttggattaacctggcggcagcgcaaaagatg

SEQ ID NO: 99451 - DNA, 103 bp, Artificial Sequence
  Synthetic Polynucleotide
taatacgactcactatagggaaagaatacatcttcatccacaaatccaaaaacagaggagatttggaatggtggatgaaaacctggcggcagcgcaaaagatg

SEQ ID NO: 99452 - DNA, 103 bp, Artificial Sequence
  Synthetic Polynucleotide
taatacgactcactataggggctgtgatactgcagtggctgtaaactgagaacagaggagactcagtatgcagccactgaacctggcggcagcgcaaaagatg

SEQ ID NO: 99453 - DNA, 103 bp, Artificial Sequence
  Synthetic Polynucleotide
taatacgactcactatagggcactaagctgaaagaatacatcttcatccaaacagaggagatggatgatgatgtattctaacctggcggcagcgcaaaagatg

SEQ ID NO: 99454 - DNA, 103 bp, Artificial Sequence
  Synthetic Polynucleotide
taatacgactcactatagggcctttgacagcactaagctgaaagaatacaaacagaggagatgtattatgtcagcttagaacctggcggcagcgcaaaagatg

SEQ ID NO: 99455 - DNA, 103 bp, Artificial Sequence
  Synthetic Polynucleotide
taatacgactcactataggggggggttttccctttgacagcactaagctgaacagaggagacagcttatggctgtcaaaaacctggcggcagcgcaaaagatg

SEQ ID NO: 99456 - DNA, 103 bp, Artificial Sequence
  Synthetic Polynucleotide
taatacgactcactatagggcacctacttggggggttttccctttgacagaacagaggagactgtcaatgggaaaacccaacctggcggcagcgcaaaagatg

SEQ ID NO: 99457 - DNA, 103 bp, Artificial Sequence
  Synthetic Polynucleotide
taatacgactcactatagggaatactctgtcacctacttggggggttttcaacagaggagagaaaacatgccaagtaggaacctggcggcagcgcaaaagatg

SEQ ID NO: 99458 - DNA, 103 bp, Artificial Sequence
  Synthetic Polynucleotide
taatacgactcactatagggagcttcaaccaatactctgtcacctacttgaacagaggagacaagtaatggacagagtaaacctggcggcagcgcaaaagatg

SEQ ID NO: 99459 - DNA, 103 bp, Artificial Sequence
  Synthetic Polynucleotide
taatacgactcactataggggattataagtagcttcaaccaatactctgtaacagaggagaacagagatgtggttgaagaacctggcggcagcgcaaaagatg

SEQ ID NO: 99460 - DNA, 103 bp, Artificial Sequence
  Synthetic Polynucleotide
taatacgactcactatagggggcatattaggattataagtagcttcaaccaacagaggagaggttgaatgtacttataaaacctggcggcagcgcaaaagatg

SEQ ID NO: 99461 - DNA, 103 bp, Artificial Sequence
  Synthetic Polynucleotide
taatacgactcactatagggccatttaaaaggcatattaggattataagtaacagaggagaacttatatgcctaatatgaacctggcggcagcgcaaaagatg

SEQ ID NO: 99462 - DNA, 103 bp, Artificial Sequence
  Synthetic Polynucleotide
taatacgactcactatagggtctgtgcattccatttaaaaggcatattagaacagaggagactaataatgcttttaaataacctggcggcagcgcaaaagatg

SEQ ID NO: 99463 - DNA, 103 bp, Artificial Sequence
  Synthetic Polynucleotide
taatacgactcactatagggagtgcagctggctgtgatactgcagtggctaacagaggagaagccacatgagtatcacaaacctggcggcagcgcaaaagatg

SEQ ID NO: 99464 - DNA, 103 bp, Artificial Sequence
  Synthetic Polynucleotide
taatacgactcactataggggtttgaattctctgtgcattccatttaaaaaacagaggagattttaaatggaatgcacaaacctggcggcagcgcaaaagatg

SEQ ID NO: 99465 - DNA, 103 bp, Artificial Sequence
  Synthetic Polynucleotide
taatacgactcactatagggatttggtagtgtttgaattctctgtgcattaacagaggagaaatgcaatgagaattcaaaacctggcggcagcgcaaaagatg

SEQ ID NO: 99466 - DNA, 103 bp, Artificial Sequence
  Synthetic Polynucleotide
taatacgactcactatagggactgattctgatttggtagtgtttgaattcaacagaggagagaattcatgcactaccaaaacctggcggcagcgcaaaagatg

SEQ ID NO: 99467 - DNA, 103 bp, Artificial Sequence
  Synthetic Polynucleotide
taatacgactcactatagggtgggtttgcgactgattctgatttggtagtaacagaggagaactaccatgtcagaatcaaacctggcggcagcgcaaaagatg

SEQ ID NO: 99468 - DNA, 103 bp, Artificial Sequence
  Synthetic Polynucleotide
taatacgactcactatagggcagtaatggctgggtttgcgactgattctgaacagaggagacagaatatgtcgcaaaccaacctggcggcagcgcaaaagatg

SEQ ID NO: 99469 - DNA, 103 bp, Artificial Sequence
  Synthetic Polynucleotide
taatacgactcactataggggaggagtcttcagtaatggctgggtttgcgaacagaggagacgcaaaatgagccattacaacctggcggcagcgcaaaagatg

SEQ ID NO: 99470 - DNA, 103 bp, Artificial Sequence
  Synthetic Polynucleotide
taatacgactcactatagggagtacagcaggaggagtcttcagtaatggcaacagaggagagccattatggaagactccaacctggcggcagcgcaaaagatg

SEQ ID NO: 99471 - DNA, 103 bp, Artificial Sequence
  Synthetic Polynucleotide
taatacgactcactatagggaattggctgaagtacagcaggaggagtcttaacagaggagaaagactatgcctgctgtaaacctggcggcagcgcaaaagatg

SEQ ID NO: 99472 - DNA, 103 bp, Artificial Sequence
  Synthetic Polynucleotide
taatacgactcactatagggtctgtggtgcaattggctgaagtacagcagaacagaggagactgctgatgttcagccaaaacctggcggcagcgcaaaagatg

SEQ ID NO: 99473 - DNA, 103 bp, Artificial Sequence
  Synthetic Polynucleotide
taatacgactcactatagggccaaatgttgtctgtggtgcaattggctgaaacagaggagatcagccatgtgcaccacaaacctggcggcagcgcaaaagatg

SEQ ID NO: 99474 - DNA, 103 bp, Artificial Sequence
  Synthetic Polynucleotide
taatacgactcactatagggttgaacacccagtgcagctggctgtgatacaacagaggagagtatcaatgccagctgcaaacctggcggcagcgcaaaagatg

SEQ ID NO: 99475 - DNA, 103 bp, Artificial Sequence
  Synthetic Polynucleotide
taatacgactcactatagggagtctgaacaccaaatgttgtctgtggtgcaacagaggagagcaccaatgacaacatttaacctggcggcagcgcaaaagatg

SEQ ID NO: 99476 - DNA, 103 bp, Artificial Sequence
  Synthetic Polynucleotide
taatacgactcactataggggctggggctgagtctgaacaccaaatgttgaacagaggagacaacatatggtgttcagaaacctggcggcagcgcaaaagatg

SEQ ID NO: 99477 - DNA, 103 bp, Artificial Sequence
  Synthetic Polynucleotide
taatacgactcactatagggagtgactggggctggggctgagtctgaacaaacagaggagatgttcaatgtcagccccaaacctggcggcagcgcaaaagatg

SEQ ID NO: 99478 - DNA, 103 bp, Artificial Sequence
  Synthetic Polynucleotide
taatacgactcactatagggtgcctgcagcagtgactggggctggggctgaacagaggagacagcccatgccccagtcaaacctggcggcagcgcaaaagatg

SEQ ID NO: 99479 - DNA, 103 bp, Artificial Sequence
  Synthetic Polynucleotide
taatacgactcactatagggctgaaatctgtgcctgcagcagtgactgggaacagaggagacccagtatgtgctgcaggaacctggcggcagcgcaaaagatg

SEQ ID NO: 99480 - DNA, 103 bp, Artificial Sequence
  Synthetic Polynucleotide
taatacgactcactatagggatagaagctgctgaaatctgtgcctgcagcaacagaggagagctgcaatgacagatttcaacctggcggcagcgcaaaagatg

SEQ ID NO: 99481 - DNA, 103 bp, Artificial Sequence
  Synthetic Polynucleotide
taatacgactcactatagggtagtggtgtaatagaagctgctgaaatctgaacagaggagacagattatggcagcttctaacctggcggcagcgcaaaagatg

SEQ ID NO: 99482 - DNA, 103 bp, Artificial Sequence
  Synthetic Polynucleotide
taatacgactcactataggggagtctgcaatagtggtgtaatagaagctgaacagaggagacagcttatgttacaccacaacctggcggcagcgcaaaagatg

SEQ ID NO: 99483 - DNA, 103 bp, Artificial Sequence
  Synthetic Polynucleotide
taatacgactcactatagggggctgtggttgagtctgcaatagtggtgtaaacagaggagatacaccatgattgcagacaacctggcggcagcgcaaaagatg

SEQ ID NO: 99484 - DNA, 103 bp, Artificial Sequence
  Synthetic Polynucleotide
taatacgactcactatagggctgtaataagggctgtggttgagtctgcaaaacagaggagattgcagatgcaaccacagaacctggcggcagcgcaaaagatg

SEQ ID NO: 99485 - DNA, 103 bp, Artificial Sequence
  Synthetic Polynucleotide
taatacgactcactataggggtgatggctgttgaacacccagtgcagctgaacagaggagacagctgatgtgggtgttcaacctggcggcagcgcaaaagatg

SEQ ID NO: 99486 - DNA, 103 bp, Artificial Sequence
  Synthetic Polynucleotide
taatacgactcactataggggctgaggctgctgtaataagggctgtggttaacagaggagaaaccacatgccttattacaacctggcggcagcgcaaaagatg

SEQ ID NO: 99487 - DNA, 103 bp, Artificial Sequence
  Synthetic Polynucleotide
taatacgactcactatagggccagctttttgctgaggctgctgtaataagaacagaggagacttattatggcagcctcaaacctggcggcagcgcaaaagatg

SEQ ID NO: 99488 - DNA, 103 bp, Artificial Sequence
  Synthetic Polynucleotide
taatacgactcactatagggctgcaataaaccagctttttgctgaggctgaacagaggagacagcctatgcaaaaagctaacctggcggcagcgcaaaagatg

SEQ ID NO: 99489 - DNA, 103 bp, Artificial Sequence
  Synthetic Polynucleotide
taatacgactcactataggggaacaggaggctgcaataaaccagctttttaacagaggagaaaaaagatggtttattgcaacctggcggcagcgcaaaagatg

SEQ ID NO: 99490 - DNA, 103 bp, Artificial Sequence
  Synthetic Polynucleotide
taatacgactcactataggggaaactatacgaacaggaggctgcaataaaaacagaggagatttattatggcctcctgtaacctggcggcagcgcaaaagatg

SEQ ID NO: 99491 - DNA, 103 bp, Artificial Sequence
  Synthetic Polynucleotide
taatacgactcactatagggttgtggctgtgaaactatacgaacaggaggaacagaggagacctcctatgcgtatagttaacctggcggcagcgcaaaagatg

SEQ ID NO: 99492 - DNA, 103 bp, Artificial Sequence
  Synthetic Polynucleotide
taatacgactcactataggggtcgtgccggttgtggctgtgaaactatacaacagaggagagtatagatgcacagccacaacctggcggcagcgcaaaagatg

SEQ ID NO: 99493 - DNA, 103 bp, Artificial Sequence
  Synthetic Polynucleotide
taatacgactcactatagggggatctaatcgtcgtgccggttgtggctgtaacagaggagaacagccatgaccggcacgaacctggcggcagcgcaaaagatg

SEQ ID NO: 99494 - DNA, 103 bp, Artificial Sequence
  Synthetic Polynucleotide
taatacgactcactatagggtcgggatgggggatctaatcgtcgtgccggaacagaggagaccggcaatgcgattagataacctggcggcagcgcaaaagatg

SEQ ID NO: 99495 - DNA, 103 bp, Artificial Sequence
  Synthetic Polynucleotide
taatacgactcactatagggttcctgaaaatcgggatgggggatctaatcaacagaggagagattagatgccccatcccaacctggcggcagcgcaaaagatg

SEQ ID NO: 99496 - DNA, 103 bp, Artificial Sequence
  Synthetic Polynucleotide
taatacgactcactataggggctccaaggagtgatggctgttgaacacccaacagaggagagggtgtatgacagccatcaacctggcggcagcgcaaaagatg

SEQ ID NO: 99497 - DNA, 103 bp, Artificial Sequence
  Synthetic Polynucleotide
taatacgactcactatagggctgtcatttcttcctgaaaatcgggatgggaacagaggagacccatcatgattttcaggaacctggcggcagcgcaaaagatg

SEQ ID NO: 99498 - DNA, 103 bp, Artificial Sequence
  Synthetic Polynucleotide
taatacgactcactatagggttgatcccctctgtcatttcttcctgaaaaaacagaggagattttcaatgagaaatgacaacctggcggcagcgcaaaagatg

SEQ ID NO: 99499 - DNA, 103 bp, Artificial Sequence
  Synthetic Polynucleotide
taatacgactcactatagggtgttaggcacttgatcccctctgtcatttcaacagaggagagaaatgatggaggggatcaacctggcggcagcgcaaaagatg

SEQ ID NO: 99500 - DNA, 103 bp, Artificial Sequence
  Synthetic Polynucleotide
taatacgactcactatagggtcatcttttctgttaggcacttgatcccctaacagaggagaaggggaatgagtgcctaaaacctggcggcagcgcaaaagatg

SEQ ID NO: 99501 - DNA, 103 bp, Artificial Sequence
  Synthetic Polynucleotide
taatacgactcactatagggacgacttcgatcatcttttctgttaggcacaacagaggagagtgcctatgagaaaagataacctggcggcagcgcaaaagatg

SEQ ID NO: 99502 - DNA, 103 bp, Artificial Sequence
  Synthetic Polynucleotide
taatacgactcactatagggtctctctctcacgacttcgatcatcttttcaacagaggagagaaaagatgatcgaagtcaacctggcggcagcgcaaaagatg

SEQ ID NO: 99503 - DNA, 103 bp, Artificial Sequence
  Synthetic Polynucleotide
taatacgactcactatagggcgtctttctctctctctctcacgacttcgaaacagaggagatcgaagatgtgagagagaaacctggcggcagcgcaaaagatg

SEQ ID NO: 99504 - DNA, 103 bp, Artificial Sequence
  Synthetic Polynucleotide
taatacgactcactatagggtctcgatctacgtctttctctctctctctcaacagaggagagagagaatgagagaaagaaacctggcggcagcgcaaaagatg

SEQ ID NO: 99505 - DNA, 103 bp, Artificial Sequence
  Synthetic Polynucleotide
taatacgactcactataggggtgatctttctctcgatctacgtctttctcaacagaggagagagaaaatggtagatcgaaacctggcggcagcgcaaaagatg

SEQ ID NO: 99506 - DNA, 103 bp, Artificial Sequence
  Synthetic Polynucleotide
taatacgactcactatagggttcctctgaggtgatctttctctcgatctaaacagaggagatagatcatgagaaagatcaacctggcggcagcgcaaaagatg

SEQ ID NO: 99507 - DNA, 103 bp, Artificial Sequence
  Synthetic Polynucleotide
taatacgactcactatagggtttgttgttgttcttcctctctccctccataacagaggagaatggagatggagaggaagaacctggcggcagcgcaaaagatg

SEQ ID NO: 99508 - DNA, 103 bp, Artificial Sequence
  Synthetic Polynucleotide
taatacgactcactatagggctgctggcgataagaaagttctttatctggaacagaggagaccagatatggaactttctaacctggcggcagcgcaaaagatg

SEQ ID NO: 99509 - DNA, 103 bp, Artificial Sequence
  Synthetic Polynucleotide
taatacgactcactatagggagaaggttgggaggacagccaacgcttgccaacagaggagaggcaagatgtggctgtccaacctggcggcagcgcaaaagatg

SEQ ID NO: 99510 - DNA, 103 bp, Artificial Sequence
  Synthetic Polynucleotide
taatacgactcactatagggctagtttgaaagaaggttgggaggacagccaacagaggagaggctgtatgcccaaccttaacctggcggcagcgcaaaagatg

SEQ ID NO: 99511 - DNA, 103 bp, Artificial Sequence
  Synthetic Polynucleotide
taatacgactcactatagggtgagtaggttctagtttgaaagaaggttggaacagaggagaccaaccatgtttcaaactaacctggcggcagcgcaaaagatg

SEQ ID NO: 99512 - DNA, 103 bp, Artificial Sequence
  Synthetic Polynucleotide
taatacgactcactatagggccgatgaccctgagtaggttctagtttgaaaacagaggagattcaaaatggaacctactaacctggcggcagcgcaaaagatg

SEQ ID NO: 99513 - DNA, 103 bp, Artificial Sequence
  Synthetic Polynucleotide
taatacgactcactatagggtctcactagtccgatgaccctgagtaggttaacagaggagaaacctaatgagggtcatcaacctggcggcagcgcaaaagatg

SEQ ID NO: 99514 - DNA, 103 bp, Artificial Sequence
  Synthetic Polynucleotide
taatacgactcactatagggagtgctaaattctcactagtccgatgacccaacagaggagagggtcaatggactagtgaaacctggcggcagcgcaaaagatg

SEQ ID NO: 99515 - DNA, 103 bp, Artificial Sequence
  Synthetic Polynucleotide
taatacgactcactatagggaactcctgtaagtgctaaattctcactagtaacagaggagaactagtatgaatttagcaaacctggcggcagcgcaaaagatg

SEQ ID NO: 99516 - DNA, 103 bp, Artificial Sequence
  Synthetic Polynucleotide
taatacgactcactatagggaggaatgatcaactcctgtaagtgctaaataacagaggagaatttagatgttacaggagaacctggcggcagcgcaaaagatg

SEQ ID NO: 99517 - DNA, 103 bp, Artificial Sequence
  Synthetic Polynucleotide
taatacgactcactatagggtcctgtggtaaggaatgatcaactcctgtaaacagaggagatacaggatgtgatcattcaacctggcggcagcgcaaaagatg

SEQ ID NO: 99518 - DNA, 103 bp, Artificial Sequence
  Synthetic Polynucleotide
taatacgactcactatagggatttgaaccatcctgtggtaaggaatgatcaacagaggagagatcatatgttaccacagaacctggcggcagcgcaaaagatg

SEQ ID NO: 99519 - DNA, 103 bp, Artificial Sequence
  Synthetic Polynucleotide
taatacgactcactataggggattggccgcctgctggcgataagaaagttaacagaggagaaactttatgatcgccagcaacctggcggcagcgcaaaagatg

SEQ ID NO: 99520 - DNA, 103 bp, Artificial Sequence
  Synthetic Polynucleotide
taatacgactcactatagggaaataaatgcatttgaaccatcctgtggtaaacagaggagataccacatgatggttcaaaacctggcggcagcgcaaaagatg

SEQ ID NO: 99521 - DNA, 103 bp, Artificial Sequence
  Synthetic Polynucleotide
taatacgactcactatagggtgcttctgggaaataaatgcatttgaaccaaacagaggagatggttcatgtgcatttataacctggcggcagcgcaaaagatg

SEQ ID NO: 99522 - DNA, 103 bp, Artificial Sequence
  Synthetic Polynucleotide
taatacgactcactatagggcttactattctgcttctgggaaataaatgcaacagaggagagcatttatgtcccagaagaacctggcggcagcgcaaaagatg

SEQ ID NO: 99523 - DNA, 103 bp, Artificial Sequence
  Synthetic Polynucleotide
taatacgactcactatagggatggcacactcttactattctgcttctgggaacagaggagacccagaatgagaatagtaaacctggcggcagcgcaaaagatg

SEQ ID NO: 99524 - DNA, 103 bp, Artificial Sequence
  Synthetic Polynucleotide
taatacgactcactatagggactttagctgatggcacactcttactattcaacagaggagagaatagatggagtgtgccaacctggcggcagcgcaaaagatg

SEQ ID NO: 99525 - DNA, 103 bp, Artificial Sequence
  Synthetic Polynucleotide
taatacgactcactatagggtttcagtgacactttagctgatggcacactaacagaggagaagtgtgatgtcagctaaaaacctggcggcagcgcaaaagatg

SEQ ID NO: 99526 - DNA, 103 bp, Artificial Sequence
  Synthetic Polynucleotide
taatacgactcactatagggcgcggtattctttcagtgacactttagctgaacagaggagacagctaatgtgtcactgaaacctggcggcagcgcaaaagatg

SEQ ID NO: 99527 - DNA, 103 bp, Artificial Sequence
  Synthetic Polynucleotide
taatacgactcactataggggcatgcttcgcgcggtattctttcagtgacaacagaggagagtcactatgagaataccgaacctggcggcagcgcaaaagatg

SEQ ID NO: 99528 - DNA, 103 bp, Artificial Sequence
  Synthetic Polynucleotide
taatacgactcactatagggcaattcttctgcatgcttcgcgcggtattcaacagaggagagaatacatggcgaagcataacctggcggcagcgcaaaagatg

SEQ ID NO: 99529 - DNA, 103 bp, Artificial Sequence
  Synthetic Polynucleotide
taatacgactcactatagggtctgggcagccaattcttctgcatgcttcgaacagaggagacgaagcatgcagaagaataacctggcggcagcgcaaaagatg

SEQ ID NO: 99530 - DNA, 103 bp, Artificial Sequence
  Synthetic Polynucleotide
taatacgactcactatagggtcctgaagcagattggccgcctgctggcgaaacagaggagatcgccaatgggcggccaaaacctggcggcagcgcaaaagatg

SEQ ID NO: 99531 - DNA, 103 bp, Artificial Sequence
  Synthetic Polynucleotide
taatacgactcactatagggagttgcctcttctgggcagccaattcttctaacagaggagaagaagaatgggctgcccaaacctggcggcagcgcaaaagatg

SEQ ID NO: 99532 - DNA, 103 bp, Artificial Sequence
  Synthetic Polynucleotide
taatacgactcactatagggcatgttctccagttgcctcttctgggcagcaacagaggagagctgccatgaagaggcaaaacctggcggcagcgcaaaagatg

SEQ ID NO: 99533 - DNA, 103 bp, Artificial Sequence
  Synthetic Polynucleotide
taatacgactcactatagggcattggcttccatgttctccagttgcctctaacagaggagaagaggcatgtggagaacaaacctggcggcagcgcaaaagatg

SEQ ID NO: 99534 - DNA, 103 bp, Artificial Sequence
  Synthetic Polynucleotide
taatacgactcactatagggtgtgacttcacattggcttccatgttctccaacagaggagaggagaaatgggaagccaaaacctggcggcagcgcaaaagatg

SEQ ID NO: 99535 - DNA, 103 bp, Artificial Sequence
  Synthetic Polynucleotide
taatacgactcactatagggatatgcatattgtgacttcacattggcttcaacagaggagagaagccatggtgaagtcaaacctggcggcagcgcaaaagatg

SEQ ID NO: 99536 - DNA, 103 bp, Artificial Sequence
  Synthetic Polynucleotide
taatacgactcactatagggtctgggcagcatatgcatattgtgacttcaaacagaggagatgaagtatgaatatgcataacctggcggcagcgcaaaagatg

SEQ ID NO: 99537 - DNA, 103 bp, Artificial Sequence
  Synthetic Polynucleotide
taatacgactcactataggggaaaggagattctgggcagcatatgcatataacagaggagaatatgcatgtgctgcccaaacctggcggcagcgcaaaagatg

SEQ ID NO: 99538 - DNA, 103 bp, Artificial Sequence
  Synthetic Polynucleotide
taatacgactcactatagggatcatgatgagaaaggagattctgggcagcaacagaggagagctgccatgaatctccttaacctggcggcagcgcaaaagatg

SEQ ID NO: 99539 - DNA, 103 bp, Artificial Sequence
  Synthetic Polynucleotide
taatacgactcactatagggaagaatggctatcatgatgagaaaggagataacagaggagaatctccatgctcatcatgaacctggcggcagcgcaaaagatg

SEQ ID NO: 99540 - DNA, 103 bp, Artificial Sequence
  Synthetic Polynucleotide
taatacgactcactatagggagaatgactgaagaatggctatcatgatgaaacagaggagatcatcaatgtagccattcaacctggcggcagcgcaaaagatg

SEQ ID NO: 99541 - DNA, 103 bp, Artificial Sequence
  Synthetic Polynucleotide
taatacgactcactatagggctgccccatgtcctgaagcagattggccgcaacagaggagagcggccatgctgcttcagaacctggcggcagcgcaaaagatg

SEQ ID NO: 99542 - DNA, 103 bp, Artificial Sequence
  Synthetic Polynucleotide
taatacgactcactataggggggcatttttagaatgactgaagaatggctaacagaggagaagccatatgtcagtcattaacctggcggcagcgcaaaagatg

SEQ ID NO: 99543 - DNA, 103 bp, Artificial Sequence
  Synthetic Polynucleotide
taatacgactcactatagggaaccctctatgggcatttttagaatgactgaacagaggagacagtcaatgtaaaaatgcaacctggcggcagcgcaaaagatg

SEQ ID NO: 99544 - DNA, 103 bp, Artificial Sequence
  Synthetic Polynucleotide
taatacgactcactataggggggttttctgaaccctctatgggcatttttaacagaggagaaaaaatatgcatagagggaacctggcggcagcgcaaaagatg

SEQ ID NO: 99545 - DNA, 103 bp, Artificial Sequence
  Synthetic Polynucleotide
taatacgactcactatagggaggccgctcggggttttctgaaccctctataacagaggagaatagagatgtcagaaaacaacctggcggcagcgcaaaagatg

SEQ ID NO: 99546 - DNA, 103 bp, Artificial Sequence
  Synthetic Polynucleotide
taatacgactcactatagggtttccagaaaaggccgctcggggttttctgaacagaggagacagaaaatgccgagcggcaacctggcggcagcgcaaaagatg

SEQ ID NO: 99547 - DNA, 103 bp, Artificial Sequence
  Synthetic Polynucleotide
taatacgactcactatagggttgtcagccttttccagaaaaggccgctcgaacagaggagacgagcgatgttttctggaaacctggcggcagcgcaaaagatg

SEQ ID NO: 99548 - DNA, 103 bp, Artificial Sequence
  Synthetic Polynucleotide
taatacgactcactataggggagagctgttttgtcagccttttccagaaaaacagaggagatttctgatgaaggctgacaacctggcggcagcgcaaaagatg

SEQ ID NO: 99549 - DNA, 103 bp, Artificial Sequence
  Synthetic Polynucleotide
taatacgactcactatagggttctcattttgagagctgttttgtcagcctaacagaggagaaggctgatgaaacagctcaacctggcggcagcgcaaaagatg

SEQ ID NO: 99550 - DNA, 103 bp, Artificial Sequence
  Synthetic Polynucleotide
taatacgactcactataggggccactgggattctcattttgagagctgttaacagaggagaaacagcatgcaaaatgagaacctggcggcagcgcaaaagatg

SEQ ID NO: 99551 - DNA, 103 bp, Artificial Sequence
  Synthetic Polynucleotide
taatacgactcactatagggatctccacctgccactgggattctcattttaacagaggagaaaaatgatgatcccagtgaacctggcggcagcgcaaaagatg

SEQ ID NO: 99552 - DNA, 103 bp, Artificial Sequence
  Synthetic Polynucleotide
taatacgactcactatagggcgttaagacgctgccccatgtcctgaagcaaacagaggagatgcttcatgacatggggcaacctggcggcagcgcaaaagatg

SEQ ID NO: 99553 - DNA, 103 bp, Artificial Sequence
  Synthetic Polynucleotide
taatacgactcactatagggacgcagctttatctccacctgccactgggaaacagaggagatcccagatgcaggtggagaacctggcggcagcgcaaaagatg

SEQ ID NO: 99554 - DNA, 103 bp, Artificial Sequence
  Synthetic Polynucleotide
taatacgactcactatagggggttttgaagacgcagctttatctccacctaacagaggagaaggtggatgtaaagctgcaacctggcggcagcgcaaaagatg

SEQ ID NO: 99555 - DNA, 103 bp, Artificial Sequence
  Synthetic Polynucleotide
taatacgactcactatagggtatctcctctggttttgaagacgcagctttaacagaggagaaaagctatgtcttcaaaaaacctggcggcagcgcaaaagatg

SEQ ID NO: 99556 - DNA, 103 bp, Artificial Sequence
  Synthetic Polynucleotide
taatacgactcactatagggtgcgcatttttatctcctctggttttgaagaacagaggagacttcaaatgcagaggagaaacctggcggcagcgcaaaagatg

SEQ ID NO: 99557 - DNA, 103 bp, Artificial Sequence
  Synthetic Polynucleotide
taatacgactcactatagggtggacttttatgcgcatttttatctcctctaacagaggagaagaggaatgaaaaatgcgaacctggcggcagcgcaaaagatg

SEQ ID NO: 99558 - DNA, 103 bp, Artificial Sequence
  Synthetic Polynucleotide
taatacgactcactatagggagctgcagcatggacttttatgcgcattttaacagaggagaaaaatgatgataaaagtcaacctggcggcagcgcaaaagatg

SEQ ID NO: 99559 - DNA, 103 bp, Artificial Sequence
  Synthetic Polynucleotide
taatacgactcactatagggtgtgcttatcagctgcagcatggacttttaaacagaggagataaaagatgatgctgcagaacctggcggcagcgcaaaagatg

SEQ ID NO: 99560 - DNA, 103 bp, Artificial Sequence
  Synthetic Polynucleotide
taatacgactcactatagggtctacagaattgtgcttatcagctgcagcaaacagaggagatgctgcatgtgataagcaaacctggcggcagcgcaaaagatg

SEQ ID NO: 99561 - DNA, 103 bp, Artificial Sequence
  Synthetic Polynucleotide
taatacgactcactatagggaacactgtcctctacagaattgtgcttatcaacagaggagagataagatgaattctgtaaacctggcggcagcgcaaaagatg

SEQ ID NO: 99562 - DNA, 103 bp, Artificial Sequence
  Synthetic Polynucleotide
taatacgactcactatagggggctctttgtaacactgtcctctacagaataacagaggagaattctgatgaggacagtgaacctggcggcagcgcaaaagatg

SEQ ID NO: 99563 - DNA, 103 bp, Artificial Sequence
  Synthetic Polynucleotide
taatacgactcactatagggaattgtgagacgttaagacgctgccccatgaacagaggagacatgggatggcgtcttaaaacctggcggcagcgcaaaagatg

SEQ ID NO: 99564 - DNA, 103 bp, Artificial Sequence
  Synthetic Polynucleotide
taatacgactcactatagggttgtgctctcggctctttgtaacactgtccaacagaggagaggacagatgtacaaagagaacctggcggcagcgcaaaagatg

SEQ ID NO: 99565 - DNA, 103 bp, Artificial Sequence
  Synthetic Polynucleotide
taatacgactcactataggggtgcttttctttgtgctctcggctctttgtaacagaggagaacaaagatgcgagagcacaacctggcggcagcgcaaaagatg

SEQ ID NO: 99566 - DNA, 103 bp, Artificial Sequence
  Synthetic Polynucleotide
taatacgactcactatagggggtgagtcttgtgcttttctttgtgctctcaacagaggagagagagcatgaagaaaagcaacctggcggcagcgcaaaagatg

SEQ ID NO: 99567 - DNA, 103 bp, Artificial Sequence
  Synthetic Polynucleotide
taatacgactcactatagggtgattagatgggtgagtcttgtgcttttctaacagaggagaagaaaaatgcaagactcaaacctggcggcagcgcaaaagatg

SEQ ID NO: 99568 - DNA, 103 bp, Artificial Sequence
  Synthetic Polynucleotide
taatacgactcactatagggatgatgatgatgattagatgggtgagtcttaacagaggagaaagactatgccatctaataacctggcggcagcgcaaaagatg

SEQ ID NO: 99569 - DNA, 103 bp, Artificial Sequence
  Synthetic Polynucleotide
taatacgactcactatagggggtgattatgatgatgatgatgattagatgaacagaggagacatctaatgatcatcatcaacctggcggcagcgcaaaagatg

SEQ ID NO: 99570 - DNA, 103 bp, Artificial Sequence
  Synthetic Polynucleotide
taatacgactcactatagggttgtgtgagtggtgattatgatgatgatgaaacagaggagatcatcaatgtcataatcaaacctggcggcagcgcaaaagatg

SEQ ID NO: 99571 - DNA, 103 bp, Artificial Sequence
  Synthetic Polynucleotide
taatacgactcactatagggatgagagtgcttgtgtgagtggtgattatgaacagaggagacataatatgcactcacacaacctggcggcagcgcaaaagatg

SEQ ID NO: 99572 - DNA, 103 bp, Artificial Sequence
  Synthetic Polynucleotide
taatacgactcactataggggaagttgggaatgagagtgcttgtgtgagtaacagaggagaactcacatgagcactctcaacctggcggcagcgcaaaagatg

SEQ ID NO: 99573 - DNA, 103 bp, Artificial Sequence
  Synthetic Polynucleotide
taatacgactcactataggggtaccaactggaagttgggaatgagagtgcaacagaggagagcactcatgttcccaactaacctggcggcagcgcaaaagatg

SEQ ID NO: 99574 - DNA, 103 bp, Artificial Sequence
  Synthetic Polynucleotide
taatacgactcactataggggttgatagtcaattgtgagacgttaagacgaacagaggagacgtcttatggtctcacaaaacctggcggcagcgcaaaagatg

SEQ ID NO: 99575 - DNA, 103 bp, Artificial Sequence
  Synthetic Polynucleotide
taatacgactcactatagggtttgttcccagtaccaactggaagttgggaaacagaggagatcccaaatgccagttggtaacctggcggcagcgcaaaagatg

SEQ ID NO: 99576 - DNA, 103 bp, Artificial Sequence
  Synthetic Polynucleotide
taatacgactcactatagggcaccaggacgtttgttcccagtaccaactgaacagaggagacagttgatgctgggaacaaacctggcggcagcgcaaaagatg

SEQ ID NO: 99577 - DNA, 103 bp, Artificial Sequence
  Synthetic Polynucleotide
taatacgactcactatagggtgttttggatcaccaggacgtttgttcccaaacagaggagatgggaaatgacgtcctggaacctggcggcagcgcaaaagatg

SEQ ID NO: 99578 - DNA, 103 bp, Artificial Sequence
  Synthetic Polynucleotide
taatacgactcactatagggctggctactatgttttggatcaccaggacgaacagaggagacgtcctatggatccaaaaaacctggcggcagcgcaaaagatg

SEQ ID NO: 99579 - DNA, 103 bp, Artificial Sequence
  Synthetic Polynucleotide
taatacgactcactatagggagttgcttgtctggctactatgttttggataacagaggagaatccaaatgatagtagccaacctggcggcagcgcaaaagatg

SEQ ID NO: 99580 - DNA, 103 bp, Artificial Sequence
  Synthetic Polynucleotide
taatacgactcactatagggttatgtgctaagttgcttgtctggctactaaacagaggagatagtagatggacaagcaaaacctggcggcagcgcaaaagatg

SEQ ID NO: 99581 - DNA, 103 bp, Artificial Sequence
  Synthetic Polynucleotide
taatacgactcactataggggctataggttttatgtgctaagttgcttgtaacagaggagaacaagcatgttagcacataacctggcggcagcgcaaaagatg

SEQ ID NO: 99582 - DNA, 103 bp, Artificial Sequence
  Synthetic Polynucleotide
taatacgactcactatagggaactagacaagctataggttttatgtgctaaacagaggagatagcacatgaaacctataaacctggcggcagcgcaaaagatg

SEQ ID NO: 99583 - DNA, 103 bp, Artificial Sequence
  Synthetic Polynucleotide
taatacgactcactataggggaggaaaaagaactagacaagctataggttaacagaggagaaacctaatgcttgtctagaacctggcggcagcgcaaaagatg

SEQ ID NO: 99584 - DNA, 103 bp, Artificial Sequence
  Synthetic Polynucleotide
taatacgactcactatagggagaactggaagaggaaaaagaactagacaaaacagaggagattgtctatgtctttttccaacctggcggcagcgcaaaagatg

SEQ ID NO: 99585 - DNA, 103 bp, Artificial Sequence
  Synthetic Polynucleotide
taatacgactcactatagggctatagcagtgttgatagtcaattgtgagaaacagaggagatctcacatgtgactatcaaacctggcggcagcgcaaaagatg

SEQ ID NO: 99586 - DNA, 103 bp, Artificial Sequence
  Synthetic Polynucleotide
taatacgactcactatagggttttacgagtagaactggaagaggaaaaagaacagaggagactttttatgcttccagttaacctggcggcagcgcaaaagatg

SEQ ID NO: 99587 - DNA, 103 bp, Artificial Sequence
  Synthetic Polynucleotide
taatacgactcactataggggagggtccccttttacgagtagaactggaaaacagaggagattccagatgtactcgtaaaacctggcggcagcgcaaaagatg

SEQ ID NO: 99588 - DNA, 103 bp, Artificial Sequence
  Synthetic Polynucleotide
taatacgactcactatagggagtctcttcagagggtccccttttacgagtaacagaggagaactcgtatgaggggacccaacctggcggcagcgcaaaagatg

SEQ ID NO: 99589 - DNA, 103 bp, Artificial Sequence
  Synthetic Polynucleotide
taatacgactcactatagggcagcccctccagtctcttcagagggtccccaacagaggagaggggacatgctgaagagaaacctggcggcagcgcaaaagatg

SEQ ID NO: 99590 - DNA, 103 bp, Artificial Sequence
  Synthetic Polynucleotide
taatacgactcactatagggtgatcaaacacagcccctccagtctcttcaaacagaggagatgaagaatgtggaggggcaacctggcggcagcgcaaaagatg

SEQ ID NO: 99591 - DNA, 103 bp, Artificial Sequence
  Synthetic Polynucleotide
taatacgactcactatagggcttggctggatgatcaaacacagcccctccaacagaggagaggagggatggtgtttgataacctggcggcagcgcaaaagatg

SEQ ID NO: 99592 - DNA, 103 bp, Artificial Sequence
  Synthetic Polynucleotide
taatacgactcactatagggtcttggcaatcttggctggatgatcaaacaaacagaggagatgtttgatgatccagccaaacctggcggcagcgcaaaagatg

SEQ ID NO: 99593 - DNA, 103 bp, Artificial Sequence
  Synthetic Polynucleotide
taatacgactcactataggggatttagtactcttggcaatcttggctggaaacagaggagatccagcatggattgccaaaacctggcggcagcgcaaaagatg

SEQ ID NO: 99594 - DNA, 103 bp, Artificial Sequence
  Synthetic Polynucleotide
taatacgactcactatagggtagggaagaggatttagtactcttggcaataacagaggagaattgccatgagtactaaaaacctggcggcagcgcaaaagatg

SEQ ID NO: 99595 - DNA, 103 bp, Artificial Sequence
  Synthetic Polynucleotide
taatacgactcactatagggaggagaaatttagggaagaggatttagtacaacagaggagagtactaatgcctcttcccaacctggcggcagcgcaaaagatg

SEQ ID NO: 99596 - DNA, 103 bp, Artificial Sequence
  Synthetic Polynucleotide
taatacgactcactatagggtgcatgtatactatagcagtgttgatagtcaacagaggagagactatatgcactgctataacctggcggcagcgcaaaagatg

SEQ ID NO: 99597 - DNA, 103 bp, Artificial Sequence
  Synthetic Polynucleotide
taatacgactcactatagggagtgaagggaaggagaaatttagggaagagaacagaggagactcttcatgaaatttctcaacctggcggcagcgcaaaagatg

SEQ ID NO: 99598 - DNA, 103 bp, Artificial Sequence
  Synthetic Polynucleotide
taatacgactcactatagggcattgtaggaagtgaagggaaggagaaattaacagaggagaaatttcatgttcccttcaaacctggcggcagcgcaaaagatg

SEQ ID NO: 99599 - DNA, 103 bp, Artificial Sequence
  Synthetic Polynucleotide
taatacgactcactataggggcatctgacccattgtaggaagtgaagggaaacagaggagatcccttatgttcctacaaaacctggcggcagcgcaaaagatg

SEQ ID NO: 99600 - DNA, 103 bp, Artificial Sequence
  Synthetic Polynucleotide
taatacgactcactatagggctatgcccaggcatctgacccattgtaggaaacagaggagatcctacatggggtcagataacctggcggcagcgcaaaagatg

SEQ ID NO: 99601 - DNA, 103 bp, Artificial Sequence
  Synthetic Polynucleotide
taatacgactcactatagggtgtgtctgagctatgcccaggcatctgaccaacagaggagaggtcagatgcctgggcataacctggcggcagcgcaaaagatg

SEQ ID NO: 99602 - DNA, 103 bp, Artificial Sequence
  Synthetic Polynucleotide
taatacgactcactatagggaaaggccacttgtgtctgagctatgcccagaacagaggagactgggcatggctcagacaaacctggcggcagcgcaaaagatg

SEQ ID NO: 99603 - DNA, 103 bp, Artificial Sequence
  Synthetic Polynucleotide
taatacgactcactatagggtgtgaaaaggaaaggccacttgtgtctgagaacagaggagactcagaatgaagtggcctaacctggcggcagcgcaaaagatg

SEQ ID NO: 99604 - DNA, 103 bp, Artificial Sequence
  Synthetic Polynucleotide
taatacgactcactatagggacagctgggctgtgaaaaggaaaggccactaacagaggagaagtggcatgtccttttcaaacctggcggcagcgcaaaagatg

SEQ ID NO: 99605 - DNA, 103 bp, Artificial Sequence
  Synthetic Polynucleotide
taatacgactcactatagggcacgagttttacagctgggctgtgaaaaggaacagaggagaccttttatgagcccagctaacctggcggcagcgcaaaagatg

SEQ ID NO: 99606 - DNA, 103 bp, Artificial Sequence
  Synthetic Polynucleotide
taatacgactcactataggggaatgagggacacgagttttacagctgggcaacagaggagagcccagatgtaaaactcgaacctggcggcagcgcaaaagatg

SEQ ID NO: 99607 - DNA, 103 bp, Artificial Sequence
  Synthetic Polynucleotide
taatacgactcactataggggtagaatcgatgcatgtatactatagcagtaacagaggagaactgctatggtatacatgaacctggcggcagcgcaaaagatg

SEQ ID NO: 99608 - DNA, 103 bp, Artificial Sequence
  Synthetic Polynucleotide
taatacgactcactatagggatccagtttcgaatgagggacacgagttttaacagaggagaaaaactatggtccctcataacctggcggcagcgcaaaagatg

SEQ ID NO: 99609 - DNA, 103 bp, Artificial Sequence
  Synthetic Polynucleotide
taatacgactcactatagggtgggccctttatccagtttcgaatgagggaaacagaggagatccctcatgcgaaactggaacctggcggcagcgcaaaagatg

SEQ ID NO: 99610 - DNA, 103 bp, Artificial Sequence
  Synthetic Polynucleotide
taatacgactcactatagggttggccccagtgggccctttatccagtttcaacagaggagagaaactatgtaaagggccaacctggcggcagcgcaaaagatg

SEQ ID NO: 99611 - DNA, 103 bp, Artificial Sequence
  Synthetic Polynucleotide
taatacgactcactataggggttgtgaccattggccccagtgggccctttaacagaggagaaaagggatgactggggccaacctggcggcagcgcaaaagatg

SEQ ID NO: 99612 - DNA, 103 bp, Artificial Sequence
  Synthetic Polynucleotide
taatacgactcactatagggtctgggtcgtgttgtgaccattggccccagaacagaggagactggggatgatggtcacaaacctggcggcagcgcaaaagatg

SEQ ID NO: 99613 - DNA, 103 bp, Artificial Sequence
  Synthetic Polynucleotide
taatacgactcactatagggtagtctattgtctgggtcgtgttgtgaccaaacagaggagatggtcaatgcacgacccaaacctggcggcagcgcaaaagatg

SEQ ID NO: 99614 - DNA, 103 bp, Artificial Sequence
  Synthetic Polynucleotide
taatacgactcactatagggagtgtcttgatagtctattgtctgggtcgtaacagaggagaacgaccatgacaatagacaacctggcggcagcgcaaaagatg

SEQ ID NO: 99615 - DNA, 103 bp, Artificial Sequence
  Synthetic Polynucleotide
taatacgactcactataggggcatattcacagtgtcttgatagtctattgaacagaggagacaatagatgatcaagacaaacctggcggcagcgcaaaagatg

SEQ ID NO: 99616 - DNA, 103 bp, Artificial Sequence
  Synthetic Polynucleotide
taatacgactcactatagggagggagtgaagcatattcacagtgtcttgaaacagaggagatcaagaatgtgtgaatataacctggcggcagcgcaaaagatg

SEQ ID NO: 99617 - DNA, 103 bp, Artificial Sequence
  Synthetic Polynucleotide
taatacgactcactatagggggcactgagcagggagtgaagcatattcacaacagaggagagtgaatatgcttcactccaacctggcggcagcgcaaaagatg

SEQ ID NO: 99618 - DNA, 103 bp, Artificial Sequence
  Synthetic Polynucleotide
taatacgactcactatagggaataccaccgtttgttgttgttcttcctctaacagaggagaagaggaatgacaacaacaaacctggcggcagcgcaaaagatg

SEQ ID NO: 99619 - DNA, 103 bp, Artificial Sequence
  Synthetic Polynucleotide
taatacgactcactatagggactgaatcatgtagaatcgatgcatgtataaacagaggagatatacaatgatcgattctaacctggcggcagcgcaaaagatg

SEQ ID NO: 99620 - DNA, 103 bp, Artificial Sequence
  Synthetic Polynucleotide
taatacgactcactataggggaacaccctgggcactgagcagggagtgaaaacagaggagattcactatgtgctcagtgaacctggcggcagcgcaaaagatg

SEQ ID NO: 99621 - DNA, 103 bp, Artificial Sequence
  Synthetic Polynucleotide
taatacgactcactatagggtgagtgggctgaacaccctgggcactgagcaacagaggagagctcagatgccagggtgtaacctggcggcagcgcaaaagatg

SEQ ID NO: 99622 - DNA, 103 bp, Artificial Sequence
  Synthetic Polynucleotide
taatacgactcactatagggtgcagtgggctgagtgggctgaacaccctgaacagaggagacagggtatgcagcccactaacctggcggcagcgcaaaagatg

SEQ ID NO: 99623 - DNA, 103 bp, Artificial Sequence
  Synthetic Polynucleotide
taatacgactcactatagggcaaattcaaatgcagtgggctgagtgggctaacagaggagaagcccaatgagcccactgaacctggcggcagcgcaaaagatg

SEQ ID NO: 99624 - DNA, 103 bp, Artificial Sequence
  Synthetic Polynucleotide
taatacgactcactatagggtaaggacgaacaaattcaaatgcagtgggcaacagaggagagcccacatgatttgaattaacctggcggcagcgcaaaagatg

SEQ ID NO: 99625 - DNA, 103 bp, Artificial Sequence
  Synthetic Polynucleotide
taatacgactcactatagggatagtcactataaggacgaacaaattcaaaaacagaggagatttgaaatggttcgtcctaacctggcggcagcgcaaaagatg

SEQ ID NO: 99626 - DNA, 103 bp, Artificial Sequence
  Synthetic Polynucleotide
taatacgactcactataggggaggattcagatagtcactataaggacgaaaacagaggagattcgtcatgatagtgactaacctggcggcagcgcaaaagatg

SEQ ID NO: 99627 - DNA, 103 bp, Artificial Sequence
  Synthetic Polynucleotide
taatacgactcactatagggccaccagaccgaggattcagatagtcactaaacagaggagatagtgaatgtctgaatccaacctggcggcagcgcaaaagatg

SEQ ID NO: 99628 - DNA, 103 bp, Artificial Sequence
  Synthetic Polynucleotide
taatacgactcactatagggcgaggagattccaccagaccgaggattcagaacagaggagactgaatatgcggtctggtaacctggcggcagcgcaaaagatg

SEQ ID NO: 99629 - DNA, 103 bp, Artificial Sequence
  Synthetic Polynucleotide
taatacgactcactatagggtgccagatctcgaggagattccaccagaccaacagaggagaggtctgatggaatctcctaacctggcggcagcgcaaaagatg

SEQ ID NO: 99630 - DNA, 103 bp, Artificial Sequence
  Synthetic Polynucleotide
taatacgactcactatagggtgtgtgaaggactgaatcatgtagaatcgaaacagaggagatcgattatgcatgattcaaacctggcggcagcgcaaaagatg

SEQ ID NO: 99631 - DNA, 103 bp, Artificial Sequence
  Synthetic Polynucleotide
taatacgactcactatagggttgtctgtattgccagatctcgaggagattaacagaggagaaatctcatggagatctggaacctggcggcagcgcaaaagatg

SEQ ID NO: 99632 - DNA, 103 bp, Artificial Sequence
  Synthetic Polynucleotide
taatacgactcactatagggtggccggggtttgtctgtattgccagatctaacagaggagaagatctatgaatacagacaacctggcggcagcgcaaaagatg

SEQ ID NO: 99633 - DNA, 103 bp, Artificial Sequence
  Synthetic Polynucleotide
taatacgactcactataggggcagaggtggtggccggggtttgtctgtataacagaggagaatacagatgaaccccggcaacctggcggcagcgcaaaagatg

SEQ ID NO: 99634 - DNA, 103 bp, Artificial Sequence
  Synthetic Polynucleotide
taatacgactcactatagggggttctgatggcagaggtggtggccggggtaacagaggagaaccccgatgaccacctctaacctggcggcagcgcaaaagatg

SEQ ID NO: 99635 - DNA, 103 bp, Artificial Sequence
  Synthetic Polynucleotide
taatacgactcactatagggtggtggaggaggttctgatggcagaggtggaacagaggagaccacctatgccatcagaaaacctggcggcagcgcaaaagatg

SEQ ID NO: 99636 - DNA, 103 bp, Artificial Sequence
  Synthetic Polynucleotide
taatacgactcactatagggggggtggaagtggtggaggaggttctgatgaacagaggagacatcagatgctcctccacaacctggcggcagcgcaaaagatg

SEQ ID NO: 99637 - DNA, 103 bp, Artificial Sequence
  Synthetic Polynucleotide
taatacgactcactatagggtacttaggaaggggtggaagtggtggaggaaacagaggagatcctccatgacttccaccaacctggcggcagcgcaaaagatg

SEQ ID NO: 99638 - DNA, 103 bp, Artificial Sequence
  Synthetic Polynucleotide
taatacgactcactatagggtccagggaactgtgtgaaggactgaatcataacagaggagaatgattatgtccttcacaaacctggcggcagcgcaaaagatg

SEQ ID NO: 99639 - DNA, 103 bp, Artificial Sequence
  Synthetic Polynucleotide
taatacgactcactatagggccacagaatttccagggaactgtgtgaaggaacagaggagaccttcaatgagttccctgaacctggcggcagcgcaaaagatg

SEQ ID NO: 99640 - DNA, 103 bp, Artificial Sequence
  Synthetic Polynucleotide
taatacgactcactataggggctgctggagccacagaatttccagggaacaacagaggagagttcccatgaaattctgtaacctggcggcagcgcaaaagatg

SEQ ID NO: 99641 - DNA, 103 bp, Artificial Sequence
  Synthetic Polynucleotide
taatacgactcactatagggtagaaacaaggctgctggagccacagaattaacagaggagaaattctatggctccagcaaacctggcggcagcgcaaaagatg

SEQ ID NO: 99642 - DNA, 103 bp, Artificial Sequence
  Synthetic Polynucleotide
taatacgactcactatagggctttagctgctagaaacaaggctgctggagaacagaggagactccagatgccttgtttcaacctggcggcagcgcaaaagatg

SEQ ID NO: 99643 - DNA, 103 bp, Artificial Sequence
  Synthetic Polynucleotide
taatacgactcactatagggtgctcctccactttagctgctagaaacaagaacagaggagacttgttatgagcagctaaaacctggcggcagcgcaaaagatg

SEQ ID NO: 99644 - DNA, 103 bp, Artificial Sequence
  Synthetic Polynucleotide
taatacgactcactatagggttttttgggctgctcctccactttagctgcaacagaggagagcagctatggtggaggagaacctggcggcagcgcaaaagatg

SEQ ID NO: 99645 - DNA, 103 bp, Artificial Sequence
  Synthetic Polynucleotide
taatacgactcactatagggcatgttccaattttttgggctgctcctccaaacagaggagatggaggatgagcccaaaaaacctggcggcagcgcaaaagatg

SEQ ID NO: 99646 - DNA, 103 bp, Artificial Sequence
  Synthetic Polynucleotide
taatacgactcactatagggtctcgagtgaaataccaccgtttgttgttgaacagaggagacaacaaatgacggtggtaaacctggcggcagcgcaaaagatg

SEQ ID NO: 99647 - DNA, 103 bp, Artificial Sequence
  Synthetic Polynucleotide
taatacgactcactatagggaccttgatgacatgttccaattttttgggcaacagaggagagcccaaatgattggaacaaacctggcggcagcgcaaaagatg

SEQ ID NO: 99648 - DNA, 103 bp, Artificial Sequence
  Synthetic Polynucleotide
taatacgactcactatagggagtatgtgctaccttgatgacatgttccaaaacagaggagattggaaatggtcatcaagaacctggcggcagcgcaaaagatg

SEQ ID NO: 99649 - DNA, 103 bp, Artificial Sequence
  Synthetic Polynucleotide
taatacgactcactataggggatggagacaagtatgtgctaccttgatgaaacagaggagatcatcaatgtagcacataaacctggcggcagcgcaaaagatg

SEQ ID NO: 99650 - DNA, 103 bp, Artificial Sequence
  Synthetic Polynucleotide
taatacgactcactataggggattcctgaggatggagacaagtatgtgctaacagaggagaagcacaatgttgtctccaaacctggcggcagcgcaaaagatg

SEQ ID NO: 99651 - DNA, 103 bp, Artificial Sequence
  Synthetic Polynucleotide
taatacgactcactatagggatcaggaagggattcctgaggatggagacaaacagaggagatgtctcatgcctcaggaaaacctggcggcagcgcaaaagatg

SEQ ID NO: 99652 - DNA, 103 bp, Artificial Sequence
  Synthetic Polynucleotide
taatacgactcactatagggcacttctagtatcaggaagggattcctgagaacagaggagactcaggatgcccttcctgaacctggcggcagcgcaaaagatg

SEQ ID NO: 99653 - DNA, 103 bp, Artificial Sequence
  Synthetic Polynucleotide
taatacgactcactatagggaaataagcctcacttctagtatcaggaaggaacagaggagaccttccatgtactagaagaacctggcggcagcgcaaaagatg

SEQ ID NO: 99654 - DNA, 103 bp, Artificial Sequence
  Synthetic Polynucleotide
taatacgactcactatagggaacttgttgcaaataagcctcacttctagtaacagaggagaactagaatggaggcttataacctggcggcagcgcaaaagatg

SEQ ID NO: 99655 - DNA, 103 bp, Artificial Sequence
  Synthetic Polynucleotide
taatacgactcactatagggccagatcttgaacttgttgcaaataagcctaacagaggagaaggcttatgtgcaacaagaacctggcggcagcgcaaaagatg

SEQ ID NO: 99656 - DNA, 103 bp, Artificial Sequence
  Synthetic Polynucleotide
taatacgactcactatagggtctaaaatgaccagatcttgaacttgttgcaacagaggagagcaacaatgtcaagatctaacctggcggcagcgcaaaagatg

SEQ ID NO: 99657 - DNA, 103 bp, Artificial Sequence
  Synthetic Polynucleotide
taatacgactcactatagggttccagctgttctcgagtgaaataccaccgaacagaggagacggtggatgttcactcgaaacctggcggcagcgcaaaagatg

SEQ ID NO: 99658 - DNA, 103 bp, Artificial Sequence
  Synthetic Polynucleotide
taatacgactcactatagggaattatgctttctaaaatgaccagatcttgaacagaggagacaagatatggtcattttaaacctggcggcagcgcaaaagatg

SEQ ID NO: 99659 - DNA, 103 bp, Artificial Sequence
  Synthetic Polynucleotide
taatacgactcactatagggaagtctgcaaaattatgctttctaaaatgaaacagaggagatcatttatgaaagcataaaacctggcggcagcgcaaaagatg

SEQ ID NO: 99660 - DNA, 103 bp, Artificial Sequence
  Synthetic Polynucleotide
taatacgactcactatagggtcaaagcctaaagtctgcaaaattatgcttaacagaggagaaagcatatgtttgcagacaacctggcggcagcgcaaaagatg

SEQ ID NO: 99661 - DNA, 103 bp, Artificial Sequence
  Synthetic Polynucleotide
taatacgactcactatagggaattgttagttcaaagcctaaagtctgcaaaacagaggagattgcagatgttaggctttaacctggcggcagcgcaaaagatg

SEQ ID NO: 99662 - DNA, 103 bp, Artificial Sequence
  Synthetic Polynucleotide
taatacgactcactataggggtgggtgatcaattgttagttcaaagcctaaacagaggagataggctatgaactaacaaaacctggcggcagcgcaaaagatg

SEQ ID NO: 99663 - DNA, 103 bp, Artificial Sequence
  Synthetic Polynucleotide
taatacgactcactatagggacatgagtatgtgggtgatcaattgttagtaacagaggagaactaacatgtgatcacccaacctggcggcagcgcaaaagatg

SEQ ID NO: 99664 - DNA, 103 bp, Artificial Sequence
  Synthetic Polynucleotide
taatacgactcactataggggcactttactacatgagtatgtgggtgatcaacagaggagagatcacatgcatactcataacctggcggcagcgcaaaagatg

SEQ ID NO: 99665 - DNA, 103 bp, Artificial Sequence
  Synthetic Polynucleotide
taatacgactcactatagggcaagttgagtgcactttactacatgagtataacagaggagaatactcatgtagtaaagtaacctggcggcagcgcaaaagatg

SEQ ID NO: 99666 - DNA, 103 bp, Artificial Sequence
  Synthetic Polynucleotide
taatacgactcactatagggcttgctcgaacaagttgagtgcactttactaacagaggagaagtaaaatgcactcaactaacctggcggcagcgcaaaagatg

SEQ ID NO: 99667 - DNA, 103 bp, Artificial Sequence
  Synthetic Polynucleotide
taatacgactcactatagggtaagtccttgcttgctcgaacaagttgagtaacagaggagaactcaaatggttcgagcaaacctggcggcagcgcaaaagatg

SEQ ID NO: 99668 - DNA, 103 bp, Artificial Sequence
  Synthetic Polynucleotide
taatacgactcactatagggatgggctattttccagctgttctcgagtgaaacagaggagatcactcatgaacagctggaacctggcggcagcgcaaaagatg

SEQ ID NO: 99669 - DNA, 103 bp, Artificial Sequence
  Synthetic Polynucleotide
taatacgactcactatagggaagtctgtgctaagtccttgcttgctcgaaaacagaggagattcgagatggcaaggactaacctggcggcagcgcaaaagatg

SEQ ID NO: 99670 - DNA, 103 bp, Artificial Sequence
  Synthetic Polynucleotide
taatacgactcactatagggatgaagtaagaagtctgtgctaagtccttgaacagaggagacaaggaatgagcacagacaacctggcggcagcgcaaaagatg

SEQ ID NO: 99671 - DNA, 103 bp, Artificial Sequence
  Synthetic Polynucleotide
taatacgactcactataggggttggttgccatgaagtaagaagtctgtgcaacagaggagagcacagatgtcttacttcaacctggcggcagcgcaaaagatg

SEQ ID NO: 99672 - DNA, 103 bp, Artificial Sequence
  Synthetic Polynucleotide
taatacgactcactatagggaatgcaggctgttggttgccatgaagtaagaacagaggagacttactatgtggcaaccaaacctggcggcagcgcaaaagatg

SEQ ID NO: 99673 - DNA, 103 bp, Artificial Sequence
  Synthetic Polynucleotide
taatacgactcactatagggaatgtggtcaaatgcaggctgttggttgccaacagaggagaggcaacatgcagcctgcaaacctggcggcagcgcaaaagatg

SEQ ID NO: 99674 - DNA, 103 bp, Artificial Sequence
  Synthetic Polynucleotide
taatacgactcactatagggctgcaggctaaatgtggtcaaatgcaggctaacagaggagaagcctgatgttgaccacaaacctggcggcagcgcaaaagatg

SEQ ID NO: 99675 - DNA, 103 bp, Artificial Sequence
  Synthetic Polynucleotide
taatacgactcactataggggaggtgtgtactgcaggctaaatgtggtcaaacagaggagatgaccaatgttagcctgcaacctggcggcagcgcaaaagatg

SEQ ID NO: 99676 - DNA, 103 bp, Artificial Sequence
  Synthetic Polynucleotide
taatacgactcactataggggccaccacaggaggtgtgtactgcaggctaaacagaggagatagcctatggtacacaccaacctggcggcagcgcaaaagatg

SEQ ID NO: 99677 - DNA, 103 bp, Artificial Sequence
  Synthetic Polynucleotide
taatacgactcactataggggcagacacaggccaccacaggaggtgtgtaaacagaggagatacacaatgcctgtggtgaacctggcggcagcgcaaaagatg

SEQ ID NO: 99678 - DNA, 103 bp, Artificial Sequence
  Synthetic Polynucleotide
taatacgactcactatagggccaggtgaatgcagacacaggccaccacagaacagaggagactgtggatgcctgtgtctaacctggcggcagcgcaaaagatg

SEQ ID NO: 99679 - DNA, 103 bp, Artificial Sequence
  Synthetic Polynucleotide
taatacgactcactatagggaaacgacgggatgggctattttccagctgtaacagaggagaacagctatgaaatagcccaacctggcggcagcgcaaaagatg

SEQ ID NO: 99680 - DNA, 103 bp, Artificial Sequence
  Synthetic Polynucleotide
taatacgactcactatagggcacttgcaagccaggtgaatgcagacacagaacagaggagactgtgtatgcattcacctaacctggcggcagcgcaaaagatg

SEQ ID NO: 99681 - DNA, 103 bp, Artificial Sequence
  Synthetic Polynucleotide
taatacgactcactatagggccaattggaccacttgcaagccaggtgaataacagaggagaattcacatggcttgcaagaacctggcggcagcgcaaaagatg

SEQ ID NO: 99682 - DNA, 103 bp, Artificial Sequence
  Synthetic Polynucleotide
taatacgactcactatagggctgggatctcccaattggaccacttgcaagaacagaggagacttgcaatgggtccaattaacctggcggcagcgcaaaagatg

SEQ ID NO: 99683 - DNA, 103 bp, Artificial Sequence
  Synthetic Polynucleotide
taatacgactcactatagggtcagttgagactgggatctcccaattggacaacagaggagagtccaaatgggagatcccaacctggcggcagcgcaaaagatg

SEQ ID NO: 99684 - DNA, 103 bp, Artificial Sequence
  Synthetic Polynucleotide
taatacgactcactataggggtgcttcccgtcagttgagactgggatctcaacagaggagagagatcatggtctcaactaacctggcggcagcgcaaaagatg

SEQ ID NO: 99685 - DNA, 103 bp, Artificial Sequence
  Synthetic Polynucleotide
taatacgactcactatagggactcccaccagtgcttcccgtcagttgagaaacagaggagatctcaaatgacgggaagcaacctggcggcagcgcaaaagatg

SEQ ID NO: 99686 - DNA, 103 bp, Artificial Sequence
  Synthetic Polynucleotide
taatacgactcactataggggcgtcaacatactcccaccagtgcttcccgaacagaggagacgggaaatgctggtgggaaacctggcggcagcgcaaaagatg

SEQ ID NO: 99687 - DNA, 103 bp, Artificial Sequence
  Synthetic Polynucleotide
taatacgactcactatagggggtcacagtggcgtcaacatactcccaccaaacagaggagatggtggatgtatgttgacaacctggcggcagcgcaaaagatg

SEQ ID NO: 99688 - DNA, 103 bp, Artificial Sequence
  Synthetic Polynucleotide
taatacgactcactatagggaaagttccaaggtcacagtggcgtcaacataacagaggagaatgttgatgccactgtgaaacctggcggcagcgcaaaagatg

SEQ ID NO: 99689 - DNA, 103 bp, Artificial Sequence
  Synthetic Polynucleotide
taatacgactcactatagggagttcatctaaaagttccaaggtcacagtgaacagaggagacactgtatgcttggaactaacctggcggcagcgcaaaagatg

SEQ ID NO: 99690 - DNA, 103 bp, Artificial Sequence
  Synthetic Polynucleotide
taatacgactcactataggggtccacgccaaaacgacgggatgggctattaacagaggagaaatagcatgtcccgtcgtaacctggcggcagcgcaaaagatg

SEQ ID NO: 99691 - DNA, 103 bp, Artificial Sequence
  Synthetic Polynucleotide
taatacgactcactatagggctcatgtgtcagttcatctaaaagttccaaaacagaggagattggaaatgttagatgaaaacctggcggcagcgcaaaagatg

SEQ ID NO: 99692 - DNA, 103 bp, Artificial Sequence
  Synthetic Polynucleotide
taatacgactcactatagggtctgtagaaactcatgtgtcagttcatctaaacagaggagatagatgatgtgacacatgaacctggcggcagcgcaaaagatg

SEQ ID NO: 99693 - DNA, 103 bp, Artificial Sequence
  Synthetic Polynucleotide
taatacgactcactatagggttctccaaaatctgtagaaactcatgtgtcaacagaggagagacacaatggtttctacaaacctggcggcagcgcaaaagatg

SEQ ID NO: 99694 - DNA, 103 bp, Artificial Sequence
  Synthetic Polynucleotide
taatacgactcactataggggttgggagttttctccaaaatctgtagaaaaacagaggagatttctaatgattttggagaacctggcggcagcgcaaaagatg

SEQ ID NO: 99695 - DNA, 103 bp, Artificial Sequence
  Synthetic Polynucleotide
taatacgactcactataggggtttgagcctgttgggagttttctccaaaaaacagaggagattttggatgaaactcccaaacctggcggcagcgcaaaagatg

SEQ ID NO: 99696 - DNA, 103 bp, Artificial Sequence
  Synthetic Polynucleotide
taatacgactcactatagggttccaaatgcgtttgagcctgttgggagttaacagaggagaaactccatgcaggctcaaaacctggcggcagcgcaaaagatg

SEQ ID NO: 99697 - DNA, 103 bp, Artificial Sequence
  Synthetic Polynucleotide
taatacgactcactatagggtgccctccaattccaaatgcgtttgagcctaacagaggagaaggctcatgcgcatttggaacctggcggcagcgcaaaagatg

SEQ ID NO: 99698 - DNA, 103 bp, Artificial Sequence
  Synthetic Polynucleotide
taatacgactcactatagggcagcctcgcatgccctccaattccaaatgcaacagaggagagcatttatgattggagggaacctggcggcagcgcaaaagatg

SEQ ID NO: 99699 - DNA, 103 bp, Artificial Sequence
  Synthetic Polynucleotide
taatacgactcactataggggttttcttggcagcctcgcatgccctccaaaacagaggagattggagatgatgcgaggcaacctggcggcagcgcaaaagatg

SEQ ID NO: 99700 - DNA, 103 bp, Artificial Sequence
  Synthetic Polynucleotide
taatacgactcactatagggatctgcttttgttttcttggcagcctcgcaaacagaggagatgcgagatggccaagaaaaacctggcggcagcgcaaaagatg

SEQ ID NO: 99701 - DNA, 103 bp, Artificial Sequence
  Synthetic Polynucleotide
taatacgactcactatagggctttatctgggtccacgccaaaacgacgggaacagaggagacccgtcatgttggcgtggaacctggcggcagcgcaaaagatg

SEQ ID NO: 99702 - DNA, 103 bp, Artificial Sequence
  Synthetic Polynucleotide
taatacgactcactatagggttcctcggtcatctgcttttgttttcttggaacagaggagaccaagaatgcaaaagcagaacctggcggcagcgcaaaagatg

SEQ ID NO: 99703 - DNA, 103 bp, Artificial Sequence
  Synthetic Polynucleotide
taatacgactcactatagggttttcatctgttcctcggtcatctgcttttaacagaggagaaaaagcatgtgaccgaggaacctggcggcagcgcaaaagatg

SEQ ID NO: 99704 - DNA, 103 bp, Artificial Sequence
  Synthetic Polynucleotide
taatacgactcactatagggctctgaagtcttttcatctgttcctcggtcaacagaggagagaccgaatgacagatgaaaacctggcggcagcgcaaaagatg

SEQ ID NO: 99705 - DNA, 103 bp, Artificial Sequence
  Synthetic Polynucleotide
taatacgactcactatagggggattgtctgctctgaagtcttttcatctgaacagaggagacagatgatgagacttcagaacctggcggcagcgcaaaagatg

SEQ ID NO: 99706 - DNA, 103 bp, Artificial Sequence
  Synthetic Polynucleotide
taatacgactcactatagggatcatattgaggattgtctgctctgaagtcaacagaggagagacttcatggcagacaataacctggcggcagcgcaaaagatg

SEQ ID NO: 99707 - DNA, 103 bp, Artificial Sequence
  Synthetic Polynucleotide
taatacgactcactataggggctctgggaaatcatattgaggattgtctgaacagaggagacagacaatgctcaatatgaacctggcggcagcgcaaaagatg

SEQ ID NO: 99708 - DNA, 103 bp, Artificial Sequence
  Synthetic Polynucleotide
taatacgactcactatagggtgtctgaagagctctgggaaatcatattgaaacagaggagatcaataatgtttcccagaaacctggcggcagcgcaaaagatg

SEQ ID NO: 99709 - DNA, 103 bp, Artificial Sequence
  Synthetic Polynucleotide
taatacgactcactataggggcaatggttgtgtctgaagagctctgggaaaacagaggagattcccaatgctcttcagaaacctggcggcagcgcaaaagatg

SEQ ID NO: 99710 - DNA, 103 bp, Artificial Sequence
  Synthetic Polynucleotide
taatacgactcactatagggcattaaacctgcaatggttgtgtctgaagaaacagaggagatcttcaatgacaaccattaacctggcggcagcgcaaaagatg

SEQ ID NO: 99711 - DNA, 103 bp, Artificial Sequence
  Synthetic Polynucleotide
taatacgactcactatagggttgacatgctcattaaacctgcaatggttgaacagaggagacaaccaatgcaggtttaaaacctggcggcagcgcaaaagatg

SEQ ID NO: 99712 - DNA, 103 bp, Artificial Sequence
  Synthetic Polynucleotide
taatacgactcactatagggtaagaaagttctttatctgggtccacgccaaacagaggagatggcgtatgcccagataaaacctggcggcagcgcaaaagatg

SEQ ID NO: 99713 - DNA, 103 bp, Artificial Sequence
  Synthetic Polynucleotide
taatacgactcactataggggtggtagaagttgacatgctcattaaacctaacagaggagaaggtttatggagcatgtcaacctggcggcagcgcaaaagatg

SEQ ID NO: 99714 - DNA, 103 bp, Artificial Sequence
  Synthetic Polynucleotide
taatacgactcactatagggcactgcacttgtggtagaagttgacatgctaacagaggagaagcatgatgacttctaccaacctggcggcagcgcaaaagatg

SEQ ID NO: 99715 - DNA, 103 bp, Artificial Sequence
  Synthetic Polynucleotide
taatacgactcactataggggcagggaaggcactgcacttgtggtagaagaacagaggagacttctaatgcaagtgcagaacctggcggcagcgcaaaagatg

SEQ ID NO: 99716 - DNA, 103 bp, Artificial Sequence
  Synthetic Polynucleotide
taatacgactcactatagggtcggagactggcagggaaggcactgcacttaacagaggagaaagtgcatggccttccctaacctggcggcagcgcaaaagatg

SEQ ID NO: 99717 - DNA, 103 bp, Artificial Sequence
  Synthetic Polynucleotide
taatacgactcactatagggggatgactcttcggagactggcagggaaggaacagaggagaccttccatgccagtctccaacctggcggcagcgcaaaagatg

SEQ ID NO: 99718 - DNA, 103 bp, Artificial Sequence
  Synthetic Polynucleotide
taatacgactcactatagggttaagttgctggatgactcttcggagactgaacagaggagacagtctatgaagagtcataacctggcggcagcgcaaaagatg

SEQ ID NO: 99719 - DNA, 103 bp, Artificial Sequence
  Synthetic Polynucleotide
taatacgactcactatagggtccacactggttaagttgctggatgactctaacagaggagaagagtcatgcagcaacttaacctggcggcagcgcaaaagatg

SEQ ID NO: 99720 - DNA, 103 bp, Artificial Sequence
  Synthetic Polynucleotide
taatacgactcactatagggcggcaacatctccacactggttaagttgctaacagaggagaagcaacatgaccagtgtgaacctggcggcagcgcaaaagatg

SEQ ID NO: 99721 - DNA, 103 bp, Artificial Sequence
  Synthetic Polynucleotide
taatacgactcactatagggaacgcttgcccggcaacatctccacactggaacagaggagaccagtgatgagatgttgcaacctggcggcagcgcaaaagatg

SEQ ID NO: 99722 - DNA, 103 bp, Artificial Sequence
  Synthetic Polynucleotide
taatacgactcactataggggaggacagccaacgcttgcccggcaacatcaacagaggagagatgttatggggcaagcgaacctggcggcagcgcaaaagatg

SEQ ID NO: 99723 - DNA, 103 bp, Artificial Sequence
  Synthetic Polynucleotide
taatacgactcactatagggtacgccccccttgatcataattcgaggcataacagaggagaatgcctatgattatgatcaacctggcggcagcgcaaaagatg

SEQ ID NO: 99724 - DNA, 103 bp, Artificial Sequence
  Synthetic Polynucleotide
taatacgactcactatagggtctatgcagcaatgaggcaatcctagaccaaacagaggagatggtctatgattgcctcaaacctggcggcagcgcaaaagatg

SEQ ID NO: 99725 - DNA, 103 bp, Artificial Sequence
  Synthetic Polynucleotide
taatacgactcactatagggctcagacaaaagtgtactggaagcagaattaacagaggagaaattctatgtccagtacaaacctggcggcagcgcaaaagatg

SEQ ID NO: 99726 - DNA, 103 bp, Artificial Sequence
  Synthetic Polynucleotide
taatacgactcactatagggtgacattgtactcagacaaaagtgtactggaacagaggagaccagtaatgttttgtctgaacctggcggcagcgcaaaagatg

SEQ ID NO: 99727 - DNA, 103 bp, Artificial Sequence
  Synthetic Polynucleotide
taatacgactcactatagggctgttgttggtgacattgtactcagacaaaaacagaggagatttgtcatggtacaatgtaacctggcggcagcgcaaaagatg

SEQ ID NO: 99728 - DNA, 103 bp, Artificial Sequence
  Synthetic Polynucleotide
taatacgactcactatagggaagagcaacgctgttgttggtgacattgtaaacagaggagatacaatatgaccaacaacaacctggcggcagcgcaaaagatg

SEQ ID NO: 99729 - DNA, 103 bp, Artificial Sequence
  Synthetic Polynucleotide
taatacgactcactataggggtggtgttctaagagcaacgctgttgttggaacagaggagaccaacaatggcgttgctcaacctggcggcagcgcaaaagatg

SEQ ID NO: 99730 - DNA, 103 bp, Artificial Sequence
  Synthetic Polynucleotide
taatacgactcactataggggctggtgttcgtggtgttctaagagcaacgaacagaggagacgttgcatgtagaacaccaacctggcggcagcgcaaaagatg

SEQ ID NO: 99731 - DNA, 103 bp, Artificial Sequence
  Synthetic Polynucleotide
taatacgactcactataggggtcctgggaagctggtgttcgtggtgttctaacagaggagaagaacaatgcgaacaccaaacctggcggcagcgcaaaagatg

SEQ ID NO: 99732 - DNA, 103 bp, Artificial Sequence
  Synthetic Polynucleotide
taatacgactcactataggggcagaattctgtcctgggaagctggtgttcaacagaggagagaacacatgcttcccaggaacctggcggcagcgcaaaagatg

SEQ ID NO: 99733 - DNA, 103 bp, Artificial Sequence
  Synthetic Polynucleotide
taatacgactcactatagggtgggcttcctgcagaattctgtcctgggaaaacagaggagattcccaatgcagaattctaacctggcggcagcgcaaaagatg

SEQ ID NO: 99734 - DNA, 103 bp, Artificial Sequence
  Synthetic Polynucleotide
taatacgactcactatagggcatgaggttctgggcttcctgcagaattctaacagaggagaagaattatgcaggaagccaacctggcggcagcgcaaaagatg

SEQ ID NO: 99735 - DNA, 103 bp, Artificial Sequence
  Synthetic Polynucleotide
taatacgactcactatagggttgctgattttctatgcagcaatgaggcaaaacagaggagattgcctatgtgctgcataaacctggcggcagcgcaaaagatg

SEQ ID NO: 99736 - DNA, 103 bp, Artificial Sequence
  Synthetic Polynucleotide
taatacgactcactatagggtggtgagggccatgaggttctgggcttcctaacagaggagaaggaagatgagaacctcaaacctggcggcagcgcaaaagatg

SEQ ID NO: 99737 - DNA, 103 bp, Artificial Sequence
  Synthetic Polynucleotide
taatacgactcactataggggtgtccacattggtgagggccatgaggttcaacagaggagagaacctatgggccctcacaacctggcggcagcgcaaaagatg

SEQ ID NO: 99738 - DNA, 103 bp, Artificial Sequence
  Synthetic Polynucleotide
taatacgactcactatagggtttcaatggggtgtccacattggtgagggcaacagaggagagccctcatgaatgtggacaacctggcggcagcgcaaaagatg

SEQ ID NO: 99739 - DNA, 103 bp, Artificial Sequence
  Synthetic Polynucleotide
taatacgactcactatagggtaagtccacctttcaatggggtgtccacataacagaggagaatgtggatgccccattgaaacctggcggcagcgcaaaagatg

SEQ ID NO: 99740 - DNA, 103 bp, Artificial Sequence
  Synthetic Polynucleotide
taatacgactcactatagggaatggggtattaagtccacctttcaatgggaacagaggagacccattatgaggtggactaacctggcggcagcgcaaaagatg

SEQ ID NO: 99741 - DNA, 103 bp, Artificial Sequence
  Synthetic Polynucleotide
taatacgactcactatagggactctcatgcaatggggtattaagtccaccaacagaggagaggtggaatgaataccccaaacctggcggcagcgcaaaagatg

SEQ ID NO: 99742 - DNA, 103 bp, Artificial Sequence
  Synthetic Polynucleotide
taatacgactcactatagggctgagaagtcactctcatgcaatggggtataacagaggagaatacccatgtgcatgagaaacctggcggcagcgcaaaagatg

SEQ ID NO: 99743 - DNA, 103 bp, Artificial Sequence
  Synthetic Polynucleotide
taatacgactcactatagggggagttacacctgagaagtcactctcatgcaacagaggagagcatgaatgtgacttctcaacctggcggcagcgcaaaagatg

SEQ ID NO: 99744 - DNA, 103 bp, Artificial Sequence
  Synthetic Polynucleotide
taatacgactcactatagggttgtcgctgtggagttacacctgagaagtcaacagaggagagacttcatgggtgtaactaacctggcggcagcgcaaaagatg

SEQ ID NO: 99745 - DNA, 103 bp, Artificial Sequence
  Synthetic Polynucleotide
taatacgactcactatagggtctgtacaacttgtcgctgtggagttacacaacagaggagagtgtaaatgcacagcgacaacctggcggcagcgcaaaagatg

SEQ ID NO: 99746 - DNA, 103 bp, Artificial Sequence
  Synthetic Polynucleotide
taatacgactcactatagggttgcactgctttgctgattttctatgcagcaacagaggagagctgcaatgaaaatcagcaacctggcggcagcgcaaaagatg

SEQ ID NO: 99747 - DNA, 103 bp, Artificial Sequence
  Synthetic Polynucleotide
taatacgactcactataggggtgtttggagtctgtacaacttgtcgctgtaacagaggagaacagcgatgagttgtacaaacctggcggcagcgcaaaagatg

SEQ ID NO: 99748 - DNA, 103 bp, Artificial Sequence
  Synthetic Polynucleotide
taatacgactcactatagggagagagaactgtgtttggagtctgtacaacaacagaggagagttgtaatgactccaaacaacctggcggcagcgcaaaagatg

SEQ ID NO: 99749 - DNA, 103 bp, Artificial Sequence
  Synthetic Polynucleotide
taatacgactcactatagggtgaatggagtagagagaactgtgtttggagaacagaggagactccaaatgcagttctctaacctggcggcagcgcaaaagatg

SEQ ID NO: 99750 - DNA, 103 bp, Artificial Sequence
  Synthetic Polynucleotide
taatacgactcactataggggaaggagtcctgaatggagtagagagaactaacagaggagaagttctatgtactccattaacctggcggcagcgcaaaagatg

SEQ ID NO: 99751 - DNA, 103 bp, Artificial Sequence
  Synthetic Polynucleotide
taatacgactcactatagggagctccattagaaggagtcctgaatggagtaacagaggagaactccaatgaggactcctaacctggcggcagcgcaaaagatg

SEQ ID NO: 99752 - DNA, 103 bp, Artificial Sequence
  Synthetic Polynucleotide
taatacgactcactatagggtcagcccttcagctccattagaaggagtccaacagaggagaggactcatgctaatggagaacctggcggcagcgcaaaagatg

SEQ ID NO: 99753 - DNA, 103 bp, Artificial Sequence
  Synthetic Polynucleotide
taatacgactcactatagggctccggggagtcagcccttcagctccattaaacagaggagataatggatgtgaagggctaacctggcggcagcgcaaaagatg

SEQ ID NO: 99754 - DNA, 103 bp, Artificial Sequence
  Synthetic Polynucleotide
taatacgactcactatagggagttgttccactccggggagtcagcccttcaacagaggagagaagggatgactccccggaacctggcggcagcgcaaaagatg

SEQ ID NO: 99755 - DNA, 103 bp, Artificial Sequence
  Synthetic Polynucleotide
taatacgactcactatagggctggtttgggagttgttccactccggggagaacagaggagactccccatggtggaacaaaacctggcggcagcgcaaaagatg

SEQ ID NO: 99756 - DNA, 103 bp, Artificial Sequence
  Synthetic Polynucleotide
taatacgactcactataggggagttaataactggtttgggagttgttccaaacagaggagatggaacatgtcccaaaccaacctggcggcagcgcaaaagatg

SEQ ID NO: 99757 - DNA, 103 bp, Artificial Sequence
  Synthetic Polynucleotide
taatacgactcactatagggccatctggctttgcactgctttgctgatttaacagaggagaaaatcaatgaagcagtgcaacctggcggcagcgcaaaagatg

SEQ ID NO: 99758 - DNA, 103 bp, Artificial Sequence
  Synthetic Polynucleotide
taatacgactcactatagggacccggagtagagttaataactggtttgggaacagaggagacccaaaatggttattaacaacctggcggcagcgcaaaagatg

SEQ ID NO: 99759 - DNA, 103 bp, Artificial Sequence
  Synthetic Polynucleotide
taatacgactcactataggggaggagttctacccggagtagagttaataaaacagaggagattattaatgctactccggaacctggcggcagcgcaaaagatg

SEQ ID NO: 99760 - DNA, 103 bp, Artificial Sequence
  Synthetic Polynucleotide
taatacgactcactatagggttgtctcgaagaggagttctacccggagtaaacagaggagatactccatgtagaactccaacctggcggcagcgcaaaagatg

SEQ ID NO: 99761 - DNA, 103 bp, Artificial Sequence
  Synthetic Polynucleotide
taatacgactcactatagggaatgtttaacttgtctcgaagaggagttctaacagaggagaagaactatgcttcgagacaacctggcggcagcgcaaaagatg

SEQ ID NO: 99762 - DNA, 103 bp, Artificial Sequence
  Synthetic Polynucleotide
taatacgactcactatagggcctcgggattaatgtttaacttgtctcgaaaacagaggagattcgagatgagttaaacaaacctggcggcagcgcaaaagatg

SEQ ID NO: 99763 - DNA, 103 bp, Artificial Sequence
  Synthetic Polynucleotide
taatacgactcactataggggccattccatcctcgggattaatgtttaacaacagaggagagttaaaatgtaatcccgaaacctggcggcagcgcaaaagatg

SEQ ID NO: 99764 - DNA, 103 bp, Artificial Sequence
  Synthetic Polynucleotide
taatacgactcactatagggactatagtctgccattccatcctcgggattaacagaggagaaatcccatggatggaatgaacctggcggcagcgcaaaagatg

SEQ ID NO: 99765 - DNA, 103 bp, Artificial Sequence
  Synthetic Polynucleotide
taatacgactcactatagggaagagggatcactatagtctgccattccataacagaggagaatggaaatgcagactataaacctggcggcagcgcaaaagatg

SEQ ID NO: 99766 - DNA, 103 bp, Artificial Sequence
  Synthetic Polynucleotide
taatacgactcactatagggtgcttcacgtaagagggatcactatagtctaacagaggagaagactaatgtgatccctcaacctggcggcagcgcaaaagatg

SEQ ID NO: 99767 - DNA, 103 bp, Artificial Sequence
  Synthetic Polynucleotide
taatacgactcactatagggtctttccatctgcttcacgtaagagggatcaacagaggagagatcccatgtacgtgaagaacctggcggcagcgcaaaagatg

SEQ ID NO: 99768 - DNA, 103 bp, Artificial Sequence
  Synthetic Polynucleotide
taatacgactcactataggggccattcataccatctggctttgcactgctaacagaggagaagcagtatgaagccagataacctggcggcagcgcaaaagatg

SEQ ID NO: 99769 - DNA, 103 bp, Artificial Sequence
  Synthetic Polynucleotide
taatacgactcactatagggctcgggattctctttccatctgcttcacgtaacagaggagaacgtgaatgagatggaaaaacctggcggcagcgcaaaagatg

SEQ ID NO: 99770 - DNA, 103 bp, Artificial Sequence
  Synthetic Polynucleotide
taatacgactcactatagggcggagatgttctcgggattctctttccatcaacagaggagagatggaatgagaatcccgaacctggcggcagcgcaaaagatg

SEQ ID NO: 99771 - DNA, 103 bp, Artificial Sequence
  Synthetic Polynucleotide
taatacgactcactatagggcaaccctaaacggagatgttctcgggattcaacagaggagagaatccatggaacatctcaacctggcggcagcgcaaaagatg

SEQ ID NO: 99772 - DNA, 103 bp, Artificial Sequence
  Synthetic Polynucleotide
taatacgactcactataggggaaggcccaacaaccctaaacggagatgttaacagaggagaaacatcatggtttagggtaacctggcggcagcgcaaaagatg

SEQ ID NO: 99773 - DNA, 103 bp, Artificial Sequence
  Synthetic Polynucleotide
taatacgactcactatagggttaggggcaggaaggcccaacaaccctaaaaacagaggagatttaggatggttgggcctaacctggcggcagcgcaaaagatg

SEQ ID NO: 99774 - DNA, 103 bp, Artificial Sequence
  Synthetic Polynucleotide
taatacgactcactatagggaaaatcattcttaggggcaggaaggcccaaaacagaggagattgggcatgcctgcccctaacctggcggcagcgcaaaagatg

SEQ ID NO: 99775 - DNA, 103 bp, Artificial Sequence
  Synthetic Polynucleotide
taatacgactcactataggggaacaatttcaaaatcattcttaggggcagaacagaggagactgcccatgagaatgattaacctggcggcagcgcaaaagatg

SEQ ID NO: 99776 - DNA, 103 bp, Artificial Sequence
  Synthetic Polynucleotide
taatacgactcactatagggttttctggtagaacaatttcaaaatcattcaacagaggagagaatgaatgtgaaattgtaacctggcggcagcgcaaaagatg

SEQ ID NO: 99777 - DNA, 103 bp, Artificial Sequence
  Synthetic Polynucleotide
taatacgactcactatagggcttctcggcattttctggtagaacaatttcaacagaggagagaaattatgctaccagaaaacctggcggcagcgcaaaagatg

SEQ ID NO: 99778 - DNA, 103 bp, Artificial Sequence
  Synthetic Polynucleotide
taatacgactcactatagggcttccagctccttctcggcattttctggtaaacagaggagataccagatgatgccgagaaacctggcggcagcgcaaaagatg

SEQ ID NO: 99779 - DNA, 103 bp, Artificial Sequence
  Synthetic Polynucleotide
taatacgactcactatagggcttggatccagccattcataccatctggctaacagaggagaagccagatggtatgaatgaacctggcggcagcgcaaaagatg

SEQ ID NO: 99780 - DNA, 103 bp, Artificial Sequence
  Synthetic Polynucleotide
taatacgactcactatagggatttcacgttcttccagctccttctcggcaaacagaggagatgccgaatgggagctggaaacctggcggcagcgcaaaagatg

SEQ ID NO: 99781 - DNA, 103 bp, Artificial Sequence
  Synthetic Polynucleotide
taatacgactcactatagggagtatcatctatttcacgttcttccagctcaacagaggagagagctgatggaacgtgaaaacctggcggcagcgcaaaagatg

SEQ ID NO: 99782 - DNA, 103 bp, Artificial Sequence
  Synthetic Polynucleotide
taatacgactcactatagggcttcaatgtaagtatcatctatttcacgttaacagaggagaaacgtgatgtagatgataaacctggcggcagcgcaaaagatg

SEQ ID NO: 99783 - DNA, 103 bp, Artificial Sequence
  Synthetic Polynucleotide
taatacgactcactatagggtcagcagcatcttcaatgtaagtatcatctaacagaggagaagatgaatgttacattgaaacctggcggcagcgcaaaagatg

SEQ ID NO: 99784 - DNA, 103 bp, Artificial Sequence
  Synthetic Polynucleotide
taatacgactcactatagggagcatccacatcagcagcatcttcaatgtaaacagaggagatacattatggatgctgctaacctggcggcagcgcaaaagatg

SEQ ID NO: 99785 - DNA, 103 bp, Artificial Sequence
  Synthetic Polynucleotide
taatacgactcactatagggcctgctttcgagcatccacatcagcagcataacagaggagaatgctgatgatgtggatgaacctggcggcagcgcaaaagatg

SEQ ID NO: 99786 - DNA, 103 bp, Artificial Sequence
  Synthetic Polynucleotide
taatacgactcactatagggtctcgtatggcctgctttcgagcatccacaaacagaggagatgtggaatgtcgaaagcaaacctggcggcagcgcaaaagatg

SEQ ID NO: 99787 - DNA, 103 bp, Artificial Sequence
  Synthetic Polynucleotide
taatacgactcactatagggacgctctgcatctcgtatggcctgctttcgaacagaggagacgaaagatggccatacgaaacctggcggcagcgcaaaagatg

SEQ ID NO: 99788 - DNA, 103 bp, Artificial Sequence
  Synthetic Polynucleotide
taatacgactcactatagggtttcctttacacgctctgcatctcgtatggaacagaggagaccatacatgatgcagagcaacctggcggcagcgcaaaagatg

SEQ ID NO: 99789 - DNA, 103 bp, Artificial Sequence
  Synthetic Polynucleotide
taatacgactcactatagggattcgtttcatttcctttacacgctctgcaaacagaggagatgcagaatgtgtaaaggaaacctggcggcagcgcaaaagatg

SEQ ID NO: 99790 - DNA, 103 bp, Artificial Sequence
  Synthetic Polynucleotide
taatacgactcactatagggcttcttaatgcttggatccagccattcataaacagaggagatatgaaatgctggatccaaacctggcggcagcgcaaaagatg

SEQ ID NO: 99791 - DNA, 103 bp, Artificial Sequence
  Synthetic Polynucleotide
taatacgactcactatagggagctttatgcattcgtttcatttcctttacaacagaggagagtaaagatgatgaaacgaaacctggcggcagcgcaaaagatg

SEQ ID NO: 99792 - DNA, 103 bp, Artificial Sequence
  Synthetic Polynucleotide
taatacgactcactatagggctttctggacagctttatgcattcgtttcaaacagaggagatgaaacatgtgcataaagaacctggcggcagcgcaaaagatg

SEQ ID NO: 99793 - DNA, 103 bp, Artificial Sequence
  Synthetic Polynucleotide
taatacgactcactatagggcttggcagatctttctggacagctttatgcaacagaggagagcataaatgtgtccagaaaacctggcggcagcgcaaaagatg

SEQ ID NO: 99794 - DNA, 103 bp, Artificial Sequence
  Synthetic Polynucleotide
taatacgactcactatagggttctgatggtcttggcagatctttctggacaacagaggagagtccagatggatctgccaaacctggcggcagcgcaaaagatg

SEQ ID NO: 99795 - DNA, 103 bp, Artificial Sequence
  Synthetic Polynucleotide
taatacgactcactatagggtttcatttacttctgatggtcttggcagataacagaggagaatctgcatggaccatcagaacctggcggcagcgcaaaagatg

SEQ ID NO: 99796 - DNA, 103 bp, Artificial Sequence
  Synthetic Polynucleotide
taatacgactcactatagggcttagaatagtttcatttacttctgatggtaacagaggagaaccatcatgagtaaatgaaacctggcggcagcgcaaaagatg

SEQ ID NO: 99797 - DNA, 103 bp, Artificial Sequence
  Synthetic Polynucleotide
taatacgactcactatagggatttaagggtcttagaatagtttcatttacaacagaggagagtaaatatgactattctaaacctggcggcagcgcaaaagatg

SEQ ID NO: 99798 - DNA, 103 bp, Artificial Sequence
  Synthetic Polynucleotide
taatacgactcactataggggcggttctacatttaagggtcttagaatagaacagaggagactattcatggacccttaaaacctggcggcagcgcaaaagatg

SEQ ID NO: 99799 - DNA, 103 bp, Artificial Sequence
  Synthetic Polynucleotide
taatacgactcactatagggtctgttaaaggcggttctacatttaagggtaacagaggagaacccttatgtgtagaaccaacctggcggcagcgcaaaagatg

SEQ ID NO: 99800 - DNA, 103 bp, Artificial Sequence
  Synthetic Polynucleotide
taatacgactcactatagggtttctgtaaatctgttaaaggcggttctacaacagaggagagtagaaatgcctttaacaaacctggcggcagcgcaaaagatg

SEQ ID NO: 99801 - DNA, 103 bp, Artificial Sequence
  Synthetic Polynucleotide
taatacgactcactatagggaccattctgtcttcttaatgcttggatccaaacagaggagatggatcatggcattaagaaacctggcggcagcgcaaaagatg

SEQ ID NO: 99802 - DNA, 103 bp, Artificial Sequence
  Synthetic Polynucleotide
taatacgactcactataggggttcttcacttttctgtaaatctgttaaagaacagaggagactttaaatgatttacagaaacctggcggcagcgcaaaagatg

SEQ ID NO: 99803 - DNA, 103 bp, Artificial Sequence
  Synthetic Polynucleotide
taatacgactcactatagggtttttgattagttcttcacttttctgtaaaaacagaggagatttacaatgaagtgaagaaacctggcggcagcgcaaaagatg

SEQ ID NO: 99804 - DNA, 103 bp, Artificial Sequence
  Synthetic Polynucleotide
taatacgactcactataggggatcatttcttttttgattagttcttcactaacagaggagaagtgaaatgctaatcaaaaacctggcggcagcgcaaaagatg

SEQ ID NO: 99805 - DNA, 103 bp, Artificial Sequence
  Synthetic Polynucleotide
taatacgactcactataggggaagcattgtgatcatttcttttttgattaaacagaggagataatcaatgaagaaatgaaacctggcggcagcgcaaaagatg

SEQ ID NO: 99806 - DNA, 103 bp, Artificial Sequence
  Synthetic Polynucleotide
taatacgactcactatagggaggtcataatgaagcattgtgatcatttctaacagaggagaagaaatatgcacaatgctaacctggcggcagcgcaaaagatg

SEQ ID NO: 99807 - DNA, 103 bp, Artificial Sequence
  Synthetic Polynucleotide
taatacgactcactataggggtgatgtagaaggtcataatgaagcattgtaacagaggagaacaatgatgcattatgacaacctggcggcagcgcaaaagatg

SEQ ID NO: 99808 - DNA, 103 bp, Artificial Sequence
  Synthetic Polynucleotide
taatacgactcactataggggttcataagggtgatgtagaaggtcataataacagaggagaattatgatgttctacatcaacctggcggcagcgcaaaagatg

SEQ ID NO: 99809 - DNA, 103 bp, Artificial Sequence
  Synthetic Polynucleotide
taatacgactcactatagggtttccagatggttcataagggtgatgtagaaacagaggagatctacaatgcccttatgaaacctggcggcagcgcaaaagatg

SEQ ID NO: 99810 - DNA, 103 bp, Artificial Sequence
  Synthetic Polynucleotide
taatacgactcactataggggccttttttatttccagatggttcataaggaacagaggagaccttatatgccatctggaaacctggcggcagcgcaaaagatg

SEQ ID NO: 99811 - DNA, 103 bp, Artificial Sequence
  Synthetic Polynucleotide
taatacgactcactatagggctacagttttgccttttttatttccagatgaacagaggagacatctgatgataaaaaagaacctggcggcagcgcaaaagatg

SEQ ID NO: 99812 - DNA, 103 bp, Artificial Sequence
  Synthetic Polynucleotide
taatacgactcactatagggtcttctctggaccattctgtcttcttaatgaacagaggagacattaaatggacagaatgaacctggcggcagcgcaaaagatg

SEQ ID NO: 99813 - DNA, 103 bp, Artificial Sequence
  Synthetic Polynucleotide
taatacgactcactataggggtaccaaaccctacagttttgccttttttaaacagaggagataaaaaatgcaaaactgtaacctggcggcagcgcaaaagatg

SEQ ID NO: 99814 - DNA, 103 bp, Artificial Sequence
  Synthetic Polynucleotide
taatacgactcactatagggtgaattattggtaccaaaccctacagttttaacagaggagaaaaactatggggtttggtaacctggcggcagcgcaaaagatg

SEQ ID NO: 99815 - DNA, 103 bp, Artificial Sequence
  Synthetic Polynucleotide
taatacgactcactatagggtaatgtgctctgaattattggtaccaaaccaacagaggagaggtttgatgccaataattaacctggcggcagcgcaaaagatg

SEQ ID NO: 99816 - DNA, 103 bp, Artificial Sequence
  Synthetic Polynucleotide
taatacgactcactatagggtccagataggtaatgtgctctgaattattgaacagaggagacaataaatgagagcacataacctggcggcagcgcaaaagatg

SEQ ID NO: 99817 - DNA, 103 bp, Artificial Sequence
  Synthetic Polynucleotide
taatacgactcactatagggaggattatgttccagataggtaatgtgctcaacagaggagagagcacatgacctatctgaacctggcggcagcgcaaaagatg

SEQ ID NO: 99818 - DNA, 103 bp, Artificial Sequence
  Synthetic Polynucleotide
taatacgactcactatagggacttttcataaggattatgttccagataggaacagaggagacctatcatgaacataatcaacctggcggcagcgcaaaagatg

SEQ ID NO: 99819 - DNA, 103 bp, Artificial Sequence
  Synthetic Polynucleotide
taatacgactcactatagggtctttggagaacttttcataaggattatgtaacagaggagaacataaatgttatgaaaaaacctggcggcagcgcaaaagatg

SEQ ID NO: 99820 - DNA, 103 bp, Artificial Sequence
  Synthetic Polynucleotide
taatacgactcactatagggtttcagctcttctttggagaacttttcataaacagaggagatatgaaatgttctccaaaaacctggcggcagcgcaaaagatg

SEQ ID NO: 99821 - DNA, 103 bp, Artificial Sequence
  Synthetic Polynucleotide
taatacgactcactatagggcctgggcctttttcagctcttctttggagaaacagaggagatctccaatgaagagctgaaacctggcggcagcgcaaaagatg

SEQ ID NO: 99822 - DNA, 103 bp, Artificial Sequence
  Synthetic Polynucleotide
taatacgactcactatagggaccaaaacatcctgggcctttttcagctctaacagaggagaagagctatgaaaggcccaaacctggcggcagcgcaaaagatg

SEQ ID NO: 99823 - DNA, 103 bp, Artificial Sequence
  Synthetic Polynucleotide
taatacgactcactatagggtttttcctcttcttctctggaccattctgtaacagaggagaacagaaatgtccagagaaaacctggcggcagcgcaaaagatg

SEQ ID NO: 99824 - DNA, 103 bp, Artificial Sequence
  Synthetic Polynucleotide
taatacgactcactatagggcatctcctgcaccaaaacatcctgggccttaacagaggagaaaggccatggatgttttgaacctggcggcagcgcaaaagatg

SEQ ID NO: 99825 - DNA, 103 bp, Artificial Sequence
  Synthetic Polynucleotide
taatacgactcactatagggtaaccacttccatctcctgcaccaaaacataacagaggagaatgtttatgtgcaggagaaacctggcggcagcgcaaaagatg

SEQ ID NO: 99826 - DNA, 103 bp, Artificial Sequence
  Synthetic Polynucleotide
taatacgactcactatagggattccttgtttaaccacttccatctcctgcaacagaggagagcaggaatgggaagtggtaacctggcggcagcgcaaaagatg

SEQ ID NO: 99827 - DNA, 103 bp, Artificial Sequence
  Synthetic Polynucleotide
taatacgactcactatagggtccatggctcattccttgtttaaccacttcaacagaggagagaagtgatgaaacaaggaaacctggcggcagcgcaaaagatg

SEQ ID NO: 99828 - DNA, 103 bp, Artificial Sequence
  Synthetic Polynucleotide
taatacgactcactatagggttgagagctctccatggctcattccttgttaacagaggagaaacaagatgtgagccatgaacctggcggcagcgcaaaagatg

SEQ ID NO: 99829 - DNA, 103 bp, Artificial Sequence
  Synthetic Polynucleotide
taatacgactcactatagggtaagcttcacttgagagctctccatggctcaacagaggagagagccaatgagagctctcaacctggcggcagcgcaaaagatg

SEQ ID NO: 99830 - DNA, 103 bp, Artificial Sequence
  Synthetic Polynucleotide
taatacgactcactatagggcacctggttataagcttcacttgagagctcaacagaggagagagctcatgagtgaagctaacctggcggcagcgcaaaagatg

SEQ ID NO: 99831 - DNA, 103 bp, Artificial Sequence
  Synthetic Polynucleotide
taatacgactcactatagggattcttcccacacctggttataagcttcacaacagaggagagtgaagatgataaccaggaacctggcggcagcgcaaaagatg

SEQ ID NO: 99832 - DNA, 103 bp, Artificial Sequence
  Synthetic Polynucleotide
taatacgactcactatagggtgactgtagcattcttcccacacctggttaaacagaggagataaccaatggtgggaagaaacctggcggcagcgcaaaagatg

SEQ ID NO: 99833 - DNA, 103 bp, Artificial Sequence
  Synthetic Polynucleotide
taatacgactcactatagggatataaaacttgactgtagcattcttcccaaacagaggagatgggaaatgtgctacagtaacctggcggcagcgcaaaagatg

SEQ ID NO: 99834 - DNA, 103 bp, Artificial Sequence
  Synthetic Polynucleotide
taatacgactcactatagggtattcctccatacgccccccttgatcataaaacagaggagattatgaatgaggggggcgaacctggcggcagcgcaaaagatg

SEQ ID NO: 99835 - DNA, 103 bp, Artificial Sequence
  Synthetic Polynucleotide
taatacgactcactatagggagtgcaagagtttttcctcttcttctctggaacagaggagaccagagatgaagaggaaaaacctggcggcagcgcaaaagatg

SEQ ID NO: 99836 - DNA, 103 bp, Artificial Sequence
  Synthetic Polynucleotide
taatacgactcactataggggcccaggaagatataaaacttgactgtagcaacagaggagagctacaatgaagttttataacctggcggcagcgcaaaagatg

SEQ ID NO: 99837 - DNA, 103 bp, Artificial Sequence
  Synthetic Polynucleotide
taatacgactcactatagggtagcggctctgcccaggaagatataaaactaacagaggagaagttttatgtcttcctggaacctggcggcagcgcaaaagatg

SEQ ID NO: 99838 - DNA, 103 bp, Artificial Sequence
  Synthetic Polynucleotide
taatacgactcactatagggggcccgtgtgtagcggctctgcccaggaagaacagaggagacttcctatgcagagccgcaacctggcggcagcgcaaaagatg

SEQ ID NO: 99839 - DNA, 103 bp, Artificial Sequence
  Synthetic Polynucleotide
taatacgactcactatagggtagccagattggcccgtgtgtagcggctctaacagaggagaagagccatgacacacgggaacctggcggcagcgcaaaagatg

SEQ ID NO: 99840 - DNA, 103 bp, Artificial Sequence
  Synthetic Polynucleotide
taatacgactcactatagggtcctttttactagccagattggcccgtgtgaacagaggagacacacgatgcaatctggcaacctggcggcagcgcaaaagatg

SEQ ID NO: 99841 - DNA, 103 bp, Artificial Sequence
  Synthetic Polynucleotide
taatacgactcactatagggttcaattctgtcctttttactagccagattaacagaggagaaatctgatgagtaaaaagaacctggcggcagcgcaaaagatg

SEQ ID NO: 99842 - DNA, 103 bp, Artificial Sequence
  Synthetic Polynucleotide
taatacgactcactatagggtttcaagtgattcaattctgtcctttttacaacagaggagagtaaaaatgacagaattgaacctggcggcagcgcaaaagatg

SEQ ID NO: 99843 - DNA, 103 bp, Artificial Sequence
  Synthetic Polynucleotide
taatacgactcactatagggtcgagcctcttttcaagtgattcaattctgaacagaggagacagaatatgatcacttgaaacctggcggcagcgcaaaagatg

SEQ ID NO: 99844 - DNA, 103 bp, Artificial Sequence
  Synthetic Polynucleotide
taatacgactcactatagggcctgtttatctcgagcctcttttcaagtgaaacagaggagatcacttatgaagaggctcaacctggcggcagcgcaaaagatg

SEQ ID NO: 99845 - DNA, 103 bp, Artificial Sequence
  Synthetic Polynucleotide
taatacgactcactatagggtcatgtgacccctgtttatctcgagcctctaacagaggagaagaggcatgagataaacaaacctggcggcagcgcaaaagatg

SEQ ID NO: 99846 - DNA, 103 bp, Artificial Sequence
  Synthetic Polynucleotide
taatacgactcactatagggaacttggccaagtgcaagagtttttcctctaacagaggagaagaggaatgactcttgcaaacctggcggcagcgcaaaagatg

SEQ ID NO: 99847 - DNA, 103 bp, Artificial Sequence
  Synthetic Polynucleotide
taatacgactcactataggggcttctgtcgtcatgtgacccctgtttatcaacagaggagagataaaatggggtcacataacctggcggcagcgcaaaagatg

SEQ ID NO: 99848 - DNA, 103 bp, Artificial Sequence
  Synthetic Polynucleotide
taatacgactcactatagggagccctcttggcttctgtcgtcatgtgaccaacagaggagaggtcacatgacgacagaaaacctggcggcagcgcaaaagatg

SEQ ID NO: 99849 - DNA, 103 bp, Artificial Sequence
  Synthetic Polynucleotide
taatacgactcactatagggccatctttgcagccctcttggcttctgtcgaacagaggagacgacagatgccaagagggaacctggcggcagcgcaaaagatg

SEQ ID NO: 99850 - DNA, 103 bp, Artificial Sequence
  Synthetic Polynucleotide
taatacgactcactatagggatcttcttttccatctttgcagccctcttgaacagaggagacaagagatgtgcaaagataacctggcggcagcgcaaaagatg

SEQ ID NO: 99851 - DNA, 103 bp, Artificial Sequence
  Synthetic Polynucleotide
taatacgactcactatagggcaaaattttcatcttcttttccatctttgcaacagaggagagcaaagatggaaaagaagaacctggcggcagcgcaaaagatg

SEQ ID NO: 99852 - DNA, 103 bp, Artificial Sequence
  Synthetic Polynucleotide
taatacgactcactatagggaacccccaagcaaaattttcatcttcttttaacagaggagaaaaagaatgtgaaaatttaacctggcggcagcgcaaaagatg

SEQ ID NO: 99853 - DNA, 103 bp, Artificial Sequence
  Synthetic Polynucleotide
taatacgactcactatagggcgagactggtaacccccaagcaaaattttcaacagaggagagaaaatatggcttgggggaacctggcggcagcgcaaaagatg

SEQ ID NO: 99854 - DNA, 103 bp, Artificial Sequence
  Synthetic Polynucleotide
taatacgactcactatagggccccatagcacgagactggtaacccccaagaacagaggagacttgggatgtaccagtctaacctggcggcagcgcaaaagatg

SEQ ID NO: 99855 - DNA, 103 bp, Artificial Sequence
  Synthetic Polynucleotide
taatacgactcactataggggtttcatgagccccatagcacgagactggtaacagaggagaaccagtatggtgctatggaacctggcggcagcgcaaaagatg

SEQ ID NO: 99856 - DNA, 103 bp, Artificial Sequence
  Synthetic Polynucleotide
taatacgactcactatagggtcattcaactgtttcatgagccccatagcaaacagaggagatgctatatggctcatgaaaacctggcggcagcgcaaaagatg

SEQ ID NO: 99857 - DNA, 103 bp, Artificial Sequence
  Synthetic Polynucleotide
taatacgactcactatagggagttggcatcaacttggccaagtgcaagagaacagaggagactcttgatgttggccaagaacctggcggcagcgcaaaagatg

SEQ ID NO: 99858 - DNA, 103 bp, Artificial Sequence
  Synthetic Polynucleotide
taatacgactcactataggggtcccataagtcattcaactgtttcatgagaacagaggagactcatgatgcagttgaataacctggcggcagcgcaaaagatg

SEQ ID NO: 99859 - DNA, 103 bp, Artificial Sequence
  Synthetic Polynucleotide
taatacgactcactataggggttcaatttggtcccataagtcattcaactaacagaggagaagttgaatgacttatgggaacctggcggcagcgcaaaagatg

SEQ ID NO: 99860 - DNA, 103 bp, Artificial Sequence
  Synthetic Polynucleotide
taatacgactcactatagggaagtgagcctgttcaatttggtcccataagaacagaggagacttatgatgccaaattgaaacctggcggcagcgcaaaagatg

SEQ ID NO: 99861 - DNA, 103 bp, Artificial Sequence
  Synthetic Polynucleotide
taatacgactcactataggggcgtaactccaagtgagcctgttcaatttgaacagaggagacaaattatgcaggctcacaacctggcggcagcgcaaaagatg

SEQ ID NO: 99862 - DNA, 103 bp, Artificial Sequence
  Synthetic Polynucleotide
taatacgactcactatagggcttcaaaagtgcgtaactccaagtgagcctaacagaggagaaggctcatgtggagttacaacctggcggcagcgcaaaagatg

SEQ ID NO: 99863 - DNA, 103 bp, Artificial Sequence
  Synthetic Polynucleotide
taatacgactcactatagggttcttgagttcttcaaaagtgcgtaactccaacagaggagaggagttatgcacttttgaaacctggcggcagcgcaaaagatg

SEQ ID NO: 99864 - DNA, 103 bp, Artificial Sequence
  Synthetic Polynucleotide
taatacgactcactatagggatcttcatgtttcttgagttcttcaaaagtaacagaggagaacttttatggaactcaagaacctggcggcagcgcaaaagatg

SEQ ID NO: 99865 - DNA, 103 bp, Artificial Sequence
  Synthetic Polynucleotide
taatacgactcactataggggaatagcagaatcttcatgtttcttgagttaacagaggagaaactcaatgaacatgaagaacctggcggcagcgcaaaagatg

SEQ ID NO: 99866 - DNA, 103 bp, Artificial Sequence
  Synthetic Polynucleotide
taatacgactcactatagggagcctccggggaatagcagaatcttcatgtaacagaggagaacatgaatgttctgctataacctggcggcagcgcaaaagatg

SEQ ID NO: 99867 - DNA, 103 bp, Artificial Sequence
  Synthetic Polynucleotide
taatacgactcactatagggtagacactctagcctccggggaatagcagaaacagaggagatctgctatgccccggaggaacctggcggcagcgcaaaagatg

SEQ ID NO: 99868 - DNA, 103 bp, Artificial Sequence
  Synthetic Polynucleotide
taatacgactcactatagggtcctccactgagttggcatcaacttggccaaacagaggagatggccaatgtgatgccaaaacctggcggcagcgcaaaagatg

SEQ ID NO: 99869 - DNA, 103 bp, Artificial Sequence
  Synthetic Polynucleotide
taatacgactcactatagggcgtcttcttttagacactctagcctccgggaacagaggagacccggaatgtagagtgtcaacctggcggcagcgcaaaagatg

SEQ ID NO: 99870 - DNA, 103 bp, Artificial Sequence
  Synthetic Polynucleotide
taatacgactcactatagggtgtcgctgaacgtcttcttttagacactctaacagaggagaagagtgatgaaaagaagaaacctggcggcagcgcaaaagatg

SEQ ID NO: 99871 - DNA, 103 bp, Artificial Sequence
  Synthetic Polynucleotide
taatacgactcactatagggtctttcttgttgtcgctgaacgtcttctttaacagaggagaaaagaaatggttcagcgaaacctggcggcagcgcaaaagatg

SEQ ID NO: 99872 - DNA, 103 bp, Artificial Sequence
  Synthetic Polynucleotide
taatacgactcactataggggttccttttctctttcttgttgtcgctgaaaacagaggagattcagcatgaacaagaaaaacctggcggcagcgcaaaagatg

SEQ ID NO: 99873 - DNA, 103 bp, Artificial Sequence
  Synthetic Polynucleotide
taatacgactcactatagggctatgttgaagttccttttctctttcttgtaacagaggagaacaagaatgagaaaaggaaacctggcggcagcgcaaaagatg

SEQ ID NO: 99874 - DNA, 103 bp, Artificial Sequence
  Synthetic Polynucleotide
taatacgactcactatagggatcagcatatctatgttgaagttccttttcaacagaggagagaaaagatgcttcaacataacctggcggcagcgcaaaagatg

SEQ ID NO: 99875 - DNA, 103 bp, Artificial Sequence
  Synthetic Polynucleotide
taatacgactcactatagggccagcagcaaatcagcatatctatgttgaaaacagaggagattcaacatggatatgctgaacctggcggcagcgcaaaagatg

SEQ ID NO: 99876 - DNA, 103 bp, Artificial Sequence
  Synthetic Polynucleotide
taatacgactcactataggggtctctttctccagcagcaaatcagcatataacagaggagaatatgcatgtttgctgctaacctggcggcagcgcaaaagatg

SEQ ID NO: 99877 - DNA, 103 bp, Artificial Sequence
  Synthetic Polynucleotide
taatacgactcactatagggtgactttaaagtctctttctccagcagcaaaacagaggagattgctgatggagaaagagaacctggcggcagcgcaaaagatg

SEQ ID NO: 99878 - DNA, 103 bp, Artificial Sequence
  Synthetic Polynucleotide
taatacgactcactatagggggagcaatggtcctccactgagttggcatcaacagaggagagatgccatgtcagtggagaacctggcggcagcgcaaaagatg

SEQ ID NO: 99879 - DNA, 103 bp, Artificial Sequence
  Synthetic Polynucleotide
taatacgactcactatagggtccaatgattggagcaatggtcctccactgaacagaggagacagtggatgaccattgctaacctggcggcagcgcaaaagatg

SEQ ID NO: 99880 - DNA, 103 bp, Artificial Sequence
  Synthetic Polynucleotide
taatacgactcactatagggccgctgttcttccaatgattggagcaatggaacagaggagaccattgatgcaatcattgaacctggcggcagcgcaaaagatg

SEQ ID NO: 99881 - DNA, 103 bp, Artificial Sequence
  Synthetic Polynucleotide
taatacgactcactatagggaagcactgggccgctgttcttccaatgattaacagaggagaaatcatatgaagaacagcaacctggcggcagcgcaaaagatg

SEQ ID NO: 99882 - DNA, 103 bp, Artificial Sequence
  Synthetic Polynucleotide
taatacgactcactatagggatagtgttctaagcactgggccgctgttctaacagaggagaagaacaatggcccagtgcaacctggcggcagcgcaaaagatg

SEQ ID NO: 99883 - DNA, 103 bp, Artificial Sequence
  Synthetic Polynucleotide
taatacgactcactataggggaagaaattcatagtgttctaagcactgggaacagaggagacccagtatgtagaacactaacctggcggcagcgcaaaagatg

SEQ ID NO: 99884 - DNA, 103 bp, Artificial Sequence
  Synthetic Polynucleotide
taatacgactcactatagggtcatcctcggtattcctccatacgccccccaacagaggagaggggggatgatggaggaaaacctggcggcagcgcaaaagatg

SEQ ID NO: 99885 - DNA, 103 bp, Artificial Sequence
  Synthetic Polynucleotide
taatacgactcactataggggctttatccagaagaaattcatagtgttctaacagaggagaagaacaatgtgaatttctaacctggcggcagcgcaaaagatg

SEQ ID NO: 99886 - DNA, 103 bp, Artificial Sequence
  Synthetic Polynucleotide
taatacgactcactatagggtctttgggcagctttatccagaagaaattcaacagaggagagaatttatgctggataaaaacctggcggcagcgcaaaagatg

SEQ ID NO: 99887 - DNA, 103 bp, Artificial Sequence
  Synthetic Polynucleotide
taatacgactcactatagggcttcattgtctctttgggcagctttatccaaacagaggagatggataatgctgcccaaaaacctggcggcagcgcaaaagatg

SEQ ID NO: 99888 - DNA, 103 bp, Artificial Sequence
  Synthetic Polynucleotide
taatacgactcactataggggttgtttcctcttcattgtctctttgggcaaacagaggagatgcccaatgagacaatgaaacctggcggcagcgcaaaagatg

SEQ ID NO: 99889 - DNA, 103 bp, Artificial Sequence
  Synthetic Polynucleotide
taatacgactcactatagggtggatcatctgttgtttcctcttcattgtcaacagaggagagacaatatggaggaaacaaacctggcggcagcgcaaaagatg

SEQ ID NO: 99890 - DNA, 103 bp, Artificial Sequence
  Synthetic Polynucleotide
taatacgactcactatagggtaagttttcgtggatcatctgttgtttcctaacagaggagaaggaaaatgcagatgatcaacctggcggcagcgcaaaagatg

SEQ ID NO: 99891 - DNA, 103 bp, Artificial Sequence
  Synthetic Polynucleotide
taatacgactcactatagggtctccaggtttaagttttcgtggatcatctaacagaggagaagatgaatgacgaaaactaacctggcggcagcgcaaaagatg

SEQ ID NO: 99892 - DNA, 103 bp, Artificial Sequence
  Synthetic Polynucleotide
taatacgactcactatagggtggatctatttctccaggtttaagttttcgaacagaggagacgaaaaatgaaacctggaaacctggcggcagcgcaaaagatg

SEQ ID NO: 99893 - DNA, 103 bp, Artificial Sequence
  Synthetic Polynucleotide
taatacgactcactatagggtttctggatttggatctatttctccaggttaacagaggagaaacctgatgaaatagatcaacctggcggcagcgcaaaagatg

SEQ ID NO: 99894 - DNA, 103 bp, Artificial Sequence
  Synthetic Polynucleotide
taatacgactcactataggggctggttttgtttctggatttggatctattaacagaggagaaatagaatgaaatccagaaacctggcggcagcgcaaaagatg

SEQ ID NO: 99895 - DNA, 103 bp, Artificial Sequence
  Synthetic Polynucleotide
taatacgactcactatagggtttcagaatttcatcctcggtattcctccaaacagaggagatggaggatgaccgaggataacctggcggcagcgcaaaagatg

SEQ ID NO: 99896 - DNA, 103 bp, Artificial Sequence
  Synthetic Polynucleotide
taatacgactcactatagggatcaggccgcgctggttttgtttctggattaacagaggagaaatccaatgacaaaaccaaacctggcggcagcgcaaaagatg

SEQ ID NO: 99897 - DNA, 103 bp, Artificial Sequence
  Synthetic Polynucleotide
taatacgactcactatagggtatcaattggatcaggccgcgctggttttgaacagaggagacaaaacatgcgcggcctgaacctggcggcagcgcaaaagatg

SEQ ID NO: 99898 - DNA, 103 bp, Artificial Sequence
  Synthetic Polynucleotide
taatacgactcactatagggtcctcatccatatcaattggatcaggccgcaacagaggagagcggccatgtccaattgaaacctggcggcagcgcaaaagatg

SEQ ID NO: 99899 - DNA, 103 bp, Artificial Sequence
  Synthetic Polynucleotide
taatacgactcactatagggctcaagttcatcctcatccatatcaattggaacagaggagaccaattatgatggatgagaacctggcggcagcgcaaaagatg

SEQ ID NO: 99900 - DNA, 103 bp, Artificial Sequence
  Synthetic Polynucleotide
taatacgactcactatagggcagaaagcatctcaagttcatcctcatccaaacagaggagatggatgatgatgaacttgaacctggcggcagcgcaaaagatg

SEQ ID NO: 99901 - DNA, 103 bp, Artificial Sequence
  Synthetic Polynucleotide
taatacgactcactataggggctctggcttcagaaagcatctcaagttcaaacagaggagatgaactatggatgctttcaacctggcggcagcgcaaaagatg

SEQ ID NO: 99902 - DNA, 103 bp, Artificial Sequence
  Synthetic Polynucleotide
taatacgactcactatagggagccaagcgggctctggcttcagaaagcataacagaggagaatgcttatggaagccagaaacctggcggcagcgcaaaagatg

SEQ ID NO: 99903 - DNA, 103 bp, Artificial Sequence
  Synthetic Polynucleotide
taatacgactcactatagggcctgagtattagccaagcgggctctggcttaacagaggagaaagccaatgcccgcttggaacctggcggcagcgcaaaagatg

SEQ ID NO: 99904 - DNA, 103 bp, Artificial Sequence
  Synthetic Polynucleotide
taatacgactcactataggggccttctttccctgagtattagccaagcggaacagaggagaccgcttatgtaatactcaaacctggcggcagcgcaaaagatg

SEQ ID NO: 99905 - DNA, 103 bp, Artificial Sequence
  Synthetic Polynucleotide
taatacgactcactatagggtttcctcttggccttctttccctgagtattaacagaggagaaatactatgggaaagaagaacctggcggcagcgcaaaagatg

SEQ ID NO: 99906 - DNA, 103 bp, Artificial Sequence
  Synthetic Polynucleotide
taatacgactcactatagggttaccgctgctttcagaatttcatcctcggaacagaggagaccgaggatgaaattctgaaacctggcggcagcgcaaaagatg

SEQ ID NO: 99907 - DNA, 103 bp, Artificial Sequence
  Synthetic Polynucleotide
taatacgactcactatagggtctctcttgctttcctcttggccttctttcaacagaggagagaaagaatgccaagaggaaacctggcggcagcgcaaaagatg

SEQ ID NO: 99908 - DNA, 103 bp, Artificial Sequence
  Synthetic Polynucleotide
taatacgactcactatagggtccaattgtttctctcttgctttcctcttgaacagaggagacaagagatgagcaagagaaacctggcggcagcgcaaaagatg

SEQ ID NO: 99909 - DNA, 103 bp, Artificial Sequence
  Synthetic Polynucleotide
taatacgactcactatagggtcttgcttcttccaattgtttctctcttgcaacagaggagagcaagaatgaaacaattgaacctggcggcagcgcaaaagatg

SEQ ID NO: 99910 - DNA, 103 bp, Artificial Sequence
  Synthetic Polynucleotide
taatacgactcactatagggcagcaagacgtcttgcttcttccaattgttaacagaggagaaacaatatgaagaagcaaaacctggcggcagcgcaaaagatg

SEQ ID NO: 99911 - DNA, 103 bp, Artificial Sequence
  Synthetic Polynucleotide
taatacgactcactatagggttttggagggcagcaagacgtcttgcttctaacagaggagaagaagcatgacgtcttgcaacctggcggcagcgcaaaagatg

SEQ ID NO: 99912 - DNA, 103 bp, Artificial Sequence
  Synthetic Polynucleotide
taatacgactcactatagggttctcttcttttttggagggcagcaagacgaacagaggagacgtcttatggccctccaaaacctggcggcagcgcaaaagatg

SEQ ID NO: 99913 - DNA, 103 bp, Artificial Sequence
  Synthetic Polynucleotide
taatacgactcactatagggctgctcgaagttctcttcttttttggagggaacagaggagaccctccatgaaagaagagaacctggcggcagcgcaaaagatg

SEQ ID NO: 99914 - DNA, 103 bp, Artificial Sequence
  Synthetic Polynucleotide
taatacgactcactatagggtctatgccagctgctcgaagttctcttcttaacagaggagaaagaagatgacttcgagcaacctggcggcagcgcaaaagatg

SEQ ID NO: 99915 - DNA, 103 bp, Artificial Sequence
  Synthetic Polynucleotide
taatacgactcactatagggcttctgaatttctatgccagctgctcgaagaacagaggagacttcgaatggctggcataaacctggcggcagcgcaaaagatg

SEQ ID NO: 99916 - DNA, 103 bp, Artificial Sequence
  Synthetic Polynucleotide
taatacgactcactatagggtttttcttttcttctgaatttctatgccagaacagaggagactggcaatgaaattcagaaacctggcggcagcgcaaaagatg

SEQ ID NO: 99917 - DNA, 103 bp, Artificial Sequence
  Synthetic Polynucleotide
taatacgactcactatagggccatatttcattaccgctgctttcagaattaacagaggagaaattctatgagcagcggtaacctggcggcagcgcaaaagatg

SEQ ID NO: 99918 - DNA, 103 bp, Artificial Sequence
  Synthetic Polynucleotide
taatacgactcactatagggcctctcttcctttttcttttcttctgaattaacagaggagaaattcaatggaaaagaaaaacctggcggcagcgcaaaagatg

SEQ ID NO: 99919 - DNA, 103 bp, Artificial Sequence
  Synthetic Polynucleotide
taatacgactcactatagggataatcaactcctctcttcctttttcttttaacagaggagaaaaagaatgaggaagagaaacctggcggcagcgcaaaagatg

SEQ ID NO: 99920 - DNA, 103 bp, Artificial Sequence
  Synthetic Polynucleotide
taatacgactcactatagggtttcggcattataatcaactcctctcttccaacagaggagaggaagaatggagttgattaacctggcggcagcgcaaaagatg

SEQ ID NO: 99921 - DNA, 103 bp, Artificial Sequence
  Synthetic Polynucleotide
taatacgactcactatagggtcaaatgggatttcggcattataatcaactaacagaggagaagttgaatgtaatgccgaaacctggcggcagcgcaaaagatg

SEQ ID NO: 99922 - DNA, 103 bp, Artificial Sequence
  Synthetic Polynucleotide
taatacgactcactatagggaggctttttttcaaatgggatttcggcattaacagaggagaaatgccatgatcccatttaacctggcggcagcgcaaaagatg

SEQ ID NO: 99923 - DNA, 103 bp, Artificial Sequence
  Synthetic Polynucleotide
taatacgactcactatagggaaccaagggcaggctttttttcaaatgggaaacagaggagatcccatatgaaaaaaagcaacctggcggcagcgcaaaagatg

SEQ ID NO: 99924 - DNA, 103 bp, Artificial Sequence
  Synthetic Polynucleotide
taatacgactcactataggggtatcataaaaaccaagggcaggcttttttaacagaggagaaaaaaaatgtgcccttggaacctggcggcagcgcaaaagatg

SEQ ID NO: 99925 - DNA, 103 bp, Artificial Sequence
  Synthetic Polynucleotide
taatacgactcactatagggttcctcagaagtatcataaaaaccaagggcaacagaggagagcccttatgttttatgataacctggcggcagcgcaaaagatg

SEQ ID NO: 99926 - DNA, 103 bp, Artificial Sequence
  Synthetic Polynucleotide
taatacgactcactatagggcttggtagttttcctcagaagtatcataaaaacagaggagatttatgatgcttctgaggaacctggcggcagcgcaaaagatg

SEQ ID NO: 99927 - DNA, 103 bp, Artificial Sequence
  Synthetic Polynucleotide
taatacgactcactataggggcgtcaagagcttggtagttttcctcagaaaacagaggagattctgaatgaaactaccaaacctggcggcagcgcaaaagatg

SEQ ID NO: 99928 - DNA, 103 bp, Artificial Sequence
  Synthetic Polynucleotide
taatacgactcactatagggctgatttttcccatatttcattaccgctgcaacagaggagagcagcgatgatgaaatataacctggcggcagcgcaaaagatg

SEQ ID NO: 99929 - DNA, 103 bp, Artificial Sequence
  Synthetic Polynucleotide
taatacgactcactatagggcctgaaatctgcgtcaagagcttggtagttaacagaggagaaactacatggctcttgacaacctggcggcagcgcaaaagatg

SEQ ID NO: 99930 - DNA, 103 bp, Artificial Sequence
  Synthetic Polynucleotide
taatacgactcactataggggtcttaatttcctgaaatctgcgtcaagagaacagaggagactcttgatgcagatttcaaacctggcggcagcgcaaaagatg

SEQ ID NO: 99931 - DNA, 103 bp, Artificial Sequence
  Synthetic Polynucleotide
taatacgactcactatagggagatcctgttgtcttaatttcctgaaatctaacagaggagaagatttatggaaattaagaacctggcggcagcgcaaaagatg

SEQ ID NO: 99932 - DNA, 103 bp, Artificial Sequence
  Synthetic Polynucleotide
taatacgactcactatagggctccccatcaagatcctgttgtcttaatttaacagaggagaaaattaatgcaacaggataacctggcggcagcgcaaaagatg

SEQ ID NO: 99933 - DNA, 103 bp, Artificial Sequence
  Synthetic Polynucleotide
taatacgactcactatagggcagatcttagctccccatcaagatcctgttaacagaggagaaacaggatgttgatggggaacctggcggcagcgcaaaagatg

SEQ ID NO: 99934 - DNA, 103 bp, Artificial Sequence
  Synthetic Polynucleotide
taatacgactcactatagggccttctttttcagatcttagctccccatcaaacagaggagatgatggatggctaagatcaacctggcggcagcgcaaaagatg

SEQ ID NO: 99935 - DNA, 103 bp, Artificial Sequence
  Synthetic Polynucleotide
taatacgactcactatagggtctatctcttccttctttttcagatcttagaacagaggagactaagaatggaaaaagaaaacctggcggcagcgcaaaagatg

SEQ ID NO: 99936 - DNA, 103 bp, Artificial Sequence
  Synthetic Polynucleotide
taatacgactcactatagggtgtctttttttctatctcttccttctttttaacagaggagaaaaaagatggaagagataaacctggcggcagcgcaaaagatg

SEQ ID NO: 99937 - DNA, 103 bp, Artificial Sequence
  Synthetic Polynucleotide
taatacgactcactatagggaaatgctgtttgtctttttttctatctcttaacagaggagaaagagaatgaaaaaaagaaacctggcggcagcgcaaaagatg

SEQ ID NO: 99938 - DNA, 103 bp, Artificial Sequence
  Synthetic Polynucleotide
taatacgactcactatagggtttccttttcaaatgctgtttgtcttttttaacagaggagaaaaaaaatgaaacagcataacctggcggcagcgcaaaagatg

SEQ ID NO: 99939 - DNA, 103 bp, Artificial Sequence
  Synthetic Polynucleotide
taatacgactcactatagggtcctagaccactgatttttcccatatttcaaacagaggagatgaaatatgggaaaaatcaacctggcggcagcgcaaaagatg

SEQ ID NO: 99940 - DNA, 103 bp, Artificial Sequence
  Synthetic Polynucleotide
taatacgactcactatagggcagattcttttttccttttcaaatgctgttaacagaggagaaacagcatgtgaaaaggaaacctggcggcagcgcaaaagatg

SEQ ID NO: 99941 - DNA, 103 bp, Artificial Sequence
  Synthetic Polynucleotide
taatacgactcactataggggatggtaaatcagattcttttttccttttcaacagaggagagaaaagatgaaaagaatcaacctggcggcagcgcaaaagatg

SEQ ID NO: 99942 - DNA, 103 bp, Artificial Sequence
  Synthetic Polynucleotide
taatacgactcactatagggaagaatagctgatggtaaatcagattctttaacagaggagaaaagaaatggatttaccaaacctggcggcagcgcaaaagatg

SEQ ID NO: 99943 - DNA, 103 bp, Artificial Sequence
  Synthetic Polynucleotide
taatacgactcactatagggcactagtttgaagaatagctgatggtaaataacagaggagaatttacatgcagctattcaacctggcggcagcgcaaaagatg

SEQ ID NO: 99944 - DNA, 103 bp, Artificial Sequence
  Synthetic Polynucleotide
taatacgactcactatagggtcagaaacaccactagtttgaagaatagctaacagaggagaagctatatgtcaaactagaacctggcggcagcgcaaaagatg

SEQ ID NO: 99945 - DNA, 103 bp, Artificial Sequence
  Synthetic Polynucleotide
taatacgactcactatagggtttagtaaattcagaaacaccactagtttgaacagaggagacaaactatgggtgtttctaacctggcggcagcgcaaaagatg

SEQ ID NO: 99946 - DNA, 103 bp, Artificial Sequence
  Synthetic Polynucleotide
taatacgactcactatagggtgcttctctttttagtaaattcagaaacacaacagaggagagtgtttatgaatttactaaacctggcggcagcgcaaaagatg

SEQ ID NO: 99947 - DNA, 103 bp, Artificial Sequence
  Synthetic Polynucleotide
taatacgactcactatagggagtactagtttgcttctctttttagtaaataacagaggagaatttacatgaaagagaagaacctggcggcagcgcaaaagatg

SEQ ID NO: 99948 - DNA, 103 bp, Artificial Sequence
  Synthetic Polynucleotide
taatacgactcactatagggaggggcaggaagtactagtttgcttctcttaacagaggagaaagagaatgaaactagtaaacctggcggcagcgcaaaagatg

SEQ ID NO: 99949 - DNA, 103 bp, Artificial Sequence
  Synthetic Polynucleotide
taatacgactcactatagggctgaaatctgaggggcaggaagtactagttaacagaggagaaactagatgttcctgcccaacctggcggcagcgcaaaagatg

SEQ ID NO: 99950 - DNA, 103 bp, Artificial Sequence
  Synthetic Polynucleotide
taatacgactcactatagggaatgaggcaatcctagaccactgatttttcaacagaggagagaaaaaatggtggtctagaacctggcggcagcgcaaaagatg

SEQ ID NO: 99951 - DNA, 103 bp, Artificial Sequence
  Synthetic Polynucleotide
taatacgactcactatagggagttctgcatctgaaatctgaggggcaggaaacagaggagatcctgcatgtcagatttcaacctggcggcagcgcaaaagatg

SEQ ID NO: 99952 - DNA, 103 bp, Artificial Sequence
  Synthetic Polynucleotide
taatacgactcactatagggaacttcctggagttctgcatctgaaatctgaacagaggagacagattatggatgcagaaaacctggcggcagcgcaaaagatg

SEQ ID NO: 99953 - DNA, 103 bp, Artificial Sequence
  Synthetic Polynucleotide
taatacgactcactatagggctacttttacaacttcctggagttctgcataacagaggagaatgcagatgtccaggaagaacctggcggcagcgcaaaagatg

SEQ ID NO: 99954 - DNA, 103 bp, Artificial Sequence
  Synthetic Polynucleotide
taatacgactcactatagggctcgcttggcctacttttacaacttcctggaacagaggagaccaggaatgtgtaaaagtaacctggcggcagcgcaaaagatg

SEQ ID NO: 99955 - DNA, 103 bp, Artificial Sequence
  Synthetic Polynucleotide
taatacgactcactatagggtgcaatttcactcgcttggcctacttttacaacagaggagagtaaaaatgggccaagcgaacctggcggcagcgcaaaagatg

SEQ ID NO: 99956 - DNA, 103 bp, Artificial Sequence
  Synthetic Polynucleotide
taatacgactcactatagggcagtttgacgtgcaatttcactcgcttggcaacagaggagagccaagatggtgaaattgaacctggcggcagcgcaaaagatg

SEQ ID NO: 99957 - DNA, 103 bp, Artificial Sequence
  Synthetic Polynucleotide
taatacgactcactataggggattcctcggcagtttgacgtgcaatttcaaacagaggagatgaaatatgacgtcaaacaacctggcggcagcgcaaaagatg

SEQ ID NO: 99958 - DNA, 103 bp, Artificial Sequence
  Synthetic Polynucleotide
taatacgactcactatagggtgttatgccagattcctcggcagtttgacgaacagaggagacgtcaaatggccgaggaaaacctggcggcagcgcaaaagatg

SEQ ID NO: 99959 - DNA, 103 bp, Artificial Sequence
  Synthetic Polynucleotide
taatacgactcactatagggaagcagaatttgttatgccagattcctcggaacagaggagaccgaggatgctggcataaaacctggcggcagcgcaaaagatg

SEQ ID NO: 99960 - DNA, 103 bp, Artificial Sequence
  Synthetic Polynucleotide
taatacgactcactatagggagtgtactggaagcagaatttgttatgccaaacagaggagatggcatatgaaattctgcaacctggcggcagcgcaaaagatg

SEQ ID NO: 99961 - DNA, 103 bp, Artificial Sequence
  Synthetic Polynucleotide
taatacgactcactatagggcttgcccccatgtctctctgaattgggcataacagaggagaatgcccatgtcagagagaaacctggcggcagcgcaaaagatg

SEQ ID NO: 99962 - DNA, 103 bp, Artificial Sequence
  Synthetic Polynucleotide
taatacgactcactatagggcgataccaagcggtgacgctctctgctgttaacagaggagaaacagcatggagcgtcacaacctggcggcagcgcaaaagatg

SEQ ID NO: 99963 - DNA, 103 bp, Artificial Sequence
  Synthetic Polynucleotide
taatacgactcactatagggccgcttgctcaggaaagggctgctggaccgaacagaggagacggtccatgagccctttcaacctggcggcagcgcaaaagatg

SEQ ID NO: 99964 - DNA, 103 bp, Artificial Sequence
  Synthetic Polynucleotide
taatacgactcactataggggactcagagaccgcttgctcaggaaagggcaacagaggagagcccttatgtgagcaagcaacctggcggcagcgcaaaagatg

SEQ ID NO: 99965 - DNA, 103 bp, Artificial Sequence
  Synthetic Polynucleotide
taatacgactcactatagggagtggactccgactcagagaccgcttgctcaacagaggagagagcaaatggtctctgagaacctggcggcagcgcaaaagatg

SEQ ID NO: 99966 - DNA, 103 bp, Artificial Sequence
  Synthetic Polynucleotide
taatacgactcactatagggcctactggggagtggactccgactcagagaaacagaggagatctctgatgcggagtccaaacctggcggcagcgcaaaagatg

SEQ ID NO: 99967 - DNA, 103 bp, Artificial Sequence
  Synthetic Polynucleotide
taatacgactcactatagggtcatggatttcctactggggagtggactccaacagaggagaggagtcatgtccccagtaaacctggcggcagcgcaaaagatg

SEQ ID NO: 99968 - DNA, 103 bp, Artificial Sequence
  Synthetic Polynucleotide
taatacgactcactatagggcttctggacttcatggatttcctactggggaacagaggagaccccagatggaaatccataacctggcggcagcgcaaaagatg

SEQ ID NO: 99969 - DNA, 103 bp, Artificial Sequence
  Synthetic Polynucleotide
taatacgactcactatagggaggacttctacttctggacttcatggatttaacagaggagaaaatccatgaagtccagaaacctggcggcagcgcaaaagatg

SEQ ID NO: 99970 - DNA, 103 bp, Artificial Sequence
  Synthetic Polynucleotide
taatacgactcactatagggttgaatatgcaggacttctacttctggactaacagaggagaagtccaatggtagaagtcaacctggcggcagcgcaaaagatg

SEQ ID NO: 99971 - DNA, 103 bp, Artificial Sequence
  Synthetic Polynucleotide
taatacgactcactataggggatgaatgtcttgaatatgcaggacttctaaacagaggagatagaagatgtgcatattcaacctggcggcagcgcaaaagatg

SEQ ID NO: 99972 - DNA, 103 bp, Artificial Sequence
  Synthetic Polynucleotide
taatacgactcactatagggactatgagaagatgaatgtcttgaatatgcaacagaggagagcatatatgagacattcaaacctggcggcagcgcaaaagatg

SEQ ID NO: 99973 - DNA, 103 bp, Artificial Sequence
  Synthetic Polynucleotide
taatacgactcactataggggcttgtgcttcgataccaagcggtgacgctaacagaggagaagcgtcatggcttggtataacctggcggcagcgcaaaagatg

SEQ ID NO: 99974 - DNA, 103 bp, Artificial Sequence
  Synthetic Polynucleotide
taatacgactcactatagggtcttctttttactatgagaagatgaatgtcaacagaggagagacattatgcttctcataaacctggcggcagcgcaaaagatg

SEQ ID NO: 99975 - DNA, 103 bp, Artificial Sequence
  Synthetic Polynucleotide
taatacgactcactataggggaactggatctcttctttttactatgagaaaacagaggagattctcaatgtaaaaagaaaacctggcggcagcgcaaaagatg

SEQ ID NO: 99976 - DNA, 103 bp, Artificial Sequence
  Synthetic Polynucleotide
taatacgactcactatagggacgactgcgtgaactggatctcttctttttaacagaggagaaaaaagatgagatccagtaacctggcggcagcgcaaaagatg

SEQ ID NO: 99977 - DNA, 103 bp, Artificial Sequence
  Synthetic Polynucleotide
taatacgactcactatagggtactggaatgacgactgcgtgaactggatcaacagaggagagatccaatgcacgcagtcaacctggcggcagcgcaaaagatg

SEQ ID NO: 99978 - DNA, 103 bp, Artificial Sequence
  Synthetic Polynucleotide
taatacgactcactatagggacaggtgagatactggaatgacgactgcgtaacagaggagaacgcagatgtcattccagaacctggcggcagcgcaaaagatg

SEQ ID NO: 99979 - DNA, 103 bp, Artificial Sequence
  Synthetic Polynucleotide
taatacgactcactatagggtggaagcctgacaggtgagatactggaatgaacagaggagacattccatgatctcacctaacctggcggcagcgcaaaagatg

SEQ ID NO: 99980 - DNA, 103 bp, Artificial Sequence
  Synthetic Polynucleotide
taatacgactcactatagggtggaattaagtggaagcctgacaggtgagaaacagaggagatctcacatgtcaggcttcaacctggcggcagcgcaaaagatg

SEQ ID NO: 99981 - DNA, 103 bp, Artificial Sequence
  Synthetic Polynucleotide
taatacgactcactataggggctcccagactggaattaagtggaagcctgaacagaggagacaggctatgacttaattcaacctggcggcagcgcaaaagatg

SEQ ID NO: 99982 - DNA, 103 bp, Artificial Sequence
  Synthetic Polynucleotide
taatacgactcactatagggactgagttcagctcccagactggaattaagaacagaggagacttaatatgagtctgggaaacctggcggcagcgcaaaagatg

SEQ ID NO: 99983 - DNA, 103 bp, Artificial Sequence
  Synthetic Polynucleotide
taatacgactcactatagggtctttttcctactgagttcagctcccagacaacagaggagagtctggatgctgaactcaaacctggcggcagcgcaaaagatg

SEQ ID NO: 99984 - DNA, 103 bp, Artificial Sequence
  Synthetic Polynucleotide
taatacgactcactataggggacttatgccgcttgtgcttcgataccaagaacagaggagacttggtatggaagcacaaaacctggcggcagcgcaaaagatg

SEQ ID NO: 99985 - DNA, 103 bp, Artificial Sequence
  Synthetic Polynucleotide
taatacgactcactataggggctctttccttctttttcctactgagttcaaacagaggagatgaactatgtaggaaaaaaacctggcggcagcgcaaaagatg

SEQ ID NO: 99986 - DNA, 103 bp, Artificial Sequence
  Synthetic Polynucleotide
taatacgactcactatagggagcagcagctgctctttccttctttttcctaacagaggagaaggaaaatgaaggaaagaaacctggcggcagcgcaaaagatg

SEQ ID NO: 99987 - DNA, 103 bp, Artificial Sequence
  Synthetic Polynucleotide
taatacgactcactatagggttgctgcagcagcagcagctgctctttcctaacagaggagaaggaaaatgcagctgctgaacctggcggcagcgcaaaagatg

SEQ ID NO: 99988 - DNA, 103 bp, Artificial Sequence
  Synthetic Polynucleotide
taatacgactcactatagggccatccatctttgctgcagcagcagcagctaacagaggagaagctgcatgtgctgcagcaacctggcggcagcgcaaaagatg

SEQ ID NO: 99989 - DNA, 103 bp, Artificial Sequence
  Synthetic Polynucleotide
taatacgactcactatagggggactcctttccatccatctttgctgcagcaacagaggagagctgcaatgaagatggataacctggcggcagcgcaaaagatg

SEQ ID NO: 99990 - DNA, 103 bp, Artificial Sequence
  Synthetic Polynucleotide
taatacgactcactataggggtgaacccttggactcctttccatccatctaacagaggagaagatggatggaaaggagtaacctggcggcagcgcaaaagatg

SEQ ID NO: 99991 - DNA, 103 bp, Artificial Sequence
  Synthetic Polynucleotide
taatacgactcactatagggaaaaatacaggtgaacccttggactcctttaacagaggagaaaaggaatgcaagggttcaacctggcggcagcgcaaaagatg

SEQ ID NO: 99992 - DNA, 103 bp, Artificial Sequence
  Synthetic Polynucleotide
taatacgactcactatagggttttctaggcaaaaatacaggtgaacccttaacagaggagaaagggtatgcctgtatttaacctggcggcagcgcaaaagatg

SEQ ID NO: 99993 - DNA, 103 bp, Artificial Sequence
  Synthetic Polynucleotide
taatacgactcactatagggaactgttctcttttctaggcaaaaatacagaacagaggagactgtatatgtgcctagaaaacctggcggcagcgcaaaagatg

SEQ ID NO: 99994 - DNA, 103 bp, Artificial Sequence
  Synthetic Polynucleotide
taatacgactcactataggggcctctactgaactgttctcttttctaggcaacagaggagagcctagatgagagaacagaacctggcggcagcgcaaaagatg

SEQ ID NO: 99995 - DNA, 103 bp, Artificial Sequence
  Synthetic Polynucleotide
taatacgactcactatagggggagtgtttggacttatgccgcttgtgcttaacagaggagaaagcacatgcggcataagaacctggcggcagcgcaaaagatg

SEQ ID NO: 99996 - DNA, 103 bp, Artificial Sequence
  Synthetic Polynucleotide
taatacgactcactatagggtgaatccttagcctctactgaactgttctcaacagaggagagagaacatgtcagtagagaacctggcggcagcgcaaaagatg

SEQ ID NO: 99997 - DNA, 103 bp, Artificial Sequence
  Synthetic Polynucleotide
taatacgactcactatagggactccaaacctgaatccttagcctctactgaacagaggagacagtagatgctaaggattaacctggcggcagcgcaaaagatg

SEQ ID NO: 99998 - DNA, 103 bp, Artificial Sequence
  Synthetic Polynucleotide
taatacgactcactatagggaactttttagactccaaacctgaatccttaaacagaggagataaggaatgaggtttggaaacctggcggcagcgcaaaagatg

SEQ ID NO: 99999 - DNA, 103 bp, Artificial Sequence
  Synthetic Polynucleotide
taatacgactcactatagggacttctgggtaactttttagactccaaaccaacagaggagaggtttgatgtctaaaaagaacctggcggcagcgcaaaagatg

SEQ ID NO: 100000 - DNA, 103 bp, Artificial Sequence
  Synthetic Polynucleotide
taatacgactcactatagggccaattttacacttctgggtaactttttagaacagaggagactaaaaatgtacccagaaaacctggcggcagcgcaaaagatg

SEQ ID NO: 100001 - DNA, 103 bp, Artificial Sequence
  Synthetic Polynucleotide
taatacgactcactataggggcagatttttccaattttacacttctgggtaacagaggagaacccagatgtgtaaaattaacctggcggcagcgcaaaagatg

SEQ ID NO: 100002 - DNA, 103 bp, Artificial Sequence
  Synthetic Polynucleotide
taatacgactcactatagggagtatctggggcagatttttccaattttacaacagaggagagtaaaaatggaaaaatctaacctggcggcagcgcaaaagatg

SEQ ID NO: 100003 - DNA, 103 bp, Artificial Sequence
  Synthetic Polynucleotide
taatacgactcactatagggtcaccagttcagtatctggggcagatttttaacagaggagaaaaaatatgccccagataaacctggcggcagcgcaaaagatg

SEQ ID NO: 100004 - DNA, 103 bp, Artificial Sequence
  Synthetic Polynucleotide
taatacgactcactatagggtgtgttacattcaccagttcagtatctgggaacagaggagacccagaatgtgaactggtaacctggcggcagcgcaaaagatg

SEQ ID NO: 100005 - DNA, 103 bp, Artificial Sequence
  Synthetic Polynucleotide
taatacgactcactatagggtgtgtttagatgtgttacattcaccagttcaacagaggagagaactgatgaatgtaacaaacctggcggcagcgcaaaagatg

SEQ ID NO: 100006 - DNA, 103 bp, Artificial Sequence
  Synthetic Polynucleotide
taatacgactcactatagggccatgtctttggagtgtttggacttatgccaacagaggagaggcataatgccaaacactaacctggcggcagcgcaaaagatg

SEQ ID NO: 100007 - DNA, 103 bp, Artificial Sequence
  Synthetic Polynucleotide
taatacgactcactatagggtttttacctctgtgtttagatgtgttacataacagaggagaatgtaaatgatctaaacaaacctggcggcagcgcaaaagatg

SEQ ID NO: 100008 - DNA, 103 bp, Artificial Sequence
  Synthetic Polynucleotide
taatacgactcactatagggtctgaagaattttttacctctgtgtttagaaacagaggagatctaaaatgagaggtaaaaacctggcggcagcgcaaaagatg

SEQ ID NO: 100009 - DNA, 103 bp, Artificial Sequence
  Synthetic Polynucleotide
taatacgactcactatagggtttccctgtatctgaagaattttttacctcaacagaggagagaggtaatgaattcttcaaacctggcggcagcgcaaaagatg

SEQ ID NO: 100010 - DNA, 103 bp, Artificial Sequence
  Synthetic Polynucleotide
taatacgactcactatagggccaactttactttccctgtatctgaagaataacagaggagaattcttatgatacagggaaacctggcggcagcgcaaaagatg

SEQ ID NO: 100011 - DNA, 103 bp, Artificial Sequence
  Synthetic Polynucleotide
taatacgactcactataggggagttctcatccaactttactttccctgtaaacagaggagatacaggatgagtaaagttaacctggcggcagcgcaaaagatg

SEQ ID NO: 100012 - DNA, 103 bp, Artificial Sequence
  Synthetic Polynucleotide
taatacgactcactatagggatgcttctcggagttctcatccaactttacaacagaggagagtaaagatggatgagaacaacctggcggcagcgcaaaagatg

SEQ ID NO: 100013 - DNA, 103 bp, Artificial Sequence
  Synthetic Polynucleotide
taatacgactcactatagggctttaacaagatgcttctcggagttctcataacagaggagaatgagaatgccgagaagcaacctggcggcagcgcaaaagatg

SEQ ID NO: 100014 - DNA, 103 bp, Artificial Sequence
  Synthetic Polynucleotide
taatacgactcactataggggctttcaaatctttaacaagatgcttctcgaacagaggagacgagaaatgtcttgttaaaacctggcggcagcgcaaaagatg

SEQ ID NO: 100015 - DNA, 103 bp, Artificial Sequence
  Synthetic Polynucleotide
taatacgactcactatagggtgttccctgtgctttcaaatctttaacaagaacagaggagacttgttatggatttgaaaaacctggcggcagcgcaaaagatg

SEQ ID NO: 100016 - DNA, 103 bp, Artificial Sequence
  Synthetic Polynucleotide
taatacgactcactatagggtagagtctcttgttccctgtgctttcaaataacagaggagaatttgaatgcacagggaaaacctggcggcagcgcaaaagatg

SEQ ID NO: 100017 - DNA, 103 bp, Artificial Sequence
  Synthetic Polynucleotide
taatacgactcactataggggtcaccaaccccatgtctttggagtgtttgaacagaggagacaaacaatgcaaagacataacctggcggcagcgcaaaagatg

SEQ ID NO: 100018 - DNA, 103 bp, Artificial Sequence
  Synthetic Polynucleotide
taatacgactcactataggggctatgggtttagagtctcttgttccctgtaacagaggagaacagggatgaagagactcaacctggcggcagcgcaaaagatg

SEQ ID NO: 100019 - DNA, 103 bp, Artificial Sequence
  Synthetic Polynucleotide
taatacgactcactatagggctctttcagtgctatgggtttagagtctctaacagaggagaagagacatgaaacccataaacctggcggcagcgcaaaagatg

SEQ ID NO: 100020 - DNA, 103 bp, Artificial Sequence
  Synthetic Polynucleotide
taatacgactcactatagggtaacaatctcctctttcagtgctatgggttaacagaggagaaacccaatgcactgaaagaacctggcggcagcgcaaaagatg

SEQ ID NO: 100021 - DNA, 103 bp, Artificial Sequence
  Synthetic Polynucleotide
taatacgactcactatagggtcctttggagtaacaatctcctctttcagtaacagaggagaactgaaatgggagattgtaacctggcggcagcgcaaaagatg

SEQ ID NO: 100022 - DNA, 103 bp, Artificial Sequence
  Synthetic Polynucleotide
taatacgactcactatagggtgtttctgtctcctttggagtaacaatctcaacagaggagagagattatgactccaaagaacctggcggcagcgcaaaagatg

SEQ ID NO: 100023 - DNA, 103 bp, Artificial Sequence
  Synthetic Polynucleotide
taatacgactcactatagggccttttctgatgtttctgtctcctttggagaacagaggagactccaaatgagacagaaaaacctggcggcagcgcaaaagatg

SEQ ID NO: 100024 - DNA, 103 bp, Artificial Sequence
  Synthetic Polynucleotide
taatacgactcactatagggggaggggtctccttttctgatgtttctgtcaacagaggagagacagaatgatcagaaaaaacctggcggcagcgcaaaagatg

SEQ ID NO: 100025 - DNA, 103 bp, Artificial Sequence
  Synthetic Polynucleotide
taatacgactcactataggggggaagaggtggaggggtctccttttctgaaacagaggagatcagaaatggagacccctaacctggcggcagcgcaaaagatg

SEQ ID NO: 100026 - DNA, 103 bp, Artificial Sequence
  Synthetic Polynucleotide
taatacgactcactatagggaagcaattgtgggaagaggtggaggggtctaacagaggagaagacccatgcacctcttcaacctggcggcagcgcaaaagatg

SEQ ID NO: 100027 - DNA, 103 bp, Artificial Sequence
  Synthetic Polynucleotide
taatacgactcactatagggggtgggggagaagcaattgtgggaagaggtaacagaggagaacctctatgcacaattgcaacctggcggcagcgcaaaagatg

SEQ ID NO: 100028 - DNA, 103 bp, Artificial Sequence
  Synthetic Polynucleotide
taatacgactcactatagggtgcttcgggggtcaccaaccccatgtctttaacagaggagaaaagacatggggttggtgaacctggcggcagcgcaaaagatg

SEQ ID NO: 100029 - DNA, 103 bp, Artificial Sequence
  Synthetic Polynucleotide
taatacgactcactatagggtggtagagggggtgggggagaagcaattgtaacagaggagaacaattatgtctcccccaaacctggcggcagcgcaaaagatg

SEQ ID NO: 100030 - DNA, 103 bp, Artificial Sequence
  Synthetic Polynucleotide
taatacgactcactataggggggtagtagttggtagagggggtgggggagaacagaggagactccccatgcccctctacaacctggcggcagcgcaaaagatg

SEQ ID NO: 100031 - DNA, 103 bp, Artificial Sequence
  Synthetic Polynucleotide
taatacgactcactatagggtgaggtggaggggtagtagttggtagagggaacagaggagaccctctatgaactactacaacctggcggcagcgcaaaagatg

SEQ ID NO: 100032 - DNA, 103 bp, Artificial Sequence
  Synthetic Polynucleotide
taatacgactcactatagggagggggtgtctgaggtggaggggtagtagtaacagaggagaactactatgcctccacctaacctggcggcagcgcaaaagatg

SEQ ID NO: 100033 - DNA, 103 bp, Artificial Sequence
  Synthetic Polynucleotide
taatacgactcactatagggaaggtggcaaagggggtgtctgaggtggagaacagaggagactccacatgagacaccccaacctggcggcagcgcaaaagatg

SEQ ID NO: 100034 - DNA, 103 bp, Artificial Sequence
  Synthetic Polynucleotide
taatacgactcactatagggattggaggcaaaggtggcaaagggggtgtcaacagaggagagacaccatgtttgccaccaacctggcggcagcgcaaaagatg

SEQ ID NO: 100035 - DNA, 103 bp, Artificial Sequence
  Synthetic Polynucleotide
taatacgactcactatagggaagagctggtattggaggcaaaggtggcaaaacagaggagattgccaatgttgcctccaaacctggcggcagcgcaaaagatg

SEQ ID NO: 100036 - DNA, 103 bp, Artificial Sequence
  Synthetic Polynucleotide
taatacgactcactataggggttgctgtggaagagctggtattggaggcaaacagaggagatgcctcatgtaccagctcaacctggcggcagcgcaaaagatg

SEQ ID NO: 100037 - DNA, 103 bp, Artificial Sequence
  Synthetic Polynucleotide
taatacgactcactatagggggcagaggtggttgctgtggaagagctggtaacagaggagaaccagcatgtccacagcaaacctggcggcagcgcaaaagatg

SEQ ID NO: 100038 - DNA, 103 bp, Artificial Sequence
  Synthetic Polynucleotide
taatacgactcactatagggctgagaaggaggcagaggtggttgctgtggaacagaggagaccacagatgccacctctgaacctggcggcagcgcaaaagatg

SEQ ID NO: 100039 - DNA, 103 bp, Artificial Sequence
  Synthetic Polynucleotide
taatacgactcactatagggccagggatgctgcttcgggggtcaccaaccaacagaggagaggttggatgcccccgaagaacctggcggcagcgcaaaagatg

SEQ ID NO: 100040 - DNA, 103 bp, Artificial Sequence
  Synthetic Polynucleotide
taatacgactcactatagggtaaatgctggctgagaaggaggcagaggtgaacagaggagacacctcatgctccttctcaacctggcggcagcgcaaaagatg

SEQ ID NO: 100041 - DNA, 103 bp, Artificial Sequence
  Synthetic Polynucleotide
taatacgactcactatagggggaacctgactaaatgctggctgagaaggaaacagaggagatccttcatggccagcattaacctggcggcagcgcaaaagatg

SEQ ID NO: 100042 - DNA, 103 bp, Artificial Sequence
  Synthetic Polynucleotide
taatacgactcactatagggactggaagcaggaacctgactaaatgctggaacagaggagaccagcaatgagtcaggttaacctggcggcagcgcaaaagatg

SEQ ID NO: 100043 - DNA, 103 bp, Artificial Sequence
  Synthetic Polynucleotide
taatacgactcactatagggaagttgaagtactggaagcaggaacctgacaacagaggagagtcaggatgctgcttccaaacctggcggcagcgcaaaagatg

SEQ ID NO: 100044 - DNA, 103 bp, Artificial Sequence
  Synthetic Polynucleotide
taatacgactcactataggggaagggggcaaagttgaagtactggaagcaaacagaggagatgcttcatgtacttcaacaacctggcggcagcgcaaaagatg

SEQ ID NO: 100045 - DNA, 103 bp, Artificial Sequence
  Synthetic Polynucleotide
taatacgactcactatagggtgagtgagtagaagggggcaaagttgaagtaacagaggagaacttcaatgttgccccctaacctggcggcagcgcaaaagatg

SEQ ID NO: 100046 - DNA, 103 bp, Artificial Sequence
  Synthetic Polynucleotide
taatacgactcactatagggcagatgtctttgagtgagtagaagggggcaaacagaggagatgccccatgctactcactaacctggcggcagcgcaaaagatg

SEQ ID NO: 100047 - DNA, 103 bp, Artificial Sequence
  Synthetic Polynucleotide
taatacgactcactataggggaggacacagcagatgtctttgagtgagtaaacagaggagatactcaatgaaagacatcaacctggcggcagcgcaaaagatg

SEQ ID NO: 100048 - DNA, 103 bp, Artificial Sequence
  Synthetic Polynucleotide
taatacgactcactatagggatttgcctgagaggacacagcagatgtcttaacagaggagaaagacaatggctgtgtccaacctggcggcagcgcaaaagatg

SEQ ID NO: 100049 - DNA, 103 bp, Artificial Sequence
  Synthetic Polynucleotide
taatacgactcactatagggggggctgagaatttgcctgagaggacacagaacagaggagactgtgtatgctcaggcaaaacctggcggcagcgcaaaagatg

SEQ ID NO: 100050 - DNA, 103 bp, Artificial Sequence
  Synthetic Polynucleotide
taatacgactcactatagggataactgtgcccagggatgctgcttcggggaacagaggagaccccgaatgagcatccctaacctggcggcagcgcaaaagatg

SEQ ID NO: 100051 - DNA, 103 bp, Artificial Sequence
  Synthetic Polynucleotide
taatacgactcactatagggacctgtacagggggctgagaatttgcctgaaacagaggagatcaggcatgttctcagccaacctggcggcagcgcaaaagatg

SEQ ID NO: 100052 - DNA, 103 bp, Artificial Sequence
  Synthetic Polynucleotide
taatacgactcactatagggcttcacagaaacctgtacagggggctgagaaacagaggagatctcagatgcctgtacagaacctggcggcagcgcaaaagatg

SEQ ID NO: 100053 - DNA, 103 bp, Artificial Sequence
  Synthetic Polynucleotide
taatacgactcactatagggatacttgagtcttcacagaaacctgtacagaacagaggagactgtacatgtttctgtgaaacctggcggcagcgcaaaagatg

SEQ ID NO: 100054 - DNA, 103 bp, Artificial Sequence
  Synthetic Polynucleotide
taatacgactcactataggggctgttacagatacttgagtcttcacagaaaacagaggagattctgtatggactcaagtaacctggcggcagcgcaaaagatg

SEQ ID NO: 100055 - DNA, 103 bp, Artificial Sequence
  Synthetic Polynucleotide
taatacgactcactatagggtggaatagcagctgttacagatacttgagtaacagaggagaactcaaatgtctgtaacaaacctggcggcagcgcaaaagatg

SEQ ID NO: 100056 - DNA, 103 bp, Artificial Sequence
  Synthetic Polynucleotide
taatacgactcactatagggttttcaggtgtggaatagcagctgttacagaacagaggagactgtaaatgctgctattcaacctggcggcagcgcaaaagatg

SEQ ID NO: 100057 - DNA, 103 bp, Artificial Sequence
  Synthetic Polynucleotide
taatacgactcactatagggaacgttgaagttttcaggtgtggaatagcaaacagaggagatgctatatgacacctgaaaacctggcggcagcgcaaaagatg

SEQ ID NO: 100058 - DNA, 103 bp, Artificial Sequence
  Synthetic Polynucleotide
taatacgactcactatagggcaaaggaggcaacgttgaagttttcaggtgaacagaggagacacctgatgacttcaacgaacctggcggcagcgcaaaagatg

SEQ ID NO: 100059 - DNA, 103 bp, Artificial Sequence
  Synthetic Polynucleotide
taatacgactcactataggggtgggaggggcaaaggaggcaacgttgaagaacagaggagacttcaaatgtgcctccttaacctggcggcagcgcaaaagatg

SEQ ID NO: 100060 - DNA, 103 bp, Artificial Sequence
  Synthetic Polynucleotide
taatacgactcactatagggggtaataagggtgggaggggcaaaggaggcaacagaggagagcctccatggcccctcccaacctggcggcagcgcaaaagatg

SEQ ID NO: 100061 - DNA, 103 bp, Artificial Sequence
  Synthetic Polynucleotide
taatacgactcactatagggcaaaggtttgataactgtgcccagggatgcaacagaggagagcatccatgggcacagttaacctggcggcagcgcaaaagatg

SEQ ID NO: 100062 - DNA, 103 bp, Artificial Sequence
  Synthetic Polynucleotide
taatacgactcactatagggatcatctccaggtaataagggtgggaggggaacagaggagacccctcatgcccttattaaacctggcggcagcgcaaaagatg

SEQ ID NO: 100063 - DNA, 103 bp, Artificial Sequence
  Synthetic Polynucleotide
taatacgactcactatagggtatccatgtcatcatctccaggtaataaggaacagaggagaccttatatgctggagatgaacctggcggcagcgcaaaagatg

SEQ ID NO: 100064 - DNA, 103 bp, Artificial Sequence
  Synthetic Polynucleotide
taatacgactcactatagggtcttttggactatccatgtcatcatctccaaacagaggagatggagaatgtgacatggaaacctggcggcagcgcaaaagatg

SEQ ID NO: 100065 - DNA, 103 bp, Artificial Sequence
  Synthetic Polynucleotide
taatacgactcactatagggaggaagagtttcttttggactatccatgtcaacagaggagagacatgatgagtccaaaaaacctggcggcagcgcaaaagatg

SEQ ID NO: 100066 - DNA, 103 bp, Artificial Sequence
  Synthetic Polynucleotide
taatacgactcactatagggcaggttttgaaggaagagtttcttttggacaacagaggagagtccaaatgaaactcttcaacctggcggcagcgcaaaagatg

SEQ ID NO: 100067 - DNA, 103 bp, Artificial Sequence
  Synthetic Polynucleotide
taatacgactcactatagggtctttcttcacaggttttgaaggaagagttaacagaggagaaactctatgttcaaaaccaacctggcggcagcgcaaaagatg

SEQ ID NO: 100068 - DNA, 103 bp, Artificial Sequence
  Synthetic Polynucleotide
taatacgactcactatagggctgttccttctctttcttcacaggttttgaaacagaggagatcaaaaatggtgaagaaaaacctggcggcagcgcaaaagatg

SEQ ID NO: 100069 - DNA, 103 bp, Artificial Sequence
  Synthetic Polynucleotide
taatacgactcactataggggacgtgtcctctgttccttctctttcttcaaacagaggagatgaagaatgagaaggaacaacctggcggcagcgcaaaagatg

SEQ ID NO: 100070 - DNA, 103 bp, Artificial Sequence
  Synthetic Polynucleotide
taatacgactcactataggggtgagtaagtgacgtgtcctctgttccttcaacagaggagagaaggaatggaggacacgaacctggcggcagcgcaaaagatg

SEQ ID NO: 100071 - DNA, 103 bp, Artificial Sequence
  Synthetic Polynucleotide
taatacgactcactatagggaggaaggtctgtgagtaagtgacgtgtcctaacagaggagaaggacaatgcacttactcaacctggcggcagcgcaaaagatg

SEQ ID NO: 100072 - DNA, 103 bp, Artificial Sequence
  Synthetic Polynucleotide
taatacgactcactatagggtcccgtccttcttgcccccatgtctctctgaacagaggagacagagaatgatgggggcaaacctggcggcagcgcaaaagatg

SEQ ID NO: 100073 - DNA, 103 bp, Artificial Sequence
  Synthetic Polynucleotide
taatacgactcactatagggcatactccaccaaaggtttgataactgtgcaacagaggagagcacagatgtcaaaccttaacctggcggcagcgcaaaagatg

SEQ ID NO: 100074 - DNA, 103 bp, Artificial Sequence
  Synthetic Polynucleotide
taatacgactcactatagggctggagggagaggaaggtctgtgagtaagtaacagaggagaacttacatgcagaccttcaacctggcggcagcgcaaaagatg

SEQ ID NO: 100075 - DNA, 103 bp, Artificial Sequence
  Synthetic Polynucleotide
taatacgactcactatagggccagggagctctggagggagaggaaggtctaacagaggagaagacctatgtctccctccaacctggcggcagcgcaaaagatg

SEQ ID NO: 100076 - DNA, 103 bp, Artificial Sequence
  Synthetic Polynucleotide
taatacgactcactatagggcagatctccaccagggagctctggagggagaacagaggagactccctatggagctccctaacctggcggcagcgcaaaagatg

SEQ ID NO: 100077 - DNA, 103 bp, Artificial Sequence
  Synthetic Polynucleotide
taatacgactcactatagggctgggggagacagatctccaccagggagctaacagaggagaagctccatggtggagatcaacctggcggcagcgcaaaagatg

SEQ ID NO: 100078 - DNA, 103 bp, Artificial Sequence
  Synthetic Polynucleotide
taatacgactcactatagggtctggagagtctgggggagacagatctccaaacagaggagatggagaatggtctcccccaacctggcggcagcgcaaaagatg

SEQ ID NO: 100079 - DNA, 103 bp, Artificial Sequence
  Synthetic Polynucleotide
taatacgactcactatagggtgcctttggttctggagagtctgggggagaaacagaggagatctcccatggactctccaaacctggcggcagcgcaaaagatg

SEQ ID NO: 100080 - DNA, 103 bp, Artificial Sequence
  Synthetic Polynucleotide
taatacgactcactataggggtggtgtgattgcctttggttctggagagtaacagaggagaactctcatgaaccaaaggaacctggcggcagcgcaaaagatg

SEQ ID NO: 100081 - DNA, 103 bp, Artificial Sequence
  Synthetic Polynucleotide
taatacgactcactatagggggttgctgaggtggtgtgattgcctttggtaacagaggagaaccaaaatgaatcacaccaacctggcggcagcgcaaaagatg

SEQ ID NO: 100082 - DNA, 103 bp, Artificial Sequence
  Synthetic Polynucleotide
taatacgactcactatagggctttttatatggttgctgaggtggtgtgataacagaggagaatcacaatgcctcagcaaaacctggcggcagcgcaaaagatg

SEQ ID NO: 100083 - DNA, 103 bp, Artificial Sequence
  Synthetic Polynucleotide
taatacgactcactatagggtttttggtctctttttatatggttgctgagaacagaggagactcagcatgcatataaaaaacctggcggcagcgcaaaagatg

SEQ ID NO: 100084 - DNA, 103 bp, Artificial Sequence
  Synthetic Polynucleotide
taatacgactcactatagggctgatatcatcatactccaccaaaggtttgaacagaggagacaaaccatgggtggagtaaacctggcggcagcgcaaaagatg

SEQ ID NO: 100085 - DNA, 103 bp, Artificial Sequence
  Synthetic Polynucleotide
taatacgactcactatagggggacaacaaatttttggtctctttttatataacagaggagaatataaatggagaccaaaaacctggcggcagcgcaaaagatg

SEQ ID NO: 100086 - DNA, 103 bp, Artificial Sequence
  Synthetic Polynucleotide
taatacgactcactatagggtccataacgaggacaacaaatttttggtctaacagaggagaagaccaatgatttgttgtaacctggcggcagcgcaaaagatg

SEQ ID NO: 100087 - DNA, 103 bp, Artificial Sequence
  Synthetic Polynucleotide
taatacgactcactataggggtcttctttctccataacgaggacaacaaaaacagaggagatttgttatgctcgttatgaacctggcggcagcgcaaaagatg

SEQ ID NO: 100088 - DNA, 103 bp, Artificial Sequence
  Synthetic Polynucleotide
taatacgactcactatagggctttctgtttgtcttctttctccataacgaaacagaggagatcgttaatgagaaagaagaacctggcggcagcgcaaaagatg

SEQ ID NO: 100089 - DNA, 103 bp, Artificial Sequence
  Synthetic Polynucleotide
taatacgactcactatagggcccccagtcgctttctgtttgtcttctttcaacagaggagagaaagaatgcaaacagaaaacctggcggcagcgcaaaagatg

SEQ ID NO: 100090 - DNA, 103 bp, Artificial Sequence
  Synthetic Polynucleotide
taatacgactcactatagggcacagcgtttcccccagtcgctttctgtttaacagaggagaaaacagatggcgactgggaacctggcggcagcgcaaaagatg

SEQ ID NO: 100091 - DNA, 103 bp, Artificial Sequence
  Synthetic Polynucleotide
taatacgactcactatagggaacttgtccacacagcgtttcccccagtcgaacagaggagacgactgatggaaacgctgaacctggcggcagcgcaaaagatg

SEQ ID NO: 100092 - DNA, 103 bp, Artificial Sequence
  Synthetic Polynucleotide
taatacgactcactatagggaataatgtcaaacttgtccacacagcgtttaacagaggagaaaacgcatggtggacaagaacctggcggcagcgcaaaagatg

SEQ ID NO: 100093 - DNA, 103 bp, Artificial Sequence
  Synthetic Polynucleotide
taatacgactcactatagggcaataatcccaataatgtcaaacttgtccaaacagaggagatggacaatgttgacattaaacctggcggcagcgcaaaagatg

SEQ ID NO: 100094 - DNA, 103 bp, Artificial Sequence
  Synthetic Polynucleotide
taatacgactcactataggggttccttctccaataatcccaataatgtcaaacagaggagatgacatatgtgggattataacctggcggcagcgcaaaagatg

SEQ ID NO: 100095 - DNA, 103 bp, Artificial Sequence
  Synthetic Polynucleotide
taatacgactcactatagggggaatcagagctgatatcatcatactccacaacagaggagagtggagatggatgatatcaacctggcggcagcgcaaaagatg

SEQ ID NO: 100096 - DNA, 103 bp, Artificial Sequence
  Synthetic Polynucleotide
taatacgactcactatagggttggccataggttccttctccaataatcccaacagaggagagggattatgggagaaggaaacctggcggcagcgcaaaagatg

SEQ ID NO: 100097 - DNA, 103 bp, Artificial Sequence
  Synthetic Polynucleotide
taatacgactcactatagggctttatatacttggccataggttccttctcaacagaggagagagaagatgcctatggccaacctggcggcagcgcaaaagatg

SEQ ID NO: 100098 - DNA, 103 bp, Artificial Sequence
  Synthetic Polynucleotide
taatacgactcactatagggttgtccttggctttatatacttggccatagaacagaggagactatggatgagtatataaaacctggcggcagcgcaaaagatg

SEQ ID NO: 100099 - DNA, 103 bp, Artificial Sequence
  Synthetic Polynucleotide
taatacgactcactatagggtcctgtgtctttgtccttggctttatatacaacagaggagagtatatatggccaaggacaacctggcggcagcgcaaaagatg

SEQ ID NO: 100100 - DNA, 103 bp, Artificial Sequence
  Synthetic Polynucleotide
taatacgactcactatagggccactagttctcctgtgtctttgtccttggaacagaggagaccaaggatgaagacacagaacctggcggcagcgcaaaagatg

SEQ ID NO: 100101 - DNA, 103 bp, Artificial Sequence
  Synthetic Polynucleotide
taatacgactcactatagggttcttcagagccactagttctcctgtgtctaacagaggagaagacacatgagaactagtaacctggcggcagcgcaaaagatg

SEQ ID NO: 100102 - DNA, 103 bp, Artificial Sequence
  Synthetic Polynucleotide
taatacgactcactatagggtagtctcaccttcttcagagccactagttcaacagaggagagaactaatggctctgaagaacctggcggcagcgcaaaagatg

SEQ ID NO: 100103 - DNA, 103 bp, Artificial Sequence
  Synthetic Polynucleotide
taatacgactcactatagggtctcattgtctagtctcaccttcttcagagaacagaggagactctgaatgaggtgagacaacctggcggcagcgcaaaagatg

SEQ ID NO: 100104 - DNA, 103 bp, Artificial Sequence
  Synthetic Polynucleotide
taatacgactcactatagggaagccctctttctcattgtctagtctcaccaacagaggagaggtgagatgagacaatgaaacctggcggcagcgcaaaagatg

SEQ ID NO: 100105 - DNA, 103 bp, Artificial Sequence
  Synthetic Polynucleotide
taatacgactcactatagggtgtgattgggaagccctctttctcattgtcaacagaggagagacaatatgaaagagggcaacctggcggcagcgcaaaagatg

SEQ ID NO: 100106 - DNA, 103 bp, Artificial Sequence
  Synthetic Polynucleotide
taatacgactcactatagggagaaggtgtcggaatcagagctgatatcataacagaggagaatgataatggctctgattaacctggcggcagcgcaaaagatg

SEQ ID NO: 100107 - DNA, 103 bp, Artificial Sequence
  Synthetic Polynucleotide
taatacgactcactatagggcacgaatggctgtgattgggaagccctcttaacagaggagaaagaggatgtcccaatcaaacctggcggcagcgcaaaagatg

SEQ ID NO: 100108 - DNA, 103 bp, Artificial Sequence
  Synthetic Polynucleotide
taatacgactcactatagggattttgatttcacgaatggctgtgattgggaacagaggagacccaatatgagccattcgaacctggcggcagcgcaaaagatg

SEQ ID NO: 100109 - DNA, 103 bp, Artificial Sequence
  Synthetic Polynucleotide
taatacgactcactatagggctgacgaaggattttgatttcacgaatggcaacagaggagagccattatggaaatcaaaaacctggcggcagcgcaaaagatg

SEQ ID NO: 100110 - DNA, 103 bp, Artificial Sequence
  Synthetic Polynucleotide
taatacgactcactatagggggtggattaactgacgaaggattttgatttaacagaggagaaaatcaatgtccttcgtcaacctggcggcagcgcaaaagatg

SEQ ID NO: 100111 - DNA, 103 bp, Artificial Sequence
  Synthetic Polynucleotide
taatacgactcactatagggacaacacttcggtggattaactgacgaaggaacagaggagaccttcgatggttaatccaaacctggcggcagcgcaaaagatg

SEQ ID NO: 100112 - DNA, 103 bp, Artificial Sequence
  Synthetic Polynucleotide
taatacgactcactatagggcttcatgttaacaacacttcggtggattaaaacagaggagattaatcatgcgaagtgttaacctggcggcagcgcaaaagatg

SEQ ID NO: 100113 - DNA, 103 bp, Artificial Sequence
  Synthetic Polynucleotide
taatacgactcactatagggtgacaatttccttcatgttaacaacacttcaacagaggagagaagtgatgttaacatgaaacctggcggcagcgcaaaagatg

SEQ ID NO: 100114 - DNA, 103 bp, Artificial Sequence
  Synthetic Polynucleotide
taatacgactcactatagggtgtttatctgtgacaatttccttcatgttaaacagaggagataacatatgggaaattgtaacctggcggcagcgcaaaagatg

SEQ ID NO: 100115 - DNA, 103 bp, Artificial Sequence
  Synthetic Polynucleotide
taatacgactcactatagggcagtgcatcttgtttatctgtgacaatttcaacagaggagagaaattatgacagataaaaacctggcggcagcgcaaaagatg

SEQ ID NO: 100116 - DNA, 103 bp, Artificial Sequence
  Synthetic Polynucleotide
taatacgactcactatagggtcttgaaatccagtgcatcttgtttatctgaacagaggagacagataatgaagatgcacaacctggcggcagcgcaaaagatg

SEQ ID NO: 100117 - DNA, 103 bp, Artificial Sequence
  Synthetic Polynucleotide
taatacgactcactatagggatgtcatcggagaaggtgtcggaatcagagaacagaggagactctgaatgcgacaccttaacctggcggcagcgcaaaagatg

SEQ ID NO: 100118 - DNA, 103 bp, Artificial Sequence
  Synthetic Polynucleotide
taatacgactcactatagggcctttgtccttcttgaaatccagtgcatctaacagaggagaagatgcatgggatttcaaaacctggcggcagcgcaaaagatg

SEQ ID NO: 100119 - DNA, 103 bp, Artificial Sequence
  Synthetic Polynucleotide
taatacgactcactataggggtaaaaggcacctttgtccttcttgaaatcaacagaggagagatttcatgaaggacaaaaacctggcggcagcgcaaaagatg

SEQ ID NO: 100120 - DNA, 103 bp, Artificial Sequence
  Synthetic Polynucleotide
taatacgactcactatagggcaaatacaaggtaaaaggcacctttgtcctaacagaggagaaggacaatggtgccttttaacctggcggcagcgcaaaagatg

SEQ ID NO: 100121 - DNA, 103 bp, Artificial Sequence
  Synthetic Polynucleotide
taatacgactcactatagggtccatatactcaaatacaaggtaaaaggcaaacagaggagatgccttatgccttgtattaacctggcggcagcgcaaaagatg

SEQ ID NO: 100122 - DNA, 103 bp, Artificial Sequence
  Synthetic Polynucleotide
taatacgactcactatagggtaagtcatggtccatatactcaaatacaagaacagaggagacttgtaatggagtatatgaacctggcggcagcgcaaaagatg

SEQ ID NO: 100123 - DNA, 103 bp, Artificial Sequence
  Synthetic Polynucleotide
taatacgactcactataggggcagtcccattaagtcatggtccatatactaacagaggagaagtataatgaccatgactaacctggcggcagcgcaaaagatg

SEQ ID NO: 100124 - DNA, 103 bp, Artificial Sequence
  Synthetic Polynucleotide
taatacgactcactatagggccagattctagcagtcccattaagtcatggaacagaggagaccatgaatgaatgggactaacctggcggcagcgcaaaagatg

SEQ ID NO: 100125 - DNA, 103 bp, Artificial Sequence
  Synthetic Polynucleotide
taatacgactcactataggggtgcaccaaaccagattctagcagtcccataacagaggagaatgggaatgctagaatctaacctggcggcagcgcaaaagatg

SEQ ID NO: 100126 - DNA, 103 bp, Artificial Sequence
  Synthetic Polynucleotide
taatacgactcactatagggcctcagaaaagtgcaccaaaccagattctaaacagaggagatagaatatggtttggtgcaacctggcggcagcgcaaaagatg

SEQ ID NO: 100127 - DNA, 103 bp, Artificial Sequence
  Synthetic Polynucleotide
taatacgactcactatagggttgatatggtcctcagaaaagtgcaccaaaaacagaggagatttggtatgcttttctgaaacctggcggcagcgcaaaagatg

SEQ ID NO: 100128 - DNA, 103 bp, Artificial Sequence
  Synthetic Polynucleotide
taatacgactcactatagggtttgaaggccatgtcatcggagaaggtgtcaacagaggagagacaccatgtccgatgacaacctggcggcagcgcaaaagatg

SEQ ID NO: 100129 - DNA, 103 bp, Artificial Sequence
  Synthetic Polynucleotide
taatacgactcactatagggcatgaacgacttgatatggtcctcagaaaaaacagaggagattttctatggaccatatcaacctggcggcagcgcaaaagatg

SEQ ID NO: 100130 - DNA, 103 bp, Artificial Sequence
  Synthetic Polynucleotide
taatacgactcactatagggttagctgtttcatgaacgacttgatatggtaacagaggagaaccataatgagtcgttcaaacctggcggcagcgcaaaagatg

SEQ ID NO: 100131 - DNA, 103 bp, Artificial Sequence
  Synthetic Polynucleotide
taatacgactcactatagggaatccttccattagctgtttcatgaacgacaacagaggagagtcgttatggaaacagctaacctggcggcagcgcaaaagatg

SEQ ID NO: 100132 - DNA, 103 bp, Artificial Sequence
  Synthetic Polynucleotide
taatacgactcactatagggacagtattccaatccttccattagctgtttaacagaggagaaaacagatgatggaaggaaacctggcggcagcgcaaaagatg

SEQ ID NO: 100133 - DNA, 103 bp, Artificial Sequence
  Synthetic Polynucleotide
taatacgactcactatagggtctttttgtgacagtattccaatccttccaaacagaggagatggaagatgtggaatactaacctggcggcagcgcaaaagatg

SEQ ID NO: 100134 - DNA, 103 bp, Artificial Sequence
  Synthetic Polynucleotide
taatacgactcactatagggtgcaggaaattctttttgtgacagtattccaacagaggagaggaataatgtcacaaaaaaacctggcggcagcgcaaaagatg

SEQ ID NO: 100135 - DNA, 103 bp, Artificial Sequence
  Synthetic Polynucleotide
taatacgactcactatagggaatatcccgatgcaggaaattctttttgtgaacagaggagacacaaaatgaatttcctgaacctggcggcagcgcaaaagatg

SEQ ID NO: 100136 - DNA, 103 bp, Artificial Sequence
  Synthetic Polynucleotide
taatacgactcactatagggtagaacacttaatatcccgatgcaggaaataacagaggagaatttccatgatcgggataaacctggcggcagcgcaaaagatg

SEQ ID NO: 100137 - DNA, 103 bp, Artificial Sequence
  Synthetic Polynucleotide
taatacgactcactatagggagcaaaatgttagaacacttaatatcccgaaacagaggagatcgggaatgtaagtgttcaacctggcggcagcgcaaaagatg

SEQ ID NO: 100138 - DNA, 103 bp, Artificial Sequence
  Synthetic Polynucleotide
taatacgactcactatagggactgttattcagcaaaatgttagaacacttaacagaggagaaagtgtatgaacattttgaacctggcggcagcgcaaaagatg

SEQ ID NO: 100139 - DNA, 103 bp, Artificial Sequence
  Synthetic Polynucleotide
taatacgactcactatagggttcggtctagtttgaaggccatgtcatcggaacagaggagaccgatgatgtggccttcaaacctggcggcagcgcaaaagatg

SEQ ID NO: 100140 - DNA, 103 bp, Artificial Sequence
  Synthetic Polynucleotide
taatacgactcactatagggtgatttgcccactgttattcagcaaaatgtaacagaggagaacatttatgtgaataacaaacctggcggcagcgcaaaagatg

SEQ ID NO: 100141 - DNA, 103 bp, Artificial Sequence
  Synthetic Polynucleotide
taatacgactcactatagggtctgctagtttgatttgcccactgttattcaacagaggagagaataaatgtgggcaaataacctggcggcagcgcaaaagatg

SEQ ID NO: 100142 - DNA, 103 bp, Artificial Sequence
  Synthetic Polynucleotide
taatacgactcactatagggaagtccaaaatctgctagtttgatttgcccaacagaggagagggcaaatgaaactagcaaacctggcggcagcgcaaaagatg

SEQ ID NO: 100143 - DNA, 103 bp, Artificial Sequence
  Synthetic Polynucleotide
taatacgactcactatagggagagccgagcaagtccaaaatctgctagttaacagaggagaaactagatgattttggacaacctggcggcagcgcaaaagatg

SEQ ID NO: 100144 - DNA, 103 bp, Artificial Sequence
  Synthetic Polynucleotide
taatacgactcactatagggtcagagttatagagccgagcaagtccaaaaaacagaggagattttggatgtgctcggctaacctggcggcagcgcaaaagatg

SEQ ID NO: 100145 - DNA, 103 bp, Artificial Sequence
  Synthetic Polynucleotide
taatacgactcactataggggcgactctcttcagagttatagagccgagcaacagaggagagctcggatgtataactctaacctggcggcagcgcaaaagatg

SEQ ID NO: 100146 - DNA, 103 bp, Artificial Sequence
  Synthetic Polynucleotide
taatacgactcactatagggttgtgtaagggcgactctcttcagagttataacagaggagaataactatgaagagagtcaacctggcggcagcgcaaaagatg

SEQ ID NO: 100147 - DNA, 103 bp, Artificial Sequence
  Synthetic Polynucleotide
taatacgactcactatagggatgactttgtttgtgtaagggcgactctctaacagaggagaagagagatgcccttacacaacctggcggcagcgcaaaagatg

SEQ ID NO: 100148 - DNA, 103 bp, Artificial Sequence
  Synthetic Polynucleotide
taatacgactcactatagggccacaaagtaatgactttgtttgtgtaaggaacagaggagaccttacatgaacaaagtcaacctggcggcagcgcaaaagatg

SEQ ID NO: 100149 - DNA, 103 bp, Artificial Sequence
  Synthetic Polynucleotide
taatacgactcactataggggaggtcggtaccacaaagtaatgactttgtaacagaggagaacaaagatgttactttgtaacctggcggcagcgcaaaagatg

SEQ ID NO: 100150 - DNA, 103 bp, Artificial Sequence
  Synthetic Polynucleotide
taatacgactcactatagggtcgttctcccttcggtctagtttgaaggccaacagaggagaggccttatgactagaccgaacctggcggcagcgcaaaagatg

SEQ ID NO: 100151 - DNA, 103 bp, Artificial Sequence
  Synthetic Polynucleotide
taatacgactcactatagggagtagttctggaggtcggtaccacaaagtaaacagaggagatactttatggtaccgaccaacctggcggcagcgcaaaagatg

SEQ ID NO: 100152 - DNA, 103 bp, Artificial Sequence
  Synthetic Polynucleotide
taatacgactcactatagggctctcctagcagtagttctggaggtcggtaaacagaggagataccgaatgccagaactaaacctggcggcagcgcaaaagatg

SEQ ID NO: 100153 - DNA, 103 bp, Artificial Sequence
  Synthetic Polynucleotide
taatacgactcactatagggtgtaacgttcctctcctagcagtagttctgaacagaggagacagaacatgtgctaggagaacctggcggcagcgcaaaagatg

SEQ ID NO: 100154 - DNA, 103 bp, Artificial Sequence
  Synthetic Polynucleotide
taatacgactcactatagggatggctggtgtgtaacgttcctctcctagcaacagaggagagctaggatgggaacgttaaacctggcggcagcgcaaaagatg

SEQ ID NO: 100155 - DNA, 103 bp, Artificial Sequence
  Synthetic Polynucleotide
taatacgactcactatagggccaaacatctatggctggtgtgtaacgttcaacagaggagagaacgtatgacaccagccaacctggcggcagcgcaaaagatg

SEQ ID NO: 100156 - DNA, 103 bp, Artificial Sequence
  Synthetic Polynucleotide
taatacgactcactatagggatccacagctccaaacatctatggctggtgaacagaggagacaccagatgtagatgtttaacctggcggcagcgcaaaagatg

SEQ ID NO: 100157 - DNA, 103 bp, Artificial Sequence
  Synthetic Polynucleotide
taatacgactcactatagggccaagaatacatccacagctccaaacatctaacagaggagaagatgtatggagctgtggaacctggcggcagcgcaaaagatg

SEQ ID NO: 100158 - DNA, 103 bp, Artificial Sequence
  Synthetic Polynucleotide
taatacgactcactataggggaatagttccccaagaatacatccacagctaacagaggagaagctgtatgtgtattcttaacctggcggcagcgcaaaagatg

SEQ ID NO: 100159 - DNA, 103 bp, Artificial Sequence
  Synthetic Polynucleotide
taatacgactcactataggggcttctttgtgaatagttccccaagaatacaacagaggagagtattcatggggaactataacctggcggcagcgcaaaagatg

SEQ ID NO: 100160 - DNA, 103 bp, Artificial Sequence
  Synthetic Polynucleotide
taatacgactcactatagggtgaaaaataggcttctttgtgaatagttccaacagaggagaggaactatgcacaaagaaaacctggcggcagcgcaaaagatg

SEQ ID NO: 100161 - DNA, 103 bp, Artificial Sequence
  Synthetic Polynucleotide
taatacgactcactatagggacgacgttcgtcgttctcccttcggtctagaacagaggagactagacatgagggagaacaacctggcggcagcgcaaaagatg

SEQ ID NO: 100162 - DNA, 103 bp, Artificial Sequence
  Synthetic Polynucleotide
taatacgactcactatagggcagattggcttgaaaaataggcttctttgtaacagaggagaacaaagatgcctatttttaacctggcggcagcgcaaaagatg

SEQ ID NO: 100163 - DNA, 103 bp, Artificial Sequence
  Synthetic Polynucleotide
taatacgactcactataggggagccagttccagattggcttgaaaaatagaacagaggagactatttatgaagccaatcaacctggcggcagcgcaaaagatg

SEQ ID NO: 100164 - DNA, 103 bp, Artificial Sequence
  Synthetic Polynucleotide
taatacgactcactatagggagttctagctgagccagttccagattggctaacagaggagaagccaaatgggaactggcaacctggcggcagcgcaaaagatg

SEQ ID NO: 100165 - DNA, 103 bp, Artificial Sequence
  Synthetic Polynucleotide
taatacgactcactatagggtcggctgatcagttctagctgagccagttcaacagaggagagaactgatgcagctagaaaacctggcggcagcgcaaaagatg

SEQ ID NO: 100166 - DNA, 103 bp, Artificial Sequence
  Synthetic Polynucleotide
taatacgactcactatagggtaccacaaagtcggctgatcagttctagctaacagaggagaagctagatgtgatcagccaacctggcggcagcgcaaaagatg

SEQ ID NO: 100167 - DNA, 103 bp, Artificial Sequence
  Synthetic Polynucleotide
taatacgactcactatagggggacaagggctaccacaaagtcggctgatcaacagaggagagatcagatgactttgtggaacctggcggcagcgcaaaagatg

SEQ ID NO: 100168 - DNA, 103 bp, Artificial Sequence
  Synthetic Polynucleotide
taatacgactcactatagggccacacagctggacaagggctaccacaaagaacagaggagactttgtatgagcccttgtaacctggcggcagcgcaaaagatg

SEQ ID NO: 100169 - DNA, 103 bp, Artificial Sequence
  Synthetic Polynucleotide
taatacgactcactatagggtaacatcaggccacacagctggacaagggcaacagaggagagcccttatgcagctgtgtaacctggcggcagcgcaaaagatg

SEQ ID NO: 100170 - DNA, 103 bp, Artificial Sequence
  Synthetic Polynucleotide
taatacgactcactatagggggcagtttgataacatcaggccacacagctaacagaggagaagctgtatggcctgatgtaacctggcggcagcgcaaaagatg

SEQ ID NO: 100171 - DNA, 103 bp, Artificial Sequence
  Synthetic Polynucleotide
taatacgactcactataggggttgaagtagggcagtttgataacatcaggaacagaggagacctgatatgatcaaactgaacctggcggcagcgcaaaagatg

SEQ ID NO: 100172 - DNA, 103 bp, Artificial Sequence
  Synthetic Polynucleotide
taatacgactcactataggggatctgatccacgacgttcgtcgttctcccaacagaggagagggagaatgacgaacgtcaacctggcggcagcgcaaaagatg

SEQ ID NO: 100173 - DNA, 103 bp, Artificial Sequence
  Synthetic Polynucleotide
taatacgactcactataggggtttcatggtgttgaagtagggcagtttgaaacagaggagatcaaacatgcctacttcaaacctggcggcagcgcaaaagatg

SEQ ID NO: 100174 - DNA, 103 bp, Artificial Sequence
  Synthetic Polynucleotide
taatacgactcactatagggtgcttcttcggtttcatggtgttgaagtagaacagaggagactacttatgcaccatgaaaacctggcggcagcgcaaaagatg

SEQ ID NO: 100175 - DNA, 103 bp, Artificial Sequence
  Synthetic Polynucleotide
taatacgactcactatagggccttcgatattgcttcttcggtttcatggtaacagaggagaaccatgatgccgaagaagaacctggcggcagcgcaaaagatg

SEQ ID NO: 100176 - DNA, 103 bp, Artificial Sequence
  Synthetic Polynucleotide
taatacgactcactatagggctcgtagacgccttcgatattgcttcttcgaacagaggagacgaagaatgaatatcgaaaacctggcggcagcgcaaaagatg

SEQ ID NO: 100177 - DNA, 103 bp, Artificial Sequence
  Synthetic Polynucleotide
taatacgactcactataggggagaattcttctcgtagacgccttcgatataacagaggagaatatcgatggcgtctacgaacctggcggcagcgcaaaagatg

SEQ ID NO: 100178 - DNA, 103 bp, Artificial Sequence
  Synthetic Polynucleotide
taatacgactcactatagggaggaatgaaagagaattcttctcgtagacgaacagaggagacgtctaatggaagaattcaacctggcggcagcgcaaaagatg

SEQ ID NO: 100179 - DNA, 103 bp, Artificial Sequence
  Synthetic Polynucleotide
taatacgactcactataggggtgctgcagaaggaatgaaagagaattcttaacagaggagaaagaatatgctttcattcaacctggcggcagcgcaaaagatg

SEQ ID NO: 100180 - DNA, 103 bp, Artificial Sequence
  Synthetic Polynucleotide
taatacgactcactatagggaataaatcaagtgctgcagaaggaatgaaaaacagaggagatttcatatgttctgcagcaacctggcggcagcgcaaaagatg

SEQ ID NO: 100181 - DNA, 103 bp, Artificial Sequence
  Synthetic Polynucleotide
taatacgactcactatagggcatgtggtccaataaatcaagtgctgcagaaacagaggagatctgcaatgcttgatttaaacctggcggcagcgcaaaagatg

SEQ ID NO: 100182 - DNA, 103 bp, Artificial Sequence
  Synthetic Polynucleotide
taatacgactcactatagggctagtgtcagcatgtggtccaataaatcaaaacagaggagattgattatgtggaccacaaacctggcggcagcgcaaaagatg

SEQ ID NO: 100183 - DNA, 103 bp, Artificial Sequence
  Synthetic Polynucleotide
taatacgactcactataggggctcctccactcccgtccttcttgcccccaaacagaggagatgggggatggaaggacggaacctggcggcagcgcaaaagatg

SEQ ID NO: 100184 - DNA, 103 bp, Artificial Sequence
  Synthetic Polynucleotide
taatacgactcactatagggcggtcgctccgatctgatccacgacgttcgaacagaggagacgaacgatgtggatcagaaacctggcggcagcgcaaaagatg

SEQ ID NO: 100185 - DNA, 103 bp, Artificial Sequence
  Synthetic Polynucleotide
taatacgactcactatagggttactaggatctagtgtcagcatgtggtccaacagaggagaggaccaatggctgacactaacctggcggcagcgcaaaagatg

SEQ ID NO: 100186 - DNA, 103 bp, Artificial Sequence
  Synthetic Polynucleotide
taatacgactcactatagggtgtgcaccgcttactaggatctagtgtcagaacagaggagactgacaatggatcctagtaacctggcggcagcgcaaaagatg

SEQ ID NO: 100187 - DNA, 103 bp, Artificial Sequence
  Synthetic Polynucleotide
taatacgactcactatagggtctgttcagctgtgcaccgcttactaggataacagaggagaatcctaatgagcggtgcaaacctggcggcagcgcaaaagatg

SEQ ID NO: 100188 - DNA, 103 bp, Artificial Sequence
  Synthetic Polynucleotide
taatacgactcactatagggctctgtagggtctgttcagctgtgcaccgcaacagaggagagcggtgatgagctgaacaaacctggcggcagcgcaaaagatg

SEQ ID NO: 100189 - DNA, 103 bp, Artificial Sequence
  Synthetic Polynucleotide
taatacgactcactatagggaaggaagtcgctctgtagggtctgttcagcaacagaggagagctgaaatgaccctacagaacctggcggcagcgcaaaagatg

SEQ ID NO: 100190 - DNA, 103 bp, Artificial Sequence
  Synthetic Polynucleotide
taatacgactcactatagggcgacatctttaaggaagtcgctctgtagggaacagaggagaccctacatggcgacttccaacctggcggcagcgcaaaagatg

SEQ ID NO: 100191 - DNA, 103 bp, Artificial Sequence
  Synthetic Polynucleotide
taatacgactcactatagggttgctgagttcgacatctttaaggaagtcgaacagaggagacgacttatgtaaagatgtaacctggcggcagcgcaaaagatg

SEQ ID NO: 100192 - DNA, 103 bp, Artificial Sequence
  Synthetic Polynucleotide
taatacgactcactatagggaggagccattttgctgagttcgacatctttaacagaggagaaaagatatggaactcagcaacctggcggcagcgcaaaagatg

SEQ ID NO: 100193 - DNA, 103 bp, Artificial Sequence
  Synthetic Polynucleotide
taatacgactcactatagggggaggtctggaggagccattttgctgagttaacagaggagaaactcaatgaaatggctcaacctggcggcagcgcaaaagatg

SEQ ID NO: 100194 - DNA, 103 bp, Artificial Sequence
  Synthetic Polynucleotide
taatacgactcactatagggtgccagtgggggaggtctggaggagccattaacagaggagaaatggcatgtccagacctaacctggcggcagcgcaaaagatg

SEQ ID NO: 100195 - DNA, 103 bp, Artificial Sequence
  Synthetic Polynucleotide
taatacgactcactatagggtttgtgcaggcggtcgctccgatctgatccaacagaggagaggatcaatgcggagcgacaacctggcggcagcgcaaaagatg

SEQ ID NO: 100196 - DNA, 103 bp, Artificial Sequence
  Synthetic Polynucleotide
taatacgactcactatagggatggcaatcctgccagtgggggaggtctggaacagaggagaccagacatgccccactggaacctggcggcagcgcaaaagatg

SEQ ID NO: 100197 - DNA, 103 bp, Artificial Sequence
  Synthetic Polynucleotide
taatacgactcactatagggtccacaactcatggcaatcctgccagtgggaacagaggagacccactatgaggattgccaacctggcggcagcgcaaaagatg

SEQ ID NO: 100198 - DNA, 103 bp, Artificial Sequence
  Synthetic Polynucleotide
taatacgactcactatagggcgtttcttactccacaactcatggcaatccaacagaggagaggattgatgtgagttgtgaacctggcggcagcgcaaaagatg

SEQ ID NO: 100199 - DNA, 103 bp, Artificial Sequence
  Synthetic Polynucleotide
taatacgactcactatagggctgacgtcgccgtttcttactccacaactcaacagaggagagagttgatgagtaagaaaaacctggcggcagcgcaaaagatg

SEQ ID NO: 100200 - DNA, 103 bp, Artificial Sequence
  Synthetic Polynucleotide
taatacgactcactatagggcactttgtcgctgacgtcgccgtttcttacaacagaggagagtaagaatgggcgacgtcaacctggcggcagcgcaaaagatg

SEQ ID NO: 100201 - DNA, 103 bp, Artificial Sequence
  Synthetic Polynucleotide
taatacgactcactatagggactacaacaccactttgtcgctgacgtcgcaacagaggagagcgacgatggcgacaaagaacctggcggcagcgcaaaagatg

SEQ ID NO: 100202 - DNA, 103 bp, Artificial Sequence
  Synthetic Polynucleotide
taatacgactcactatagggtggctcttcgactacaacaccactttgtcgaacagaggagacgacaaatgggtgttgtaaacctggcggcagcgcaaaagatg

SEQ ID NO: 100203 - DNA, 103 bp, Artificial Sequence
  Synthetic Polynucleotide
taatacgactcactatagggtggatggaggtggctcttcgactacaacacaacagaggagagtgttgatgtcgaagagcaacctggcggcagcgcaaaagatg

SEQ ID NO: 100204 - DNA, 103 bp, Artificial Sequence
  Synthetic Polynucleotide
taatacgactcactatagggcgagaagttttggatggaggtggctcttcgaacagaggagacgaagaatgacctccatcaacctggcggcagcgcaaaagatg

SEQ ID NO: 100205 - DNA, 103 bp, Artificial Sequence
  Synthetic Polynucleotide
taatacgactcactatagggagtttcttttcgagaagttttggatggaggaacagaggagacctccaatgaaaacttctaacctggcggcagcgcaaaagatg

SEQ ID NO: 100206 - DNA, 103 bp, Artificial Sequence
  Synthetic Polynucleotide
taatacgactcactatagggggtgacgatgtttgtgcaggcggtcgctccaacagaggagaggagcgatggcctgcacaaacctggcggcagcgcaaaagatg

SEQ ID NO: 100207 - DNA, 103 bp, Artificial Sequence
  Synthetic Polynucleotide
taatacgactcactatagggtccctgaggtagtttcttttcgagaagtttaacagaggagaaaacttatggaaaagaaaaacctggcggcagcgcaaaagatg

SEQ ID NO: 100208 - DNA, 103 bp, Artificial Sequence
  Synthetic Polynucleotide
taatacgactcactatagggtcagtacttgtccctgaggtagtttcttttaacagaggagaaaaagaatgtacctcaggaacctggcggcagcgcaaaagatg

SEQ ID NO: 100209 - DNA, 103 bp, Artificial Sequence
  Synthetic Polynucleotide
taatacgactcactatagggcttcacaggctcagtacttgtccctgaggtaacagaggagaacctcaatgacaagtactaacctggcggcagcgcaaaagatg

SEQ ID NO: 100210 - DNA, 103 bp, Artificial Sequence
  Synthetic Polynucleotide
taatacgactcactatagggggctgctgttcttcacaggctcagtacttgaacagaggagacaagtaatgagcctgtgaaacctggcggcagcgcaaaagatg

SEQ ID NO: 100211 - DNA, 103 bp, Artificial Sequence
  Synthetic Polynucleotide
taatacgactcactatagggggtggtgctgggctgctgttcttcacaggcaacagaggagagcctgtatggaacagcagaacctggcggcagcgcaaaagatg

SEQ ID NO: 100212 - DNA, 103 bp, Artificial Sequence
  Synthetic Polynucleotide
taatacgactcactatagggagcaggctgaggtggtgctgggctgctgttaacagaggagaaacagcatgccagcaccaaacctggcggcagcgcaaaagatg

SEQ ID NO: 100213 - DNA, 103 bp, Artificial Sequence
  Synthetic Polynucleotide
taatacgactcactatagggccttgccaggagcaggctgaggtggtgctgaacagaggagacagcacatgctcagcctgaacctggcggcagcgcaaaagatg

SEQ ID NO: 100214 - DNA, 103 bp, Artificial Sequence
  Synthetic Polynucleotide
taatacgactcactatagggccagactccaccttgccaggagcaggctgaaacagaggagatcagccatgtcctggcaaaacctggcggcagcgcaaaagatg

SEQ ID NO: 100215 - DNA, 103 bp, Artificial Sequence
  Synthetic Polynucleotide
taatacgactcactatagggatccccagccccagactccaccttgccaggaacagaggagacctggcatggtggagtctaacctggcggcagcgcaaaagatg

SEQ ID NO: 100216 - DNA, 103 bp, Artificial Sequence
  Synthetic Polynucleotide
taatacgactcactatagggggcctattgcatccccagccccagactccaaacagaggagatggagtatggggctggggaacctggcggcagcgcaaaagatg

SEQ ID NO: 100217 - DNA, 103 bp, Artificial Sequence
  Synthetic Polynucleotide
taatacgactcactatagggctgtgctggtggtgacgatgtttgtgcaggaacagaggagacctgcaatgacatcgtcaaacctggcggcagcgcaaaagatg

SEQ ID NO: 100218 - DNA, 103 bp, Artificial Sequence
  Synthetic Polynucleotide
taatacgactcactatagggatgtcagcaaggcctattgcatccccagccaacagaggagaggctggatgtgcaataggaacctggcggcagcgcaaaagatg

SEQ ID NO: 100219 - DNA, 103 bp, Artificial Sequence
  Synthetic Polynucleotide
taatacgactcactatagggctgttgtgtgatgtcagcaaggcctattgcaacagaggagagcaataatgcttgctgacaacctggcggcagcgcaaaagatg

SEQ ID NO: 100220 - DNA, 103 bp, Artificial Sequence
  Synthetic Polynucleotide
taatacgactcactatagggtttgattcagctgttgtgtgatgtcagcaaaacagaggagattgctgatgtcacacaacaacctggcggcagcgcaaaagatg

SEQ ID NO: 100221 - DNA, 103 bp, Artificial Sequence
  Synthetic Polynucleotide
taatacgactcactataggggccaattcactttgattcagctgttgtgtgaacagaggagacacacaatggctgaatcaaacctggcggcagcgcaaaagatg

SEQ ID NO: 100222 - DNA, 103 bp, Artificial Sequence
  Synthetic Polynucleotide
taatacgactcactatagggtaataacactgccaattcactttgattcagaacagaggagactgaatatgagtgaattgaacctggcggcagcgcaaaagatg

SEQ ID NO: 100223 - DNA, 103 bp, Artificial Sequence
  Synthetic Polynucleotide
taatacgactcactataggggcagcaggtttaataacactgccaattcacaacagaggagagtgaatatgcagtgttataacctggcggcagcgcaaaagatg

SEQ ID NO: 100224 - DNA, 103 bp, Artificial Sequence
  Synthetic Polynucleotide
taatacgactcactataggggtttggctctgcagcaggtttaataacactaacagaggagaagtgttatgaaacctgctaacctggcggcagcgcaaaagatg

SEQ ID NO: 100225 - DNA, 103 bp, Artificial Sequence
  Synthetic Polynucleotide
taatacgactcactataggggctcaggtcggtttggctctgcagcaggttaacagaggagaaacctgatgcagagccaaaacctggcggcagcgcaaaagatg

SEQ ID NO: 100226 - DNA, 103 bp, Artificial Sequence
  Synthetic Polynucleotide
taatacgactcactatagggtttgagggatgctcaggtcggtttggctctaacagaggagaagagccatgccgacctgaaacctggcggcagcgcaaaagatg

SEQ ID NO: 100227 - DNA, 103 bp, Artificial Sequence
  Synthetic Polynucleotide
taatacgactcactatagggagctgtgccatttgagggatgctcaggtcgaacagaggagacgacctatgcatccctcaaacctggcggcagcgcaaaagatg

SEQ ID NO: 100228 - DNA, 103 bp, Artificial Sequence
  Synthetic Polynucleotide
taatacgactcactatagggccgggaacgcctgtgctggtggtgacgatgaacagaggagacatcgtatgcaccagcacaacctggcggcagcgcaaaagatg

SEQ ID NO: 100229 - DNA, 103 bp, Artificial Sequence
  Synthetic Polynucleotide
taatacgactcactataggggatgttaagcagctgtgccatttgagggataacagaggagaatccctatgatggcacagaacctggcggcagcgcaaaagatg

SEQ ID NO: 100230 - DNA, 103 bp, Artificial Sequence
  Synthetic Polynucleotide
taatacgactcactatagggggttggagtggatgttaagcagctgtgccaaacagaggagatggcacatgtgcttaacaaacctggcggcagcgcaaaagatg

SEQ ID NO: 100231 - DNA, 103 bp, Artificial Sequence
  Synthetic Polynucleotide
taatacgactcactatagggtgcatctctgggttggagtggatgttaagcaacagaggagagcttaaatgccactccaaaacctggcggcagcgcaaaagatg

SEQ ID NO: 100232 - DNA, 103 bp, Artificial Sequence
  Synthetic Polynucleotide
taatacgactcactatagggcagctgctgctgcatctctgggttggagtgaacagaggagacactccatgccagagatgaacctggcggcagcgcaaaagatg

SEQ ID NO: 100233 - DNA, 103 bp, Artificial Sequence
  Synthetic Polynucleotide
taatacgactcactatagggtcagggcttccagctgctgctgcatctctgaacagaggagacagagaatgagcagcagcaacctggcggcagcgcaaaagatg

SEQ ID NO: 100234 - DNA, 103 bp, Artificial Sequence
  Synthetic Polynucleotide
taatacgactcactatagggatggattggttcagggcttccagctgctgcaacagaggagagcagcaatgggaagccctaacctggcggcagcgcaaaagatg

SEQ ID NO: 100235 - DNA, 103 bp, Artificial Sequence
  Synthetic Polynucleotide
taatacgactcactatagggcagggcactgatggattggttcagggcttcaacagaggagagaagccatgaaccaatccaacctggcggcagcgcaaaagatg

SEQ ID NO: 100236 - DNA, 103 bp, Artificial Sequence
  Synthetic Polynucleotide
taatacgactcactatagggtagcttccgtcagggcactgatggattggtaacagaggagaaccaatatgtcagtgcccaacctggcggcagcgcaaaagatg

SEQ ID NO: 100237 - DNA, 103 bp, Artificial Sequence
  Synthetic Polynucleotide
taatacgactcactatagggtgctgggaagtagcttccgtcagggcactgaacagaggagacagtgcatggacggaagcaacctggcggcagcgcaaaagatg

SEQ ID NO: 100238 - DNA, 103 bp, Artificial Sequence
  Synthetic Polynucleotide
taatacgactcactatagggtgagtcctgctgctgggaagtagcttccgtaacagaggagaacggaaatgacttcccagaacctggcggcagcgcaaaagatg

SEQ ID NO: 100239 - DNA, 103 bp, Artificial Sequence
  Synthetic Polynucleotide
taatacgactcactatagggttagtaagtcccgggaacgcctgtgctggtaacagaggagaaccagcatgggcgttcccaacctggcggcagcgcaaaagatg

SEQ ID NO: 100240 - DNA, 103 bp, Artificial Sequence
  Synthetic Polynucleotide
taatacgactcactatagggccatggtctctgagtcctgctgctgggaagaacagaggagacttcccatgagcaggactaacctggcggcagcgcaaaagatg

SEQ ID NO: 100241 - DNA, 103 bp, Artificial Sequence
  Synthetic Polynucleotide
taatacgactcactatagggtcctctggggccatggtctctgagtcctgcaacagaggagagcaggaatgagagaccataacctggcggcagcgcaaaagatg

SEQ ID NO: 100242 - DNA, 103 bp, Artificial Sequence
  Synthetic Polynucleotide
taatacgactcactatagggcttcaaagactcctctggggccatggtctcaacagaggagagagaccatggccccagagaacctggcggcagcgcaaaagatg

SEQ ID NO: 100243 - DNA, 103 bp, Artificial Sequence
  Synthetic Polynucleotide
taatacgactcactatagggagggtgcttccttcaaagactcctctggggaacagaggagaccccagatgagtctttgaaacctggcggcagcgcaaaagatg

SEQ ID NO: 100244 - DNA, 103 bp, Artificial Sequence
  Synthetic Polynucleotide
taatacgactcactatagggactggggcagagggtgcttccttcaaagacaacagaggagagtctttatgggaagcaccaacctggcggcagcgcaaaagatg

SEQ ID NO: 100245 - DNA, 103 bp, Artificial Sequence
  Synthetic Polynucleotide
taatacgactcactatagggaggcaggatcactggggcagagggtgcttcaacagaggagagaagcaatgtctgccccaaacctggcggcagcgcaaaagatg

SEQ ID NO: 100246 - DNA, 103 bp, Artificial Sequence
  Synthetic Polynucleotide
taatacgactcactataggggttctgctgaaggcaggatcactggggcagaacagaggagactgcccatgtgatcctgcaacctggcggcagcgcaaaagatg

SEQ ID NO: 100247 - DNA, 103 bp, Artificial Sequence
  Synthetic Polynucleotide
taatacgactcactatagggagggtcgtctgttctgctgaaggcaggatcaacagaggagagatcctatgttcagcagaaacctggcggcagcgcaaaagatg

SEQ ID NO: 100248 - DNA, 103 bp, Artificial Sequence
  Synthetic Polynucleotide
taatacgactcactatagggtgaagcttcaagggtcgtctgttctgctgaaacagaggagatcagcaatgcagacgaccaacctggcggcagcgcaaaagatg

SEQ ID NO: 100249 - DNA, 103 bp, Artificial Sequence
  Synthetic Polynucleotide
taatacgactcactatagggctggtgtgcttgaagcttcaagggtcgtctaacagaggagaagacgaatgttgaagcttaacctggcggcagcgcaaaagatg

SEQ ID NO: 100250 - DNA, 103 bp, Artificial Sequence
  Synthetic Polynucleotide
taatacgactcactatagggtgtttagcttttagtaagtcccgggaacgcaacagaggagagcgttcatgggacttactaacctggcggcagcgcaaaagatg

SEQ ID NO: 100251 - DNA, 103 bp, Artificial Sequence
  Synthetic Polynucleotide
taatacgactcactatagggtgcatgtcagctggtgtgcttgaagcttcaaacagaggagatgaagcatgaagcacaccaacctggcggcagcgcaaaagatg

SEQ ID NO: 100252 - DNA, 103 bp, Artificial Sequence
  Synthetic Polynucleotide
taatacgactcactatagggcaatatattctgcatgtcagctggtgtgctaacagaggagaagcacaatggctgacatgaacctggcggcagcgcaaaagatg

SEQ ID NO: 100253 - DNA, 103 bp, Artificial Sequence
  Synthetic Polynucleotide
taatacgactcactatagggagagaactgccaatatattctgcatgtcagaacagaggagactgacaatgagaatatataacctggcggcagcgcaaaagatg

SEQ ID NO: 100254 - DNA, 103 bp, Artificial Sequence
  Synthetic Polynucleotide
taatacgactcactatagggagctgactcaagagaactgccaatatattcaacagaggagagaatatatgggcagttctaacctggcggcagcgcaaaagatg

SEQ ID NO: 100255 - DNA, 103 bp, Artificial Sequence
  Synthetic Polynucleotide
taatacgactcactatagggggttttcatcagctgactcaagagaactgcaacagaggagagcagttatgttgagtcagaacctggcggcagcgcaaaagatg

SEQ ID NO: 100256 - DNA, 103 bp, Artificial Sequence
  Synthetic Polynucleotide
taatacgactcactatagggctggctcttgggttttcatcagctgactcaaacagaggagatgagtcatgtgatgaaaaaacctggcggcagcgcaaaagatg

SEQ ID NO: 100257 - DNA, 103 bp, Artificial Sequence
  Synthetic Polynucleotide
taatacgactcactatagggagactgcctgctggctcttgggttttcatcaacagaggagagatgaaatgccaagagccaacctggcggcagcgcaaaagatg

SEQ ID NO: 100258 - DNA, 103 bp, Artificial Sequence
  Synthetic Polynucleotide
taatacgactcactataggggttttcctccagactgcctgctggctcttgaacagaggagacaagagatggcaggcagtaacctggcggcagcgcaaaagatg

SEQ ID NO: 100259 - DNA, 103 bp, Artificial Sequence
  Synthetic Polynucleotide
taatacgactcactatagggtgtcactgttgttttcctccagactgcctgaacagaggagacaggcaatgtggaggaaaaacctggcggcagcgcaaaagatg

SEQ ID NO: 100260 - DNA, 103 bp, Artificial Sequence
  Synthetic Polynucleotide
taatacgactcactatagggccactgttcttgtcactgttgttttcctccaacagaggagaggaggaatgcaacagtgaaacctggcggcagcgcaaaagatg

SEQ ID NO: 100261 - DNA, 103 bp, Artificial Sequence
  Synthetic Polynucleotide
taatacgactcactatagggtttttcggtctgtttagcttttagtaagtcaacagaggagagacttaatgaaagctaaaaacctggcggcagcgcaaaagatg

SEQ ID NO: 100262 - DNA, 103 bp, Artificial Sequence
  Synthetic Polynucleotide
taatacgactcactatagggcccctgtggcccactgttcttgtcactgttaacagaggagaaacagtatgaagaacagtaacctggcggcagcgcaaaagatg

SEQ ID NO: 100263 - DNA, 103 bp, Artificial Sequence
  Synthetic Polynucleotide
taatacgactcactatagggttcttcggggcccctgtggcccactgttctaacagaggagaagaacaatgggccacaggaacctggcggcagcgcaaaagatg

SEQ ID NO: 100264 - DNA, 103 bp, Artificial Sequence
  Synthetic Polynucleotide
taatacgactcactatagggattgtgggagttcttcggggcccctgtggcaacagaggagagccacaatggccccgaagaacctggcggcagcgcaaaagatg

SEQ ID NO: 100265 - DNA, 103 bp, Artificial Sequence
  Synthetic Polynucleotide
taatacgactcactatagggctcctgtggcattgtgggagttcttcggggaacagaggagaccccgaatgactcccacaaacctggcggcagcgcaaaagatg

SEQ ID NO: 100266 - DNA, 103 bp, Artificial Sequence
  Synthetic Polynucleotide
taatacgactcactatagggctgctgcctcctcctgtggcattgtgggagaacagaggagactcccaatgtgccacaggaacctggcggcagcgcaaaagatg

SEQ ID NO: 100267 - DNA, 103 bp, Artificial Sequence
  Synthetic Polynucleotide
taatacgactcactatagggggaggacatgctgctgcctcctcctgtggcaacagaggagagccacaatgggaggcagcaacctggcggcagcgcaaaagatg

SEQ ID NO: 100268 - DNA, 103 bp, Artificial Sequence
  Synthetic Polynucleotide
taatacgactcactatagggaagaatgtgaggaggacatgctgctgcctcaacagaggagagaggcaatggcatgtcctaacctggcggcagcgcaaaagatg

SEQ ID NO: 100269 - DNA, 103 bp, Artificial Sequence
  Synthetic Polynucleotide
taatacgactcactatagggtctctggtggaagaatgtgaggaggacatgaacagaggagacatgtcatgctcacattcaacctggcggcagcgcaaaagatg

SEQ ID NO: 100270 - DNA, 103 bp, Artificial Sequence
  Synthetic Polynucleotide
taatacgactcactataggggggggcctcttctctggtggaagaatgtgaaacagaggagatcacatatgtccaccagaaacctggcggcagcgcaaaagatg

SEQ ID NO: 100271 - DNA, 103 bp, Artificial Sequence
  Synthetic Polynucleotide
taatacgactcactatagggggggggctcagggggcctcttctctggtggaacagaggagaccaccaatgaagaggcccaacctggcggcagcgcaaaagatg

SEQ ID NO: 100272 - DNA, 103 bp, Artificial Sequence
  Synthetic Polynucleotide
taatacgactcactatagggggcttttttctttttcggtctgtttagcttaacagaggagaaagctaatgagaccgaaaaacctggcggcagcgcaaaagatg

SEQ ID NO: 100273 - DNA, 103 bp, Artificial Sequence
  Synthetic Polynucleotide
taatacgactcactataggggtggaggtccggggggctcagggggcctctaacagaggagaagaggcatgctgagccccaacctggcggcagcgcaaaagatg

SEQ ID NO: 100274 - DNA, 103 bp, Artificial Sequence
  Synthetic Polynucleotide
taatacgactcactatagggggtggcggcggtggaggtccggggggctcaaacagaggagatgagccatgcggacctccaacctggcggcagcgcaaaagatg

SEQ ID NO: 100275 - DNA, 103 bp, Artificial Sequence
  Synthetic Polynucleotide
taatacgactcactatagggagggggtggaggtggcggcggtggaggtccaacagaggagaggacctatgccgccgccaaacctggcggcagcgcaaaagatg

SEQ ID NO: 100276 - DNA, 103 bp, Artificial Sequence
  Synthetic Polynucleotide
taatacgactcactatagggcttcaaccagagggggtggaggtggcggcgaacagaggagacgccgcatgctccaccccaacctggcggcagcgcaaaagatg

SEQ ID NO: 100277 - DNA, 103 bp, Artificial Sequence
  Synthetic Polynucleotide
taatacgactcactataggggaaagatcgccttcaaccagagggggtggaaacagaggagatccaccatgtctggttgaaacctggcggcagcgcaaaagatg

SEQ ID NO: 100278 - DNA, 103 bp, Artificial Sequence
  Synthetic Polynucleotide
taatacgactcactataggggggggcgctggaaagatcgccttcaaccagaacagaggagactggttatgggcgatcttaacctggcggcagcgcaaaagatg

SEQ ID NO: 100279 - DNA, 103 bp, Artificial Sequence
  Synthetic Polynucleotide
taatacgactcactatagggtcaactcctggggggcgctggaaagatcgcaacagaggagagcgatcatgccagcgcccaacctggcggcagcgcaaaagatg

SEQ ID NO: 100280 - DNA, 103 bp, Artificial Sequence
  Synthetic Polynucleotide
taatacgactcactatagggacggctgggttcaactcctggggggcgctgaacagaggagacagcgcatgccaggagttaacctggcggcagcgcaaaagatg

SEQ ID NO: 100281 - DNA, 103 bp, Artificial Sequence
  Synthetic Polynucleotide
taatacgactcactatagggggcggctgtcacggctgggttcaactcctgaacagaggagacaggagatgaacccagccaacctggcggcagcgcaaaagatg

SEQ ID NO: 100282 - DNA, 103 bp, Artificial Sequence
  Synthetic Polynucleotide
taatacgactcactataggggttgcagcaaggcggctgtcacggctgggtaacagaggagaacccagatgtgacagccgaacctggcggcagcgcaaaagatg

SEQ ID NO: 100283 - DNA, 103 bp, Artificial Sequence
  Synthetic Polynucleotide
taatacgactcactataggggagacttcttggcttttttctttttcggtcaacagaggagagaccgaatgagaaaaaagaacctggcggcagcgcaaaagatg

SEQ ID NO: 100284 - DNA, 103 bp, Artificial Sequence
  Synthetic Polynucleotide
taatacgactcactatagggtgggataaaagttgcagcaaggcggctgtcaacagaggagagacagcatgcttgctgcaaacctggcggcagcgcaaaagatg

SEQ ID NO: 100285 - DNA, 103 bp, Artificial Sequence
  Synthetic Polynucleotide
taatacgactcactatagggtgcttcaggctgggataaaagttgcagcaaaacagaggagattgctgatgcttttatccaacctggcggcagcgcaaaagatg

SEQ ID NO: 100286 - DNA, 103 bp, Artificial Sequence
  Synthetic Polynucleotide
taatacgactcactatagggcaggaggctctgcttcaggctgggataaaaaacagaggagattttatatgagcctgaagaacctggcggcagcgcaaaagatg

SEQ ID NO: 100287 - DNA, 103 bp, Artificial Sequence
  Synthetic Polynucleotide
taatacgactcactatagggggcaggtggccaggaggctctgcttcaggcaacagaggagagcctgaatgagagcctccaacctggcggcagcgcaaaagatg

SEQ ID NO: 100288 - DNA, 103 bp, Artificial Sequence
  Synthetic Polynucleotide
taatacgactcactataggggtgctcatgtggcaggtggccaggaggctcaacagaggagagagcctatgggccacctgaacctggcggcagcgcaaaagatg

SEQ ID NO: 100289 - DNA, 103 bp, Artificial Sequence
  Synthetic Polynucleotide
taatacgactcactatagggtcaaggcctggtgctcatgtggcaggtggcaacagaggagagccaccatgcacatgagcaacctggcggcagcgcaaaagatg

SEQ ID NO: 100290 - DNA, 103 bp, Artificial Sequence
  Synthetic Polynucleotide
taatacgactcactatagggtccattggtctcaaggcctggtgctcatgtaacagaggagaacatgaatgccaggccttaacctggcggcagcgcaaaagatg

SEQ ID NO: 100291 - DNA, 103 bp, Artificial Sequence
  Synthetic Polynucleotide
taatacgactcactatagggggtggagtactccattggtctcaaggcctgaacagaggagacaggccatgagaccaatgaacctggcggcagcgcaaaagatg

SEQ ID NO: 100292 - DNA, 103 bp, Artificial Sequence
  Synthetic Polynucleotide
taatacgactcactataggggacggggtcgggtggagtactccattggtcaacagaggagagaccaaatgagtactccaaacctggcggcagcgcaaaagatg

SEQ ID NO: 100293 - DNA, 103 bp, Artificial Sequence
  Synthetic Polynucleotide
taatacgactcactataggggtcctgtttggacggggtcgggtggagtacaacagaggagagtactcatgccgaccccgaacctggcggcagcgcaaaagatg

SEQ ID NO: 100294 - DNA, 103 bp, Artificial Sequence
  Synthetic Polynucleotide
taatacgactcactatagggagttccagaagctcctccactcccgtccttaacagaggagaaaggacatgagtggaggaaacctggcggcagcgcaaaagatg

SEQ ID NO: 100295 - DNA, 103 bp, Artificial Sequence
  Synthetic Polynucleotide
taatacgactcactatagggcgacttgctggagacttcttggcttttttcaacagaggagagaaaaaatgcaagaagtcaacctggcggcagcgcaaaagatg

SEQ ID NO: 100296 - DNA, 103 bp, Artificial Sequence
  Synthetic Polynucleotide
taatacgactcactataggggtttccataagtcctgtttggacggggtcgaacagaggagacgacccatgccaaacaggaacctggcggcagcgcaaaagatg

SEQ ID NO: 100297 - DNA, 103 bp, Artificial Sequence
  Synthetic Polynucleotide
taatacgactcactataggggcccatcagtgtttccataagtcctgtttgaacagaggagacaaacaatgcttatggaaaacctggcggcagcgcaaaagatg

SEQ ID NO: 100298 - DNA, 103 bp, Artificial Sequence
  Synthetic Polynucleotide
taatacgactcactatagggcctgtttcaggcccatcagtgtttccataaaacagaggagattatggatgcactgatggaacctggcggcagcgcaaaagatg

SEQ ID NO: 100299 - DNA, 103 bp, Artificial Sequence
  Synthetic Polynucleotide
taatacgactcactatagggggcactgaaccctgtttcaggcccatcagtaacagaggagaactgatatgcctgaaacaaacctggcggcagcgcaaaagatg

SEQ ID NO: 100300 - DNA, 103 bp, Artificial Sequence
  Synthetic Polynucleotide
taatacgactcactatagggcagtgtcaatggcactgaaccctgtttcagaacagaggagactgaaaatgggttcagtgaacctggcggcagcgcaaaagatg

SEQ ID NO: 100301 - DNA, 103 bp, Artificial Sequence
  Synthetic Polynucleotide
taatacgactcactatagggtttcgttcatcagtgtcaatggcactgaacaacagaggagagttcagatgcattgacacaacctggcggcagcgcaaaagatg

SEQ ID NO: 100302 - DNA, 103 bp, Artificial Sequence
  Synthetic Polynucleotide
taatacgactcactatagggtggaccagagtttcgttcatcagtgtcaataacagaggagaattgacatggatgaacgaaacctggcggcagcgcaaaagatg

SEQ ID NO: 100303 - DNA, 103 bp, Artificial Sequence
  Synthetic Polynucleotide
taatacgactcactatagggctgtcaaggctggaccagagtttcgttcataacagaggagaatgaacatgactctggtcaacctggcggcagcgcaaaagatg

SEQ ID NO: 100304 - DNA, 103 bp, Artificial Sequence
  Synthetic Polynucleotide
taatacgactcactatagggaccaaggattctgtcaaggctggaccagagaacagaggagactctggatgagccttgacaacctggcggcagcgcaaaagatg

SEQ ID NO: 100305 - DNA, 103 bp, Artificial Sequence
  Synthetic Polynucleotide
taatacgactcactatagggcagggtctggaccaaggattctgtcaaggcaacagaggagagccttgatggaatccttgaacctggcggcagcgcaaaagatg

SEQ ID NO: 100306 - DNA, 103 bp, Artificial Sequence
  Synthetic Polynucleotide
taatacgactcactatagggtcatcgatcccgacttgctggagacttcttaacagaggagaaagaagatgccagcaagtaacctggcggcagcgcaaaagatg

SEQ ID NO: 100307 - DNA, 103 bp, Artificial Sequence
  Synthetic Polynucleotide
taatacgactcactatagggtgttcttcaccagggtctggaccaaggattaacagaggagaaatcctatgtccagacccaacctggcggcagcgcaaaagatg

SEQ ID NO: 100308 - DNA, 103 bp, Artificial Sequence
  Synthetic Polynucleotide
taatacgactcactataggggagaaggtcctgttcttcaccagggtctggaacagaggagaccagacatgggtgaagaaaacctggcggcagcgcaaaagatg

SEQ ID NO: 100309 - DNA, 103 bp, Artificial Sequence
  Synthetic Polynucleotide
taatacgactcactatagggcagagagcctgagaaggtcctgttcttcacaacagaggagagtgaagatgaggaccttcaacctggcggcagcgcaaaagatg

SEQ ID NO: 100310 - DNA, 103 bp, Artificial Sequence
  Synthetic Polynucleotide
taatacgactcactatagggcaaggtggctcagagagcctgagaaggtccaacagaggagaggacctatgcaggctctcaacctggcggcagcgcaaaagatg

SEQ ID NO: 100311 - DNA, 103 bp, Artificial Sequence
  Synthetic Polynucleotide
taatacgactcactatagggctggactccccaaggtggctcagagagcctaacagaggagaaggctcatggagccacctaacctggcggcagcgcaaaagatg

SEQ ID NO: 100312 - DNA, 103 bp, Artificial Sequence
  Synthetic Polynucleotide
taatacgactcactatagggctggtaactgctggactccccaaggtggctaacagaggagaagccacatgggggagtccaacctggcggcagcgcaaaagatg

SEQ ID NO: 100313 - DNA, 103 bp, Artificial Sequence
  Synthetic Polynucleotide
taatacgactcactatagggaccctgtgccctggtaactgctggactcccaacagaggagagggagtatggcagttaccaacctggcggcagcgcaaaagatg

SEQ ID NO: 100314 - DNA, 103 bp, Artificial Sequence
  Synthetic Polynucleotide
taatacgactcactatagggaactgcactgaccctgtgccctggtaactgaacagaggagacagttaatggggcacaggaacctggcggcagcgcaaaagatg

SEQ ID NO: 100315 - DNA, 103 bp, Artificial Sequence
  Synthetic Polynucleotide
taatacgactcactataggggtcccctggaaactgcactgaccctgtgccaacagaggagaggcacaatgtcagtgcagaacctggcggcagcgcaaaagatg

SEQ ID NO: 100316 - DNA, 103 bp, Artificial Sequence
  Synthetic Polynucleotide
taatacgactcactatagggggaggtcctggtcccctggaaactgcactgaacagaggagacagtgcatgttccaggggaacctggcggcagcgcaaaagatg

SEQ ID NO: 100317 - DNA, 103 bp, Artificial Sequence
  Synthetic Polynucleotide
taatacgactcactatagggatccggtccttcatcgatcccgacttgctgaacagaggagacagcaaatggggatcgataacctggcggcagcgcaaaagatg

SEQ ID NO: 100318 - DNA, 103 bp, Artificial Sequence
  Synthetic Polynucleotide
taatacgactcactatagggctggcaaaacggaggtcctggtcccctggaaacagaggagatccaggatgccaggacctaacctggcggcagcgcaaaagatg

SEQ ID NO: 100319 - DNA, 103 bp, Artificial Sequence
  Synthetic Polynucleotide
taatacgactcactatagggtaaggggaccctggcaaaacggaggtcctgaacagaggagacaggacatgcgttttgccaacctggcggcagcgcaaaagatg

SEQ ID NO: 100320 - DNA, 103 bp, Artificial Sequence
  Synthetic Polynucleotide
taatacgactcactatagggggtgtaacgctaaggggaccctggcaaaacaacagaggagagttttgatggggtcccctaacctggcggcagcgcaaaagatg

SEQ ID NO: 100321 - DNA, 103 bp, Artificial Sequence
  Synthetic Polynucleotide
taatacgactcactatagggccgaccaccgggtgtaacgctaaggggaccaacagaggagaggtcccatgagcgttacaaacctggcggcagcgcaaaagatg

SEQ ID NO: 100322 - DNA, 103 bp, Artificial Sequence
  Synthetic Polynucleotide
taatacgactcactataggggaatggttgcccgaccaccgggtgtaacgcaacagaggagagcgttaatgccggtggtcaacctggcggcagcgcaaaagatg

SEQ ID NO: 100323 - DNA, 103 bp, Artificial Sequence
  Synthetic Polynucleotide
taatacgactcactatagggcagccttcaggaatggttgcccgaccaccgaacagaggagacggtggatgggcaaccataacctggcggcagcgcaaaagatg

SEQ ID NO: 100324 - DNA, 103 bp, Artificial Sequence
  Synthetic Polynucleotide
taatacgactcactatagggctgcttccctcagccttcaggaatggttgcaacagaggagagcaaccatgcctgaaggcaacctggcggcagcgcaaaagatg

SEQ ID NO: 100325 - DNA, 103 bp, Artificial Sequence
  Synthetic Polynucleotide
taatacgactcactatagggcacagaattgctgcttccctcagccttcagaacagaggagactgaagatggagggaagcaacctggcggcagcgcaaaagatg

SEQ ID NO: 100326 - DNA, 103 bp, Artificial Sequence
  Synthetic Polynucleotide
taatacgactcactatagggctgcatgtaccacagaattgctgcttccctaacagaggagaagggaaatggcaattctgaacctggcggcagcgcaaaagatg

SEQ ID NO: 100327 - DNA, 103 bp, Artificial Sequence
  Synthetic Polynucleotide
taatacgactcactatagggaatttggtctctgcatgtaccacagaattgaacagaggagacaattcatgggtacatgcaacctggcggcagcgcaaaagatg

SEQ ID NO: 100328 - DNA, 103 bp, Artificial Sequence
  Synthetic Polynucleotide
taatacgactcactatagggacttcccgatatccggtccttcatcgatccaacagaggagaggatcgatgaaggaccggaacctggcggcagcgcaaaagatg

SEQ ID NO: 100329 - DNA, 103 bp, Artificial Sequence
  Synthetic Polynucleotide
taatacgactcactatagggatagttttgcaatttggtctctgcatgtacaacagaggagagtacatatggagaccaaaaacctggcggcagcgcaaaagatg

SEQ ID NO: 100330 - DNA, 103 bp, Artificial Sequence
  Synthetic Polynucleotide
taatacgactcactatagggccagctccccatagttttgcaatttggtctaacagaggagaagaccaatgtgcaaaactaacctggcggcagcgcaaaagatg

SEQ ID NO: 100331 - DNA, 103 bp, Artificial Sequence
  Synthetic Polynucleotide
taatacgactcactataggggttcctggccccagctccccatagttttgcaacagaggagagcaaaaatgtggggagctaacctggcggcagcgcaaaagatg

SEQ ID NO: 100332 - DNA, 103 bp, Artificial Sequence
  Synthetic Polynucleotide
taatacgactcactatagggggccccagtggttcctggccccagctccccaacagaggagaggggagatggggccaggaaacctggcggcagcgcaaaagatg

SEQ ID NO: 100333 - DNA, 103 bp, Artificial Sequence
  Synthetic Polynucleotide
taatacgactcactatagggctgagctgctggccccagtggttcctggccaacagaggagaggccagatgccactggggaacctggcggcagcgcaaaagatg

SEQ ID NO: 100334 - DNA, 103 bp, Artificial Sequence
  Synthetic Polynucleotide
taatacgactcactatagggaggcctgctcctgagctgctggccccagtgaacagaggagacactggatgcagcagctcaacctggcggcagcgcaaaagatg

SEQ ID NO: 100335 - DNA, 103 bp, Artificial Sequence
  Synthetic Polynucleotide
taatacgactcactatagggcccccagtgaaggcctgctcctgagctgctaacagaggagaagcagcatgggagcaggcaacctggcggcagcgcaaaagatg

SEQ ID NO: 100336 - DNA, 103 bp, Artificial Sequence
  Synthetic Polynucleotide
taatacgactcactataggggagttgggcccccccagtgaaggcctgctcaacagaggagagagcagatgttcactgggaacctggcggcagcgcaaaagatg

SEQ ID NO: 100337 - DNA, 103 bp, Artificial Sequence
  Synthetic Polynucleotide
taatacgactcactataggggcagaagactgagttgggcccccccagtgaaacagaggagatcactgatggggcccaacaacctggcggcagcgcaaaagatg

SEQ ID NO: 100338 - DNA, 103 bp, Artificial Sequence
  Synthetic Polynucleotide
taatacgactcactatagggttttccataagcagaagactgagttgggccaacagaggagaggcccaatgcagtcttctaacctggcggcagcgcaaaagatg

SEQ ID NO: 100339 - DNA, 103 bp, Artificial Sequence
  Synthetic Polynucleotide
taatacgactcactatagggaacgctttgaacttcccgatatccggtcctaacagaggagaaggaccatgtatcgggaaaacctggcggcagcgcaaaagatg

SEQ ID NO: 100340 - DNA, 103 bp, Artificial Sequence
  Synthetic Polynucleotide
taatacgactcactatagggcccgatagagttttccataagcagaagactaacagaggagaagtcttatgcttatggaaaacctggcggcagcgcaaaagatg

SEQ ID NO: 100341 - DNA, 103 bp, Artificial Sequence
  Synthetic Polynucleotide
taatacgactcactatagggcttgtaggcccccgatagagttttccataaaacagaggagattatggatgactctatcgaacctggcggcagcgcaaaagatg

SEQ ID NO: 100342 - DNA, 103 bp, Artificial Sequence
  Synthetic Polynucleotide
taatacgactcactatagggtggtgggactcttgtaggcccccgatagagaacagaggagactctatatggggcctacaaacctggcggcagcgcaaaagatg

SEQ ID NO: 100343 - DNA, 103 bp, Artificial Sequence
  Synthetic Polynucleotide
taatacgactcactatagggttccccctcttggtgggactcttgtaggccaacagaggagaggcctaatggagtcccacaacctggcggcagcgcaaaagatg

SEQ ID NO: 100344 - DNA, 103 bp, Artificial Sequence
  Synthetic Polynucleotide
taatacgactcactatagggcctctccctcttccccctcttggtgggactaacagaggagaagtcccatgaagagggggaacctggcggcagcgcaaaagatg

SEQ ID NO: 100345 - DNA, 103 bp, Artificial Sequence
  Synthetic Polynucleotide
taatacgactcactataggggtaaggaactcctctccctcttccccctctaacagaggagaagagggatgagagggagaaacctggcggcagcgcaaaagatg

SEQ ID NO: 100346 - DNA, 103 bp, Artificial Sequence
  Synthetic Polynucleotide
taatacgactcactatagggtcctcattcgaacgctttgaacttcccgataacagaggagaatcgggatgttcaaagcgaacctggcggcagcgcaaaagatg

SEQ ID NO: 100347 - DNA, 103 bp, Artificial Sequence
  Synthetic Polynucleotide
taatacgactcactataggggtcatcagtctcctcattcgaacgctttgaaacagaggagatcaaagatgtcgaatgagaacctggcggcagcgcaaaagatg

SEQ ID NO: 100348 - DNA, 103 bp, Artificial Sequence
  Synthetic Polynucleotide
taatacgactcactatagggccttcccatagtcatcagtctcctcattcgaacagaggagacgaatgatgagactgatgaacctggcggcagcgcaaaagatg

SEQ ID NO: 100349 - DNA, 103 bp, Artificial Sequence
  Synthetic Polynucleotide
taatacgactcactataggggctacctgcgccttcccatagtcatcagtcaacagaggagagactgaatgctatgggaaaacctggcggcagcgcaaaagatg

SEQ ID NO: 100350 - DNA, 103 bp, Artificial Sequence
  Synthetic Polynucleotide
taatacgactcactataggggctgcttttggctacctgcgccttcccataaacagaggagatatgggatggcgcaggtaaacctggcggcagcgcaaaagatg

SEQ ID NO: 100351 - DNA, 103 bp, Artificial Sequence
  Synthetic Polynucleotide
taatacgactcactatagggacggctgcaaagttccagaagctcctccacaacagaggagagtggagatgcttctggaaaacctggcggcagcgcaaaagatg

SEQ ID NO: 100352 - DNA, 103 bp, Artificial Sequence
  Synthetic Polynucleotide
taatacgactcactatagggattccttgctgctgcttttggctacctgcgaacagaggagacgcaggatgccaaaagcaaacctggcggcagcgcaaaagatg

SEQ ID NO: 100353 - DNA, 103 bp, Artificial Sequence
  Synthetic Polynucleotide
taatacgactcactataggggatgacctggattccttgctgctgcttttgaacagaggagacaaaagatgcagcaaggaaacctggcggcagcgcaaaagatg

SEQ ID NO: 100354 - DNA, 103 bp, Artificial Sequence
  Synthetic Polynucleotide
taatacgactcactataggggtggagcttggatgacctggattccttgctaacagaggagaagcaagatgtccaggtcaaacctggcggcagcgcaaaagatg

SEQ ID NO: 100355 - DNA, 103 bp, Artificial Sequence
  Synthetic Polynucleotide
taatacgactcactatagggtcttctccttgtggagcttggatgacctggaacagaggagaccaggtatgccaagctccaacctggcggcagcgcaaaagatg

SEQ ID NO: 100356 - DNA, 103 bp, Artificial Sequence
  Synthetic Polynucleotide
taatacgactcactatagggtctttcctggtcttctccttgtggagcttgaacagaggagacaagctatgcaaggagaaaacctggcggcagcgcaaaagatg

SEQ ID NO: 100357 - DNA, 103 bp, Artificial Sequence
  Synthetic Polynucleotide
taatacgactcactatagggcagctcccgttctttcctggtcttctccttaacagaggagaaaggagatgaccaggaaaaacctggcggcagcgcaaaagatg

SEQ ID NO: 100358 - DNA, 103 bp, Artificial Sequence
  Synthetic Polynucleotide
taatacgactcactataggggcccagacttcagctcccgttctttcctggaacagaggagaccaggaatgaacgggagcaacctggcggcagcgcaaaagatg

SEQ ID NO: 100359 - DNA, 103 bp, Artificial Sequence
  Synthetic Polynucleotide
taatacgactcactatagggcggtctttgtgcccagacttcagctcccgtaacagaggagaacgggaatggaagtctggaacctggcggcagcgcaaaagatg

SEQ ID NO: 100360 - DNA, 103 bp, Artificial Sequence
  Synthetic Polynucleotide
taatacgactcactatagggacttttactccggtctttgtgcccagacttaacagaggagaaagtctatgcacaaagacaacctggcggcagcgcaaaagatg

SEQ ID NO: 100361 - DNA, 103 bp, Artificial Sequence
  Synthetic Polynucleotide
taatacgactcactatagggtttttcgatgacttttactccggtctttgtaacagaggagaacaaagatgggagtaaaaaacctggcggcagcgcaaaagatg

SEQ ID NO: 100362 - DNA, 103 bp, Artificial Sequence
  Synthetic Polynucleotide
taatacgactcactatagggcctcccgatgacggctgcaaagttccagaaaacagaggagattctggatgtttgcagccaacctggcggcagcgcaaaagatg

SEQ ID NO: 100363 - DNA, 103 bp, Artificial Sequence
  Synthetic Polynucleotide
taatacgactcactatagggggtgtttccctttttcgatgacttttactcaacagaggagagagtaaatgtcatcgaaaaacctggcggcagcgcaaaagatg

SEQ ID NO: 100364 - DNA, 103 bp, Artificial Sequence
  Synthetic Polynucleotide
taatacgactcactataggggtaacttttgggtgtttccctttttcgatgaacagaggagacatcgaatgagggaaacaaacctggcggcagcgcaaaagatg

SEQ ID NO: 100365 - DNA, 103 bp, Artificial Sequence
  Synthetic Polynucleotide
taatacgactcactatagggccactgttttgtaacttttgggtgtttcccaacagaggagagggaaaatgccaaaagttaacctggcggcagcgcaaaagatg

SEQ ID NO: 100366 - DNA, 103 bp, Artificial Sequence
  Synthetic Polynucleotide
taatacgactcactatagggtttgggctgtccactgttttgtaacttttgaacagaggagacaaaagatgcaaaacagtaacctggcggcagcgcaaaagatg

SEQ ID NO: 100367 - DNA, 103 bp, Artificial Sequence
  Synthetic Polynucleotide
taatacgactcactatagggggatctccgttttgggctgtccactgttttaacagaggagaaaaacaatggacagcccaaacctggcggcagcgcaaaagatg

SEQ ID NO: 100368 - DNA, 103 bp, Artificial Sequence
  Synthetic Polynucleotide
taatacgactcactataggggggggctcctggatctccgttttgggctgtaacagaggagaacagccatgaacggagataacctggcggcagcgcaaaagatg

SEQ ID NO: 100369 - DNA, 103 bp, Artificial Sequence
  Synthetic Polynucleotide
taatacgactcactatagggcacttcctgtgggggctcctggatctccgtaacagaggagaacggagatgcaggagcccaacctggcggcagcgcaaaagatg

SEQ ID NO: 100370 - DNA, 103 bp, Artificial Sequence
  Synthetic Polynucleotide
taatacgactcactataggggctgtcagaccacttcctgtgggggctcctaacagaggagaaggagcatgcacaggaagaacctggcggcagcgcaaaagatg

SEQ ID NO: 100371 - DNA, 103 bp, Artificial Sequence
  Synthetic Polynucleotide
taatacgactcactatagggcttgtttggagctgtcagaccacttcctgtaacagaggagaacaggaatgggtctgacaaacctggcggcagcgcaaaagatg

SEQ ID NO: 100372 - DNA, 103 bp, Artificial Sequence
  Synthetic Polynucleotide
taatacgactcactataggggggctatcatcttgtttggagctgtcagacaacagaggagagtctgaatgctccaaacaaacctggcggcagcgcaaaagatg

SEQ ID NO: 100373 - DNA, 103 bp, Artificial Sequence
  Synthetic Polynucleotide
taatacgactcactatagggagagctgccgcctcccgatgacggctgcaaaacagaggagattgcagatgtcatcgggaaacctggcggcagcgcaaaagatg

SEQ ID NO: 100374 - DNA, 103 bp, Artificial Sequence
  Synthetic Polynucleotide
taatacgactcactatagggagctcccgaggggctatcatcttgtttggaaacagaggagatccaaaatggatgatagcaacctggcggcagcgcaaaagatg

SEQ ID NO: 100375 - DNA, 103 bp, Artificial Sequence
  Synthetic Polynucleotide
taatacgactcactatagggggccataagaagctcccgaggggctatcataacagaggagaatgataatgcctcgggagaacctggcggcagcgcaaaagatg

SEQ ID NO: 100376 - DNA, 103 bp, Artificial Sequence
  Synthetic Polynucleotide
taatacgactcactatagggtcataatcttggccataagaagctcccgagaacagaggagactcgggatgttcttatggaacctggcggcagcgcaaaagatg

SEQ ID NO: 100377 - DNA, 103 bp, Artificial Sequence
  Synthetic Polynucleotide
taatacgactcactataggggggactaaggtcataatcttggccataagaaacagaggagatcttatatgcaagattataacctggcggcagcgcaaaagatg

SEQ ID NO: 100378 - DNA, 103 bp, Artificial Sequence
  Synthetic Polynucleotide
taatacgactcactataggggagatcgtgagggactaaggtcataatcttaacagaggagaaagattatgaccttagtcaacctggcggcagcgcaaaagatg

SEQ ID NO: 100379 - DNA, 103 bp, Artificial Sequence
  Synthetic Polynucleotide
taatacgactcactatagggctcgaggtatgagatcgtgagggactaaggaacagaggagaccttagatgctcacgatcaacctggcggcagcgcaaaagatg

SEQ ID NO: 100380 - DNA, 103 bp, Artificial Sequence
  Synthetic Polynucleotide
taatacgactcactataggggtcataattgctcgaggtatgagatcgtgaaacagaggagatcacgaatgcatacctcgaacctggcggcagcgcaaaagatg

SEQ ID NO: 100381 - DNA, 103 bp, Artificial Sequence
  Synthetic Polynucleotide
taatacgactcactatagggtcttgtaggagtcataattgctcgaggtataacagaggagaatacctatggcaattatgaacctggcggcagcgcaaaagatg

SEQ ID NO: 100382 - DNA, 103 bp, Artificial Sequence
  Synthetic Polynucleotide
taatacgactcactatagggccaggacttttcttgtaggagtcataattgaacagaggagacaattaatgctcctacaaaacctggcggcagcgcaaaagatg

SEQ ID NO: 100383 - DNA, 103 bp, Artificial Sequence
  Synthetic Polynucleotide
taatacgactcactatagggcgaggtacttccaggacttttcttgtaggaaacagaggagatcctacatgaaaagtcctaacctggcggcagcgcaaaagatg

SEQ ID NO: 100384 - DNA, 103 bp, Artificial Sequence
  Synthetic Polynucleotide
taatacgactcactatagggctctgctgttagagctgccgcctcccgatgaacagaggagacatcggatggcggcagctaacctggcggcagcgcaaaagatg

SEQ ID NO: 100385 - DNA, 103 bp, Artificial Sequence
  Synthetic Polynucleotide
taatacgactcactatagggactgccttctcgaggtacttccaggactttaacagaggagaaaagtcatggaagtacctaacctggcggcagcgcaaaagatg

SEQ ID NO: 100386 - DNA, 103 bp, Artificial Sequence
  Synthetic Polynucleotide
taatacgactcactatagggggactgaccgactgccttctcgaggtacttaacagaggagaaagtacatggagaaggcaaacctggcggcagcgcaaaagatg

SEQ ID NO: 100387 - DNA, 103 bp, Artificial Sequence
  Synthetic Polynucleotide
taatacgactcactatagggcttgtaagggggactgaccgactgccttctaacagaggagaagaaggatgtcggtcagtaacctggcggcagcgcaaaagatg

SEQ ID NO: 100388 - DNA, 103 bp, Artificial Sequence
  Synthetic Polynucleotide
taatacgactcactatagggccgaaggctccttgtaagggggactgaccgaacagaggagacggtcaatgccccttacaaacctggcggcagcgcaaaagatg

SEQ ID NO: 100389 - DNA, 103 bp, Artificial Sequence
  Synthetic Polynucleotide
taatacgactcactataggggactggtaggccgaaggctccttgtaagggaacagaggagacccttaatgggagccttcaacctggcggcagcgcaaaagatg

SEQ ID NO: 100390 - DNA, 103 bp, Artificial Sequence
  Synthetic Polynucleotide
taatacgactcactatagggccgggtgctggactggtaggccgaaggctcaacagaggagagagcctatggcctaccagaacctggcggcagcgcaaaagatg

SEQ ID NO: 100391 - DNA, 103 bp, Artificial Sequence
  Synthetic Polynucleotide
taatacgactcactatagggggctcggtgaccgggtgctggactggtaggaacagaggagacctaccatgccagcacccaacctggcggcagcgcaaaagatg

SEQ ID NO: 100392 - DNA, 103 bp, Artificial Sequence
  Synthetic Polynucleotide
taatacgactcactatagggctactgtaggggctcggtgaccgggtgctgaacagaggagacagcacatggtcaccgagaacctggcggcagcgcaaaagatg

SEQ ID NO: 100393 - DNA, 103 bp, Artificial Sequence
  Synthetic Polynucleotide
taatacgactcactatagggtctctgtcgcctactgtaggggctcggtgaaacagaggagatcaccgatgccctacagtaacctggcggcagcgcaaaagatg

SEQ ID NO: 100394 - DNA, 103 bp, Artificial Sequence
  Synthetic Polynucleotide
taatacgactcactataggggactgacagatctctgtcgcctactgtaggaacagaggagacctacaatgggcgacagaaacctggcggcagcgcaaaagatg

SEQ ID NO: 100395 - DNA, 103 bp, Artificial Sequence
  Synthetic Polynucleotide
taatacgactcactatagggcggtgacgctctctgctgttagagctgccgaacagaggagacggcagatgtaacagcagaacctggcggcagcgcaaaagatg

SEQ ID NO: 100396 - DNA, 103 bp, Artificial Sequence
  Synthetic Polynucleotide
taatacgactcactatagggctgctatagggactgacagatctctgtcgcaacagaggagagcgacaatgatctgtcagaacctggcggcagcgcaaaagatg

SEQ ID NO: 100397 - DNA, 103 bp, Artificial Sequence
  Synthetic Polynucleotide
taatacgactcactatagggcgaccgtctcctgctatagggactgacagaaacagaggagatctgtcatgccctatagcaacctggcggcagcgcaaaagatg

SEQ ID NO: 100398 - DNA, 103 bp, Artificial Sequence
  Synthetic Polynucleotide
taatacgactcactatagggcgtagctggacgaccgtctcctgctataggaacagaggagacctataatgggagacggtaacctggcggcagcgcaaaagatg

SEQ ID NO: 100399 - DNA, 103 bp, Artificial Sequence
  Synthetic Polynucleotide
taatacgactcactatagggccacttctttcgtagctggacgaccgtctcaacagaggagagagacgatggtccagctaaacctggcggcagcgcaaaagatg

SEQ ID NO: 100400 - DNA, 103 bp, Artificial Sequence
  Synthetic Polynucleotide
taatacgactcactataggggctgtaagagccacttctttcgtagctggaaacagaggagatccagcatggaaagaagtaacctggcggcagcgcaaaagatg

SEQ ID NO: 100401 - DNA, 103 bp, Artificial Sequence
  Synthetic Polynucleotide
taatacgactcactataggggcgatcgcccgctgtaagagccacttctttaacagaggagaaaagaaatggctcttacaaacctggcggcagcgcaaaagatg

SEQ ID NO: 100402 - DNA, 103 bp, Artificial Sequence
  Synthetic Polynucleotide
taatacgactcactatagggtagggactgggcgatcgcccgctgtaagagaacagaggagactcttaatgcgggcgatcaacctggcggcagcgcaaaagatg

SEQ ID NO: 100403 - DNA, 103 bp, Artificial Sequence
  Synthetic Polynucleotide
taatacgactcactatagggccttcgaccatagggactgggcgatcgcccaacagaggagagggcgaatgcccagtcccaacctggcggcagcgcaaaagatg

SEQ ID NO: 100404 - DNA, 103 bp, Artificial Sequence
  Synthetic Polynucleotide
taatacgactcactatagggtgctggaccgccttcgaccatagggactggaacagaggagaccagtcatgatggtcgaaaacctggcggcagcgcaaaagatg

SEQ ID NO: 100405 - DNA, 103 bp, Artificial Sequence
  Synthetic Polynucleotide
taatacgactcactatagggaggaaagggctgctggaccgccttcgaccaaacagaggagatggtcgatggcggtccagaacctggcggcagcgcaaaagatg

SEQ ID NO: 100406 - DNA, 103 bp, Artificial Sequence
  Synthetic Polynucleotide
taatacgactcactatagggccccagcgccgtgtccgagctgctcggcataacagaggagaatgccgatgagctcggacaacctggcggcagcgcaaaagatg

SEQ ID NO: 100407 - DNA, 103 bp, Artificial Sequence
  Synthetic Polynucleotide
taatacgactcactatagggcagcagcggcggctgctgaggggacaggaaaacagaggagattcctgatgcctcagcagaacctggcggcagcgcaaaagatg

SEQ ID NO: 100408 - DNA, 103 bp, Artificial Sequence
  Synthetic Polynucleotide
taatacgactcactatagggggacttgcggctcctcaggctctgagaggcaacagaggagagcctctatgagcctgaggaacctggcggcagcgcaaaagatg

SEQ ID NO: 100409 - DNA, 103 bp, Artificial Sequence
  Synthetic Polynucleotide
taatacgactcactatagggccgggctgggggacttgcggctcctcaggcaacagaggagagcctgaatggccgcaagtaacctggcggcagcgcaaaagatg

SEQ ID NO: 100410 - DNA, 103 bp, Artificial Sequence
  Synthetic Polynucleotide
taatacgactcactatagggccacctcctgccgggctgggggacttgcggaacagaggagaccgcaaatgccccagcccaacctggcggcagcgcaaaagatg

SEQ ID NO: 100411 - DNA, 103 bp, Artificial Sequence
  Synthetic Polynucleotide
taatacgactcactatagggggggctgctgccacctcctgccgggctgggaacagaggagacccagcatggcaggaggtaacctggcggcagcgcaaaagatg

SEQ ID NO: 100412 - DNA, 103 bp, Artificial Sequence
  Synthetic Polynucleotide
taatacgactcactataggggccgagaataggggctgctgccacctcctgaacagaggagacaggagatggcagcagccaacctggcggcagcgcaaaagatg

SEQ ID NO: 100413 - DNA, 103 bp, Artificial Sequence
  Synthetic Polynucleotide
taatacgactcactatagggcgcggcagccgccgagaataggggctgctgaacagaggagacagcagatgctattctcgaacctggcggcagcgcaaaagatg

SEQ ID NO: 100414 - DNA, 103 bp, Artificial Sequence
  Synthetic Polynucleotide
taatacgactcactataggggctcggggagcgcggcagccgccgagaataaacagaggagatattctatgcggctgccgaacctggcggcagcgcaaaagatg

SEQ ID NO: 100415 - DNA, 103 bp, Artificial Sequence
  Synthetic Polynucleotide
taatacgactcactataggggactgtaggggctcggggagcgcggcagccaacagaggagaggctgcatggctccccgaaacctggcggcagcgcaaaagatg

SEQ ID NO: 100416 - DNA, 103 bp, Artificial Sequence
  Synthetic Polynucleotide
taatacgactcactataggggagcggcggcgactgtaggggctcggggagaacagaggagactccccatgcccctacagaacctggcggcagcgcaaaagatg

SEQ ID NO: 100417 - DNA, 103 bp, Artificial Sequence
  Synthetic Polynucleotide
taatacgactcactataggggtagctgggggagcggcggcgactgtagggaacagaggagaccctacatgcgccgccgcaacctggcggcagcgcaaaagatg

SEQ ID NO: 100418 - DNA, 103 bp, Artificial Sequence
  Synthetic Polynucleotide
taatacgactcactatagggggagcggcaacagcagcggcggctgctgagaacagaggagactcagcatgcgccgctgcaacctggcggcagcgcaaaagatg

SEQ ID NO: 100419 - DNA, 103 bp, Artificial Sequence
  Synthetic Polynucleotide
taatacgactcactatagggtgtggcggctgtagctgggggagcggcggcaacagaggagagccgccatgcccccagctaacctggcggcagcgcaaaagatg

SEQ ID NO: 100420 - DNA, 103 bp, Artificial Sequence
  Synthetic Polynucleotide
taatacgactcactatagggtcgtaggagctgtggcggctgtagctggggaacagaggagaccccagatgcagccgccaaacctggcggcagcgcaaaagatg

SEQ ID NO: 100421 - DNA, 103 bp, Artificial Sequence
  Synthetic Polynucleotide
taatacgactcactataggggccgccccgctcgtaggagctgtggcggctaacagaggagaagccgcatgagctcctacaacctggcggcagcgcaaaagatg

SEQ ID NO: 100422 - DNA, 103 bp, Artificial Sequence
  Synthetic Polynucleotide
taatacgactcactataggggggacacgtcgccgccccgctcgtaggagcaacagaggagagctcctatgagcggggcgaacctggcggcagcgcaaaagatg

SEQ ID NO: 100423 - DNA, 103 bp, Artificial Sequence
  Synthetic Polynucleotide
taatacgactcactatagggtagggactaggggacacgtcgccgccccgcaacagaggagagcggggatgcgacgtgtcaacctggcggcagcgcaaaagatg

SEQ ID NO: 100424 - DNA, 103 bp, Artificial Sequence
  Synthetic Polynucleotide
taatacgactcactataggggctgctgctgtagggactaggggacacgtcaacagaggagagacgtgatgcctagtcccaacctggcggcagcgcaaaagatg

SEQ ID NO: 100425 - DNA, 103 bp, Artificial Sequence
  Synthetic Polynucleotide
taatacgactcactatagggggcgccagctgctgctgctgtagggactagaacagaggagactagtcatgacagcagcaaacctggcggcagcgcaaaagatg

SEQ ID NO: 100426 - DNA, 103 bp, Artificial Sequence
  Synthetic Polynucleotide
taatacgactcactatagggctgcgagagcggcgccagctgctgctgctgaacagaggagacagcagatgcagctggcgaacctggcggcagcgcaaaagatg

SEQ ID NO: 100427 - DNA, 103 bp, Artificial Sequence
  Synthetic Polynucleotide
taatacgactcactataggggctgtagggactgcgagagcggcgccagctaacagaggagaagctggatgcgctctcgcaacctggcggcagcgcaaaagatg

SEQ ID NO: 100428 - DNA, 103 bp, Artificial Sequence
  Synthetic Polynucleotide
taatacgactcactatagggtgagcacagggctgtagggactgcgagagcaacagaggagagctctcatggtccctacaaacctggcggcagcgcaaaagatg

SEQ ID NO: 100429 - DNA, 103 bp, Artificial Sequence
  Synthetic Polynucleotide
taatacgactcactatagggtgcggctgcaggagcggcaacagcagcggcaacagaggagagccgctatggttgccgctaacctggcggcagcgcaaaagatg

SEQ ID NO: 100430 - DNA, 103 bp, Artificial Sequence
  Synthetic Polynucleotide
taatacgactcactatagggccagaccgtctgagcacagggctgtagggaaacagaggagatccctaatgccctgtgctaacctggcggcagcgcaaaagatg

SEQ ID NO: 100431 - DNA, 103 bp, Artificial Sequence
  Synthetic Polynucleotide
taatacgactcactatagggtcgggattttccagaccgtctgagcacaggaacagaggagacctgtgatgagacggtctaacctggcggcagcgcaaaagatg

SEQ ID NO: 100432 - DNA, 103 bp, Artificial Sequence
  Synthetic Polynucleotide
taatacgactcactatagggggcttctgcttcgggattttccagaccgtcaacagaggagagacggtatggaaaatcccaacctggcggcagcgcaaaagatg

SEQ ID NO: 100433 - DNA, 103 bp, Artificial Sequence
  Synthetic Polynucleotide
taatacgactcactataggggatgaatacgggcttctgcttcgggattttaacagaggagaaaaatcatgaagcagaagaacctggcggcagcgcaaaagatg

SEQ ID NO: 100434 - DNA, 103 bp, Artificial Sequence
  Synthetic Polynucleotide
taatacgactcactatagggtgaatgcctagatgaatacgggcttctgctaacagaggagaagcagaatgccgtattcaaacctggcggcagcgcaaaagatg

SEQ ID NO: 100435 - DNA, 103 bp, Artificial Sequence
  Synthetic Polynucleotide
taatacgactcactatagggtacgagatcttgaatgcctagatgaatacgaacagaggagacgtattatgctaggcattaacctggcggcagcgcaaaagatg

SEQ ID NO: 100436 - DNA, 103 bp, Artificial Sequence
  Synthetic Polynucleotide
taatacgactcactatagggctgtgcctgctacgagatcttgaatgcctaaacagaggagataggcaatgaagatctcgaacctggcggcagcgcaaaagatg

SEQ ID NO: 100437 - DNA, 103 bp, Artificial Sequence
  Synthetic Polynucleotide
taatacgactcactatagggtctagacaatctgtgcctgctacgagatctaacagaggagaagatctatgagcaggcacaacctggcggcagcgcaaaagatg

SEQ ID NO: 100438 - DNA, 103 bp, Artificial Sequence
  Synthetic Polynucleotide
taatacgactcactataggggacttctggatctagacaatctgtgcctgcaacagaggagagcaggcatggattgtctaaacctggcggcagcgcaaaagatg

SEQ ID NO: 100439 - DNA, 103 bp, Artificial Sequence
  Synthetic Polynucleotide
taatacgactcactatagggctagaatgacgacttctggatctagacaataacagaggagaattgtcatgatccagaagaacctggcggcagcgcaaaagatg

SEQ ID NO: 100440 - DNA, 103 bp, Artificial Sequence
  Synthetic Polynucleotide
taatacgactcactatagggttgcaggagctgcggctgcaggagcggcaaaacagaggagattgccgatgctgcagccgaacctggcggcagcgcaaaagatg

SEQ ID NO: 100441 - DNA, 103 bp, Artificial Sequence
  Synthetic Polynucleotide
taatacgactcactatagggaggagaaatactagaatgacgacttctggaaacagaggagatccagaatgcgtcattctaacctggcggcagcgcaaaagatg

SEQ ID NO: 100442 - DNA, 103 bp, Artificial Sequence
  Synthetic Polynucleotide
taatacgactcactatagggttagtgtgctaggagaaatactagaatgacaacagaggagagtcattatggtatttctcaacctggcggcagcgcaaaagatg

SEQ ID NO: 100443 - DNA, 103 bp, Artificial Sequence
  Synthetic Polynucleotide
taatacgactcactatagggctcttcagagttagtgtgctaggagaaataaacagaggagatatttcatgtagcacactaacctggcggcagcgcaaaagatg

SEQ ID NO: 100444 - DNA, 103 bp, Artificial Sequence
  Synthetic Polynucleotide
taatacgactcactatagggtgccaggctactcttcagagttagtgtgctaacagaggagaagcacaatgactctgaagaacctggcggcagcgcaaaagatg

SEQ ID NO: 100445 - DNA, 103 bp, Artificial Sequence
  Synthetic Polynucleotide
taatacgactcactatagggtcaattcagctgccaggctactcttcagagaacagaggagactctgaatggtagcctggaacctggcggcagcgcaaaagatg

SEQ ID NO: 100446 - DNA, 103 bp, Artificial Sequence
  Synthetic Polynucleotide
taatacgactcactatagggttattcttgttcaattcagctgccaggctaaacagaggagatagcctatgagctgaattaacctggcggcagcgcaaaagatg

SEQ ID NO: 100447 - DNA, 103 bp, Artificial Sequence
  Synthetic Polynucleotide
taatacgactcactatagggtcgtgcttttttattcttgttcaattcagcaacagaggagagctgaaatgaacaagaataacctggcggcagcgcaaaagatg

SEQ ID NO: 100448 - DNA, 103 bp, Artificial Sequence
  Synthetic Polynucleotide
taatacgactcactatagggcctctgctgctcgtgcttttttattcttgtaacagaggagaacaagaatgaaaaagcacaacctggcggcagcgcaaaagatg

SEQ ID NO: 100449 - DNA, 103 bp, Artificial Sequence
  Synthetic Polynucleotide
taatacgactcactataggggctcttgctgcctctgctgctcgtgcttttaacagaggagaaaaagcatgagcagcagaaacctggcggcagcgcaaaagatg

SEQ ID NO: 100450 - DNA, 103 bp, Artificial Sequence
  Synthetic Polynucleotide
taatacgactcactatagggtgcttctgcggctcttgctgcctctgctgcaacagaggagagcagcaatggcagcaagaaacctggcggcagcgcaaaagatg

SEQ ID NO: 100451 - DNA, 103 bp, Artificial Sequence
  Synthetic Polynucleotide
taatacgactcactataggggcggcggcggttgcaggagctgcggctgcaaacagaggagatgcagcatgagctcctgcaacctggcggcagcgcaaaagatg

SEQ ID NO: 100452 - DNA, 103 bp, Artificial Sequence
  Synthetic Polynucleotide
taatacgactcactatagggcagctttcgctgcttctgcggctcttgctgaacagaggagacagcaaatgccgcagaagaacctggcggcagcgcaaaagatg

SEQ ID NO: 100453 - DNA, 103 bp, Artificial Sequence
  Synthetic Polynucleotide
taatacgactcactataggggttgcttctgcagctttcgctgcttctgcgaacagaggagacgcagaatgagcgaaagcaacctggcggcagcgcaaaagatg

SEQ ID NO: 100454 - DNA, 103 bp, Artificial Sequence
  Synthetic Polynucleotide
taatacgactcactatagggagcagccttagttgcttctgcagctttcgcaacagaggagagcgaaaatggcagaagcaaacctggcggcagcgcaaaagatg

SEQ ID NO: 100455 - DNA, 103 bp, Artificial Sequence
  Synthetic Polynucleotide
taatacgactcactatagggcagcagcctcagcagccttagttgcttctgaacagaggagacagaagatgctaaggctgaacctggcggcagcgcaaaagatg

SEQ ID NO: 100456 - DNA, 103 bp, Artificial Sequence
  Synthetic Polynucleotide
taatacgactcactataggggcagccttggcagcagcctcagcagccttaaacagaggagataaggcatgtgaggctgcaacctggcggcagcgcaaaagatg

SEQ ID NO: 100457 - DNA, 103 bp, Artificial Sequence
  Synthetic Polynucleotide
taatacgactcactatagggtgaagcttttgcagccttggcagcagcctcaacagaggagagaggctatggccaaggctaacctggcggcagcgcaaaagatg

SEQ ID NO: 100458 - DNA, 103 bp, Artificial Sequence
  Synthetic Polynucleotide
taatacgactcactatagggtagaagtgtttgaagcttttgcagccttggaacagaggagaccaaggatgcaaaagcttaacctggcggcagcgcaaaagatg

SEQ ID NO: 100459 - DNA, 103 bp, Artificial Sequence
  Synthetic Polynucleotide
taatacgactcactatagggttggtaggtgtagaagtgtttgaagcttttaacagaggagaaaaagcatgaaacacttcaacctggcggcagcgcaaaagatg

SEQ ID NO: 100460 - DNA, 103 bp, Artificial Sequence
  Synthetic Polynucleotide
taatacgactcactatagggcgtgttccccttggtaggtgtagaagtgttaacagaggagaaacactatgacacctaccaacctggcggcagcgcaaaagatg

SEQ ID NO: 100461 - DNA, 103 bp, Artificial Sequence
  Synthetic Polynucleotide
taatacgactcactatagggcactagtttccgtgttccccttggtaggtgaacagaggagacacctaatgaggggaacaaacctggcggcagcgcaaaagatg

SEQ ID NO: 100462 - DNA, 103 bp, Artificial Sequence
  Synthetic Polynucleotide
taatacgactcactatagggggcggcgggggcggcggcggttgcaggagcaacagaggagagctcctatgaccgccgccaacctggcggcagcgcaaaagatg

SEQ ID NO: 100463 - DNA, 103 bp, Artificial Sequence
  Synthetic Polynucleotide
taatacgactcactataggggatgcactggcactagtttccgtgttccccaacagaggagaggggaaatgggaaactagaacctggcggcagcgcaaaagatg

SEQ ID NO: 100464 - DNA, 103 bp, Artificial Sequence
  Synthetic Polynucleotide
taatacgactcactataggggtttgtttgtgatgcactggcactagtttcaacagaggagagaaactatggccagtgcaaacctggcggcagcgcaaaagatg

SEQ ID NO: 100465 - DNA, 103 bp, Artificial Sequence
  Synthetic Polynucleotide
taatacgactcactatagggccttcacatggtttgtttgtgatgcactggaacagaggagaccagtgatgcacaaacaaaacctggcggcagcgcaaaagatg

SEQ ID NO: 100466 - DNA, 103 bp, Artificial Sequence
  Synthetic Polynucleotide
taatacgactcactatagggttcttcacatccttcacatggtttgtttgtaacagaggagaacaaacatgccatgtgaaaacctggcggcagcgcaaaagatg

SEQ ID NO: 100467 - DNA, 103 bp, Artificial Sequence
  Synthetic Polynucleotide
taatacgactcactatagggaattttaattttcttcacatccttcacatgaacagaggagacatgtgatggatgtgaagaacctggcggcagcgcaaaagatg

SEQ ID NO: 100468 - DNA, 103 bp, Artificial Sequence
  Synthetic Polynucleotide
taatacgactcactataggggtgcatgttcaattttaattttcttcacataacagaggagaatgtgaatgaaattaaaaaacctggcggcagcgcaaaagatg

SEQ ID NO: 100469 - DNA, 103 bp, Artificial Sequence
  Synthetic Polynucleotide
taatacgactcactataggggagggagaaggtgcatgttcaattttaattaacagaggagaaattaaatgtgaacatgcaacctggcggcagcgcaaaagatg

SEQ ID NO: 100470 - DNA, 103 bp, Artificial Sequence
  Synthetic Polynucleotide
taatacgactcactatagggtccaccacttgagggagaaggtgcatgttcaacagaggagagaacatatgccttctcccaacctggcggcagcgcaaaagatg

SEQ ID NO: 100471 - DNA, 103 bp, Artificial Sequence
  Synthetic Polynucleotide
taatacgactcactatagggtttttaaagttccaccacttgagggagaagaacagaggagacttctcatgcaagtggtgaacctggcggcagcgcaaaagatg

SEQ ID NO: 100472 - DNA, 103 bp, Artificial Sequence
  Synthetic Polynucleotide
taatacgactcactataggggctttgtcattttttaaagttccaccacttaacagaggagaaagtggatgaactttaaaaacctggcggcagcgcaaaagatg

SEQ ID NO: 100473 - DNA, 103 bp, Artificial Sequence
  Synthetic Polynucleotide
taatacgactcactataggggaagagcagaggcggcgggggcggcggcggaacagaggagaccgccgatgcccccgccgaacctggcggcagcgcaaaagatg

SEQ ID NO: 100474 - DNA, 103 bp, Artificial Sequence
  Synthetic Polynucleotide
taatacgactcactatagggctttgtttttgctttgtcattttttaaagtaacagaggagaactttaatgaatgacaaaaacctggcggcagcgcaaaagatg

SEQ ID NO: 100475 - DNA, 103 bp, Artificial Sequence
  Synthetic Polynucleotide
taatacgactcactataggggaagaggtggctttgtttttgctttgtcataacagaggagaatgacaatgcaaaaacaaaacctggcggcagcgcaaaagatg

SEQ ID NO: 100476 - DNA, 103 bp, Artificial Sequence
  Synthetic Polynucleotide
taatacgactcactatagggttcgttacctgaagaggtggctttgtttttaacagaggagaaaaaacatggccacctctaacctggcggcagcgcaaaagatg

SEQ ID NO: 100477 - DNA, 103 bp, Artificial Sequence
  Synthetic Polynucleotide
taatacgactcactatagggattttccaccttcgttacctgaagaggtggaacagaggagaccacctatgcaggtaacgaacctggcggcagcgcaaaagatg

SEQ ID NO: 100478 - DNA, 103 bp, Artificial Sequence
  Synthetic Polynucleotide
taatacgactcactatagggcaatcaaattattttccaccttcgttacctaacagaggagaaggtaaatgaggtggaaaaacctggcggcagcgcaaaagatg

SEQ ID NO: 100479 - DNA, 103 bp, Artificial Sequence
  Synthetic Polynucleotide
taatacgactcactataggggctttatctacaatcaaattattttccaccaacagaggagaggtggaatgtaatttgataacctggcggcagcgcaaaagatg

SEQ ID NO: 100480 - DNA, 103 bp, Artificial Sequence
  Synthetic Polynucleotide
taatacgactcactatagggtttcttggtggctttatctacaatcaaattaacagaggagaaatttgatggtagataaaaacctggcggcagcgcaaaagatg

SEQ ID NO: 100481 - DNA, 103 bp, Artificial Sequence
  Synthetic Polynucleotide
taatacgactcactatagggctatgactgctttcttggtggctttatctaaacagaggagatagataatgccaccaagaaacctggcggcagcgcaaaagatg

SEQ ID NO: 100482 - DNA, 103 bp, Artificial Sequence
  Synthetic Polynucleotide
taatacgactcactatagggtcctttccaactatgactgctttcttggtgaacagaggagacaccaaatgagcagtcataacctggcggcagcgcaaaagatg

SEQ ID NO: 100483 - DNA, 103 bp, Artificial Sequence
  Synthetic Polynucleotide
taatacgactcactatagggagatttactctcctttccaactatgactgcaacagaggagagcagtcatggttggaaagaacctggcggcagcgcaaaagatg

SEQ ID NO: 100484 - DNA, 103 bp, Artificial Sequence
  Synthetic Polynucleotide
taatacgactcactataggggagcagccaggaagagcagaggcggcggggaacagaggagaccccgcatgctctgctctaacctggcggcagcgcaaaagatg

SEQ ID NO: 100485 - DNA, 103 bp, Artificial Sequence
  Synthetic Polynucleotide
taatacgactcactatagggttgtagcagcagatttactctcctttccaaaacagaggagattggaaatgagagtaaataacctggcggcagcgcaaaagatg

SEQ ID NO: 100486 - DNA, 103 bp, Artificial Sequence
  Synthetic Polynucleotide
taatacgactcactataggggattcctcctttgtagcagcagatttactcaacagaggagagagtaaatgtgctgctacaacctggcggcagcgcaaaagatg

SEQ ID NO: 100487 - DNA, 103 bp, Artificial Sequence
  Synthetic Polynucleotide
taatacgactcactatagggaagagatactgattcctcctttgtagcagcaacagaggagagctgctatgaaggaggaaaacctggcggcagcgcaaaagatg

SEQ ID NO: 100488 - DNA, 103 bp, Artificial Sequence
  Synthetic Polynucleotide
taatacgactcactatagggttttctctttaagagatactgattcctcctaacagaggagaaggaggatgcagtatctcaacctggcggcagcgcaaaagatg

SEQ ID NO: 100489 - DNA, 103 bp, Artificial Sequence
  Synthetic Polynucleotide
taatacgactcactatagggagtggtttggttttctctttaagagatactaacagaggagaagtatcatgtaaagagaaaacctggcggcagcgcaaaagatg

SEQ ID NO: 100490 - DNA, 103 bp, Artificial Sequence
  Synthetic Polynucleotide
taatacgactcactataggggcttggtgtaagtggtttggttttctctttaacagaggagaaaagagatgaccaaaccaaacctggcggcagcgcaaaagatg

SEQ ID NO: 100491 - DNA, 103 bp, Artificial Sequence
  Synthetic Polynucleotide
taatacgactcactatagggtggctcctatgcttggtgtaagtggtttggaacagaggagaccaaacatgttacaccaaaacctggcggcagcgcaaaagatg

SEQ ID NO: 100492 - DNA, 103 bp, Artificial Sequence
  Synthetic Polynucleotide
taatacgactcactatagggtccttctccttggctcctatgcttggtgtaaacagaggagatacaccatgcataggagcaacctggcggcagcgcaaaagatg

SEQ ID NO: 100493 - DNA, 103 bp, Artificial Sequence
  Synthetic Polynucleotide
taatacgactcactatagggtacatgttgctccttctccttggctcctataacagaggagaataggaatgaaggagaagaacctggcggcagcgcaaaagatg

SEQ ID NO: 100494 - DNA, 103 bp, Artificial Sequence
  Synthetic Polynucleotide
taatacgactcactatagggtgactaaagctacatgttgctccttctcctaacagaggagaaggagaatgagcaacatgaacctggcggcagcgcaaaagatg

SEQ ID NO: 100495 - DNA, 103 bp, Artificial Sequence
  Synthetic Polynucleotide
taatacgactcactataggggccgtgccgggagcagccaggaagagcagaaacagaggagatctgctatgcctggctgcaacctggcggcagcgcaaaagatg

SEQ ID NO: 100496 - DNA, 103 bp, Artificial Sequence
  Synthetic Polynucleotide
taatacgactcactatagggaatgtagaggtgactaaagctacatgttgcaacagaggagagcaacaatgagctttagtaacctggcggcagcgcaaaagatg

SEQ ID NO: 100497 - DNA, 103 bp, Artificial Sequence
  Synthetic Polynucleotide
taatacgactcactatagggtaacggtggtaatgtagaggtgactaaagcaacagaggagagctttaatgacctctacaaacctggcggcagcgcaaaagatg

SEQ ID NO: 100498 - DNA, 103 bp, Artificial Sequence
  Synthetic Polynucleotide
taatacgactcactataggggaggcaaaggtaacggtggtaatgtagaggaacagaggagacctctaatgtaccaccgtaacctggcggcagcgcaaaagatg

SEQ ID NO: 100499 - DNA, 103 bp, Artificial Sequence
  Synthetic Polynucleotide
taatacgactcactatagggggcagcatgggaggcaaaggtaacggtggtaacagaggagaaccaccatgacctttgccaacctggcggcagcgcaaaagatg

SEQ ID NO: 100500 - DNA, 103 bp, Artificial Sequence
  Synthetic Polynucleotide
taatacgactcactatagggtttatcttcaggcagcatgggaggcaaaggaacagaggagacctttgatgcccatgctgaacctggcggcagcgcaaaagatg

SEQ ID NO: 100501 - DNA, 103 bp, Artificial Sequence
  Synthetic Polynucleotide
taatacgactcactatagggtatcagcttctttatcttcaggcagcatggaacagaggagaccatgcatgctgaagataaacctggcggcagcgcaaaagatg

SEQ ID NO: 100502 - DNA, 103 bp, Artificial Sequence
  Synthetic Polynucleotide
taatacgactcactatagggcctcgtaagctatcagcttctttatcttcaaacagaggagatgaagaatgagaagctgaaacctggcggcagcgcaaaagatg

SEQ ID NO: 100503 - DNA, 103 bp, Artificial Sequence
  Synthetic Polynucleotide
taatacgactcactatagggtgaaatatttcctcgtaagctatcagcttcaacagaggagagaagctatgagcttacgaaacctggcggcagcgcaaaagatg

SEQ ID NO: 100504 - DNA, 103 bp, Artificial Sequence
  Synthetic Polynucleotide
taatacgactcactatagggctgcttttactgaaatatttcctcgtaagcaacagaggagagcttacatggaaatatttaacctggcggcagcgcaaaagatg

SEQ ID NO: 100505 - DNA, 103 bp, Artificial Sequence
  Synthetic Polynucleotide
taatacgactcactatagggtcttttttaactgcttttactgaaatatttaacagaggagaaaatatatgagtaaaagcaacctggcggcagcgcaaaagatg

SEQ ID NO: 100506 - DNA, 103 bp, Artificial Sequence
  Synthetic Polynucleotide
taatacgactcactatagggtgcggcggcggccgtgccgggagcagccagaacagaggagactggctatgcccggcacgaacctggcggcagcgcaaaagatg

SEQ ID NO: 100507 - DNA, 103 bp, Artificial Sequence
  Synthetic Polynucleotide
taatacgactcactatagggcttttctacttcttttttaactgcttttacaacagaggagagtaaaaatggttaaaaaaaacctggcggcagcgcaaaagatg

SEQ ID NO: 100508 - DNA, 103 bp, Artificial Sequence
  Synthetic Polynucleotide
taatacgactcactatagggatcggagtttcttttctacttcttttttaaaacagaggagattaaaaatgaagtagaaaaacctggcggcagcgcaaaagatg

SEQ ID NO: 100509 - DNA, 103 bp, Artificial Sequence
  Synthetic Polynucleotide
taatacgactcactataggggcaagaagacatcggagtttcttttctactaacagaggagaagtagaatggaaactccgaacctggcggcagcgcaaaagatg

SEQ ID NO: 100510 - DNA, 103 bp, Artificial Sequence
  Synthetic Polynucleotide
taatacgactcactatagggcggtaaatcagcaagaagacatcggagtttaacagaggagaaaactcatgtgtcttcttaacctggcggcagcgcaaaagatg

SEQ ID NO: 100511 - DNA, 103 bp, Artificial Sequence
  Synthetic Polynucleotide
taatacgactcactatagggcagggggcagcggtaaatcagcaagaagacaacagaggagagtcttcatgctgatttacaacctggcggcagcgcaaaagatg

SEQ ID NO: 100512 - DNA, 103 bp, Artificial Sequence
  Synthetic Polynucleotide
taatacgactcactatagggcctggtagctcagggggcagcggtaaatcaaacagaggagatgatttatggctgcccccaacctggcggcagcgcaaaagatg

SEQ ID NO: 100513 - DNA, 103 bp, Artificial Sequence
  Synthetic Polynucleotide
taatacgactcactatagggatcatctcctcctggtagctcagggggcagaacagaggagactgcccatggagctaccaaacctggcggcagcgcaaaagatg

SEQ ID NO: 100514 - DNA, 103 bp, Artificial Sequence
  Synthetic Polynucleotide
taatacgactcactatagggtctttgaaagatcatctcctcctggtagctaacagaggagaagctacatggaggagatgaacctggcggcagcgcaaaagatg

SEQ ID NO: 100515 - DNA, 103 bp, Artificial Sequence
  Synthetic Polynucleotide
taatacgactcactatagggtcctctggactctttgaaagatcatctcctaacagaggagaaggagaatgtctttcaaaaacctggcggcagcgcaaaagatg

SEQ ID NO: 100516 - DNA, 103 bp, Artificial Sequence
  Synthetic Polynucleotide
taatacgactcactatagggtgttttcttttcctctggactctttgaaagaacagaggagactttcaatgagtccagagaacctggcggcagcgcaaaagatg

SEQ ID NO: 100517 - DNA, 103 bp, Artificial Sequence
  Synthetic Polynucleotide
taatacgactcactatagggccccgcctccccccagcgccgtgtccgagcaacagaggagagctcggatgcggcgctggaacctggcggcagcgcaaaagatg

SEQ ID NO: 100518 - DNA, 103 bp, Artificial Sequence
  Synthetic Polynucleotide
taatacgactcactatagggcggcggcggctgcggcggcggccgtgccggaacagaggagaccggcaatgccgccgccgaacctggcggcagcgcaaaagatg

SEQ ID NO: 100519 - DNA, 103 bp, Artificial Sequence
  Synthetic Polynucleotide
taatacgactcactatagggactgtgttgctgttttcttttcctctggacaacagaggagagtccagatgaaaagaaaaaacctggcggcagcgcaaaagatg

SEQ ID NO: 100520 - DNA, 103 bp, Artificial Sequence
  Synthetic Polynucleotide
taatacgactcactatagggttactatgtaactgtgttgctgttttctttaacagaggagaaaagaaatgagcaacacaaacctggcggcagcgcaaaagatg

SEQ ID NO: 100521 - DNA, 103 bp, Artificial Sequence
  Synthetic Polynucleotide
taatacgactcactatagggaggcctccttttactatgtaactgtgttgcaacagaggagagcaacaatgttacatagtaacctggcggcagcgcaaaagatg

SEQ ID NO: 100522 - DNA, 103 bp, Artificial Sequence
  Synthetic Polynucleotide
taatacgactcactatagggcacatattttaggcctccttttactatgtaaacagaggagatacataatgaaaggaggcaacctggcggcagcgcaaaagatg

SEQ ID NO: 100523 - DNA, 103 bp, Artificial Sequence
  Synthetic Polynucleotide
taatacgactcactatagggtagcgaggcccacatattttaggcctccttaacagaggagaaaggagatgtaaaatatgaacctggcggcagcgcaaaagatg

SEQ ID NO: 100524 - DNA, 103 bp, Artificial Sequence
  Synthetic Polynucleotide
taatacgactcactatagggggtttcaccatagcgaggcccacatattttaacagaggagaaaaataatggggcctcgcaacctggcggcagcgcaaaagatg

SEQ ID NO: 100525 - DNA, 103 bp, Artificial Sequence
  Synthetic Polynucleotide
taatacgactcactatagggctttttctttggtttcaccatagcgaggccaacagaggagaggcctcatgatggtgaaaaacctggcggcagcgcaaaagatg

SEQ ID NO: 100526 - DNA, 103 bp, Artificial Sequence
  Synthetic Polynucleotide
taatacgactcactatagggcagtcaatatctttttctttggtttcaccaaacagaggagatggtgaatgcaaagaaaaaacctggcggcagcgcaaaagatg

SEQ ID NO: 100527 - DNA, 103 bp, Artificial Sequence
  Synthetic Polynucleotide
taatacgactcactataggggcgttttccccagtcaatatctttttctttaacagaggagaaaagaaatggatattgacaacctggcggcagcgcaaaagatg

SEQ ID NO: 100528 - DNA, 103 bp, Artificial Sequence
  Synthetic Polynucleotide
taatacgactcactatagggtatccacgcagcgttttccccagtcaatataacagaggagaatattgatgggggaaaacaacctggcggcagcgcaaaagatg

SEQ ID NO: 100529 - DNA, 103 bp, Artificial Sequence
  Synthetic Polynucleotide
taatacgactcactataggggaggccgcggcggcggcggctgcggcggcgaacagaggagacgccgcatgagccgccgcaacctggcggcagcgcaaaagatg

SEQ ID NO: 100530 - DNA, 103 bp, Artificial Sequence
  Synthetic Polynucleotide
taatacgactcactatagggatatcaaatttatccacgcagcgttttcccaacagaggagagggaaaatgctgcgtggaaacctggcggcagcgcaaaagatg

SEQ ID NO: 100531 - DNA, 103 bp, Artificial Sequence
  Synthetic Polynucleotide
taatacgactcactatagggaattccgatgatatcaaatttatccacgcaaacagaggagatgcgtgatgaaatttgataacctggcggcagcgcaaaagatg

SEQ ID NO: 100532 - DNA, 103 bp, Artificial Sequence
  Synthetic Polynucleotide
taatacgactcactatagggcttctccaataattccgatgatatcaaattaacagaggagaaatttgatgtcatcggaaaacctggcggcagcgcaaaagatg

SEQ ID NO: 100533 - DNA, 103 bp, Artificial Sequence
  Synthetic Polynucleotide
taatacgactcactatagggccgtaagtaccttctccaataattccgatgaacagaggagacatcggatgtattggagaaacctggcggcagcgcaaaagatg

SEQ ID NO: 100534 - DNA, 103 bp, Artificial Sequence
  Synthetic Polynucleotide
taatacgactcactataggggtaaacttgtccgtaagtaccttctccaataacagaggagaattggaatgggtacttacaacctggcggcagcgcaaaagatg

SEQ ID NO: 100535 - DNA, 103 bp, Artificial Sequence
  Synthetic Polynucleotide
taatacgactcactatagggccctggctttgtaaacttgtccgtaagtacaacagaggagagtacttatggacaagtttaacctggcggcagcgcaaaagatg

SEQ ID NO: 100536 - DNA, 103 bp, Artificial Sequence
  Synthetic Polynucleotide
taatacgactcactataggggtgtctttatccctggctttgtaaacttgtaacagaggagaacaagtatgcaaagccagaacctggcggcagcgcaaaagatg

SEQ ID NO: 100537 - DNA, 103 bp, Artificial Sequence
  Synthetic Polynucleotide
taatacgactcactatagggcatttctccagtgtctttatccctggctttaacagaggagaaaagccatggataaagacaacctggcggcagcgcaaaagatg

SEQ ID NO: 100538 - DNA, 103 bp, Artificial Sequence
  Synthetic Polynucleotide
taatacgactcactatagggttaaggctaccatttctccagtgtctttataacagaggagaataaagatgctggagaaaaacctggcggcagcgcaaaagatg

SEQ ID NO: 100539 - DNA, 103 bp, Artificial Sequence
  Synthetic Polynucleotide
taatacgactcactatagggcgtactttttttaaggctaccatttctccaaacagaggagatggagaatgggtagccttaacctggcggcagcgcaaaagatg

SEQ ID NO: 100540 - DNA, 103 bp, Artificial Sequence
  Synthetic Polynucleotide
taatacgactcactataggggcaagaggaggaggccgcggcggcggcggcaacagaggagagccgccatggccgcggccaacctggcggcagcgcaaaagatg

SEQ ID NO: 100541 - DNA, 103 bp, Artificial Sequence
  Synthetic Polynucleotide
taatacgactcactatagggattatccagacgtactttttttaaggctacaacagaggagagtagccatgaaaaaagtaaacctggcggcagcgcaaaagatg

SEQ ID NO: 100542 - DNA, 103 bp, Artificial Sequence
  Synthetic Polynucleotide
taatacgactcactatagggcttccttttcattatccagacgtactttttaacagaggagaaaaaagatggtctggataaacctggcggcagcgcaaaagatg

SEQ ID NO: 100543 - DNA, 103 bp, Artificial Sequence
  Synthetic Polynucleotide
taatacgactcactatagggattggaaagccttccttttcattatccagaaacagaggagatctggaatgtgaaaaggaaacctggcggcagcgcaaaagatg

SEQ ID NO: 100544 - DNA, 103 bp, Artificial Sequence
  Synthetic Polynucleotide
taatacgactcactatagggaattgctgtaattggaaagccttccttttcaacagaggagagaaaagatgggctttccaaacctggcggcagcgcaaaagatg

SEQ ID NO: 100545 - DNA, 103 bp, Artificial Sequence
  Synthetic Polynucleotide
taatacgactcactatagggtaatttctcgaattgctgtaattggaaagcaacagaggagagctttcatgttacagcaaaacctggcggcagcgcaaaagatg

SEQ ID NO: 100546 - DNA, 103 bp, Artificial Sequence
  Synthetic Polynucleotide
taatacgactcactatagggcggagaattttaatttctcgaattgctgtaaacagaggagatacagcatgtcgagaaataacctggcggcagcgcaaaagatg

SEQ ID NO: 100547 - DNA, 103 bp, Artificial Sequence
  Synthetic Polynucleotide
taatacgactcactatagggggtaagctgccggagaattttaatttctcgaacagaggagacgagaaatgaaaattctcaacctggcggcagcgcaaaagatg

SEQ ID NO: 100548 - DNA, 103 bp, Artificial Sequence
  Synthetic Polynucleotide
taatacgactcactatagggtactctgatgggtaagctgccggagaatttaacagaggagaaaattcatgggcagcttaaacctggcggcagcgcaaaagatg

SEQ ID NO: 100549 - DNA, 103 bp, Artificial Sequence
  Synthetic Polynucleotide
taatacgactcactatagggatattgataatactctgatgggtaagctgcaacagaggagagcagctatgccatcagagaacctggcggcagcgcaaaagatg

SEQ ID NO: 100550 - DNA, 103 bp, Artificial Sequence
  Synthetic Polynucleotide
taatacgactcactatagggtatttccttcatattgataatactctgatgaacagaggagacatcagatgattatcaataacctggcggcagcgcaaaagatg

SEQ ID NO: 100551 - DNA, 103 bp, Artificial Sequence
  Synthetic Polynucleotide
taatacgactcactatagggccgggctgaagcaagaggaggaggccgcggaacagaggagaccgcggatgcctcctcttaacctggcggcagcgcaaaagatg

SEQ ID NO: 100552 - DNA, 103 bp, Artificial Sequence
  Synthetic Polynucleotide
taatacgactcactatagggtatcagtcactatttccttcatattgataaaacagaggagattatcaatgtgaaggaaaaacctggcggcagcgcaaaagatg

SEQ ID NO: 100553 - DNA, 103 bp, Artificial Sequence
  Synthetic Polynucleotide
taatacgactcactataggggcatcttctttatcagtcactatttccttcaacagaggagagaaggaatgagtgactgaaacctggcggcagcgcaaaagatg

SEQ ID NO: 100554 - DNA, 103 bp, Artificial Sequence
  Synthetic Polynucleotide
taatacgactcactataggggaaatccaaagcatcttctttatcagtcacaacagaggagagtgactatgaaagaagataacctggcggcagcgcaaaagatg

SEQ ID NO: 100555 - DNA, 103 bp, Artificial Sequence
  Synthetic Polynucleotide
taatacgactcactatagggtgtccttcttgaaatccaaagcatcttcttaacagaggagaaagaagatgctttggattaacctggcggcagcgcaaaagatg

SEQ ID NO: 100556 - DNA, 103 bp, Artificial Sequence
  Synthetic Polynucleotide
taatacgactcactatagggaatgcacctttgtccttcttgaaatccaaaaacagaggagatttggaatgcaagaaggaaacctggcggcagcgcaaaagatg

SEQ ID NO: 100557 - DNA, 103 bp, Artificial Sequence
  Synthetic Polynucleotide
taatacgactcactatagggcaccagataaaatgcacctttgtccttcttaacagaggagaaagaagatgaaaggtgcaaacctggcggcagcgcaaaagatg

SEQ ID NO: 100558 - DNA, 103 bp, Artificial Sequence
  Synthetic Polynucleotide
taatacgactcactatagggtatattcaaacaccagataaaatgcaccttaacagaggagaaaggtgatgtttatctggaacctggcggcagcgcaaaagatg

SEQ ID NO: 100559 - DNA, 103 bp, Artificial Sequence
  Synthetic Polynucleotide
taatacgactcactatagggtcatggtccatatattcaaacaccagataaaacagaggagattatctatggtttgaataaacctggcggcagcgcaaaagatg

SEQ ID NO: 100560 - DNA, 103 bp, Artificial Sequence
  Synthetic Polynucleotide
taatacgactcactatagggtcccatcagatcatggtccatatattcaaaaacagaggagatttgaaatgatggaccataacctggcggcagcgcaaaagatg

SEQ ID NO: 100561 - DNA, 103 bp, Artificial Sequence
  Synthetic Polynucleotide
taatacgactcactatagggattccagtagtcccatcagatcatggtccaaacagaggagatggaccatgatctgatggaacctggcggcagcgcaaaagatg

SEQ ID NO: 100562 - DNA, 103 bp, Artificial Sequence
  Synthetic Polynucleotide
taatacgactcactatagggagaggggggcccgggctgaagcaagaggagaacagaggagactcctcatgcttcagcccaacctggcggcagcgcaaaagatg

SEQ ID NO: 100563 - DNA, 103 bp, Artificial Sequence
  Synthetic Polynucleotide
taatacgactcactatagggaccaagcctgattccagtagtcccatcagaaacagaggagatctgatatgactactggaaacctggcggcagcgcaaaagatg

SEQ ID NO: 100564 - DNA, 103 bp, Artificial Sequence
  Synthetic Polynucleotide
taatacgactcactatagggattaaaatgaaccaagcctgattccagtagaacagaggagactactgatgtcaggcttgaacctggcggcagcgcaaaagatg

SEQ ID NO: 100565 - DNA, 103 bp, Artificial Sequence
  Synthetic Polynucleotide
taatacgactcactatagggtgtgattttcattaaaatgaaccaagcctgaacagaggagacaggctatgttcattttaaacctggcggcagcgcaaaagatg

SEQ ID NO: 100566 - DNA, 103 bp, Artificial Sequence
  Synthetic Polynucleotide
taatacgactcactatagggaatgactttatgtgattttcattaaaatgaaacagaggagatcatttatgtgaaaatcaaacctggcggcagcgcaaaagatg

SEQ ID NO: 100567 - DNA, 103 bp, Artificial Sequence
  Synthetic Polynucleotide
taatacgactcactatagggctgtctcataaatgactttatgtgattttcaacagaggagagaaaatatgataaagtcaaacctggcggcagcgcaaaagatg

SEQ ID NO: 100568 - DNA, 103 bp, Artificial Sequence
  Synthetic Polynucleotide
taatacgactcactatagggcctccatgagctgtctcataaatgactttaaacagaggagataaagtatgttatgagacaacctggcggcagcgcaaaagatg

SEQ ID NO: 100569 - DNA, 103 bp, Artificial Sequence
  Synthetic Polynucleotide
taatacgactcactatagggtaatccagaccctccatgagctgtctcataaacagaggagatatgagatggctcatggaaacctggcggcagcgcaaaagatg

SEQ ID NO: 100570 - DNA, 103 bp, Artificial Sequence
  Synthetic Polynucleotide
taatacgactcactatagggcttatgacaataatccagaccctccatgagaacagaggagactcatgatgggtctggataacctggcggcagcgcaaaagatg

SEQ ID NO: 100571 - DNA, 103 bp, Artificial Sequence
  Synthetic Polynucleotide
taatacgactcactatagggaaaagttcttcttatgacaataatccagacaacagaggagagtctggatgattgtcataaacctggcggcagcgcaaaagatg

SEQ ID NO: 100572 - DNA, 103 bp, Artificial Sequence
  Synthetic Polynucleotide
taatacgactcactatagggtctctatgcaaaaagttcttcttatgacaaaacagaggagattgtcaatggaagaacttaacctggcggcagcgcaaaagatg

SEQ ID NO: 100573 - DNA, 103 bp, Artificial Sequence
  Synthetic Polynucleotide
taatacgactcactatagggcttgacctccagaggggggcccgggctgaaaacagaggagattcagcatgggcccccctaacctggcggcagcgcaaaagatg

SEQ ID NO: 100574 - DNA, 103 bp, Artificial Sequence
  Synthetic Polynucleotide
taatacgactcactatagggacatttaatatctctatgcaaaaagttcttaacagaggagaaagaacatgttgcatagaaacctggcggcagcgcaaaagatg

SEQ ID NO: 100575 - DNA, 103 bp, Artificial Sequence
  Synthetic Polynucleotide
taatacgactcactatagggggatattggaacatttaatatctctatgcaaacagaggagatgcataatgatattaaataacctggcggcagcgcaaaagatg

SEQ ID NO: 100576 - DNA, 103 bp, Artificial Sequence
  Synthetic Polynucleotide
taatacgactcactatagggttatttagaaggatattggaacatttaataaacagaggagatattaaatgttccaatataacctggcggcagcgcaaaagatg

SEQ ID NO: 100577 - DNA, 103 bp, Artificial Sequence
  Synthetic Polynucleotide
taatacgactcactatagggctgccctctattatttagaaggatattggaaacagaggagatccaatatgcttctaaataacctggcggcagcgcaaaagatg

SEQ ID NO: 100578 - DNA, 103 bp, Artificial Sequence
  Synthetic Polynucleotide
taatacgactcactatagggcaagttttatctgccctctattatttagaaaacagaggagattctaaatgatagagggcaacctggcggcagcgcaaaagatg

SEQ ID NO: 100579 - DNA, 103 bp, Artificial Sequence
  Synthetic Polynucleotide
taatacgactcactatagggccaaagtctgcaagttttatctgccctctaaacagaggagatagaggatggataaaactaacctggcggcagcgcaaaagatg

SEQ ID NO: 100580 - DNA, 103 bp, Artificial Sequence
  Synthetic Polynucleotide
taatacgactcactatagggtcgagcaagtccaaagtctgcaagttttataacagaggagaataaaaatggcagactttaacctggcggcagcgcaaaagatg

SEQ ID NO: 100581 - DNA, 103 bp, Artificial Sequence
  Synthetic Polynucleotide
taatacgactcactatagggagctatacaatcgagcaagtccaaagtctgaacagaggagacagactatggacttgctcaacctggcggcagcgcaaaagatg

SEQ ID NO: 100582 - DNA, 103 bp, Artificial Sequence
  Synthetic Polynucleotide
taatacgactcactatagggctttcttctgagctatacaatcgagcaagtaacagaggagaacttgcatgattgtatagaacctggcggcagcgcaaaagatg

SEQ ID NO: 100583 - DNA, 103 bp, Artificial Sequence
  Synthetic Polynucleotide
taatacgactcactatagggatacggccgactttcttctgagctatacaaaacagaggagattgtatatgtcagaagaaaacctggcggcagcgcaaaagatg

SEQ ID NO: 100584 - DNA, 103 bp, Artificial Sequence
  Synthetic Polynucleotide
taatacgactcactatagggtcgccagccgcttgacctccagaggggggcaacagaggagagcccccatgtggaggtcaaacctggcggcagcgcaaaagatg

SEQ ID NO: 100585 - DNA, 103 bp, Artificial Sequence
  Synthetic Polynucleotide
taatacgactcactatagggccttgttagtatacggccgactttcttctgaacagaggagacagaagatggtcggccgtaacctggcggcagcgcaaaagatg

SEQ ID NO: 100586 - DNA, 103 bp, Artificial Sequence
  Synthetic Polynucleotide
taatacgactcactatagggaaagtaattaccttgttagtatacggccgaaacagaggagatcggccatgtactaacaaaacctggcggcagcgcaaaagatg

SEQ ID NO: 100587 - DNA, 103 bp, Artificial Sequence
  Synthetic Polynucleotide
taatacgactcactatagggacggtaccataaagtaattaccttgttagtaacagaggagaactaacatggtaattactaacctggcggcagcgcaaaagatg

SEQ ID NO: 100588 - DNA, 103 bp, Artificial Sequence
  Synthetic Polynucleotide
taatacgactcactataggggttcaggtggacggtaccataaagtaattaaacagaggagataattaatgtatggtaccaacctggcggcagcgcaaaagatg

SEQ ID NO: 100589 - DNA, 103 bp, Artificial Sequence
  Synthetic Polynucleotide
taatacgactcactatagggcccagtagcagttcaggtggacggtaccataacagaggagaatggtaatgtccacctgaaacctggcggcagcgcaaaagatg

SEQ ID NO: 100590 - DNA, 103 bp, Artificial Sequence
  Synthetic Polynucleotide
taatacgactcactatagggtcgttcttctcccagtagcagttcaggtggaacagaggagaccacctatgctgctactgaacctggcggcagcgcaaaagatg

SEQ ID NO: 100591 - DNA, 103 bp, Artificial Sequence
  Synthetic Polynucleotide
taatacgactcactatagggctggtgtgtatcgttcttctcccagtagcaaacagaggagatgctacatggagaagaacaacctggcggcagcgcaaaagatg

SEQ ID NO: 100592 - DNA, 103 bp, Artificial Sequence
  Synthetic Polynucleotide
taatacgactcactatagggacatcaatggctggtgtgtatcgttcttctaacagaggagaagaagaatgatacacaccaacctggcggcagcgcaaaagatg

SEQ ID NO: 100593 - DNA, 103 bp, Artificial Sequence
  Synthetic Polynucleotide
taatacgactcactatagggacagctccatacatcaatggctggtgtgtaaacagaggagatacacaatggccattgataacctggcggcagcgcaaaagatg

SEQ ID NO: 100594 - DNA, 103 bp, Artificial Sequence
  Synthetic Polynucleotide
taatacgactcactatagggggatacagccacagctccatacatcaatggaacagaggagaccattgatgtatggagctaacctggcggcagcgcaaaagatg

SEQ ID NO: 100595 - DNA, 103 bp, Artificial Sequence
  Synthetic Polynucleotide
taatacgactcactatagggctcttgcctctcgccagccgcttgacctccaacagaggagaggaggtatggcggctggcaacctggcggcagcgcaaaagatg

SEQ ID NO: 100596 - DNA, 103 bp, Artificial Sequence
  Synthetic Polynucleotide
taatacgactcactatagggagttcgccaaggatacagccacagctccataacagaggagaatggagatgtggctgtataacctggcggcagcgcaaaagatg

SEQ ID NO: 100597 - DNA, 103 bp, Artificial Sequence
  Synthetic Polynucleotide
taatacgactcactatagggtttagtgaagagttcgccaaggatacagccaacagaggagaggctgtatgcttggcgaaaacctggcggcagcgcaaaagatg

SEQ ID NO: 100598 - DNA, 103 bp, Artificial Sequence
  Synthetic Polynucleotide
taatacgactcactatagggatataggttttttagtgaagagttcgccaaaacagaggagattggcgatgtcttcactaaacctggcggcagcgcaaaagatg

SEQ ID NO: 100599 - DNA, 103 bp, Artificial Sequence
  Synthetic Polynucleotide
taatacgactcactatagggtttgcttgaaatataggttttttagtgaagaacagaggagacttcacatgaaaacctataacctggcggcagcgcaaaagatg

SEQ ID NO: 100600 - DNA, 103 bp, Artificial Sequence
  Synthetic Polynucleotide
taatacgactcactatagggaagttcctgatttgcttgaaatataggtttaacagaggagaaaacctatgtttcaagcaaacctggcggcagcgcaaaagatg

SEQ ID NO: 100601 - DNA, 103 bp, Artificial Sequence
  Synthetic Polynucleotide
taatacgactcactatagggctagttgtgcaagttcctgatttgcttgaaaacagaggagattcaagatgatcaggaacaacctggcggcagcgcaaaagatg

SEQ ID NO: 100602 - DNA, 103 bp, Artificial Sequence
  Synthetic Polynucleotide
taatacgactcactatagggcttattaattctagttgtgcaagttcctgaaacagaggagatcaggaatgtgcacaactaacctggcggcagcgcaaaagatg

SEQ ID NO: 100603 - DNA, 103 bp, Artificial Sequence
  Synthetic Polynucleotide
taatacgactcactatagggacatattcggcttattaattctagttgtgcaacagaggagagcacaaatggaattaataaacctggcggcagcgcaaaagatg

SEQ ID NO: 100604 - DNA, 103 bp, Artificial Sequence
  Synthetic Polynucleotide
taatacgactcactatagggatggactcccacatattcggcttattaattaacagaggagaaattaaatggccgaatataacctggcggcagcgcaaaagatg

SEQ ID NO: 100605 - DNA, 103 bp, Artificial Sequence
  Synthetic Polynucleotide
taatacgactcactatagggactgcaggacatggactcccacatattcggaacagaggagaccgaatatgtgggagtccaacctggcggcagcgcaaaagatg

SEQ ID NO: 100606 - DNA, 103 bp, Artificial Sequence
  Synthetic Polynucleotide
taatacgactcactatagggtcctgcgcgcctcttgcctctcgccagccgaacagaggagacggctgatgagaggcaagaacctggcggcagcgcaaaagatg

SEQ ID NO: 100607 - DNA, 103 bp, Artificial Sequence
  Synthetic Polynucleotide
taatacgactcactatagggatcaggccacactgcaggacatggactcccaacagaggagagggagtatgtgtcctgcaaacctggcggcagcgcaaaagatg

SEQ ID NO: 100608 - DNA, 103 bp, Artificial Sequence
  Synthetic Polynucleotide
taatacgactcactataggggtttgattacatcaggccacactgcaggacaacagaggagagtcctgatgtgtggcctgaacctggcggcagcgcaaaagatg

SEQ ID NO: 100609 - DNA, 103 bp, Artificial Sequence
  Synthetic Polynucleotide
taatacgactcactatagggaaatatggtagtttgattacatcaggccacaacagaggagagtggccatgtgtaatcaaaacctggcggcagcgcaaaagatg

SEQ ID NO: 100610 - DNA, 103 bp, Artificial Sequence
  Synthetic Polynucleotide
taatacgactcactatagggcatggtgttgaaatatggtagtttgattacaacagaggagagtaatcatgctaccatataacctggcggcagcgcaaaagatg

SEQ ID NO: 100611 - DNA, 103 bp, Artificial Sequence
  Synthetic Polynucleotide
taatacgactcactatagggtctttggtttcatggtgttgaaatatggtaaacagaggagataccatatgtcaacaccaaacctggcggcagcgcaaaagatg

SEQ ID NO: 100612 - DNA, 103 bp, Artificial Sequence
  Synthetic Polynucleotide
taatacgactcactatagggcgatattgcttctttggtttcatggtgttgaacagaggagacaacacatggaaaccaaaaacctggcggcagcgcaaaagatg

SEQ ID NO: 100613 - DNA, 103 bp, Artificial Sequence
  Synthetic Polynucleotide
taatacgactcactatagggtaactttcgacgatattgcttctttggtttaacagaggagaaaaccaatgaagcaatataacctggcggcagcgcaaaagatg

SEQ ID NO: 100614 - DNA, 103 bp, Artificial Sequence
  Synthetic Polynucleotide
taatacgactcactatagggattcttctcttaactttcgacgatattgctaacagaggagaagcaatatggtcgaaagtaacctggcggcagcgcaaaagatg

SEQ ID NO: 100615 - DNA, 103 bp, Artificial Sequence
  Synthetic Polynucleotide
taatacgactcactatagggataaaaacaaattcttctcttaactttcgaaacagaggagatcgaaaatgaagagaagaaacctggcggcagcgcaaaagatg

SEQ ID NO: 100616 - DNA, 103 bp, Artificial Sequence
  Synthetic Polynucleotide
taatacgactcactatagggagctgcaggaataaaaacaaattcttctctaacagaggagaagagaaatgtttgtttttaacctggcggcagcgcaaaagatg

SEQ ID NO: 100617 - DNA, 103 bp, Artificial Sequence
  Synthetic Polynucleotide
taatacgactcactatagggtctgccgccctcctgcgcgcctcttgcctcaacagaggagagaggcaatgggcgcgcagaacctggcggcagcgcaaaagatg

SEQ ID NO: 100618 - DNA, 103 bp, Artificial Sequence
  Synthetic Polynucleotide
taatacgactcactatagggagtctagcgcagctgcaggaataaaaacaaaacagaggagattgtttatgttcctgcagaacctggcggcagcgcaaaagatg

SEQ ID NO: 100619 - DNA, 103 bp, Artificial Sequence
  Synthetic Polynucleotide
taatacgactcactatagggtaatcaaataagtctagcgcagctgcaggaaacagaggagatcctgcatgtgcgctagaaacctggcggcagcgcaaaagatg

SEQ ID NO: 100620 - DNA, 103 bp, Artificial Sequence
  Synthetic Polynucleotide
taatacgactcactatagggggcaagcatgtaatcaaataagtctagcgcaacagaggagagcgctaatgttatttgataacctggcggcagcgcaaaagatg

SEQ ID NO: 100621 - DNA, 103 bp, Artificial Sequence
  Synthetic Polynucleotide
taatacgactcactatagggtaggatccaaggcaagcatgtaatcaaataaacagaggagatatttgatgacatgcttgaacctggcggcagcgcaaaagatg

SEQ ID NO: 100622 - DNA, 103 bp, Artificial Sequence
  Synthetic Polynucleotide
taatacgactcactatagggcagcgcttactaggatccaaggcaagcatgaacagaggagacatgctatgcttggatccaacctggcggcagcgcaaaagatg

SEQ ID NO: 100623 - DNA, 103 bp, Artificial Sequence
  Synthetic Polynucleotide
taatacgactcactatagggttcagcagtgcagcgcttactaggatccaaaacagaggagattggatatgagtaagcgcaacctggcggcagcgcaaaagatg

SEQ ID NO: 100624 - DNA, 103 bp, Artificial Sequence
  Synthetic Polynucleotide
taatacgactcactataggggaagagcctgttcagcagtgcagcgcttacaacagaggagagtaagcatggcactgctgaacctggcggcagcgcaaaagatg

SEQ ID NO: 100625 - DNA, 103 bp, Artificial Sequence
  Synthetic Polynucleotide
taatacgactcactatagggaactcgcactgaagagcctgttcagcagtgaacagaggagacactgcatgacaggctctaacctggcggcagcgcaaaagatg

SEQ ID NO: 100626 - DNA, 103 bp, Artificial Sequence
  Synthetic Polynucleotide
taatacgactcactatagggatctcggaggaactcgcactgaagagcctgaacagaggagacaggctatgcagtgcgagaacctggcggcagcgcaaaagatg

SEQ ID NO: 100627 - DNA, 103 bp, Artificial Sequence
  Synthetic Polynucleotide
taatacgactcactatagggagggttccacatctcggaggaactcgcactaacagaggagaagtgcgatgtcctccgagaacctggcggcagcgcaaaagatg

SEQ ID NO: 100628 - DNA, 103 bp, Artificial Sequence
  Synthetic Polynucleotide
taatacgactcactatagggcagctcaggcccccgcctccccccagcgccaacagaggagaggcgctatggggaggcggaacctggcggcagcgcaaaagatg

SEQ ID NO: 100629 - DNA, 103 bp, Artificial Sequence
  Synthetic Polynucleotide
taatacgactcactatagggcgacgccgcttctgccgccctcctgcgcgcaacagaggagagcgcgcatgagggcggcaaacctggcggcagcgcaaaagatg

SEQ ID NO: 100630 - DNA, 103 bp, Artificial Sequence
  Synthetic Polynucleotide
taatacgactcactatagggggcatttttgagggttccacatctcggaggaacagaggagacctccgatgtgtggaaccaacctggcggcagcgcaaaagatg

SEQ ID NO: 100631 - DNA, 103 bp, Artificial Sequence
  Synthetic Polynucleotide
taatacgactcactatagggatctggtggaggcatttttgagggttccacaacagaggagagtggaaatgtcaaaaatgaacctggcggcagcgcaaaagatg

SEQ ID NO: 100632 - DNA, 103 bp, Artificial Sequence
  Synthetic Polynucleotide
taatacgactcactatagggataaagggagatctggtggaggcatttttgaacagaggagacaaaaaatgctccaccagaacctggcggcagcgcaaaagatg

SEQ ID NO: 100633 - DNA, 103 bp, Artificial Sequence
  Synthetic Polynucleotide
taatacgactcactatagggcaatcttgccataaagggagatctggtggaaacagaggagatccaccatgtctccctttaacctggcggcagcgcaaaagatg

SEQ ID NO: 100634 - DNA, 103 bp, Artificial Sequence
  Synthetic Polynucleotide
taatacgactcactatagggtaactcatgacaatcttgccataaagggagaacagaggagactccctatgtggcaagataacctggcggcagcgcaaaagatg

SEQ ID NO: 100635 - DNA, 103 bp, Artificial Sequence
  Synthetic Polynucleotide
taatacgactcactatagggttttactccataactcatgacaatcttgccaacagaggagaggcaagatggtcatgagtaacctggcggcagcgcaaaagatg

SEQ ID NO: 100636 - DNA, 103 bp, Artificial Sequence
  Synthetic Polynucleotide
taatacgactcactatagggcttcttcgctttttactccataactcatgaaacagaggagatcatgaatgatggagtaaaacctggcggcagcgcaaaagatg

SEQ ID NO: 100637 - DNA, 103 bp, Artificial Sequence
  Synthetic Polynucleotide
taatacgactcactatagggctgcttctgtcttcttcgctttttactccaaacagaggagatggagtatgaagcgaagaaacctggcggcagcgcaaaagatg

SEQ ID NO: 100638 - DNA, 103 bp, Artificial Sequence
  Synthetic Polynucleotide
taatacgactcactatagggtcatgcccatctgcttctgtcttcttcgctaacagaggagaagcgaaatggacagaagcaacctggcggcagcgcaaaagatg

SEQ ID NO: 100639 - DNA, 103 bp, Artificial Sequence
  Synthetic Polynucleotide
taatacgactcactatagggacatcatcagtcatgcccatctgcttctgtaacagaggagaacagaaatggatgggcataacctggcggcagcgcaaaagatg

SEQ ID NO: 100640 - DNA, 103 bp, Artificial Sequence
  Synthetic Polynucleotide
taatacgactcactataggggcggggcccgcgacgccgcttctgccgcccaacagaggagagggcggatgaagcggcgtaacctggcggcagcgcaaaagatg

SEQ ID NO: 100641 - DNA, 103 bp, Artificial Sequence
  Synthetic Polynucleotide
taatacgactcactatagggaattgtggaaacatcatcagtcatgcccataacagaggagaatgggcatgactgatgataacctggcggcagcgcaaaagatg

SEQ ID NO: 100642 - DNA, 103 bp, Artificial Sequence
  Synthetic Polynucleotide
taatacgactcactatagggtgggggctttaattgtggaaacatcatcagaacagaggagactgatgatgtttccacaaaacctggcggcagcgcaaaagatg

SEQ ID NO: 100643 - DNA, 103 bp, Artificial Sequence
  Synthetic Polynucleotide
taatacgactcactatagggaagtccttcctgggggctttaattgtggaaaacagaggagattccacatgtaaagccccaacctggcggcagcgcaaaagatg

SEQ ID NO: 100644 - DNA, 103 bp, Artificial Sequence
  Synthetic Polynucleotide
taatacgactcactataggggcccagagacaagtccttcctgggggctttaacagaggagaaaagccatgaggaaggacaacctggcggcagcgcaaaagatg

SEQ ID NO: 100645 - DNA, 103 bp, Artificial Sequence
  Synthetic Polynucleotide
taatacgactcactatagggtgtcatccaagcccagagacaagtccttccaacagaggagaggaaggatgtgtctctggaacctggcggcagcgcaaaagatg

SEQ ID NO: 100646 - DNA, 103 bp, Artificial Sequence
  Synthetic Polynucleotide
taatacgactcactatagggttggttctgctgtcatccaagcccagagacaacagaggagagtctctatgcttggatgaaacctggcggcagcgcaaaagatg

SEQ ID NO: 100647 - DNA, 103 bp, Artificial Sequence
  Synthetic Polynucleotide
taatacgactcactatagggctggggtgtgttggttctgctgtcatccaaaacagaggagattggatatgagcagaaccaacctggcggcagcgcaaaagatg

SEQ ID NO: 100648 - DNA, 103 bp, Artificial Sequence
  Synthetic Polynucleotide
taatacgactcactataggggcagcacaccctggggtgtgttggttctgcaacagaggagagcagaaatgacacaccccaacctggcggcagcgcaaaagatg

SEQ ID NO: 100649 - DNA, 103 bp, Artificial Sequence
  Synthetic Polynucleotide
taatacgactcactatagggtgtgaagatggcagcacaccctggggtgtgaacagaggagacacaccatggggtgtgctaacctggcggcagcgcaaaagatg

SEQ ID NO: 100650 - DNA, 103 bp, Artificial Sequence
  Synthetic Polynucleotide
taatacgactcactatagggagatttcagctgtgaagatggcagcacaccaacagaggagaggtgtgatgccatcttcaaacctggcggcagcgcaaaagatg

SEQ ID NO: 100651 - DNA, 103 bp, Artificial Sequence
  Synthetic Polynucleotide
taatacgactcactatagggcctgcccggcgcggggcccgcgacgccgctaacagaggagaagcggcatggcgggccccaacctggcggcagcgcaaaagatg

SEQ ID NO: 100652 - DNA, 103 bp, Artificial Sequence
  Synthetic Polynucleotide
taatacgactcactatagggagctgccctgagatttcagctgtgaagatgaacagaggagacatcttatgagctgaaataacctggcggcagcgcaaaagatg

SEQ ID NO: 100653 - DNA, 103 bp, Artificial Sequence
  Synthetic Polynucleotide
taatacgactcactataggggccacatttgagctgccctgagatttcagcaacagaggagagctgaaatgtcagggcagaacctggcggcagcgcaaaagatg

SEQ ID NO: 100654 - DNA, 103 bp, Artificial Sequence
  Synthetic Polynucleotide
taatacgactcactatagggttttacaggtgccacatttgagctgccctgaacagaggagacagggcatgtcaaatgtgaacctggcggcagcgcaaaagatg

SEQ ID NO: 100655 - DNA, 103 bp, Artificial Sequence
  Synthetic Polynucleotide
taatacgactcactatagggcagggcctgtttttacaggtgccacatttgaacagaggagacaaatgatgcacctgtaaaacctggcggcagcgcaaaagatg

SEQ ID NO: 100656 - DNA, 103 bp, Artificial Sequence
  Synthetic Polynucleotide
taatacgactcactatagggaagtgctgtccagggcctgtttttacaggtaacagaggagaacctgtatgaacaggcccaacctggcggcagcgcaaaagatg

SEQ ID NO: 100657 - DNA, 103 bp, Artificial Sequence
  Synthetic Polynucleotide
taatacgactcactatagggactgtggtttaagtgctgtccagggcctgtaacagaggagaacaggcatgggacagcacaacctggcggcagcgcaaaagatg

SEQ ID NO: 100658 - DNA, 103 bp, Artificial Sequence
  Synthetic Polynucleotide
taatacgactcactatagggttgccaattcactgtggtttaagtgctgtcaacagaggagagacagcatgtaaaccacaaacctggcggcagcgcaaaagatg

SEQ ID NO: 100659 - DNA, 103 bp, Artificial Sequence
  Synthetic Polynucleotide
taatacgactcactatagggtttagtagaattgccaattcactgtggtttaacagaggagaaaaccaatgtgaattggcaacctggcggcagcgcaaaagatg

SEQ ID NO: 100660 - DNA, 103 bp, Artificial Sequence
  Synthetic Polynucleotide
taatacgactcactatagggttgtagtaggtttagtagaattgccaattcaacagaggagagaattgatgattctactaaacctggcggcagcgcaaaagatg

SEQ ID NO: 100661 - DNA, 103 bp, Artificial Sequence
  Synthetic Polynucleotide
taatacgactcactatagggttgttttagattgtagtaggtttagtagaaaacagaggagattctacatgacctactacaacctggcggcagcgcaaaagatg

SEQ ID NO: 100662 - DNA, 103 bp, Artificial Sequence
  Synthetic Polynucleotide
taatacgactcactatagggttctccgcctcctgcccggcgcggggcccgaacagaggagacgggccatgcgccgggcaaacctggcggcagcgcaaaagatg

SEQ ID NO: 100663 - DNA, 103 bp, Artificial Sequence
  Synthetic Polynucleotide
taatacgactcactatagggatattaacacttgttttagattgtagtaggaacagaggagacctactatgatctaaaacaacctggcggcagcgcaaaagatg

SEQ ID NO: 100664 - DNA, 103 bp, Artificial Sequence
  Synthetic Polynucleotide
taatacgactcactatagggaaaatcagccatattaacacttgttttagaaacagaggagatctaaaatgagtgttaataacctggcggcagcgcaaaagatg

SEQ ID NO: 100665 - DNA, 103 bp, Artificial Sequence
  Synthetic Polynucleotide
taatacgactcactatagggacacttggacaaaatcagccatattaacacaacagaggagagtgttaatgtggctgattaacctggcggcagcgcaaaagatg

SEQ ID NO: 100666 - DNA, 103 bp, Artificial Sequence
  Synthetic Polynucleotide
taatacgactcactatagggttaatgttcaacacttggacaaaatcagccaacagaggagaggctgaatgtgtccaagtaacctggcggcagcgcaaaagatg

SEQ ID NO: 100667 - DNA, 103 bp, Artificial Sequence
  Synthetic Polynucleotide
taatacgactcactatagggagagtttaccttaatgttcaacacttggacaacagaggagagtccaaatgttgaacattaacctggcggcagcgcaaaagatg

SEQ ID NO: 100668 - DNA, 103 bp, Artificial Sequence
  Synthetic Polynucleotide
taatacgactcactataggggttgagtctcagagtttaccttaatgttcaaacagaggagatgaacaatgaggtaaactaacctggcggcagcgcaaaagatg

SEQ ID NO: 100669 - DNA, 103 bp, Artificial Sequence
  Synthetic Polynucleotide
taatacgactcactatagggtttagctgctgttgagtctcagagtttaccaacagaggagaggtaaaatgtgagactcaaacctggcggcagcgcaaaagatg

SEQ ID NO: 100670 - DNA, 103 bp, Artificial Sequence
  Synthetic Polynucleotide
taatacgactcactataggggtttattttatttagctgctgttgagtctcaacagaggagagagactatgcagcagctaaacctggcggcagcgcaaaagatg

SEQ ID NO: 100671 - DNA, 103 bp, Artificial Sequence
  Synthetic Polynucleotide
taatacgactcactatagggcagcaggaaggtttattttatttagctgctaacagaggagaagcagcatgataaaataaaacctggcggcagcgcaaaagatg

SEQ ID NO: 100672 - DNA, 103 bp, Artificial Sequence
  Synthetic Polynucleotide
taatacgactcactataggggccaaaattccagcaggaaggtttattttaaacagaggagataaaatatgccttcctgcaacctggcggcagcgcaaaagatg

SEQ ID NO: 100673 - DNA, 103 bp, Artificial Sequence
  Synthetic Polynucleotide
taatacgactcactataggggacccgacgcttctccgcctcctgcccggcaacagaggagagccgggatggaggcggagaacctggcggcagcgcaaaagatg

SEQ ID NO: 100674 - DNA, 103 bp, Artificial Sequence
  Synthetic Polynucleotide
taatacgactcactatagggttcacctgttgccaaaattccagcaggaagaacagaggagacttcctatgggaattttgaacctggcggcagcgcaaaagatg

SEQ ID NO: 100675 - DNA, 103 bp, Artificial Sequence
  Synthetic Polynucleotide
taatacgactcactatagggctgtctgtttttcacctgttgccaaaattcaacagaggagagaatttatgcaacaggtgaacctggcggcagcgcaaaagatg

SEQ ID NO: 100676 - DNA, 103 bp, Artificial Sequence
  Synthetic Polynucleotide
taatacgactcactataggggttgatggatctgtctgtttttcacctgttaacagaggagaaacaggatgaaaacagacaacctggcggcagcgcaaaagatg

SEQ ID NO: 100677 - DNA, 103 bp, Artificial Sequence
  Synthetic Polynucleotide
taatacgactcactatagggctgttgtggtgttgatggatctgtctgtttaacagaggagaaaacagatggatccatcaaacctggcggcagcgcaaaagatg

SEQ ID NO: 100678 - DNA, 103 bp, Artificial Sequence
  Synthetic Polynucleotide
taatacgactcactatagggtcgaagactcctgttgtggtgttgatggataacagaggagaatccatatgcaccacaacaacctggcggcagcgcaaaagatg

SEQ ID NO: 100679 - DNA, 103 bp, Artificial Sequence
  Synthetic Polynucleotide
taatacgactcactatagggcccaacggtttcgaagactcctgttgtggtaacagaggagaaccacaatgggagtcttcaacctggcggcagcgcaaaagatg

SEQ ID NO: 100680 - DNA, 103 bp, Artificial Sequence
  Synthetic Polynucleotide
taatacgactcactatagggctgaattcctcccaacggtttcgaagactcaacagaggagagagtctatgaaaccgttgaacctggcggcagcgcaaaagatg

SEQ ID NO: 100681 - DNA, 103 bp, Artificial Sequence
  Synthetic Polynucleotide
taatacgactcactataggggagaagaaggctgaattcctcccaacggttaacagaggagaaaccgtatggaggaattcaacctggcggcagcgcaaaagatg

SEQ ID NO: 100682 - DNA, 103 bp, Artificial Sequence
  Synthetic Polynucleotide
taatacgactcactatagggtggatggtctgagaagaaggctgaattcctaacagaggagaaggaatatggccttcttcaacctggcggcagcgcaaaagatg

SEQ ID NO: 100683 - DNA, 103 bp, Artificial Sequence
  Synthetic Polynucleotide
taatacgactcactatagggcactttaggctggatggtctgagaagaaggaacagaggagaccttctatgcagaccatcaacctggcggcagcgcaaaagatg

SEQ ID NO: 100684 - DNA, 103 bp, Artificial Sequence
  Synthetic Polynucleotide
taatacgactcactataggggcagcgagaagacccgacgcttctccgcctaacagaggagaaggcggatgagcgtcgggaacctggcggcagcgcaaaagatg

SEQ ID NO: 100685 - DNA, 103 bp, Artificial Sequence
  Synthetic Polynucleotide
taatacgactcactatagggcatcagtctccactttaggctggatggtctaacagaggagaagaccaatgagcctaaagaacctggcggcagcgcaaaagatg

SEQ ID NO: 100686 - DNA, 103 bp, Artificial Sequence
  Synthetic Polynucleotide
taatacgactcactataggggcctgggcagcatcagtctccactttaggcaacagaggagagcctaaatgggagactgaaacctggcggcagcgcaaaagatg

SEQ ID NO: 100687 - DNA, 103 bp, Artificial Sequence
  Synthetic Polynucleotide
taatacgactcactatagggctgcacagccgcctgggcagcatcagtctcaacagaggagagagactatggctgcccagaacctggcggcagcgcaaaagatg

SEQ ID NO: 100688 - DNA, 103 bp, Artificial Sequence
  Synthetic Polynucleotide
taatacgactcactatagggcaaatgcactctgcacagccgcctgggcagaacagaggagactgcccatgcggctgtgcaacctggcggcagcgcaaaagatg

SEQ ID NO: 100689 - DNA, 103 bp, Artificial Sequence
  Synthetic Polynucleotide
taatacgactcactatagggaacagaactgcaaatgcactctgcacagccaacagaggagaggctgtatggagtgcattaacctggcggcagcgcaaaagatg

SEQ ID NO: 100690 - DNA, 103 bp, Artificial Sequence
  Synthetic Polynucleotide
taatacgactcactatagggtaactgagtcaacagaactgcaaatgcactaacagaggagaagtgcaatggcagttctgaacctggcggcagcgcaaaagatg

SEQ ID NO: 100691 - DNA, 103 bp, Artificial Sequence
  Synthetic Polynucleotide
taatacgactcactataggggagcctttattaactgagtcaacagaactgaacagaggagacagttcatgtgactcagtaacctggcggcagcgcaaaagatg

SEQ ID NO: 100692 - DNA, 103 bp, Artificial Sequence
  Synthetic Polynucleotide
taatacgactcactatagggtttgactgctgagcctttattaactgagtcaacagaggagagactcaatgaataaaggcaacctggcggcagcgcaaaagatg

SEQ ID NO: 100693 - DNA, 103 bp, Artificial Sequence
  Synthetic Polynucleotide
taatacgactcactatagggatctttctgctttgactgctgagcctttataacagaggagaataaagatgcagcagtcaaacctggcggcagcgcaaaagatg

SEQ ID NO: 100694 - DNA, 103 bp, Artificial Sequence
  Synthetic Polynucleotide
taatacgactcactatagggctagtagcacatctttctgctttgactgctaacagaggagaagcagtatgagcagaaagaacctggcggcagcgcaaaagatg

SEQ ID NO: 100695 - DNA, 103 bp, Artificial Sequence
  Synthetic Polynucleotide
taatacgactcactatagggtgcggctggggcagcgagaagacccgacgcaacagaggagagcgtcgatgcttctcgctaacctggcggcagcgcaaaagatg

SEQ ID NO: 100696 - DNA, 103 bp, Artificial Sequence
  Synthetic Polynucleotide
taatacgactcactatagggtccctctcttctagtagcacatctttctgcaacagaggagagcagaaatgtgtgctactaacctggcggcagcgcaaaagatg

SEQ ID NO: 100697 - DNA, 103 bp, Artificial Sequence
  Synthetic Polynucleotide
taatacgactcactatagggcgatccattttccctctcttctagtagcacaacagaggagagtgctaatggaagagaggaacctggcggcagcgcaaaagatg

SEQ ID NO: 100698 - DNA, 103 bp, Artificial Sequence
  Synthetic Polynucleotide
taatacgactcactatagggcttcatgtcccgatccattttccctctcttaacagaggagaaagagaatgaaaatggataacctggcggcagcgcaaaagatg

SEQ ID NO: 100699 - DNA, 103 bp, Artificial Sequence
  Synthetic Polynucleotide
taatacgactcactatagggtgtaatgacgcttcatgtcccgatccatttaacagaggagaaaatggatggggacatgaaacctggcggcagcgcaaaagatg

SEQ ID NO: 100700 - DNA, 103 bp, Artificial Sequence
  Synthetic Polynucleotide
taatacgactcactatagggtggcctgagttgtaatgacgcttcatgtccaacagaggagaggacatatggcgtcattaaacctggcggcagcgcaaaagatg

SEQ ID NO: 100701 - DNA, 103 bp, Artificial Sequence
  Synthetic Polynucleotide
taatacgactcactataggggttctggaggtggcctgagttgtaatgacgaacagaggagacgtcatatgaactcaggcaacctggcggcagcgcaaaagatg

SEQ ID NO: 100702 - DNA, 103 bp, Artificial Sequence
  Synthetic Polynucleotide
taatacgactcactatagggggagtgctaggttctggaggtggcctgagtaacagaggagaactcagatgacctccagaaacctggcggcagcgcaaaagatg

SEQ ID NO: 100703 - DNA, 103 bp, Artificial Sequence
  Synthetic Polynucleotide
taatacgactcactatagggtcccgacaccggagtgctaggttctggaggaacagaggagacctccaatgcctagcactaacctggcggcagcgcaaaagatg

SEQ ID NO: 100704 - DNA, 103 bp, Artificial Sequence
  Synthetic Polynucleotide
taatacgactcactatagggggtcatcttgtcccgacaccggagtgctagaacagaggagactagcaatgcggtgtcggaacctggcggcagcgcaaaagatg

SEQ ID NO: 100705 - DNA, 103 bp, Artificial Sequence
  Synthetic Polynucleotide
taatacgactcactatagggtgctggatgaggtcatcttgtcccgacaccaacagaggagaggtgtcatgacaagatgaaacctggcggcagcgcaaaagatg

SEQ ID NO: 100706 - DNA, 103 bp, Artificial Sequence
  Synthetic Polynucleotide
taatacgactcactataggggccgtcctgctgcggctggggcagcgagaaaacagaggagattctcgatgccccagccgaacctggcggcagcgcaaaagatg

SEQ ID NO: 100707 - DNA, 103 bp, Artificial Sequence
  Synthetic Polynucleotide
taatacgactcactatagggcatatcttgatgctggatgaggtcatcttgaacagaggagacaagatatgctcatccagaacctggcggcagcgcaaaagatg

SEQ ID NO: 100708 - DNA, 103 bp, Artificial Sequence
  Synthetic Polynucleotide
taatacgactcactatagggccaagatcctcatatcttgatgctggatgaaacagaggagatcatccatgatcaagataaacctggcggcagcgcaaaagatg

SEQ ID NO: 100709 - DNA, 103 bp, Artificial Sequence
  Synthetic Polynucleotide
taatacgactcactatagggggcgttagctccaagatcctcatatcttgaaacagaggagatcaagaatggaggatcttaacctggcggcagcgcaaaagatg

SEQ ID NO: 100710 - DNA, 103 bp, Artificial Sequence
  Synthetic Polynucleotide
taatacgactcactataggggtctggttctggcgttagctccaagatcctaacagaggagaaggatcatggagctaacgaacctggcggcagcgcaaaagatg

SEQ ID NO: 100711 - DNA, 103 bp, Artificial Sequence
  Synthetic Polynucleotide
taatacgactcactatagggttcgaggccggtctggttctggcgttagctaacagaggagaagctaaatgcagaaccagaacctggcggcagcgcaaaagatg

SEQ ID NO: 100712 - DNA, 103 bp, Artificial Sequence
  Synthetic Polynucleotide
taatacgactcactatagggggaggcagaattcgaggccggtctggttctaacagaggagaagaaccatgccggcctcgaacctggcggcagcgcaaaagatg

SEQ ID NO: 100713 - DNA, 103 bp, Artificial Sequence
  Synthetic Polynucleotide
taatacgactcactatagggtcgttggtcaggaggcagaattcgaggccgaacagaggagacggcctatgattctgcctaacctggcggcagcgcaaaagatg

SEQ ID NO: 100714 - DNA, 103 bp, Artificial Sequence
  Synthetic Polynucleotide
taatacgactcactataggggctcgggaggtcgttggtcaggaggcagaaaacagaggagattctgcatgctgaccaacaacctggcggcagcgcaaaagatg

SEQ ID NO: 100715 - DNA, 103 bp, Artificial Sequence
  Synthetic Polynucleotide
taatacgactcactatagggggttcaggaggctcgggaggtcgttggtcaaacagaggagatgaccaatgacctcccgaaacctggcggcagcgcaaaagatg

SEQ ID NO: 100716 - DNA, 103 bp, Artificial Sequence
  Synthetic Polynucleotide
taatacgactcactataggggactggtggtggttcaggaggctcgggaggaacagaggagacctcccatgcctcctgaaaacctggcggcagcgcaaaagatg

SEQ ID NO: 100717 - DNA, 103 bp, Artificial Sequence
  Synthetic Polynucleotide
taatacgactcactatagggcaccgccaccgccgtcctgctgcggctgggaacagaggagacccagcatgagcaggacgaacctggcggcagcgcaaaagatg

SEQ ID NO: 100718 - DNA, 103 bp, Artificial Sequence
  Synthetic Polynucleotide
taatacgactcactatagggcttcctcagtgactggtggtggttcaggagaacagaggagactcctgatgcaccaccagaacctggcggcagcgcaaaagatg

SEQ ID NO: 100719 - DNA, 103 bp, Artificial Sequence
  Synthetic Polynucleotide
taatacgactcactatagggtaatctagatcttcctcagtgactggtggtaacagaggagaaccaccatgcactgaggaaacctggcggcagcgcaaaagatg

SEQ ID NO: 100720 - DNA, 103 bp, Artificial Sequence
  Synthetic Polynucleotide
taatacgactcactatagggttctgtccgataatctagatcttcctcagtaacagaggagaactgagatggatctagataacctggcggcagcgcaaaagatg

SEQ ID NO: 100721 - DNA, 103 bp, Artificial Sequence
  Synthetic Polynucleotide
taatacgactcactatagggcatgctggttttctgtccgataatctagataacagaggagaatctagatgatcggacagaacctggcggcagcgcaaaagatg

SEQ ID NO: 100722 - DNA, 103 bp, Artificial Sequence
  Synthetic Polynucleotide
taatacgactcactataggggtggtgggtacatgctggttttctgtccgaaacagaggagatcggacatgaaaccagcaaacctggcggcagcgcaaaagatg

SEQ ID NO: 100723 - DNA, 103 bp, Artificial Sequence
  Synthetic Polynucleotide
taatacgactcactatagggtgaagaactggtggtgggtacatgctggttaacagaggagaaaccagatggtacccaccaacctggcggcagcgcaaaagatg

SEQ ID NO: 100724 - DNA, 103 bp, Artificial Sequence
  Synthetic Polynucleotide
taatacgactcactatagggggtcagttaatgaagaactggtggtgggtaaacagaggagatacccaatgccagttcttaacctggcggcagcgcaaaagatg

SEQ ID NO: 100725 - DNA, 103 bp, Artificial Sequence
  Synthetic Polynucleotide
taatacgactcactatagggccggcatgagggtcagttaatgaagaactgaacagaggagacagttcatgattaactgaaacctggcggcagcgcaaaagatg

SEQ ID NO: 100726 - DNA, 103 bp, Artificial Sequence
  Synthetic Polynucleotide
taatacgactcactatagggtgccttcactccggcatgagggtcagttaaaacagaggagattaactatgcctcatgccaacctggcggcagcgcaaaagatg

SEQ ID NO: 100727 - DNA, 103 bp, Artificial Sequence
  Synthetic Polynucleotide
taatacgactcactataggggtaacagggctgccttcactccggcatgagaacagaggagactcatgatggagtgaaggaacctggcggcagcgcaaaagatg

SEQ ID NO: 100728 - DNA, 103 bp, Artificial Sequence
  Synthetic Polynucleotide
taatacgactcactatagggccgctactagcaccgccaccgccgtcctgcaacagaggagagcaggaatgcggtggcggaacctggcggcagcgcaaaagatg

SEQ ID NO: 100729 - DNA, 103 bp, Artificial Sequence
  Synthetic Polynucleotide
taatacgactcactataggggcaagcagctgtaacagggctgccttcactaacagaggagaagtgaaatgagccctgttaacctggcggcagcgcaaaagatg

SEQ ID NO: 100730 - DNA, 103 bp, Artificial Sequence
  Synthetic Polynucleotide
taatacgactcactatagggctgatgctgagcaagcagctgtaacagggcaacagaggagagccctgatgcagctgcttaacctggcggcagcgcaaaagatg

SEQ ID NO: 100731 - DNA, 103 bp, Artificial Sequence
  Synthetic Polynucleotide
taatacgactcactatagggcatcctggggctgatgctgagcaagcagctaacagaggagaagctgcatgctcagcatcaacctggcggcagcgcaaaagatg

SEQ ID NO: 100732 - DNA, 103 bp, Artificial Sequence
  Synthetic Polynucleotide
taatacgactcactatagggcttttggggtcatcctggggctgatgctgaaacagaggagatcagcaatggccccaggaaacctggcggcagcgcaaaagatg

SEQ ID NO: 100733 - DNA, 103 bp, Artificial Sequence
  Synthetic Polynucleotide
taatacgactcactatagggcccaccttctcttttggggtcatcctggggaacagaggagaccccagatggaccccaaaaacctggcggcagcgcaaaagatg

SEQ ID NO: 100734 - DNA, 103 bp, Artificial Sequence
  Synthetic Polynucleotide
taatacgactcactataggggataatcaatcccaccttctcttttggggtaacagaggagaaccccaatggagaaggtgaacctggcggcagcgcaaaagatg

SEQ ID NO: 100735 - DNA, 103 bp, Artificial Sequence
  Synthetic Polynucleotide
taatacgactcactatagggtctcctgcttgataatcaatcccaccttctaacagaggagaagaaggatggattgattaaacctggcggcagcgcaaaagatg

SEQ ID NO: 100736 - DNA, 103 bp, Artificial Sequence
  Synthetic Polynucleotide
taatacgactcactatagggcacgtaagtgtctcctgcttgataatcaataacagaggagaattgatatgcaagcaggaaacctggcggcagcgcaaaagatg

SEQ ID NO: 100737 - DNA, 103 bp, Artificial Sequence
  Synthetic Polynucleotide
taatacgactcactatagggctgaagtggacacgtaagtgtctcctgcttaacagaggagaaagcagatgacacttacgaacctggcggcagcgcaaaagatg

SEQ ID NO: 100738 - DNA, 103 bp, Artificial Sequence
  Synthetic Polynucleotide
taatacgactcactatagggtccttgtagtctgaagtggacacgtaagtgaacagaggagacacttaatggtccacttcaacctggcggcagcgcaaaagatg

SEQ ID NO: 100739 - DNA, 103 bp, Artificial Sequence
  Synthetic Polynucleotide
taatacgactcactatagggcttctccgcccagctcaggcccccgcctccaacagaggagaggaggcatgggcctgagcaacctggcggcagcgcaaaagatg

SEQ ID NO: 100740 - DNA, 103 bp, Artificial Sequence
  Synthetic Polynucleotide
taatacgactcactatagggcacacccccgccgctactagcaccgccaccaacagaggagaggtggcatggctagtagcaacctggcggcagcgcaaaagatg

SEQ ID NO: 100741 - DNA, 103 bp, Artificial Sequence
  Synthetic Polynucleotide
taatacgactcactatagggtccaaagttgtccttgtagtctgaagtggaaacagaggagatccactatggactacaagaacctggcggcagcgcaaaagatg

SEQ ID NO: 100742 - DNA, 103 bp, Artificial Sequence
  Synthetic Polynucleotide
taatacgactcactatagggaagaagaggatccaaagttgtccttgtagtaacagaggagaactacaatgacaactttgaacctggcggcagcgcaaaagatg

SEQ ID NO: 100743 - DNA, 103 bp, Artificial Sequence
  Synthetic Polynucleotide
taatacgactcactataggggcagaagagaaagaagaggatccaaagttgaacagaggagacaacttatgatcctcttcaacctggcggcagcgcaaaagatg

SEQ ID NO: 100744 - DNA, 103 bp, Artificial Sequence
  Synthetic Polynucleotide
taatacgactcactatagggaacataaggagcagaagagaaagaagaggaaacagaggagatcctctatgttctcttctaacctggcggcagcgcaaaagatg

SEQ ID NO: 100745 - DNA, 103 bp, Artificial Sequence
  Synthetic Polynucleotide
taatacgactcactatagggcatcattgctaacataaggagcagaagagaaacagaggagatctcttatgctccttatgaacctggcggcagcgcaaaagatg

SEQ ID NO: 100746 - DNA, 103 bp, Artificial Sequence
  Synthetic Polynucleotide
taatacgactcactatagggcttcctagaccatcattgctaacataaggaaacagaggagatccttaatgtagcaatgaaacctggcggcagcgcaaaagatg

SEQ ID NO: 100747 - DNA, 103 bp, Artificial Sequence
  Synthetic Polynucleotide
taatacgactcactatagggagcagaactgcttcctagaccatcattgctaacagaggagaagcaatatgggtctaggaaacctggcggcagcgcaaaagatg

SEQ ID NO: 100748 - DNA, 103 bp, Artificial Sequence
  Synthetic Polynucleotide
taatacgactcactatagggctagtggtggagcagaactgcttcctagacaacagaggagagtctagatggcagttctgaacctggcggcagcgcaaaagatg

SEQ ID NO: 100749 - DNA, 103 bp, Artificial Sequence
  Synthetic Polynucleotide
taatacgactcactatagggctacgtcgttctagtggtggagcagaactgaacagaggagacagttcatgtccaccactaacctggcggcagcgcaaaagatg

SEQ ID NO: 100750 - DNA, 103 bp, Artificial Sequence
  Synthetic Polynucleotide
taatacgactcactatagggtccaatgaaactacgtcgttctagtggtggaacagaggagaccaccaatggaacgacgtaacctggcggcagcgcaaaagatg

SEQ ID NO: 100751 - DNA, 103 bp, Artificial Sequence
  Synthetic Polynucleotide
taatacgactcactatagggccagcggggtcacacccccgccgctactagaacagaggagactagtaatggcgggggtgaacctggcggcagcgcaaaagatg

SEQ ID NO: 100752 - DNA, 103 bp, Artificial Sequence
  Synthetic Polynucleotide
taatacgactcactatagggtatctgaatttccaatgaaactacgtcgttaacagaggagaaacgacatggtttcattgaacctggcggcagcgcaaaagatg

SEQ ID NO: 100753 - DNA, 103 bp, Artificial Sequence
  Synthetic Polynucleotide
taatacgactcactatagggaaagactgaatatctgaatttccaatgaaaaacagaggagatttcatatgaaattcagaaacctggcggcagcgcaaaagatg

SEQ ID NO: 100754 - DNA, 103 bp, Artificial Sequence
  Synthetic Polynucleotide
taatacgactcactataggggtagttatccaaagactgaatatctgaattaacagaggagaaattcaatgattcagtctaacctggcggcagcgcaaaagatg

SEQ ID NO: 100755 - DNA, 103 bp, Artificial Sequence
  Synthetic Polynucleotide
taatacgactcactatagggaagcagtactgtagttatccaaagactgaaaacagaggagattcagtatgtggataactaacctggcggcagcgcaaaagatg

SEQ ID NO: 100756 - DNA, 103 bp, Artificial Sequence
  Synthetic Polynucleotide
taatacgactcactataggggaatgagatgaagcagtactgtagttatccaacagaggagaggataaatgcagtactgcaacctggcggcagcgcaaaagatg

SEQ ID NO: 100757 - DNA, 103 bp, Artificial Sequence
  Synthetic Polynucleotide
taatacgactcactatagggtggaccaccagaatgagatgaagcagtactaacagaggagaagtactatgtcatctcataacctggcggcagcgcaaaagatg

SEQ ID NO: 100758 - DNA, 103 bp, Artificial Sequence
  Synthetic Polynucleotide
taatacgactcactatagggaaggctgaggtggaccaccagaatgagatgaacagaggagacatctcatgctggtggtcaacctggcggcagcgcaaaagatg

SEQ ID NO: 100759 - DNA, 103 bp, Artificial Sequence
  Synthetic Polynucleotide
taatacgactcactataggggaaaaggcagaaggctgaggtggaccaccaaacagaggagatggtggatgacctcagccaacctggcggcagcgcaaaagatg

SEQ ID NO: 100760 - DNA, 103 bp, Artificial Sequence
  Synthetic Polynucleotide
taatacgactcactatagggaaatgactcagaaaaggcagaaggctgaggaacagaggagacctcagatgtctgcctttaacctggcggcagcgcaaaagatg

SEQ ID NO: 100761 - DNA, 103 bp, Artificial Sequence
  Synthetic Polynucleotide
taatacgactcactatagggctgaactgggaaatgactcagaaaaggcagaacagaggagactgcctatgctgagtcataacctggcggcagcgcaaaagatg

SEQ ID NO: 100762 - DNA, 103 bp, Artificial Sequence
  Synthetic Polynucleotide
taatacgactcactatagggtcgtattccaccagcggggtcacacccccgaacagaggagacgggggatggaccccgctaacctggcggcagcgcaaaagatg

SEQ ID NO: 100763 - DNA, 103 bp, Artificial Sequence
  Synthetic Polynucleotide
taatacgactcactatagggtatccagctactgaactgggaaatgactcaaacagaggagatgagtcatgtcccagttcaacctggcggcagcgcaaaagatg

SEQ ID NO: 100764 - DNA, 103 bp, Artificial Sequence
  Synthetic Polynucleotide
taatacgactcactatagggaatgtctccatatccagctactgaactgggaacagaggagacccagtatggtagctggaaacctggcggcagcgcaaaagatg

SEQ ID NO: 100765 - DNA, 103 bp, Artificial Sequence
  Synthetic Polynucleotide
taatacgactcactatagggcattgaggtaaatgtctccatatccagctaaacagaggagatagctgatgatggagacaaacctggcggcagcgcaaaagatg

SEQ ID NO: 100766 - DNA, 103 bp, Artificial Sequence
  Synthetic Polynucleotide
taatacgactcactatagggatgggaccagcattgaggtaaatgtctccaaacagaggagatggagaatgttacctcaaaacctggcggcagcgcaaaagatg

SEQ ID NO: 100767 - DNA, 103 bp, Artificial Sequence
  Synthetic Polynucleotide
taatacgactcactatagggactaaacaacatgggaccagcattgaggtaaacagaggagatacctcatggctggtcccaacctggcggcagcgcaaaagatg

SEQ ID NO: 100768 - DNA, 103 bp, Artificial Sequence
  Synthetic Polynucleotide
taatacgactcactatagggccttgtctccactaaacaacatgggaccagaacagaggagactggtcatgtgttgtttaaacctggcggcagcgcaaaagatg

SEQ ID NO: 100769 - DNA, 103 bp, Artificial Sequence
  Synthetic Polynucleotide
taatacgactcactatagggaatctatggtccttgtctccactaaacaacaacagaggagagttgttatgtggagacaaaacctggcggcagcgcaaaagatg

SEQ ID NO: 100770 - DNA, 103 bp, Artificial Sequence
  Synthetic Polynucleotide
taatacgactcactataggggctatattcaaatctatggtccttgtctccaacagaggagaggagacatggaccatagaaacctggcggcagcgcaaaagatg

SEQ ID NO: 100771 - DNA, 103 bp, Artificial Sequence
  Synthetic Polynucleotide
taatacgactcactatagggtaggaccatggctatattcaaatctatggtaacagaggagaaccataatgttgaatataaacctggcggcagcgcaaaagatg

SEQ ID NO: 100772 - DNA, 103 bp, Artificial Sequence
  Synthetic Polynucleotide
taatacgactcactatagggaggactgcaataggaccatggctatattcaaacagaggagatgaataatgccatggtccaacctggcggcagcgcaaaagatg

SEQ ID NO: 100773 - DNA, 103 bp, Artificial Sequence
  Synthetic Polynucleotide
taatacgactcactataggggctcacatcctcgtattccaccagcggggtaacagaggagaaccccgatggtggaatacaacctggcggcagcgcaaaagatg

SEQ ID NO: 100774 - DNA, 103 bp, Artificial Sequence
  Synthetic Polynucleotide
taatacgactcactataggggctgtttgccaggactgcaataggaccatgaacagaggagacatggtatgattgcagtcaacctggcggcagcgcaaaagatg

SEQ ID NO: 100775 - DNA, 103 bp, Artificial Sequence
  Synthetic Polynucleotide
taatacgactcactatagggaagggtcactgctgtttgccaggactgcaaaacagaggagattgcagatgtggcaaacaaacctggcggcagcgcaaaagatg

SEQ ID NO: 100776 - DNA, 103 bp, Artificial Sequence
  Synthetic Polynucleotide
taatacgactcactatagggggccccgtggaagggtcactgctgtttgccaacagaggagaggcaaaatgcagtgacccaacctggcggcagcgcaaaagatg

SEQ ID NO: 100777 - DNA, 103 bp, Artificial Sequence
  Synthetic Polynucleotide
taatacgactcactatagggagtactctctggccccgtggaagggtcactaacagaggagaagtgacatgtccacggggaacctggcggcagcgcaaaagatg

SEQ ID NO: 100778 - DNA, 103 bp, Artificial Sequence
  Synthetic Polynucleotide
taatacgactcactataggggcaaaggatgagtactctctggccccgtggaacagaggagaccacggatgcagagagtaaacctggcggcagcgcaaaagatg

SEQ ID NO: 100779 - DNA, 103 bp, Artificial Sequence
  Synthetic Polynucleotide
taatacgactcactatagggatctttgctggcaaaggatgagtactctctaacagaggagaagagagatgtcatcctttaacctggcggcagcgcaaaagatg

SEQ ID NO: 100780 - DNA, 103 bp, Artificial Sequence
  Synthetic Polynucleotide
taatacgactcactatagggatagttgtgcatctttgctggcaaaggatgaacagaggagacatcctatgccagcaaagaacctggcggcagcgcaaaagatg

SEQ ID NO: 100781 - DNA, 103 bp, Artificial Sequence
  Synthetic Polynucleotide
taatacgactcactatagggcaccatagttatagttgtgcatctttgctgaacagaggagacagcaaatgtgcacaactaacctggcggcagcgcaaaagatg

SEQ ID NO: 100782 - DNA, 103 bp, Artificial Sequence
  Synthetic Polynucleotide
taatacgactcactatagggtgtaagttaccaccatagttatagttgtgcaacagaggagagcacaaatgtaactatggaacctggcggcagcgcaaaagatg

SEQ ID NO: 100783 - DNA, 103 bp, Artificial Sequence
  Synthetic Polynucleotide
taatacgactcactatagggcggattttcctgtaagttaccaccatagttaacagaggagaaactatatgggtaacttaaacctggcggcagcgcaaaagatg

SEQ ID NO: 100784 - DNA, 103 bp, Artificial Sequence
  Synthetic Polynucleotide
taatacgactcactatagggcggactgggagctcacatcctcgtattccaaacagaggagatggaatatgaggatgtgaaacctggcggcagcgcaaaagatg

SEQ ID NO: 100785 - DNA, 103 bp, Artificial Sequence
  Synthetic Polynucleotide
taatacgactcactatagggtggggccactcggattttcctgtaagttacaacagaggagagtaactatgaggaaaatcaacctggcggcagcgcaaaagatg

SEQ ID NO: 100786 - DNA, 103 bp, Artificial Sequence
  Synthetic Polynucleotide
taatacgactcactatagggtgcatgaggctggggccactcggattttccaacagaggagaggaaaaatggagtggcccaacctggcggcagcgcaaaagatg

SEQ ID NO: 100787 - DNA, 103 bp, Artificial Sequence
  Synthetic Polynucleotide
taatacgactcactatagggggtctgtccatgcatgaggctggggccactaacagaggagaagtggcatgagcctcatgaacctggcggcagcgcaaaagatg

SEQ ID NO: 100788 - DNA, 103 bp, Artificial Sequence
  Synthetic Polynucleotide
taatacgactcactataggggagaagtccaggtctgtccatgcatgaggcaacagaggagagcctcaatgatggacagaaacctggcggcagcgcaaaagatg

SEQ ID NO: 100789 - DNA, 103 bp, Artificial Sequence
  Synthetic Polynucleotide
taatacgactcactatagggccttgggcaggagaagtccaggtctgtccaaacagaggagatggacaatgctggacttcaacctggcggcagcgcaaaagatg

SEQ ID NO: 100790 - DNA, 103 bp, Artificial Sequence
  Synthetic Polynucleotide
taatacgactcactatagggatatccaggtccttgggcaggagaagtccaaacagaggagatggactatgcctgcccaaaacctggcggcagcgcaaaagatg

SEQ ID NO: 100791 - DNA, 103 bp, Artificial Sequence
  Synthetic Polynucleotide
taatacgactcactatagggatccttgtgaatatccaggtccttgggcagaacagaggagactgcccatggacctggataacctggcggcagcgcaaaagatg

SEQ ID NO: 100792 - DNA, 103 bp, Artificial Sequence
  Synthetic Polynucleotide
taatacgactcactatagggtgtcccctgtatccttgtgaatatccaggtaacagaggagaacctggatgttcacaaggaacctggcggcagcgcaaaagatg

SEQ ID NO: 100793 - DNA, 103 bp, Artificial Sequence
  Synthetic Polynucleotide
taatacgactcactatagggtgtgctaatatgtcccctgtatccttgtgaaacagaggagatcacaaatgtacaggggaaacctggcggcagcgcaaaagatg

SEQ ID NO: 100794 - DNA, 103 bp, Artificial Sequence
  Synthetic Polynucleotide
taatacgactcactatagggtgccagttgatgtgctaatatgtcccctgtaacagaggagaacagggatgatattagcaaacctggcggcagcgcaaaagatg

SEQ ID NO: 100795 - DNA, 103 bp, Artificial Sequence
  Synthetic Polynucleotide
taatacgactcactatagggagcccctgctcggactgggagctcacatccaacagaggagaggatgtatgctcccagtcaacctggcggcagcgcaaaagatg

SEQ ID NO: 100796 - DNA, 103 bp, Artificial Sequence
  Synthetic Polynucleotide
taatacgactcactatagggcctctgcctctgccagttgatgtgctaataaacagaggagatattagatgatcaactggaacctggcggcagcgcaaaagatg

SEQ ID NO: 100797 - DNA, 103 bp, Artificial Sequence
  Synthetic Polynucleotide
taatacgactcactatagggtaaccctctgcctctgcctctgccagttgaaacagaggagatcaactatgagaggcagaaacctggcggcagcgcaaaagatg

SEQ ID NO: 100798 - DNA, 103 bp, Artificial Sequence
  Synthetic Polynucleotide
taatacgactcactatagggccccagcagcagcccctgctcggactgggaaacagaggagatcccagatggagcaggggaacctggcggcagcgcaaaagatg

SEQ ID NO: 100799 - DNA, 103 bp, Artificial Sequence
  Synthetic Polynucleotide
taatacgactcactatagggcgctggccccccccagcagcagcccctgctaacagaggagaagcaggatgtgctgctggaacctggcggcagcgcaaaagatg

SEQ ID NO: 100800 - DNA, 103 bp, Artificial Sequence
  Synthetic Polynucleotide
taatacgactcactataggggccgttgccgcgctggccccccccagcagcaacagaggagagctgctatggggggccagaacctggcggcagcgcaaaagatg

SEQ ID NO: 100801 - DNA, 103 bp, Artificial Sequence
  Synthetic Polynucleotide
taatacgactcactatagggagccgtcgccgccgttgccgcgctggccccaacagaggagaggggccatggcggcaacgaacctggcggcagcgcaaaagatg

SEQ ID NO: 100802 - DNA, 103 bp, Artificial Sequence
  Synthetic Polynucleotide
taatacgactcactatagggcctccaacttcttctccgcccagctcaggcaacagaggagagcctgaatggggcggagaaacctggcggcagcgcaaaagatg

SEQ ID NO: 100803 - DNA, 103 bp, Artificial Sequence
  Synthetic Polynucleotide
taatacgactcactatagggttcccccggcagccgtcgccgccgttgccgaacagaggagacggcaaatgcggcgacggaacctggcggcagcgcaaaagatg

SEQ ID NO: 100804 - DNA, 103 bp, Artificial Sequence
  Synthetic Polynucleotide
taatacgactcactatagggctgccccccgttcccccggcagccgtcgccaacagaggagaggcgacatgtgccgggggaacctggcggcagcgcaaaagatg

SEQ ID NO: 100805 - DNA, 103 bp, Artificial Sequence
  Synthetic Polynucleotide
taatacgactcactatagggactcccgccgctgccccccgttcccccggcaacagaggagagccgggatgacggggggcaacctggcggcagcgcaaaagatg

SEQ ID NO: 100806 - DNA, 103 bp, Artificial Sequence
  Synthetic Polynucleotide
taatacgactcactatagggaggaggccggactcccgccgctgccccccgaacagaggagacgggggatggcggcgggaaacctggcggcagcgcaaaagatg

SEQ ID NO: 100807 - DNA, 103 bp, Artificial Sequence
  Synthetic Polynucleotide
taatacgactcactataggggtgccggaggaggaggccggactcccgccgaacagaggagacggcggatgtccggcctcaacctggcggcagcgcaaaagatg

SEQ ID NO: 100808 - DNA, 103 bp, Artificial Sequence
  Synthetic Polynucleotide
taatacgactcactataggggcgccgctgggtgccggaggaggaggccggaacagaggagaccggccatgtcctccggcaacctggcggcagcgcaaaagatg

SEQ ID NO: 100809 - DNA, 103 bp, Artificial Sequence
  Synthetic Polynucleotide
taatacgactcactatagggacccctccccgcgccgctgggtgccggaggaacagaggagacctccgatgcccagcggcaacctggcggcagcgcaaaagatg

SEQ ID NO: 100810 - DNA, 103 bp, Artificial Sequence
  Synthetic Polynucleotide
taatacgactcactatagggctgcgctccgacccctccccgcgccgctggaacagaggagaccagcgatgcggggagggaacctggcggcagcgcaaaagatg

SEQ ID NO: 100811 - DNA, 103 bp, Artificial Sequence
  Synthetic Polynucleotide
taatacgactcactatagggccggcggggcctgcgctccgacccctccccaacagaggagaggggagatgtcggagcgcaacctggcggcagcgcaaaagatg

SEQ ID NO: 100812 - DNA, 103 bp, Artificial Sequence
  Synthetic Polynucleotide
taatacgactcactatagggtgcggcggtcccggcggggcctgcgctccgaacagaggagacggagcatgggccccgccaacctggcggcagcgcaaaagatg

SEQ ID NO: 100813 - DNA, 103 bp, Artificial Sequence
  Synthetic Polynucleotide
taatacgactcactatagggttgcggcgttcctccaacttcttctccgccaacagaggagaggcggaatggaagttggaaacctggcggcagcgcaaaagatg

SEQ ID NO: 100814 - DNA, 103 bp, Artificial Sequence
  Synthetic Polynucleotide
taatacgactcactatagggccactgctgctgcggcggtcccggcggggcaacagaggagagccccgatgggaccgccgaacctggcggcagcgcaaaagatg

SEQ ID NO: 100815 - DNA, 103 bp, Artificial Sequence
  Synthetic Polynucleotide
taatacgactcactatagggcttgctgcggccactgctgctgcggcggtcaacagaggagagaccgcatgagcagcagtaacctggcggcagcgcaaaagatg

SEQ ID NO: 100816 - DNA, 103 bp, Artificial Sequence
  Synthetic Polynucleotide
taatacgactcactatagggggtggcgctccttgctgcggccactgctgcaacagaggagagcagcaatggccgcagcaaacctggcggcagcgcaaaagatg

SEQ ID NO: 100817 - DNA, 103 bp, Artificial Sequence
  Synthetic Polynucleotide
taatacgactcactatagggcggtgctcgcggtggcgctccttgctgcggaacagaggagaccgcagatgggagcgccaaacctggcggcagcgcaaaagatg

SEQ ID NO: 100818 - DNA, 103 bp, Artificial Sequence
  Synthetic Polynucleotide
taatacgactcactatagggatcccgccgccggtgctcgcggtggcgctcaacagaggagagagcgcatgcgcgagcacaacctggcggcagcgcaaaagatg

SEQ ID NO: 100819 - DNA, 103 bp, Artificial Sequence
  Synthetic Polynucleotide
taatacgactcactatagggcgcgctgcccatcccgccgccggtgctcgcaacagaggagagcgagcatgggcggcgggaacctggcggcagcgcaaaagatg

SEQ ID NO: 100820 - DNA, 103 bp, Artificial Sequence
  Synthetic Polynucleotide
taatacgactcactatagggtcgctgccaccgcgctgcccatcccgccgcaacagaggagagcggcgatgtgggcagcgaacctggcggcagcgcaaaagatg

SEQ ID NO: 100821 - DNA, 103 bp, Artificial Sequence
  Synthetic Polynucleotide
taatacgactcactatagggcttggaggcctcgctgccaccgcgctgcccaacagaggagagggcagatgggtggcagcaacctggcggcagcgcaaaagatg

SEQ ID NO: 100822 - DNA, 103 bp, Artificial Sequence
  Synthetic Polynucleotide
taatacgactcactatagggggctgcgggacttggaggcctcgctgccacaacagaggagagtggcaatgaggcctccaaacctggcggcagcgcaaaagatg

SEQ ID NO: 100823 - DNA, 103 bp, Artificial Sequence
  Synthetic Polynucleotide
taatacgactcactatagggtggctgtggcggctgcgggacttggaggccaacagaggagaggcctcatggtcccgcagaacctggcggcagcgcaaaagatg

SEQ ID NO: 100824 - DNA, 103 bp, Artificial Sequence
  Synthetic Polynucleotide
taatacgactcactatagggtcgcctccgcttgcggcgttcctccaacttaacagaggagaaagttgatggaacgccgcaacctggcggcagcgcaaaagatg

SEQ ID NO: 100825 - DNA, 103 bp, Artificial Sequence
  Synthetic Polynucleotide
taatacgactcactatagggctcgccgctgtggctgtggcggctgcgggaaacagaggagatcccgcatgcgccacagcaacctggcggcagcgcaaaagatg

SEQ ID NO: 100826 - DNA, 103 bp, Artificial Sequence
  Synthetic Polynucleotide
taatacgactcactatagggcggcccgttcctcgccgctgtggctgtggcaacagaggagagccacaatgacagcggcgaacctggcggcagcgcaaaagatg

SEQ ID NO: 100827 - DNA, 103 bp, Artificial Sequence
  Synthetic Polynucleotide
taatacgactcactatagggttggcgacctcggcccgttcctcgccgctgaacagaggagacagcggatgggaacgggcaacctggcggcagcgcaaaagatg

SEQ ID NO: 100828 - DNA, 103 bp, Artificial Sequence
  Synthetic Polynucleotide
taatacgactcactataggggctgccgctcttggcgacctcggcccgttcaacagaggagagaacggatggaggtcgccaacctggcggcagcgcaaaagatg

SEQ ID NO: 100829 - DNA, 103 bp, Artificial Sequence
  Synthetic Polynucleotide
taatacgactcactatagggtgctgctgctgctgccgctcttggcgacctaacagaggagaaggtcgatgagagcggcaaacctggcggcagcgcaaaagatg

SEQ ID NO: 100830 - DNA, 103 bp, Artificial Sequence
  Synthetic Polynucleotide
taatacgactcactatagggcggccgccgctgctgctgctgctgccgctcaacagaggagagagcggatgcagcagcagaacctggcggcagcgcaaaagatg

SEQ ID NO: 100831 - DNA, 103 bp, Artificial Sequence
  Synthetic Polynucleotide
taatacgactcactataggggcttttccggcggccgccgctgctgctgctaacagaggagaagcagcatgagcggcggcaacctggcggcagcgcaaaagatg

SEQ ID NO: 100832 - DNA, 103 bp, Artificial Sequence
  Synthetic Polynucleotide
taatacgactcactatagggtggccgaagcgcttttccggcggccgccgcaacagaggagagcggcgatggccggaaaaaacctggcggcagcgcaaaagatg

SEQ ID NO: 100833 - DNA, 103 bp, Artificial Sequence
  Synthetic Polynucleotide
taatacgactcactatagggctgctggatgtggccgaagcgcttttccggaacagaggagaccggaaatgcgcttcggcaacctggcggcagcgcaaaagatg

SEQ ID NO: 100834 - DNA, 103 bp, Artificial Sequence
  Synthetic Polynucleotide
taatacgactcactataggggctgctactgctgctggatgtggccgaagcaacagaggagagcttcgatgacatccagcaacctggcggcagcgcaaaagatg

SEQ ID NO: 100835 - DNA, 103 bp, Artificial Sequence
  Synthetic Polynucleotide
taatacgactcactataggggggacaggaatcgcctccgcttgcggcgttaacagaggagaaacgccatgagcggaggcaacctggcggcagcgcaaaagatg

SEQ ID NO: 100836 - DNA, 103 bp, Artificial Sequence
  Synthetic Polynucleotide
taatacgactcactatagggggtccttgcggctgctactgctgctggatgaacagaggagacatccaatggcagtagcaaacctggcggcagcgcaaaagatg

SEQ ID NO: 100837 - DNA, 103 bp, Artificial Sequence
  Synthetic Polynucleotide
taatacgactcactatagggttcgagtcccggtccttgcggctgctactgaacagaggagacagtagatgccgcaaggaaacctggcggcagcgcaaaagatg

SEQ ID NO: 100838 - DNA, 103 bp, Artificial Sequence
  Synthetic Polynucleotide
taatacgactcactataggggcggtgggccttcgagtcccggtccttgcgaacagaggagacgcaagatgcgggactcgaacctggcggcagcgcaaaagatg

SEQ ID NO: 100839 - DNA, 103 bp, Artificial Sequence
  Synthetic Polynucleotide
taatacgactcactatagggtagtccggctgcggtgggccttcgagtcccaacagaggagagggactatgaggcccaccaacctggcggcagcgcaaaagatg

SEQ ID NO: 100840 - DNA, 103 bp, Artificial Sequence
  Synthetic Polynucleotide
taatacgactcactatagggttggacgacttagtccggctgcggtgggccaacagaggagaggcccaatgcagccggacaacctggcggcagcgcaaaagatg

SEQ ID NO: 100841 - DNA, 103 bp, Artificial Sequence
  Synthetic Polynucleotide
taatacgactcactatagggaggcggctccttggacgacttagtccggctaacagaggagaagccggatgaagtcgtccaacctggcggcagcgcaaaagatg

SEQ ID NO: 100842 - DNA, 103 bp, Artificial Sequence
  Synthetic Polynucleotide
taatacgactcactatagggtgtaggccgaaggcggctccttggacgactaacagaggagaagtcgtatgaggagccgcaacctggcggcagcgcaaaagatg

SEQ ID NO: 100843 - DNA, 103 bp, Artificial Sequence
  Synthetic Polynucleotide
taatacgactcactatagggggcggttccttgtaggccgaaggcggctccaacagaggagaggagccatgttcggcctaaacctggcggcagcgcaaaagatg

SEQ ID NO: 100844 - DNA, 103 bp, Artificial Sequence
  Synthetic Polynucleotide
taatacgactcactataggggtaggccttgggcggttccttgtaggccgaaacagaggagatcggccatgaaggaaccgaacctggcggcagcgcaaaagatg

SEQ ID NO: 100845 - DNA, 103 bp, Artificial Sequence
  Synthetic Polynucleotide
taatacgactcactatagggtgtcctcccggtaggccttgggcggttcctaacagaggagaaggaacatgccaaggcctaacctggcggcagcgcaaaagatg

SEQ ID NO: 100846 - DNA, 103 bp, Artificial Sequence
  Synthetic Polynucleotide
taatacgactcactatagggggctgctgaggggacaggaatcgcctccgcaacagaggagagcggagatgattcctgtcaacctggcggcagcgcaaaagatg

SEQ ID NO: 100847 - DNA, 103 bp, Artificial Sequence
  Synthetic Polynucleotide
taatacgactcactatagggggctcggtcttgtcctcccggtaggccttgaacagaggagacaaggcatgccgggaggaaacctggcggcagcgcaaaagatg

SEQ ID NO: 100848 - DNA, 103 bp, Artificial Sequence
  Synthetic Polynucleotide
taatacgactcactataggggtaggccttaggctcggtcttgtcctcccgaacagaggagacgggagatgaagaccgagaacctggcggcagcgcaaaagatg

SEQ ID NO: 100849 - DNA, 103 bp, Artificial Sequence
  Synthetic Polynucleotide
taatacgactcactataggggccgccgcctgtaggccttaggctcggtctaacagaggagaagaccgatgctaaggcctaacctggcggcagcgcaaaagatg

SEQ ID NO: 100850 - DNA, 103 bp, Artificial Sequence
  Synthetic Polynucleotide
taatacgactcactatagggctgagggaccgccgccgcctgtaggccttaaacagaggagataaggcatgcaggcggcgaacctggcggcagcgcaaaagatg

SEQ ID NO: 100851 - DNA, 103 bp, Artificial Sequence
  Synthetic Polynucleotide
taatacgactcactatagggtcccagtgggctgagggaccgccgccgcctaacagaggagaaggcggatgcggtccctcaacctggcggcagcgcaaaagatg

SEQ ID NO: 100852 - DNA, 103 bp, Artificial Sequence
  Synthetic Polynucleotide
taatacgactcactatagggcgtcccggcctcccagtgggctgagggaccaacagaggagaggtcccatggcccactggaacctggcggcagcgcaaaagatg

SEQ ID NO: 100853 - DNA, 103 bp, Artificial Sequence
  Synthetic Polynucleotide
taatacgactcactatagggaccgggctgtcgtcccggcctcccagtgggaacagaggagacccactatgaggccgggaaacctggcggcagcgcaaaagatg

SEQ ID NO: 100854 - DNA, 103 bp, Artificial Sequence
  Synthetic Polynucleotide
taatacgactcactatagggcctgtgggacaccgggctgtcgtcccggccaacagaggagaggccggatggacagcccgaacctggcggcagcgcaaaagatg

SEQ ID NO: 100855 - DNA, 103 bp, Artificial Sequence
  Synthetic Polynucleotide
taatacgactcactatagggtctgagaggccctgtgggacaccgggctgtaacagaggagaacagccatgtgtcccacaaacctggcggcagcgcaaaagatg

SEQ ID NO: 100856 - DNA, 103 bp, Artificial Sequence
  Synthetic Polynucleotide
taatacgactcactatagggctcctcaggctctgagaggccctgtgggacaacagaggagagtcccaatgggcctctcaaacctggcggcagcgcaaaagatg

SEQ ID NO: 100857 - DNA, 103 bp, Artificial Sequence
  Synthetic Polynucleotide
taatacgactcactataggggacgtcctcttccaacaccaagtccatcataacagaggagaatgatgatgttggtgttgaacctggcggcagcgcaaaagatg

SEQ ID NO: 100858 - DNA, 103 bp, Artificial Sequence
  Synthetic Polynucleotide
taatacgactcactatagggtcccaacccagcattggggttgatgccatcaacagaggagagatggcatgaaccccaataacctggcggcagcgcaaaagatg

SEQ ID NO: 100859 - DNA, 103 bp, Artificial Sequence
  Synthetic Polynucleotide
taatacgactcactatagggttcagagttaagttcttcaacctttttttcaacagaggagagaaaaaatggttgaagaaaacctggcggcagcgcaaaagatg

SEQ ID NO: 100860 - DNA, 103 bp, Artificial Sequence
  Synthetic Polynucleotide
taatacgactcactataggggcttttcaatttcagagttaagttcttcaaaacagaggagattgaagatgttaactctgaacctggcggcagcgcaaaagatg

SEQ ID NO: 100861 - DNA, 103 bp, Artificial Sequence
  Synthetic Polynucleotide
taatacgactcactataggggcagcactgagcttttcaatttcagagttaaacagaggagataactcatgaattgaaaaaacctggcggcagcgcaaaagatg

SEQ ID NO: 100862 - DNA, 103 bp, Artificial Sequence
  Synthetic Polynucleotide
taatacgactcactatagggtttagcaaaggcagcactgagcttttcaataacagaggagaattgaaatgctcagtgctaacctggcggcagcgcaaaagatg

SEQ ID NO: 100863 - DNA, 103 bp, Artificial Sequence
  Synthetic Polynucleotide
taatacgactcactatagggcctctctggctttagcaaaggcagcactgaaacagaggagatcagtgatgcctttgctaaacctggcggcagcgcaaaagatg

SEQ ID NO: 100864 - DNA, 103 bp, Artificial Sequence
  Synthetic Polynucleotide
taatacgactcactatagggttctgtagggcctctctggctttagcaaagaacagaggagactttgcatgagccagagaaacctggcggcagcgcaaaagatg

SEQ ID NO: 100865 - DNA, 103 bp, Artificial Sequence
  Synthetic Polynucleotide
taatacgactcactatagggggtctgtgctttctgtagggcctctctggcaacagaggagagccagaatggccctacagaacctggcggcagcgcaaaagatg

SEQ ID NO: 100866 - DNA, 103 bp, Artificial Sequence
  Synthetic Polynucleotide
taatacgactcactataggggaaattcctgggtctgtgctttctgtagggaacagaggagaccctacatgaagcacagaaacctggcggcagcgcaaaagatg

SEQ ID NO: 100867 - DNA, 103 bp, Artificial Sequence
  Synthetic Polynucleotide
taatacgactcactatagggtcagacccctgaaattcctgggtctgtgctaacagaggagaagcacaatgccaggaattaacctggcggcagcgcaaaagatg

SEQ ID NO: 100868 - DNA, 103 bp, Artificial Sequence
  Synthetic Polynucleotide
taatacgactcactatagggctcatagtcttcagacccctgaaattcctgaacagaggagacaggaaatgcaggggtctaacctggcggcagcgcaaaagatg

SEQ ID NO: 100869 - DNA, 103 bp, Artificial Sequence
  Synthetic Polynucleotide
taatacgactcactataggggcagaccatttcccaacccagcattggggtaacagaggagaaccccaatgctgggttggaacctggcggcagcgcaaaagatg

SEQ ID NO: 100870 - DNA, 103 bp, Artificial Sequence
  Synthetic Polynucleotide
taatacgactcactatagggatagagcagtctcatagtcttcagacccctaacagaggagaaggggtatgaagactatgaacctggcggcagcgcaaaagatg

SEQ ID NO: 100871 - DNA, 103 bp, Artificial Sequence
  Synthetic Polynucleotide
taatacgactcactatagggtcctttcctgatagagcagtctcatagtctaacagaggagaagactaatggactgctctaacctggcggcagcgcaaaagatg

SEQ ID NO: 100872 - DNA, 103 bp, Artificial Sequence
  Synthetic Polynucleotide
taatacgactcactatagggcgaaagggcttcctttcctgatagagcagtaacagaggagaactgctatgtcaggaaagaacctggcggcagcgcaaaagatg

SEQ ID NO: 100873 - DNA, 103 bp, Artificial Sequence
  Synthetic Polynucleotide
taatacgactcactataggggcagcgcagccgaaagggcttcctttcctgaacagaggagacaggaaatgaagccctttaacctggcggcagcgcaaaagatg

SEQ ID NO: 100874 - DNA, 103 bp, Artificial Sequence
  Synthetic Polynucleotide
taatacgactcactatagggttttgtgagcgcagcgcagccgaaagggctaacagaggagaagccctatgggctgcgctaacctggcggcagcgcaaaagatg

SEQ ID NO: 100875 - DNA, 103 bp, Artificial Sequence
  Synthetic Polynucleotide
taatacgactcactatagggcttggtgaggttttgtgagcgcagcgcagcaacagaggagagctgcgatgcgctcacaaaacctggcggcagcgcaaaagatg

SEQ ID NO: 100876 - DNA, 103 bp, Artificial Sequence
  Synthetic Polynucleotide
taatacgactcactatagggtctctgtactcttggtgaggttttgtgagcaacagaggagagctcacatgacctcaccaaacctggcggcagcgcaaaagatg

SEQ ID NO: 100877 - DNA, 103 bp, Artificial Sequence
  Synthetic Polynucleotide
taatacgactcactatagggagtctgtggttctctgtactcttggtgaggaacagaggagacctcacatggagtacagaaacctggcggcagcgcaaaagatg

SEQ ID NO: 100878 - DNA, 103 bp, Artificial Sequence
  Synthetic Polynucleotide
taatacgactcactataggggcttctacgcagtctgtggttctctgtactaacagaggagaagtacaatgaaccacagaaacctggcggcagcgcaaaagatg

SEQ ID NO: 100879 - DNA, 103 bp, Artificial Sequence
  Synthetic Polynucleotide
taatacgactcactatagggtcttcttaatgcttctacgcagtctgtggtaacagaggagaaccacaatgtgcgtagaaaacctggcggcagcgcaaaagatg

SEQ ID NO: 100880 - DNA, 103 bp, Artificial Sequence
  Synthetic Polynucleotide
taatacgactcactatagggacatttgggagcagaccatttcccaacccaaacagaggagatgggttatgaaatggtctaacctggcggcagcgcaaaagatg

SEQ ID NO: 100881 - DNA, 103 bp, Artificial Sequence
  Synthetic Polynucleotide
taatacgactcactatagggtcctgggtgatcttcttaatgcttctacgcaacagaggagagcgtagatgcattaagaaaacctggcggcagcgcaaaagatg

SEQ ID NO: 100882 - DNA, 103 bp, Artificial Sequence
  Synthetic Polynucleotide
taatacgactcactataggggtcactcagctcctgggtgatcttcttaataacagaggagaattaagatgatcacccagaacctggcggcagcgcaaaagatg

SEQ ID NO: 100883 - DNA, 103 bp, Artificial Sequence
  Synthetic Polynucleotide
taatacgactcactatagggcctgctgcaagtcactcagctcctgggtgaaacagaggagatcacccatgagctgagtgaacctggcggcagcgcaaaagatg

SEQ ID NO: 100884 - DNA, 103 bp, Artificial Sequence
  Synthetic Polynucleotide
taatacgactcactatagggctctccctctcctgctgcaagtcactcagcaacagaggagagctgagatgcttgcagcaaacctggcggcagcgcaaaagatg

SEQ ID NO: 100885 - DNA, 103 bp, Artificial Sequence
  Synthetic Polynucleotide
taatacgactcactatagggcttctccagtctctccctctcctgctgcaaaacagaggagattgcagatggagagggagaacctggcggcagcgcaaaagatg

SEQ ID NO: 100886 - DNA, 103 bp, Artificial Sequence
  Synthetic Polynucleotide
taatacgactcactatagggcctccaggtccttctccagtctctccctctaacagaggagaagagggatggactggagaaacctggcggcagcgcaaaagatg

SEQ ID NO: 100887 - DNA, 103 bp, Artificial Sequence
  Synthetic Polynucleotide
taatacgactcactatagggcgatgggcttcctccaggtccttctccagtaacagaggagaactggaatgggacctggaaacctggcggcagcgcaaaagatg

SEQ ID NO: 100888 - DNA, 103 bp, Artificial Sequence
  Synthetic Polynucleotide
taatacgactcactataggggctcttctctcgatgggcttcctccaggtcaacagaggagagacctgatggaagcccataacctggcggcagcgcaaaagatg

SEQ ID NO: 100889 - DNA, 103 bp, Artificial Sequence
  Synthetic Polynucleotide
taatacgactcactatagggagtctcctttgctcttctctcgatgggcttaacagaggagaaagcccatggagagaagaaacctggcggcagcgcaaaagatg

SEQ ID NO: 100890 - DNA, 103 bp, Artificial Sequence
  Synthetic Polynucleotide
taatacgactcactatagggcggatggtgcagtctcctttgctcttctctaacagaggagaagagaaatgcaaaggagaaacctggcggcagcgcaaaagatg

SEQ ID NO: 100891 - DNA, 103 bp, Artificial Sequence
  Synthetic Polynucleotide
taatacgactcactatagggttcttctgacacatttgggagcagaccattaacagaggagaaatggtatgctcccaaataacctggcggcagcgcaaaagatg

SEQ ID NO: 100892 - DNA, 103 bp, Artificial Sequence
  Synthetic Polynucleotide
taatacgactcactatagggtctaagatcacggatggtgcagtctcctttaacagaggagaaaaggaatgtgcaccatcaacctggcggcagcgcaaaagatg

SEQ ID NO: 100893 - DNA, 103 bp, Artificial Sequence
  Synthetic Polynucleotide
taatacgactcactatagggcaacttcatttctaagatcacggatggtgcaacagaggagagcaccaatggtgatcttaaacctggcggcagcgcaaaagatg

SEQ ID NO: 100894 - DNA, 103 bp, Artificial Sequence
  Synthetic Polynucleotide
taatacgactcactatagggcgtaatttttcaacttcatttctaagatcaaacagaggagatgatctatgaaatgaagtaacctggcggcagcgcaaaagatg

SEQ ID NO: 100895 - DNA, 103 bp, Artificial Sequence
  Synthetic Polynucleotide
taatacgactcactatagggcacttcattgcgtaatttttcaacttcattaacagaggagaaatgaaatggaaaaattaaacctggcggcagcgcaaaagatg

SEQ ID NO: 100896 - DNA, 103 bp, Artificial Sequence
  Synthetic Polynucleotide
taatacgactcactatagggctctttcattcacttcattgcgtaatttttaacagaggagaaaaaatatggcaatgaagaacctggcggcagcgcaaaagatg

SEQ ID NO: 100897 - DNA, 103 bp, Artificial Sequence
  Synthetic Polynucleotide
taatacgactcactatagggattgctttctctctttcattcacttcattgaacagaggagacaatgaatggaatgaaagaacctggcggcagcgcaaaagatg

SEQ ID NO: 100898 - DNA, 103 bp, Artificial Sequence
  Synthetic Polynucleotide
taatacgactcactatagggacgattttccattgctttctctctttcattaacagaggagaaatgaaatggagaaagcaaacctggcggcagcgcaaaagatg

SEQ ID NO: 100899 - DNA, 103 bp, Artificial Sequence
  Synthetic Polynucleotide
taatacgactcactataggggactcttgtaacgattttccattgctttctaacagaggagaagaaagatgtggaaaatcaacctggcggcagcgcaaaagatg

SEQ ID NO: 100900 - DNA, 103 bp, Artificial Sequence
  Synthetic Polynucleotide
taatacgactcactatagggtcactcagaagactcttgtaacgattttccaacagaggagaggaaaaatgttacaagagaacctggcggcagcgcaaaagatg

SEQ ID NO: 100901 - DNA, 103 bp, Artificial Sequence
  Synthetic Polynucleotide
taatacgactcactatagggtttattgctttcactcagaagactcttgtaaacagaggagatacaagatgcttctgagtaacctggcggcagcgcaaaagatg

SEQ ID NO: 100902 - DNA, 103 bp, Artificial Sequence
  Synthetic Polynucleotide
taatacgactcactataggggagacactgtttcttctgacacatttgggaaacagaggagatcccaaatgtgtcagaagaacctggcggcagcgcaaaagatg

SEQ ID NO: 100903 - DNA, 103 bp, Artificial Sequence
  Synthetic Polynucleotide
taatacgactcactatagggtgtgcaattttttattgctttcactcagaaaacagaggagattctgaatgaaagcaataaacctggcggcagcgcaaaagatg

SEQ ID NO: 100904 - DNA, 103 bp, Artificial Sequence
  Synthetic Polynucleotide
taatacgactcactatagggtgctcttgattgtgcaattttttattgcttaacagaggagaaagcaaatgaaaattgcaaacctggcggcagcgcaaaagatg

SEQ ID NO: 100905 - DNA, 103 bp, Artificial Sequence
  Synthetic Polynucleotide
taatacgactcactatagggtttgatcacttgctcttgattgtgcaatttaacagaggagaaaattgatgaatcaagagaacctggcggcagcgcaaaagatg

SEQ ID NO: 100906 - DNA, 103 bp, Artificial Sequence
  Synthetic Polynucleotide
taatacgactcactatagggctgttagatgtttgatcacttgctcttgataacagaggagaatcaagatgaagtgatcaaacctggcggcagcgcaaaagatg

SEQ ID NO: 100907 - DNA, 103 bp, Artificial Sequence
  Synthetic Polynucleotide
taatacgactcactatagggttggtactttctgttagatgtttgatcactaacagaggagaagtgatatgacatctaacaacctggcggcagcgcaaaagatg

SEQ ID NO: 100908 - DNA, 103 bp, Artificial Sequence
  Synthetic Polynucleotide
taatacgactcactataggggtccttctgattggtactttctgttagatgaacagaggagacatctaatggaaagtaccaacctggcggcagcgcaaaagatg

SEQ ID NO: 100909 - DNA, 103 bp, Artificial Sequence
  Synthetic Polynucleotide
taatacgactcactataggggaagcaacacgtccttctgattggtactttaacagaggagaaaagtaatgatcagaaggaacctggcggcagcgcaaaagatg

SEQ ID NO: 100910 - DNA, 103 bp, Artificial Sequence
  Synthetic Polynucleotide
taatacgactcactatagggttgaatttctgaagcaacacgtccttctgaaacagaggagatcagaaatgcgtgttgctaacctggcggcagcgcaaaagatg

SEQ ID NO: 100911 - DNA, 103 bp, Artificial Sequence
  Synthetic Polynucleotide
taatacgactcactatagggatctttttcattgaatttctgaagcaacacaacagaggagagtgttgatgcagaaattcaacctggcggcagcgcaaaagatg

SEQ ID NO: 100912 - DNA, 103 bp, Artificial Sequence
  Synthetic Polynucleotide
taatacgactcactatagggttacttccaaatctttttcattgaatttctaacagaggagaagaaatatgatgaaaaagaacctggcggcagcgcaaaagatg

SEQ ID NO: 100913 - DNA, 103 bp, Artificial Sequence
  Synthetic Polynucleotide
taatacgactcactataggggctctggtgggagacactgtttcttctgacaacagaggagagtcagaatgaacagtgtcaacctggcggcagcgcaaaagatg

SEQ ID NO: 100914 - DNA, 103 bp, Artificial Sequence
  Synthetic Polynucleotide
taatacgactcactatagggttctgctgtattacttccaaatctttttcaaacagaggagatgaaaaatgtttggaagtaacctggcggcagcgcaaaagatg

SEQ ID NO: 100915 - DNA, 103 bp, Artificial Sequence
  Synthetic Polynucleotide
taatacgactcactatagggtaaatagcagttctgctgtattacttccaaaacagaggagattggaaatgatacagcagaacctggcggcagcgcaaaagatg

SEQ ID NO: 100916 - DNA, 103 bp, Artificial Sequence
  Synthetic Polynucleotide
taatacgactcactatagggctgcagccattaaatagcagttctgctgtaaacagaggagatacagcatgactgctattaacctggcggcagcgcaaaagatg

SEQ ID NO: 100917 - DNA, 103 bp, Artificial Sequence
  Synthetic Polynucleotide
taatacgactcactatagggtcaagatcctctgcagccattaaatagcagaacagaggagactgctaatgaatggctgcaacctggcggcagcgcaaaagatg

SEQ ID NO: 100918 - DNA, 103 bp, Artificial Sequence
  Synthetic Polynucleotide
taatacgactcactatagggactcctgagctcaagatcctctgcagccataacagaggagaatggctatggaggatcttaacctggcggcagcgcaaaagatg

SEQ ID NO: 100919 - DNA, 103 bp, Artificial Sequence
  Synthetic Polynucleotide
taatacgactcactatagggttaagccttcactcctgagctcaagatcctaacagaggagaaggatcatgagctcaggaaacctggcggcagcgcaaaagatg

SEQ ID NO: 100920 - DNA, 103 bp, Artificial Sequence
  Synthetic Polynucleotide
taatacgactcactatagggttttctgttattaagccttcactcctgagcaacagaggagagctcagatgtgaaggcttaacctggcggcagcgcaaaagatg

SEQ ID NO: 100921 - DNA, 103 bp, Artificial Sequence
  Synthetic Polynucleotide
taatacgactcactatagggagaagagcacttttctgttattaagccttcaacagaggagagaaggcatgataacagaaaacctggcggcagcgcaaaagatg

SEQ ID NO: 100922 - DNA, 103 bp, Artificial Sequence
  Synthetic Polynucleotide
taatacgactcactataggggtggctgttgagaagagcacttttctgttaaacagaggagataacagatgagtgctcttaacctggcggcagcgcaaaagatg

SEQ ID NO: 100923 - DNA, 103 bp, Artificial Sequence
  Synthetic Polynucleotide
taatacgactcactatagggttgctgcctggtggctgttgagaagagcacaacagaggagagtgctcatgtcaacagccaacctggcggcagcgcaaaagatg

SEQ ID NO: 100924 - DNA, 103 bp, Artificial Sequence
  Synthetic Polynucleotide
taatacgactcactatagggcatgttccgtgctctggtgggagacactgtaacagaggagaacagtgatgcccaccagaaacctggcggcagcgcaaaagatg

SEQ ID NO: 100925 - DNA, 103 bp, Artificial Sequence
  Synthetic Polynucleotide
taatacgactcactataggggaagatggttttgctgcctggtggctgttgaacagaggagacaacagatgccaggcagcaacctggcggcagcgcaaaagatg

SEQ ID NO: 100926 - DNA, 103 bp, Artificial Sequence
  Synthetic Polynucleotide
taatacgactcactatagggtttccttagagaagatggttttgctgcctgaacagaggagacaggcaatgaaaccatctaacctggcggcagcgcaaaagatg

SEQ ID NO: 100927 - DNA, 103 bp, Artificial Sequence
  Synthetic Polynucleotide
taatacgactcactataggggattgtttcttttccttagagaagatggttaacagaggagaaaccatatgctctaaggaaacctggcggcagcgcaaaagatg

SEQ ID NO: 100928 - DNA, 103 bp, Artificial Sequence
  Synthetic Polynucleotide
taatacgactcactatagggatagtctgatgattgtttcttttccttagaaacagaggagatctaagatgaagaaacaaaacctggcggcagcgcaaaagatg

SEQ ID NO: 100929 - DNA, 103 bp, Artificial Sequence
  Synthetic Polynucleotide
taatacgactcactatagggtcagctcttcatagtctgatgattgtttctaacagaggagaagaaacatgcatcagactaacctggcggcagcgcaaaagatg

SEQ ID NO: 100930 - DNA, 103 bp, Artificial Sequence
  Synthetic Polynucleotide
taatacgactcactatagggaagacctgaatcagctcttcatagtctgataacagaggagaatcagaatgtgaagagctaacctggcggcagcgcaaaagatg

SEQ ID NO: 100931 - DNA, 103 bp, Artificial Sequence
  Synthetic Polynucleotide
taatacgactcactatagggctctttctttaagacctgaatcagctcttcaacagaggagagaagagatgattcaggtcaacctggcggcagcgcaaaagatg

SEQ ID NO: 100932 - DNA, 103 bp, Artificial Sequence
  Synthetic Polynucleotide
taatacgactcactatagggagatgtcctgctctttctttaagacctgaaaacagaggagattcaggatgtaaagaaagaacctggcggcagcgcaaaagatg

SEQ ID NO: 100933 - DNA, 103 bp, Artificial Sequence
  Synthetic Polynucleotide
taatacgactcactatagggagatgggtatagatgtcctgctctttctttaacagaggagaaaagaaatggcaggacataacctggcggcagcgcaaaagatg

SEQ ID NO: 100934 - DNA, 103 bp, Artificial Sequence
  Synthetic Polynucleotide
taatacgactcactatagggagatttgaccagatgggtatagatgtcctgaacagaggagacaggacatgtatacccataacctggcggcagcgcaaaagatg

SEQ ID NO: 100935 - DNA, 103 bp, Artificial Sequence
  Synthetic Polynucleotide
taatacgactcactatagggcaaagtccttcatgttccgtgctctggtggaacagaggagaccaccaatgcacggaacaaacctggcggcagcgcaaaagatg

SEQ ID NO: 100936 - DNA, 103 bp, Artificial Sequence
  Synthetic Polynucleotide
taatacgactcactatagggattcctgcagagatttgaccagatgggtataacagaggagaatacccatgtggtcaaataacctggcggcagcgcaaaagatg

SEQ ID NO: 100937 - DNA, 103 bp, Artificial Sequence
  Synthetic Polynucleotide
taatacgactcactatagggatactgtctgattcctgcagagatttgaccaacagaggagaggtcaaatgtctgcaggaaacctggcggcagcgcaaaagatg

SEQ ID NO: 100938 - DNA, 103 bp, Artificial Sequence
  Synthetic Polynucleotide
taatacgactcactatagggcaggttgttgatactgtctgattcctgcagaacagaggagactgcagatgtcagacagtaacctggcggcagcgcaaaagatg

SEQ ID NO: 100939 - DNA, 103 bp, Artificial Sequence
  Synthetic Polynucleotide
taatacgactcactatagggactcagcctgcaggttgttgatactgtctgaacagaggagacagacaatgtcaacaaccaacctggcggcagcgcaaaagatg

SEQ ID NO: 100940 - DNA, 103 bp, Artificial Sequence
  Synthetic Polynucleotide
taatacgactcactatagggatcttgtttaactcagcctgcaggttgttgaacagaggagacaacaaatggcaggctgaaacctggcggcagcgcaaaagatg

SEQ ID NO: 100941 - DNA, 103 bp, Artificial Sequence
  Synthetic Polynucleotide
taatacgactcactatagggcagggcaaaaatcttgtttaactcagcctgaacagaggagacaggctatgttaaacaagaacctggcggcagcgcaaaagatg

SEQ ID NO: 100942 - DNA, 103 bp, Artificial Sequence
  Synthetic Polynucleotide
taatacgactcactataggggttgcttccgcagggcaaaaatcttgtttaaacagaggagataaacaatgtttttgcccaacctggcggcagcgcaaaagatg

SEQ ID NO: 100943 - DNA, 103 bp, Artificial Sequence
  Synthetic Polynucleotide
taatacgactcactatagggtcctgctccagttgcttccgcagggcaaaaaacagaggagattttgcatggcggaagcaaacctggcggcagcgcaaaagatg

SEQ ID NO: 100944 - DNA, 103 bp, Artificial Sequence
  Synthetic Polynucleotide
taatacgactcactatagggtgaaagcacatcctgctccagttgcttccgaacagaggagacggaagatgctggagcagaacctggcggcagcgcaaaagatg

SEQ ID NO: 100945 - DNA, 103 bp, Artificial Sequence
  Synthetic Polynucleotide
taatacgactcactatagggaattctgatatgaaagcacatcctgctccaaacagaggagatggagcatgatgtgctttaacctggcggcagcgcaaaagatg

SEQ ID NO: 100946 - DNA, 103 bp, Artificial Sequence
  Synthetic Polynucleotide
taatacgactcactatagggatttgattttcaaagtccttcatgttccgtaacagaggagaacggaaatggaaggacttaacctggcggcagcgcaaaagatg

SEQ ID NO: 100947 - DNA, 103 bp, Artificial Sequence
  Synthetic Polynucleotide
taatacgactcactataggggtcttccgcaaattctgatatgaaagcacaaacagaggagatgtgctatgatatcagaaaacctggcggcagcgcaaaagatg

SEQ ID NO: 100948 - DNA, 103 bp, Artificial Sequence
  Synthetic Polynucleotide
taatacgactcactatagggctcctccaaggtcttccgcaaattctgataaacagaggagatatcagatgttgcggaagaacctggcggcagcgcaaaagatg

SEQ ID NO: 100949 - DNA, 103 bp, Artificial Sequence
  Synthetic Polynucleotide
taatacgactcactatagggcgctgatctgctcctccaaggtcttccgcaaacagaggagatgcggaatgccttggaggaacctggcggcagcgcaaaagatg

SEQ ID NO: 100950 - DNA, 103 bp, Artificial Sequence
  Synthetic Polynucleotide
taatacgactcactatagggctccgaatttcgctgatctgctcctccaagaacagaggagacttggaatggcagatcagaacctggcggcagcgcaaaagatg

SEQ ID NO: 100951 - DNA, 103 bp, Artificial Sequence
  Synthetic Polynucleotide
taatacgactcactatagggttcttcccgcctccgaatttcgctgatctgaacagaggagacagatcatggaaattcggaacctggcggcagcgcaaaagatg

SEQ ID NO: 100952 - DNA, 103 bp, Artificial Sequence
  Synthetic Polynucleotide
taatacgactcactatagggaaaatgattcttcttcccgcctccgaatttaacagaggagaaaattcatgggcgggaagaacctggcggcagcgcaaaagatg

SEQ ID NO: 100953 - DNA, 103 bp, Artificial Sequence
  Synthetic Polynucleotide
taatacgactcactatagggctataaagtgaaaatgattcttcttcccgcaacagaggagagcgggaatgagaatcattaacctggcggcagcgcaaaagatg

SEQ ID NO: 100954 - DNA, 103 bp, Artificial Sequence
  Synthetic Polynucleotide
taatacgactcactatagggtgtttgatcactataaagtgaaaatgattcaacagaggagagaatcaatgtcactttataacctggcggcagcgcaaaagatg

SEQ ID NO: 100955 - DNA, 103 bp, Artificial Sequence
  Synthetic Polynucleotide
taatacgactcactatagggttagataagatgtttgatcactataaagtgaacagaggagacactttatggtgatcaaaaacctggcggcagcgcaaaagatg

SEQ ID NO: 100956 - DNA, 103 bp, Artificial Sequence
  Synthetic Polynucleotide
taatacgactcactatagggaggcaaatacttagataagatgtttgatcaaacagaggagatgatcaatgatcttatctaacctggcggcagcgcaaaagatg

SEQ ID NO: 100957 - DNA, 103 bp, Artificial Sequence
  Synthetic Polynucleotide
taatacgactcactatagggcaattcagtgatttgattttcaaagtccttaacagaggagaaaggacatggaaaatcaaaacctggcggcagcgcaaaagatg

SEQ ID NO: 100958 - DNA, 103 bp, Artificial Sequence
  Synthetic Polynucleotide
taatacgactcactataggggttttcttcaaggcaaatacttagataagaaacagaggagatcttatatgagtatttgcaacctggcggcagcgcaaaagatg

SEQ ID NO: 100959 - DNA, 103 bp, Artificial Sequence
  Synthetic Polynucleotide
taatacgactcactataggggaaaccgattgttttcttcaaggcaaatacaacagaggagagtatttatgttgaagaaaaacctggcggcagcgcaaaagatg

SEQ ID NO: 100960 - DNA, 103 bp, Artificial Sequence
  Synthetic Polynucleotide
taatacgactcactatagggtgttccacttgaaaccgattgttttcttcaaacagaggagatgaagaatgcaatcggttaacctggcggcagcgcaaaagatg

SEQ ID NO: 100961 - DNA, 103 bp, Artificial Sequence
  Synthetic Polynucleotide
taatacgactcactatagggttgagaaaaatgttccacttgaaaccgattaacagaggagaaatcggatgcaagtggaaaacctggcggcagcgcaaaagatg

SEQ ID NO: 100962 - DNA, 103 bp, Artificial Sequence
  Synthetic Polynucleotide
taatacgactcactatagggtaagttcttcttgagaaaaatgttccacttaacagaggagaaagtggatgatttttctcaacctggcggcagcgcaaaagatg

SEQ ID NO: 100963 - DNA, 103 bp, Artificial Sequence
  Synthetic Polynucleotide
taatacgactcactatagggacctttttcttaagttcttcttgagaaaaaaacagaggagatttttcatgagaagaactaacctggcggcagcgcaaaagatg

SEQ ID NO: 100964 - DNA, 103 bp, Artificial Sequence
  Synthetic Polynucleotide
taatacgactcactatagggaaggtcactgacctttttcttaagttcttcaacagaggagagaagaaatgaagaaaaagaacctggcggcagcgcaaaagatg

SEQ ID NO: 100965 - DNA, 103 bp, Artificial Sequence
  Synthetic Polynucleotide
taatacgactcactatagggctagctgtataaggtcactgacctttttctaacagaggagaagaaaaatgtcagtgaccaacctggcggcagcgcaaaagatg

SEQ ID NO: 100966 - DNA, 103 bp, Artificial Sequence
  Synthetic Polynucleotide
taatacgactcactatagggagctccttcactagctgtataaggtcactgaacagaggagacagtgaatgtatacagctaacctggcggcagcgcaaaagatg

SEQ ID NO: 100967 - DNA, 103 bp, Artificial Sequence
  Synthetic Polynucleotide
taatacgactcactataggggtctgtatacagctccttcactagctgtataacagaggagaatacagatggtgaaggagaacctggcggcagcgcaaaagatg

SEQ ID NO: 100968 - DNA, 103 bp, Artificial Sequence
  Synthetic Polynucleotide
taatacgactcactatagggcagggacggtgacgtcctcttccaacaccaaacagaggagatggtgtatgaagaggacgaacctggcggcagcgcaaaagatg

SEQ ID NO: 100969 - DNA, 103 bp, Artificial Sequence
  Synthetic Polynucleotide
taatacgactcactatagggtttctttcttcaattcagtgatttgattttaacagaggagaaaaatcatgtcactgaataacctggcggcagcgcaaaagatg

SEQ ID NO: 100970 - DNA, 103 bp, Artificial Sequence
  Synthetic Polynucleotide
taatacgactcactatagggggtgctggttgtctgtatacagctccttcaaacagaggagatgaaggatgtgtatacagaacctggcggcagcgcaaaagatg

SEQ ID NO: 100971 - DNA, 103 bp, Artificial Sequence
  Synthetic Polynucleotide
taatacgactcactataggggttttcttcaggtgctggttgtctgtatacaacagaggagagtatacatgcaaccagcaaacctggcggcagcgcaaaagatg

SEQ ID NO: 100972 - DNA, 103 bp, Artificial Sequence
  Synthetic Polynucleotide
taatacgactcactatagggatcaaaaatggttttcttcaggtgctggttaacagaggagaaaccagatgctgaagaaaaacctggcggcagcgcaaaagatg

SEQ ID NO: 100973 - DNA, 103 bp, Artificial Sequence
  Synthetic Polynucleotide
taatacgactcactatagggtgcaggagagatcaaaaatggttttcttcaaacagaggagatgaagaatgccatttttgaacctggcggcagcgcaaaagatg

SEQ ID NO: 100974 - DNA, 103 bp, Artificial Sequence
  Synthetic Polynucleotide
taatacgactcactatagggtggaaacccatgcaggagagatcaaaaatgaacagaggagacattttatgtctctcctgaacctggcggcagcgcaaaagatg

SEQ ID NO: 100975 - DNA, 103 bp, Artificial Sequence
  Synthetic Polynucleotide
taatacgactcactatagggcccatttccctggaaacccatgcaggagagaacagaggagactctccatgatgggtttcaacctggcggcagcgcaaaagatg

SEQ ID NO: 100976 - DNA, 103 bp, Artificial Sequence
  Synthetic Polynucleotide
taatacgactcactatagggtatctggaaacccatttccctggaaacccaaacagaggagatgggttatgagggaaatgaacctggcggcagcgcaaaagatg

SEQ ID NO: 100977 - DNA, 103 bp, Artificial Sequence
  Synthetic Polynucleotide
taatacgactcactataggggacgcaagtctatctggaaacccatttcccaacagaggagagggaaaatggtttccagaaacctggcggcagcgcaaaagatg

SEQ ID NO: 100978 - DNA, 103 bp, Artificial Sequence
  Synthetic Polynucleotide
taatacgactcactatagggttgttctgtagacgcaagtctatctggaaaaacagaggagatttccaatgagacttgcgaacctggcggcagcgcaaaagatg

SEQ ID NO: 100979 - DNA, 103 bp, Artificial Sequence
  Synthetic Polynucleotide
taatacgactcactataggggaagctctgtttgttctgtagacgcaagtcaacagaggagagacttgatgctacagaacaacctggcggcagcgcaaaagatg

SEQ ID NO: 100980 - DNA, 103 bp, Artificial Sequence
  Synthetic Polynucleotide
taatacgactcactatagggaggttaaagttttctttcttcaattcagtgaacagaggagacactgaatggaagaaagaaacctggcggcagcgcaaaagatg

SEQ ID NO: 100981 - DNA, 103 bp, Artificial Sequence
  Synthetic Polynucleotide
taatacgactcactatagggttgctagccagaagctctgtttgttctgtaaacagaggagatacagaatgaacagagctaacctggcggcagcgcaaaagatg

SEQ ID NO: 100982 - DNA, 103 bp, Artificial Sequence
  Synthetic Polynucleotide
taatacgactcactatagggctcgtcctccttgctagccagaagctctgtaacagaggagaacagagatgctggctagcaacctggcggcagcgcaaaagatg

SEQ ID NO: 100983 - DNA, 103 bp, Artificial Sequence
  Synthetic Polynucleotide
taatacgactcactatagggtgatcgtgtcctcgtcctccttgctagccaaacagaggagatggctaatgaggaggacgaacctggcggcagcgcaaaagatg

SEQ ID NO: 100984 - DNA, 103 bp, Artificial Sequence
  Synthetic Polynucleotide
taatacgactcactatagggtccccaattttgatcgtgtcctcgtcctccaacagaggagaggaggaatgggacacgataacctggcggcagcgcaaaagatg

SEQ ID NO: 100985 - DNA, 103 bp, Artificial Sequence
  Synthetic Polynucleotide
taatacgactcactatagggctcgtcatcctccccaattttgatcgtgtcaacagaggagagacacgatgaaaattgggaacctggcggcagcgcaaaagatg

SEQ ID NO: 100986 - DNA, 103 bp, Artificial Sequence
  Synthetic Polynucleotide
taatacgactcactatagggggaaattaatctcgtcatcctccccaatttaacagaggagaaaattgatgaggatgacgaacctggcggcagcgcaaaagatg

SEQ ID NO: 100987 - DNA, 103 bp, Artificial Sequence
  Synthetic Polynucleotide
taatacgactcactatagggtggtcactcaggaaattaatctcgtcatccaacagaggagaggatgaatggattaatttaacctggcggcagcgcaaaagatg

SEQ ID NO: 100988 - DNA, 103 bp, Artificial Sequence
  Synthetic Polynucleotide
taatacgactcactatagggctgcaaatgctggtcactcaggaaattaataacagaggagaattaatatgctgagtgacaacctggcggcagcgcaaaagatg

SEQ ID NO: 100989 - DNA, 103 bp, Artificial Sequence
  Synthetic Polynucleotide
taatacgactcactatagggcattactctgctgcaaatgctggtcactcaaacagaggagatgagtgatgagcatttgcaacctggcggcagcgcaaaagatg

SEQ ID NO: 100990 - DNA, 103 bp, Artificial Sequence
  Synthetic Polynucleotide
taatacgactcactatagggttcataatctcattactctgctgcaaatgcaacagaggagagcatttatggcagagtaaaacctggcggcagcgcaaaagatg

SEQ ID NO: 100991 - DNA, 103 bp, Artificial Sequence
  Synthetic Polynucleotide
taatacgactcactataggggcggagctttaggttaaagttttctttcttaacagaggagaaagaaaatgaactttaacaacctggcggcagcgcaaaagatg

SEQ ID NO: 100992 - DNA, 103 bp, Artificial Sequence
  Synthetic Polynucleotide
taatacgactcactatagggggaaaggtctttcataatctcattactctgaacagaggagacagagtatggagattatgaacctggcggcagcgcaaaagatg

SEQ ID NO: 100993 - DNA, 103 bp, Artificial Sequence
  Synthetic Polynucleotide
taatacgactcactatagggagcctcctttggaaaggtctttcataatctaacagaggagaagattaatgaagacctttaacctggcggcagcgcaaaagatg

SEQ ID NO: 100994 - DNA, 103 bp, Artificial Sequence
  Synthetic Polynucleotide
taatacgactcactatagggccatttttgcagcctcctttggaaaggtctaacagaggagaagacctatgcaaaggaggaacctggcggcagcgcaaaagatg

SEQ ID NO: 100995 - DNA, 103 bp, Artificial Sequence
  Synthetic Polynucleotide
taatacgactcactatagggccttaagtatccatttttgcagcctcctttaacagaggagaaaaggaatgtgcaaaaataacctggcggcagcgcaaaagatg

SEQ ID NO: 100996 - DNA, 103 bp, Artificial Sequence
  Synthetic Polynucleotide
taatacgactcactatagggactccgtgtgccttaagtatccatttttgcaacagaggagagcaaaaatggatacttaaaacctggcggcagcgcaaaagatg

SEQ ID NO: 100997 - DNA, 103 bp, Artificial Sequence
  Synthetic Polynucleotide
taatacgactcactataggggaaatcttagactccgtgtgccttaagtataacagaggagaatacttatggcacacggaaacctggcggcagcgcaaaagatg

SEQ ID NO: 100998 - DNA, 103 bp, Artificial Sequence
  Synthetic Polynucleotide
taatacgactcactatagggatcacaatctgaaatcttagactccgtgtgaacagaggagacacacgatgtctaagattaacctggcggcagcgcaaaagatg

SEQ ID NO: 100999 - DNA, 103 bp, Artificial Sequence
  Synthetic Polynucleotide
taatacgactcactatagggcgtgggccccatcacaatctgaaatcttagaacagaggagactaagaatgcagattgtgaacctggcggcagcgcaaaagatg

SEQ ID NO: 101000 - DNA, 103 bp, Artificial Sequence
  Synthetic Polynucleotide
taatacgactcactatagggcagccaggtgcgtgggccccatcacaatctaacagaggagaagattgatgtggggcccaaacctggcggcagcgcaaaagatg

SEQ ID NO: 101001 - DNA, 103 bp, Artificial Sequence
  Synthetic Polynucleotide
taatacgactcactatagggttcttctaggcagccaggtgcgtgggccccaacagaggagaggggccatggcacctggcaacctggcggcagcgcaaaagatg

SEQ ID NO: 101002 - DNA, 103 bp, Artificial Sequence
  Synthetic Polynucleotide
taatacgactcactatagggggaaatagatgcggagctttaggttaaagtaacagaggagaactttaatgtaaagctccaacctggcggcagcgcaaaagatg

SEQ ID NO: 101003 - DNA, 103 bp, Artificial Sequence
  Synthetic Polynucleotide
taatacgactcactatagggtgaatgcaccttcttctaggcagccaggtgaacagaggagacacctgatggcctagaagaacctggcggcagcgcaaaagatg

SEQ ID NO: 101004 - DNA, 103 bp, Artificial Sequence
  Synthetic Polynucleotide
taatacgactcactatagggagcaggtttatgaatgcaccttcttctaggaacagaggagacctagaatgaggtgcattaacctggcggcagcgcaaaagatg

SEQ ID NO: 101005 - DNA, 103 bp, Artificial Sequence
  Synthetic Polynucleotide
taatacgactcactatagggcaaaggggcaagcaggtttatgaatgcaccaacagaggagaggtgcaatgataaacctgaacctggcggcagcgcaaaagatg

SEQ ID NO: 101006 - DNA, 103 bp, Artificial Sequence
  Synthetic Polynucleotide
taatacgactcactatagggtctcattgaacaaaggggcaagcaggtttaaacagaggagataaaccatgttgccccttaacctggcggcagcgcaaaagatg

SEQ ID NO: 101007 - DNA, 103 bp, Artificial Sequence
  Synthetic Polynucleotide
taatacgactcactatagggaatgtggccttctcattgaacaaaggggcaaacagaggagatgccccatggttcaatgaaacctggcggcagcgcaaaagatg

SEQ ID NO: 101008 - DNA, 103 bp, Artificial Sequence
  Synthetic Polynucleotide
taatacgactcactatagggttccagtaataatgtggccttctcattgaaaacagaggagattcaatatgaaggccacaaacctggcggcagcgcaaaagatg

SEQ ID NO: 101009 - DNA, 103 bp, Artificial Sequence
  Synthetic Polynucleotide
taatacgactcactatagggctggcctggattccagtaataatgtggcctaacagaggagaaggccaatgtattactggaacctggcggcagcgcaaaagatg

SEQ ID NO: 101010 - DNA, 103 bp, Artificial Sequence
  Synthetic Polynucleotide
taatacgactcactatagggttcagaaggtctggcctggattccagtaataacagaggagaattactatgatccaggccaacctggcggcagcgcaaaagatg

SEQ ID NO: 101011 - DNA, 103 bp, Artificial Sequence
  Synthetic Polynucleotide
taatacgactcactatagggccgtaccactttcagaaggtctggcctggaaacagaggagatccaggatggaccttctgaacctggcggcagcgcaaaagatg

SEQ ID NO: 101012 - DNA, 103 bp, Artificial Sequence
  Synthetic Polynucleotide
taatacgactcactataggggaagcagttcccgtaccactttcagaaggtaacagaggagaaccttcatgaagtggtacaacctggcggcagcgcaaaagatg

SEQ ID NO: 101013 - DNA, 103 bp, Artificial Sequence
  Synthetic Polynucleotide
taatacgactcactatagggctttcctcaaggaaatagatgcggagctttaacagaggagaaaagctatgcatctatttaacctggcggcagcgcaaaagatg

SEQ ID NO: 101014 - DNA, 103 bp, Artificial Sequence
  Synthetic Polynucleotide
taatacgactcactatagggagttgtcccagaagcagttcccgtaccactaacagaggagaagtggtatgggaactgctaacctggcggcagcgcaaaagatg

SEQ ID NO: 101015 - DNA, 103 bp, Artificial Sequence
  Synthetic Polynucleotide
taatacgactcactatagggtgtcaagaatagttgtcccagaagcagttcaacagaggagagaactgatgctgggacaaaacctggcggcagcgcaaaagatg

SEQ ID NO: 101016 - DNA, 103 bp, Artificial Sequence
  Synthetic Polynucleotide
taatacgactcactatagggcttcctgctctgtcaagaatagttgtcccaaacagaggagatgggacatgtattcttgaaacctggcggcagcgcaaaagatg

SEQ ID NO: 101017 - DNA, 103 bp, Artificial Sequence
  Synthetic Polynucleotide
taatacgactcactatagggtctccagaaacttcctgctctgtcaagaataacagaggagaattcttatgagagcaggaaacctggcggcagcgcaaaagatg

SEQ ID NO: 101018 - DNA, 103 bp, Artificial Sequence
  Synthetic Polynucleotide
taatacgactcactatagggatcaaggtgttctccagaaacttcctgctcaacagaggagagagcagatggtttctggaaacctggcggcagcgcaaaagatg

SEQ ID NO: 101019 - DNA, 103 bp, Artificial Sequence
  Synthetic Polynucleotide
taatacgactcactatagggcagttttaccatcaaggtgttctccagaaaaacagaggagatttctgatgaacaccttgaacctggcggcagcgcaaaagatg

SEQ ID NO: 101020 - DNA, 103 bp, Artificial Sequence
  Synthetic Polynucleotide
taatacgactcactatagggggtgtcttctcagttttaccatcaaggtgtaacagaggagaacacctatgtggtaaaacaacctggcggcagcgcaaaagatg

SEQ ID NO: 101021 - DNA, 103 bp, Artificial Sequence
  Synthetic Polynucleotide
taatacgactcactatagggtttttgcttaggtgtcttctcagttttaccaacagaggagaggtaaaatggagaagacaaacctggcggcagcgcaaaagatg

SEQ ID NO: 101022 - DNA, 103 bp, Artificial Sequence
  Synthetic Polynucleotide
taatacgactcactatagggcaagttcacctttttgcttaggtgtcttctaacagaggagaagaagaatgctaagcaaaaacctggcggcagcgcaaaagatg

SEQ ID NO: 101023 - DNA, 103 bp, Artificial Sequence
  Synthetic Polynucleotide
taatacgactcactatagggacaaaatgtacaagttcacctttttgcttaaacagaggagataagcaatgaggtgaactaacctggcggcagcgcaaaagatg

SEQ ID NO: 101024 - DNA, 103 bp, Artificial Sequence
  Synthetic Polynucleotide
taatacgactcactatagggctgttgcattctttcctcaaggaaatagataacagaggagaatctatatgcttgaggaaaacctggcggcagcgcaaaagatg

SEQ ID NO: 101025 - DNA, 103 bp, Artificial Sequence
  Synthetic Polynucleotide
taatacgactcactataggggttggtttggacaaaatgtacaagttcaccaacagaggagaggtgaaatggtacattttaacctggcggcagcgcaaaagatg

SEQ ID NO: 101026 - DNA, 103 bp, Artificial Sequence
  Synthetic Polynucleotide
taatacgactcactatagggtggaaaatgagttggtttggacaaaatgtaaacagaggagatacattatgtccaaaccaaacctggcggcagcgcaaaagatg

SEQ ID NO: 101027 - DNA, 103 bp, Artificial Sequence
  Synthetic Polynucleotide
taatacgactcactatagggtcatgtggcttggaaaatgagttggtttggaacagaggagaccaaacatgctcattttcaacctggcggcagcgcaaaagatg

SEQ ID NO: 101028 - DNA, 103 bp, Artificial Sequence
  Synthetic Polynucleotide
taatacgactcactatagggcttcagttcatcatgtggcttggaaaatgaaacagaggagatcatttatgaagccacataacctggcggcagcgcaaaagatg

SEQ ID NO: 101029 - DNA, 103 bp, Artificial Sequence
  Synthetic Polynucleotide
taatacgactcactatagggcacaagacaacttcagttcatcatgtggctaacagaggagaagccacatgatgaactgaaacctggcggcagcgcaaaagatg

SEQ ID NO: 101030 - DNA, 103 bp, Artificial Sequence
  Synthetic Polynucleotide
taatacgactcactatagggagctgggcctcacaagacaacttcagttcaaacagaggagatgaactatggttgtcttgaacctggcggcagcgcaaaagatg

SEQ ID NO: 101031 - DNA, 103 bp, Artificial Sequence
  Synthetic Polynucleotide
taatacgactcactatagggtgcctttactagctgggcctcacaagacaaaacagaggagattgtctatggaggcccagaacctggcggcagcgcaaaagatg

SEQ ID NO: 101032 - DNA, 103 bp, Artificial Sequence
  Synthetic Polynucleotide
taatacgactcactataggggcacttcgcctgcctttactagctgggcctaacagaggagaaggcccatgtagtaaaggaacctggcggcagcgcaaaagatg

SEQ ID NO: 101033 - DNA, 103 bp, Artificial Sequence
  Synthetic Polynucleotide
taatacgactcactatagggcctaccttgggcacttcgcctgcctttactaacagaggagaagtaaaatgaggcgaagtaacctggcggcagcgcaaaagatg

SEQ ID NO: 101034 - DNA, 103 bp, Artificial Sequence
  Synthetic Polynucleotide
taatacgactcactatagggatctttcagtcctaccttgggcacttcgccaacagaggagaggcgaaatgcccaaggtaaacctggcggcagcgcaaaagatg

SEQ ID NO: 101035 - DNA, 103 bp, Artificial Sequence
  Synthetic Polynucleotide
taatacgactcactatagggcatgaaattcctgttgcattctttcctcaaaacagaggagattgaggatggaatgcaacaacctggcggcagcgcaaaagatg

SEQ ID NO: 101036 - DNA, 103 bp, Artificial Sequence
  Synthetic Polynucleotide
taatacgactcactataggggcactgaggcatctttcagtcctaccttggaacagaggagaccaaggatggactgaaagaacctggcggcagcgcaaaagatg

SEQ ID NO: 101037 - DNA, 103 bp, Artificial Sequence
  Synthetic Polynucleotide
taatacgactcactataggggccacagtctgcactgaggcatctttcagtaacagaggagaactgaaatgtgcctcagtaacctggcggcagcgcaaaagatg

SEQ ID NO: 101038 - DNA, 103 bp, Artificial Sequence
  Synthetic Polynucleotide
taatacgactcactataggggccctccgtggccacagtctgcactgaggcaacagaggagagcctcaatgcagactgtgaacctggcggcagcgcaaaagatg

SEQ ID NO: 101039 - DNA, 103 bp, Artificial Sequence
  Synthetic Polynucleotide
taatacgactcactatagggtcagcaggtcgccctccgtggccacagtctaacagaggagaagactgatgccacggaggaacctggcggcagcgcaaaagatg

SEQ ID NO: 101040 - DNA, 103 bp, Artificial Sequence
  Synthetic Polynucleotide
taatacgactcactatagggtgcttgaatctcagcaggtcgccctccgtgaacagaggagacacggaatgcgacctgctaacctggcggcagcgcaaaagatg

SEQ ID NO: 101041 - DNA, 103 bp, Artificial Sequence
  Synthetic Polynucleotide
taatacgactcactatagggtgttgcttcatgcttgaatctcagcaggtcaacagaggagagacctgatgagattcaagaacctggcggcagcgcaaaagatg

SEQ ID NO: 101042 - DNA, 103 bp, Artificial Sequence
  Synthetic Polynucleotide
taatacgactcactatagggaagcctctcttgttgcttcatgcttgaatcaacagaggagagattcaatgatgaagcaaaacctggcggcagcgcaaaagatg

SEQ ID NO: 101043 - DNA, 103 bp, Artificial Sequence
  Synthetic Polynucleotide
taatacgactcactatagggttctcttcccaagcctctcttgttgcttcaaacagaggagatgaagcatgaagagaggcaacctggcggcagcgcaaaagatg

SEQ ID NO: 101044 - DNA, 103 bp, Artificial Sequence
  Synthetic Polynucleotide
taatacgactcactataggggttgatcggtttctcttcccaagcctctctaacagaggagaagagagatgtgggaagagaacctggcggcagcgcaaaagatg

SEQ ID NO: 101045 - DNA, 103 bp, Artificial Sequence
  Synthetic Polynucleotide
taatacgactcactatagggtgagtgcagtgttgatcggtttctcttcccaacagaggagagggaagatgaaccgatcaaacctggcggcagcgcaaaagatg

SEQ ID NO: 101046 - DNA, 103 bp, Artificial Sequence
  Synthetic Polynucleotide
taatacgactcactatagggtcagtggggccatgaaattcctgttgcattaacagaggagaaatgcaatgggaatttcaaacctggcggcagcgcaaaagatg

SEQ ID NO: 101047 - DNA, 103 bp, Artificial Sequence
  Synthetic Polynucleotide
taatacgactcactatagggtgctctgcgctgagtgcagtgttgatcggtaacagaggagaaccgatatgcactgcactaacctggcggcagcgcaaaagatg

SEQ ID NO: 101048 - DNA, 103 bp, Artificial Sequence
  Synthetic Polynucleotide
taatacgactcactatagggctctggccgatgctctgcgctgagtgcagtaacagaggagaactgcaatgagcgcagagaacctggcggcagcgcaaaagatg

SEQ ID NO: 101049 - DNA, 103 bp, Artificial Sequence
  Synthetic Polynucleotide
taatacgactcactatagggcgtgcaggttctctggccgatgctctgcgcaacagaggagagcgcagatgatcggccagaacctggcggcagcgcaaaagatg

SEQ ID NO: 101050 - DNA, 103 bp, Artificial Sequence
  Synthetic Polynucleotide
taatacgactcactatagggccaggcaccccgtgcaggttctctggccgaaacagaggagatcggccatggaacctgcaaacctggcggcagcgcaaaagatg

SEQ ID NO: 101051 - DNA, 103 bp, Artificial Sequence
  Synthetic Polynucleotide
taatacgactcactatagggagcctgccacccaggcaccccgtgcaggttaacagaggagaaacctgatgggggtgcctaacctggcggcagcgcaaaagatg

SEQ ID NO: 101052 - DNA, 103 bp, Artificial Sequence
  Synthetic Polynucleotide
taatacgactcactatagggaaaggagggcagcctgccacccaggcacccaacagaggagagggtgcatgggtggcaggaacctggcggcagcgcaaaagatg

SEQ ID NO: 101053 - DNA, 103 bp, Artificial Sequence
  Synthetic Polynucleotide
taatacgactcactatagggccagggagggaaaggagggcagcctgccacaacagaggagagtggcaatgtgccctcctaacctggcggcagcgcaaaagatg

SEQ ID NO: 101054 - DNA, 103 bp, Artificial Sequence
  Synthetic Polynucleotide
taatacgactcactataggggttggtaataccagggagggaaaggagggcaacagaggagagccctcatgtccctccctaacctggcggcagcgcaaaagatg

SEQ ID NO: 101055 - DNA, 103 bp, Artificial Sequence
  Synthetic Polynucleotide
taatacgactcactatagggtagcctctctgttggtaataccagggagggaacagaggagaccctccatggtattaccaaacctggcggcagcgcaaaagatg

SEQ ID NO: 101056 - DNA, 103 bp, Artificial Sequence
  Synthetic Polynucleotide
taatacgactcactatagggcgggacttcttagcctctctgttggtaataaacagaggagatattacatgcagagaggcaacctggcggcagcgcaaaagatg

SEQ ID NO: 101057 - DNA, 103 bp, Artificial Sequence
  Synthetic Polynucleotide
taatacgactcactataggggtagatatgttcagtggggccatgaaattcaacagaggagagaatttatgggccccactaacctggcggcagcgcaaaagatg

SEQ ID NO: 101058 - DNA, 103 bp, Artificial Sequence
  Synthetic Polynucleotide
taatacgactcactataggggattggcaagcgggacttcttagcctctctaacagaggagaagagagatgaagaagtccaacctggcggcagcgcaaaagatg

SEQ ID NO: 101059 - DNA, 103 bp, Artificial Sequence
  Synthetic Polynucleotide
taatacgactcactataggggttttattaggattggcaagcgggacttctaacagaggagaagaagtatggcttgccaaaacctggcggcagcgcaaaagatg

SEQ ID NO: 101060 - DNA, 103 bp, Artificial Sequence
  Synthetic Polynucleotide
taatacgactcactataggggaccgggatggttttattaggattggcaagaacagaggagacttgccatgcctaataaaaacctggcggcagcgcaaaagatg

SEQ ID NO: 101061 - DNA, 103 bp, Artificial Sequence
  Synthetic Polynucleotide
taatacgactcactatagggatttcctaatgaccgggatggttttattagaacagaggagactaataatgccatcccggaacctggcggcagcgcaaaagatg

SEQ ID NO: 101062 - DNA, 103 bp, Artificial Sequence
  Synthetic Polynucleotide
taatacgactcactataggggacgatacatatttcctaatgaccgggatgaacagaggagacatcccatgcattaggaaaacctggcggcagcgcaaaagatg

SEQ ID NO: 101063 - DNA, 103 bp, Artificial Sequence
  Synthetic Polynucleotide
taatacgactcactataggggtggcagggagacgatacatatttcctaataacagaggagaattaggatgtatgtatcgaacctggcggcagcgcaaaagatg

SEQ ID NO: 101064 - DNA, 103 bp, Artificial Sequence
  Synthetic Polynucleotide
taatacgactcactatagggcacctcctgggtggcagggagacgatacataacagaggagaatgtatatgctccctgccaacctggcggcagcgcaaaagatg

SEQ ID NO: 101065 - DNA, 103 bp, Artificial Sequence
  Synthetic Polynucleotide
taatacgactcactataggggctgcgtcaccacctcctgggtggcagggaaacagaggagatccctgatgcccaggaggaacctggcggcagcgcaaaagatg

SEQ ID NO: 101066 - DNA, 103 bp, Artificial Sequence
  Synthetic Polynucleotide
taatacgactcactatagggtggctctgcagctgcgtcaccacctcctggaacagaggagaccaggaatgggtgacgcaaacctggcggcagcgcaaaagatg

SEQ ID NO: 101067 - DNA, 103 bp, Artificial Sequence
  Synthetic Polynucleotide
taatacgactcactatagggctccaagatctggctctgcagctgcgtcacaacagaggagagtgacgatgctgcagagcaacctggcggcagcgcaaaagatg

SEQ ID NO: 101068 - DNA, 103 bp, Artificial Sequence
  Synthetic Polynucleotide
taatacgactcactatagggtgttagttttgtagatatgttcagtggggcaacagaggagagccccaatgaacatatctaacctggcggcagcgcaaaagatg

SEQ ID NO: 101069 - DNA, 103 bp, Artificial Sequence
  Synthetic Polynucleotide
taatacgactcactatagggccccctgcagctccaagatctggctctgcaaacagaggagatgcagaatgagatcttggaacctggcggcagcgcaaaagatg

SEQ ID NO: 101070 - DNA, 103 bp, Artificial Sequence
  Synthetic Polynucleotide
taatacgactcactatagggtccttcagctccccctgcagctccaagatcaacagaggagagatcttatggctgcagggaacctggcggcagcgcaaaagatg

SEQ ID NO: 101071 - DNA, 103 bp, Artificial Sequence
  Synthetic Polynucleotide
taatacgactcactatagggagttttaaactccttcagctccccctgcagaacagaggagactgcagatggagctgaagaacctggcggcagcgcaaaagatg

SEQ ID NO: 101072 - DNA, 103 bp, Artificial Sequence
  Synthetic Polynucleotide
taatacgactcactataggggcttattacaagttttaaactccttcagctaacagaggagaagctgaatgagtttaaaaaacctggcggcagcgcaaaagatg

SEQ ID NO: 101073 - DNA, 103 bp, Artificial Sequence
  Synthetic Polynucleotide
taatacgactcactatagggtggtgaagttgcttattacaagttttaaacaacagaggagagtttaaatgttgtaataaaacctggcggcagcgcaaaagatg

SEQ ID NO: 101074 - DNA, 103 bp, Artificial Sequence
  Synthetic Polynucleotide
taatacgactcactatagggaattaacttttggtgaagttgcttattacaaacagaggagatgtaatatgcaacttcacaacctggcggcagcgcaaaagatg

SEQ ID NO: 101075 - DNA, 103 bp, Artificial Sequence
  Synthetic Polynucleotide
taatacgactcactatagggcttcagccagaattaacttttggtgaagttaacagaggagaaacttcatgaaaagttaaaacctggcggcagcgcaaaagatg

SEQ ID NO: 101076 - DNA, 103 bp, Artificial Sequence
  Synthetic Polynucleotide
taatacgactcactatagggtccatcactgcttcagccagaattaactttaacagaggagaaaagttatgtctggctgaaacctggcggcagcgcaaaagatg

SEQ ID NO: 101077 - DNA, 103 bp, Artificial Sequence
  Synthetic Polynucleotide
taatacgactcactatagggtggcctcccctccatcactgcttcagccagaacagaggagactggctatggcagtgatgaacctggcggcagcgcaaaagatg

SEQ ID NO: 101078 - DNA, 103 bp, Artificial Sequence
  Synthetic Polynucleotide
taatacgactcactatagggtgtcgggcgttggcctcccctccatcactgaacagaggagacagtgaatgaggggaggcaacctggcggcagcgcaaaagatg

SEQ ID NO: 101079 - DNA, 103 bp, Artificial Sequence
  Synthetic Polynucleotide
taatacgactcactatagggctgagcgtcccagggacggtgacgtcctctaacagaggagaagaggaatgcaccgtcccaacctggcggcagcgcaaaagatg

SEQ ID NO: 101080 - DNA, 103 bp, Artificial Sequence
  Synthetic Polynucleotide
taatacgactcactatagggttgagctcaatgttagttttgtagatatgtaacagaggagaacatatatgcaaaactaaaacctggcggcagcgcaaaagatg

SEQ ID NO: 101081 - DNA, 103 bp, Artificial Sequence
  Synthetic Polynucleotide
taatacgactcactatagggagcaacgttttgtcgggcgttggcctccccaacagaggagaggggagatgaacgcccgaaacctggcggcagcgcaaaagatg

SEQ ID NO: 101082 - DNA, 103 bp, Artificial Sequence
  Synthetic Polynucleotide
taatacgactcactatagggctgagcattcagcaacgttttgtcgggcgtaacagaggagaacgcccatgaaaacgttgaacctggcggcagcgcaaaagatg

SEQ ID NO: 101083 - DNA, 103 bp, Artificial Sequence
  Synthetic Polynucleotide
taatacgactcactatagggccacagggggctgagcattcagcaacgtttaacagaggagaaaacgtatgtgaatgctcaacctggcggcagcgcaaaagatg

SEQ ID NO: 101084 - DNA, 103 bp, Artificial Sequence
  Synthetic Polynucleotide
taatacgactcactatagggtaggctgctcccacagggggctgagcattcaacagaggagagaatgcatggccccctgtaacctggcggcagcgcaaaagatg

SEQ ID NO: 101085 - DNA, 103 bp, Artificial Sequence
  Synthetic Polynucleotide
taatacgactcactataggggctgtcctggtaggctgctcccacagggggaacagaggagaccccctatgggagcagccaacctggcggcagcgcaaaagatg

SEQ ID NO: 101086 - DNA, 103 bp, Artificial Sequence
  Synthetic Polynucleotide
taatacgactcactataggggctctcctgggctgtcctggtaggctgctcaacagaggagagagcagatgaccaggacaaacctggcggcagcgcaaaagatg

SEQ ID NO: 101087 - DNA, 103 bp, Artificial Sequence
  Synthetic Polynucleotide
taatacgactcactatagggattcctttctgctctcctgggctgtcctggaacagaggagaccaggaatgcccaggagaaacctggcggcagcgcaaaagatg

SEQ ID NO: 101088 - DNA, 103 bp, Artificial Sequence
  Synthetic Polynucleotide
taatacgactcactatagggtgtggttttaattcctttctgctctcctggaacagaggagaccaggaatgcagaaaggaaacctggcggcagcgcaaaagatg

SEQ ID NO: 101089 - DNA, 103 bp, Artificial Sequence
  Synthetic Polynucleotide
taatacgactcactatagggagacagaagatgtggttttaattcctttctaacagaggagaagaaagatgttaaaaccaaacctggcggcagcgcaaaagatg

SEQ ID NO: 101090 - DNA, 103 bp, Artificial Sequence
  Synthetic Polynucleotide
taatacgactcactatagggttgtctctccagacagaagatgtggttttaaacagaggagataaaacatgatcttctgtaacctggcggcagcgcaaaagatg

SEQ ID NO: 101091 - DNA, 103 bp, Artificial Sequence
  Synthetic Polynucleotide
taatacgactcactatagggtacttccaccttgagctcaatgttagttttaacagaggagaaaaactatgattgagctcaacctggcggcagcgcaaaagatg

SEQ ID NO: 101092 - DNA, 103 bp, Artificial Sequence
  Synthetic Polynucleotide
taatacgactcactataggggtccatttccttgtctctccagacagaagaaacagaggagatcttctatgtggagagacaacctggcggcagcgcaaaagatg

SEQ ID NO: 101093 - DNA, 103 bp, Artificial Sequence
  Synthetic Polynucleotide
taatacgactcactataggggctgatcactgtccatttccttgtctctccaacagaggagaggagagatgaggaaatggaacctggcggcagcgcaaaagatg

SEQ ID NO: 101094 - DNA, 103 bp, Artificial Sequence
  Synthetic Polynucleotide
taatacgactcactatagggtagcttctttgctgatcactgtccatttccaacagaggagaggaaatatgcagtgatcaaacctggcggcagcgcaaaagatg

SEQ ID NO: 101095 - DNA, 103 bp, Artificial Sequence
  Synthetic Polynucleotide
taatacgactcactataggggtcaatctcgtagcttctttgctgatcactaacagaggagaagtgatatgcaaagaagcaacctggcggcagcgcaaaagatg

SEQ ID NO: 101096 - DNA, 103 bp, Artificial Sequence
  Synthetic Polynucleotide
taatacgactcactatagggaaatctcagagtcaatctcgtagcttctttaacagaggagaaaagaaatgacgagattgaacctggcggcagcgcaaaagatg

SEQ ID NO: 101097 - DNA, 103 bp, Artificial Sequence
  Synthetic Polynucleotide
taatacgactcactatagggtcaggtgggcaaatctcagagtcaatctcgaacagaggagacgagatatgctctgagataacctggcggcagcgcaaaagatg

SEQ ID NO: 101098 - DNA, 103 bp, Artificial Sequence
  Synthetic Polynucleotide
taatacgactcactatagggggcaaggtcatcaggtgggcaaatctcagaaacagaggagatctgagatgtgcccacctaacctggcggcagcgcaaaagatg

SEQ ID NO: 101099 - DNA, 103 bp, Artificial Sequence
  Synthetic Polynucleotide
taatacgactcactatagggatggcaagctggcaaggtcatcaggtgggcaacagaggagagcccacatgatgaccttgaacctggcggcagcgcaaaagatg

SEQ ID NO: 101100 - DNA, 103 bp, Artificial Sequence
  Synthetic Polynucleotide
taatacgactcactatagggtctttgcatgatggcaagctggcaaggtcaaacagaggagatgacctatgcagcttgccaacctggcggcagcgcaaaagatg

SEQ ID NO: 101101 - DNA, 103 bp, Artificial Sequence
  Synthetic Polynucleotide
taatacgactcactatagggttcaggattttctttgcatgatggcaagctaacagaggagaagcttgatgtcatgcaaaaacctggcggcagcgcaaaagatg

SEQ ID NO: 101102 - DNA, 103 bp, Artificial Sequence
  Synthetic Polynucleotide
taatacgactcactatagggtcagactttctacttccaccttgagctcaaaacagaggagattgagcatgaggtggaagaacctggcggcagcgcaaaagatg

SEQ ID NO: 101103 - DNA, 103 bp, Artificial Sequence
  Synthetic Polynucleotide
taatacgactcactatagggtcagaacatcttcaggattttctttgcatgaacagaggagacatgcaatgaaaatcctgaacctggcggcagcgcaaaagatg

SEQ ID NO: 101104 - DNA, 103 bp, Artificial Sequence
  Synthetic Polynucleotide
taatacgactcactataggggaagttgggctcagaacatcttcaggatttaacagaggagaaaatccatgagatgttctaacctggcggcagcgcaaaagatg

SEQ ID NO: 101105 - DNA, 103 bp, Artificial Sequence
  Synthetic Polynucleotide
taatacgactcactatagggagtagctactgaagttgggctcagaacatcaacagaggagagatgttatgagcccaactaacctggcggcagcgcaaaagatg

SEQ ID NO: 101106 - DNA, 103 bp, Artificial Sequence
  Synthetic Polynucleotide
taatacgactcactatagggaactcaggtaagtagctactgaagttgggcaacagaggagagcccaaatgcagtagctaaacctggcggcagcgcaaaagatg

SEQ ID NO: 101107 - DNA, 103 bp, Artificial Sequence
  Synthetic Polynucleotide
taatacgactcactatagggtgactcttggaactcaggtaagtagctactaacagaggagaagtagcatgttacctgagaacctggcggcagcgcaaaagatg

SEQ ID NO: 101108 - DNA, 103 bp, Artificial Sequence
  Synthetic Polynucleotide
taatacgactcactatagggagcagaaggctgactcttggaactcaggtaaacagaggagatacctgatgtccaagagtaacctggcggcagcgcaaaagatg

SEQ ID NO: 101109 - DNA, 103 bp, Artificial Sequence
  Synthetic Polynucleotide
taatacgactcactatagggcactgactttagcagaaggctgactcttggaacagaggagaccaagaatgagccttctgaacctggcggcagcgcaaaagatg

SEQ ID NO: 101110 - DNA, 103 bp, Artificial Sequence
  Synthetic Polynucleotide
taatacgactcactataggggtccccatcacactgactttagcagaaggcaacagaggagagccttcatgtaaagtcagaacctggcggcagcgcaaaagatg

SEQ ID NO: 101111 - DNA, 103 bp, Artificial Sequence
  Synthetic Polynucleotide
taatacgactcactatagggtgactgatcagtccccatcacactgactttaacagaggagaaaagtcatggtgatggggaacctggcggcagcgcaaaagatg

SEQ ID NO: 101112 - DNA, 103 bp, Artificial Sequence
  Synthetic Polynucleotide
taatacgactcactatagggtaatgctctctgactgatcagtccccatcaaacagaggagatgatggatgctgatcagtaacctggcggcagcgcaaaagatg

SEQ ID NO: 101113 - DNA, 103 bp, Artificial Sequence
  Synthetic Polynucleotide
taatacgactcactatagggagttcccgcttcagactttctacttccaccaacagaggagaggtggaatgagaaagtctaacctggcggcagcgcaaaagatg

SEQ ID NO: 101114 - DNA, 103 bp, Artificial Sequence
  Synthetic Polynucleotide
taatacgactcactatagggtttgaggtattaatgctctctgactgatcaaacagaggagatgatcaatgagagagcataacctggcggcagcgcaaaagatg

SEQ ID NO: 101115 - DNA, 103 bp, Artificial Sequence
  Synthetic Polynucleotide
taatacgactcactatagggttctgtctcatttgaggtattaatgctctcaacagaggagagagagcatgaatacctcaaacctggcggcagcgcaaaagatg

SEQ ID NO: 101116 - DNA, 103 bp, Artificial Sequence
  Synthetic Polynucleotide
taatacgactcactataggggttttaagtattctgtctcatttgaggtataacagaggagaatacctatgatgagacagaacctggcggcagcgcaaaagatg

SEQ ID NO: 101117 - DNA, 103 bp, Artificial Sequence
  Synthetic Polynucleotide
taatacgactcactatagggtggattttctgttttaagtattctgtctcaaacagaggagatgagacatgatacttaaaaacctggcggcagcgcaaaagatg

SEQ ID NO: 101118 - DNA, 103 bp, Artificial Sequence
  Synthetic Polynucleotide
taatacgactcactatagggttccaagtcatggattttctgttttaagtaaacagaggagatacttaatgcagaaaatcaacctggcggcagcgcaaaagatg

SEQ ID NO: 101119 - DNA, 103 bp, Artificial Sequence
  Synthetic Polynucleotide
taatacgactcactatagggccagctcagtttccaagtcatggattttctaacagaggagaagaaaaatgatgacttggaacctggcggcagcgcaaaagatg

SEQ ID NO: 101120 - DNA, 103 bp, Artificial Sequence
  Synthetic Polynucleotide
taatacgactcactatagggtggtagccttccagctcagtttccaagtcaaacagaggagatgacttatgaactgagctaacctggcggcagcgcaaaagatg

SEQ ID NO: 101121 - DNA, 103 bp, Artificial Sequence
  Synthetic Polynucleotide
taatacgactcactatagggtatgaaattctggtagccttccagctcagtaacagaggagaactgagatggaaggctacaacctggcggcagcgcaaaagatg

SEQ ID NO: 101122 - DNA, 103 bp, Artificial Sequence
  Synthetic Polynucleotide
taatacgactcactataggggaagctgaaatatgaaattctggtagccttaacagaggagaaaggctatgagaatttcaaacctggcggcagcgcaaaagatg

SEQ ID NO: 101123 - DNA, 103 bp, Artificial Sequence
  Synthetic Polynucleotide
taatacgactcactataggggagtgcttttgaagctgaaatatgaaattcaacagaggagagaatttatgatttcagctaacctggcggcagcgcaaaagatg

SEQ ID NO: 101124 - DNA, 103 bp, Artificial Sequence
  Synthetic Polynucleotide
taatacgactcactatagggtctctcctggagttcccgcttcagactttcaacagaggagagaaagtatgaagcgggaaaacctggcggcagcgcaaaagatg

SEQ ID NO: 101125 - DNA, 103 bp, Artificial Sequence
  Synthetic Polynucleotide
taatacgactcactatagggactgcactgggagtgcttttgaagctgaaaaacagaggagatttcagatgcaaaagcacaacctggcggcagcgcaaaagatg

SEQ ID NO: 101126 - DNA, 103 bp, Artificial Sequence
  Synthetic Polynucleotide
taatacgactcactatagggttatggcctcactgcactgggagtgcttttaacagaggagaaaaagcatgcccagtgcaaacctggcggcagcgcaaaagatg

SEQ ID NO: 101127 - DNA, 103 bp, Artificial Sequence
  Synthetic Polynucleotide
taatacgactcactatagggaaaactgtaattatggcctcactgcactggaacagaggagaccagtgatgtgaggccataacctggcggcagcgcaaaagatg

SEQ ID NO: 101128 - DNA, 103 bp, Artificial Sequence
  Synthetic Polynucleotide
taatacgactcactatagggtgtcccacacaaaactgtaattatggcctcaacagaggagagaggccatgattacagttaacctggcggcagcgcaaaagatg

SEQ ID NO: 101129 - DNA, 103 bp, Artificial Sequence
  Synthetic Polynucleotide
taatacgactcactataggggggccccttctgtcccacacaaaactgtaaaacagaggagattacagatgtgtgtgggaaacctggcggcagcgcaaaagatg

SEQ ID NO: 101130 - DNA, 103 bp, Artificial Sequence
  Synthetic Polynucleotide
taatacgactcactatagggaagccatcctgggccccttctgtcccacacaacagaggagagtgtggatgagaaggggcaacctggcggcagcgcaaaagatg

SEQ ID NO: 101131 - DNA, 103 bp, Artificial Sequence
  Synthetic Polynucleotide
taatacgactcactataggggggcttgctcaagccatcctgggccccttcaacagaggagagaagggatgcaggatggcaacctggcggcagcgcaaaagatg

SEQ ID NO: 101132 - DNA, 103 bp, Artificial Sequence
  Synthetic Polynucleotide
taatacgactcactatagggaaccattcttgggcttgctcaagccatcctaacagaggagaaggatgatgtgagcaagcaacctggcggcagcgcaaaagatg

SEQ ID NO: 101133 - DNA, 103 bp, Artificial Sequence
  Synthetic Polynucleotide
taatacgactcactatagggtccccatcagaaccattcttgggcttgctcaacagaggagagagcaaatgcaagaatggaacctggcggcagcgcaaaagatg

SEQ ID NO: 101134 - DNA, 103 bp, Artificial Sequence
  Synthetic Polynucleotide
taatacgactcactatagggggtcatttcttccccatcagaaccattcttaacagaggagaaagaatatgtctgatgggaacctggcggcagcgcaaaagatg

SEQ ID NO: 101135 - DNA, 103 bp, Artificial Sequence
  Synthetic Polynucleotide
taatacgactcactataggggcagctgctctctctcctggagttcccgctaacagaggagaagcgggatgtccaggagaaacctggcggcagcgcaaaagatg

SEQ ID NO: 101136 - DNA, 103 bp, Artificial Sequence
  Synthetic Polynucleotide
taatacgactcactatagggaacttgaaaaggtcatttcttccccatcagaacagaggagactgatgatgaagaaatgaaacctggcggcagcgcaaaagatg

SEQ ID NO: 101137 - DNA, 103 bp, Artificial Sequence
  Synthetic Polynucleotide
taatacgactcactatagggacttggtgcaaacttgaaaaggtcatttctaacagaggagaagaaatatgcttttcaagaacctggcggcagcgcaaaagatg

SEQ ID NO: 101138 - DNA, 103 bp, Artificial Sequence
  Synthetic Polynucleotide
taatacgactcactatagggcacgtatcgcacttggtgcaaacttgaaaaaacagaggagattttcaatgttgcaccaaaacctggcggcagcgcaaaagatg

SEQ ID NO: 101139 - DNA, 103 bp, Artificial Sequence
  Synthetic Polynucleotide
taatacgactcactatagggtcacgtgtttcacgtatcgcacttggtgcaaacagaggagatgcaccatgtgcgatacgaacctggcggcagcgcaaaagatg

SEQ ID NO: 101140 - DNA, 103 bp, Artificial Sequence
  Synthetic Polynucleotide
taatacgactcactatagggccgaggattttcacgtgtttcacgtatcgcaacagaggagagcgataatggaaacacgtaacctggcggcagcgcaaaagatg

SEQ ID NO: 101141 - DNA, 103 bp, Artificial Sequence
  Synthetic Polynucleotide
taatacgactcactatagggggccagcggaccgaggattttcacgtgtttaacagaggagaaaacacatgaaaatcctcaacctggcggcagcgcaaaagatg

SEQ ID NO: 101142 - DNA, 103 bp, Artificial Sequence
  Synthetic Polynucleotide
taatacgactcactatagggtcatctctggggccagcggaccgaggatttaacagaggagaaaatccatggtccgctggaacctggcggcagcgcaaaagatg

SEQ ID NO: 101143 - DNA, 103 bp, Artificial Sequence
  Synthetic Polynucleotide
taatacgactcactatagggctgctgtcaatcatctctggggccagcggaaacagaggagatccgctatgcccagagataacctggcggcagcgcaaaagatg

SEQ ID NO: 101144 - DNA, 103 bp, Artificial Sequence
  Synthetic Polynucleotide
taatacgactcactatagggctccagcaccctgctgtcaatcatctctggaacagaggagaccagagatgattgacagcaacctggcggcagcgcaaaagatg

SEQ ID NO: 101145 - DNA, 103 bp, Artificial Sequence
  Synthetic Polynucleotide
taatacgactcactataggggtttgaggttctccagcaccctgctgtcaaaacagaggagattgacaatggggtgctggaacctggcggcagcgcaaaagatg

SEQ ID NO: 101146 - DNA, 103 bp, Artificial Sequence
  Synthetic Polynucleotide
taatacgactcactataggggctttgatgagcagctgctctctctcctggaacagaggagaccaggaatgagagcagctaacctggcggcagcgcaaaagatg

SEQ ID NO: 101147 - DNA, 103 bp, Artificial Sequence
  Synthetic Polynucleotide
taatacgactcactatagggtccagctgctgtttgaggttctccagcaccaacagaggagaggtgctatggaacctcaaaacctggcggcagcgcaaaagatg

SEQ ID NO: 101148 - DNA, 103 bp, Artificial Sequence
  Synthetic Polynucleotide
taatacgactcactatagggttcctgttcctccagctgctgtttgaggttaacagaggagaaacctcatgcagcagctgaacctggcggcagcgcaaaagatg

SEQ ID NO: 101149 - DNA, 103 bp, Artificial Sequence
  Synthetic Polynucleotide
taatacgactcactataggggcagcttgtattcctgttcctccagctgctaacagaggagaagcagcatgaggaacaggaacctggcggcagcgcaaaagatg

SEQ ID NO: 101150 - DNA, 103 bp, Artificial Sequence
  Synthetic Polynucleotide
taatacgactcactatagggtgctccttctgcagcttgtattcctgttccaacagaggagaggaacaatgatacaagctaacctggcggcagcgcaaaagatg

SEQ ID NO: 101151 - DNA, 103 bp, Artificial Sequence
  Synthetic Polynucleotide
taatacgactcactataggggttcaaattctgctccttctgcagcttgtaaacagaggagatacaagatgcagaaggagaacctggcggcagcgcaaaagatg

SEQ ID NO: 101152 - DNA, 103 bp, Artificial Sequence
  Synthetic Polynucleotide
taatacgactcactatagggaaagttgcatgttcaaattctgctccttctaacagaggagaagaaggatgagaatttgaaacctggcggcagcgcaaaagatg

SEQ ID NO: 101153 - DNA, 103 bp, Artificial Sequence
  Synthetic Polynucleotide
taatacgactcactatagggatctcactgaaaagttgcatgttcaaattcaacagaggagagaatttatgcatgcaactaacctggcggcagcgcaaaagatg

SEQ ID NO: 101154 - DNA, 103 bp, Artificial Sequence
  Synthetic Polynucleotide
taatacgactcactatagggcagattatggatctcactgaaaagttgcataacagaggagaatgcaaatgttcagtgagaacctggcggcagcgcaaaagatg

SEQ ID NO: 101155 - DNA, 103 bp, Artificial Sequence
  Synthetic Polynucleotide
taatacgactcactatagggacttattctgcagattatggatctcactgaaacagaggagatcagtgatgtccataatcaacctggcggcagcgcaaaagatg

SEQ ID NO: 101156 - DNA, 103 bp, Artificial Sequence
  Synthetic Polynucleotide
taatacgactcactatagggagatctctgaacttattctgcagattatggaacagaggagaccataaatggcagaataaaacctggcggcagcgcaaaagatg

SEQ ID NO: 101157 - DNA, 103 bp, Artificial Sequence
  Synthetic Polynucleotide
taatacgactcactatagggtgctttggaggctttgatgagcagctgctcaacagaggagagagcagatgctcatcaaaaacctggcggcagcgcaaaagatg

SEQ ID NO: 101158 - DNA, 103 bp, Artificial Sequence
  Synthetic Polynucleotide
taatacgactcactataggggggaggtgagagatctctgaacttattctgaacagaggagacagaatatgttcagagataacctggcggcagcgcaaaagatg

SEQ ID NO: 101159 - DNA, 103 bp, Artificial Sequence
  Synthetic Polynucleotide
taatacgactcactatagggaatcgtatctgggaggtgagagatctctgaaacagaggagatcagagatgtctcacctcaacctggcggcagcgcaaaagatg

SEQ ID NO: 101160 - DNA, 103 bp, Artificial Sequence
  Synthetic Polynucleotide
taatacgactcactatagggtgaactaatgaatcgtatctgggaggtgagaacagaggagactcaccatgcagatacgaaacctggcggcagcgcaaaagatg

SEQ ID NO: 101161 - DNA, 103 bp, Artificial Sequence
  Synthetic Polynucleotide
taatacgactcactatagggggcttgggactgaactaatgaatcgtatctaacagaggagaagatacatgtcattagttaacctggcggcagcgcaaaagatg

SEQ ID NO: 101162 - DNA, 103 bp, Artificial Sequence
  Synthetic Polynucleotide
taatacgactcactatagggagagctccctggcttgggactgaactaatgaacagaggagacattagatgagtcccaagaacctggcggcagcgcaaaagatg

SEQ ID NO: 101163 - DNA, 103 bp, Artificial Sequence
  Synthetic Polynucleotide
taatacgactcactatagggcgttgaagggagagctccctggcttgggacaacagaggagagtcccaatgcagggagctaacctggcggcagcgcaaaagatg

SEQ ID NO: 101164 - DNA, 103 bp, Artificial Sequence
  Synthetic Polynucleotide
taatacgactcactatagggaatctgctgccgttgaagggagagctccctaacagaggagaagggagatgtcccttcaaaacctggcggcagcgcaaaagatg

SEQ ID NO: 101165 - DNA, 103 bp, Artificial Sequence
  Synthetic Polynucleotide
taatacgactcactatagggggccatccttaatctgctgccgttgaagggaacagaggagacccttcatgggcagcagaaacctggcggcagcgcaaaagatg

SEQ ID NO: 101166 - DNA, 103 bp, Artificial Sequence
  Synthetic Polynucleotide
taatacgactcactatagggcagatgccatggccatccttaatctgctgcaacagaggagagcagcaatgtaaggatggaacctggcggcagcgcaaaagatg

SEQ ID NO: 101167 - DNA, 103 bp, Artificial Sequence
  Synthetic Polynucleotide
taatacgactcactatagggggagatgacacagatgccatggccatccttaacagaggagaaaggatatgcatggcatcaacctggcggcagcgcaaaagatg

SEQ ID NO: 101168 - DNA, 103 bp, Artificial Sequence
  Synthetic Polynucleotide
taatacgactcactatagggagctctcaactgctttggaggctttgatgaaacagaggagatcatcaatgcctccaaagaacctggcggcagcgcaaaagatg

SEQ ID NO: 101169 - DNA, 103 bp, Artificial Sequence
  Synthetic Polynucleotide
taatacgactcactatagggtgtgttgacgggagatgacacagatgccataacagaggagaatggcaatggtgtcatctaacctggcggcagcgcaaaagatg

SEQ ID NO: 101170 - DNA, 103 bp, Artificial Sequence
  Synthetic Polynucleotide
taatacgactcactatagggatggtgttcatgtgttgacgggagatgacaaacagaggagatgtcatatgccgtcaacaaacctggcggcagcgcaaaagatg

SEQ ID NO: 101171 - DNA, 103 bp, Artificial Sequence
  Synthetic Polynucleotide
taatacgactcactatagggtgccttaatcatggtgttcatgtgttgacgaacagaggagacgtcaaatgatgaacaccaacctggcggcagcgcaaaagatg

SEQ ID NO: 101172 - DNA, 103 bp, Artificial Sequence
  Synthetic Polynucleotide
taatacgactcactatagggactcctcaaatgccttaatcatggtgttcaaacagaggagatgaacaatgtgattaaggaacctggcggcagcgcaaaagatg

SEQ ID NO: 101173 - DNA, 103 bp, Artificial Sequence
  Synthetic Polynucleotide
taatacgactcactataggggcctgcagcaactcctcaaatgccttaatcaacagaggagagattaaatgatttgaggaaacctggcggcagcgcaaaagatg

SEQ ID NO: 101174 - DNA, 103 bp, Artificial Sequence
  Synthetic Polynucleotide
taatacgactcactatagggcacatcactggcctgcagcaactcctcaaaaacagaggagatttgagatgttgctgcagaacctggcggcagcgcaaaagatg

SEQ ID NO: 101175 - DNA, 103 bp, Artificial Sequence
  Synthetic Polynucleotide
taatacgactcactatagggcacagtaatccacatcactggcctgcagcaaacagaggagatgctgcatgccagtgatgaacctggcggcagcgcaaaagatg

SEQ ID NO: 101176 - DNA, 103 bp, Artificial Sequence
  Synthetic Polynucleotide
taatacgactcactatagggccctcggccacacagtaatccacatcactgaacagaggagacagtgaatgggattactgaacctggcggcagcgcaaaagatg

SEQ ID NO: 101177 - DNA, 103 bp, Artificial Sequence
  Synthetic Polynucleotide
taatacgactcactatagggttcctggaaaccctcggccacacagtaatcaacagaggagagattacatggtggccgagaacctggcggcagcgcaaaagatg

SEQ ID NO: 101178 - DNA, 103 bp, Artificial Sequence
  Synthetic Polynucleotide
taatacgactcactataggggattcagctgttcctggaaaccctcggccaaacagaggagatggccgatggtttccaggaacctggcggcagcgcaaaagatg

SEQ ID NO: 101179 - DNA, 103 bp, Artificial Sequence
  Synthetic Polynucleotide
taatacgactcactataggggcttcagctaagctctcaactgctttggagaacagaggagactccaaatgagttgagagaacctggcggcagcgcaaaagatg

SEQ ID NO: 101180 - DNA, 103 bp, Artificial Sequence
  Synthetic Polynucleotide
taatacgactcactatagggtcagcacattgattcagctgttcctggaaaaacagaggagatttccaatgacagctgaaaacctggcggcagcgcaaaagatg

SEQ ID NO: 101181 - DNA, 103 bp, Artificial Sequence
  Synthetic Polynucleotide
taatacgactcactatagggctccagcagctcagcacattgattcagctgaacagaggagacagctgatgcaatgtgctaacctggcggcagcgcaaaagatg

SEQ ID NO: 101182 - DNA, 103 bp, Artificial Sequence
  Synthetic Polynucleotide
taatacgactcactatagggtttccaatttctccagcagctcagcacattaacagaggagaaatgtgatgagctgctggaacctggcggcagcgcaaaagatg

SEQ ID NO: 101183 - DNA, 103 bp, Artificial Sequence
  Synthetic Polynucleotide
taatacgactcactatagggagaaatagcttttccaatttctccagcagcaacagaggagagctgctatggaaattggaaacctggcggcagcgcaaaagatg

SEQ ID NO: 101184 - DNA, 103 bp, Artificial Sequence
  Synthetic Polynucleotide
taatacgactcactatagggttttccgttgagaaatagcttttccaatttaacagaggagaaaattgatgaagctatttaacctggcggcagcgcaaaagatg

SEQ ID NO: 101185 - DNA, 103 bp, Artificial Sequence
  Synthetic Polynucleotide
taatacgactcactatagggctccaactgattttccgttgagaaatagctaacagaggagaagctatatgtcaacggaaaacctggcggcagcgcaaaagatg

SEQ ID NO: 101186 - DNA, 103 bp, Artificial Sequence
  Synthetic Polynucleotide
taatacgactcactatagggttcatttccactccaactgattttccgttgaacagaggagacaacggatgatcagttggaacctggcggcagcgcaaaagatg

SEQ ID NO: 101187 - DNA, 103 bp, Artificial Sequence
  Synthetic Polynucleotide
taatacgactcactatagggattctgggtgttcatttccactccaactgaaacagaggagatcagttatggtggaaatgaacctggcggcagcgcaaaagatg

SEQ ID NO: 101188 - DNA, 103 bp, Artificial Sequence
  Synthetic Polynucleotide
taatacgactcactatagggccatcagttcattctgggtgttcatttccaaacagaggagatggaaaatgacacccagaaacctggcggcagcgcaaaagatg

SEQ ID NO: 101189 - DNA, 103 bp, Artificial Sequence
  Synthetic Polynucleotide
taatacgactcactatagggtcaatcctctccatcagttcattctgggtgaacagaggagacacccaatgtgaactgataacctggcggcagcgcaaaagatg

SEQ ID NO: 101190 - DNA, 103 bp, Artificial Sequence
  Synthetic Polynucleotide
taatacgactcactatagggactgcagccgctgagcgtcccagggacggtaacagaggagaaccgtcatggggacgctcaacctggcggcagcgcaaaagatg

SEQ ID NO: 101191 - DNA, 103 bp, Artificial Sequence
  Synthetic Polynucleotide
taatacgactcactatagggagagccacctgcttcagctaagctctcaacaacagaggagagttgagatgttagctgaaaacctggcggcagcgcaaaagatg

SEQ ID NO: 101192 - DNA, 103 bp, Artificial Sequence
  Synthetic Polynucleotide
taatacgactcactataggggttgtcttcctcaatcctctccatcagttcaacagaggagagaactgatggagaggattaacctggcggcagcgcaaaagatg

SEQ ID NO: 101193 - DNA, 103 bp, Artificial Sequence
  Synthetic Polynucleotide
taatacgactcactatagggggtaggttaagttgtcttcctcaatcctctaacagaggagaagaggaatgaggaagacaaacctggcggcagcgcaaaagatg

SEQ ID NO: 101194 - DNA, 103 bp, Artificial Sequence
  Synthetic Polynucleotide
taatacgactcactatagggagaagatgttggtaggttaagttgtcttccaacagaggagaggaagaatgcttaacctaaacctggcggcagcgcaaaagatg

SEQ ID NO: 101195 - DNA, 103 bp, Artificial Sequence
  Synthetic Polynucleotide
taatacgactcactatagggagattcaggcagaagatgttggtaggttaaaacagaggagattaaccatgcaacatcttaacctggcggcagcgcaaaagatg

SEQ ID NO: 101196 - DNA, 103 bp, Artificial Sequence
  Synthetic Polynucleotide
taatacgactcactatagggaaggctcaggagattcaggcagaagatgttaacagaggagaaacatcatgtgcctgaataacctggcggcagcgcaaaagatg

SEQ ID NO: 101197 - DNA, 103 bp, Artificial Sequence
  Synthetic Polynucleotide
taatacgactcactatagggtgagaggctgaaggctcaggagattcaggcaacagaggagagcctgaatgtcctgagccaacctggcggcagcgcaaaagatg

SEQ ID NO: 101198 - DNA, 103 bp, Artificial Sequence
  Synthetic Polynucleotide
taatacgactcactatagggagagagcgcatgagaggctgaaggctcaggaacagaggagacctgagatgtcagcctctaacctggcggcagcgcaaaagatg

SEQ ID NO: 101199 - DNA, 103 bp, Artificial Sequence
  Synthetic Polynucleotide
taatacgactcactatagggtttcataatcagagagcgcatgagaggctgaacagaggagacagcctatgatgcgctctaacctggcggcagcgcaaaagatg

SEQ ID NO: 101200 - DNA, 103 bp, Artificial Sequence
  Synthetic Polynucleotide
taatacgactcactatagggttttcagatgtttcataatcagagagcgcaaacagaggagatgcgctatgtgattatgaaacctggcggcagcgcaaaagatg

SEQ ID NO: 101201 - DNA, 103 bp, Artificial Sequence
  Synthetic Polynucleotide
taatacgactcactataggggaagaaggacttttcagatgtttcataatcaacagaggagagattatatgacatctgaaaacctggcggcagcgcaaaagatg

SEQ ID NO: 101202 - DNA, 103 bp, Artificial Sequence
  Synthetic Polynucleotide
taatacgactcactataggggctggatttcagagccacctgcttcagctaaacagaggagatagctgatgcaggtggctaacctggcggcagcgcaaaagatg

SEQ ID NO: 101203 - DNA, 103 bp, Artificial Sequence
  Synthetic Polynucleotide
taatacgactcactatagggggtctcgtgagaagaaggacttttcagatgaacagaggagacatctgatgagtccttctaacctggcggcagcgcaaaagatg

SEQ ID NO: 101204 - DNA, 103 bp, Artificial Sequence
  Synthetic Polynucleotide
taatacgactcactatagggtcttgcttctggtctcgtgagaagaaggacaacagaggagagtccttatgctcacgagaaacctggcggcagcgcaaaagatg

SEQ ID NO: 101205 - DNA, 103 bp, Artificial Sequence
  Synthetic Polynucleotide
taatacgactcactatagggtgtctcattatcttgcttctggtctcgtgaaacagaggagatcacgaatgcagaagcaaaacctggcggcagcgcaaaagatg

SEQ ID NO: 101206 - DNA, 103 bp, Artificial Sequence
  Synthetic Polynucleotide
taatacgactcactatagggaagtcttctctgtctcattatcttgcttctaacagaggagaagaagcatgataatgagaaacctggcggcagcgcaaaagatg

SEQ ID NO: 101207 - DNA, 103 bp, Artificial Sequence
  Synthetic Polynucleotide
taatacgactcactatagggaccataactgaagtcttctctgtctcattaaacagaggagataatgaatgagagaagacaacctggcggcagcgcaaaagatg

SEQ ID NO: 101208 - DNA, 103 bp, Artificial Sequence
  Synthetic Polynucleotide
taatacgactcactatagggaaaactgttcaccataactgaagtcttctcaacagaggagagagaagatgtcagttatgaacctggcggcagcgcaaaagatg

SEQ ID NO: 101209 - DNA, 103 bp, Artificial Sequence
  Synthetic Polynucleotide
taatacgactcactatagggagtcttgagaaaaactgttcaccataactgaacagaggagacagttaatgtgaacagttaacctggcggcagcgcaaaagatg

SEQ ID NO: 101210 - DNA, 103 bp, Artificial Sequence
  Synthetic Polynucleotide
taatacgactcactatagggtccattagtaagtcttgagaaaaactgttcaacagaggagagaacagatgttctcaagaaacctggcggcagcgcaaaagatg

SEQ ID NO: 101211 - DNA, 103 bp, Artificial Sequence
  Synthetic Polynucleotide
taatacgactcactatagggctgtatgtgttccattagtaagtcttgagaaacagaggagatctcaaatgttactaatgaacctggcggcagcgcaaaagatg

SEQ ID NO: 101212 - DNA, 103 bp, Artificial Sequence
  Synthetic Polynucleotide
taatacgactcactatagggttcgaatttcctgtatgtgttccattagtaaacagaggagatactaaatgaacacatacaacctggcggcagcgcaaaagatg

SEQ ID NO: 101213 - DNA, 103 bp, Artificial Sequence
  Synthetic Polynucleotide
taatacgactcactatagggtctttcacccgctggatttcagagccacctaacagaggagaaggtggatgtgaaatccaaacctggcggcagcgcaaaagatg

SEQ ID NO: 101214 - DNA, 103 bp, Artificial Sequence
  Synthetic Polynucleotide
taatacgactcactatagggtttctcaaagttcgaatttcctgtatgtgtaacagaggagaacacatatgggaaattcgaacctggcggcagcgcaaaagatg

SEQ ID NO: 101215 - DNA, 103 bp, Artificial Sequence
  Synthetic Polynucleotide
taatacgactcactatagggttctaaacgctttctcaaagttcgaatttcaacagaggagagaaattatgactttgagaaacctggcggcagcgcaaaagatg

SEQ ID NO: 101216 - DNA, 103 bp, Artificial Sequence
  Synthetic Polynucleotide
taatacgactcactatagggtaatagattcttctaaacgctttctcaaagaacagaggagactttgaatgagcgtttagaacctggcggcagcgcaaaagatg

SEQ ID NO: 101217 - DNA, 103 bp, Artificial Sequence
  Synthetic Polynucleotide
taatacgactcactatagggtcatttgttttaatagattcttctaaacgcaacagaggagagcgtttatgagaatctataacctggcggcagcgcaaaagatg

SEQ ID NO: 101218 - DNA, 103 bp, Artificial Sequence
  Synthetic Polynucleotide
taatacgactcactatagggccgtagcttctcatttgttttaatagattcaacagaggagagaatctatgaaaacaaataacctggcggcagcgcaaaagatg

SEQ ID NO: 101219 - DNA, 103 bp, Artificial Sequence
  Synthetic Polynucleotide
taatacgactcactatagggccaactgtttccgtagcttctcatttgtttaacagaggagaaaacaaatgagaagctacaacctggcggcagcgcaaaagatg

SEQ ID NO: 101220 - DNA, 103 bp, Artificial Sequence
  Synthetic Polynucleotide
taatacgactcactatagggccttgccgttccaactgtttccgtagcttcaacagaggagagaagctatggaaacagttaacctggcggcagcgcaaaagatg

SEQ ID NO: 101221 - DNA, 103 bp, Artificial Sequence
  Synthetic Polynucleotide
taatacgactcactatagggaaattcagatccttgccgttccaactgtttaacagaggagaaaacagatggaacggcaaaacctggcggcagcgcaaaagatg

SEQ ID NO: 101222 - DNA, 103 bp, Artificial Sequence
  Synthetic Polynucleotide
taatacgactcactatagggaaccttgaacaaattcagatccttgccgttaacagaggagaaacggcatggatctgaataacctggcggcagcgcaaaagatg

SEQ ID NO: 101223 - DNA, 103 bp, Artificial Sequence
  Synthetic Polynucleotide
taatacgactcactatagggatgcttgtagaaccttgaacaaattcagataacagaggagaatctgaatgtgttcaaggaacctggcggcagcgcaaaagatg

SEQ ID NO: 101224 - DNA, 103 bp, Artificial Sequence
  Synthetic Polynucleotide
taatacgactcactatagggtcgagcatcttctttcacccgctggatttcaacagaggagagaaatcatgcgggtgaaaaacctggcggcagcgcaaaagatg

SEQ ID NO: 101225 - DNA, 103 bp, Artificial Sequence
  Synthetic Polynucleotide
taatacgactcactatagggagaagcaaaaatgcttgtagaaccttgaacaacagaggagagttcaaatgtctacaagcaacctggcggcagcgcaaaagatg

SEQ ID NO: 101226 - DNA, 103 bp, Artificial Sequence
  Synthetic Polynucleotide
taatacgactcactataggggctctgaaccagaagcaaaaatgcttgtagaacagaggagactacaaatgtttttgcttaacctggcggcagcgcaaaagatg

SEQ ID NO: 101227 - DNA, 103 bp, Artificial Sequence
  Synthetic Polynucleotide
taatacgactcactataggggaactatgaagctctgaaccagaagcaaaaaacagaggagattttgcatgtggttcagaaacctggcggcagcgcaaaagatg

SEQ ID NO: 101228 - DNA, 103 bp, Artificial Sequence
  Synthetic Polynucleotide
taatacgactcactatagggtgatgttagagaactatgaagctctgaaccaacagaggagaggttcaatgcttcatagtaacctggcggcagcgcaaaagatg

SEQ ID NO: 101229 - DNA, 103 bp, Artificial Sequence
  Synthetic Polynucleotide
taatacgactcactatagggaatgaatttctgatgttagagaactatgaaaacagaggagattcataatgctctaacataacctggcggcagcgcaaaagatg

SEQ ID NO: 101230 - DNA, 103 bp, Artificial Sequence
  Synthetic Polynucleotide
taatacgactcactatagggttcctcaagaaatgaatttctgatgttagaaacagaggagatctaacatgagaaattcaaacctggcggcagcgcaaaagatg

SEQ ID NO: 101231 - DNA, 103 bp, Artificial Sequence
  Synthetic Polynucleotide
taatacgactcactatagggctggttctgcttcctcaagaaatgaatttcaacagaggagagaaattatgttcttgaggaacctggcggcagcgcaaaagatg

SEQ ID NO: 101232 - DNA, 103 bp, Artificial Sequence
  Synthetic Polynucleotide
taatacgactcactatagggcattgagggcctggttctgcttcctcaagaaacagaggagatcttgaatgagcagaaccaacctggcggcagcgcaaaagatg

SEQ ID NO: 101233 - DNA, 103 bp, Artificial Sequence
  Synthetic Polynucleotide
taatacgactcactatagggatgagcattgcattgagggcctggttctgcaacagaggagagcagaaatgggccctcaaaacctggcggcagcgcaaaagatg

SEQ ID NO: 101234 - DNA, 103 bp, Artificial Sequence
  Synthetic Polynucleotide
taatacgactcactatagggggatcctttaatgagcattgcattgagggcaacagaggagagccctcatggcaatgctcaacctggcggcagcgcaaaagatg

SEQ ID NO: 101235 - DNA, 103 bp, Artificial Sequence
  Synthetic Polynucleotide
taatacgactcactataggggcaccttctttcgagcatcttctttcacccaacagaggagagggtgaatgaagatgctcaacctggcggcagcgcaaaagatg

SEQ ID NO: 101236 - DNA, 103 bp, Artificial Sequence
  Synthetic Polynucleotide
taatacgactcactataggggtttatctctggatcctttaatgagcattgaacagaggagacaatgcatgttaaaggataacctggcggcagcgcaaaagatg

SEQ ID NO: 101237 - DNA, 103 bp, Artificial Sequence
  Synthetic Polynucleotide
taatacgactcactatagggttctccttctgtttatctctggatcctttaaacagaggagataaaggatgcagagataaaacctggcggcagcgcaaaagatg

SEQ ID NO: 101238 - DNA, 103 bp, Artificial Sequence
  Synthetic Polynucleotide
taatacgactcactatagggtaatttgtcattctccttctgtttatctctaacagaggagaagagatatgcagaaggagaacctggcggcagcgcaaaagatg

SEQ ID NO: 101239 - DNA, 103 bp, Artificial Sequence
  Synthetic Polynucleotide
taatacgactcactataggggggactctcgtaatttgtcattctccttctaacagaggagaagaaggatgatgacaaataacctggcggcagcgcaaaagatg

SEQ ID NO: 101240 - DNA, 103 bp, Artificial Sequence
  Synthetic Polynucleotide
taatacgactcactatagggttcctggagagggactctcgtaatttgtcaaacagaggagatgacaaatgacgagagtcaacctggcggcagcgcaaaagatg

SEQ ID NO: 101241 - DNA, 103 bp, Artificial Sequence
  Synthetic Polynucleotide
taatacgactcactataggggctcacggtcttcctggagagggactctcgaacagaggagacgagagatgctctccaggaacctggcggcagcgcaaaagatg

SEQ ID NO: 101242 - DNA, 103 bp, Artificial Sequence
  Synthetic Polynucleotide
taatacgactcactatagggggtgctccaggctcacggtcttcctggagaaacagaggagatctccaatgagaccgtgaaacctggcggcagcgcaaaagatg

SEQ ID NO: 101243 - DNA, 103 bp, Artificial Sequence
  Synthetic Polynucleotide
taatacgactcactatagggtcccgctgaaggtgctccaggctcacggtcaacagaggagagaccgtatgcctggagcaaacctggcggcagcgcaaaagatg

SEQ ID NO: 101244 - DNA, 103 bp, Artificial Sequence
  Synthetic Polynucleotide
taatacgactcactataggggctggcatactcccgctgaaggtgctccagaacagaggagactggagatgcttcagcggaacctggcggcagcgcaaaagatg

SEQ ID NO: 101245 - DNA, 103 bp, Artificial Sequence
  Synthetic Polynucleotide
taatacgactcactatagggcttccttcacgctggcatactcccgctgaaaacagaggagattcagcatgagtatgccaaacctggcggcagcgcaaaagatg

SEQ ID NO: 101246 - DNA, 103 bp, Artificial Sequence
  Synthetic Polynucleotide
taatacgactcactatagggtccacctgctgcaccttctttcgagcatctaacagaggagaagatgcatgaaagaaggtaacctggcggcagcgcaaaagatg

SEQ ID NO: 101247 - DNA, 103 bp, Artificial Sequence
  Synthetic Polynucleotide
taatacgactcactatagggctttcattttcttccttcacgctggcatacaacagaggagagtatgcatgcgtgaaggaaacctggcggcagcgcaaaagatg

SEQ ID NO: 101248 - DNA, 103 bp, Artificial Sequence
  Synthetic Polynucleotide
taatacgactcactatagggtttctgcagcctttcattttcttccttcacaacagaggagagtgaagatggaaaatgaaaacctggcggcagcgcaaaagatg

SEQ ID NO: 101249 - DNA, 103 bp, Artificial Sequence
  Synthetic Polynucleotide
taatacgactcactatagggcgctgccttctttctgcagcctttcattttaacagaggagaaaaatgatgggctgcagaaacctggcggcagcgcaaaagatg

SEQ ID NO: 101250 - DNA, 103 bp, Artificial Sequence
  Synthetic Polynucleotide
taatacgactcactatagggctctccttctcgctgccttctttctgcagcaacagaggagagctgcaatgagaaggcagaacctggcggcagcgcaaaagatg

SEQ ID NO: 101251 - DNA, 103 bp, Artificial Sequence
  Synthetic Polynucleotide
taatacgactcactatagggctggttgtgtctctccttctcgctgccttcaacagaggagagaaggcatggagaaggagaacctggcggcagcgcaaaagatg

SEQ ID NO: 101252 - DNA, 103 bp, Artificial Sequence
  Synthetic Polynucleotide
taatacgactcactatagggggatcagctgctggttgtgtctctccttctaacagaggagaagaaggatggacacaaccaacctggcggcagcgcaaaagatg

SEQ ID NO: 101253 - DNA, 103 bp, Artificial Sequence
  Synthetic Polynucleotide
taatacgactcactatagggcggacctcctggatcagctgctggttgtgtaacagaggagaacacaaatggcagctgataacctggcggcagcgcaaaagatg

SEQ ID NO: 101254 - DNA, 103 bp, Artificial Sequence
  Synthetic Polynucleotide
taatacgactcactataggggccgctgcagcggacctcctggatcagctgaacagaggagacagctgatgcaggaggtcaacctggcggcagcgcaaaagatg

SEQ ID NO: 101255 - DNA, 103 bp, Artificial Sequence
  Synthetic Polynucleotide
taatacgactcactatagggtcagctcctggccgctgcagcggacctcctaacagaggagaaggaggatggctgcagcgaacctggcggcagcgcaaaagatg

SEQ ID NO: 101256 - DNA, 103 bp, Artificial Sequence
  Synthetic Polynucleotide
taatacgactcactatagggtgcaccctgctcagctcctggccgctgcagaacagaggagactgcagatgccaggagctaacctggcggcagcgcaaaagatg

SEQ ID NO: 101257 - DNA, 103 bp, Artificial Sequence
  Synthetic Polynucleotide
taatacgactcactatagggtaggagatcttccacctgctgcaccttcttaacagaggagaaagaagatgcagcaggtgaacctggcggcagcgcaaaagatg

SEQ ID NO: 101258 - DNA, 103 bp, Artificial Sequence
  Synthetic Polynucleotide
taatacgactcactatagggcacctcctcctgcaccctgctcagctcctgaacagaggagacaggagatgagcagggtgaacctggcggcagcgcaaaagatg

SEQ ID NO: 101259 - DNA, 103 bp, Artificial Sequence
  Synthetic Polynucleotide
taatacgactcactataggggcctcaacttcacctcctcctgcaccctgcaacagaggagagcagggatgaggaggaggaacctggcggcagcgcaaaagatg

SEQ ID NO: 101260 - DNA, 103 bp, Artificial Sequence
  Synthetic Polynucleotide
taatacgactcactatagggagcagctgctgcctcaacttcacctcctccaacagaggagaggaggaatggaagttgagaacctggcggcagcgcaaaagatg

SEQ ID NO: 101261 - DNA, 103 bp, Artificial Sequence
  Synthetic Polynucleotide
taatacgactcactatagggattctgtgagagcagctgctgcctcaacttaacagaggagaaagttgatgcagcagctgaacctggcggcagcgcaaaagatg

SEQ ID NO: 101262 - DNA, 103 bp, Artificial Sequence
  Synthetic Polynucleotide
taatacgactcactatagggatagcttgtcattctgtgagagcagctgctaacagaggagaagcagcatgtctcacagaaacctggcggcagcgcaaaagatg

SEQ ID NO: 101263 - DNA, 103 bp, Artificial Sequence
  Synthetic Polynucleotide
taatacgactcactatagggagagactgcaatagcttgtcattctgtgagaacagaggagactcacaatgtgacaagctaacctggcggcagcgcaaaagatg

SEQ ID NO: 101264 - DNA, 103 bp, Artificial Sequence
  Synthetic Polynucleotide
taatacgactcactatagggctccactcggagagactgcaatagcttgtcaacagaggagagacaagatgttgcagtctaacctggcggcagcgcaaaagatg

SEQ ID NO: 101265 - DNA, 103 bp, Artificial Sequence
  Synthetic Polynucleotide
taatacgactcactatagggacgccttcagctccactcggagagactgcaaacagaggagatgcagtatgtccgagtggaacctggcggcagcgcaaaagatg

SEQ ID NO: 101266 - DNA, 103 bp, Artificial Sequence
  Synthetic Polynucleotide
taatacgactcactatagggagcttctcatacgccttcagctccactcggaacagaggagaccgagtatggctgaaggcaacctggcggcagcgcaaaagatg

SEQ ID NO: 101267 - DNA, 103 bp, Artificial Sequence
  Synthetic Polynucleotide
taatacgactcactatagggctcttcatccagcttctcatacgccttcagaacagaggagactgaagatgtatgagaagaacctggcggcagcgcaaaagatg

SEQ ID NO: 101268 - DNA, 103 bp, Artificial Sequence
  Synthetic Polynucleotide
taatacgactcactatagggttcttttagttaggagatcttccacctgctaacagaggagaagcaggatgaagatctccaacctggcggcagcgcaaaagatg

SEQ ID NO: 101269 - DNA, 103 bp, Artificial Sequence
  Synthetic Polynucleotide
taatacgactcactataggggtctcctgtgctcttcatccagcttctcataacagaggagaatgagaatgtggatgaagaacctggcggcagcgcaaaagatg

SEQ ID NO: 101270 - DNA, 103 bp, Artificial Sequence
  Synthetic Polynucleotide
taatacgactcactataggggcctctctcagtctcctgtgctcttcatccaacagaggagaggatgaatggcacaggagaacctggcggcagcgcaaaagatg

SEQ ID NO: 101271 - DNA, 103 bp, Artificial Sequence
  Synthetic Polynucleotide
taatacgactcactatagggttctcccgacgcctctctcagtctcctgtgaacagaggagacacaggatgctgagagagaacctggcggcagcgcaaaagatg

SEQ ID NO: 101272 - DNA, 103 bp, Artificial Sequence
  Synthetic Polynucleotide
taatacgactcactatagggccttccagccttctcccgacgcctctctcaaacagaggagatgagagatgcgtcgggagaacctggcggcagcgcaaaagatg

SEQ ID NO: 101273 - DNA, 103 bp, Artificial Sequence
  Synthetic Polynucleotide
taatacgactcactatagggggatcctgccccttccagccttctcccgacaacagaggagagtcgggatgaggctggaaaacctggcggcagcgcaaaagatg

SEQ ID NO: 101274 - DNA, 103 bp, Artificial Sequence
  Synthetic Polynucleotide
taatacgactcactataggggtccctgaaaggatcctgccccttccagccaacagaggagaggctggatggggcaggataacctggcggcagcgcaaaagatg

SEQ ID NO: 101275 - DNA, 103 bp, Artificial Sequence
  Synthetic Polynucleotide
taatacgactcactatagggggctgtgcaggtccctgaaaggatcctgccaacagaggagaggcaggatgctttcagggaacctggcggcagcgcaaaagatg

SEQ ID NO: 101276 - DNA, 103 bp, Artificial Sequence
  Synthetic Polynucleotide
taatacgactcactatagggtccatcaggaggctgtgcaggtccctgaaaaacagaggagatttcagatgcctgcacagaacctggcggcagcgcaaaagatg

SEQ ID NO: 101277 - DNA, 103 bp, Artificial Sequence
  Synthetic Polynucleotide
taatacgactcactatagggagcctggatctccatcaggaggctgtgcagaacagaggagactgcacatgctcctgatgaacctggcggcagcgcaaaagatg

SEQ ID NO: 101278 - DNA, 103 bp, Artificial Sequence
  Synthetic Polynucleotide
taatacgactcactataggggcaagcgcagagcctggatctccatcaggaaacagaggagatcctgaatgagatccaggaacctggcggcagcgcaaaagatg

SEQ ID NO: 101279 - DNA, 103 bp, Artificial Sequence
  Synthetic Polynucleotide
taatacgactcactatagggaaaaggagtattcttttagttaggagatctaacagaggagaagatctatgaactaaaagaacctggcggcagcgcaaaagatg

SEQ ID NO: 101280 - DNA, 103 bp, Artificial Sequence
  Synthetic Polynucleotide
taatacgactcactatagggctttctagttgcaagcgcagagcctggatcaacagaggagagatccaatgtctgcgcttaacctggcggcagcgcaaaagatg

SEQ ID NO: 101281 - DNA, 103 bp, Artificial Sequence
  Synthetic Polynucleotide
taatacgactcactatagggttcgatgctcctttctagttgcaagcgcagaacagaggagactgcgcatgcaactagaaaacctggcggcagcgcaaaagatg

SEQ ID NO: 101282 - DNA, 103 bp, Artificial Sequence
  Synthetic Polynucleotide
taatacgactcactatagggtgctgctggtttcgatgctcctttctagttaacagaggagaaactagatgggagcatcgaacctggcggcagcgcaaaagatg

SEQ ID NO: 101283 - DNA, 103 bp, Artificial Sequence
  Synthetic Polynucleotide
taatacgactcactatagggctctgcagagtgctgctggtttcgatgctcaacagaggagagagcatatgaaccagcagaacctggcggcagcgcaaaagatg

SEQ ID NO: 101284 - DNA, 103 bp, Artificial Sequence
  Synthetic Polynucleotide
taatacgactcactatagggcttgagcctgctctgcagagtgctgctggtaacagaggagaaccagcatgactctgcagaacctggcggcagcgcaaaagatg

SEQ ID NO: 101285 - DNA, 103 bp, Artificial Sequence
  Synthetic Polynucleotide
taatacgactcactatagggccagctgttccttgagcctgctctgcagagaacagaggagactctgcatggcaggctcaaacctggcggcagcgcaaaagatg

SEQ ID NO: 101286 - DNA, 103 bp, Artificial Sequence
  Synthetic Polynucleotide
taatacgactcactataggggccccccttgccagctgttccttgagcctgaacagaggagacaggctatgggaacagctaacctggcggcagcgcaaaagatg

SEQ ID NO: 101287 - DNA, 103 bp, Artificial Sequence
  Synthetic Polynucleotide
taatacgactcactatagggtgccttctctgccccccttgccagctgttcaacagaggagagaacagatggcaagggggaacctggcggcagcgcaaaagatg

SEQ ID NO: 101288 - DNA, 103 bp, Artificial Sequence
  Synthetic Polynucleotide
taatacgactcactatagggctccttcctgtgccttctctgccccccttgaacagaggagacaagggatgcagagaaggaacctggcggcagcgcaaaagatg

SEQ ID NO: 101289 - DNA, 103 bp, Artificial Sequence
  Synthetic Polynucleotide
taatacgactcactatagggagagtgagggctccttcctgtgccttctctaacagaggagaagagaaatgacaggaaggaacctggcggcagcgcaaaagatg

SEQ ID NO: 101290 - DNA, 103 bp, Artificial Sequence
  Synthetic Polynucleotide
taatacgactcactatagggatccttttccaaaaggagtattcttttagtaacagaggagaactaaaatgatactccttaacctggcggcagcgcaaaagatg

SEQ ID NO: 101291 - DNA, 103 bp, Artificial Sequence
  Synthetic Polynucleotide
taatacgactcactatagggttggacagccagagtgagggctccttcctgaacagaggagacaggaaatggccctcactaacctggcggcagcgcaaaagatg

SEQ ID NO: 101292 - DNA, 103 bp, Artificial Sequence
  Synthetic Polynucleotide
taatacgactcactatagggtggacacggcttggacagccagagtgagggaacagaggagaccctcaatgtggctgtccaacctggcggcagcgcaaaagatg

SEQ ID NO: 101293 - DNA, 103 bp, Artificial Sequence
  Synthetic Polynucleotide
taatacgactcactatagggacctcagggatggacacggcttggacagccaacagaggagaggctgtatgagccgtgtcaacctggcggcagcgcaaaagatg

SEQ ID NO: 101294 - DNA, 103 bp, Artificial Sequence
  Synthetic Polynucleotide
taatacgactcactatagggctgaaggggcacctcagggatggacacggcaacagaggagagccgtgatgatccctgagaacctggcggcagcgcaaaagatg

SEQ ID NO: 101295 - DNA, 103 bp, Artificial Sequence
  Synthetic Polynucleotide
taatacgactcactataggggtttgtcaggctgaaggggcacctcagggaaacagaggagatccctgatgtgccccttcaacctggcggcagcgcaaaagatg

SEQ ID NO: 101296 - DNA, 103 bp, Artificial Sequence
  Synthetic Polynucleotide
taatacgactcactatagggtcaccatcgtgtttgtcaggctgaaggggcaacagaggagagcccctatggcctgacaaaacctggcggcagcgcaaaagatg

SEQ ID NO: 101297 - DNA, 103 bp, Artificial Sequence
  Synthetic Polynucleotide
taatacgactcactataggggggatatttgtcaccatcgtgtttgtcaggaacagaggagacctgacatgcacgatggtaacctggcggcagcgcaaaagatg

SEQ ID NO: 101298 - DNA, 103 bp, Artificial Sequence
  Synthetic Polynucleotide
taatacgactcactatagggcactttccatgggatatttgtcaccatcgtaacagaggagaacgatgatgacaaatatcaacctggcggcagcgcaaaagatg

SEQ ID NO: 101299 - DNA, 103 bp, Artificial Sequence
  Synthetic Polynucleotide
taatacgactcactatagggaatgaattatcactttccatgggatatttgaacagaggagacaaataatgcatggaaagaacctggcggcagcgcaaaagatg

SEQ ID NO: 101300 - DNA, 103 bp, Artificial Sequence
  Synthetic Polynucleotide
taatacgactcactatagggaaacagatcaaatgaattatcactttccataacagaggagaatggaaatggataattcaaacctggcggcagcgcaaaagatg

SEQ ID NO: 101301 - DNA, 103 bp, Artificial Sequence
  Synthetic Polynucleotide
taatacgactcactataggggaacaaggccactgcagccgctgagcgtccaacagaggagaggacgcatggcggctgcaaacctggcggcagcgcaaaagatg

SEQ ID NO: 101302 - DNA, 103 bp, Artificial Sequence
  Synthetic Polynucleotide
taatacgactcactatagggcggctgtcacatccttttccaaaaggagtaaacagaggagatactccatgtggaaaaggaacctggcggcagcgcaaaagatg

SEQ ID NO: 101303 - DNA, 103 bp, Artificial Sequence
  Synthetic Polynucleotide
taatacgactcactataggggggaggaatcaaacagatcaaatgaattataacagaggagaataattatgttgatctgtaacctggcggcagcgcaaaagatg

SEQ ID NO: 101304 - DNA, 103 bp, Artificial Sequence
  Synthetic Polynucleotide
taatacgactcactataggggtcactgcctgggaggaatcaaacagatcaaacagaggagatgatctatgtgattcctcaacctggcggcagcgcaaaagatg

SEQ ID NO: 101305 - DNA, 103 bp, Artificial Sequence
  Synthetic Polynucleotide
taatacgactcactatagggtgattttggtgtcactgcctgggaggaatcaacagaggagagattccatgcaggcagtgaacctggcggcagcgcaaaagatg

SEQ ID NO: 101306 - DNA, 103 bp, Artificial Sequence
  Synthetic Polynucleotide
taatacgactcactatagggtctctgaaactgattttggtgtcactgcctaacagaggagaaggcagatgcaccaaaataacctggcggcagcgcaaaagatg

SEQ ID NO: 101307 - DNA, 103 bp, Artificial Sequence
  Synthetic Polynucleotide
taatacgactcactatagggagtggaggagtctctgaaactgattttggtaacagaggagaaccaaaatgagtttcagaaacctggcggcagcgcaaaagatg

SEQ ID NO: 101308 - DNA, 103 bp, Artificial Sequence
  Synthetic Polynucleotide
taatacgactcactatagggattcccagagagtggaggagtctctgaaacaacagaggagagtttcaatgactcctccaaacctggcggcagcgcaaaagatg

SEQ ID NO: 101309 - DNA, 103 bp, Artificial Sequence
  Synthetic Polynucleotide
taatacgactcactatagggagtccgtgtcattcccagagagtggaggagaacagaggagactcctcatgtctctgggaaacctggcggcagcgcaaaagatg

SEQ ID NO: 101310 - DNA, 103 bp, Artificial Sequence
  Synthetic Polynucleotide
taatacgactcactatagggcaggagagggagtccgtgtcattcccagagaacagaggagactctggatgtgacacggaaacctggcggcagcgcaaaagatg

SEQ ID NO: 101311 - DNA, 103 bp, Artificial Sequence
  Synthetic Polynucleotide
taatacgactcactataggggccactgtcgcaggagagggagtccgtgtcaacagaggagagacacgatgtccctctccaacctggcggcagcgcaaaagatg

SEQ ID NO: 101312 - DNA, 103 bp, Artificial Sequence
  Synthetic Polynucleotide
taatacgactcactatagggttgccgaactgccactgtcgcaggagagggaacagaggagaccctctatggcgacagtgaacctggcggcagcgcaaaagatg

SEQ ID NO: 101313 - DNA, 103 bp, Artificial Sequence
  Synthetic Polynucleotide
taatacgactcactatagggtctgcctgggcggctgtcacatccttttccaacagaggagaggaaaaatgtgtgacagcaacctggcggcagcgcaaaagatg

SEQ ID NO: 101314 - DNA, 103 bp, Artificial Sequence
  Synthetic Polynucleotide
taatacgactcactatagggggagtgctagttgccgaactgccactgtcgaacagaggagacgacagatgcagttcggcaacctggcggcagcgcaaaagatg

SEQ ID NO: 101315 - DNA, 103 bp, Artificial Sequence
  Synthetic Polynucleotide
taatacgactcactatagggggacacacacggagtgctagttgccgaactaacagaggagaagttcgatgactagcactaacctggcggcagcgcaaaagatg

SEQ ID NO: 101316 - DNA, 103 bp, Artificial Sequence
  Synthetic Polynucleotide
taatacgactcactatagggtgaccaggcgggacacacacggagtgctagaacagaggagactagcaatgcgtgtgtgtaacctggcggcagcgcaaaagatg

SEQ ID NO: 101317 - DNA, 103 bp, Artificial Sequence
  Synthetic Polynucleotide
taatacgactcactatagggtggtggccagtgaccaggcgggacacacacaacagaggagagtgtgtatgccgcctggtaacctggcggcagcgcaaaagatg

SEQ ID NO: 101318 - DNA, 103 bp, Artificial Sequence
  Synthetic Polynucleotide
taatacgactcactatagggggcccacaggtggtggccagtgaccaggcgaacagaggagacgcctgatgactggccacaacctggcggcagcgcaaaagatg

SEQ ID NO: 101319 - DNA, 103 bp, Artificial Sequence
  Synthetic Polynucleotide
taatacgactcactatagggcattcttgctggcccacaggtggtggccagaacagaggagactggccatgacctgtgggaacctggcggcagcgcaaaagatg

SEQ ID NO: 101320 - DNA, 103 bp, Artificial Sequence
  Synthetic Polynucleotide
taatacgactcactatagggacatggcggccattcttgctggcccacaggaacagaggagacctgtgatgcagcaagaaaacctggcggcagcgcaaaagatg

SEQ ID NO: 101321 - DNA, 103 bp, Artificial Sequence
  Synthetic Polynucleotide
taatacgactcactatagggcaggcccaggacatggcggccattcttgctaacagaggagaagcaagatgggccgccataacctggcggcagcgcaaaagatg

SEQ ID NO: 101322 - DNA, 103 bp, Artificial Sequence
  Synthetic Polynucleotide
taatacgactcactatagggagtcctcaatcaggcccaggacatggcggcaacagaggagagccgccatgtcctgggccaacctggcggcagcgcaaaagatg

SEQ ID NO: 101323 - DNA, 103 bp, Artificial Sequence
  Synthetic Polynucleotide
taatacgactcactatagggagggcctcatagtcctcaatcaggcccaggaacagaggagacctgggatggattgaggaaacctggcggcagcgcaaaagatg

SEQ ID NO: 101324 - DNA, 103 bp, Artificial Sequence
  Synthetic Polynucleotide
taatacgactcactatagggcttttccagttctgcctgggcggctgtcacaacagaggagagtgacaatggcccaggcaaacctggcggcagcgcaaaagatg

SEQ ID NO: 101325 - DNA, 103 bp, Artificial Sequence
  Synthetic Polynucleotide
taatacgactcactatagggctgtttgagcagggcctcatagtcctcaataacagaggagaattgagatgtatgaggccaacctggcggcagcgcaaaagatg

SEQ ID NO: 101326 - DNA, 103 bp, Artificial Sequence
  Synthetic Polynucleotide
taatacgactcactatagggcctggctgatctgtttgagcagggcctcataacagaggagaatgaggatgtgctcaaacaacctggcggcagcgcaaaagatg

SEQ ID NO: 101327 - DNA, 103 bp, Artificial Sequence
  Synthetic Polynucleotide
taatacgactcactatagggagcctctgtccctggctgatctgtttgagcaacagaggagagctcaaatggatcagccaaacctggcggcagcgcaaaagatg

SEQ ID NO: 101328 - DNA, 103 bp, Artificial Sequence
  Synthetic Polynucleotide
taatacgactcactatagggttcagcaaggagcctctgtccctggctgataacagaggagaatcagcatgggacagaggaacctggcggcagcgcaaaagatg

SEQ ID NO: 101329 - DNA, 103 bp, Artificial Sequence
  Synthetic Polynucleotide
taatacgactcactataggggaatgtccatttcagcaaggagcctctgtcaacagaggagagacagaatgtccttgctgaacctggcggcagcgcaaaagatg

SEQ ID NO: 101330 - DNA, 103 bp, Artificial Sequence
  Synthetic Polynucleotide
taatacgactcactatagggtcttgggtttgaatgtccatttcagcaaggaacagaggagaccttgcatgaatggacataacctggcggcagcgcaaaagatg

SEQ ID NO: 101331 - DNA, 103 bp, Artificial Sequence
  Synthetic Polynucleotide
taatacgactcactataggggctgggagcctcttgggtttgaatgtccataacagaggagaatggacatgcaaacccaaaacctggcggcagcgcaaaagatg

SEQ ID NO: 101332 - DNA, 103 bp, Artificial Sequence
  Synthetic Polynucleotide
taatacgactcactataggggacttgtggagctgggagcctcttgggtttaacagaggagaaaacccatgaggctcccaaacctggcggcagcgcaaaagatg

SEQ ID NO: 101333 - DNA, 103 bp, Artificial Sequence
  Synthetic Polynucleotide
taatacgactcactatagggcccagctcttgacttgtggagctgggagccaacagaggagaggctccatgctccacaagaacctggcggcagcgcaaaagatg

SEQ ID NO: 101334 - DNA, 103 bp, Artificial Sequence
  Synthetic Polynucleotide
taatacgactcactatagggaccctttgttcccagctcttgacttgtggaaacagaggagatccacaatgcaagagctgaacctggcggcagcgcaaaagatg

SEQ ID NO: 101335 - DNA, 103 bp, Artificial Sequence
  Synthetic Polynucleotide
taatacgactcactatagggctgcaaaggccttttccagttctgcctgggaacagaggagacccaggatgaactggaaaaacctggcggcagcgcaaaagatg

SEQ ID NO: 101336 - DNA, 103 bp, Artificial Sequence
  Synthetic Polynucleotide
taatacgactcactatagggctgggtgtggaccctttgttcccagctcttaacagaggagaaagagcatggaacaaaggaacctggcggcagcgcaaaagatg

SEQ ID NO: 101337 - DNA, 103 bp, Artificial Sequence
  Synthetic Polynucleotide
taatacgactcactatagggctcagtggtgctgggtgtggaccctttgttaacagaggagaaacaaaatgtccacacccaacctggcggcagcgcaaaagatg

SEQ ID NO: 101338 - DNA, 103 bp, Artificial Sequence
  Synthetic Polynucleotide
taatacgactcactatagggcacaaacttgctcagtggtgctgggtgtggaacagaggagaccacacatggcaccactgaacctggcggcagcgcaaaagatg

SEQ ID NO: 101339 - DNA, 103 bp, Artificial Sequence
  Synthetic Polynucleotide
taatacgactcactatagggtcacactgctcacaaacttgctcagtggtgaacagaggagacaccacatggcaagtttgaacctggcggcagcgcaaaagatg

SEQ ID NO: 101340 - DNA, 103 bp, Artificial Sequence
  Synthetic Polynucleotide
taatacgactcactatagggttggccgtgctcacactgctcacaaacttgaacagaggagacaagttatggagcagtgtaacctggcggcagcgcaaaagatg

SEQ ID NO: 101341 - DNA, 103 bp, Artificial Sequence
  Synthetic Polynucleotide
taatacgactcactatagggcagggtcagcttggccgtgctcacactgctaacagaggagaagcagtatgagcacggccaacctggcggcagcgcaaaagatg

SEQ ID NO: 101342 - DNA, 103 bp, Artificial Sequence
  Synthetic Polynucleotide
taatacgactcactatagggaggcctcttccagggtcagcttggccgtgcaacagaggagagcacggatgagctgacccaacctggcggcagcgcaaaagatg

SEQ ID NO: 101343 - DNA, 103 bp, Artificial Sequence
  Synthetic Polynucleotide
taatacgactcactatagggagccgcctgtaggcctcttccagggtcagcaacagaggagagctgacatgggaagaggcaacctggcggcagcgcaaaagatg

SEQ ID NO: 101344 - DNA, 103 bp, Artificial Sequence
  Synthetic Polynucleotide
taatacgactcactataggggagaagcttcagccgcctgtaggcctcttcaacagaggagagaagagatgtacaggcggaacctggcggcagcgcaaaagatg

SEQ ID NO: 101345 - DNA, 103 bp, Artificial Sequence
  Synthetic Polynucleotide
taatacgactcactatagggagactctccagagaagcttcagccgcctgtaacagaggagaacaggcatgtgaagcttcaacctggcggcagcgcaaaagatg

SEQ ID NO: 101346 - DNA, 103 bp, Artificial Sequence
  Synthetic Polynucleotide
taatacgactcactataggggtctctgtccctgcaaaggccttttccagtaacagaggagaactggaatgggcctttgcaacctggcggcagcgcaaaagatg

SEQ ID NO: 101347 - DNA, 103 bp, Artificial Sequence
  Synthetic Polynucleotide
taatacgactcactatagggtcggggagtgagactctccagagaagcttcaacagaggagagaagctatgctggagagtaacctggcggcagcgcaaaagatg

SEQ ID NO: 101348 - DNA, 103 bp, Artificial Sequence
  Synthetic Polynucleotide
taatacgactcactatagggctggccatcctcggggagtgagactctccaaacagaggagatggagaatgtcactccccaacctggcggcagcgcaaaagatg

SEQ ID NO: 101349 - DNA, 103 bp, Artificial Sequence
  Synthetic Polynucleotide
taatacgactcactataggggaagggggcactggccatcctcggggagtgaacagaggagacactccatgaggatggccaacctggcggcagcgcaaaagatg

SEQ ID NO: 101350 - DNA, 103 bp, Artificial Sequence
  Synthetic Polynucleotide
taatacgactcactatagggtgctcacagtgaagggggcactggccatccaacagaggagaggatggatggtgccccctaacctggcggcagcgcaaaagatg

SEQ ID NO: 101351 - DNA, 103 bp, Artificial Sequence
  Synthetic Polynucleotide
taatacgactcactatagggttctccaatctgctcacagtgaagggggcaaacagaggagatgccccatgcactgtgagaacctggcggcagcgcaaaagatg

SEQ ID NO: 101352 - DNA, 103 bp, Artificial Sequence
  Synthetic Polynucleotide
taatacgactcactatagggctgccttcatttctccaatctgctcacagtaacagaggagaactgtgatgagattggagaacctggcggcagcgcaaaagatg

SEQ ID NO: 101353 - DNA, 103 bp, Artificial Sequence
  Synthetic Polynucleotide
taatacgactcactatagggttggtgacctctgccttcatttctccaatcaacagaggagagattggatgaatgaaggcaacctggcggcagcgcaaaagatg

SEQ ID NO: 101354 - DNA, 103 bp, Artificial Sequence
  Synthetic Polynucleotide
taatacgactcactatagggtttatgtagtttggtgacctctgccttcataacagaggagaatgaagatggaggtcaccaacctggcggcagcgcaaaagatg

SEQ ID NO: 101355 - DNA, 103 bp, Artificial Sequence
  Synthetic Polynucleotide
taatacgactcactatagggcaaacaattttttatgtagtttggtgacctaacagaggagaaggtcaatgaactacataaacctggcggcagcgcaaaagatg

SEQ ID NO: 101356 - DNA, 103 bp, Artificial Sequence
  Synthetic Polynucleotide
taatacgactcactatagggttttcttgttcaaacaattttttatgtagtaacagaggagaactacaatgaaaattgttaacctggcggcagcgcaaaagatg

SEQ ID NO: 101357 - DNA, 103 bp, Artificial Sequence
  Synthetic Polynucleotide
taatacgactcactatagggagccttctccgtctctgtccctgcaaaggcaacagaggagagcctttatggggacagagaacctggcggcagcgcaaaagatg

SEQ ID NO: 101358 - DNA, 103 bp, Artificial Sequence
  Synthetic Polynucleotide
taatacgactcactatagggttgcaacttcttttcttgttcaaacaatttaacagaggagaaaattgatggaacaagaaaacctggcggcagcgcaaaagatg

SEQ ID NO: 101359 - DNA, 103 bp, Artificial Sequence
  Synthetic Polynucleotide
taatacgactcactatagggtcatggtgttttgcaacttcttttcttgttaacagaggagaaacaagatgagaagttgcaacctggcggcagcgcaaaagatg

SEQ ID NO: 101360 - DNA, 103 bp, Artificial Sequence
  Synthetic Polynucleotide
taatacgactcactatagggtgcaaaagcttcatggtgttttgcaacttcaacagaggagagaagttatgaaacaccataacctggcggcagcgcaaaagatg

SEQ ID NO: 101361 - DNA, 103 bp, Artificial Sequence
  Synthetic Polynucleotide
taatacgactcactatagggcttgctcagctgcaaaagcttcatggtgttaacagaggagaaacaccatgaagcttttgaacctggcggcagcgcaaaagatg

SEQ ID NO: 101362 - DNA, 103 bp, Artificial Sequence
  Synthetic Polynucleotide
taatacgactcactatagggtttcctggcgcttgctcagctgcaaaagctaacagaggagaagctttatgagctgagcaaacctggcggcagcgcaaaagatg

SEQ ID NO: 101363 - DNA, 103 bp, Artificial Sequence
  Synthetic Polynucleotide
taatacgactcactatagggaagatgactttttcctggcgcttgctcagcaacagaggagagctgagatggcgccaggaaacctggcggcagcgcaaaagatg

SEQ ID NO: 101364 - DNA, 103 bp, Artificial Sequence
  Synthetic Polynucleotide
taatacgactcactatagggcaattgatcaaagatgactttttcctggcgaacagaggagacgccagatgaaagtcatcaacctggcggcagcgcaaaagatg

SEQ ID NO: 101365 - DNA, 103 bp, Artificial Sequence
  Synthetic Polynucleotide
taatacgactcactataggggggttacgaccaattgatcaaagatgacttaacagaggagaaagtcaatgttgatcaataacctggcggcagcgcaaaagatg

SEQ ID NO: 101366 - DNA, 103 bp, Artificial Sequence
  Synthetic Polynucleotide
taatacgactcactatagggaggattttgtgggttacgaccaattgatcaaacagaggagatgatcaatgggtcgtaacaacctggcggcagcgcaaaagatg

SEQ ID NO: 101367 - DNA, 103 bp, Artificial Sequence
  Synthetic Polynucleotide
taatacgactcactatagggggccttccgaaggattttgtgggttacgacaacagaggagagtcgtaatgcacaaaatcaacctggcggcagcgcaaaagatg

SEQ ID NO: 101368 - DNA, 103 bp, Artificial Sequence
  Synthetic Polynucleotide
taatacgactcactataggggcaaccgaagagccttctccgtctctgtccaacagaggagaggacagatgcggagaaggaacctggcggcagcgcaaaagatg

SEQ ID NO: 101369 - DNA, 103 bp, Artificial Sequence
  Synthetic Polynucleotide
taatacgactcactatagggggtttcctctggccttccgaaggattttgtaacagaggagaacaaaaatgttcggaaggaacctggcggcagcgcaaaagatg

SEQ ID NO: 101370 - DNA, 103 bp, Artificial Sequence
  Synthetic Polynucleotide
taatacgactcactatagggctaagctccaggtttcctctggccttccgaaacagaggagatcggaaatgcagaggaaaaacctggcggcagcgcaaaagatg

SEQ ID NO: 101371 - DNA, 103 bp, Artificial Sequence
  Synthetic Polynucleotide
taatacgactcactatagggtcccccaggcctaagctccaggtttcctctaacagaggagaagaggaatgctggagcttaacctggcggcagcgcaaaagatg

SEQ ID NO: 101372 - DNA, 103 bp, Artificial Sequence
  Synthetic Polynucleotide
taatacgactcactatagggctggatgggctcccccaggcctaagctccaaacagaggagatggagcatgggcctggggaacctggcggcagcgcaaaagatg

SEQ ID NO: 101373 - DNA, 103 bp, Artificial Sequence
  Synthetic Polynucleotide
taatacgactcactatagggctgcatgttcctggatgggctcccccaggcaacagaggagagcctggatgagcccatccaacctggcggcagcgcaaaagatg

SEQ ID NO: 101374 - DNA, 103 bp, Artificial Sequence
  Synthetic Polynucleotide
taatacgactcactatagggtctgctgggactgcatgttcctggatgggcaacagaggagagcccatatgggaacatgcaacctggcggcagcgcaaaagatg

SEQ ID NO: 101375 - DNA, 103 bp, Artificial Sequence
  Synthetic Polynucleotide
taatacgactcactatagggaggagcctggtctgctgggactgcatgttcaacagaggagagaacatatggtcccagcaaacctggcggcagcgcaaaagatg

SEQ ID NO: 101376 - DNA, 103 bp, Artificial Sequence
  Synthetic Polynucleotide
taatacgactcactatagggctttccaaacgcaaccgaagagccttctccaacagaggagaggagaaatgtcttcggttaacctggcggcagcgcaaaagatg

SEQ ID NO: 101377 - DNA, 103 bp, Artificial Sequence
  Synthetic Polynucleotide
taatacgactcactatagggtgaaagcttgctttccaaacgcaaccgaagaacagaggagacttcggatgcgtttggaaaacctggcggcagcgcaaaagatg

SEQ ID NO: 101378 - DNA, 103 bp, Artificial Sequence
  Synthetic Polynucleotide
taatacgactcactatagggtcttcatctctgaaagcttgctttccaaacaacagaggagagtttggatggcaagctttaacctggcggcagcgcaaaagatg

SEQ ID NO: 101379 - DNA, 103 bp, Artificial Sequence
  Synthetic Polynucleotide
taatacgactcactatagggggtacactgggaacaaggccactgcagccgaacagaggagacggctgatgtggccttgtaacctggcggcagcgcaaaagatg

SEQ ID NO: 101380 - DNA, 103 bp, Artificial Sequence
  Synthetic Polynucleotide
taatacgactcactatagggtcgtgcatcttcttcatctctgaaagcttgaacagaggagacaagctatgagagatgaaaacctggcggcagcgcaaaagatg

SEQ ID NO: 101381 - DNA, 103 bp, Artificial Sequence
  Synthetic Polynucleotide
taatacgactcactatagggcaagtccccctcgtgcatcttcttcatctcaacagaggagagagatgatgaagatgcacaacctggcggcagcgcaaaagatg

SEQ ID NO: 101382 - DNA, 103 bp, Artificial Sequence
  Synthetic Polynucleotide
taatacgactcactataggggagccatcgccaagtccccctcgtgcatctaacagaggagaagatgcatgagggggactaacctggcggcagcgcaaaagatg

SEQ ID NO: 101383 - DNA, 103 bp, Artificial Sequence
  Synthetic Polynucleotide
taatacgactcactatagggtccaggaccagagccatcgccaagtcccccaacagaggagagggggaatgggcgatggcaacctggcggcagcgcaaaagatg

SEQ ID NO: 101384 - DNA, 103 bp, Artificial Sequence
  Synthetic Polynucleotide
taatacgactcactataggggtctttctcatccaggaccagagccatcgcaacagaggagagcgatgatgctggtcctgaacctggcggcagcgcaaaagatg

SEQ ID NO: 101385 - DNA, 103 bp, Artificial Sequence
  Synthetic Polynucleotide
taatacgactcactatagggcaatcagtctgtctttctcatccaggaccaaacagaggagatggtccatgatgagaaagaacctggcggcagcgcaaaagatg

SEQ ID NO: 101386 - DNA, 103 bp, Artificial Sequence
  Synthetic Polynucleotide
taatacgactcactatagggttcaactcctcaatcagtctgtctttctcaaacagaggagatgagaaatgcagactgataacctggcggcagcgcaaaagatg

SEQ ID NO: 101387 - DNA, 103 bp, Artificial Sequence
  Synthetic Polynucleotide
taatacgactcactatagggcaaagacagcttcaactcctcaatcagtctaacagaggagaagactgatggaggagttgaacctggcggcagcgcaaaagatg

SEQ ID NO: 101388 - DNA, 103 bp, Artificial Sequence
  Synthetic Polynucleotide
taatacgactcactatagggctttgctcttcaaagacagcttcaactcctaacagaggagaaggagtatgagctgtcttaacctggcggcagcgcaaaagatg

SEQ ID NO: 101389 - DNA, 103 bp, Artificial Sequence
  Synthetic Polynucleotide
taatacgactcactatagggattaaagcttctttgctcttcaaagacagcaacagaggagagctgtcatggaagagcaaaacctggcggcagcgcaaaagatg

SEQ ID NO: 101390 - DNA, 103 bp, Artificial Sequence
  Synthetic Polynucleotide
taatacgactcactatagggcaggtcatctggtacactgggaacaaggccaacagaggagaggccttatgcccagtgtaaacctggcggcagcgcaaaagatg

SEQ ID NO: 101391 - DNA, 103 bp, Artificial Sequence
  Synthetic Polynucleotide
taatacgactcactatagggaaggcactgaattaaagcttctttgctcttaacagaggagaaagagcatggaagctttaaacctggcggcagcgcaaaagatg

SEQ ID NO: 101392 - DNA, 103 bp, Artificial Sequence
  Synthetic Polynucleotide
taatacgactcactatagggtctcctctttaaggcactgaattaaagcttaacagaggagaaagcttatgttcagtgccaacctggcggcagcgcaaaagatg

SEQ ID NO: 101393 - DNA, 103 bp, Artificial Sequence
  Synthetic Polynucleotide
taatacgactcactatagggatctgagatttctcctctttaaggcactgaaacagaggagatcagtgatgtaaagaggaaacctggcggcagcgcaaaagatg

SEQ ID NO: 101394 - DNA, 103 bp, Artificial Sequence
  Synthetic Polynucleotide
taatacgactcactatagggaggacatgccatctgagatttctcctctttaacagaggagaaaagagatgaaatctcagaacctggcggcagcgcaaaagatg

SEQ ID NO: 101395 - DNA, 103 bp, Artificial Sequence
  Synthetic Polynucleotide
taatacgactcactatagggcattctcatcaggacatgccatctgagattaacagaggagaaatctcatgtggcatgtcaacctggcggcagcgcaaaagatg

SEQ ID NO: 101396 - DNA, 103 bp, Artificial Sequence
  Synthetic Polynucleotide
taatacgactcactatagggccagatgacacattctcatcaggacatgccaacagaggagaggcatgatgtgatgagaaaacctggcggcagcgcaaaagatg

SEQ ID NO: 101397 - DNA, 103 bp, Artificial Sequence
  Synthetic Polynucleotide
taatacgactcactatagggtcggagctctccagatgacacattctcatcaacagaggagagatgagatggtgtcatctaacctggcggcagcgcaaaagatg

SEQ ID NO: 101398 - DNA, 103 bp, Artificial Sequence
  Synthetic Polynucleotide
taatacgactcactatagggcacaaagtcctcggagctctccagatgacaaacagaggagatgtcatatggagagctccaacctggcggcagcgcaaaagatg

SEQ ID NO: 101399 - DNA, 103 bp, Artificial Sequence
  Synthetic Polynucleotide
taatacgactcactatagggcttggagcagcacaaagtcctcggagctctaacagaggagaagagctatgaggactttgaacctggcggcagcgcaaaagatg

SEQ ID NO: 101400 - DNA, 103 bp, Artificial Sequence
  Synthetic Polynucleotide
taatacgactcactatagggcttttcttcccttggagcagcacaaagtccaacagaggagaggacttatggctgctccaaacctggcggcagcgcaaaagatg

SEQ ID NO: 101401 - DNA, 103 bp, Artificial Sequence
  Synthetic Polynucleotide
taatacgactcactatagggtgatgccatccaggtcatctggtacactggaacagaggagaccagtgatgcagatgaccaacctggcggcagcgcaaaagatg

SEQ ID NO: 101402 - DNA, 103 bp, Artificial Sequence
  Synthetic Polynucleotide
taatacgactcactatagggtttctctctccttttcttcccttggagcagaacagaggagactgctcatggggaagaaaaacctggcggcagcgcaaaagatg

SEQ ID NO: 101403 - DNA, 103 bp, Artificial Sequence
  Synthetic Polynucleotide
taatacgactcactataggggcagcctcagtttctctctccttttcttccaacagaggagaggaagaatgggagagagaaacctggcggcagcgcaaaagatg

SEQ ID NO: 101404 - DNA, 103 bp, Artificial Sequence
  Synthetic Polynucleotide
taatacgactcactatagggctccatttgtgcagcctcagtttctctctcaacagaggagagagagaatgactgaggctaacctggcggcagcgcaaaagatg

SEQ ID NO: 101405 - DNA, 103 bp, Artificial Sequence
  Synthetic Polynucleotide
taatacgactcactatagggccttctgatgctccatttgtgcagcctcagaacagaggagactgaggatgcacaaatggaacctggcggcagcgcaaaagatg

SEQ ID NO: 101406 - DNA, 103 bp, Artificial Sequence
  Synthetic Polynucleotide
taatacgactcactatagggctgtttctctccttctgatgctccatttgtaacagaggagaacaaatatggcatcagaaaacctggcggcagcgcaaaagatg

SEQ ID NO: 101407 - DNA, 103 bp, Artificial Sequence
  Synthetic Polynucleotide
taatacgactcactatagggctcttcaaagctgtttctctccttctgatgaacagaggagacatcagatggagagaaacaacctggcggcagcgcaaaagatg

SEQ ID NO: 101408 - DNA, 103 bp, Artificial Sequence
  Synthetic Polynucleotide
taatacgactcactatagggcctggatcctctcttcaaagctgtttctctaacagaggagaagagaaatggctttgaagaacctggcggcagcgcaaaagatg

SEQ ID NO: 101409 - DNA, 103 bp, Artificial Sequence
  Synthetic Polynucleotide
taatacgactcactatagggtcttcaagtgcctggatcctctcttcaaagaacagaggagactttgaatggaggatccaaacctggcggcagcgcaaaagatg

SEQ ID NO: 101410 - DNA, 103 bp, Artificial Sequence
  Synthetic Polynucleotide
taatacgactcactatagggtctcaggtcctcttcaagtgcctggatcctaacagaggagaaggatcatggcacttgaaaacctggcggcagcgcaaaagatg

SEQ ID NO: 101411 - DNA, 103 bp, Artificial Sequence
  Synthetic Polynucleotide
taatacgactcactatagggtttccttctctctcaggtcctcttcaagtgaacagaggagacacttgatgaggacctgaaacctggcggcagcgcaaaagatg

SEQ ID NO: 101412 - DNA, 103 bp, Artificial Sequence
  Synthetic Polynucleotide
taatacgactcactataggggcattggggttgatgccatccaggtcatctaacagaggagaagatgaatgggatggcataacctggcggcagcgcaaaagatg

SEQ ID NO: 101413 - DNA, 103 bp, Artificial Sequence
  Synthetic Polynucleotide
taatacgactcactataggggcaatttctctttccttctctctcaggtccaacagaggagaggacctatgagagaaggaaacctggcggcagcgcaaaagatg

SEQ ID NO: 101414 - DNA, 103 bp, Artificial Sequence
  Synthetic Polynucleotide
taatacgactcactatagggcttctctgtagcaatttctctttccttctcaacagaggagagagaagatgagagaaattaacctggcggcagcgcaaaagatg

SEQ ID NO: 101415 - DNA, 103 bp, Artificial Sequence
  Synthetic Polynucleotide
taatacgactcactataggggactatttttcttctctgtagcaatttctcaacagaggagagagaaaatgctacagagaaacctggcggcagcgcaaaagatg

SEQ ID NO: 101416 - DNA, 103 bp, Artificial Sequence
  Synthetic Polynucleotide
taatacgactcactatagggtccctctttagactatttttcttctctgtaaacagaggagatacagaatggaaaaatagaacctggcggcagcgcaaaagatg

SEQ ID NO: 101417 - DNA, 103 bp, Artificial Sequence
  Synthetic Polynucleotide
taatacgactcactatagggaatggctttatccctctttagactatttttaacagaggagaaaaaatatgctaaagaggaacctggcggcagcgcaaaagatg

SEQ ID NO: 101418 - DNA, 103 bp, Artificial Sequence
  Synthetic Polynucleotide
taatacgactcactatagggttaaaccctgaatggctttatccctctttaaacagaggagataaagaatgataaagccaaacctggcggcagcgcaaaagatg

SEQ ID NO: 101419 - DNA, 103 bp, Artificial Sequence
  Synthetic Polynucleotide
taatacgactcactatagggaatgccatggttaaaccctgaatggctttaaacagaggagataaagcatgtcagggtttaacctggcggcagcgcaaaagatg

SEQ ID NO: 101420 - DNA, 103 bp, Artificial Sequence
  Synthetic Polynucleotide
taatacgactcactatagggctttgattttaatgccatggttaaaccctgaacagaggagacagggtatgaccatggcaaacctggcggcagcgcaaaagatg

SEQ ID NO: 101421 - DNA, 103 bp, Artificial Sequence
  Synthetic Polynucleotide
taatacgactcactatagggcctttttttcctttgattttaatgccatggaacagaggagaccatggatgtaaaatcaaaacctggcggcagcgcaaaagatg

SEQ ID NO: 101422 - DNA, 103 bp, Artificial Sequence
  Synthetic Polynucleotide
taatacgactcactatagggagttcttcaacctttttttcctttgattttaacagaggagaaaaatcatgggaaaaaaaaacctggcggcagcgcaaaagatg

SEQ ID NO: 101423 - DNA, 103 bp, Artificial Sequence
  Synthetic Polynucleotide
taatacgactcactataggggcactccaccgagtcgtactgctttgccataacagaggagaatggcaatgcagtacgacaacctggcggcagcgcaaaagatg

SEQ ID NO: 101424 - DNA, 103 bp, Artificial Sequence
  Synthetic Polynucleotide
taatacgactcactatagggcttgcggtgcctggccttgaacacctccccaacagaggagaggggagatgttcaaggccaacctggcggcagcgcaaaagatg

SEQ ID NO: 101425 - DNA, 103 bp, Artificial Sequence
  Synthetic Polynucleotide
taatacgactcactatagggtgccaagtactcgaacatggacgtcaggtgaacagaggagacacctgatgtccatgttcaacctggcggcagcgcaaaagatg

SEQ ID NO: 101426 - DNA, 103 bp, Artificial Sequence
  Synthetic Polynucleotide
taatacgactcactatagggggcgcggtggtgccaagtactcgaacatggaacagaggagaccatgtatgagtacttggaacctggcggcagcgcaaaagatg

SEQ ID NO: 101427 - DNA, 103 bp, Artificial Sequence
  Synthetic Polynucleotide
taatacgactcactatagggctgcccttccggcgcggtggtgccaagtacaacagaggagagtacttatgaccaccgcgaacctggcggcagcgcaaaagatg

SEQ ID NO: 101428 - DNA, 103 bp, Artificial Sequence
  Synthetic Polynucleotide
taatacgactcactatagggggtgatctggctgcccttccggcgcggtggaacagaggagaccaccgatgcggaagggcaacctggcggcagcgcaaaagatg

SEQ ID NO: 101429 - DNA, 103 bp, Artificial Sequence
  Synthetic Polynucleotide
taatacgactcactatagggtggactgctgggtgatctggctgcccttccaacagaggagaggaaggatggccagatcaaacctggcggcagcgcaaaagatg

SEQ ID NO: 101430 - DNA, 103 bp, Artificial Sequence
  Synthetic Polynucleotide
taatacgactcactatagggctctggttggtggactgctgggtgatctggaacagaggagaccagatatgccagcagtcaacctggcggcagcgcaaaagatg

SEQ ID NO: 101431 - DNA, 103 bp, Artificial Sequence
  Synthetic Polynucleotide
taatacgactcactataggggggattgcgactctggttggtggactgctgaacagaggagacagcagatgaccaaccagaacctggcggcagcgcaaaagatg

SEQ ID NO: 101432 - DNA, 103 bp, Artificial Sequence
  Synthetic Polynucleotide
taatacgactcactatagggtggtggtggcgggattgcgactctggttggaacagaggagaccaaccatggtcgcaatcaacctggcggcagcgcaaaagatg

SEQ ID NO: 101433 - DNA, 103 bp, Artificial Sequence
  Synthetic Polynucleotide
taatacgactcactatagggtccgtctggttggtggtggcgggattgcgaaacagaggagatcgcaaatgcgccaccacaacctggcggcagcgcaaaagatg

SEQ ID NO: 101434 - DNA, 103 bp, Artificial Sequence
  Synthetic Polynucleotide
taatacgactcactataggggcgctcaaactccgtctggttggtggtggcaacagaggagagccaccatgaaccagacgaacctggcggcagcgcaaaagatg

SEQ ID NO: 101435 - DNA, 103 bp, Artificial Sequence
  Synthetic Polynucleotide
taatacgactcactatagggtctggccggtcttgcggtgcctggccttgaaacagaggagatcaaggatgggcaccgcaaacctggcggcagcgcaaaagatg

SEQ ID NO: 101436 - DNA, 103 bp, Artificial Sequence
  Synthetic Polynucleotide
taatacgactcactatagggagagccaccttctggccggtcttgcggtgcaacagaggagagcaccgatggaccggccaaacctggcggcagcgcaaaagatg

SEQ ID NO: 101437 - DNA, 103 bp, Artificial Sequence
  Synthetic Polynucleotide
taatacgactcactatagggcaccttcttcagagccaccttctggccggtaacagaggagaaccggcatgaaggtggctaacctggcggcagcgcaaaagatg

SEQ ID NO: 101438 - DNA, 103 bp, Artificial Sequence
  Synthetic Polynucleotide
taatacgactcactatagggtttccatcagcaccttcttcagagccacctaacagaggagaaggtggatgtgaagaaggaacctggcggcagcgcaaaagatg

SEQ ID NO: 101439 - DNA, 103 bp, Artificial Sequence
  Synthetic Polynucleotide
taatacgactcactatagggtccttctcgttttccatcagcaccttcttcaacagaggagagaagaaatggctgatggaaacctggcggcagcgcaaaagatg

SEQ ID NO: 101440 - DNA, 103 bp, Artificial Sequence
  Synthetic Polynucleotide
taatacgactcactatagggggggaacccctccttctcgttttccatcagaacagaggagactgatgatgaacgagaagaacctggcggcagcgcaaaagatg

SEQ ID NO: 101441 - DNA, 103 bp, Artificial Sequence
  Synthetic Polynucleotide
taatacgactcactatagggaggctgtaatggggaacccctccttctcgtaacagaggagaacgagaatgaggggttccaacctggcggcagcgcaaaagatg

SEQ ID NO: 101442 - DNA, 103 bp, Artificial Sequence
  Synthetic Polynucleotide
taatacgactcactatagggatctcccgcaaggctgtaatggggaaccccaacagaggagaggggttatgcattacagcaacctggcggcagcgcaaaagatg

SEQ ID NO: 101443 - DNA, 103 bp, Artificial Sequence
  Synthetic Polynucleotide
taatacgactcactatagggaaggatcttgatctcccgcaaggctgtaataacagaggagaattacaatgttgcgggagaacctggcggcagcgcaaaagatg

SEQ ID NO: 101444 - DNA, 103 bp, Artificial Sequence
  Synthetic Polynucleotide
taatacgactcactatagggcacaaaaagggcactccaccgagtcgtactaacagaggagaagtacgatgcggtggagtaacctggcggcagcgcaaaagatg

SEQ ID NO: 101445 - DNA, 103 bp, Artificial Sequence
  Synthetic Polynucleotide
taatacgactcactatagggttagaagctgaaggatcttgatctcccgcaaacagaggagatgcgggatgtcaagatccaacctggcggcagcgcaaaagatg

SEQ ID NO: 101446 - DNA, 103 bp, Artificial Sequence
  Synthetic Polynucleotide
taatacgactcactatagggttctcgtgttttagaagctgaaggatcttgaacagaggagacaagatatgtcagcttctaacctggcggcagcgcaaaagatg

SEQ ID NO: 101447 - DNA, 103 bp, Artificial Sequence
  Synthetic Polynucleotide
taatacgactcactataggggttgaccacattctcgtgttttagaagctgaacagaggagacagcttatgaaacacgagaacctggcggcagcgcaaaagatg

SEQ ID NO: 101448 - DNA, 103 bp, Artificial Sequence
  Synthetic Polynucleotide
taatacgactcactatagggtctcaatcaagttgaccacattctcgtgttaacagaggagaaacacgatgatgtggtcaaacctggcggcagcgcaaaagatg

SEQ ID NO: 101449 - DNA, 103 bp, Artificial Sequence
  Synthetic Polynucleotide
taatacgactcactataggggttcgacaaatctcaatcaagttgaccacaaacagaggagatgtggtatgcttgattgaaacctggcggcagcgcaaaagatg

SEQ ID NO: 101450 - DNA, 103 bp, Artificial Sequence
  Synthetic Polynucleotide
taatacgactcactatagggggaagctttggttcgacaaatctcaatcaaaacagaggagattgattatgatttgtcgaaacctggcggcagcgcaaaagatg

SEQ ID NO: 101451 - DNA, 103 bp, Artificial Sequence
  Synthetic Polynucleotide
taatacgactcactatagggggttatagggggaagctttggttcgacaaaaacagaggagatttgtcatgccaaagcttaacctggcggcagcgcaaaagatg

SEQ ID NO: 101452 - DNA, 103 bp, Artificial Sequence
  Synthetic Polynucleotide
taatacgactcactatagggcccttgcagcggttatagggggaagctttgaacagaggagacaaagcatgcccctataaaacctggcggcagcgcaaaagatg

SEQ ID NO: 101453 - DNA, 103 bp, Artificial Sequence
  Synthetic Polynucleotide
taatacgactcactataggggtatatactacccttgcagcggttatagggaacagaggagaccctatatgcgctgcaagaacctggcggcagcgcaaaagatg

SEQ ID NO: 101454 - DNA, 103 bp, Artificial Sequence
  Synthetic Polynucleotide
taatacgactcactatagggcgaacaccaggtatatactacccttgcagcaacagaggagagctgcaatggtagtatataacctggcggcagcgcaaaagatg

SEQ ID NO: 101455 - DNA, 103 bp, Artificial Sequence
  Synthetic Polynucleotide
taatacgactcactataggggaaacttcatcacaaaaagggcactccaccaacagaggagaggtggaatgccctttttgaacctggcggcagcgcaaaagatg

SEQ ID NO: 101456 - DNA, 103 bp, Artificial Sequence
  Synthetic Polynucleotide
taatacgactcactatagggtcgcagaagtcgaacaccaggtatatactaaacagaggagatagtatatgcctggtgttaacctggcggcagcgcaaaagatg

SEQ ID NO: 101457 - DNA, 103 bp, Artificial Sequence
  Synthetic Polynucleotide
taatacgactcactatagggaaggtcatgctcgcagaagtcgaacaccagaacagaggagactggtgatggacttctgcaacctggcggcagcgcaaaagatg

SEQ ID NO: 101458 - DNA, 103 bp, Artificial Sequence
  Synthetic Polynucleotide
taatacgactcactatagggacagcccagcaaggtcatgctcgcagaagtaacagaggagaacttctatgagcatgaccaacctggcggcagcgcaaaagatg

SEQ ID NO: 101459 - DNA, 103 bp, Artificial Sequence
  Synthetic Polynucleotide
taatacgactcactatagggacattgctcaacagcccagcaaggtcatgcaacagaggagagcatgaatgtgctgggctaacctggcggcagcgcaaaagatg

SEQ ID NO: 101460 - DNA, 103 bp, Artificial Sequence
  Synthetic Polynucleotide
taatacgactcactatagggcttgaccaaaacattgctcaacagcccagcaacagaggagagctgggatgttgagcaataacctggcggcagcgcaaaagatg

SEQ ID NO: 101461 - DNA, 103 bp, Artificial Sequence
  Synthetic Polynucleotide
taatacgactcactatagggacagcgtgaacttgaccaaaacattgctcaaacagaggagatgagcaatgttttggtcaaacctggcggcagcgcaaaagatg

SEQ ID NO: 101462 - DNA, 103 bp, Artificial Sequence
  Synthetic Polynucleotide
taatacgactcactatagggttgatctcagacagcgtgaacttgaccaaaaacagaggagatttggtatggttcacgctaacctggcggcagcgcaaaagatg

SEQ ID NO: 101463 - DNA, 103 bp, Artificial Sequence
  Synthetic Polynucleotide
taatacgactcactatagggcatcaccctcttgatctcagacagcgtgaaaacagaggagattcacgatgtctgagatcaacctggcggcagcgcaaaagatg

SEQ ID NO: 101464 - DNA, 103 bp, Artificial Sequence
  Synthetic Polynucleotide
taatacgactcactataggggcagcatctgcatcaccctcttgatctcagaacagaggagactgagaatgagagggtgaaacctggcggcagcgcaaaagatg

SEQ ID NO: 101465 - DNA, 103 bp, Artificial Sequence
  Synthetic Polynucleotide
taatacgactcactatagggaggccgttaagcagcatctgcatcaccctcaacagaggagagagggtatggcagatgctaacctggcggcagcgcaaaagatg

SEQ ID NO: 101466 - DNA, 103 bp, Artificial Sequence
  Synthetic Polynucleotide
taatacgactcactatagggctcgtatttggaaacttcatcacaaaaaggaacagaggagaccttttatggatgaagttaacctggcggcagcgcaaaagatg

SEQ ID NO: 101467 - DNA, 103 bp, Artificial Sequence
  Synthetic Polynucleotide
taatacgactcactataggggatgtagtagaggccgttaagcagcatctgaacagaggagacagatgatgcttaacggcaacctggcggcagcgcaaaagatg

SEQ ID NO: 101468 - DNA, 103 bp, Artificial Sequence
  Synthetic Polynucleotide
taatacgactcactatagggtgtttctgtggatgtagtagaggccgttaaaacagaggagattaacgatgtctactacaaacctggcggcagcgcaaaagatg

SEQ ID NO: 101469 - DNA, 103 bp, Artificial Sequence
  Synthetic Polynucleotide
taatacgactcactatagggtgcaggatcttgtttctgtggatgtagtagaacagaggagactactaatgccacagaaaaacctggcggcagcgcaaaagatg

SEQ ID NO: 101470 - DNA, 103 bp, Artificial Sequence
  Synthetic Polynucleotide
taatacgactcactatagggcatgtccctatgcaggatcttgtttctgtgaacagaggagacacagaatgaagatcctgaacctggcggcagcgcaaaagatg

SEQ ID NO: 101471 - DNA, 103 bp, Artificial Sequence
  Synthetic Polynucleotide
taatacgactcactatagggtagcagccttcatgtccctatgcaggatctaacagaggagaagatccatgatagggacaaacctggcggcagcgcaaaagatg

SEQ ID NO: 101472 - DNA, 103 bp, Artificial Sequence
  Synthetic Polynucleotide
taatacgactcactatagggataagcacattagcagccttcatgtccctaaacagaggagatagggaatggaaggctgcaacctggcggcagcgcaaaagatg

SEQ ID NO: 101473 - DNA, 103 bp, Artificial Sequence
  Synthetic Polynucleotide
taatacgactcactatagggatcacgagtgataagcacattagcagccttaacagaggagaaaggctatgaatgtgcttaacctggcggcagcgcaaaagatg

SEQ ID NO: 101474 - DNA, 103 bp, Artificial Sequence
  Synthetic Polynucleotide
taatacgactcactatagggtcaggaccccatcacgagtgataagcacataacagaggagaatgtgcatgtcactcgtgaacctggcggcagcgcaaaagatg

SEQ ID NO: 101475 - DNA, 103 bp, Artificial Sequence
  Synthetic Polynucleotide
taatacgactcactatagggtctgccagcttcaggaccccatcacgagtgaacagaggagacactcgatgtggggtcctaacctggcggcagcgcaaaagatg

SEQ ID NO: 101476 - DNA, 103 bp, Artificial Sequence
  Synthetic Polynucleotide
taatacgactcactatagggcagcccaaagtctgccagcttcaggaccccaacagaggagaggggtcatgaagctggcaaacctggcggcagcgcaaaagatg

SEQ ID NO: 101477 - DNA, 103 bp, Artificial Sequence
  Synthetic Polynucleotide
taatacgactcactatagggtggcgagcttctcgtatttggaaacttcataacagaggagaatgaagatgccaaatacgaacctggcggcagcgcaaaagatg

SEQ ID NO: 101478 - DNA, 103 bp, Artificial Sequence
  Synthetic Polynucleotide
taatacgactcactatagggaggcccgggccagcccaaagtctgccagctaacagaggagaagctggatgactttgggcaacctggcggcagcgcaaaagatg

SEQ ID NO: 101479 - DNA, 103 bp, Artificial Sequence
  Synthetic Polynucleotide
taatacgactcactataggggccaggctgaaggcccgggccagcccaaagaacagaggagactttggatgggcccgggcaacctggcggcagcgcaaaagatg

SEQ ID NO: 101480 - DNA, 103 bp, Artificial Sequence
  Synthetic Polynucleotide
taatacgactcactataggggctgttcttggccaggctgaaggcccgggcaacagaggagagcccggatgttcagcctgaacctggcggcagcgcaaaagatg

SEQ ID NO: 101481 - DNA, 103 bp, Artificial Sequence
  Synthetic Polynucleotide
taatacgactcactatagggggttgggctggctgttcttggccaggctgaaacagaggagatcagccatgccaagaacaaacctggcggcagcgcaaaagatg

SEQ ID NO: 101482 - DNA, 103 bp, Artificial Sequence
  Synthetic Polynucleotide
taatacgactcactatagggttggtgtagcggttgggctggctgttcttgaacagaggagacaagaaatgccagcccaaaacctggcggcagcgcaaaagatg

SEQ ID NO: 101483 - DNA, 103 bp, Artificial Sequence
  Synthetic Polynucleotide
taatacgactcactatagggcaccacacggttggtgtagcggttgggctgaacagaggagacagcccatgcgctacaccaacctggcggcagcgcaaaagatg

SEQ ID NO: 101484 - DNA, 103 bp, Artificial Sequence
  Synthetic Polynucleotide
taatacgactcactatagggaccagagtgtcaccacacggttggtgtagcaacagaggagagctacaatgaccgtgtggaacctggcggcagcgcaaaagatg

SEQ ID NO: 101485 - DNA, 103 bp, Artificial Sequence
  Synthetic Polynucleotide
taatacgactcactataggggggggccggtaccagagtgtcaccacacggaacagaggagaccgtgtatggacactctgaacctggcggcagcgcaaaagatg

SEQ ID NO: 101486 - DNA, 103 bp, Artificial Sequence
  Synthetic Polynucleotide
taatacgactcactatagggcaacagctccgggggccggtaccagagtgtaacagaggagaacactcatgtaccggcccaacctggcggcagcgcaaaagatg

SEQ ID NO: 101487 - DNA, 103 bp, Artificial Sequence
  Synthetic Polynucleotide
taatacgactcactataggggctccccgagcaacagctccgggggccggtaacagaggagaaccggcatgcggagctgtaacctggcggcagcgcaaaagatg

SEQ ID NO: 101488 - DNA, 103 bp, Artificial Sequence
  Synthetic Polynucleotide
taatacgactcactatagggtggccgatcttggcgagcttctcgtatttgaacagaggagacaaataatggaagctcgcaacctggcggcagcgcaaaagatg

SEQ ID NO: 101489 - DNA, 103 bp, Artificial Sequence
  Synthetic Polynucleotide
taatacgactcactatagggccgtagtcccgctccccgagcaacagctccaacagaggagaggagctatggctcggggaaacctggcggcagcgcaaaagatg

SEQ ID NO: 101490 - DNA, 103 bp, Artificial Sequence
  Synthetic Polynucleotide
taatacgactcactatagggaatgggggggccgtagtcccgctccccgagaacagaggagactcgggatgcgggactacaacctggcggcagcgcaaaagatg

SEQ ID NO: 101491 - DNA, 103 bp, Artificial Sequence
  Synthetic Polynucleotide
taatacgactcactatagggcccacaggtcaatgggggggccgtagtcccaacagaggagagggactatggcccccccaaacctggcggcagcgcaaaagatg

SEQ ID NO: 101492 - DNA, 103 bp, Artificial Sequence
  Synthetic Polynucleotide
taatacgactcactatagggcacccagcaccccacaggtcaatgggggggaacagaggagaccccccatgtgacctgtgaacctggcggcagcgcaaaagatg

SEQ ID NO: 101493 - DNA, 103 bp, Artificial Sequence
  Synthetic Polynucleotide
taatacgactcactatagggtgccatgatgcacccagcaccccacaggtcaacagaggagagacctgatgggtgctgggaacctggcggcagcgcaaaagatg

SEQ ID NO: 101494 - DNA, 103 bp, Artificial Sequence
  Synthetic Polynucleotide
taatacgactcactatagggtccacatctctgccatgatgcacccagcacaacagaggagagtgctgatggcatcatggaacctggcggcagcgcaaaagatg

SEQ ID NO: 101495 - DNA, 103 bp, Artificial Sequence
  Synthetic Polynucleotide
taatacgactcactataggggggctgcgggtccacatctctgccatgatgaacagaggagacatcatatgagagatgtgaacctggcggcagcgcaaaagatg

SEQ ID NO: 101496 - DNA, 103 bp, Artificial Sequence
  Synthetic Polynucleotide
taatacgactcactatagggctgcatgatggggctgcgggtccacatctcaacagaggagagagatgatgacccgcagcaacctggcggcagcgcaaaagatg

SEQ ID NO: 101497 - DNA, 103 bp, Artificial Sequence
  Synthetic Polynucleotide
taatacgactcactatagggccgtgttgccctgcatgatggggctgcgggaacagaggagacccgcaatgccatcatgcaacctggcggcagcgcaaaagatg

SEQ ID NO: 101498 - DNA, 103 bp, Artificial Sequence
  Synthetic Polynucleotide
taatacgactcactatagggtggtgctgctccgtgttgccctgcatgatgaacagaggagacatcatatggggcaacacaacctggcggcagcgcaaaagatg

SEQ ID NO: 101499 - DNA, 103 bp, Artificial Sequence
  Synthetic Polynucleotide
taatacgactcactataggggaaggtgccttggccgatcttggcgagcttaacagaggagaaagctcatgaagatcggcaacctggcggcagcgcaaaagatg

SEQ ID NO: 101500 - DNA, 103 bp, Artificial Sequence
  Synthetic Polynucleotide
taatacgactcactataggggagggcgagttggtgctgctccgtgttgccaacagaggagaggcaacatggagcagcacaacctggcggcagcgcaaaagatg

SEQ ID NO: 101501 - DNA, 103 bp, Artificial Sequence
  Synthetic Polynucleotide
taatacgactcactataggggctgactgatgagggcgagttggtgctgctaacagaggagaagcagcatgaactcgcccaacctggcggcagcgcaaaagatg

SEQ ID NO: 101502 - DNA, 103 bp, Artificial Sequence
  Synthetic Polynucleotide
taatacgactcactataggggagccgcagagctgactgatgagggcgagtaacagaggagaactcgcatgcatcagtcaaacctggcggcagcgcaaaagatg

SEQ ID NO: 101503 - DNA, 103 bp, Artificial Sequence
  Synthetic Polynucleotide
taatacgactcactatagggaggggtgatggagccgcagagctgactgataacagaggagaatcagtatgctctgcggcaacctggcggcagcgcaaaagatg

SEQ ID NO: 101504 - DNA, 103 bp, Artificial Sequence
  Synthetic Polynucleotide
taatacgactcactataggggccacacctcaggggtgatggagccgcagaaacagaggagatctgcgatgccatcacccaacctggcggcagcgcaaaagatg

SEQ ID NO: 101505 - DNA, 103 bp, Artificial Sequence
  Synthetic Polynucleotide
taatacgactcactatagggtccacgtttggccacacctcaggggtgatgaacagaggagacatcacatgtgaggtgtgaacctggcggcagcgcaaaagatg

SEQ ID NO: 101506 - DNA, 103 bp, Artificial Sequence
  Synthetic Polynucleotide
taatacgactcactatagggctcatagttgtccacgtttggccacacctcaacagaggagagaggtgatgccaaacgtgaacctggcggcagcgcaaaagatg

SEQ ID NO: 101507 - DNA, 103 bp, Artificial Sequence
  Synthetic Polynucleotide
taatacgactcactatagggtttcgtacagctcatagttgtccacgtttgaacagaggagacaaacgatgacaactatgaacctggcggcagcgcaaaagatg

SEQ ID NO: 101508 - DNA, 103 bp, Artificial Sequence
  Synthetic Polynucleotide
taatacgactcactatagggagctccagcttttcgtacagctcatagttgaacagaggagacaactaatggctgtacgaaacctggcggcagcgcaaaagatg

SEQ ID NO: 101509 - DNA, 103 bp, Artificial Sequence
  Synthetic Polynucleotide
taatacgactcactataggggcccttgaccagctccagcttttcgtacagaacagaggagactgtacatgaagctggagaacctggcggcagcgcaaaagatg

SEQ ID NO: 101510 - DNA, 103 bp, Artificial Sequence
  Synthetic Polynucleotide
taatacgactcactatagggacacctccccgaaggtgccttggccgatctaacagaggagaagatcgatgaaggcacctaacctggcggcagcgcaaaagatg

SEQ ID NO: 101511 - DNA, 103 bp, Artificial Sequence
  Synthetic Polynucleotide
taatacgactcactatagggtccgcttctggcccttgaccagctccagctaacagaggagaagctggatgtggtcaaggaacctggcggcagcgcaaaagatg

SEQ ID NO: 101512 - DNA, 103 bp, Artificial Sequence
  Synthetic Polynucleotide
taatacgactcactatagggtccttcaccttccgcttctggcccttgaccaacagaggagaggtcaaatgccagaagcgaacctggcggcagcgcaaaagatg

SEQ ID NO: 101513 - DNA, 103 bp, Artificial Sequence
  Synthetic Polynucleotide
taatacgactcactatagggcttcagcctgtccttcaccttccgcttctgaacagaggagacagaagatgaaggtgaagaacctggcggcagcgcaaaagatg

SEQ ID NO: 101514 - DNA, 103 bp, Artificial Sequence
  Synthetic Polynucleotide
taatacgactcactataggggcacataggccttcagcctgtccttcacctaacagaggagaaggtgaatgacaggctgaaacctggcggcagcgcaaaagatg

SEQ ID NO: 101515 - DNA, 103 bp, Artificial Sequence
  Synthetic Polynucleotide
taatacgactcactatagggtatgggtcacgcacataggccttcagcctgaacagaggagacaggctatgggcctatgtaacctggcggcagcgcaaaagatg

SEQ ID NO: 101516 - DNA, 103 bp, Artificial Sequence
  Synthetic Polynucleotide
taatacgactcactataggggtccagtgcgtatgggtcacgcacataggcaacagaggagagcctatatgcgtgacccaaacctggcggcagcgcaaaagatg

SEQ ID NO: 101517 - DNA, 103 bp, Artificial Sequence
  Synthetic Polynucleotide
taatacgactcactatagggtgtcgatgaggtccagtgcgtatgggtcacaacagaggagagtgaccatgacgcactggaacctggcggcagcgcaaaagatg

SEQ ID NO: 101518 - DNA, 103 bp, Artificial Sequence
  Synthetic Polynucleotide
taatacgactcactatagggaccagcagcttgtcgatgaggtccagtgcgaacagaggagacgcactatgcctcatcgaaacctggcggcagcgcaaaagatg

SEQ ID NO: 101519 - DNA, 103 bp, Artificial Sequence
  Synthetic Polynucleotide
taatacgactcactatagggagggtccagcaccagcagcttgtcgatgagaacagaggagactcatcatgaagctgctgaacctggcggcagcgcaaaagatg

SEQ ID NO: 101520 - DNA, 103 bp, Artificial Sequence
  Synthetic Polynucleotide
taatacgactcactatagggtgcgctgggcagggtccagcaccagcagctaacagaggagaagctgcatgtgctggaccaacctggcggcagcgcaaaagatg

SEQ ID NO: 101521 - DNA, 103 bp, Artificial Sequence
  Synthetic Polynucleotide
taatacgactcactatagggctggccttgaacacctccccgaaggtgcctaacagaggagaaggcacatgcggggaggtaacctggcggcagcgcaaaagatg

SEQ ID NO: 101522 - DNA, 103 bp, Artificial Sequence
  Synthetic Polynucleotide
taatacgactcactatagggtcgctgtcgatgcgctgggcagggtccagcaacagaggagagctggaatgtgcccagcgaacctggcggcagcgcaaaagatg

SEQ ID NO: 101523 - DNA, 103 bp, Artificial Sequence
  Synthetic Polynucleotide
taatacgactcactataggggagggcgtcatcgctgtcgatgcgctgggcaacagaggagagcccagatgatcgacagcaacctggcggcagcgcaaaagatg

SEQ ID NO: 101524 - DNA, 103 bp, Artificial Sequence
  Synthetic Polynucleotide
taatacgactcactatagggagtcgtggttgagggcgtcatcgctgtcgaaacagaggagatcgacaatgatgacgcccaacctggcggcagcgcaaaagatg

SEQ ID NO: 101525 - DNA, 103 bp, Artificial Sequence
  Synthetic Polynucleotide
taatacgactcactataggggaccagaagaagtcgtggttgagggcgtcaaacagaggagatgacgcatgcaaccacgaaacctggcggcagcgcaaaagatg

SEQ ID NO: 101526 - DNA, 103 bp, Artificial Sequence
  Synthetic Polynucleotide
taatacgactcactatagggcatggggtcggaccagaagaagtcgtggttaacagaggagaaaccacatgttcttctggaacctggcggcagcgcaaaagatg

SEQ ID NO: 101527 - DNA, 103 bp, Artificial Sequence
  Synthetic Polynucleotide
taatacgactcactatagggggtcggagggcatggggtcggaccagaagaaacagaggagatcttctatgccgaccccaaacctggcggcagcgcaaaagatg

SEQ ID NO: 101528 - DNA, 103 bp, Artificial Sequence
  Synthetic Polynucleotide
taatacgactcactatagggatgcccttgaggtcggagggcatggggtcgaacagaggagacgacccatggccctccgaaacctggcggcagcgcaaaagatg

SEQ ID NO: 101529 - DNA, 103 bp, Artificial Sequence
  Synthetic Polynucleotide
taatacgactcactatagggggtggagagcatgcccttgaggtcggagggaacagaggagaccctccatgctcaagggcaacctggcggcagcgcaaaagatg

SEQ ID NO: 101530 - DNA, 103 bp, Artificial Sequence
  Synthetic Polynucleotide
taatacgactcactatagggacgtcaggtgggtggagagcatgcccttgaaacagaggagatcaaggatgtgctctccaaacctggcggcagcgcaaaagatg

SEQ ID NO: 101531 - DNA, 103 bp, Artificial Sequence
  Synthetic Polynucleotide
taatacgactcactatagggtcgaacatggacgtcaggtgggtggagagcaacagaggagagctctcatgccacctgacaacctggcggcagcgcaaaagatg

SEQ ID NO: 101532 - DNA, 103 bp, Artificial Sequence
  Synthetic Polynucleotide
taatacgactcactatagggatccttgtccagcacatagcccacatacataacagaggagaatgtatatgggctatgtgaacctggcggcagcgcaaaagatg

SEQ ID NO: 101533 - DNA, 103 bp, Artificial Sequence
  Synthetic Polynucleotide
taatacgactcactatagggcgggggcgccgggggcggggccggggggccaacagaggagaggccccatggccccgcccaacctggcggcagcgcaaaagatg

SEQ ID NO: 101534 - DNA, 103 bp, Artificial Sequence
  Synthetic Polynucleotide
taatacgactcactatagggcggggtactgcgggggcgccgggggcggggaacagaggagaccccgcatgcggcgccccaacctggcggcagcgcaaaagatg

SEQ ID NO: 101535 - DNA, 103 bp, Artificial Sequence
  Synthetic Polynucleotide
taatacgactcactatagggctggagaagtcggggtactgcgggggcgccaacagaggagaggcgccatggcagtacccaacctggcggcagcgcaaaagatg

SEQ ID NO: 101536 - DNA, 103 bp, Artificial Sequence
  Synthetic Polynucleotide
taatacgactcactataggggtgagagtagctggagaagtcggggtactgaacagaggagacagtacatggacttctccaacctggcggcagcgcaaaagatg

SEQ ID NO: 101537 - DNA, 103 bp, Artificial Sequence
  Synthetic Polynucleotide
taatacgactcactatagggccggctccacgtgagagtagctggagaagtaacagaggagaacttctatggctactctcaacctggcggcagcgcaaaagatg

SEQ ID NO: 101538 - DNA, 103 bp, Artificial Sequence
  Synthetic Polynucleotide
taatacgactcactatagggggcgcgggggccggctccacgtgagagtagaacagaggagactactcatgcgtggagccaacctggcggcagcgcaaaagatg

SEQ ID NO: 101539 - DNA, 103 bp, Artificial Sequence
  Synthetic Polynucleotide
taatacgactcactatagggggccgtcgggggcgcgggggccggctccacaacagaggagagtggagatggcccccgcgaacctggcggcagcgcaaaagatg

SEQ ID NO: 101540 - DNA, 103 bp, Artificial Sequence
  Synthetic Polynucleotide
taatacgactcactataggggcgccccccaggccgtcgggggcgcgggggaacagaggagacccccgatgccccgacggaacctggcggcagcgcaaaagatg

SEQ ID NO: 101541 - DNA, 103 bp, Artificial Sequence
  Synthetic Polynucleotide
taatacgactcactataggggcagggaagggcgccccccaggccgtcgggaacagaggagacccgacatgctggggggcaacctggcggcagcgcaaaagatg

SEQ ID NO: 101542 - DNA, 103 bp, Artificial Sequence
  Synthetic Polynucleotide
taatacgactcactataggggtccttgggcgcagggaagggcgccccccaaacagaggagatgggggatgcccttccctaacctggcggcagcgcaaaagatg

SEQ ID NO: 101543 - DNA, 103 bp, Artificial Sequence
  Synthetic Polynucleotide
taatacgactcactatagggacacgggcgaatccttgtccagcacatagcaacagaggagagctatgatgtggacaaggaacctggcggcagcgcaaaagatg

SEQ ID NO: 101544 - DNA, 103 bp, Artificial Sequence
  Synthetic Polynucleotide
taatacgactcactatagggcggcccagtcgtccttgggcgcagggaaggaacagaggagaccttccatgcgcccaaggaacctggcggcagcgcaaaagatg

SEQ ID NO: 101545 - DNA, 103 bp, Artificial Sequence
  Synthetic Polynucleotide
taatacgactcactatagggccgtaggcggcggcccagtcgtccttgggcaacagaggagagcccaaatgcgactgggcaacctggcggcagcgcaaaagatg

SEQ ID NO: 101546 - DNA, 103 bp, Artificial Sequence
  Synthetic Polynucleotide
taatacgactcactatagggggggcccgggccgtaggcggcggcccagtcaacagaggagagactggatggccgcctacaacctggcggcagcgcaaaagatg

SEQ ID NO: 101547 - DNA, 103 bp, Artificial Sequence
  Synthetic Polynucleotide
taatacgactcactatagggcaggggccgcggggcccgggccgtaggcggaacagaggagaccgcctatggcccgggccaacctggcggcagcgcaaaagatg

SEQ ID NO: 101548 - DNA, 103 bp, Artificial Sequence
  Synthetic Polynucleotide
taatacgactcactataggggggctggcggcaggggccgcggggcccgggaacagaggagacccgggatgcgcggccccaacctggcggcagcgcaaaagatg

SEQ ID NO: 101549 - DNA, 103 bp, Artificial Sequence
  Synthetic Polynucleotide
taatacgactcactatagggcagcgaagctgggctggcggcaggggccgcaacagaggagagcggccatggccgccagcaacctggcggcagcgcaaaagatg

SEQ ID NO: 101550 - DNA, 103 bp, Artificial Sequence
  Synthetic Polynucleotide
taatacgactcactataggggcccgaatgccagcgaagctgggctggcggaacagaggagaccgccaatgcagcttcgcaacctggcggcagcgcaaaagatg

SEQ ID NO: 101551 - DNA, 103 bp, Artificial Sequence
  Synthetic Polynucleotide
taatacgactcactatagggtctggagggggcccgaatgccagcgaagctaacagaggagaagcttcatgggcattcggaacctggcggcagcgcaaaagatg

SEQ ID NO: 101552 - DNA, 103 bp, Artificial Sequence
  Synthetic Polynucleotide
taatacgactcactatagggcgggctaaagtctggagggggcccgaatgcaacagaggagagcattcatgccccctccaaacctggcggcagcgcaaaagatg

SEQ ID NO: 101553 - DNA, 103 bp, Artificial Sequence
  Synthetic Polynucleotide
taatacgactcactataggggcgccggcaccgggctaaagtctggaggggaacagaggagacccctcatgactttagccaacctggcggcagcgcaaaagatg

SEQ ID NO: 101554 - DNA, 103 bp, Artificial Sequence
  Synthetic Polynucleotide
taatacgactcactataggggggccggggtacacgggcgaatccttgtccaacagaggagaggacaaatgttcgcccgtaacctggcggcagcgcaaaagatg

SEQ ID NO: 101555 - DNA, 103 bp, Artificial Sequence
  Synthetic Polynucleotide
taatacgactcactatagggggcccagggggcgccggcaccgggctaaagaacagaggagactttagatgggtgccggcaacctggcggcagcgcaaaagatg

SEQ ID NO: 101556 - DNA, 103 bp, Artificial Sequence
  Synthetic Polynucleotide
taatacgactcactataggggcccgggccgggcccagggggcgccggcacaacagaggagagtgccgatgccccctgggaacctggcggcagcgcaaaagatg

SEQ ID NO: 101557 - DNA, 103 bp, Artificial Sequence
  Synthetic Polynucleotide
taatacgactcactataggggcgccaggaggcccgggccgggcccaggggaacagaggagacccctgatgccggcccggaacctggcggcagcgcaaaagatg

SEQ ID NO: 101558 - DNA, 103 bp, Artificial Sequence
  Synthetic Polynucleotide
taatacgactcactatagggccgaggggctgcgccaggaggcccgggccgaacagaggagacggcccatgcctcctggcaacctggcggcagcgcaaaagatg

SEQ ID NO: 101559 - DNA, 103 bp, Artificial Sequence
  Synthetic Polynucleotide
taatacgactcactataggggcccgggcccccgaggggctgcgccaggagaacagaggagactcctgatgcagcccctcaacctggcggcagcgcaaaagatg

SEQ ID NO: 101560 - DNA, 103 bp, Artificial Sequence
  Synthetic Polynucleotide
taatacgactcactatagggaggacggtgtgcccgggcccccgaggggctaacagaggagaagccccatgggggcccggaacctggcggcagcgcaaaagatg

SEQ ID NO: 101561 - DNA, 103 bp, Artificial Sequence
  Synthetic Polynucleotide
taatacgactcactataggggctccgggcgaggacggtgtgcccgggcccaacagaggagagggcccatgcacaccgtcaacctggcggcagcgcaaaagatg

SEQ ID NO: 101562 - DNA, 103 bp, Artificial Sequence
  Synthetic Polynucleotide
taatacgactcactatagggcggcctctgcgctccgggcgaggacggtgtaacagaggagaacaccgatgtcgcccggaaacctggcggcagcgcaaaagatg

SEQ ID NO: 101563 - DNA, 103 bp, Artificial Sequence
  Synthetic Polynucleotide
taatacgactcactatagggcgtagggcgtcggcctctgcgctccgggcgaacagaggagacgcccgatgcgcagaggcaacctggcggcagcgcaaaagatg

SEQ ID NO: 101564 - DNA, 103 bp, Artificial Sequence
  Synthetic Polynucleotide
taatacgactcactatagggcgcatccactcgtagggcgtcggcctctgcaacagaggagagcagagatggacgccctaaacctggcggcagcgcaaaagatg

SEQ ID NO: 101565 - DNA, 103 bp, Artificial Sequence
  Synthetic Polynucleotide
taatacgactcactatagggtggcctggctgggccggggtacacgggcgaaacagaggagatcgcccatgtaccccggcaacctggcggcagcgcaaaagatg

SEQ ID NO: 101566 - DNA, 103 bp, Artificial Sequence
  Synthetic Polynucleotide
taatacgactcactatagggcacgctgcgccgcatccactcgtagggcgtaacagaggagaacgcccatggagtggatgaacctggcggcagcgcaaaagatg

SEQ ID NO: 101567 - DNA, 103 bp, Artificial Sequence
  Synthetic Polynucleotide
taatacgactcactatagggctccggccgccacgctgcgccgcatccactaacagaggagaagtggaatgggcgcagcgaacctggcggcagcgcaaaagatg

SEQ ID NO: 101568 - DNA, 103 bp, Artificial Sequence
  Synthetic Polynucleotide
taatacgactcactatagggccaccgccgcctccggccgccacgctgcgcaacagaggagagcgcagatgggcggccggaacctggcggcagcgcaaaagatg

SEQ ID NO: 101569 - DNA, 103 bp, Artificial Sequence
  Synthetic Polynucleotide
taatacgactcactatagggcttaccgctgccaccgccgcctccggccgcaacagaggagagcggccatgggcggcggtaacctggcggcagcgcaaaagatg

SEQ ID NO: 101570 - DNA, 103 bp, Artificial Sequence
  Synthetic Polynucleotide
taatacgactcactatagggtggtccgagtcttaccgctgccaccgccgcaacagaggagagcggcgatggcagcggtaaacctggcggcagcgcaaaagatg

SEQ ID NO: 101571 - DNA, 103 bp, Artificial Sequence
  Synthetic Polynucleotide
taatacgactcactatagggtacttgtccttggtccgagtcttaccgctgaacagaggagacagcggatggactcggacaacctggcggcagcgcaaaagatg

SEQ ID NO: 101572 - DNA, 103 bp, Artificial Sequence
  Synthetic Polynucleotide
taatacgactcactataggggaccacgcggtacttgtccttggtccgagtaacagaggagaactcggatgaaggacaagaacctggcggcagcgcaaaagatg

SEQ ID NO: 101573 - DNA, 103 bp, Artificial Sequence
  Synthetic Polynucleotide
taatacgactcactatagggggtcggtgtagaccacgcggtacttgtcctaacagaggagaaggacaatgaccgcgtggaacctggcggcagcgcaaaagatg

SEQ ID NO: 101574 - DNA, 103 bp, Artificial Sequence
  Synthetic Polynucleotide
taatacgactcactatagggaggcgttggtggtcggtgtagaccacgcggaacagaggagaccgcgtatgctacaccgaaacctggcggcagcgcaaaagatg

SEQ ID NO: 101575 - DNA, 103 bp, Artificial Sequence
  Synthetic Polynucleotide
taatacgactcactatagggctccagctccaggcgttggtggtcggtgtaaacagaggagatacaccatgcaccaacgcaacctggcggcagcgcaaaagatg

SEQ ID NO: 101576 - DNA, 103 bp, Artificial Sequence
  Synthetic Polynucleotide
taatacgactcactatagggcgaggctggctggcctggctgggccggggtaacagaggagaaccccgatgcagccaggcaacctggcggcagcgcaaaagatg

SEQ ID NO: 101577 - DNA, 103 bp, Artificial Sequence
  Synthetic Polynucleotide
taatacgactcactataggggaaactccttctccagctccaggcgttggtaacagaggagaaccaacatgtggagctggaacctggcggcagcgcaaaagatg

SEQ ID NO: 101578 - DNA, 103 bp, Artificial Sequence
  Synthetic Polynucleotide
taatacgactcactatagggcggctgtaatgaaactccttctccagctccaacagaggagaggagctatggaaggagttaacctggcggcagcgcaaaagatg

SEQ ID NO: 101579 - DNA, 103 bp, Artificial Sequence
  Synthetic Polynucleotide
taatacgactcactatagggtgtgatgtaacggctgtaatgaaactccttaacagaggagaaaggagatgcattacagcaacctggcggcagcgcaaaagatg

SEQ ID NO: 101580 - DNA, 103 bp, Artificial Sequence
  Synthetic Polynucleotide
taatacgactcactatagggtccgccggattgtgatgtaacggctgtaataacagaggagaattacaatggttacatcaaacctggcggcagcgcaaaagatg

SEQ ID NO: 101581 - DNA, 103 bp, Artificial Sequence
  Synthetic Polynucleotide
taatacgactcactatagggagctctgatttccgccggattgtgatgtaaaacagaggagattacatatgaatccggcgaacctggcggcagcgcaaaagatg

SEQ ID NO: 101582 - DNA, 103 bp, Artificial Sequence
  Synthetic Polynucleotide
taatacgactcactatagggattggcagccagctctgatttccgccggataacagaggagaatccggatgaaatcagagaacctggcggcagcgcaaaagatg

SEQ ID NO: 101583 - DNA, 103 bp, Artificial Sequence
  Synthetic Polynucleotide
taatacgactcactatagggtgagccccagattggcagccagctctgattaacagaggagaaatcagatgtggctgccaaacctggcggcagcgcaaaagatg

SEQ ID NO: 101584 - DNA, 103 bp, Artificial Sequence
  Synthetic Polynucleotide
taatacgactcactatagggtgccgttcagtgagccccagattggcagccaacagaggagaggctgcatgtctggggctaacctggcggcagcgcaaaagatg

SEQ ID NO: 101585 - DNA, 103 bp, Artificial Sequence
  Synthetic Polynucleotide
taatacgactcactataggggatcttcacctgccgttcagtgagccccagaacagaggagactggggatgactgaacggaacctggcggcagcgcaaaagatg

SEQ ID NO: 101586 - DNA, 103 bp, Artificial Sequence
  Synthetic Polynucleotide
taatacgactcactatagggtttggaaccagatcttcacctgccgttcagaacagaggagactgaacatgaggtgaagaaacctggcggcagcgcaaaagatg

SEQ ID NO: 101587 - DNA, 103 bp, Artificial Sequence
  Synthetic Polynucleotide
taatacgactcactataggggggcccaggccgaggctggctggcctggctaacagaggagaagccagatgagccagcctaacctggcggcagcgcaaaagatg

SEQ ID NO: 101588 - DNA, 103 bp, Artificial Sequence
  Synthetic Polynucleotide
taatacgactcactataggggcccgccggttttggaaccagatcttcaccaacagaggagaggtgaaatgctggttccaaacctggcggcagcgcaaaagatg

SEQ ID NO: 101589 - DNA, 103 bp, Artificial Sequence
  Synthetic Polynucleotide
taatacgactcactataggggcgctcctttgcccgccggttttggaaccaaacagaggagatggttcatgaaccggcggaacctggcggcagcgcaaaagatg

SEQ ID NO: 101590 - DNA, 103 bp, Artificial Sequence
  Synthetic Polynucleotide
taatacgactcactatagggtgttcactttgcgctcctttgcccgccggtaacagaggagaaccggcatgcaaaggagcaacctggcggcagcgcaaaagatg

SEQ ID NO: 101591 - DNA, 103 bp, Artificial Sequence
  Synthetic Polynucleotide
taatacgactcactatagggtgtttcttcttgttcactttgcgctcctttaacagaggagaaaaggaatgcaaagtgaaaacctggcggcagcgcaaaagatg

SEQ ID NO: 101592 - DNA, 103 bp, Artificial Sequence
  Synthetic Polynucleotide
taatacgactcactatagggttgctgctgctgtttcttcttgttcactttaacagaggagaaaagtgatgaagaagaaaaacctggcggcagcgcaaaagatg

SEQ ID NO: 101593 - DNA, 103 bp, Artificial Sequence
  Synthetic Polynucleotide
taatacgactcactataggggtgggggctgttgctgctgctgtttcttctaacagaggagaagaagaatgagcagcagcaacctggcggcagcgcaaaagatg

SEQ ID NO: 101594 - DNA, 103 bp, Artificial Sequence
  Synthetic Polynucleotide
taatacgactcactatagggatcggcggctgtgggggctgttgctgctgcaacagaggagagcagcaatgacagcccccaacctggcggcagcgcaaaagatg

SEQ ID NO: 101595 - DNA, 103 bp, Artificial Sequence
  Synthetic Polynucleotide
taatacgactcactataggggtcgtgggccatcggcggctgtgggggctgaacagaggagacagcccatgcagccgccgaacctggcggcagcgcaaaagatg

SEQ ID NO: 101596 - DNA, 103 bp, Artificial Sequence
  Synthetic Polynucleotide
taatacgactcactatagggtggccgtgatgtcgtgggccatcggcggctaacagaggagaagccgcatgtggcccacgaacctggcggcagcgcaaaagatg

SEQ ID NO: 101597 - DNA, 103 bp, Artificial Sequence
  Synthetic Polynucleotide
taatacgactcactatagggccggctggggtggccgtgatgtcgtgggccaacagaggagaggcccaatgcatcacggcaacctggcggcagcgcaaaagatg

SEQ ID NO: 101598 - DNA, 103 bp, Artificial Sequence
  Synthetic Polynucleotide
taatacgactcactataggggtaggcttgcgggcccaggccgaggctggcaacagaggagagccagcatgggcctgggcaacctggcggcagcgcaaaagatg

SEQ ID NO: 101599 - DNA, 103 bp, Artificial Sequence
  Synthetic Polynucleotide
taatacgactcactatagggcagggatggcccggctggggtggccgtgataacagaggagaatcacgatgaccccagccaacctggcggcagcgcaaaagatg

SEQ ID NO: 101600 - DNA, 103 bp, Artificial Sequence
  Synthetic Polynucleotide
taatacgactcactatagggacaggccccccagggatggcccggctggggaacagaggagaccccagatgggccatcccaacctggcggcagcgcaaaagatg

SEQ ID NO: 101601 - DNA, 103 bp, Artificial Sequence
  Synthetic Polynucleotide
taatacgactcactatagggttgctgggacacaggccccccagggatggcaacagaggagagccatcatgggggggcctaacctggcggcagcgcaaaagatg

SEQ ID NO: 101602 - DNA, 103 bp, Artificial Sequence
  Synthetic Polynucleotide
taatacgactcactataggggaggctggtgttgctgggacacaggcccccaacagaggagagggggcatgtgtcccagcaacctggcggcagcgcaaaagatg

SEQ ID NO: 101603 - DNA, 103 bp, Artificial Sequence
  Synthetic Polynucleotide
taatacgactcactatagggaggtggccaggaggctggtgttgctgggacaacagaggagagtcccaatgacaccagccaacctggcggcagcgcaaaagatg

SEQ ID NO: 101604 - DNA, 103 bp, Artificial Sequence
  Synthetic Polynucleotide
taatacgactcactatagggattggagaggaggtggccaggaggctggtgaacagaggagacaccagatgcctggccacaacctggcggcagcgcaaaagatg

SEQ ID NO: 101605 - DNA, 103 bp, Artificial Sequence
  Synthetic Polynucleotide
taatacgactcactatagggtttcacaggcattggagaggaggtggccagaacagaggagactggccatgtcctctccaaacctggcggcagcgcaaaagatg

SEQ ID NO: 101606 - DNA, 103 bp, Artificial Sequence
  Synthetic Polynucleotide
taatacgactcactataggggaaactcctctttcacaggcattggagaggaacagaggagacctctcatgtgcctgtgaaacctggcggcagcgcaaaagatg

SEQ ID NO: 101607 - DNA, 103 bp, Artificial Sequence
  Synthetic Polynucleotide
taatacgactcactatagggccggggggccgtaggcttgcgggcccaggcaacagaggagagcctggatgcgcaagcctaacctggcggcagcgcaaaagatg

SEQ ID NO: 101608 - DNA, 103 bp, Artificial Sequence
  Synthetic Polynucleotide
taatacgactcactataggggggggcggggccggggggccgtaggcttgcaacagaggagagcaagcatgcggccccccaacctggcggcagcgcaaaagatg

SEQ ID NO: 101609 - DNA, 103 bp, Artificial Sequence
  Synthetic Polynucleotide
taatacgactcactataggggtccttgtccaggaggtagctcacgtacataacagaggagaatgtacatgagctacctcaacctggcggcagcgcaaaagatg

SEQ ID NO: 101610 - DNA, 103 bp, Artificial Sequence
  Synthetic Polynucleotide
taatacgactcactataggggtagtccgggtactgcggggggctgacgaaaacagaggagattcgtcatgcccccgcagaacctggcggcagcgcaaaagatg

SEQ ID NO: 101611 - DNA, 103 bp, Artificial Sequence
  Synthetic Polynucleotide
taatacgactcactatagggggtaaccgccgtagtccgggtactgcggggaacagaggagaccccgcatgacccggactaacctggcggcagcgcaaaagatg

SEQ ID NO: 101612 - DNA, 103 bp, Artificial Sequence
  Synthetic Polynucleotide
taatacgactcactataggggccgccacgtggtaaccgccgtagtccgggaacagaggagacccggaatgcggcggttaaacctggcggcagcgcaaaagatg

SEQ ID NO: 101613 - DNA, 103 bp, Artificial Sequence
  Synthetic Polynucleotide
taatacgactcactatagggtgcagctgcggccgccacgtggtaaccgccaacagaggagaggcggtatgcacgtggcgaacctggcggcagcgcaaaagatg

SEQ ID NO: 101614 - DNA, 103 bp, Artificial Sequence
  Synthetic Polynucleotide
taatacgactcactatagggtcgctgccgctgcagctgcggccgccacgtaacagaggagaacgtggatgccgcagctgaacctggcggcagcgcaaaagatg

SEQ ID NO: 101615 - DNA, 103 bp, Artificial Sequence
  Synthetic Polynucleotide
taatacgactcactatagggctgtccaagttcgctgccgctgcagctgcgaacagaggagacgcagcatgagcggcagcaacctggcggcagcgcaaaagatg

SEQ ID NO: 101616 - DNA, 103 bp, Artificial Sequence
  Synthetic Polynucleotide
taatacgactcactatagggggactgcgcgctgtccaagttcgctgccgcaacagaggagagcggcaatgaacttggacaacctggcggcagcgcaaaagatg

SEQ ID NO: 101617 - DNA, 103 bp, Artificial Sequence
  Synthetic Polynucleotide
taatacgactcactatagggatggccccggggactgcgcgctgtccaagtaacagaggagaacttggatggcgcgcagtaacctggcggcagcgcaaaagatg

SEQ ID NO: 101618 - DNA, 103 bp, Artificial Sequence
  Synthetic Polynucleotide
taatacgactcactataggggccggccaggatggccccggggactgcgcgaacagaggagacgcgcaatgcccggggccaacctggcggcagcgcaaaagatg

SEQ ID NO: 101619 - DNA, 103 bp, Artificial Sequence
  Synthetic Polynucleotide
taatacgactcactataggggccatacgctgccggccaggatggccccggaacagaggagaccggggatgtcctggccgaacctggcggcagcgcaaaagatg

SEQ ID NO: 101620 - DNA, 103 bp, Artificial Sequence
  Synthetic Polynucleotide
taatacgactcactatagggacatgctcacgtccttgtccaggaggtagcaacagaggagagctaccatgtggacaaggaacctggcggcagcgcaaaagatg

SEQ ID NO: 101621 - DNA, 103 bp, Artificial Sequence
  Synthetic Polynucleotide
taatacgactcactatagggggagtggggcgccatacgctgccggccaggaacagaggagacctggcatgcagcgtatgaacctggcggcagcgcaaaagatg

SEQ ID NO: 101622 - DNA, 103 bp, Artificial Sequence
  Synthetic Polynucleotide
taatacgactcactatagggcagtcctcccggagtggggcgccatacgctaacagaggagaagcgtaatgcgccccactaacctggcggcagcgcaaaagatg

SEQ ID NO: 101623 - DNA, 103 bp, Artificial Sequence
  Synthetic Polynucleotide
taatacgactcactataggggtagccattccagtcctcccggagtggggcaacagaggagagccccaatgcgggaggacaacctggcggcagcgcaaaagatg

SEQ ID NO: 101624 - DNA, 103 bp, Artificial Sequence
  Synthetic Polynucleotide
taatacgactcactatagggctccgggcgcgtagccattccagtcctcccaacagaggagagggaggatgggaatggctaacctggcggcagcgcaaaagatg

SEQ ID NO: 101625 - DNA, 103 bp, Artificial Sequence
  Synthetic Polynucleotide
taatacgactcactataggggccgcggcgcctccgggcgcgtagccattcaacagaggagagaatggatgcgcgcccggaacctggcggcagcgcaaaagatg

SEQ ID NO: 101626 - DNA, 103 bp, Artificial Sequence
  Synthetic Polynucleotide
taatacgactcactataggggttggcggcggccgcggcgcctccgggcgcaacagaggagagcgcccatgggcgccgcgaacctggcggcagcgcaaaagatg

SEQ ID NO: 101627 - DNA, 103 bp, Artificial Sequence
  Synthetic Polynucleotide
taatacgactcactataggggagccacggcgttggcggcggccgcggcgcaacagaggagagcgccgatgccgccgccaaacctggcggcagcgcaaaagatg

SEQ ID NO: 101628 - DNA, 103 bp, Artificial Sequence
  Synthetic Polynucleotide
taatacgactcactatagggttgaggccgtgagccacggcgttggcggcgaacagaggagacgccgcatgcgccgtggcaacctggcggcagcgcaaaagatg

SEQ ID NO: 101629 - DNA, 103 bp, Artificial Sequence
  Synthetic Polynucleotide
taatacgactcactatagggggagccaccgttgaggccgtgagccacggcaacagaggagagccgtgatgcacggcctcaacctggcggcagcgcaaaagatg

SEQ ID NO: 101630 - DNA, 103 bp, Artificial Sequence
  Synthetic Polynucleotide
taatacgactcactatagggctgcggccggggagccaccgttgaggccgtaacagaggagaacggccatgacggtggctaacctggcggcagcgcaaaagatg

SEQ ID NO: 101631 - DNA, 103 bp, Artificial Sequence
  Synthetic Polynucleotide
taatacgactcactataggggagctagggtacatgctcacgtccttgtccaacagaggagaggacaaatgcgtgagcataacctggcggcagcgcaaaagatg

SEQ ID NO: 101632 - DNA, 103 bp, Artificial Sequence
  Synthetic Polynucleotide
taatacgactcactatagggtagcccatggctgcggccggggagccaccgaacagaggagacggtggatgcccggccgcaacctggcggcagcgcaaaagatg

SEQ ID NO: 101633 - DNA, 103 bp, Artificial Sequence
  Synthetic Polynucleotide
taatacgactcactatagggggggctgctgtagcccatggctgcggccggaacagaggagaccggccatggccatgggcaacctggcggcagcgcaaaagatg

SEQ ID NO: 101634 - DNA, 103 bp, Artificial Sequence
  Synthetic Polynucleotide
taatacgactcactatagggggtagtctgcggggctgctgtagcccatggaacagaggagaccatggatgacagcagccaacctggcggcagcgcaaaagatg

SEQ ID NO: 101635 - DNA, 103 bp, Artificial Sequence
  Synthetic Polynucleotide
taatacgactcactatagggtggtgcggatggtagtctgcggggctgctgaacagaggagacagcagatgcgcagactaaacctggcggcagcgcaaaagatg

SEQ ID NO: 101636 - DNA, 103 bp, Artificial Sequence
  Synthetic Polynucleotide
taatacgactcactatagggatgcgggtggtggtgcggatggtagtctgcaacagaggagagcagacatgcatccgcacaacctggcggcagcgcaaaagatg

SEQ ID NO: 101637 - DNA, 103 bp, Artificial Sequence
  Synthetic Polynucleotide
taatacgactcactataggggcgggtggtgatgcgggtggtggtgcggataacagaggagaatccgcatgaccacccgcaacctggcggcagcgcaaaagatg

SEQ ID NO: 101638 - DNA, 103 bp, Artificial Sequence
  Synthetic Polynucleotide
taatacgactcactataggggccgggtggtgcgggtggtgatgcgggtggaacagaggagaccacccatgtcaccacccaacctggcggcagcgcaaaagatg

SEQ ID NO: 101639 - DNA, 103 bp, Artificial Sequence
  Synthetic Polynucleotide
taatacgactcactatagggaggcgcggcggccgggtggtgcgggtggtgaacagaggagacaccacatgcaccacccgaacctggcggcagcgcaaaagatg

SEQ ID NO: 101640 - DNA, 103 bp, Artificial Sequence
  Synthetic Polynucleotide
taatacgactcactatagggaagcgcaggaaggcgcggcggccgggtggtaacagaggagaaccaccatgccgccgcgcaacctggcggcagcgcaaaagatg

SEQ ID NO: 101641 - DNA, 103 bp, Artificial Sequence
  Synthetic Polynucleotide
taatacgactcactatagggagcagcccagaagcgcaggaaggcgcggcgaacagaggagacgccgcatgttcctgcgcaacctggcggcagcgcaaaagatg

SEQ ID NO: 101642 - DNA, 103 bp, Artificial Sequence
  Synthetic Polynucleotide
taatacgactcactataggggtggcgcacggagctagggtacatgctcacaacagaggagagtgagcatgtaccctagcaacctggcggcagcgcaaaagatg

SEQ ID NO: 101643 - DNA, 103 bp, Artificial Sequence
  Synthetic Polynucleotide
taatacgactcactataggggagcgtttgcagcagcccagaagcgcaggaaacagaggagatcctgcatgtctgggctgaacctggcggcagcgcaaaagatg

SEQ ID NO: 101644 - DNA, 103 bp, Artificial Sequence
  Synthetic Polynucleotide
taatacgactcactatagggggccggggttgagcgtttgcagcagcccagaacagaggagactgggcatgtgcaaacgcaacctggcggcagcgcaaaagatg

SEQ ID NO: 101645 - DNA, 103 bp, Artificial Sequence
  Synthetic Polynucleotide
taatacgactcactatagggggcccaggagggccggggttgagcgtttgcaacagaggagagcaaacatgcaaccccggaacctggcggcagcgcaaaagatg

SEQ ID NO: 101646 - DNA, 103 bp, Artificial Sequence
  Synthetic Polynucleotide
taatacgactcactatagggggtggcggcgggcccaggagggccggggttaacagaggagaaaccccatgcctcctgggaacctggcggcagcgcaaaagatg

SEQ ID NO: 101647 - DNA, 103 bp, Artificial Sequence
  Synthetic Polynucleotide
taatacgactcactatagggcggcggcagcggtggcggcgggcccaggagaacagaggagactcctgatgccgccgccaaacctggcggcagcgcaaaagatg

SEQ ID NO: 101648 - DNA, 103 bp, Artificial Sequence
  Synthetic Polynucleotide
taatacgactcactataggggacagctgctcggcggcagcggtggcggcgaacagaggagacgccgcatgcgctgccgcaacctggcggcagcgcaaaagatg

SEQ ID NO: 101649 - DNA, 103 bp, Artificial Sequence
  Synthetic Polynucleotide
taatacgactcactataggggccgccgggagacagctgctcggcggcagcaacagaggagagctgccatggagcagctgaacctggcggcagcgcaaaagatg

SEQ ID NO: 101650 - DNA, 103 bp, Artificial Sequence
  Synthetic Polynucleotide
taatacgactcactatagggtccgccgctggccgccgggagacagctgctaacagaggagaagcagcatgctcccggcgaacctggcggcagcgcaaaagatg

SEQ ID NO: 101651 - DNA, 103 bp, Artificial Sequence
  Synthetic Polynucleotide
taatacgactcactatagggtcgcacaggttccgccgctggccgccgggaaacagaggagatcccggatgccagcggcgaacctggcggcagcgcaaaagatg

SEQ ID NO: 101652 - DNA, 103 bp, Artificial Sequence
  Synthetic Polynucleotide
taatacgactcactatagggccgcatccactcgcacaggttccgccgctgaacagaggagacagcggatgaacctgtgcaacctggcggcagcgcaaaagatg

SEQ ID NO: 101653 - DNA, 103 bp, Artificial Sequence
  Synthetic Polynucleotide
taatacgactcactatagggggccgccagagtggcgcacggagctagggtaacagaggagaaccctaatgccgtgcgccaacctggcggcagcgcaaaagatg

SEQ ID NO: 101654 - DNA, 103 bp, Artificial Sequence
  Synthetic Polynucleotide
taatacgactcactataggggcgccggcttccgcatccactcgcacaggtaacagaggagaacctgtatgagtggatgcaacctggcggcagcgcaaaagatg

SEQ ID NO: 101655 - DNA, 103 bp, Artificial Sequence
  Synthetic Polynucleotide
taatacgactcactatagggagggactgctgcgccggcttccgcatccacaacagaggagagtggatatggaagccggcaacctggcggcagcgcaaaagatg

SEQ ID NO: 101656 - DNA, 103 bp, Artificial Sequence
  Synthetic Polynucleotide
taatacgactcactatagggttggctgccgagggactgctgcgccggcttaacagaggagaaagccgatgcagcagtccaacctggcggcagcgcaaaagatg

SEQ ID NO: 101657 - DNA, 103 bp, Artificial Sequence
  Synthetic Polynucleotide
taatacgactcactatagggtggttttcacttggctgccgagggactgctaacagaggagaagcagtatgtcggcagccaacctggcggcagcgcaaaagatg

SEQ ID NO: 101658 - DNA, 103 bp, Artificial Sequence
  Synthetic Polynucleotide
taatacgactcactatagggtctttcgtcctggttttcacttggctgccgaacagaggagacggcagatgagtgaaaacaacctggcggcagcgcaaaagatg

SEQ ID NO: 101659 - DNA, 103 bp, Artificial Sequence
  Synthetic Polynucleotide
taatacgactcactatagggtcgatatttgtctttcgtcctggttttcacaacagaggagagtgaaaatgaggacgaaaaacctggcggcagcgcaaaagatg

SEQ ID NO: 101660 - DNA, 103 bp, Artificial Sequence
  Synthetic Polynucleotide
taatacgactcactatagggtgtacaccactcgatatttgtctttcgtccaacagaggagaggacgaatgacaaatatcaacctggcggcagcgcaaaagatg

SEQ ID NO: 101661 - DNA, 103 bp, Artificial Sequence
  Synthetic Polynucleotide
taatacgactcactatagggtggtggtccgtgtacaccactcgatatttgaacagaggagacaaataatgagtggtgtaaacctggcggcagcgcaaaagatg

SEQ ID NO: 101662 - DNA, 103 bp, Artificial Sequence
  Synthetic Polynucleotide
taatacgactcactatagggctccagccgctggtggtccgtgtacaccacaacagaggagagtggtgatgacggaccacaacctggcggcagcgcaaaagatg

SEQ ID NO: 101663 - DNA, 103 bp, Artificial Sequence
  Synthetic Polynucleotide
taatacgactcactatagggccttctccagctccagccgctggtggtccgaacagaggagacggaccatgagcggctggaacctggcggcagcgcaaaagatg

SEQ ID NO: 101664 - DNA, 103 bp, Artificial Sequence
  Synthetic Polynucleotide
taatacgactcactataggggccaggttgaggccgccagagtggcgcacgaacagaggagacgtgcgatgctctggcggaacctggcggcagcgcaaaagatg

SEQ ID NO: 101665 - DNA, 103 bp, Artificial Sequence
  Synthetic Polynucleotide
taatacgactcactatagggtagtgaaactccttctccagctccagccgcaacagaggagagcggctatggctggagaaaacctggcggcagcgcaaaagatg

SEQ ID NO: 101666 - DNA, 103 bp, Artificial Sequence
  Synthetic Polynucleotide
taatacgactcactataggggtagcgactgtagtgaaactccttctccagaacagaggagactggagatggagtttcacaacctggcggcagcgcaaaagatg

SEQ ID NO: 101667 - DNA, 103 bp, Artificial Sequence
  Synthetic Polynucleotide
taatacgactcactatagggggatggtgatgtagcgactgtagtgaaactaacagaggagaagtttcatgacagtcgctaacctggcggcagcgcaaaagatg

SEQ ID NO: 101668 - DNA, 103 bp, Artificial Sequence
  Synthetic Polynucleotide
taatacgactcactataggggctttcctccggatggtgatgtagcgactgaacagaggagacagtcgatgcatcaccataacctggcggcagcgcaaaagatg

SEQ ID NO: 101669 - DNA, 103 bp, Artificial Sequence
  Synthetic Polynucleotide
taatacgactcactatagggggctagctcggctttcctccggatggtgataacagaggagaatcaccatgcggaggaaaaacctggcggcagcgcaaaagatg

SEQ ID NO: 101670 - DNA, 103 bp, Artificial Sequence
  Synthetic Polynucleotide
taatacgactcactatagggccagcgtggcggctagctcggctttcctccaacagaggagaggaggaatgccgagctagaacctggcggcagcgcaaaagatg

SEQ ID NO: 101671 - DNA, 103 bp, Artificial Sequence
  Synthetic Polynucleotide
taatacgactcactatagggtcagagagccccagcgtggcggctagctcgaacagaggagacgagctatgcgccacgctaacctggcggcagcgcaaaagatg

SEQ ID NO: 101672 - DNA, 103 bp, Artificial Sequence
  Synthetic Polynucleotide
taatacgactcactatagggaacctgcctctcagagagccccagcgtggcaacagaggagagccacgatggggctctctaacctggcggcagcgcaaaagatg

SEQ ID NO: 101673 - DNA, 103 bp, Artificial Sequence
  Synthetic Polynucleotide
taatacgactcactatagggaccagattttaacctgcctctcagagagccaacagaggagaggctctatgagaggcaggaacctggcggcagcgcaaaagatg

SEQ ID NO: 101674 - DNA, 103 bp, Artificial Sequence
  Synthetic Polynucleotide
taatacgactcactatagggcggttctgaaaccagattttaacctgcctcaacagaggagagaggcaatgtaaaatctgaacctggcggcagcgcaaaagatg

SEQ ID NO: 101675 - DNA, 103 bp, Artificial Sequence
  Synthetic Polynucleotide
taatacgactcactataggggttctgcggcgccaggttgaggccgccagaaacagaggagatctggcatgctcaacctgaacctggcggcagcgcaaaagatg

SEQ ID NO: 101676 - DNA, 103 bp, Artificial Sequence
  Synthetic Polynucleotide
taatacgactcactatagggctttgctctgcggttctgaaaccagattttaacagaggagaaaaatcatgtttcagaacaacctggcggcagcgcaaaagatg

SEQ ID NO: 101677 - DNA, 103 bp, Artificial Sequence
  Synthetic Polynucleotide
taatacgactcactatagggttttcctctcctttgctctgcggttctgaaaacagaggagattcagaatggcagagcaaaacctggcggcagcgcaaaagatg

SEQ ID NO: 101678 - DNA, 103 bp, Artificial Sequence
  Synthetic Polynucleotide
taatacgactcactatagggttcttgttgattttcctctcctttgctctgaacagaggagacagagcatgggagaggaaaacctggcggcagcgcaaaagatg

SEQ ID NO: 101679 - DNA, 103 bp, Artificial Sequence
  Synthetic Polynucleotide
taatacgactcactatagggctgcaacttcttcttgttgattttcctctcaacagaggagagagaggatgatcaacaagaacctggcggcagcgcaaaagatg

SEQ ID NO: 101680 - DNA, 103 bp, Artificial Sequence
  Synthetic Polynucleotide
taatacgactcactataggggctgttgctgctgcaacttcttcttgttgaaacagaggagatcaacaatgagaagttgcaacctggcggcagcgcaaaagatg

SEQ ID NO: 101681 - DNA, 103 bp, Artificial Sequence
  Synthetic Polynucleotide
taatacgactcactatagggggctgctgctgctgttgctgctgcaacttcaacagaggagagaagttatggcagcaacaaacctggcggcagcgcaaaagatg

SEQ ID NO: 101682 - DNA, 103 bp, Artificial Sequence
  Synthetic Polynucleotide
taatacgactcactatagggcggctgtggtggctgctgctgctgttgctgaacagaggagacagcaaatgcagcagcagaacctggcggcagcgcaaaagatg

SEQ ID NO: 101683 - DNA, 103 bp, Artificial Sequence
  Synthetic Polynucleotide
taatacgactcactataggggcggcggaggcggctgtggtggctgctgctaacagaggagaagcagcatgcaccacagcaacctggcggcagcgcaaaagatg

SEQ ID NO: 101684 - DNA, 103 bp, Artificial Sequence
  Synthetic Polynucleotide
taatacgactcactatagggggctgtggtggcggcggaggcggctgtggtaacagaggagaaccacaatggcctccgccaacctggcggcagcgcaaaagatg

SEQ ID NO: 101685 - DNA, 103 bp, Artificial Sequence
  Synthetic Polynucleotide
taatacgactcactatagggaggctggggaggctgtggtggcggcggaggaacagaggagacctccgatgccaccacagaacctggcggcagcgcaaaagatg

SEQ ID NO: 101686 - DNA, 103 bp, Artificial Sequence
  Synthetic Polynucleotide
taatacgactcactatagggggctgacgaagttctgcggcgccaggttgaaacagaggagatcaaccatgcgccgcagaaacctggcggcagcgcaaaagatg

SEQ ID NO: 101687 - DNA, 103 bp, Artificial Sequence
  Synthetic Polynucleotide
taatacgactcactataggggacctggctgaggctggggaggctgtggtgaacagaggagacaccacatgctccccagcaacctggcggcagcgcaaaagatg

SEQ ID NO: 101688 - DNA, 103 bp, Artificial Sequence
  Synthetic Polynucleotide
taatacgactcactatagggcttctcagaggacctggctgaggctggggaaacagaggagatccccaatgtcagccaggaacctggcggcagcgcaaaagatg

SEQ ID NO: 101689 - DNA, 103 bp, Artificial Sequence
  Synthetic Polynucleotide
taatacgactcactatagggctctgggacacttctcagaggacctggctgaacagaggagacagccaatgcctctgagaaacctggcggcagcgcaaaagatg

SEQ ID NO: 101690 - DNA, 103 bp, Artificial Sequence
  Synthetic Polynucleotide
taatacgactcactataggggactcaagggctctgggacacttctcagagaacagaggagactctgaatggtgtcccagaacctggcggcagcgcaaaagatg

SEQ ID NO: 101691 - DNA, 103 bp, Artificial Sequence
  Synthetic Polynucleotide
taatacgactcactataggggaagacaccggactcaagggctctgggacaaacagaggagatgtcccatggcccttgagaacctggcggcagcgcaaaagatg

SEQ ID NO: 101692 - DNA, 103 bp, Artificial Sequence
  Synthetic Polynucleotide
taatacgactcactatagggggcttgcagggaagacaccggactcaagggaacagaggagacccttgatgccggtgtctaacctggcggcagcgcaaaagatg

SEQ ID NO: 101693 - DNA, 103 bp, Artificial Sequence
  Synthetic Polynucleotide
taatacgactcactatagggcaggcactgaggcttgcagggaagacaccgaacagaggagacggtgtatgccctgcaagaacctggcggcagcgcaaaagatg

SEQ ID NO: 101694 - DNA, 103 bp, Artificial Sequence
  Synthetic Polynucleotide
taatacgactcactataggggggacagagccaggcactgaggcttgcaggaacagaggagacctgcaatgctcagtgccaacctggcggcagcgcaaaagatg

SEQ ID NO: 101695 - DNA, 103 bp, Artificial Sequence
  Synthetic Polynucleotide
taatacgactcactatagggcagaaccccagggacagagccaggcactgaaacagaggagatcagtgatgggctctgtcaacctggcggcagcgcaaaagatg

SEQ ID NO: 101696 - DNA, 103 bp, Artificial Sequence
  Synthetic Polynucleotide
taatacgactcactatagggcagttggccccagaaccccagggacagagcaacagaggagagctctgatgctggggttcaacctggcggcagcgcaaaagatg

SEQ ID NO: 101697 - DNA, 103 bp, Artificial Sequence
  Synthetic Polynucleotide
taatacgactcactatagggtactgcggggggctgacgaagttctgcggcaacagaggagagccgcaatgcttcgtcagaacctggcggcagcgcaaaagatg

SEQ ID NO: 101698 - DNA, 103 bp, Artificial Sequence
  Synthetic Polynucleotide
taatacgactcactatagggagcacccccccagttggccccagaaccccaaacagaggagatggggtatgggggccaacaacctggcggcagcgcaaaagatg

SEQ ID NO: 101699 - DNA, 103 bp, Artificial Sequence
  Synthetic Polynucleotide
taatacgactcactatagggggtggggtttagcacccccccagttggcccaacagaggagagggccaatggggggggtgaacctggcggcagcgcaaaagatg

SEQ ID NO: 101700 - DNA, 103 bp, Artificial Sequence
  Synthetic Polynucleotide
taatacgactcactatagggactgggtgacggtggggtttagcaccccccaacagaggagaggggggatgtaaaccccaaacctggcggcagcgcaaaagatg

SEQ ID NO: 101701 - DNA, 103 bp, Artificial Sequence
  Synthetic Polynucleotide
taatacgactcactatagggttctttctccaaaagacagcttccgtacataacagaggagaatgtacatgagctgtcttaacctggcggcagcgcaaaagatg

SEQ ID NO: 101702 - DNA, 103 bp, Artificial Sequence
  Synthetic Polynucleotide
taatacgactcactatagggtggcatcggactcccaccgccccctgtgccaacagaggagaggcacaatgggcggtgggaacctggcggcagcgcaaaagatg

SEQ ID NO: 101703 - DNA, 103 bp, Artificial Sequence
  Synthetic Polynucleotide
taatacgactcactatagggaattggaggctggcatcggactcccaccgcaacagaggagagcggtgatggtccgatgcaacctggcggcagcgcaaaagatg

SEQ ID NO: 101704 - DNA, 103 bp, Artificial Sequence
  Synthetic Polynucleotide
taatacgactcactataggggccgcagcgaaattggaggctggcatcggaaacagaggagatccgatatgagcctccaaaacctggcggcagcgcaaaagatg

SEQ ID NO: 101705 - DNA, 103 bp, Artificial Sequence
  Synthetic Polynucleotide
taatacgactcactataggggaaagccggtgccgcagcgaaattggaggcaacagaggagagcctccatgttcgctgcgaacctggcggcagcgcaaaagatg

SEQ ID NO: 101706 - DNA, 103 bp, Artificial Sequence
  Synthetic Polynucleotide
taatacgactcactatagggtatagtgcgagaaagccggtgccgcagcgaaacagaggagatcgctgatgcaccggcttaacctggcggcagcgcaaaagatg

SEQ ID NO: 101707 - DNA, 103 bp, Artificial Sequence
  Synthetic Polynucleotide
taatacgactcactatagggggataccccatatagtgcgagaaagccggtaacagaggagaaccggcatgctcgcactaaacctggcggcagcgcaaaagatg

SEQ ID NO: 101708 - DNA, 103 bp, Artificial Sequence
  Synthetic Polynucleotide
taatacgactcactataggggggcatatgaggataccccatatagtgcgaaacagaggagatcgcacatgatggggtataacctggcggcagcgcaaaagatg

SEQ ID NO: 101709 - DNA, 103 bp, Artificial Sequence
  Synthetic Polynucleotide
taatacgactcactataggggatccatgctgggcatatgaggataccccaaacagaggagatggggtatgctcatatgcaacctggcggcagcgcaaaagatg

SEQ ID NO: 101710 - DNA, 103 bp, Artificial Sequence
  Synthetic Polynucleotide
taatacgactcactatagggggccagtgaggatccatgctgggcatatgaaacagaggagatcatatatgcagcatggaaacctggcggcagcgcaaaagatg

SEQ ID NO: 101711 - DNA, 103 bp, Artificial Sequence
  Synthetic Polynucleotide
taatacgactcactatagggtcccagagacggccagtgaggatccatgctaacagaggagaagcatgatgcctcactggaacctggcggcagcgcaaaagatg

SEQ ID NO: 101712 - DNA, 103 bp, Artificial Sequence
  Synthetic Polynucleotide
taatacgactcactatagggacatgcctgcttctttctccaaaagacagcaacagaggagagctgtcatgtggagaaagaacctggcggcagcgcaaaagatg

SEQ ID NO: 101713 - DNA, 103 bp, Artificial Sequence
  Synthetic Polynucleotide
taatacgactcactatagggagccccagactcccagagacggccagtgagaacagaggagactcactatgcgtctctggaacctggcggcagcgcaaaagatg

SEQ ID NO: 101714 - DNA, 103 bp, Artificial Sequence
  Synthetic Polynucleotide
taatacgactcactatagggctgtagggtgagccccagactcccagagacaacagaggagagtctctatgagtctggggaacctggcggcagcgcaaaagatg

SEQ ID NO: 101715 - DNA, 103 bp, Artificial Sequence
  Synthetic Polynucleotide
taatacgactcactatagggtcgcgggggactgtagggtgagccccagacaacagaggagagtctggatgtcaccctacaacctggcggcagcgcaaaagatg

SEQ ID NO: 101716 - DNA, 103 bp, Artificial Sequence
  Synthetic Polynucleotide
taatacgactcactatagggtccagtcttctcgcgggggactgtagggtgaacagaggagacaccctatggtcccccgcaacctggcggcagcgcaaaagatg

SEQ ID NO: 101717 - DNA, 103 bp, Artificial Sequence
  Synthetic Polynucleotide
taatacgactcactatagggggatacacgctccagtcttctcgcgggggaaacagaggagatcccccatgagaagactgaacctggcggcagcgcaaaagatg

SEQ ID NO: 101718 - DNA, 103 bp, Artificial Sequence
  Synthetic Polynucleotide
taatacgactcactatagggagacggcccaggatacacgctccagtcttcaacagaggagagaagacatgagcgtgtataacctggcggcagcgcaaaagatg

SEQ ID NO: 101719 - DNA, 103 bp, Artificial Sequence
  Synthetic Polynucleotide
taatacgactcactatagggccattgtactagacggcccaggatacacgcaacagaggagagcgtgtatgctgggccgtaacctggcggcagcgcaaaagatg

SEQ ID NO: 101720 - DNA, 103 bp, Artificial Sequence
  Synthetic Polynucleotide
taatacgactcactatagggggcactgtgcccattgtactagacggcccaaacagaggagatgggccatgtagtacaataacctggcggcagcgcaaaagatg

SEQ ID NO: 101721 - DNA, 103 bp, Artificial Sequence
  Synthetic Polynucleotide
taatacgactcactataggggtcgttcaccggcactgtgcccattgtactaacagaggagaagtacaatgggcacagtgaacctggcggcagcgcaaaagatg

SEQ ID NO: 101722 - DNA, 103 bp, Artificial Sequence
  Synthetic Polynucleotide
taatacgactcactatagggtagaggtcacgtcgttcaccggcactgtgcaacagaggagagcacagatgcggtgaacgaacctggcggcagcgcaaaagatg

SEQ ID NO: 101723 - DNA, 103 bp, Artificial Sequence
  Synthetic Polynucleotide
taatacgactcactataggggtgcccgggtacatgcctgcttctttctccaacagaggagaggagaaatgagcaggcataacctggcggcagcgcaaaagatg

SEQ ID NO: 101724 - DNA, 103 bp, Artificial Sequence
  Synthetic Polynucleotide
taatacgactcactataggggcggcggggctagaggtcacgtcgttcaccaacagaggagaggtgaaatgcgtgacctcaacctggcggcagcgcaaaagatg

SEQ ID NO: 101725 - DNA, 103 bp, Artificial Sequence
  Synthetic Polynucleotide
taatacgactcactatagggcgagcagaaagcggcggggctagaggtcacaacagaggagagtgaccatgagccccgccaacctggcggcagcgcaaaagatg

SEQ ID NO: 101726 - DNA, 103 bp, Artificial Sequence
  Synthetic Polynucleotide
taatacgactcactatagggtgtagtcggtcgagcagaaagcggcggggcaacagaggagagccccgatgctttctgctaacctggcggcagcgcaaaagatg

SEQ ID NO: 101727 - DNA, 103 bp, Artificial Sequence
  Synthetic Polynucleotide
taatacgactcactatagggcccaagttgctgtagtcggtcgagcagaaaaacagaggagatttctgatggaccgactaaacctggcggcagcgcaaaagatg

SEQ ID NO: 101728 - DNA, 103 bp, Artificial Sequence
  Synthetic Polynucleotide
taatacgactcactataggggcccacagggcccaagttgctgtagtcggtaacagaggagaaccgacatgagcaacttgaacctggcggcagcgcaaaagatg

SEQ ID NO: 101729 - DNA, 103 bp, Artificial Sequence
  Synthetic Polynucleotide
taatacgactcactatagggtagttccaccgcccacagggcccaagttgcaacagaggagagcaactatggccctgtggaacctggcggcagcgcaaaagatg

SEQ ID NO: 101730 - DNA, 103 bp, Artificial Sequence
  Synthetic Polynucleotide
taatacgactcactatagggctgctgccgctagttccaccgcccacagggaacagaggagaccctgtatgcggtggaacaacctggcggcagcgcaaaagatg

SEQ ID NO: 101731 - DNA, 103 bp, Artificial Sequence
  Synthetic Polynucleotide
taatacgactcactataggggcctggtaggctgctgccgctagttccaccaacagaggagaggtggaatgagcggcagcaacctggcggcagcgcaaaagatg

SEQ ID NO: 101732 - DNA, 103 bp, Artificial Sequence
  Synthetic Polynucleotide
taatacgactcactatagggcgccagcctggcctggtaggctgctgccgcaacagaggagagcggcaatggcctaccagaacctggcggcagcgcaaaagatg

SEQ ID NO: 101733 - DNA, 103 bp, Artificial Sequence
  Synthetic Polynucleotide
taatacgactcactatagggacaagcgacccgccagcctggcctggtaggaacagaggagacctaccatgccaggctggaacctggcggcagcgcaaaagatg

SEQ ID NO: 101734 - DNA, 103 bp, Artificial Sequence
  Synthetic Polynucleotide
taatacgactcactataggggctcatgagagtgcccgggtacatgcctgcaacagaggagagcaggcatgtacccgggcaacctggcggcagcgcaaaagatg

SEQ ID NO: 101735 - DNA, 103 bp, Artificial Sequence
  Synthetic Polynucleotide
taatacgactcactataggggtccgtcgggacaagcgacccgccagcctgaacagaggagacaggctatggggtcgcttaacctggcggcagcgcaaaagatg

SEQ ID NO: 101736 - DNA, 103 bp, Artificial Sequence
  Synthetic Polynucleotide
taatacgactcactatagggcggcgcctgcgtccgtcgggacaagcgaccaacagaggagaggtcgcatgtcccgacggaacctggcggcagcgcaaaagatg

SEQ ID NO: 101737 - DNA, 103 bp, Artificial Sequence
  Synthetic Polynucleotide
taatacgactcactatagggctggccttggcggcgcctgcgtccgtcgggaacagaggagacccgacatgcgcaggcgcaacctggcggcagcgcaaaagatg

SEQ ID NO: 101738 - DNA, 103 bp, Artificial Sequence
  Synthetic Polynucleotide
taatacgactcactataggggctgggggaactggccttggcggcgcctgcaacagaggagagcaggcatggccaaggccaacctggcggcagcgcaaaagatg

SEQ ID NO: 101739 - DNA, 103 bp, Artificial Sequence
  Synthetic Polynucleotide
taatacgactcactatagggggcggctcctgctgggggaactggccttggaacagaggagaccaaggatggttcccccaaacctggcggcagcgcaaaagatg

SEQ ID NO: 101740 - DNA, 103 bp, Artificial Sequence
  Synthetic Polynucleotide
taatacgactcactatagggtaggggctgtggcggctcctgctgggggaaaacagaggagattccccatgcaggagccgaacctggcggcagcgcaaaagatg

SEQ ID NO: 101741 - DNA, 103 bp, Artificial Sequence
  Synthetic Polynucleotide
taatacgactcactatagggcatccatgcataggggctgtggcggctcctaacagaggagaaggagcatgcacagccccaacctggcggcagcgcaaaagatg

SEQ ID NO: 101742 - DNA, 103 bp, Artificial Sequence
  Synthetic Polynucleotide
taatacgactcactatagggccgtcttgcgcatccatgcataggggctgtaacagaggagaacagccatgatgcatggaaacctggcggcagcgcaaaagatg

SEQ ID NO: 101743 - DNA, 103 bp, Artificial Sequence
  Synthetic Polynucleotide
taatacgactcactataggggtcacctgcaccgtcttgcgcatccatgcaaacagaggagatgcatgatggcgcaagacaacctggcggcagcgcaaaagatg

SEQ ID NO: 101744 - DNA, 103 bp, Artificial Sequence
  Synthetic Polynucleotide
taatacgactcactatagggggttttccccgtcacctgcaccgtcttgcgaacagaggagacgcaagatggtgcaggtgaacctggcggcagcgcaaaagatg

SEQ ID NO: 101745 - DNA, 103 bp, Artificial Sequence
  Synthetic Polynucleotide
taatacgactcactatagggcgcccccagggctcatgagagtgcccgggtaacagaggagaacccggatgctctcatgaaacctggcggcagcgcaaaagatg

SEQ ID NO: 101746 - DNA, 103 bp, Artificial Sequence
  Synthetic Polynucleotide
taatacgactcactatagggcttttgtcctggttttccccgtcacctgcaaacagaggagatgcaggatgcggggaaaaaacctggcggcagcgcaaaagatg

SEQ ID NO: 101747 - DNA, 103 bp, Artificial Sequence
  Synthetic Polynucleotide
taatacgactcactatagggcgatacttttcttttgtcctggttttccccaacagaggagaggggaaatgcaggacaaaaacctggcggcagcgcaaaagatg

SEQ ID NO: 101748 - DNA, 103 bp, Artificial Sequence
  Synthetic Polynucleotide
taatacgactcactataggggtaaactacacgatacttttcttttgtcctaacagaggagaaggacaatggaaaagtataacctggcggcagcgcaaaagatg

SEQ ID NO: 101749 - DNA, 103 bp, Artificial Sequence
  Synthetic Polynucleotide
taatacgactcactataggggatgatcagtgtaaactacacgatacttttaacagaggagaaaaagtatggtgtagtttaacctggcggcagcgcaaaagatg

SEQ ID NO: 101750 - DNA, 103 bp, Artificial Sequence
  Synthetic Polynucleotide
taatacgactcactatagggtccaatctttgatgatcagtgtaaactacaaacagaggagatgtagtatgcactgatcaaacctggcggcagcgcaaaagatg

SEQ ID NO: 101751 - DNA, 103 bp, Artificial Sequence
  Synthetic Polynucleotide
taatacgactcactatagggcttttccagctccaatctttgatgatcagtaacagaggagaactgatatgcaaagattgaacctggcggcagcgcaaaagatg

SEQ ID NO: 101752 - DNA, 103 bp, Artificial Sequence
  Synthetic Polynucleotide
taatacgactcactatagggaatggaattccttttccagctccaatctttaacagaggagaaaagatatgagctggaaaaacctggcggcagcgcaaaagatg

SEQ ID NO: 101753 - DNA, 103 bp, Artificial Sequence
  Synthetic Polynucleotide
taatacgactcactatagggtatctattgcaatggaattccttttccagcaacagaggagagctggaatgggaattccaaacctggcggcagcgcaaaagatg

SEQ ID NO: 101754 - DNA, 103 bp, Artificial Sequence
  Synthetic Polynucleotide
taatacgactcactataggggatggtgatatatctattgcaatggaattcaacagaggagagaattcatgtgcaatagaaacctggcggcagcgcaaaagatg

SEQ ID NO: 101755 - DNA, 103 bp, Artificial Sequence
  Synthetic Polynucleotide
taatacgactcactatagggattttctctggatggtgatatatctattgcaacagaggagagcaataatgatatcaccaaacctggcggcagcgcaaaagatg

SEQ ID NO: 101756 - DNA, 103 bp, Artificial Sequence
  Synthetic Polynucleotide
taatacgactcactataggggctgtgccgtcgcccccagggctcatgagaaacagaggagatctcatatgccctgggggaacctggcggcagcgcaaaagatg

SEQ ID NO: 101757 - DNA, 103 bp, Artificial Sequence
  Synthetic Polynucleotide
taatacgactcactataggggccagctctgattttctctggatggtgataaacagaggagatatcacatgccagagaaaaacctggcggcagcgcaaaagatg

SEQ ID NO: 101758 - DNA, 103 bp, Artificial Sequence
  Synthetic Polynucleotide
taatacgactcactatagggcaggttaactgccagctctgattttctctgaacagaggagacagagaatgtcagagctgaacctggcggcagcgcaaaagatg

SEQ ID NO: 101759 - DNA, 103 bp, Artificial Sequence
  Synthetic Polynucleotide
taatacgactcactatagggcggaaaggcccaggttaactgccagctctgaacagaggagacagagcatgcagttaaccaacctggcggcagcgcaaaagatg

SEQ ID NO: 101760 - DNA, 103 bp, Artificial Sequence
  Synthetic Polynucleotide
taatacgactcactatagggacctgtctctcggaaaggcccaggttaactaacagaggagaagttaaatggggcctttcaacctggcggcagcgcaaaagatg

SEQ ID NO: 101761 - DNA, 103 bp, Artificial Sequence
  Synthetic Polynucleotide
taatacgactcactatagggccagattttcacctgtctctcggaaaggccaacagaggagaggccttatggagagacagaacctggcggcagcgcaaaagatg

SEQ ID NO: 101762 - DNA, 103 bp, Artificial Sequence
  Synthetic Polynucleotide
taatacgactcactataggggattctgaaaccagattttcacctgtctctaacagaggagaagagacatgtgaaaatctaacctggcggcagcgcaaaagatg

SEQ ID NO: 101763 - DNA, 103 bp, Artificial Sequence
  Synthetic Polynucleotide
taatacgactcactatagggttggctctgcgattctgaaaccagattttcaacagaggagagaaaatatggtttcagaaaacctggcggcagcgcaaaagatg

SEQ ID NO: 101764 - DNA, 103 bp, Artificial Sequence
  Synthetic Polynucleotide
taatacgactcactatagggctttctctccttggctctgcgattctgaaaaacagaggagatttcagatgcgcagagccaacctggcggcagcgcaaaagatg

SEQ ID NO: 101765 - DNA, 103 bp, Artificial Sequence
  Synthetic Polynucleotide
taatacgactcactatagggttttgatcatctttctctccttggctctgcaacagaggagagcagagatgaggagagaaaacctggcggcagcgcaaaagatg

SEQ ID NO: 101766 - DNA, 103 bp, Artificial Sequence
  Synthetic Polynucleotide
taatacgactcactataggggagattttctttttgatcatctttctctccaacagaggagaggagagatggatgatcaaaacctggcggcagcgcaaaagatg

SEQ ID NO: 101767 - DNA, 103 bp, Artificial Sequence
  Synthetic Polynucleotide
taatacgactcactataggggcctgtcccagctgtgccgtcgcccccaggaacagaggagacctgggatggacggcacaaacctggcggcagcgcaaaagatg

SEQ ID NO: 101768 - DNA, 103 bp, Artificial Sequence
  Synthetic Polynucleotide
taatacgactcactatagggctcaaactgggagattttctttttgatcataacagaggagaatgatcatgaagaaaatcaacctggcggcagcgcaaaagatg

SEQ ID NO: 101769 - DNA, 103 bp, Artificial Sequence
  Synthetic Polynucleotide
taatacgactcactatagggctccactattctcaaactgggagattttctaacagaggagaagaaaaatgcccagtttgaacctggcggcagcgcaaaagatg

SEQ ID NO: 101770 - DNA, 103 bp, Artificial Sequence
  Synthetic Polynucleotide
taatacgactcactatagggtgcaccgagcctccactattctcaaactggaacagaggagaccagttatggaatagtggaacctggcggcagcgcaaaagatg

SEQ ID NO: 101771 - DNA, 103 bp, Artificial Sequence
  Synthetic Polynucleotide
taatacgactcactatagggagagtcactttgcaccgagcctccactattaacagaggagaaatagtatgggctcggtgaacctggcggcagcgcaaaagatg

SEQ ID NO: 101772 - DNA, 103 bp, Artificial Sequence
  Synthetic Polynucleotide
taatacgactcactatagggtgatggagtcagagtcactttgcaccgagcaacagaggagagctcggatgaaagtgactaacctggcggcagcgcaaaagatg

SEQ ID NO: 101773 - DNA, 103 bp, Artificial Sequence
  Synthetic Polynucleotide
taatacgactcactatagggtccccagggctgatggagtcagagtcacttaacagaggagaaagtgaatgtgactccataacctggcggcagcgcaaaagatg

SEQ ID NO: 101774 - DNA, 103 bp, Artificial Sequence
  Synthetic Polynucleotide
taatacgactcactataggggttaggtagttccccagggctgatggagtcaacagaggagagactccatgagccctgggaacctggcggcagcgcaaaagatg

SEQ ID NO: 101775 - DNA, 103 bp, Artificial Sequence
  Synthetic Polynucleotide
taatacgactcactatagggtgaaaaaagtgttaggtagttccccagggcaacagaggagagccctgatgaactacctaaacctggcggcagcgcaaaagatg

SEQ ID NO: 101776 - DNA, 103 bp, Artificial Sequence
  Synthetic Polynucleotide
taatacgactcactataggggatggtgtggtgaaaaaagtgttaggtagtaacagaggagaactaccatgcacttttttaacctggcggcagcgcaaaagatg

SEQ ID NO: 101777 - DNA, 103 bp, Artificial Sequence
  Synthetic Polynucleotide
taatacgactcactatagggacgaacagcagatggtgtggtgaaaaaagtaacagaggagaacttttatgaccacaccaaacctggcggcagcgcaaaagatg

SEQ ID NO: 101778 - DNA, 103 bp, Artificial Sequence
  Synthetic Polynucleotide
taatacgactcactatagggcccctgtgccgcctgtcccagctgtgccgtaacagaggagaacggcaatgctgggacagaacctggcggcagcgcaaaagatg

SEQ ID NO: 101779 - DNA, 103 bp, Artificial Sequence
  Synthetic Polynucleotide
taatacgactcactataggggttgaaatccacgaacagcagatggtgtggaacagaggagaccacacatgctgctgttcaacctggcggcagcgcaaaagatg

SEQ ID NO: 101780 - DNA, 103 bp, Artificial Sequence
  Synthetic Polynucleotide
taatacgactcactatagggatctcaataggttgaaatccacgaacagcaaacagaggagatgctgtatgtggatttcaaacctggcggcagcgcaaaagatg

SEQ ID NO: 101781 - DNA, 103 bp, Artificial Sequence
  Synthetic Polynucleotide
taatacgactcactatagggaacctgctgtatctcaataggttgaaatccaacagaggagaggatttatgcctattgagaacctggcggcagcgcaaaagatg

SEQ ID NO: 101782 - DNA, 103 bp, Artificial Sequence
  Synthetic Polynucleotide
taatacgactcactatagggcggagactataacctgctgtatctcaatagaacagaggagactattgatgtacagcaggaacctggcggcagcgcaaaagatg

SEQ ID NO: 101783 - DNA, 103 bp, Artificial Sequence
  Synthetic Polynucleotide
taatacgactcactatagggctcccaccgccccctgtgccgcctgtcccaaacagaggagatgggacatgcggcacaggaacctggcggcagcgcaaaagatg

SEQ ID NO: 101784 - DNA, 103 bp, Artificial Sequence
  Synthetic Polynucleotide
taatacgactcactatagggctccgcctcgtagaagtcggccgactccataacagaggagaatggagatggccgacttcaacctggcggcagcgcaaaagatg

SEQ ID NO: 101785 - DNA, 103 bp, Artificial Sequence
  Synthetic Polynucleotide
taatacgactcactatagggcgcggggcccgcgccccggggaaagccgaaaacagaggagattcggcatgccccggggcaacctggcggcagcgcaaaagatg

SEQ ID NO: 101786 - DNA, 103 bp, Artificial Sequence
  Synthetic Polynucleotide
taatacgactcactataggggccccgcagcgtgtccagttcgcggctcagaacagaggagactgagcatggaactggacaacctggcggcagcgcaaaagatg

SEQ ID NO: 101787 - DNA, 103 bp, Artificial Sequence
  Synthetic Polynucleotide
taatacgactcactatagggggcggaagatgccccgcagcgtgtccagttaacagaggagaaactggatgcgctgcgggaacctggcggcagcgcaaaagatg

SEQ ID NO: 101788 - DNA, 103 bp, Artificial Sequence
  Synthetic Polynucleotide
taatacgactcactatagggtctggcagctggcggaagatgccccgcagcaacagaggagagctgcgatgcatcttccgaacctggcggcagcgcaaaagatg

SEQ ID NO: 101789 - DNA, 103 bp, Artificial Sequence
  Synthetic Polynucleotide
taatacgactcactatagggcaaggagctctctggcagctggcggaagataacagaggagaatcttcatgcagctgccaaacctggcggcagcgcaaaagatg

SEQ ID NO: 101790 - DNA, 103 bp, Artificial Sequence
  Synthetic Polynucleotide
taatacgactcactatagggtggccttgaccaaggagctctctggcagctaacagaggagaagctgcatgagagctcctaacctggcggcagcgcaaaagatg

SEQ ID NO: 101791 - DNA, 103 bp, Artificial Sequence
  Synthetic Polynucleotide
taatacgactcactatagggcagttgcccatggccttgaccaaggagctcaacagaggagagagctcatgggtcaaggcaacctggcggcagcgcaaaagatg

SEQ ID NO: 101792 - DNA, 103 bp, Artificial Sequence
  Synthetic Polynucleotide
taatacgactcactatagggcgggaggctgcgcggggcccgcgccccgggaacagaggagacccgggatgcgggccccgaacctggcggcagcgcaaaagatg

SEQ ID NO: 101793 - DNA, 103 bp, Artificial Sequence
  Synthetic Polynucleotide
taatacgactcactataggggcaggtggggcgggaggctgcgcggggcccaacagaggagagggcccatggcagcctccaacctggcggcagcgcaaaagatg

SEQ ID NO: 101794 - DNA, 103 bp, Artificial Sequence
  Synthetic Polynucleotide
taatacgactcactatagggctccggggcggcaggtggggcgggaggctgaacagaggagacagcctatggccccacctaacctggcggcagcgcaaaagatg

SEQ ID NO: 101795 - DNA, 103 bp, Artificial Sequence
  Synthetic Polynucleotide
taatacgactcactatagggcgcccagcggctccggggcggcaggtggggaacagaggagaccccacatgccgccccggaacctggcggcagcgcaaaagatg

SEQ ID NO: 101796 - DNA, 103 bp, Artificial Sequence
  Synthetic Polynucleotide
taatacgactcactatagggtcgcagatgccgcccagcggctccggggcgaacagaggagacgccccatggccgctgggaacctggcggcagcgcaaaagatg

SEQ ID NO: 101797 - DNA, 103 bp, Artificial Sequence
  Synthetic Polynucleotide
taatacgactcactatagggcgtctcgtgctcgcagatgccgcccagcggaacagaggagaccgctgatgggcatctgcaacctggcggcagcgcaaaagatg

SEQ ID NO: 101798 - DNA, 103 bp, Artificial Sequence
  Synthetic Polynucleotide
taatacgactcactatagggtgtcgatggacgtctcgtgctcgcagatgcaacagaggagagcatctatgagcacgagaaacctggcggcagcgcaaaagatg

SEQ ID NO: 101799 - DNA, 103 bp, Artificial Sequence
  Synthetic Polynucleotide
taatacgactcactatagggtaggcgctgatgtcgatggacgtctcgtgcaacagaggagagcacgaatggtccatcgaaacctggcggcagcgcaaaagatg

SEQ ID NO: 101800 - DNA, 103 bp, Artificial Sequence
  Synthetic Polynucleotide
taatacgactcactatagggcgggtcgatgtaggcgctgatgtcgatggaaacagaggagatccatcatgatcagcgccaacctggcggcagcgcaaaagatg

SEQ ID NO: 101801 - DNA, 103 bp, Artificial Sequence
  Synthetic Polynucleotide
taatacgactcactatagggggggccgcggctccgcctcgtagaagtcggaacagaggagaccgactatgacgaggcggaacctggcggcagcgcaaaagatg

SEQ ID NO: 101802 - DNA, 103 bp, Artificial Sequence
  Synthetic Polynucleotide
taatacgactcactatagggtgaaggcggccgggtcgatgtaggcgctgaaacagaggagatcagcgatgacatcgaccaacctggcggcagcgcaaaagatg

SEQ ID NO: 101803 - DNA, 103 bp, Artificial Sequence
  Synthetic Polynucleotide
taatacgactcactatagggaactcgtcgttgaaggcggccgggtcgatgaacagaggagacatcgaatgggccgccttaacctggcggcagcgcaaaagatg

SEQ ID NO: 101804 - DNA, 103 bp, Artificial Sequence
  Synthetic Polynucleotide
taatacgactcactataggggtcggccaggaactcgtcgttgaaggcggcaacagaggagagccgccatgaacgacgagaacctggcggcagcgcaaaagatg

SEQ ID NO: 101805 - DNA, 103 bp, Artificial Sequence
  Synthetic Polynucleotide
taatacgactcactataggggctggaacaggtcggccaggaactcgtcgtaacagaggagaacgacgatgtcctggccgaacctggcggcagcgcaaaagatg

SEQ ID NO: 101806 - DNA, 103 bp, Artificial Sequence
  Synthetic Polynucleotide
taatacgactcactatagggtgccggctgtgctggaacaggtcggccaggaacagaggagacctggcatgcctgttccaaacctggcggcagcgcaaaagatg

SEQ ID NO: 101807 - DNA, 103 bp, Artificial Sequence
  Synthetic Polynucleotide
taatacgactcactatagggcttctcctgctgccggctgtgctggaacagaacagaggagactgttcatgcacagccggaacctggcggcagcgcaaaagatg

SEQ ID NO: 101808 - DNA, 103 bp, Artificial Sequence
  Synthetic Polynucleotide
taatacgactcactatagggccgccttggccttctcctgctgccggctgtaacagaggagaacagccatgagcaggagaaacctggcggcagcgcaaaagatg

SEQ ID NO: 101809 - DNA, 103 bp, Artificial Sequence
  Synthetic Polynucleotide
taatacgactcactataggggggcccacggccgccttggccttctcctgcaacagaggagagcaggaatgggccaaggcaacctggcggcagcgcaaaagatg

SEQ ID NO: 101810 - DNA, 103 bp, Artificial Sequence
  Synthetic Polynucleotide
taatacgactcactataggggccgcccgtggggcccacggccgccttggcaacagaggagagccaagatggccgtgggcaacctggcggcagcgcaaaagatg

SEQ ID NO: 101811 - DNA, 103 bp, Artificial Sequence
  Synthetic Polynucleotide
taatacgactcactatagggcgccgccgccgccgcccgtggggcccacggaacagaggagaccgtggatgccacgggcgaacctggcggcagcgcaaaagatg

SEQ ID NO: 101812 - DNA, 103 bp, Artificial Sequence
  Synthetic Polynucleotide
taatacgactcactatagggctgctcatcgggggccgcggctccgcctcgaacagaggagacgaggcatggccgcggccaacctggcggcagcgcaaaagatg

SEQ ID NO: 101813 - DNA, 103 bp, Artificial Sequence
  Synthetic Polynucleotide
taatacgactcactatagggtcaaagtcgccgccgccgccgccgcccgtgaacagaggagacacgggatgcggcggcggaacctggcggcagcgcaaaagatg

SEQ ID NO: 101814 - DNA, 103 bp, Artificial Sequence
  Synthetic Polynucleotide
taatacgactcactataggggcccgggtagtcaaagtcgccgccgccgccaacagaggagaggcggcatgggcgactttaacctggcggcagcgcaaaagatg

SEQ ID NO: 101815 - DNA, 103 bp, Artificial Sequence
  Synthetic Polynucleotide
taatacgactcactatagggccgcgggcgcgcccgggtagtcaaagtcgcaacagaggagagcgactatgactacccggaacctggcggcagcgcaaaagatg

SEQ ID NO: 101816 - DNA, 103 bp, Artificial Sequence
  Synthetic Polynucleotide
taatacgactcactatagggccgccggggcccgcgggcgcgcccgggtagaacagaggagactacccatgcgcgcccgcaacctggcggcagcgcaaaagatg

SEQ ID NO: 101817 - DNA, 103 bp, Artificial Sequence
  Synthetic Polynucleotide
taatacgactcactatagggcatgacggcgccgccggggcccgcgggcgcaacagaggagagcgcccatgggccccggcaacctggcggcagcgcaaaagatg

SEQ ID NO: 101818 - DNA, 103 bp, Artificial Sequence
  Synthetic Polynucleotide
taatacgactcactatagggctcccccgggcatgacggcgccgccggggcaacagaggagagccccgatggcgccgtcaaacctggcggcagcgcaaaagatg

SEQ ID NO: 101819 - DNA, 103 bp, Artificial Sequence
  Synthetic Polynucleotide
taatacgactcactatagggggcccgtgcgctcccccgggcatgacggcgaacagaggagacgccgtatggcccgggggaacctggcggcagcgcaaaagatg

SEQ ID NO: 101820 - DNA, 103 bp, Artificial Sequence
  Synthetic Polynucleotide
taatacgactcactataggggccgggcgggggcccgtgcgctcccccgggaacagaggagacccgggatggcgcacgggaacctggcggcagcgcaaaagatg

SEQ ID NO: 101821 - DNA, 103 bp, Artificial Sequence
  Synthetic Polynucleotide
taatacgactcactatagggcgcagccgtagccgggcgggggcccgtgcgaacagaggagacgcacgatgccccgcccgaacctggcggcagcgcaaaagatg

SEQ ID NO: 101822 - DNA, 103 bp, Artificial Sequence
  Synthetic Polynucleotide
taatacgactcactatagggccggcggccgcgcagccgtagccgggcgggaacagaggagacccgccatgctacggctgaacctggcggcagcgcaaaagatg

SEQ ID NO: 101823 - DNA, 103 bp, Artificial Sequence
  Synthetic Polynucleotide
taatacgactcactatagggctgcaggtggctgctcatcgggggccgcggaacagaggagaccgcggatgccgatgagcaacctggcggcagcgcaaaagatg

SEQ ID NO: 101824 - DNA, 103 bp, Artificial Sequence
  Synthetic Polynucleotide
taatacgactcactataggggtccaggtagccggcggccgcgcagccgtaaacagaggagatacggcatggcggccgccaacctggcggcagcgcaaaagatg

SEQ ID NO: 101825 - DNA, 103 bp, Artificial Sequence
  Synthetic Polynucleotide
taatacgactcactatagggccagcctgccgtccaggtagccggcggccgaacagaggagacggccgatggctacctggaacctggcggcagcgcaaaagatg

SEQ ID NO: 101826 - DNA, 103 bp, Artificial Sequence
  Synthetic Polynucleotide
taatacgactcactatagggtacaggggctccagcctgccgtccaggtagaacagaggagactacctatgcggcaggctaacctggcggcagcgcaaaagatg

SEQ ID NO: 101827 - DNA, 103 bp, Artificial Sequence
  Synthetic Polynucleotide
taatacgactcactataggggacgcgctcgtacaggggctccagcctgccaacagaggagaggcaggatggagcccctgaacctggcggcagcgcaaaagatg

SEQ ID NO: 101828 - DNA, 103 bp, Artificial Sequence
  Synthetic Polynucleotide
taatacgactcactatagggccggcgccccgacgcgctcgtacaggggctaacagaggagaagccccatgacgagcgcgaacctggcggcagcgcaaaagatg

SEQ ID NO: 101829 - DNA, 103 bp, Artificial Sequence
  Synthetic Polynucleotide
taatacgactcactatagggggccgcagcgccggcgccccgacgcgctcgaacagaggagacgagcgatgcggggcgccaacctggcggcagcgcaaaagatg

SEQ ID NO: 101830 - DNA, 103 bp, Artificial Sequence
  Synthetic Polynucleotide
taatacgactcactataggggatcaccagcggccgcagcgccggcgccccaacagaggagaggggcgatggcgctgcggaacctggcggcagcgcaaaagatg

SEQ ID NO: 101831 - DNA, 103 bp, Artificial Sequence
  Synthetic Polynucleotide
taatacgactcactataggggctcctgcttgatcaccagcggccgcagcgaacagaggagacgctgcatgcgctggtgaaacctggcggcagcgcaaaagatg

SEQ ID NO: 101832 - DNA, 103 bp, Artificial Sequence
  Synthetic Polynucleotide
taatacgactcactatagggtcctcgcggggctcctgcttgatcaccagcaacagaggagagctggtatgcaagcaggaaacctggcggcagcgcaaaagatg

SEQ ID NO: 101833 - DNA, 103 bp, Artificial Sequence
  Synthetic Polynucleotide
taatacgactcactatagggggcttcatcctcctcgcggggctcctgcttaacagaggagaaagcagatgccccgcgagaacctggcggcagcgcaaaagatg

SEQ ID NO: 101834 - DNA, 103 bp, Artificial Sequence
  Synthetic Polynucleotide
taatacgactcactataggggcggggggctctgcaggtggctgctcatcgaacagaggagacgatgaatggccacctgcaacctggcggcagcgcaaaagatg

SEQ ID NO: 101835 - DNA, 103 bp, Artificial Sequence
  Synthetic Polynucleotide
taatacgactcactatagggccagctgcttggcttcatcctcctcgcgggaacagaggagacccgcgatgaggatgaagaacctggcggcagcgcaaaagatg

SEQ ID NO: 101836 - DNA, 103 bp, Artificial Sequence
  Synthetic Polynucleotide
taatacgactcactatagggccggccagcgccagctgcttggcttcatccaacagaggagaggatgaatgcaagcagctaacctggcggcagcgcaaaagatg

SEQ ID NO: 101837 - DNA, 103 bp, Artificial Sequence
  Synthetic Polynucleotide
taatacgactcactatagggagggaagaggccggccagcgccagctgcttaacagaggagaaagcagatggcgctggccaacctggcggcagcgcaaaagatg

SEQ ID NO: 101838 - DNA, 103 bp, Artificial Sequence
  Synthetic Polynucleotide
taatacgactcactataggggcggctggtaagggaagaggccggccagcgaacagaggagacgctggatggcctcttccaacctggcggcagcgcaaaagatg

SEQ ID NO: 101839 - DNA, 103 bp, Artificial Sequence
  Synthetic Polynucleotide
taatacgactcactatagggggcggcggcggcggctggtaagggaagaggaacagaggagacctcttatgttaccagccaacctggcggcagcgcaaaagatg

SEQ ID NO: 101840 - DNA, 103 bp, Artificial Sequence
  Synthetic Polynucleotide
taatacgactcactatagggcgagggcggcggcggcggcggcggctggtaaacagaggagataccagatgccgccgccgaacctggcggcagcgcaaaagatg

SEQ ID NO: 101841 - DNA, 103 bp, Artificial Sequence
  Synthetic Polynucleotide
taatacgactcactatagggggtgcgggtgcgagggcggcggcggcggcgaacagaggagacgccgcatgcgccgccctaacctggcggcagcgcaaaagatg

SEQ ID NO: 101842 - DNA, 103 bp, Artificial Sequence
  Synthetic Polynucleotide
taatacgactcactatagggggcgggtgcgggtgcgggtgcgagggcggcaacagaggagagccgccatggcacccgcaaacctggcggcagcgcaaaagatg

SEQ ID NO: 101843 - DNA, 103 bp, Artificial Sequence
  Synthetic Polynucleotide
taatacgactcactataggggtgcgcgggcggcgggtgcgggtgcgggtgaacagaggagacacccgatgccgcacccgaacctggcggcagcgcaaaagatg

SEQ ID NO: 101844 - DNA, 103 bp, Artificial Sequence
  Synthetic Polynucleotide
taatacgactcactataggggggcggccaggtgcgcgggcggcgggtgcgaacagaggagacgcaccatgcgcccgcgcaacctggcggcagcgcaaaagatg

SEQ ID NO: 101845 - DNA, 103 bp, Artificial Sequence
  Synthetic Polynucleotide
taatacgactcactatagggctgggcgcgtgcggggggctctgcaggtggaacagaggagaccacctatggagccccccaacctggcggcagcgcaaaagatg

SEQ ID NO: 101846 - DNA, 103 bp, Artificial Sequence
  Synthetic Polynucleotide
taatacgactcactatagggtgcaggtgcggggcggccaggtgcgcgggcaacagaggagagcccgcatgcctggccgcaacctggcggcagcgcaaaagatg

SEQ ID NO: 101847 - DNA, 103 bp, Artificial Sequence
  Synthetic Polynucleotide
taatacgactcactataggggatctggaactgcaggtgcggggcggccagaacagaggagactggccatgccgcacctgaacctggcggcagcgcaaaagatg

SEQ ID NO: 101848 - DNA, 103 bp, Artificial Sequence
  Synthetic Polynucleotide
taatacgactcactatagggcgcagtgcgcgatctggaactgcaggtgcgaacagaggagacgcaccatgagttccagaaacctggcggcagcgcaaaagatg

SEQ ID NO: 101849 - DNA, 103 bp, Artificial Sequence
  Synthetic Polynucleotide
taatacgactcactataggggtggtctggccgcagtgcgcgatctggaacaacagaggagagttccaatgcgcgcactgaacctggcggcagcgcaaaagatg

SEQ ID NO: 101850 - DNA, 103 bp, Artificial Sequence
  Synthetic Polynucleotide
taatacgactcactatagggcaggtgcatggtggtctggccgcagtgcgcaacagaggagagcgcacatgggccagaccaacctggcggcagcgcaaaagatg

SEQ ID NO: 101851 - DNA, 103 bp, Artificial Sequence
  Synthetic Polynucleotide
taatacgactcactataggggaccgggctgcaggtgcatggtggtctggcaacagaggagagccagaatgccatgcaccaacctggcggcagcgcaaaagatg

SEQ ID NO: 101852 - DNA, 103 bp, Artificial Sequence
  Synthetic Polynucleotide
taatacgactcactatagggggcgtggggtgaccgggctgcaggtgcatgaacagaggagacatgcaatggcagcccggaacctggcggcagcgcaaaagatg

SEQ ID NO: 101853 - DNA, 103 bp, Artificial Sequence
  Synthetic Polynucleotide
taatacgactcactatagggcgtgggcggcggcgtggggtgaccgggctgaacagaggagacagcccatgcaccccacgaacctggcggcagcgcaaaagatg

SEQ ID NO: 101854 - DNA, 103 bp, Artificial Sequence
  Synthetic Polynucleotide
taatacgactcactatagggtgggcacgggcgtgggcggcggcgtggggtaacagaggagaaccccaatgcgccgcccaaacctggcggcagcgcaaaagatg

SEQ ID NO: 101855 - DNA, 103 bp, Artificial Sequence
  Synthetic Polynucleotide
taatacgactcactataggggggtgcgggctgggcacgggcgtgggcggcaacagaggagagccgccatggcccgtgccaacctggcggcagcgcaaaagatg

SEQ ID NO: 101856 - DNA, 103 bp, Artificial Sequence
  Synthetic Polynucleotide
taatacgactcactatagggggcggcgctgctgggcgcgtgcggggggctaacagaggagaagccccatgcacgcgcccaacctggcggcagcgcaaaagatg

SEQ ID NO: 101857 - DNA, 103 bp, Artificial Sequence
  Synthetic Polynucleotide
taatacgactcactatagggcgcgggcgcggggtgcgggctgggcacgggaacagaggagacccgtgatgagcccgcacaacctggcggcagcgcaaaagatg

SEQ ID NO: 101858 - DNA, 103 bp, Artificial Sequence
  Synthetic Polynucleotide
taatacgactcactatagggcggcaccgagcgcgggcgcggggtgcgggcaacagaggagagcccgcatgccgcgcccgaacctggcggcagcgcaaaagatg

SEQ ID NO: 101859 - DNA, 103 bp, Artificial Sequence
  Synthetic Polynucleotide
taatacgactcactatagggggcaggccggcggcaccgagcgcgggcgcgaacagaggagacgcgccatggctcggtgcaacctggcggcagcgcaaaagatg

SEQ ID NO: 101860 - DNA, 103 bp, Artificial Sequence
  Synthetic Polynucleotide
taatacgactcactataggggccagggcccggcaggccggcggcaccgagaacagaggagactcggtatggccggcctgaacctggcggcagcgcaaaagatg

SEQ ID NO: 101861 - DNA, 103 bp, Artificial Sequence
  Synthetic Polynucleotide
taatacgactcactatagggtgagcgcgctgccagggcccggcaggccggaacagaggagaccggccatgcgggccctgaacctggcggcagcgcaaaagatg

SEQ ID NO: 101862 - DNA, 103 bp, Artificial Sequence
  Synthetic Polynucleotide
taatacgactcactatagggcccagccccttgagcgcgctgccagggcccaacagaggagagggcccatgcagcgcgctaacctggcggcagcgcaaaagatg

SEQ ID NO: 101863 - DNA, 103 bp, Artificial Sequence
  Synthetic Polynucleotide
taatacgactcactataggggtgcgcggcgcccagccccttgagcgcgctaacagaggagaagcgcgatgaaggggctgaacctggcggcagcgcaaaagatg

SEQ ID NO: 101864 - DNA, 103 bp, Artificial Sequence
  Synthetic Polynucleotide
taatacgactcactatagggggaggtcggggtgcgcggcgcccagcccctaacagaggagaaggggcatggcgccgcgcaacctggcggcagcgcaaaagatg

SEQ ID NO: 101865 - DNA, 103 bp, Artificial Sequence
  Synthetic Polynucleotide
taatacgactcactatagggccactcgcgcggaggtcggggtgcgcggcgaacagaggagacgccgcatgccccgacctaacctggcggcagcgcaaaagatg

SEQ ID NO: 101866 - DNA, 103 bp, Artificial Sequence
  Synthetic Polynucleotide
taatacgactcactataggggccgctgccgccactcgcgcggaggtcgggaacagaggagacccgacatgcgcgcgagtaacctggcggcagcgcaaaagatg

SEQ ID NO: 101867 - DNA, 103 bp, Artificial Sequence
  Synthetic Polynucleotide
taatacgactcactataggggaaagccgaaggcggcgctgctgggcgcgtaacagaggagaacgcgcatggcagcgccgaacctggcggcagcgcaaaagatg

SEQ ID NO: 101868 - DNA, 103 bp, Artificial Sequence
  Synthetic Polynucleotide
taatacgactcactatagggccttgcccgcgccgctgccgccactcgcgcaacagaggagagcgcgaatggcggcagcgaacctggcggcagcgcaaaagatg

SEQ ID NO: 101869 - DNA, 103 bp, Artificial Sequence
  Synthetic Polynucleotide
taatacgactcactataggggacttcttggccttgcccgcgccgctgccgaacagaggagacggcagatgcgcgggcaaaacctggcggcagcgcaaaagatg

SEQ ID NO: 101870 - DNA, 103 bp, Artificial Sequence
  Synthetic Polynucleotide
taatacgactcactatagggcttgtccaccgacttcttggccttgcccgcaacagaggagagcgggcatggccaagaagaacctggcggcagcgcaaaagatg

SEQ ID NO: 101871 - DNA, 103 bp, Artificial Sequence
  Synthetic Polynucleotide
taatacgactcactatagggcgttgctgttcttgtccaccgacttcttggaacagaggagaccaagaatgcggtggacaaacctggcggcagcgcaaaagatg

SEQ ID NO: 101872 - DNA, 103 bp, Artificial Sequence
  Synthetic Polynucleotide
taatacgactcactatagggacccggtactcgttgctgttcttgtccaccaacagaggagaggtggaatggaacagcaaaacctggcggcagcgcaaaagatg

SEQ ID NO: 101873 - DNA, 103 bp, Artificial Sequence
  Synthetic Polynucleotide
taatacgactcactatagggctcgcgccgcacccggtactcgttgctgttaacagaggagaaacagcatggagtaccggaacctggcggcagcgcaaaagatg

SEQ ID NO: 101874 - DNA, 103 bp, Artificial Sequence
  Synthetic Polynucleotide
taatacgactcactatagggtgttgttgcgctcgcgccgcacccggtactaacagaggagaagtaccatgtgcggcgcgaacctggcggcagcgcaaaagatg

SEQ ID NO: 101875 - DNA, 103 bp, Artificial Sequence
  Synthetic Polynucleotide
taatacgactcactatagggcgcaccgcgatgttgttgcgctcgcgccgcaacagaggagagcggcgatggcgcaacaaaacctggcggcagcgcaaaagatg

SEQ ID NO: 101876 - DNA, 103 bp, Artificial Sequence
  Synthetic Polynucleotide
taatacgactcactataggggcggctcttgcgcaccgcgatgttgttgcgaacagaggagacgcaacatgatcgcggtgaacctggcggcagcgcaaaagatg

SEQ ID NO: 101877 - DNA, 103 bp, Artificial Sequence
  Synthetic Polynucleotide
taatacgactcactatagggtggccttgtcgcggctcttgcgcaccgcgaaacagaggagatcgcggatggcaagagccaacctggcggcagcgcaaaagatg

SEQ ID NO: 101878 - DNA, 103 bp, Artificial Sequence
  Synthetic Polynucleotide
taatacgactcactataggggcgccccggggaaagccgaaggcggcgctgaacagaggagacagcgcatgcttcggcttaacctggcggcagcgcaaaagatg

SEQ ID NO: 101879 - DNA, 103 bp, Artificial Sequence
  Synthetic Polynucleotide
taatacgactcactatagggttgcgctgcttggccttgtcgcggctcttgaacagaggagacaagagatgcgacaaggcaacctggcggcagcgcaaaagatg

SEQ ID NO: 101880 - DNA, 103 bp, Artificial Sequence
  Synthetic Polynucleotide
taatacgactcactatagggcgtctccacgttgcgctgcttggccttgtcaacagaggagagacaagatgaagcagcgcaacctggcggcagcgcaaaagatg

SEQ ID NO: 101881 - DNA, 103 bp, Artificial Sequence
  Synthetic Polynucleotide
taatacgactcactatagggccttctgctgcgtctccacgttgcgctgctaacagaggagaagcagcatgacgtggagaaacctggcggcagcgcaaaagatg

SEQ ID NO: 101882 - DNA, 103 bp, Artificial Sequence
  Synthetic Polynucleotide
taatacgactcactatagggagctccagcaccttctgctgcgtctccacgaacagaggagacgtggaatggcagcagaaaacctggcggcagcgcaaaagatg

SEQ ID NO: 101883 - DNA, 103 bp, Artificial Sequence
  Synthetic Polynucleotide
taatacgactcactataggggtcactggtcagctccagcaccttctgctgaacagaggagacagcagatggtgctggagaacctggcggcagcgcaaaagatg

SEQ ID NO: 101884 - DNA, 103 bp, Artificial Sequence
  Synthetic Polynucleotide
taatacgactcactatagggggcggtcattgtcactggtcagctccagcaaacagaggagatgctggatgtgaccagtgaacctggcggcagcgcaaaagatg

SEQ ID NO: 101885 - DNA, 103 bp, Artificial Sequence
  Synthetic Polynucleotide
taatacgactcactatagggcgcttgcgcaggcggtcattgtcactggtcaacagaggagagaccagatgcaatgaccgaacctggcggcagcgcaaaagatg

SEQ ID NO: 101886 - DNA, 103 bp, Artificial Sequence
  Synthetic Polynucleotide
taatacgactcactatagggctgttccacccgcttgcgcaggcggtcattaacagaggagaaatgacatgctgcgcaagaacctggcggcagcgcaaaagatg

SEQ ID NO: 101887 - DNA, 103 bp, Artificial Sequence
  Synthetic Polynucleotide
taatacgactcactatagggcgcggctcagctgttccacccgcttgcgcaaacagaggagatgcgcaatggggtggaacaacctggcggcagcgcaaaagatg

SEQ ID NO: 101888 - DNA, 103 bp, Artificial Sequence
  Synthetic Polynucleotide
taatacgactcactataggggtgtccagttcgcggctcagctgttccaccaacagaggagaggtggaatggctgagccgaacctggcggcagcgcaaaagatg

SEQ ID NO: 101889 - DNA, 103 bp, Artificial Sequence
  Synthetic Polynucleotide
taatacgactcactatagggtgctgggtcccaggccaccaggcgttgcataacagaggagaatgcaaatgctggtggccaacctggcggcagcgcaaaagatg

SEQ ID NO: 101890 - DNA, 103 bp, Artificial Sequence
  Synthetic Polynucleotide
taatacgactcactataggggtacgcagcagccaagcagtccgcctcgtaaacagaggagatacgagatggactgcttgaacctggcggcagcgcaaaagatg

SEQ ID NO: 101891 - DNA, 103 bp, Artificial Sequence
  Synthetic Polynucleotide
taatacgactcactatagggggcgagcaggggctcgggcagctgcttgaaaacagaggagattcaagatgctgcccgagaacctggcggcagcgcaaaagatg

SEQ ID NO: 101892 - DNA, 103 bp, Artificial Sequence
  Synthetic Polynucleotide
taatacgactcactatagggggccggaggaggcgagcaggggctcgggcaaacagaggagatgcccgatgccctgctcgaacctggcggcagcgcaaaagatg

SEQ ID NO: 101893 - DNA, 103 bp, Artificial Sequence
  Synthetic Polynucleotide
taatacgactcactatagggccttgccgccgtacgcagcagccaagcagtaacagaggagaactgctatgctgctgcgtaacctggcggcagcgcaaaagatg

SEQ ID NO: 101894 - DNA, 103 bp, Artificial Sequence
  Synthetic Polynucleotide
taatacgactcactataggggcgggggccgccttgccgccgtacgcagcaaacagaggagatgctgcatgcggcggcaaaacctggcggcagcgcaaaagatg

SEQ ID NO: 101895 - DNA, 103 bp, Artificial Sequence
  Synthetic Polynucleotide
taatacgactcactatagggggggggcgccgcgggggccgccttgccgccaacagaggagaggcggcatggcggcccccaacctggcggcagcgcaaaagatg

SEQ ID NO: 101896 - DNA, 103 bp, Artificial Sequence
  Synthetic Polynucleotide
taatacgactcactataggggtctggccgcggggggcgccgcgggggccgaacagaggagacggcccatgcggcgccccaacctggcggcagcgcaaaagatg

SEQ ID NO: 101897 - DNA, 103 bp, Artificial Sequence
  Synthetic Polynucleotide
taatacgactcactatagggcgcggcccgggtctggccgcggggggcgccaacagaggagaggcgccatgcgcggccagaacctggcggcagcgcaaaagatg

SEQ ID NO: 101898 - DNA, 103 bp, Artificial Sequence
  Synthetic Polynucleotide
taatacgactcactatagggggcgggggggcgcggcccgggtctggccgcaacagaggagagcggccatgcccgggccgaacctggcggcagcgcaaaagatg

SEQ ID NO: 101899 - DNA, 103 bp, Artificial Sequence
  Synthetic Polynucleotide
taatacgactcactatagggccagctcgccggcgggggggcgcggcccggaacagaggagaccgggcatggcccccccgaacctggcggcagcgcaaaagatg

SEQ ID NO: 101900 - DNA, 103 bp, Artificial Sequence
  Synthetic Polynucleotide
taatacgactcactatagggccgatgctgcccagctcgccggcgggggggaacagaggagaccccccatgcggcgagctaacctggcggcagcgcaaaagatg

SEQ ID NO: 101901 - DNA, 103 bp, Artificial Sequence
  Synthetic Polynucleotide
taatacgactcactatagggctcgtggtcgccgatgctgcccagctcgccaacagaggagaggcgagatgggcagcatcaacctggcggcagcgcaaaagatg

SEQ ID NO: 101902 - DNA, 103 bp, Artificial Sequence
  Synthetic Polynucleotide
taatacgactcactataggggggggagacatgctgggtcccaggccaccaaacagaggagatggtggatggggacccagaacctggcggcagcgcaaaagatg

SEQ ID NO: 101903 - DNA, 103 bp, Artificial Sequence
  Synthetic Polynucleotide
taatacgactcactatagggcgatggcgcgctcgtggtcgccgatgctgcaacagaggagagcagcaatggcgaccacgaacctggcggcagcgcaaaagatg

SEQ ID NO: 101904 - DNA, 103 bp, Artificial Sequence
  Synthetic Polynucleotide
taatacgactcactataggggggctgaagtcgatggcgcgctcgtggtcgaacagaggagacgaccaatggcgcgccataacctggcggcagcgcaaaagatg

SEQ ID NO: 101905 - DNA, 103 bp, Artificial Sequence
  Synthetic Polynucleotide
taatacgactcactatagggctccaggtacgggctgaagtcgatggcgcgaacagaggagacgcgccatggacttcagcaacctggcggcagcgcaaaagatg

SEQ ID NO: 101906 - DNA, 103 bp, Artificial Sequence
  Synthetic Polynucleotide
taatacgactcactatagggcgcccagcggctccaggtacgggctgaagtaacagaggagaacttcaatgcgtacctggaacctggcggcagcgcaaaagatg

SEQ ID NO: 101907 - DNA, 103 bp, Artificial Sequence
  Synthetic Polynucleotide
taatacgactcactataggggcctgcggcgcgcccagcggctccaggtacaacagaggagagtacctatggccgctgggaacctggcggcagcgcaaaagatg

SEQ ID NO: 101908 - DNA, 103 bp, Artificial Sequence
  Synthetic Polynucleotide
taatacgactcactataggggggcgccggggcctgcggcgcgcccagcggaacagaggagaccgctgatggcgccgcagaacctggcggcagcgcaaaagatg

SEQ ID NO: 101909 - DNA, 103 bp, Artificial Sequence
  Synthetic Polynucleotide
taatacgactcactatagggtggccgtggcgggcgccggggcctgcggcgaacagaggagacgccgcatgccccggcgcaacctggcggcagcgcaaaagatg

SEQ ID NO: 101910 - DNA, 103 bp, Artificial Sequence
  Synthetic Polynucleotide
taatacgactcactatagggaaggtgtccgtggccgtggcgggcgccgggaacagaggagacccggcatgcgccacggcaacctggcggcagcgcaaaagatg

SEQ ID NO: 101911 - DNA, 103 bp, Artificial Sequence
  Synthetic Polynucleotide
taatacgactcactatagggagccgcctcgaaggtgtccgtggccgtggcaacagaggagagccacgatgacggacaccaacctggcggcagcgcaaaagatg

SEQ ID NO: 101912 - DNA, 103 bp, Artificial Sequence
  Synthetic Polynucleotide
taatacgactcactataggggcgcgggcggagccgcctcgaaggtgtccgaacagaggagacggacaatgtcgaggcggaacctggcggcagcgcaaaagatg

SEQ ID NO: 101913 - DNA, 103 bp, Artificial Sequence
  Synthetic Polynucleotide
taatacgactcactatagggggcggcggcagggggagacatgctgggtccaacagaggagaggacccatgatgtctcccaacctggcggcagcgcaaaagatg

SEQ ID NO: 101914 - DNA, 103 bp, Artificial Sequence
  Synthetic Polynucleotide
taatacgactcactataggggcgggggcgggcgcgggcggagccgcctcgaacagaggagacgaggcatgtccgcccgcaacctggcggcagcgcaaaagatg

SEQ ID NO: 101915 - DNA, 103 bp, Artificial Sequence
  Synthetic Polynucleotide
taatacgactcactatagggggaggcgggcgcgggggcgggcgcgggcggaacagaggagaccgcccatgcccgcccccaacctggcggcagcgcaaaagatg

SEQ ID NO: 101916 - DNA, 103 bp, Artificial Sequence
  Synthetic Polynucleotide
taatacgactcactataggggctgcccggaggaggcgggcgcgggggcggaacagaggagaccgcccatgcgcccgcctaacctggcggcagcgcaaaagatg

SEQ ID NO: 101917 - DNA, 103 bp, Artificial Sequence
  Synthetic Polynucleotide
taatacgactcactatagggaagtcgtggtgctgcccggaggaggcgggcaacagaggagagcccgcatgctccgggcaaacctggcggcagcgcaaaagatg

SEQ ID NO: 101918 - DNA, 103 bp, Artificial Sequence
  Synthetic Polynucleotide
taatacgactcactataggggtcggagaggaagtcgtggtgctgcccggaaacagaggagatccgggatgcaccacgacaacctggcggcagcgcaaaagatg

SEQ ID NO: 101919 - DNA, 103 bp, Artificial Sequence
  Synthetic Polynucleotide
taatacgactcactatagggcggagaagaggtcggagaggaagtcgtggtaacagaggagaaccacgatgtcctctccgaacctggcggcagcgcaaaagatg

SEQ ID NO: 101920 - DNA, 103 bp, Artificial Sequence
  Synthetic Polynucleotide
taatacgactcactatagggccgtagtcgtcggagaagaggtcggagaggaacagaggagacctctcatgcctcttctcaacctggcggcagcgcaaaagatg

SEQ ID NO: 101921 - DNA, 103 bp, Artificial Sequence
  Synthetic Polynucleotide
taatacgactcactataggggttcttgcccccgtagtcgtcggagaagagaacagaggagactcttcatggacgactacaacctggcggcagcgcaaaagatg

SEQ ID NO: 101922 - DNA, 103 bp, Artificial Sequence
  Synthetic Polynucleotide
taatacgactcactataggggcttcttgcagttcttgcccccgtagtcgtaacagaggagaacgactatgggggcaagaaacctggcggcagcgcaaaagatg

SEQ ID NO: 101923 - DNA, 103 bp, Artificial Sequence
  Synthetic Polynucleotide
taatacgactcactatagggtactcggccggcttcttgcagttcttgcccaacagaggagagggcaaatgctgcaagaaaacctggcggcagcgcaaaagatg

SEQ ID NO: 101924 - DNA, 103 bp, Artificial Sequence
  Synthetic Polynucleotide
taatacgactcactatagggggcaggcggcggcggcggcagggggagacaaacagaggagatgtctcatgctgccgccgaacctggcggcagcgcaaaagatg

SEQ ID NO: 101925 - DNA, 103 bp, Artificial Sequence
  Synthetic Polynucleotide
taatacgactcactatagggcacgtagccgtactcggccggcttcttgcaaacagaggagatgcaagatgccggccgagaacctggcggcagcgcaaaagatg

SEQ ID NO: 101926 - DNA, 103 bp, Artificial Sequence
  Synthetic Polynucleotide
taatacgactcactataggggccccaggctcacgtagccgtactcggccgaacagaggagacggccgatgacggctacgaacctggcggcagcgcaaaagatg

SEQ ID NO: 101927 - DNA, 103 bp, Artificial Sequence
  Synthetic Polynucleotide
taatacgactcactataggggcccccaggcgccccaggctcacgtagccgaacagaggagacggctaatggagcctgggaacctggcggcagcgcaaaagatg

SEQ ID NO: 101928 - DNA, 103 bp, Artificial Sequence
  Synthetic Polynucleotide
taatacgactcactataggggcccttggcggcccccaggcgccccaggctaacagaggagaagcctgatgcgcctggggaacctggcggcagcgcaaaagatg

SEQ ID NO: 101929 - DNA, 103 bp, Artificial Sequence
  Synthetic Polynucleotide
taatacgactcactatagggggtgcagcgcgcccttggcggcccccaggcaacagaggagagcctggatgccgccaaggaacctggcggcagcgcaaaagatg

SEQ ID NO: 101930 - DNA, 103 bp, Artificial Sequence
  Synthetic Polynucleotide
taatacgactcactatagggaagcagccggggtgcagcgcgcccttggcgaacagaggagacgccaaatgcgcgctgcaaacctggcggcagcgcaaaagatg

SEQ ID NO: 101931 - DNA, 103 bp, Artificial Sequence
  Synthetic Polynucleotide
taatacgactcactatagggcaggggcgcgaagcagccggggtgcagcgcaacagaggagagcgctgatgcccggctgcaacctggcggcagcgcaaaagatg

SEQ ID NO: 101932 - DNA, 103 bp, Artificial Sequence
  Synthetic Polynucleotide
taatacgactcactataggggcggtgggtgcaggggcgcgaagcagccggaacagaggagaccggctatgtcgcgccccaacctggcggcagcgcaaaagatg

SEQ ID NO: 101933 - DNA, 103 bp, Artificial Sequence
  Synthetic Polynucleotide
taatacgactcactatagggggcggcgggggcggtgggtgcaggggcgcgaacagaggagacgcgccatggcacccaccaacctggcggcagcgcaaaagatg

SEQ ID NO: 101934 - DNA, 103 bp, Artificial Sequence
  Synthetic Polynucleotide
taatacgactcactataggggggcggcggcggcggcgggggcggtgggtgaacagaggagacacccaatgcccccgccgaacctggcggcagcgcaaaagatg

SEQ ID NO: 101935 - DNA, 103 bp, Artificial Sequence
  Synthetic Polynucleotide
taatacgactcactatagggtggatttaaaggcaggcggcggcggcggcaaacagaggagatgccgcatgcgccgcctgaacctggcggcagcgcaaaagatg

SEQ ID NO: 101936 - DNA, 103 bp, Artificial Sequence
  Synthetic Polynucleotide
taatacgactcactatagggtgagctcggcgggcggcggcggcggcggggaacagaggagaccccgcatgcgccgccgcaacctggcggcagcgcaaaagatg

SEQ ID NO: 101937 - DNA, 103 bp, Artificial Sequence
  Synthetic Polynucleotide
taatacgactcactatagggggctccgccttgagctcggcgggcggcggcaacagaggagagccgccatgcgccgagctaacctggcggcagcgcaaaagatg

SEQ ID NO: 101938 - DNA, 103 bp, Artificial Sequence
  Synthetic Polynucleotide
taatacgactcactatagggctcgaagcccggctccgccttgagctcggcaacagaggagagccgagatgaaggcggagaacctggcggcagcgcaaaagatg

SEQ ID NO: 101939 - DNA, 103 bp, Artificial Sequence
  Synthetic Polynucleotide
taatacgactcactatagggagtccgcgggctcgaagcccggctccgcctaacagaggagaaggcggatgcgggcttcgaacctggcggcagcgcaaaagatg

SEQ ID NO: 101940 - DNA, 103 bp, Artificial Sequence
  Synthetic Polynucleotide
taatacgactcactatagggttccgcttgcagtccgcgggctcgaagcccaacagaggagagggcttatggcccgcggaaacctggcggcagcgcaaaagatg

SEQ ID NO: 101941 - DNA, 103 bp, Artificial Sequence
  Synthetic Polynucleotide
taatacgactcactatagggggcctcctccttccgcttgcagtccgcgggaacagaggagacccgcgatgtgcaagcggaacctggcggcagcgcaaaagatg

SEQ ID NO: 101942 - DNA, 103 bp, Artificial Sequence
  Synthetic Polynucleotide
taatacgactcactatagggccggcgccccggcctcctccttccgcttgcaacagaggagagcaagcatgaggaggaggaacctggcggcagcgcaaaagatg

SEQ ID NO: 101943 - DNA, 103 bp, Artificial Sequence
  Synthetic Polynucleotide
taatacgactcactataggggcgccgccgcccggcgccccggcctcctccaacagaggagaggaggaatgcggggcgccaacctggcggcagcgcaaaagatg

SEQ ID NO: 101944 - DNA, 103 bp, Artificial Sequence
  Synthetic Polynucleotide
taatacgactcactatagggcgccatgcctgcgccgccgcccggcgccccaacagaggagaggggcgatgggcggcggcaacctggcggcagcgcaaaagatg

SEQ ID NO: 101945 - DNA, 103 bp, Artificial Sequence
  Synthetic Polynucleotide
taatacgactcactatagggggaagcccgccgccatgcctgcgccgccgcaacagaggagagcggcgatgcaggcatggaacctggcggcagcgcaaaagatg

SEQ ID NO: 101946 - DNA, 103 bp, Artificial Sequence
  Synthetic Polynucleotide
taatacgactcactataggggccacttccatggatttaaaggcaggcggcaacagaggagagccgccatgctttaaatcaacctggcggcagcgcaaaagatg

SEQ ID NO: 101947 - DNA, 103 bp, Artificial Sequence
  Synthetic Polynucleotide
taatacgactcactatagggagcgcgtacgggaagcccgccgccatgcctaacagaggagaaggcatatgggcgggcttaacctggcggcagcgcaaaagatg

SEQ ID NO: 101948 - DNA, 103 bp, Artificial Sequence
  Synthetic Polynucleotide
taatacgactcactataggggtaagcgcgcagcgcgtacgggaagcccgcaacagaggagagcgggcatgccgtacgcgaacctggcggcagcgcaaaagatg

SEQ ID NO: 101949 - DNA, 103 bp, Artificial Sequence
  Synthetic Polynucleotide
taatacgactcactatagggggtagccgaggtaagcgcgcagcgcgtacgaacagaggagacgtacgatgtgcgcgcttaacctggcggcagcgcaaaagatg

SEQ ID NO: 101950 - DNA, 103 bp, Artificial Sequence
  Synthetic Polynucleotide
taatacgactcactatagggggcaccgcctggtagccgaggtaagcgcgcaacagaggagagcgcgcatgcctcggctaaacctggcggcagcgcaaaagatg

SEQ ID NO: 101951 - DNA, 103 bp, Artificial Sequence
  Synthetic Polynucleotide
taatacgactcactataggggctgccgctcggcaccgcctggtagccgagaacagaggagactcggcatgcaggcggtgaacctggcggcagcgcaaaagatg

SEQ ID NO: 101952 - DNA, 103 bp, Artificial Sequence
  Synthetic Polynucleotide
taatacgactcactatagggggctcccgctgctgccgctcggcaccgcctaacagaggagaaggcggatgcgagcggcaaacctggcggcagcgcaaaagatg

SEQ ID NO: 101953 - DNA, 103 bp, Artificial Sequence
  Synthetic Polynucleotide
taatacgactcactataggggacgtggagaggctcccgctgctgccgctcaacagaggagagagcggatgcagcgggagaacctggcggcagcgcaaaagatg

SEQ ID NO: 101954 - DNA, 103 bp, Artificial Sequence
  Synthetic Polynucleotide
taatacgactcactatagggggacgaggaggacgtggagaggctcccgctaacagaggagaagcgggatgctctccacgaacctggcggcagcgcaaaagatg

SEQ ID NO: 101955 - DNA, 103 bp, Artificial Sequence
  Synthetic Polynucleotide
taatacgactcactatagggcgggcgggctggacgaggaggacgtggagaaacagaggagatctccaatgcctcctcgtaacctggcggcagcgcaaaagatg

SEQ ID NO: 101956 - DNA, 103 bp, Artificial Sequence
  Synthetic Polynucleotide
taatacgactcactatagggctcggcgtgccgggcgggctggacgaggagaacagaggagactcctcatgcagcccgccaacctggcggcagcgcaaaagatg

SEQ ID NO: 101957 - DNA, 103 bp, Artificial Sequence
  Synthetic Polynucleotide
taatacgactcactataggggtagaagttggccacttccatggatttaaaaacagaggagatttaaaatgatggaagtgaacctggcggcagcgcaaaagatg

SEQ ID NO: 101958 - DNA, 103 bp, Artificial Sequence
  Synthetic Polynucleotide
taatacgactcactataggggtcagcggggctcggcgtgccgggcgggctaacagaggagaagcccgatgggcacgccgaacctggcggcagcgcaaaagatg

SEQ ID NO: 101959 - DNA, 103 bp, Artificial Sequence
  Synthetic Polynucleotide
taatacgactcactataggggcgccttggcgtcagcggggctcggcgtgcaacagaggagagcacgcatggccccgctgaacctggcggcagcgcaaaagatg

SEQ ID NO: 101960 - DNA, 103 bp, Artificial Sequence
  Synthetic Polynucleotide
taatacgactcactataggggcggtcgggggcgccttggcgtcagcggggaacagaggagaccccgcatgcgccaaggcaacctggcggcagcgcaaaagatg

SEQ ID NO: 101961 - DNA, 103 bp, Artificial Sequence
  Synthetic Polynucleotide
taatacgactcactatagggcgcgtagcaggcggtcgggggcgccttggcaacagaggagagccaagatgcccccgaccaacctggcggcagcgcaaaagatg

SEQ ID NO: 101962 - DNA, 103 bp, Artificial Sequence
  Synthetic Polynucleotide
taatacgactcactataggggcgcggcccccgcgtagcaggcggtcggggaacagaggagaccccgaatgcctgctacgaacctggcggcagcgcaaaagatg

SEQ ID NO: 101963 - DNA, 103 bp, Artificial Sequence
  Synthetic Polynucleotide
taatacgactcactataggggagggcgccggcgcggcccccgcgtagcagaacagaggagactgctaatggggggccgcaacctggcggcagcgcaaaagatg

SEQ ID NO: 101964 - DNA, 103 bp, Artificial Sequence
  Synthetic Polynucleotide
taatacgactcactatagggcttgacctgcgagggcgccggcgcggccccaacagaggagaggggccatgccggcgcccaacctggcggcagcgcaaaagatg

SEQ ID NO: 101965 - DNA, 103 bp, Artificial Sequence
  Synthetic Polynucleotide
taatacgactcactatagggtggccttgctcttgacctgcgagggcgccgaacagaggagacggcgcatgcgcaggtcaaacctggcggcagcgcaaaagatg

SEQ ID NO: 101966 - DNA, 103 bp, Artificial Sequence
  Synthetic Polynucleotide
taatacgactcactatagggacggtcttcttggccttgctcttgacctgcaacagaggagagcaggtatggagcaaggcaacctggcggcagcgcaaaagatg

SEQ ID NO: 101967 - DNA, 103 bp, Artificial Sequence
  Synthetic Polynucleotide
taatacgactcactataggggtgcttgtccacggtcttcttggccttgctaacagaggagaagcaagatgaagaagaccaacctggcggcagcgcaaaagatg

SEQ ID NO: 101968 - DNA, 103 bp, Artificial Sequence
  Synthetic Polynucleotide
taatacgactcactatagggccgcctcgtagtagaagttggccacttccaaacagaggagatggaagatgccaacttctaacctggcggcagcgcaaaagatg

SEQ ID NO: 101969 - DNA, 103 bp, Artificial Sequence
  Synthetic Polynucleotide
taatacgactcactatagggactcgtcgctgtgcttgtccacggtcttctaacagaggagaagaagaatgtggacaagcaacctggcggcagcgcaaaagatg

SEQ ID NO: 101970 - DNA, 103 bp, Artificial Sequence
  Synthetic Polynucleotide
taatacgactcactatagggcggatcttgtactcgtcgctgtgcttgtccaacagaggagaggacaaatgcagcgacgaaacctggcggcagcgcaaaagatg

SEQ ID NO: 101971 - DNA, 103 bp, Artificial Sequence
  Synthetic Polynucleotide
taatacgactcactataggggcgctcgcgccggatcttgtactcgtcgctaacagaggagaagcgacatgtacaagatcaacctggcggcagcgcaaaagatg

SEQ ID NO: 101972 - DNA, 103 bp, Artificial Sequence
  Synthetic Polynucleotide
taatacgactcactatagggcgatgttgttgcgctcgcgccggatcttgtaacagaggagaacaagaatgggcgcgagcaacctggcggcagcgcaaaagatg

SEQ ID NO: 101973 - DNA, 103 bp, Artificial Sequence
  Synthetic Polynucleotide
taatacgactcactatagggttgcgcacggcgatgttgttgcgctcgcgcaacagaggagagcgcgaatgcaacaacataacctggcggcagcgcaaaagatg

SEQ ID NO: 101974 - DNA, 103 bp, Artificial Sequence
  Synthetic Polynucleotide
taatacgactcactataggggtcgcggctcttgcgcacggcgatgttgttaacagaggagaaacaacatggccgtgcgcaacctggcggcagcgcaaaagatg

SEQ ID NO: 101975 - DNA, 103 bp, Artificial Sequence
  Synthetic Polynucleotide
taatacgactcactatagggtcttggccttgtcgcggctcttgcgcacggaacagaggagaccgtgcatgagagccgcgaacctggcggcagcgcaaaagatg

SEQ ID NO: 101976 - DNA, 103 bp, Artificial Sequence
  Synthetic Polynucleotide
taatacgactcactatagggaggttgcgcatcttggccttgtcgcggctcaacagaggagagagccgatgcaaggccaaaacctggcggcagcgcaaaagatg

SEQ ID NO: 101977 - DNA, 103 bp, Artificial Sequence
  Synthetic Polynucleotide
taatacgactcactatagggctgcgtctccaggttgcgcatcttggccttaacagaggagaaaggccatgatgcgcaacaacctggcggcagcgcaaaagatg

SEQ ID NO: 101978 - DNA, 103 bp, Artificial Sequence
  Synthetic Polynucleotide
taatacgactcactatagggggaccttgtgctgcgtctccaggttgcgcaaacagaggagatgcgcaatgtggagacgcaacctggcggcagcgcaaaagatg

SEQ ID NO: 101979 - DNA, 103 bp, Artificial Sequence
  Synthetic Polynucleotide
taatacgactcactataggggccaagcagtccgcctcgtagtagaagttgaacagaggagacaacttatgctacgaggcaacctggcggcagcgcaaaagatg

SEQ ID NO: 101980 - DNA, 103 bp, Artificial Sequence
  Synthetic Polynucleotide
taatacgactcactataggggtgagctccaggaccttgtgctgcgtctccaacagaggagaggagacatggcacaaggtaacctggcggcagcgcaaaagatg

SEQ ID NO: 101981 - DNA, 103 bp, Artificial Sequence
  Synthetic Polynucleotide
taatacgactcactataggggttctcggccgtgagctccaggaccttgtgaacagaggagacacaagatgctggagctcaacctggcggcagcgcaaaagatg

SEQ ID NO: 101982 - DNA, 103 bp, Artificial Sequence
  Synthetic Polynucleotide
taatacgactcactataggggcagccgctcgttctcggccgtgagctccaaacagaggagatggagcatgcggccgagaaacctggcggcagcgcaaaagatg

SEQ ID NO: 101983 - DNA, 103 bp, Artificial Sequence
  Synthetic Polynucleotide
taatacgactcactatagggaccttcttctgcagccgctcgttctcggccaacagaggagaggccgaatgcgagcggctaacctggcggcagcgcaaaagatg

SEQ ID NO: 101984 - DNA, 103 bp, Artificial Sequence
  Synthetic Polynucleotide
taatacgactcactatagggcagctgctccaccttcttctgcagccgctcaacagaggagagagcggatgcagaagaagaacctggcggcagcgcaaaagatg

SEQ ID NO: 101985 - DNA, 103 bp, Artificial Sequence
  Synthetic Polynucleotide
taatacgactcactataggggctcgcgcgacagctgctccaccttcttctaacagaggagaagaagaatgtggagcagcaacctggcggcagcgcaaaagatg

SEQ ID NO: 101986 - DNA, 103 bp, Artificial Sequence
  Synthetic Polynucleotide
taatacgactcactatagggagggtgctgagctcgcgcgacagctgctccaacagaggagaggagcaatggtcgcgcgaaacctggcggcagcgcaaaagatg

SEQ ID NO: 101987 - DNA, 103 bp, Artificial Sequence
  Synthetic Polynucleotide
taatacgactcactatagggcaagttccgcagggtgctgagctcgcgcgaaacagaggagatcgcgcatgctcagcaccaacctggcggcagcgcaaaagatg

SEQ ID NO: 101988 - DNA, 103 bp, Artificial Sequence
  Synthetic Polynucleotide
taatacgactcactataggggctgcttgaacaagttccgcagggtgctgaaacagaggagatcagcaatgtgcggaactaacctggcggcagcgcaaaagatg

SEQ ID NO: 101989 - DNA, 103 bp, Artificial Sequence
  Synthetic Polynucleotide
taatacgactcactatagggggctcgggcagctgcttgaacaagttccgcaacagaggagagcggaaatggttcaagcaaacctggcggcagcgcaaaagatg

SEQ ID NO: 101990 - DNA, 103 bp, Artificial Sequence
  Synthetic Polynucleotide
taatacgactcactataggggccgtccaggctgaagagcgcggcgctcataacagaggagaatgagcatggcgctcttcaacctggcggcagcgcaaaagatg

SEQ ID NO: 101991 - DNA, 103 bp, Artificial Sequence
  Synthetic Polynucleotide
taatacgactcactatagggccctggctcggccccgcggcccggcttgccaacagaggagaggcaagatgggccgcgggaacctggcggcagcgcaaaagatg

SEQ ID NO: 101992 - DNA, 103 bp, Artificial Sequence
  Synthetic Polynucleotide
taatacgactcactatagggcgcctagggcccctggctcggccccgcggcaacagaggagagccgcgatgccgagccagaacctggcggcagcgcaaaagatg

SEQ ID NO: 101993 - DNA, 103 bp, Artificial Sequence
  Synthetic Polynucleotide
taatacgactcactataggggcgcctggctcgcctagggcccctggctcgaacagaggagacgagccatgggccctaggaacctggcggcagcgcaaaagatg

SEQ ID NO: 101994 - DNA, 103 bp, Artificial Sequence
  Synthetic Polynucleotide
taatacgactcactataggggggggcggcggcgcctggctcgcctagggcaacagaggagagccctaatggagccaggcaacctggcggcagcgcaaaagatg

SEQ ID NO: 101995 - DNA, 103 bp, Artificial Sequence
  Synthetic Polynucleotide
taatacgactcactatagggcgtacatggcgggggcggcggcgcctggctaacagaggagaagccagatgccgccgcccaacctggcggcagcgcaaaagatg

SEQ ID NO: 101996 - DNA, 103 bp, Artificial Sequence
  Synthetic Polynucleotide
taatacgactcactatagggctctcgtcgtcgtacatggcgggggcggcgaacagaggagacgccgcatgcgccatgtaaacctggcggcagcgcaaaagatg

SEQ ID NO: 101997 - DNA, 103 bp, Artificial Sequence
  Synthetic Polynucleotide
taatacgactcactataggggtcgatggcgctctcgtcgtcgtacatggcaacagaggagagccatgatggacgacgagaacctggcggcagcgcaaaagatg

SEQ ID NO: 101998 - DNA, 103 bp, Artificial Sequence
  Synthetic Polynucleotide
taatacgactcactatagggaggcgctgaagtcgatggcgctctcgtcgtaacagaggagaacgacgatggcgccatcgaacctggcggcagcgcaaaagatg

SEQ ID NO: 101999 - DNA, 103 bp, Artificial Sequence
  Synthetic Polynucleotide
taatacgactcactataggggagtcgatgtaggcgctgaagtcgatggcgaacagaggagacgccatatgcttcagcgcaacctggcggcagcgcaaaagatg

SEQ ID NO: 102000 - DNA, 103 bp, Artificial Sequence
  Synthetic Polynucleotide
taatacgactcactatagggggcggccatggagtcgatgtaggcgctgaaaacagaggagattcagcatgtacatcgacaacctggcggcagcgcaaaagatg

SEQ ID NO: 102001 - DNA, 103 bp, Artificial Sequence
  Synthetic Polynucleotide
taatacgactcactatagggcgcgcgccgggccgtccaggctgaagagcgaacagaggagacgctctatggcctggacgaacctggcggcagcgcaaaagatg

SEQ ID NO: 102002 - DNA, 103 bp, Artificial Sequence
  Synthetic Polynucleotide
taatacgactcactataggggggtgggcacggcggccatggagtcgatgtaacagaggagaacatcgatgccatggccgaacctggcggcagcgcaaaagatg

SEQ ID NO: 102003 - DNA, 103 bp, Artificial Sequence
  Synthetic Polynucleotide
taatacgactcactatagggcacagctccagggtgggcacggcggccatgaacagaggagacatggcatgcgtgcccacaacctggcggcagcgcaaaagatg

SEQ ID NO: 102004 - DNA, 103 bp, Artificial Sequence
  Synthetic Polynucleotide
taatacgactcactatagggctcgtcgtggcacagctccagggtgggcacaacagaggagagtgcccatgctggagctgaacctggcggcagcgcaaaagatg

SEQ ID NO: 102005 - DNA, 103 bp, Artificial Sequence
  Synthetic Polynucleotide
taatacgactcactatagggcggcgaagagctcgtcgtggcacagctccaaacagaggagatggagcatggccacgacgaacctggcggcagcgcaaaagatg

SEQ ID NO: 102006 - DNA, 103 bp, Artificial Sequence
  Synthetic Polynucleotide
taatacgactcactatagggttgaagaggtcggcgaagagctcgtcgtggaacagaggagaccacgaatggctcttcgcaacctggcggcagcgcaaaagatg

SEQ ID NO: 102007 - DNA, 103 bp, Artificial Sequence
  Synthetic Polynucleotide
taatacgactcactataggggtgattgctgttgaagaggtcggcgaagagaacagaggagactcttcatggacctcttcaacctggcggcagcgcaaaagatg

SEQ ID NO: 102008 - DNA, 103 bp, Artificial Sequence
  Synthetic Polynucleotide
taatacgactcactatagggcgcccgccttgtgattgctgttgaagaggtaacagaggagaacctctatgacagcaatcaacctggcggcagcgcaaaagatg

SEQ ID NO: 102009 - DNA, 103 bp, Artificial Sequence
  Synthetic Polynucleotide
taatacgactcactatagggggccccgcgccgcccgccttgtgattgctgaacagaggagacagcaaatgcaaggcgggaacctggcggcagcgcaaaagatg

SEQ ID NO: 102010 - DNA, 103 bp, Artificial Sequence
  Synthetic Polynucleotide
taatacgactcactatagggaagctccaggggccccgcgccgcccgccttaacagaggagaaaggcgatgggcgcggggaacctggcggcagcgcaaaagatg

SEQ ID NO: 102011 - DNA, 103 bp, Artificial Sequence
  Synthetic Polynucleotide
taatacgactcactatagggcgccgggaagaagctccaggggccccgcgcaacagaggagagcgcggatgccctggagcaacctggcggcagcgcaaaagatg

SEQ ID NO: 102012 - DNA, 103 bp, Artificial Sequence
  Synthetic Polynucleotide
taatacgactcactatagggcagggcgcgccgcgcgccgggccgtccaggaacagaggagacctggaatgcccggcgcgaacctggcggcagcgcaaaagatg

SEQ ID NO: 102013 - DNA, 103 bp, Artificial Sequence
  Synthetic Polynucleotide
taatacgactcactatagggcgcgcggggccgccgggaagaagctccaggaacagaggagacctggaatgtcttcccggaacctggcggcagcgcaaaagatg

SEQ ID NO: 102014 - DNA, 103 bp, Artificial Sequence
  Synthetic Polynucleotide
taatacgactcactataggggcccaaggggcgcgcggggccgccgggaagaacagaggagacttcccatgggccccgcgaacctggcggcagcgcaaaagatg

SEQ ID NO: 102015 - DNA, 103 bp, Artificial Sequence
  Synthetic Polynucleotide
taatacgactcactatagggcagggcccgggcccaaggggcgcgcggggcaacagaggagagccccgatggccccttggaacctggcggcagcgcaaaagatg

SEQ ID NO: 102016 - DNA, 103 bp, Artificial Sequence
  Synthetic Polynucleotide
taatacgactcactatagggcggggagcggcagggcccgggcccaaggggaacagaggagaccccttatgcccgggcccaacctggcggcagcgcaaaagatg

SEQ ID NO: 102017 - DNA, 103 bp, Artificial Sequence
  Synthetic Polynucleotide
taatacgactcactatagggcttgagcaggcggggagcggcagggcccggaacagaggagaccgggcatggccgctcccaacctggcggcagcgcaaaagatg

SEQ ID NO: 102018 - DNA, 103 bp, Artificial Sequence
  Synthetic Polynucleotide
taatacgactcactatagggcgggctcgcgcttgagcaggcggggagcggaacagaggagaccgctcatggcctgctcaaacctggcggcagcgcaaaagatg

SEQ ID NO: 102019 - DNA, 103 bp, Artificial Sequence
  Synthetic Polynucleotide
taatacgactcactatagggtcgccccagtcgggctcgcgcttgagcaggaacagaggagacctgctatggcgcgagccaacctggcggcagcgcaaaagatg

SEQ ID NO: 102020 - DNA, 103 bp, Artificial Sequence
  Synthetic Polynucleotide
taatacgactcactatagggcgcgtcgccgtcgccccagtcgggctcgcgaacagaggagacgcgagatggactggggcaacctggcggcagcgcaaaagatg

SEQ ID NO: 102021 - DNA, 103 bp, Artificial Sequence
  Synthetic Polynucleotide
taatacgactcactataggggcgagccgggcgcgtcgccgtcgccccagtaacagaggagaactgggatgacggcgacgaacctggcggcagcgcaaaagatg

SEQ ID NO: 102022 - DNA, 103 bp, Artificial Sequence
  Synthetic Polynucleotide
taatacgactcactataggggcgggcaacagcgagccgggcgcgtcgccgaacagaggagacggcgaatggcccggctcaacctggcggcagcgcaaaagatg

SEQ ID NO: 102023 - DNA, 103 bp, Artificial Sequence
  Synthetic Polynucleotide
taatacgactcactatagggctccgcaggccagggcgcgccgcgcgccggaacagaggagaccggcgatgggcgcgcccaacctggcggcagcgcaaaagatg

SEQ ID NO: 102024 - DNA, 103 bp, Artificial Sequence
  Synthetic Polynucleotide
taatacgactcactatagggggccacctgcgcgggcaacagcgagccgggaacagaggagacccggcatgctgttgcccaacctggcggcagcgcaaaagatg

SEQ ID NO: 102025 - DNA, 103 bp, Artificial Sequence
  Synthetic Polynucleotide
taatacgactcactataggggtgcgcacgcggccacctgcgcgggcaacaaacagaggagatgttgcatgcgcaggtggaacctggcggcagcgcaaaagatg

SEQ ID NO: 102026 - DNA, 103 bp, Artificial Sequence
  Synthetic Polynucleotide
taatacgactcactatagggaccacggtctgtgcgcacgcggccacctgcaacagaggagagcaggtatgcgcgtgcgcaacctggcggcagcgcaaaagatg

SEQ ID NO: 102027 - DNA, 103 bp, Artificial Sequence
  Synthetic Polynucleotide
taatacgactcactatagggcgccaagctcaccacggtctgtgcgcacgcaacagaggagagcgtgcatgcagaccgtgaacctggcggcagcgcaaaagatg

SEQ ID NO: 102028 - DNA, 103 bp, Artificial Sequence
  Synthetic Polynucleotide
taatacgactcactataggggccctgcggccgccaagctcaccacggtctaacagaggagaagaccgatgtgagcttggaacctggcggcagcgcaaaagatg

SEQ ID NO: 102029 - DNA, 103 bp, Artificial Sequence
  Synthetic Polynucleotide
taatacgactcactatagggggggtgggctgccctgcggccgccaagctcaacagaggagagagcttatgggccgcaggaacctggcggcagcgcaaaagatg

SEQ ID NO: 102030 - DNA, 103 bp, Artificial Sequence
  Synthetic Polynucleotide
taatacgactcactatagggcgacgtgggcggggtgggctgccctgcggcaacagaggagagccgcaatgcagcccaccaacctggcggcagcgcaaaagatg

SEQ ID NO: 102031 - DNA, 103 bp, Artificial Sequence
  Synthetic Polynucleotide
taatacgactcactataggggcggctccggcgacgtgggcggggtgggctaacagaggagaagcccaatgcgcccacgtaacctggcggcagcgcaaaagatg

SEQ ID NO: 102032 - DNA, 103 bp, Artificial Sequence
  Synthetic Polynucleotide
taatacgactcactatagggctgctgcgcggcggctccggcgacgtgggcaacagaggagagcccacatggccggagccaacctggcggcagcgcaaaagatg

SEQ ID NO: 102033 - DNA, 103 bp, Artificial Sequence
  Synthetic Polynucleotide
taatacgactcactatagggctgcctggggctgctgcgcggcggctccggaacagaggagaccggagatgccgcgcagcaacctggcggcagcgcaaaagatg

SEQ ID NO: 102034 - DNA, 103 bp, Artificial Sequence
  Synthetic Polynucleotide
taatacgactcactatagggagggcgcaggctccgcaggccagggcgcgcaacagaggagagcgcgcatgggcctgcggaacctggcggcagcgcaaaagatg

SEQ ID NO: 102035 - DNA, 103 bp, Artificial Sequence
  Synthetic Polynucleotide
taatacgactcactataggggcgcgggggtctgcctggggctgctgcgcgaacagaggagacgcgcaatggccccaggcaacctggcggcagcgcaaaagatg

SEQ ID NO: 102036 - DNA, 103 bp, Artificial Sequence
  Synthetic Polynucleotide
taatacgactcactataggggcggggccgggcgcgggggtctgcctggggaacagaggagaccccagatggacccccgcaacctggcggcagcgcaaaagatg

SEQ ID NO: 102037 - DNA, 103 bp, Artificial Sequence
  Synthetic Polynucleotide
taatacgactcactatagggcttctcccgggcggggccgggcgcgggggtaacagaggagaacccccatgcccggccccaacctggcggcagcgcaaaagatg

SEQ ID NO: 102038 - DNA, 103 bp, Artificial Sequence
  Synthetic Polynucleotide
taatacgactcactatagggtgccggcgctcttctcccgggcggggccggaacagaggagaccggccatgcccgggagaaacctggcggcagcgcaaaagatg

SEQ ID NO: 102039 - DNA, 103 bp, Artificial Sequence
  Synthetic Polynucleotide
taatacgactcactataggggggcccctcttgccggcgctcttctcccggaacagaggagaccgggaatggagcgccggaacctggcggcagcgcaaaagatg

SEQ ID NO: 102040 - DNA, 103 bp, Artificial Sequence
  Synthetic Polynucleotide
taatacgactcactataggggccgcggtccgggcccctcttgccggcgctaacagaggagaagcgccatgaagaggggcaacctggcggcagcgcaaaagatg

SEQ ID NO: 102041 - DNA, 103 bp, Artificial Sequence
  Synthetic Polynucleotide
taatacgactcactatagggactcggggctgccgcggtccgggcccctctaacagaggagaagagggatgcggaccgcgaacctggcggcagcgcaaaagatg

SEQ ID NO: 102042 - DNA, 103 bp, Artificial Sequence
  Synthetic Polynucleotide
taatacgactcactatagggcgctgccggtactcggggctgccgcggtccaacagaggagaggaccgatgcagccccgaaacctggcggcagcgcaaaagatg

SEQ ID NO: 102043 - DNA, 103 bp, Artificial Sequence
  Synthetic Polynucleotide
taatacgactcactataggggcgctcgcgccgctgccggtactcggggctaacagaggagaagccccatgtaccggcagaacctggcggcagcgcaaaagatg

SEQ ID NO: 102044 - DNA, 103 bp, Artificial Sequence
  Synthetic Polynucleotide
taatacgactcactatagggcgatgttgttgcgctcgcgccgctgccggtaacagaggagaaccggcatgggcgcgagcaacctggcggcagcgcaaaagatg

SEQ ID NO: 102045 - DNA, 103 bp, Artificial Sequence
  Synthetic Polynucleotide
taatacgactcactatagggggttcgtagaagggcgcaggctccgcaggcaacagaggagagcctgcatggcctgcgccaacctggcggcagcgcaaaagatg

SEQ ID NO: 102046 - DNA, 103 bp, Artificial Sequence; identical to SEQ ID NO: 101973
  Synthetic Polynucleotide

SEQ ID NO: 102047 - DNA, 103 bp, Artificial Sequence; identical to SEQ ID NO: 101974
  Synthetic Polynucleotide

SEQ ID NO: 102048 - DNA, 103 bp, Artificial Sequence
  Synthetic Polynucleotide
taatacgactcactataggggcttggccttgtcgcggctcttgcgcacggaacagaggagaccgtgcatgagagccgcgaacctggcggcagcgcaaaagatg

SEQ ID NO: 102049 - DNA, 103 bp, Artificial Sequence
  Synthetic Polynucleotide
taatacgactcactatagggtggttgcgccgcttggccttgtcgcggctcaacagaggagagagccgatgcaaggccaaaacctggcggcagcgcaaaagatg

SEQ ID NO: 102050 - DNA, 103 bp, Artificial Sequence
  Synthetic Polynucleotide
taatacgactcactatagggctgcatctcctggttgcgccgcttggccttaacagaggagaaaggccatgcggcgcaacaacctggcggcagcgcaaaagatg

SEQ ID NO: 102051 - DNA, 103 bp, Artificial Sequence
  Synthetic Polynucleotide
taatacgactcactatagggccaacttctgctgcatctcctggttgcgccaacagaggagaggcgcaatgaggagatgcaacctggcggcagcgcaaaagatg

SEQ ID NO: 102052 - DNA, 103 bp, Artificial Sequence
  Synthetic Polynucleotide
taatacgactcactataggggacagctccaccaacttctgctgcatctccaacagaggagaggagatatggcagaagttaacctggcggcagcgcaaaagatg

SEQ ID NO: 102053 - DNA, 103 bp, Artificial Sequence
  Synthetic Polynucleotide
taatacgactcactataggggttctcagccgacagctccaccaacttctgaacagaggagacagaagatggtggagctgaacctggcggcagcgcaaaagatg

SEQ ID NO: 102054 - DNA, 103 bp, Artificial Sequence
  Synthetic Polynucleotide
taatacgactcactataggggcagcttctcgttctcagccgacagctccaaacagaggagatggagcatgcggctgagaaacctggcggcagcgcaaaagatg

SEQ ID NO: 102055 - DNA, 103 bp, Artificial Sequence
  Synthetic Polynucleotide
taatacgactcactatagggacgcgctggtgcagcttctcgttctcagccaacagaggagaggctgaatgcgagaagctaacctggcggcagcgcaaaagatg

SEQ ID NO: 102056 - DNA, 103 bp, Artificial Sequence
  Synthetic Polynucleotide
taatacgactcactatagggcgcccggcccggttcgtagaagggcgcaggaacagaggagacctgcgatgttctacgaaaacctggcggcagcgcaaaagatg

SEQ ID NO: 102057 - DNA, 103 bp, Artificial Sequence
  Synthetic Polynucleotide
taatacgactcactataggggagctgctccacgcgctggtgcagcttctcaacagaggagagagaagatgcaccagcgcaacctggcggcagcgcaaaagatg

SEQ ID NO: 102058 - DNA, 103 bp, Artificial Sequence
  Synthetic Polynucleotide
taatacgactcactatagggggtcccgcgtgagctgctccacgcgctggtaacagaggagaaccagcatgtggagcagcaacctggcggcagcgcaaaagatg

SEQ ID NO: 102059 - DNA, 103 bp, Artificial Sequence
  Synthetic Polynucleotide
taatacgactcactatagggaggccggccaggtcccgcgtgagctgctccaacagaggagaggagcaatgcacgcgggaaacctggcggcagcgcaaaagatg

SEQ ID NO: 102060 - DNA, 103 bp, Artificial Sequence
  Synthetic Polynucleotide
taatacgactcactataggggaactgccggaggccggccaggtcccgcgtaacagaggagaacgcggatgctggccggcaacctggcggcagcgcaaaagatg

SEQ ID NO: 102061 - DNA, 103 bp, Artificial Sequence
  Synthetic Polynucleotide
taatacgactcactataggggctgcttgaagaactgccggaggccggccaaacagaggagatggccgatgtccggcagtaacctggcggcagcgcaaaagatg

SEQ ID NO: 102062 - DNA, 103 bp, Artificial Sequence
  Synthetic Polynucleotide
taatacgactcactataggggggctgggcagctgcttgaagaactgccggaacagaggagaccggcaatgcttcaagcaaacctggcggcagcgcaaaagatg

SEQ ID NO: 102063 - DNA, 103 bp, Artificial Sequence
  Synthetic Polynucleotide
taatacgactcactatagggcaggaagggcgggctgggcagctgcttgaaaacagaggagattcaagatgctgcccagcaacctggcggcagcgcaaaagatg

SEQ ID NO: 102064 - DNA, 103 bp, Artificial Sequence
  Synthetic Polynucleotide
taatacgactcactatagggcggcggccggcaggaagggcgggctgggcaaacagaggagatgcccaatgcgcccttccaacctggcggcagcgcaaaagatg

SEQ ID NO: 102065 - DNA, 103 bp, Artificial Sequence
  Synthetic Polynucleotide
taatacgactcactatagggtctgctgtcccggcggccggcaggaagggcaacagaggagagcccttatggccggccgcaacctggcggcagcgcaaaagatg

SEQ ID NO: 102066 - DNA, 103 bp, Artificial Sequence
  Synthetic Polynucleotide
taatacgactcactatagggttaccggcagtctgctgtcccggcggccggaacagaggagaccggccatggggacagcaaacctggcggcagcgcaaaagatg

SEQ ID NO: 102067 - DNA, 103 bp, Artificial Sequence
  Synthetic Polynucleotide
taatacgactcactatagggccggcttgcccgcccggcccggttcgtagaaacagaggagatctacgatgcgggccgggaacctggcggcagcgcaaaagatg

SEQ ID NO: 102068 - DNA, 103 bp, Artificial Sequence
  Synthetic Polynucleotide
taatacgactcactataggggccccgcggcccggcttgcccgcccggcccaacagaggagagggccgatggggcaagccaacctggcggcagcgcaaaagatg

SEQ ID NO: 102069 - DNA, 103 bp, Artificial Sequence
  Synthetic Polynucleotide
taatacgactcactatagggctcacactcgtagtaggtcccgtgggacataacagaggagaatgtccatggggacctacaacctggcggcagcgcaaaagatg

SEQ ID NO: 102070 - DNA, 103 bp, Artificial Sequence
  Synthetic Polynucleotide
taatacgactcactatagggaatggaggcctcatgctcacacatgtccccaacagaggagaggggacatgtgtgagcataacctggcggcagcgcaaaagatg

SEQ ID NO: 102071 - DNA, 103 bp, Artificial Sequence
  Synthetic Polynucleotide
taatacgactcactatagggcggagaggtcaatggaggcctcatgctcacaacagaggagagtgagcatgaggcctccaaacctggcggcagcgcaaaagatg

SEQ ID NO: 102072 - DNA, 103 bp, Artificial Sequence
  Synthetic Polynucleotide
taatacgactcactatagggtcgatgtaggcggagaggtcaatggaggccaacagaggagaggcctcatgtgacctctcaacctggcggcagcgcaaaagatg

SEQ ID NO: 102073 - DNA, 103 bp, Artificial Sequence
  Synthetic Polynucleotide
taatacgactcactatagggttccccagactcgatgtaggcggagaggtcaacagaggagagacctcatggcctacatcaacctggcggcagcgcaaaagatg

SEQ ID NO: 102074 - DNA, 103 bp, Artificial Sequence
  Synthetic Polynucleotide
taatacgactcactataggggaagctgctcttccccagactcgatgtaggaacagaggagacctacaatgagtctggggaacctggcggcagcgcaaaagatg

SEQ ID NO: 102075 - DNA, 103 bp, Artificial Sequence
  Synthetic Polynucleotide
taatacgactcactatagggagatcggagagaagctgctcttccccagacaacagaggagagtctggatgagagcagctaacctggcggcagcgcaaaagatg

SEQ ID NO: 102076 - DNA, 103 bp, Artificial Sequence
  Synthetic Polynucleotide
taatacgactcactatagggcacggcaaagagatcggagagaagctgctcaacagaggagagagcagatgctctccgataacctggcggcagcgcaaaagatg

SEQ ID NO: 102077 - DNA, 103 bp, Artificial Sequence
  Synthetic Polynucleotide
taatacgactcactataggggcgctggcttcacggcaaagagatcggagaaacagaggagatctccgatgtctttgccgaacctggcggcagcgcaaaagatg

SEQ ID NO: 102078 - DNA, 103 bp, Artificial Sequence
  Synthetic Polynucleotide
taatacgactcactatagggctggcctcaggcgctggcttcacggcaaagaacagaggagactttgcatggaagccagcaacctggcggcagcgcaaaagatg

SEQ ID NO: 102079 - DNA, 103 bp, Artificial Sequence
  Synthetic Polynucleotide
taatacgactcactatagggcttgaggcctctggcctcaggcgctggcttaacagaggagaaagccaatgcctgaggccaacctggcggcagcgcaaaagatg

SEQ ID NO: 102080 - DNA, 103 bp, Artificial Sequence
  Synthetic Polynucleotide
taatacgactcactatagggcaccccggggctcacactcgtagtaggtccaacagaggagaggacctatgacgagtgtgaacctggcggcagcgcaaaagatg

SEQ ID NO: 102081 - DNA, 103 bp, Artificial Sequence
  Synthetic Polynucleotide
taatacgactcactatagggttccggggcccttgaggcctctggcctcagaacagaggagactgaggatggaggcctcaaacctggcggcagcgcaaaagatg

SEQ ID NO: 102082 - DNA, 103 bp, Artificial Sequence
  Synthetic Polynucleotide
taatacgactcactatagggaaggcaggggttccggggcccttgaggcctaacagaggagaaggcctatggggccccggaacctggcggcagcgcaaaagatg

SEQ ID NO: 102083 - DNA, 103 bp, Artificial Sequence
  Synthetic Polynucleotide
taatacgactcactataggggtagtgggggaaggcaggggttccggggccaacagaggagaggccccatgacccctgccaacctggcggcagcgcaaaagatg

SEQ ID NO: 102084 - DNA, 103 bp, Artificial Sequence
  Synthetic Polynucleotide
taatacgactcactatagggcaggcggcaagtagtgggggaaggcaggggaacagaggagacccctgatgtcccccactaacctggcggcagcgcaaaagatg

SEQ ID NO: 102085 - DNA, 103 bp, Artificial Sequence
  Synthetic Polynucleotide
taatacgactcactatagggggccgagggtcaggcggcaagtagtgggggaacagaggagacccccaatgcttgccgccaacctggcggcagcgcaaaagatg

SEQ ID NO: 102086 - DNA, 103 bp, Artificial Sequence
  Synthetic Polynucleotide
taatacgactcactataggggtaggcaaagggccgagggtcaggcggcaaaacagaggagattgccgatggaccctcggaacctggcggcagcgcaaaagatg

SEQ ID NO: 102087 - DNA, 103 bp, Artificial Sequence
  Synthetic Polynucleotide
taatacgactcactatagggtatgtggagggtaggcaaagggccgagggtaacagaggagaaccctcatgcctttgcctaacctggcggcagcgcaaaagatg

SEQ ID NO: 102088 - DNA, 103 bp, Artificial Sequence
  Synthetic Polynucleotide
taatacgactcactataggggggccgaaggtatgtggagggtaggcaaagaacagaggagactttgcatgccctccacaaacctggcggcagcgcaaaagatg

SEQ ID NO: 102089 - DNA, 103 bp, Artificial Sequence
  Synthetic Polynucleotide
taatacgactcactatagggcttcctgtctgggccgaaggtatgtggaggaacagaggagacctccaatgaccttcggcaacctggcggcagcgcaaaagatg

SEQ ID NO: 102090 - DNA, 103 bp, Artificial Sequence
  Synthetic Polynucleotide
taatacgactcactataggggccccagcgccttcctgtctgggccgaaggaacagaggagaccttcgatgcagacaggaaacctggcggcagcgcaaaagatg

SEQ ID NO: 102091 - DNA, 103 bp, Artificial Sequence
  Synthetic Polynucleotide
taatacgactcactatagggggctgctggccaccccggggctcacactcgaacagaggagacgagtgatggccccggggaacctggcggcagcgcaaaagatg

SEQ ID NO: 102092 - DNA, 103 bp, Artificial Sequence
  Synthetic Polynucleotide
taatacgactcactatagggtagatgccaggccccagcgccttcctgtctaacagaggagaagacagatgggcgctgggaacctggcggcagcgcaaaagatg

SEQ ID NO: 102093 - DNA, 103 bp, Artificial Sequence
  Synthetic Polynucleotide
taatacgactcactatagggtgggctgctgtagatgccaggccccagcgcaacagaggagagcgctgatgcctggcatcaacctggcggcagcgcaaaagatg

SEQ ID NO: 102094 - DNA, 103 bp, Artificial Sequence
  Synthetic Polynucleotide
taatacgactcactatagggcgtagctccctgggctgctgtagatgccagaacagaggagactggcaatgacagcagccaacctggcggcagcgcaaaagatg

SEQ ID NO: 102095 - DNA, 103 bp, Artificial Sequence
  Synthetic Polynucleotide
taatacgactcactataggggccctggggtcgtagctccctgggctgctgaacagaggagacagcagatgagggagctaaacctggcggcagcgcaaaagatg

SEQ ID NO: 102096 - DNA, 103 bp, Artificial Sequence
  Synthetic Polynucleotide
taatacgactcactatagggcaccgccacagccctggggtcgtagctcccaacagaggagagggagcatggaccccaggaacctggcggcagcgcaaaagatg

SEQ ID NO: 102097 - DNA, 103 bp, Artificial Sequence
  Synthetic Polynucleotide
taatacgactcactataggggctcctccttcaccgccacagccctggggtaacagaggagaaccccaatgctgtggcggaacctggcggcagcgcaaaagatg
